United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 116

SEQ ID NO: 225259 - DNA, 2526 bp, Artificial Sequence
  Description of Artificial Sequence: Synthetic coding sequence
atggcccaggccttgagcgaggaggagtttcagcgtatgcaagcccagctgctggaactcaggaccaacaattatcagcttagcgacgaattgcggaaaaacggcgttgagctaacttctcttcggcagaaagtggcatacctggataaggagttttctaaggcccagaaggccctgtccaagtctaaaaaagcccaggaagtcgaggtgcttctgtcagaaaatgagatgctgcaggctaagcttcattctcaggaggaggatttccgcctgcagaacagcaccctgatggccgaattcagcaagctttgctcacagatggagcaactcgagcaggagaatcagcaactgaaggagggagcggcaggtgctggcgtcgcacaggctgggcctctggtggatggcgagttactccgcctacaagctgagaataccgctttgcaaaagaatgtggcagcacttcaggaaaggtacgggaaagaggccggaaaattttctgctgtgagcgaaggccaaggcgacccacccggtggccctgccccaaccgttttggcccctatgccactcgcagaggtcgagctgaagtgggaaatggaaaaggaggagaagaggctcttgtgggaacagttgcagggactggagtcctccaagcaggccgaaacctccagattacaggaagagctcgccaagttgtccgagaagctcaaaaagaaacaagagtccttctgtcggttacagaccgagaaggagacattgttcaacgactcacgcaacaagatagaagaactgcagcagcgaaaggaggctgatcataaagcgcagcttgctcgcactcaaaaactccagcaagaattggaggctgctaaccagtcactcgctgagctcagagatcagaggcagggggaacgcctggaacacgctgctgcgctcagagccctgcaggaccaggtttccattcagagcgcggacgcacaagaacaggttgagggattgctagcagaaaataacgctttgcgtacttctctggcggctctggaacagatccagaccgccaagactcaagagctgaatatgctgagggagcaaacaaccggactagccgcagagctacagcagcagcaggcagagtacgaggatctgatgggacagaaggatgatctcaactctcagctccaggagagtctccgcgcaaactctcgactcctggaacagcttcaagagatcggccaggagaaggaacagctaacccaagagctgcaagaggcacgcaagtctgctgagaaaaggaaggccatgcttgatgaactagctatggagactcttcaggaaaagtcccaacacaaagaagagttgggggcagtaagactacggcacgaaaaggaagttctgggggtgagagccaggtacgaacgcgagctcagggagctccatgaagacaagaagaggcaggaggaggaactacggggacagattagggaggagaaggcacggacacgggagcttgagacgctacagcagacagtcgaagaactgcaagcccaagtgcactcaatggacggcgcaaaagggtggtttgagaggcggctgaaggaagccgaagagtctctgcagcagcaacagcaagaacaagaagaggccttgaaacagtgtagggagcagcatgccgctgaactgaagggaaaagaagaggaattgcaagatgtgagagatcagctggaacaggcacaggaggaaagagactgccatctgaagacgatctcttctctgaaacaggaagtaaaggatacggtcgacgggcagagaattctggagaaaaagggcagtgctgccctgaaagatctgaagagacagctacatcttgaacggaagcgtgccgataagcttcaggagcggctccaggacatcttaaccaactcgaagagccgaagtggcctcgaggagttagttctaagcgaaatgaatagccctagcaggacacagactggtgattcttcatcaatctcctcattttcgtatcgggaaatcctgcgggagaaggaaagcagcgccgttcctgctaggtcccttagctcctcacctcaggctcaacctccaaggccagccgaattgagcgacgaggaggttgccgagttgtttcagcgcttagcagagacacagcaggagaagtggatgcttgaggaaaaggtcaagcatctggaagtttcaagcgcgagtatggctgaagatctgtgtcgcaagagcgctattatcgagacctatgttatggactcacggatcgacgtgagcgtggccgcaggtcataccgaccgctcaggactagggtctgtgcttagagatttggtgaaacctggagacgaaaatttgagagagatgaacaaaaagctccagaacatgttggaagagcagttaaccaaaaatatgcatctccataaggacatggaggttctctctcaggagatcgtgcgactttccaaagaatgtgtaggtccccctgatcccgatctggagcctggggaaacctcttag

SEQ ID NO: 225260 - DNA, 2391 bp, Artificial Sequence
  Description of Artificial Sequence: Synthetic coding sequence
atggcccaggccttgtctgaagaagaatttcaaaggatgcaggcacagctcttggagttgcggactaacaactatcaattatccgacgagctccgtaaaaatggtgtagagttgactagtctaagacaaaaagtggcgtaccttgacaaggaattttcgaaagcacagaagctgtgctcacaaatggaacagctggaacaggagaatcagcagctgaaggaaggggctgccggagccggagtcgcccaggccggaccactagtggacggcgagttgctgaggttacaagccgaaaatactgccttgcaaaagaatgtggccgcactacaggagcgctatggtaaagaggccggtaagttctctgccgtgtcagaggggcagggtgatccgcctgggggaccggctccaactgtgctggccccaatgccactcgcagaggtagagttgaagtgggagatggaaaaggaggagaagagactcctatgggagcagctgcaagggctggagagttcaaaacaggccgagacaagccgtctacaggaagagctggcaaaattgtctgagaaactgaagaaaaagcaagagtccttctgtagattgcagactgagaaagagaccctctttaacgatagtcgcaataagatcgaagagcttcagcagaggaaagaggcagaccacaaggcgcagctcgcccgaactcaaaagttgcaacaagaattggaggcagctaatcagtccctcgcagagcttagggatcagcgacagggtgagagactggagcatgccgctgcgctgcgcgcactccaggatcaagtctcaattcagagcgccgacgcccaggaacaagtcgagggcctgctggccgaaaacaacgcgctcaggacttcactggccgcactggaacagatccagactgctaaaacgcaggagctgaacatgttacgcgagcagaccactggcctggctgccgaactgcagcagcaacaggctgaatatgaggacctgatgggccagaaagatgatctaaattcacagttgcaggagagcctccgcgcaaacagtcggctcctggagcaacttcaagagattggtcaagagaaggagcaattaacccaggagctccaggaggcccgaaagtctgctgagaagcgcaaggcgatgctggacgagttagcaatggagacactccaggagaaatcgcagcacaaagaagaactgggagcagtccgcctgcgacatgagaaggaggttctcggggttcgggcaaggtatgagagggaactcagagagctacacgaggacaagaaaaggcaagaagaggagttacggggacagattcgcgaagagaaggctcgcactagggagctggaaacgctccaacagacggtggaggagcttcaggctcaggtccattccatggacggagctaaaggctggttcgagcgccgtttaaaagaggcagaagagtcactccaacagcagcaacaggaacaagaggaagcactgaagcagtgtcgggagcagcacgcggctgagttaaaaggcaaggaggaggagctccaggacgttagggaccagctcgaacaggcccaggaggaaagggactgtcacctgaagaccatttccagcttgaaacaggaagtcaaggataccgttgacgggcagagaattctggagaagaagggctccgcagctttgaaggatctgaaacggcagctacatttagaaaggaaaagagcagataaactgcaggaacgtctgcaggatattttgactaactccaagtccagatccggcctagaagagcttgtgctcagcgagatgaactccccaagccggacacagactggggacagtagctcaatctcttcattctcttatcgcgagatcctgcgcgagaaggagtcctccgccgtacctgcaaggtccctctccagttctcctcaggcccagcctcctagacctgctgaattgtctgacgaagaagttgccgaactgttccagcggttagcagagactcagcaagagaaatggatgctcgaggagaaggtcaagcacttggaggtgtcaagcgcctcgatggccgaggatctgtgtaggaagagcgcgatcattgagacctacgtgatggacagcaggatcgacgtgtctgttgcagcagggcacaccgacaggtcgggcttggggtctgttttgcgggaccttgttaagccgggagacgagaacttgagagaaatgaataagaagttgcagaacatgctggaggaacaacttacgaagaatatgcacttacacaaggacatggaagtgctaagtcaggagattgtgcggcttagcaaagaatgcgttggaccaccagaccccgaccttgaacccggagaaacaagctag

SEQ ID NO: 225261 - DNA, 2433 bp, Artificial Sequence
  Description of Artificial Sequence: Synthetic coding sequence
atggcccaggcactgtctgaggaagagtttcagcggatgcaggcccagctcctcgaattgcgcaccaataattatcagttaagcgacgagctgcggaagaacggcgtcgaattgactagtctgcgccaaaaagtcgcctatttggacaaggagttttcaaaggctcaaaagtctcccggtccttgcttgccgttgcaagaggttgaggtgcttctctccgaaaatgagatgcttcaggccaaactgcactcacaagaagaggactttagactgcaaaatagcactttgatggctgaatttagcaaactctgtagccagatggagcagttggaacaggaaaaccagcaattgaaggaaggtgccgcaggcgcaggtgtcgcacaggcgggaccgttggtagacggggagcttttgcgcctgcaggccgagaatactgccctccagaagaacgtagccgctctccaggagcgctatggcaaggaagctggcaaattctccgccgtcagcgagggacagggggatcctcctggcggtcctgcccctacagtgctcgctccgatgcctctggcggaggtggagctgaaatgggagatggaaaaggaggagaaaagacttctttgggagcaattgcagggcctggagagttcaaagcaggctgagacctctagattgcaggaggagctcgcgaaactgtctgagaagctgaaaaagaagcaggagtctttctgtagacttcagaccgagaaagaaaccctgttcaatgactcaaggaacaaaattgaggagctccagcaacggaaagaagcagatcacaaagcacaactggctcggacacaaaaactccagcaggagttggaggctgctaaccaatccctggccgagcttagggaccagcggcagggtgagagactggaacatgcagccgctctcagggcccttcaagaccagatccagacagctaagactcaggaactcaacatgctcagagagcagacaacagggcttgctgccgagcttcagcagcagcaagccgagtacgaagatctaatgggacagaaggatgacttgaacagccagttacaagaatccctgcgggctaacagccgccttcttgaacagctgcaggaaattggccaggagaaagagcaactgacccaagaactccaggaagcgcgaaagagcgccgagaagcggaaagctatgctggatgagctggcgatggaaacacttcaggagaagtcacagcacaaagaggagctgggcgctgtccgattacgacacgaaaaagaagttctgggagtcagggcccgatacgaaagagagctaagagagctgcacgaggataagaaacggcaagaagaagagttgcgtgggcagattcgagaggagaaagctaggacccgggaactcgagaccttacaacagaccgtggaagaactccaagcccaggtccacagcatggacggagcgaagggctggttcgagagacggctgaaggaggccgaggaatccctccagcaacagcaacaggagcaggaggaagcactgaaacagtgtcgggagcagcacgccgctgaactgaaaggaaaagaagaggagctgcaggatgttagggaccagttggaacaagcccaggaagaaagggactgtcacttgaaaacgatttcctctcttaagcaagaggtgaaggacacagtggacggacaaaggatattggaaaaaaagggctcagccgctcttaaagacctcaagcgccagctacaccttgaacgcaaacgggcagacaaactgcaggagaggcttcaggacatacttacaaactctaagtctagatcaggcctggaggagctcgttctctccgagatgaatagcccatctaggacacaaaccggtgactcatcctccatttccagtttcagttacagggaaattctacgggagaaggaaagttcagcagttcctgcccgatctttaagttctagtcctcaagctcagccccctcgcccagcagagctgagtgatgaggaggtggcggaattgttccagcggttggccgagacccagcaggaaaaatggatgctcgaagagaaagtcaagcatctggaggtgagtagtgcctctatggccgaggacctgtgccgtaaatctgctatcatcgagacgtacgtgatggacagccggatcgatgtttcagtcgcggcaggccatactgataggagtggtttaggctcggtgttgagggatttagtgaagccgggtgacgagaacctccgcgagatgaacaagaagttacagaacatgctagaggaacaactgacaaagaacatgcacctgcacaaggatatggaggttctgtcacaggaaatagtgaggcttagcaaggaatgtgtgggtccacctgatcctgacctggagccaggggaaacctcttag

SEQ ID NO: 225262 - DNA, 1425 bp, Artificial Sequence
  Description of Artificial Sequence: Synthetic coding sequence
atgaaacgagtactggtgctacttctggccgtggcttttggccatgcgctagagaggggaagggactatgagaagaataaagtatgtaaagaattttcccatttaggcaaagaagacttcacctccctgagcctcgtcttatactctagaaaatttccatcaggcacttttgaacaggtgtcccaactggtgaaggaggttgtcagcttgaccgaggcctgttgcgctgagggagccgatcccgattgctatgacacccgcacaagtgccctgtccgcaaaatcttgcgagtccaattcaccattccccgtacacccaggcacagcagaatgctgtactaaagaggggctcgaaaggaagctttgcatggcagctctgaaacaccagccccaggaattcccaacttacgtcgagcctacaaatgacgagatatgcgaagccttccgaaaagaccccaaagaatatgctaaccagttcatgtgggagtactcaacaaattacggacaggccccactcagcttactggtgtcatatacaaaatcttacctgtctatggtgggaagctgctgcacctctgcttccccaaccgtttgcttcctaaaggagagactgcagcttaagcacttatctcttcttaccactctaagcaatagggtgtgctcacagtacgctgcctatggggaaaaaaaatcccggctgtctaacctaataaagctggcccagaaagtgcccaccgccgatctcgaggacgtcctgcctttggctgaagatattacgaacattctgtcaaaatgctgcgagtcagcctctgaggattgtatggccaaagagttgccagaacatactgtaaaattgtgtgataatctgtctactaaaaactcgaagttcgaggattgctgtcaggagaagaccgcaatggatgtgtttgtctgtacatacttcatgccagcagcccagttacccgagcttcctgatgttgagctcccaactaataaggacgtctgcgatcctggcaacaccaaagtcatggacaagtacacattcgagctgtcccgcaggacgcacctaccggaggtctttctctccaaggtccttgaaccaaccctgaagtccctgggagaatgctgcgatgtagaggatagcaccacctgtttcaacgcaaaaggcccactcttaaaaaaggagctgtctagcttcatagacaaagggcaggagttgtgtgcagactactccgagaacacatttaccgaatataagaaaaagctagccgagcggttaaaagcgaagctcccagatgccacacccactgaactggcaaaacttgtgaataagcacagcgacttcgcctcgaattgctgctctataaacagcccgcctttatactgcgactccgagattgatgctgagcttaaaaacatcctgtag

SEQ ID NO: 225263 - DNA, 438 bp, Artificial Sequence
  Description of Artificial Sequence: Synthetic coding sequence
atgaaaagagtgctggtgttgctgcttgctgtcgcctttgggcatgctctggaacggggtcgcgattacgaaaagaataaagtctgtaaggaattcagtcatttgggcaaagaagatttcactagtctgtcactggtcctttacagtcgcaagtttcccagtggcacgttcgaacaggtgagtcagctggtgaaggaggttgtttccttgactgaggcctgctgtgccgagggtgctgaccctgactgctatgacacccggacttcggcactgtctgctaagagctgcgagtcaaattctcccttcccagtccatccgggtactgccgagtgttgcaccaaggaaggattagaaagaaagctgtgtatggcagctttgaaacatcagccccaggagttcccaacctacgttgagcctaccaatgatgagatctgctag

SEQ ID NO: 225264 - DNA, 1482 bp, Artificial Sequence
  Description of Artificial Sequence: Synthetic coding sequence
atgctatggtcctggagtgaggagagaggaggtgccgctcggttgtcaggacggaaaatgaaaagagtattggtcctgctcttggcagttgcgttcgggcatgcactggagagaggtcgcgactatgagaaaaacaaagtctgcaaagagttctcacacctaggcaaggaagatttcacgtccctcagcctggtcctttattctcgaaagttcccttccggcacgtttgagcaggtgtcacagctggtgaaggaggttgtttcgctcactgaagcttgctgcgccgaaggggctgacccagactgctatgacacacgaacctccgccctatccgctaagagttgcgaatccaattccccttttccagtgcatcctggaacggctgagtgttgtactaaggagggacttgagagaaagctctgtatggccgcactcaaacatcagccacaggaattccccacctacgtcgagccaacaaatgatgagatctgtgaggcctttcggaaggatcccaaggagtacgctaaccagttcatgtgggagtatagtacaaattacgggcaggcccctctatcactcctggtgagttatactaagtcctatcttagcatggttggatcctgttgcacctcggccagccccacagtgtgtttcctgaaggagcgcctccagctcaagcacctaagcttacttactaccctatcgaacagggtgtgctctcaatatgccgcatacggggagaagaagagccgcctgtccaatttgataaagctagcccagaaagttcccaccgccgatctggaagatgtccttcccctggctgaggatatcaccaatattctgtcaaagtgctgtgagtctgcgagcgaagactgtatggcaaaagagcttccggaacacactgtgaaactgtgcgacaaccttagcacaaaaaactcaaaattcgaggactgttgccaggagaagacggcaatggacgtttttgtgtgtacttactttatgcccgctgcacagttgcctgaactgcccgatgtggagctgccgacaaacaaagacgtctgcgacccgggaaatacaaaggtgatggacaaatatacctttgagctctcaaggcgcacacaccttcctgaggtgttcttgtccaaggtcctcgagcccaccttgaagagtctgggagaatgctgtgacgtggaggacagtaccacatgcttcaatgcgaaaggccctttactgaagaaagaactgtcttcctttattgacaagggacaggaactgtgtgcagactattctgagaacacattcacagagtataaaaaaaaattagcggaaaggttgaaggccaaacttcctgacgcaactcccaccgagcttgctaagctcgtgaataagcactccgatttcgcctctaactgttgctcaataaacagccctcccctttattgcgacagcgagatagatgctgagctgaagaatatcctatag

SEQ ID NO: 225265 - DNA, 669 bp, Artificial Sequence
  Description of Artificial Sequence: Synthetic coding sequence
atggccgcaagtgtgaggcaggctcggagcttactcggtgttgccgctacactggcaccaggttctcgtgggtatagggccagaccccctcctagacgtaggccaggcccacgttggccagacccggaagacctgcttactccacgatggcagctggggccaagatatgccgctaaacaatttgcgaggtatggggctgcaagtggcgtggtcccaggcagtctctggccaagcccggaacaacttcgcgaattggaagccgaggagcgtgaatggtacccttcactggccacaatgcaagagtcccttagggttaaacagttggcagaggagcaaaagcggagggaacgcgaacagcatatcgcagagtgtatggccaagatgccccagatgatcgttaactggcagcaacagcagcgcgaaaattgggaaaaggcccaagctgacaaggagcgcagagcacggcttcaggccgaggctcaggagttactgggctaccaggtggacccccgatccgccagattccaggaactgcttcaggacctcgaaaaaaaggaaaggaagaggctgaaggaagaaaagcagaaacggaagaaagaggccagagccgctgccttagctgctgccgtagcccaggacccagccgcttccggtgcccctagcagttag

SEQ ID NO: 225266 - DNA, 1038 bp, Artificial Sequence
  Description of Artificial Sequence: Synthetic coding sequence
atggtggctgcgttattaggtgggggaggcgaggctcgcggaggaacagtccccggtgcctggctttgtctcatggccctgcttcagctcctgggctcagctcccaggggatcgggcctcgctcatggccgaagactcatctgttggcaggcattactgcagtgccagggcgagcctgaatgttcctatgcttataaccagtatgcagaggcttgtgcacctgttctagcccagcatgggggaggagacgccccaggggcagctgccgcagctttccctgcctctgcggcttccttttccagtcggtggcgttgccctagccattgcatatctgctctaattcaattgaaccacaccaggagaggcccagctctggaagattgtgactgtgcccaggacgaaaattgcaagtcaactaaaagagccatagagccttgcttacccaggacttcaggtggcggtgcaggaggccctggtgccggaggtgttatgggctgcacagaagcccgtagaaggtgtgaccgggattccaggtgcaacttggccctgtccaggtacctcacatattgcggaaaagttttcaatgggcttcgctgtaccgatgagtgccggaccgtaatcgaagacatgctcgcaatgcccaaggccgcactgctaaacgattgcgtgtgtgatgggctggaacgcccaatctgtgaatccgtgaaagagaacatggcaaggctgtgttttggcgcagagttgggcaatggcccaggcagcagcggatcagacggtggactagacgattactacgacgaggactacgatgatgaacagcgcaccggcggagctggtggcgaacagccacttgacgatgatgatggggttccccatccgccaagaccaggatctggcgctgcagcatcgggcggacgcggagatcttccatacgggccaggtcgtagatctagcggcggtggaggtcggctggccccacgaggagcatggacccctttagcctcaattctgctcctcctgttgggacctttgttctag

SEQ ID NO: 225267 - DNA, 942 bp, Artificial Sequence
  Description of Artificial Sequence: Synthetic coding sequence
atgtgcacagctttatccccaaaagtgcgatccggacccggtctgtctgacatgcatcagtattctcagtggctggcttctagacacgaggccaacctgttgccgatgaaggaagatctggccctgtggctgaccaacctgttggggaaggaaatcacagctgaaacctttatggaaaaactcgataatggtgcccttctctgtcagctggccgaaaccatgcaagaaaagttcaaagaatccatggacgccaacaagcccacaaagaacctgcccctcaagaagatcccttgtaaaacttctgccccatccggatcatttttcgccagagacaacaccgccaattttctgtcgtggtgtcgggatctgggcgtggatgagacctgtctgttcgagtctgaaggcttggttctgcataaacagcctagagaggtctgcctctgcctgctggaactcggcagaatcgcggctaggtacggcgttgagcctcctgggctcatcaagctggaaaaggagatcgaacaggaggaaacactctcagctccttctccctcaccaagcccaagctctaaatcttccggcaaaaagagcacaggaaatctgcttgatgacgcagttaaacggatctcagaagaccctccttgcaagtgtcccaataaattctgtgtggaacggctttctcaaggtcggtaccgagtgggcgagaaaatcctcttcatcaggatgctacacaacaaacatgtgatggtgagagtcggagggggatgggagacattcgccggttacttgctcaagcacgacccttgccggatgctacaaattagtcgcgtggatgggaagacctccccaatccagtctaagtccccaaccctgaaggacatgaatcctgataactatttagtggtcagtgccagttacaaagccaaaaaggaaatcaagtag

SEQ ID NO: 225268 - DNA, 942 bp, Artificial Sequence
  Description of Artificial Sequence: Synthetic coding sequence
atgtgcacagctttgtctcctaaagtgcgcagtggccctggactttcagatatgcatcagtactctcagtggctcgcgtctcgtcatgaagcaaatttactgcctatgaaggaggatttagccctatggctgaccaatctgctcggcaaggagatcaccgccgagacattcatggaaaaactggacaatggggcactgctgtgccagctggctgagactatgcaggagaaattcaaagagtctatggatgcaaacaagcctaccaaaaaccttccattgaagaagatcccatgcaagacatccgcaccatccgggtcattcttcgccagagataacacagcaaatttcctctcttggtgtcgtgatctgggggtggacgagacttgcctatttgagagcgagggtctggtgcttcacaagcagcctagagaagtctgcctatgcttgctggaattggggaggatcgccgctcgctacggggtggagccccctggcctaatcaagcttgaaaaagaaattgagcaggaggagacactgtcagcgccatctcccagcccgtctccttcttcaaagagcagtggtaaaaagtctactggcaatctgctggacgacgctgttaaacgcatcagcgaggaccctccgtgcaagtgtccaaacaagttttgtgtagaacgcctgtcccagggcagatatagggttggggagaagatcctcttcattcggatgctgcacaataagcatgtgatggttcgcgtcggagggggttgggagactttcgctggctacttgctcaaacatgatccctgtagaatgctgcaaattagccgggtcgacgggaagaccagtcccatccaatcaaagtccccaacccttaaggatatgaatcctgataactacctcgtcgtgtcagcctcgtataaggctaagaaagaaattaagtag

SEQ ID NO: 225269 - DNA, 942 bp, Artificial Sequence
  Description of Artificial Sequence: Synthetic coding sequence
atgtgtaccgcactctcgcccaaggtgcggtccggccctgggctgagcgacatgcaccagtatagtcagtggctggccagtcggcacgaggctaatctgcttccaatgaaggaggatctggccttgtggctgacaaacttgctcggtaaagaaataacagccgagacatttatggagaaattagataacggggctttgctctgtcagctggccgaaacgatgcaggagaaattcaaagaaagtatggatgcgaacaaaccaacaaaaaatctaccattgaagaagatcccctgtaagaccagcgccccatccggtagcttttttgcacgggacaataccgctaatttcctcagctggtgtcgggatctgggtgttgacgaaacttgcctttttgaatcggagggactggtattgcacaagcagcccagggaggtctgcctgtgccttcttgagctcggtcgcatcgcagcccgttacggcgtggagccgcctggactcattaagctagaaaaagagatcgagcaggaggaaactctcagtgctccatcaccgtcgccgagtccatcaagtaaatcgtcaggtaagaagagtaccggcaatctgttggatgacgcagtcaagcggatttctgaagacccaccgtgtaagtgtccaaacaagttctgcgtcgaaagactttctcagggtagataccgcgtgggtgagaaaattctgttcattcggatgctgcacaacaagcatgtcatggtgcgggtgggaggaggatgggagacattcgcaggttatctgcttaagcacgatccttgcagaatgcttcagatctcacgggtggacgggaagacaagcccgattcagtctaagtcgcctaccttaaaagacatgaacccagataactatctcgtggtctctgcctcatacaaagctaagaaagagatcaagtag

SEQ ID NO: 225270 - DNA, 546 bp, Artificial Sequence
  Description of Artificial Sequence: Synthetic coding sequence
atgtgcaccgccctctccccgaaagtgcgctctggtccgggtcttagcgacatgcaccagtattctcaatggctggctagcagacatgaggccaatctcctgcctatgaaggaggaccttgcgctgtggttgacgaatcttctgggaaaagagatcaccgctgagacatttatggaaaaacttgataatggagcattgctctgtcaactggcagaaacaatgcaggaaaagttcaaggagagcatggatgcaaataagcctactaaaaaccttcccctgaagaagattccgtgcaaaacgagtgctccctctggctctttttttgcacgcgacaatacagcgaactttctcagctggtgcagagatctcggggtagatgaaacctgcttgttcgaaagtgaaggcctcgttcttcacaaacagcctcgcgaagtatgcctgtgtctgttggagctcggacgaattgcagcgaggtacggagtcgaaccgccagggttgataaagctggagaaggagatcgagcaggaggagactctcagcgcttag

SEQ ID NO: 225271 - DNA, 618 bp, Artificial Sequence
  Description of Artificial Sequence: Synthetic coding sequence
atgtgcactgcgctcagccctaaagtcagatccggccctggcctctcggatatgcaccagtattctcagtggctcgccagtcgccatgaggctaacctgctccccatgaaagaggacctggccttgtggctcacgaatttactcggaaaggagatcactgctgagactttcatggagaaattggataacggggcactgctgtgccagttggctgaaacgatgcaggagaagtttaaagaatcaatggatgccaataaaccgaccaagaacctccctctcaagaaaatcccttgcaagacctctgcaccctccggatccttcttcgcaagggataacaccgccaatttcttgtcttggtgcagagaccttggtgtcgacgagacatgcctgttcgagtctgaggggctggtgctgcacaagcagccgagagaggtgtgcctgtgtctgctcgaactaggcagaattgcagcaaggtacggcgtggagccgccaggactgattaaactggagaaggaaatcgagcaagaggaaactctgtctgcgccatccccttctcccagccctagcagtaagtcgtccggcaaaaagagtactggtaatttgcttgacgacgcctag

SEQ ID NO: 225272 - DNA, 411 bp, Artificial Sequence
  Description of Artificial Sequence: Synthetic coding sequence
atgtgcaccgccctgtccccaaaggtgaggagcgggcctggcctgtcggacatgcaccagtactcgcaatggctggcctctcgccacgaagccaacctgctgcctatgaaagaggatctggccctttggctgaccaatctcctaggtaaagagatcactgccgagacatttatggagaaacttgacaatggggctctgctttgtcagctggccgagaccatgcaggagaagtttaaggaatcgatggatgctaataagcctacgaaaaatctccctcttaaaaaaattccttgtaagacctccgcgccttccggttcatttttcgccagggataatacagccaacttcctgtcgtggtgccgagaccttggcgttgatgagacatgtctctttgagtctgagggtctttag

SEQ ID NO: 225273 - DNA, 468 bp, Artificial Sequence
  Description of Artificial Sequence: Synthetic coding sequence
atgtgcaccgcgctgtctccaaaagtgcgcagtggccctggcctaagcgacatgcaccagtattctcagtggttagctagccgccatgaggccaacctactaccaatgaaggaggatctggccttgtggctcaccaatcttctcgggaaggaaatcaccgcggagaccttcatggagaagctggacaacggggcattgttgtgccagcttgccgaaacgatgcaagagaagttcaaggagtcaatggatgccaataaacccactaaaaaccttcccctgaaaaaaatcccctgcaaaacaagtgcgccatcaggctcattttttgctcgcgacaatacagctaactttctgagctggtgtcgggatcttggggtggacgaaacctgtttattcgaaagtgaagggctcgtccttcacaagcagcctcgagaagtatgtctgtgcctgctggaactgggtcgaatttag

SEQ ID NO: 225274 - DNA, 2043 bp, Artificial Sequence
  Description of Artificial Sequence: Synthetic coding sequence
atggctgatcccgtggctggtattgcaggtagtgctgcaaaaagcgtcagacctttcagatcctctgaggcctacgtcgaggccatgaaggaggacctggccgaatggctcaatgctctttatggcctcgggctgcctggcggtggtgacggcttcctgactggtcttgccacaggtaccactctctgccagcatgctaacgcggtcacagaggctgctcgagccctcgctgctgccagacctgcccgaggcgttgctttccaagcccattctgtggtgcctggcagtttcatggcccgagacaacgttgccacattcatcgggtggtgccgagtagaactaggtgtgccagaagttctcatgttcgagacagaagaccttgtgctccgaaagaatgaaaaatccgtggtactgtgcttgctggaggtggcaagaagaggcgctcggttaggtctcctagcaccccgactggtccagttcgaacaggagatcgaacgggagcttcgcgcagccccacccgctcctaatgcgcctgcagctggagaggacactaccgagacggcacccgctccaggaaccccggctcgcggtccacgcatgacaccttctgatttgcgtaacctggatgaactggttcgggagattctggggcgttgcacctgtcccgaccagtttccaatgatcaaggtgagcgagggaaaatatagggttggcgactcttcactccttattttcgtcagggtcttacgaagccatgtcatggtgcgggtggggggagggtgggatacccttgaacattatctggacaaacacgacccttgtcgatgtagctcaaccgcacatcgccctccacagcctcgagtctgcacgttcagcccccagcgcgttagtccgaccactagtccaagacccgcaagtcctgtcccagggtcagagaggcggggatctaggcccgaaatgacccccgtgagcctgcgttctacaaaagaaggcccagaaacaccacctagaccacgggaccagttaccaccgcaccccaggtctaggagatattctggagactctgattcctcagccagctctgctcagagtggaccccttggaaccaggtctgacgacactggaactgggccacggagagaacgaccatcaaggcgccttaccaccggcactccagcttccccccgacgaccccctctccgtagccagtcacgtgatcgtctcgaccgaggacgaccgagaggagcccctgggggtaggggggctcagttgagcgttccctctccagccagacgggcacgctcacaatcaagggaagaacaagccgtgctactggtacgtcgcgatagggacggacagcattcctgggtaccaaggggtagaggcagtgggggttcagggcgatcaaccccccagactccaagagccaggtcccctgcagccccaagactgtcccgggtttcctcaccttcccccgagcttggtacaacacccgcatcaatctttcgcacacctctccagctggatcctcagcaggagcagcagctattcagacggttggaggaagaattcctggctaacgcccgagccctggaggcggtggcttctgtgacaccaacaggacccgcacctgatccagctagggccccagaccctcccgcacccgatagtgcttattgcagttcgtctagttccagcagttctttgtctgtgctgggcggtaaatgcggtcagcccggagatagcggccgtacagccaatgggctccccggaccacgctcccaggctctgtctagctccagcgacgagggatctccttgtccaggtatgggcggacccctggacgcgccaggatctccactggcttgcaccgaaccttcaaggacgtgggctagaggtagaatggatacccagcccgaccgaaagccttctagaatcccaaccccacgcggtcccagaagaccatctggcccagctgagctgggaacgtggcatgcacttcattctgtaaccccacgagccgaacctgacagctggatgtag

SEQ ID NO: 225275 - DNA, 1014 bp, Artificial Sequence
  Description of Artificial Sequence: Synthetic coding sequence
atggctgaccctgtcgcaggcatagcagggagcgccgcaaaaagtgtgaggccctttcggtcatccgaggcctatgttgaagcgatgaaagaggacctcgccgaatggttaaatgcattgtatggcctgggtctgccaggcggaggtgacggcttcctgacagggctggctactggaacgaccctgtgtcagcatgcaaacgccgtaaccgaggctgcaagagccttggccgcagcgagacctgcccgtggggtggcgttccaggcacattctgttgtgcctggttccttcatggcacgggacaatgttgcaacttttatcggctggtgtcgtgttgaattgggagtgccggaagtcctcatgttcgagaccgaggatctggtactaagaaagaatgagaaatctgtggtgttgtgcctcctcgaagtcgcccgacggggagcgcgacttggactgctggcccctcggttggtgcagtttgagcaggagattgagagggaattacgagccgcaccacccgcaccgaacgcacccgctgccggagaagatacaactgagaccgctcctgcccctggcactcccgctcgtgggcctcgaatgacaccgtctgacttgcggaatctggacgagcttgttcgggaaatcctagggagatgtacttgtcccgaccagtttccgatgattaaggttagcgaagggaagtatagagtaggtgactccagtctcctgatcttcgtcagagtcctgagatcccatgtaatggttcgtgtgggaggaggctgggacacacttgagcactacttagataagcatgacccttgtcgctgcagctctacggctcatcgccctccacagcccagggtgtgcacattctccccccagagggtgtcaccaaccacttctccaagaccagcttcccccgtacctggttccgagaggagaggctcccgcccagagatgacccccgtctcactccggtccactaaagagggcccagaaacgccccctagatag

SEQ ID NO: 225276 - DNA, 990 bp, Artificial Sequence
  Description of Artificial Sequence: Synthetic coding sequence
atggctgatcctgtggctggcatcgcagggtcagctgccaagtctgtgaggccattccggagttctgaggcgtatgtggaggctatgaaagaagacctggccgaatggttaaatgcgttgtacggcctcgggcttcccggaggcggagacggtttcctgacgggccttgctaccgggacaacactctgccagcatgcaaatgctgtcaccgaggcagctcgcgcactggcagctgcgagacctgcccgaggggtggcgttccaagctcactcagttgttcctggatctttcatggcccgtgataacgtggcaacgtttattggttggtgtcgggtggaacttggcgtccctgaagtgctgatgtttgagaccgaagatctggtactccggaagaacgagaaaagcgttgttctatgccttttagaagtggcacggagaggagcacggctaggtctacttgccccacgactggtgcaattcgagcaggagattgaacgcgaactcagagcagccccacctgcgcctaatgccccagccgctggtgaggatactaccgagactgctcccgctcctggaacacccgcaaggggccctcgcatgactcctagcgatctcagaaatctcgatgagttagtcagagagattctggggaggtgcacctgccccgaccaattcccaatgattaaagtcagtgagggaaaatatagagtgggggattcttcattactcatctttgtccgcgttttgcggtcccatgtgatggtacgggtgggtggaggctgggatacactggaacattacttggacaagcatgatccctgtaggtgctcttctaccggccctggaatatcatgcccacccatccccgcacccgctgccacaccagggactgtgaccccccagccgcctccacccagggctgccccactagtgccggctgttatgacccaggcgctggctccgggaggctcagatccggctggaggctag

SEQ ID NO: 225277 - DNA, 1614 bp, Artificial Sequence
  Description of Artificial Sequence: Synthetic coding sequence
atggcagacccagttgcagggatcgctggatcagcagccaaatccgtcagaccattcagatcgtccgaagcctacgtagaagccatgaaggaggatctggccgaatggctaaacgctttgtacggattaggccttcctgggggaggtgacgggttcctgaccggactggccactggcactacactatgccagcatgctaacgccgttactgaggccgcacgtgctctggcggcagcgagacctgcccgtggcgttgccttccaggcacattcagttgtccctggctcttttatggcaagggataacgtcgcgacattcattggctggtgtcgggtcgagctgggggtgcccgaggtgctaatgttcgagacagaagacctcgttctcagaaagaatgagaagagcgttgttctctgcttacttgaagtggccagaagaggagcccgactcgggcttctggccccacggcttgtgcagttcgaacaagagatcgagagggaattgcgagctgcaccgccagcgcctaacgcccctgctgccggtgaggatacaacagaaacagctcctgctcctggaactcccgcacgaggtcccagaatgactccttctgatctgcggaatttggacgaactggttagggagatcctggggagatgcacttgtcctgatcagtttcccatgattaaagtgtcggaaggtaagtacagggtgggggattccagcttgctcatatttgtccgtgtgctacggagtcatgtgatggtgcgggtcggaggcggttgggacacgctcgaacactaccttgataagcatgatccctgccgctgttctagcaccgctcataggccacctcagccaagggtctgtactttttctcctcaacgggtgtcccccaccactagtccacgccctgctagccctgtacctggaagcgagaggaggggaagccgaccagagatgaccccagtctccctgaggtctaccaaggagggcccagaaacaccccctagaccaagggaccagctgcctccacatcccagaagccggaggtactctggtgacagcgactcgtccgcctcctctgcccagtctggcccactgggcaccagaagtgacgacaccggaaccggccctcgcagggaacgcccatcccggaggttaacgaccggtacccctgccagcccaaggcggccacctgcgtgcgctgcctccccagagaccggttggatcgctgccggtcccggtgggcctcaggaggccggagaaccaagctgtcggtccccagctctgccaggtggaccaggtgctcgcgctgccaggtcacggttatgctgtctgtgtgctggaattgagacagggtccacccacggatgccagggagccggtgcagtgggggctcgggcaggagcacctcctcggttgcccgtgccagccgcactccagcacccaggattcccaggttccccagcacctgtccagagctgggcaccccaccggccagcgtccagtgcccatccctgctccagcacccgctccagatctagctcttgcagtggcgcatggaaaaggagctcctggcctatgcctgggcctctgagattattgctggcatag

SEQ ID NO: 225278 - DNA, 1614 bp, Artificial Sequence
  Description of Artificial Sequence: Synthetic coding sequence
atggccgaccctgtggccggtattgcgggaagcgcagctaagtccgtgagaccgttcagatcatcagaggcgtatgtcgaagccatgaaagaggacctggccgaatggctgaacgccttatacggactcggcctgcccggaggaggcgatggctttcttaccgggcttgcaactggtacgactctgtgtcagcacgcgaacgctgtaactgaggcagcacgtgccctggcagccgctagacctgccagaggcgttgcgttccaggctcattccgtggtgccgggaagctttatggctagagataatgtggccaccttcattggttggtgtcgagtcgagttaggggtacccgaagtgcttatgttcgagacagaggacctggtgttgcggaagaacgaaaagtcagtggtgctctgcctgctggaagttgctcgcaggggtgcaaggttggggcttctggccccacgtcttgttcaatttgagcaagagattgaacgtgaattgcgcgcagctccaccagccccaaatgcacctgccgcaggagaagataccacagagaccgcccctgccccaggcactccagccagagggccaaggatgaccccttcggacctaaggaatctggatgagttggtcagagagattctcggacgctgcacgtgtccagaccaatttccaatgatcaaggtttccgaagggaagtatcgcgtgggtgattcatcgctcttgattttcgtccgggtgctacgatcacatgtcatggtgagggtcggcggaggatgggacaccctagagcactatctagataagcacgatccttgtagatgctctagcactgctcatagaccaccacagcccagggtctgtacctttagtccccagagggtgtcacctacaacctctcccagaccagcctctcccgtgcctggttctgaaaggagaggatcccggccagagatgacgccagtgtctctccggagtacaaaagaagggcctgaaacccccccacggcctcgggatcaattgcccccacacccccgatcacgccgatactccggcgattctgattcgagcgcctccagcgcacagtccggacccctcggaacgcgcagcgatgacacaggcacaggccctaggagagagcgacccagccgcagactgaccactggaacccccgcaagccctcgacgtccccctgcttgtgcagcttctcctgagactggatggatcgctgctggtccaggcggaccacaggaagcaggggaaccctcctgcaggtcaccagcccttcctggcggacccggtgcaagggccgctcgttcgcgactgtgctgtctctgcgccggtatcgagacgggttccacccatggatgccagggcgcaggagctgtgggagccagggccggtgcacctccacggctgcctgtgccggcagcgctccagcatcctggctttcccggatcgccggcacccgtccagagctgggccccacataggcctgcatcctccgcacatccttgctcgtccacaagaagtagaagcagcagctgcagtggtgcctggaagcgttcttcatggccgatgcctgggccattgcgccttctcctcgcatag

SEQ ID NO: 225279 - DNA, 1614 bp, Artificial Sequence
  Description of Artificial Sequence: Synthetic coding sequence
atggctgatcctgtcgccggaatagcaggatccgccgctaagtccgttaggccgttcaggagctctgaggcttacgtagaagccatgaaggaggacctcgccgaatggcttaacgccctgtacggactcggattgcccggaggaggggatgggttcctgaccggtctcgccaccgggaccaccctatgtcagcacgctaacgccgttacggaggctgccagggctctcgccgctgcacggcctgctcgaggagtagcctttcaggcccattctgtagtccctggttccttcatggctcgggataatgtggcaacctttattggctggtgcagagtggagttgggtgttcccgaggtgctgatgttcgagaccgaggatttggtactgcggaaaaacgagaagagtgtggtcttatgtctgcttgaagttgccagacgaggcgctagattgggcctgctcgcaccacgccttgtacaatttgagcaggagatcgaaagagaactcagggcagctcctccagctcctaatgccccagctgctggagaagacaccactgaaactgctccagcgccagggactcccgctcggggacctcggatgactcccagcgatctacgtaatctggatgaactggtgagggaaatcctggggaggtgtacatgccccgatcagtttccaatgataaaggtgtccgaggggaagtatagagtgggcgacagctcactactgattttcgtccgagtgctgcgtagtcacgtcatggtgcgcgttggaggcggttgggataccctcgagcactacctggataagcacgacccttgtcggtgctctagcaccgcccaccgtccccctcaaccacgtgtgtgtactttttcaccccagagggtgagtcctacaacaagcccccgaccagcgtcgccggtgccagggtcggaaaggcgcggatcaaggcccgagatgacccctgtatctctgaggtcaacgaaagagggacccgaaacacctccaagacctagagaccagctgccccctcatcctagaagccgaagatacagtggggactctgattcctccgcgtcaagcgcccagtctggccctctcgggacacgctctgatgatactggcaccggcccacgcagggagaggccaagcaggaggctgacaacgggcacccccgcttcacccagaaggccccctgcttgtgccgctagccctgagactggctggattgccgcaggcccaggcggaccgcaggaagccggtgagcccagttgtcgatcacctgccctgcctggcggtccgggagcccgagctgctagatcccggttgtgttgcctgtgtgcaggcattgaaaccgggtccacacacggttgccagggggctggcgcagtgggggctcgcgctggggctccacccagactcccagtgcctgctgctctacagcaccccggatttccgggtagtccagctcctgtgcagagttgggccccacacagacccgcaagctccgcacacccctgctctagtactcgctcaaggtcaagctcatgctccggggcttggaagcgctccagctggcccatgcccggacccctgcggctcctgctggcatag

SEQ ID NO: 225280 - DNA, 417 bp, Artificial Sequence
  Description of Artificial Sequence: Synthetic coding sequence
atggcagatcctgtggcgggtattgcgggttctgccgctaagagcgtgcgaccctttcggtccagtgaagcttatgttgaagccatgaaggaagacctggccgaatggctaaatgcgctctacggactgggcctaccagggggaggagacggctttctcacaggcttggctactggaacaaccttatgtcagcacgctaatgccgtgaccgaggcagccagagcactcgccgctgctaggccagctcggggagttgcctttcaggcacactctgtagtgcccggttccttcatggcacgggataacgtggctaccttcattggttggtgtagagtcgagctgggcgtcccagaagttttgatgtttgaaactgaggatctggtcctgcggaagaacgagaaatcagtcgttctgtag

SEQ ID NO: 225281 - DNA, 432 bp, Artificial Sequence
  Description of Artificial Sequence: Synthetic coding sequence
atggcagacccagtggccggtattgcaggttcagctgccaagtccgtacgaccctttaggtcctcggaggcctacgttgaggccatgaaggaggacctggccgagtggttaaacgctctctacggcctgggacttccaggcggaggcgacggattcttgacaggcttggcgaccgggactacactgtgtcagcacgccaacgctgtcaccgaggcagcaagagccctcgcagccgcacgcccagctaggggagtcgcatttcaggcgcactctgtagtgcctggatccttcatggcccgagacaacgttgccacatttattggctggtgtcgtgtcgagcttggcgtgcctgaagtattgatgtttgagactgaggatctggtgttaaggaaaaacgagaagagcgttgtgttatgcctgcttgaggtctag

SEQ ID NO: 225282 - DNA, 1614 bp, Artificial Sequence
  Description of Artificial Sequence: Synthetic coding sequence
atggcagaccctgtggctggaatcgctggcagcgccgctaaatcggttcgacctttccgaagtagcgaagcctacgttgaagctatgaaggaggatttggctgaatggttgaacgccctctatggcttgggactcccaggtggaggggatggctttttgaccggactggcgactggcaccacactgtgtcagcacgctaatgcagtcaccgaggcagctagggcactggccgcagctcgcccagccagaggcgtggcattccaggcgcatagtgtagtcccagggagttttatggccagagacaatgtggcaaccttcatcggctggtgcagggtagagctgggtgtgcctgaggtgctaatgtttgagaccgaagacctcgtactccgaaaaaacgagaagtccgttgtattatgcctacttgaggtcgctagaagaggtgcaaggctcggcctgctggcacctcgtctagtgcagtttgaacaggagatcgaaagggagcttagagccgcaccgccagccccaaacgcccctgctgctggcgaggacactacagagaccgcgccagctccgggaactccggctcgtggtccaaggatgacaccctccgacctacgcaacctggacgagctggttcgtgagatcttgggcagatgcacatgtccggatcaatttccaatgatcaaggtgtcagagggcaagtatcgcgtgggcgattctagcttacttatatttgtacgtgtactgcggtcacacgtgatggtgagagtgggaggtggctgggataccctagaacattatctggataaacacgatccctgtcggtgctcatccacagcccatcggccaccccaaccaagggtttgcacctttagccctcaacgagtgtcgcctaccaccagtccacgaccagccagccctgtgccgggaagcgagaggcgaggctctaggccagagatgacaccggtctctttgagatcaacaaaagaagggcctgagactcccccaaggcctcgagaccagctccctcctcaccccaggagcagaagatatagcggggacagtgactcctccgctagttccgcccagtctggccctcttggtacgagatccgatgacacaggtacaggccctcgcagggagcggccatcgagaagactgactaccggcacccctgcgtcacctagacgcccacccgcttgcgctgcatcccctgagaccggatggattgccgctggcccaggcggaccccaggaggccggagaaccctcgtgccggagccccgcacttcctggcggtcccggtgctcgcgctgctagaagtcgcctgtgttgtctatgcgccggtatcgagacaggctccacccacgggtgccagggagcaggagctgtcggcgcaagggcgggagccccacctcggctccctgttcctgcagccttgcaacacccaggatttcccggatctcccgcacccgttcaatcctgggctccgcaccgaccagcttccagcgcccatccctgttcttcaactcggagcaggagctcttcctgtagcggtgcctggaagcgctccagttggccaatgccaggcccactccggttgctgcttgcttag

SEQ ID NO: 225283 - DNA, 2037 bp, Artificial Sequence
  Description of Artificial Sequence: Synthetic coding sequence
atggctcccagcctcagtccagggcctgcagctctgcgaagagcaccccagctgctgctgctgttactggcagccgaatgcgcgctggcagctctcctgccagctcgtgaagcaacccagttccttaggccccgacagcggcgagctttccaggttttcgaggaggctaaacagggacacctggagagagaatgtgttgaggaactatgtagcagagaggaggccagagaggtttttgaaaatgatcccgagacggattacttttatccacggtatttagattgcatcaataaatacggaagcccatataccaagaatagtggatttgctacatgcgtgcagaacctgccggaccagtgcacgcccaatccctgcgatcggaaggggacgcaggcgtgtcaggatctaatgggtaattttttctgcctttgcaaagctggctgggggggaagactctgtgacaaggatgttaatgaatgtagtcaggaaaacggaggttgtctgcagatctgtcacaataagcccggaagcttccattgttcatgccacagtggttttgagctctcctccgacggtcgcacatgtcaggatatcgacgaatgtgcggacagtgaggcctgcggcgaagcccgttgtaaaaatttgccgggatcttactcttgtctttgtgacgagggctttgcgtatagctcacaggagaaggcctgccgagatgtagacgaatgtttgcaggggaggtgcgaacaggtatgtgttaattctcccggttcatatacatgtcactgcgacggcagagggggactcaagctgagtcaggatatggatacctgcgaggacatacttccgtgcgtgcccttctcagtggcaaaatccgtgaagtccctgtatctaggtcgcatgttctctggcacaccggtgattcgtctgcgatttaaacggctacagccgaccaggttggtcgcagagttcgatttccggaccttcgatccagaaggtattctgctcttcgcgggtggacaccaagacagcacatggatcgtgttagctttacgcgcagggaggctggagctgcagctccgatacaatggggtcggtcgggtcacctcaagtggtcctgtgattaatcacggcatgtggcaaacaatttcggtggaggagttagccagaaacctggtcatcaaggtcaacagagatgccgtcatgaagatcgccgttgcgggagacctctttcagccagaaagggggctataccacctgaacctgaccgtaggcggaatccctttccatgagaaagacttggtgcagccaatcaatccgaggttggatggttgtatgagatcttggaattggttgaacggtgaagataccaccattcaggagacagtgaaggtgaatactagaatgcagtgtttttctgtgaccgagcgtggctctttctaccctgggtccggcttcgcattctactctctcgactatatgcggacccccctggacgtcgggactgagtcaacttgggaagtggaggtagtcgcgcacattcgaccagctgctgacacaggagttttgtttgccctgtgggcacccgacctgagggccgtcccactctccgtggccctcgtcgattatcactccacaaagaaactcaagaagcagctggtagtactggcagtagagcacactgctctggcccttatggaaattaaagtctgcgatggacaggagcacgtggtcactgtatctctgagagacggagaggctacgctcgaagtcgacggcacaagaggtcagtccgaggtgtccgccgctcagctccaggagcggctcgccgtcctggagcgtcaccttagatcacccgttctgaccttcgcaggtggactgcctgatgtgcctgtgacttcggcccctgtgactgcattttatcgcggttgtatgaccctcgaagtcaatcggcgactgctggaccttgacgaagcagcatacaagcattccgacatcaccgctcacagttgtcctcccgtggagcccgctgcggcatag

SEQ ID NO: 225284 - DNA, 1875 bp, Artificial Sequence
  Description of Artificial Sequence: Synthetic coding sequence
atgtgtatgtgccaggctagccccccacccgcagcgctggccggttgtcttcttagctcctgtgtgcaaccagcgcgagagcacggcggagcctttagtaaggccgaatggctgtccaattgcattaataagtacgggtccccttatacaaagaatagtggctttgccacatgtgtccaaaacttgccggatcagtgtacccctaatccatgcgacaggaaagggacacaggcctgccaagacttgatgggcaatttcttctgtctgtgcaaggccggttggggaggcaggctgtgcgataaggatgtgaatgaatgttcacaagagaacggcggatgtctccagatctgccataataaacctggctcttttcactgcagttgtcactccggcttcgaactcagctccgacggacggacttgccaagacattgatgaatgtgcggatagcgaggcatgcggcgaagctcggtgtaagaatttacccggatcctattcttgcctatgtgatgagggttttgcctacagctctcaggagaaagcatgtcgagacgtggatgaatgcctccaaggtagatgtgagcaggtgtgtgtgaacagcccgggatcttacacttgccattgtgacggcagaggaggcctaaaactttcccaggatatggatacatgtgaggacatactgccatgcgttccatttagtgtagccaaatctgtgaaatcactttatctcggcaggatgttttctggaactccagtgatcaggctgagatttaaacgtctacagcccacgagacttgtggccgaatttgatttccgaacctttgaccccgaaggaattctgctattcgccggagggcaccaagacagtacttggattgtgcttgcgttacgggctggtaggttggagctgcagctccggtataacggagtcggacgagtaacctcttccgggcctgtcatcaatcatggcatgtggcaaactatttctgtggaggagcttgctagaaacctggtgattaaggtgaatcgggacgctgtaatgaagattgctgtcgccggtgatttattccagcccgagcggggattatatcacttaaacttaaccgttggcggaattcctttccacgaaaaagaccttgttcagcctataaatcccaggcttgacggctgtatgagaagctggaattggttgaatggggaggatacaaccattcaggagactgtcaaggtaaatacccggatgcagtgcttcagtgtcacagagcgagggtctttttatccgggaagcggattcgccttctattcccttgactatatgaggaccccgctagacgttggaactgagagcacgtgggaggtcgaggtggtggcacacatacggccagctgctgatacaggtgtgctctttgccttgtgggctcctgaccttcgggctgtgcctctaagtgtcgcactcgtagactaccatagcacaaaaaaattgaagaagcagctggtggttttagctgttgagcacactgcactggcattgatggaaatcaaagtttgtgacggtcaggaacacgttgtgactgtgagtctgcgggacggagaggctactctggaagtcgatggtactcgtgggcaaagcgaggtgtccgcagcgcagctacaggagagacttgcagtgttggaaaggcatctccgttcaccagtcctcacctttgctggcggactgccggatgtcccagtgacatccgcccctgttaccgctttctatcggggatgcatgactttggaagtaaatcggcgtttgctggatctggacgaagccgcatataaacacagtgacatcaccgcccatagctgcccaccggtggagcccgcagcagcctag

SEQ ID NO: 225285 - DNA, 2166 bp, Artificial Sequence
  Description of Artificial Sequence: Synthetic coding sequence
atggccccaagtctctcacctggcccagccgctttgaggagggcaccgcagctcctcttgctactcctcgcagccgagtgtgcgctggcagcattgttgccagctagagaagccacgcaattcctgagaccccgacagaggcgtgcatttcaggtctttgaagaagccaagcaaggccatttggagagagagtgtgtggaggagctgtgtagccgtgaggaggccagagaggtgtttgaaaacgacccggaaacagattacttctaccccagatatcttgactgcatcaataagtacggttccccttacacaaagaactccggatttgcgacttgcgtccagaacctgcccgaccagtgtacaccaaacccatgcgaccggaaggggacacaagcctgccaggaccttatggggaattttttctgtctctgcaaagcaggatggggcggtcgactgtgtgacaaagatgtcaatgaatgttcacaggaaaatgggggatgcctgcagatttgtcacaataagcctggcagctttcattgttcgtgccacagcggattcgagctttcgagtgacggtcggacctgccaggatatagatgagtgtgctgactcagaagcttgtggcgaggcacgctgcaaaaatctgcccggttcctattcctgtctttgcgatgaaggttttgcttactcatcccaagaaaaggcctgccgagacgttgacgagtgcctccagggcagatgcgagcaagtgtgcgtgaacagccctgggtcctacacctgtcactgtgatggcagagggggtttaaagttgagccaggatatggacacttgtgagctggaggcagggtggccactacctcggcacagacgcgactctggcccagccgctcgaccgggacgcggagcacaggggtcgcggtctgagggtcatatcccagaccgacgcggaccaaggccttggcaggatattctcccctgcgtgccgttctccgtcgcgaagtcggtgaaatccctttacttaggacgcatgttcagtgggacgcccgtcattcggctgcggtttaaacgactccaacctactaggctggtcgccgagttcgattttagaacttttgatccagagggtattctgctctttgccggaggccaccaggattccacttggatcgtcctggcgctccgagctggcagacttgagctgcaattgaggtataacggggtggggagagtgaccagcagcggaccagtcatcaaccatggaatgtggcagactatatcagtagaagagctagcacgtaacctggtgattaaagtgaacagagacgctgtgatgaagattgcagtagcaggcgatcttttccagccagagcggggactataccacctgaacctcaccgtgggcggtataccttttcacgaaaaagacctggtgcagcctattaatccccgactggatgggtgtatgcggtcctggaattggctgaacggtgaggacacgacaatccaagagaccgtcaaagtcaatacacggatgcagtgctttagcgtgacagaaagaggctccttttaccccggtagcggttttgcattttattccctcgattatatgagaacgcccctcgatgttggtaccgagtccacatgggaagtggaggtagtggcccacattcgaccagcagctgataccggggtgctttttgctctgtgggcccctgatcttcgagcagtaccattgtcggtggctctggtggactaccattctactaaaaaactaaaaaagcagctggttgtcctggcggtggagcacaccgccttggctctgatggagattaaggtatgtgacgggcaggagcacgtggtgaccgtatctttaagagacggtgaggccactttggaagtcgacggaacgcgcggacagtccgaagtcagcgctgctcagctgcaggagagactggccgtgttggaacgccacctgagatctcccgtgttgaccttcgctgggggattaccggatgtgccagtcaccagcgcaccggttaccgcgttctaccggggttgtatgaccctagaggtaaataggcggctactggatctggacgaggcggcatataagcacagcgatattaccgcccattcatgtcctcctgttgaacccgcagctgcatag

SEQ ID NO: 225286 - DNA, 1140 bp, Artificial Sequence
  Description of Artificial Sequence: Synthetic coding sequence
atgttttccggtactcctgtcatccgcctgcgatttaagcgcttgcagcccacccggttggtggcagaatttgattttcgaacttttgaccccgaggggatcctgctcttcgcgggagggcatcaggactcaacttggatagttttagccctgcgggctgggagacttgagctgcagctgaggtataacggcgtcggcagggtgacctccagtggacctgtgattaatcatggcatgtggcaaacgatctctgtagaggagttagcacggaatctggtgataaaggttaaccgtgatgctgttatgaagattgccgtagcgggagacctgtttcagccagagcgagggctgtaccatctgaatctcacagtaggcggaatccccttccatgaaaaagacttagtgcagcccattaacccccgacttgatggttgtatgcgatcttggaattggctgaatggagaggatactacgatccaggagactgttaaggttaacacaagaatgcagtgcttctcagtgaccgaaagaggctcgttctatccagggagcggattcgcattttactccctcgactacatgcggactcctctggacgtggggacagagagcacctgggaagtcgaagttgttgcgcacatccggccagccgcagataccggggtcctattcgctctgtgggcgcctgaccttcgcgcagtacccctctctgtggccctagtggactatcatagcacaaagaagcttaagaagcagctcgttgtgctggctgttgaacacacagccctcgcattgatggagattaaggtctgcgatggacaggagcacgtggtgacagtgagcctcagggacggcgaagctacactcgaggtggacggcactcgcggacagtcagaggtgagcgctgcccagctgcaggagcgcctggccgtgctagagcggcacctgcggtcgcctgtgctcacttttgccggtggcctacctgatgtgcctgtcacatcggcacccgtcaccgcattttaccggggttgtatgactcttgaagtaaaccgccgtctgctggacctggatgaggcggcttacaagcactccgacataactgcccactcctgtccccctgtagagcctgctgccgcttag

SEQ ID NO: 225287 - DNA, 1218 bp, Artificial Sequence
  Description of Artificial Sequence: Synthetic coding sequence
atggatacctgcgaggatattctcccatgcgtcccattttcagtagcaaaaagtgtcaagtctctctacctggggcgtatgttttccggtactccggtcattagactgagatttaagcgcctgcagcctactaggttagtcgccgagtttgatttccgcacatttgatccggagggaattctactcttcgccggaggccaccaagactctacttggatcgttctggctctgagagctggacgtctggaactgcagctgagatataacggtgttggacgggtgacttcttcaggacccgtgataaaccacggaatgtggcagacaatcagtgtggaagagctggccagaaacctggtgatcaaagttaatagagatgctgtcatgaaaatcgctgtagccggagacctattccagcctgaaagaggcctgtatcatctgaacctgactgtcggcggaattcccttccacgagaaagatctggtgcagcccatcaacccacgattggatggctgtatgagaagctggaattggctgaatggcgaggacaccacaatacaagagacagtgaaagtgaacaccagaatgcagtgtttcagtgtcaccgagaggggaagtttctatcctgggagcggcttcgccttctattccctggactacatgcgcactcccttagacgtgggcacagaaagcacgtgggaagtggaagtggtggcccacattaggcctgcggctgatacaggggtgctctttgcactctgggcgcctgacctgcgggcagtaccattaagtgttgctctcgttgattaccattcaacaaaaaaactgaagaagcagctagtggtgttggctgtcgagcacacagccctggccctcatggagataaaggtgtgcgacggtcaggaacacgtggtgacagtctctctgagggacggcgaggcaacactggaggttgacggaacgagagggcagagcgaggttagcgccgctcagctccaggaacgtctcgcagtgctcgagcgacacctgcgaagcccagtacttactttcgctggagggttgcctgacgttcctgtaacatccgcccctgttaccgccttctatagaggctgtatgactttagaggtaaatcgaagactactggacctcgacgaggccgcatacaagcactccgacatcacagctcactcttgtcctcctgtggagcccgcagccgcttag

SEQ ID NO: 225288 - DNA, 1431 bp, Artificial Sequence
  Description of Artificial Sequence: Synthetic coding sequence
atgtctggagcgaggtgcagaacactgtatcctttttccggagagaggcacggacaaggcctgaggttcgcagccggtgaattaattactctgctgcaagttcctgatgggggttggtgggagggggaaaaggaggacgggttaagaggttggttccccgcttcctatgtgcaactgttggaaaaacctgggatggtgcccccaccacccggagaggagagccagacagtgattcttccacccggttggcagagctacctctccccccagggacggcgttactatgtaaataccacgactaatgagacaacttgggaaagaccctccagttcacctggcatccccgctagccccggaagccatagaagtagtttgccacctacagtaaatggataccacgcaagcgggactcctgcccacccgccagagaccgcgcacatgtccgttaggaaatccacaggcgactcccagaacctgggaagctcatctccaagcaagaagcagagtaaggagaatacaattactatcaattgtgttacattccctcatcccgataccatgcctgagcagcagttgttaaaacccacagagtggtcttactgcgattatttttgggccgataagaaagatcctcaggggaatggcaccgtcgcgggattcgaattactcctacagaagcaactgaaaggtaaacagatgcagaaagaaatgtcagaattcatcagggagcggatcaagattgaggaggactatgccaagaatttggctaagttgagtcagaacagtctcgcctctcaagaggagggtagcctcggtgaagcatgggcccaggtaaaaaagtcgctggcggatgaggccgaagtccacctcaagttttccgccaagctgcacagtgaggtggaaaagcccctcatgaacttccgcgagaatttcaagaaagatatgaagaaatgtgatcaccacatcgccgaccttagaaaacagctggccagcaggtatgcttctgtcgagaaggcccgaaaagcacttactgagcgtcagcgggaccttgagatgaagacacagcaactggagatcaaactgagtaataagaccgaggaagatataaagaaggccaggcggaaatccacccaggcaggcgatgatctgatgagatgtgttgatttgtacaatcaggcccagagtaagtggtttgaggagatggtgactactaccctggaacttgaacggctggaggtcgagcgggtcgaaatgatccgtcagcacctatgtcagtacacccagctgaggcacgaaacggacatgtttaatcaatccactgtggagccagtggaccagttactgcggaaagttgatcccgcaaaagaccgcgagctctgggttagagagcacaaaaccgggaacataagaccagtggatatggaaatatag

SEQ ID NO: 225289 - DNA, 1251 bp, Artificial Sequence
  Description of Artificial Sequence: Synthetic coding sequence
atgaagcctggcatggtccccccaccacctggtgaggagtctcagaccgtgatattgcctcccggatggcaatcatatttgtcacctcagggacgtcggtattatgtcaataccacaacaaatgagaccacttgggagagacccagctcaagccctggaatccctgcctcacccggttcgcaccggagctccctgcctccgacagtcaatggttaccacgccagtggcacacccgctcatccacccgagacagcacatatgtctgtccgaaaaagcacaggcgattcgcagaatctgggctctagttcacccagcaagaagcagtctaaggagaatacaatcaccatcaactgtgtcacgttcccacaccccgacactatgcccgagcaacagctgctcaaaccgactgaatggtcctactgtgattacttctgggccgataaaaaggaccctcagggcaatggcacagtggcgggtttcgagctgctgctccaaaaacagctgaaagggaagcagatgcaaaaggagatgagtgaattcatccgggagaggatcaaaattgaggaagattatgctaagaacctggccaaattgtcacaaaactccctggcaagccaggaggagggctccctgggtgaagcctgggcccaagtaaaaaagtctctcgccgacgaagcagaagtacacctgaaatttagtgcgaagttacacagtgaagtcgagaaaccactcatgaacttccgggaaaactttaagaaggatatgaagaaatgcgatcaccatattgccgatctccgcaaacagctcgctagcaggtatgcctccgtggagaaggccaggaaagcccttactgagcgtcaacgggatcttgagatgaagacgcagcaacttgaaattaaactgagcaacaagactgaggaagacattaaaaaagcgcgaagaaagtccacccaagccggagacgatctgatgcgatgtgtggacctctacaaccaggcacaaagcaagtggtttgaggagatggtgactactacactggaactggaacggttagaagtggaacgggtggagatgatccgccagcatctatgccaatacacacagctcaggcatgagacagacatgttcaaccaatccacagtggaaccagtcgatcagctgcttaggaaagtcgaccccgcaaaggaccgcgaattatgggtcagggaacataaaaccggaaacatcaggcctgtagacatggagatctag

SEQ ID NO: 225290 - DNA, 1011 bp, Artificial Sequence
  Description of Artificial Sequence: Synthetic coding sequence
atgtctaatatggagaattccttcgacgacgtatcctgcctgtctccccagaacctgggctcctcgtccccgtcaaagaagcagagcaaggagaacaccattacgatcaattgtgtgacatttccacatcctgacacgatgcccgaacagcagctgttaaaaccaaccgagtggtcctattgcgactatttctgggccgacaaaaaggatccacagggtaacggcacagtggcaggcttcgagctgttgctccagaagcagctcaaagggaagcagatgcagaaagagatgtcagaattcattagggaacggatcaagattgaggaggactacgccaagaacctcgctaaactctctcagaattccctagccagccaagaggagggttccttgggcgaggcgtgggcccaggtaaagaaaagccttgcagatgaggccgaggtgcacttgaaattttccgcgaagctccattcagaggtagagaaaccactcatgaattttagggagaactttaaaaaggatatgaaaaagtgcgatcaccatatcgctgaccttcggaaacagttagcgagcaggtacgcctcagttgaaaaggcacgcaaagccctgaccgagaggcagcgagatttggaaatgaagacacaacagctcgaaatcaagctgagcaacaaaactgaggaagacattaagaaggcacgccgtaagagcacacaagccggtgacgacctgatgcgatgcgtcgacctttataaccaggcgcagagtaagtggtttgaggagatggtcactacaaccctcgagttggaacgcctagaggtcgagcgggtcgaaatgattaggcagcatctctgtcagtacacacagctacgccatgaaaccgatatgttcaatcaatctactgtagaacctgtcgatcagctgctgagaaaggtggacccagccaaagaccgcgaactatgggtgcgagaacacaagaccggtaacattagacctgttgatatggagatctag

SEQ ID NO: 225291 - DNA, 1248 bp, Artificial Sequence
  Description of Artificial Sequence: Synthetic coding sequence
aagcccggaatggtgcccccaccacctggcgaagagagtcaaactgtgatcctgccaccaggctggcagagctatctatccccacagggaagaagatactatgtgaacaccaccaccaatgaaacgacttgggagagaccatctagcagccccggtatcccagcatctcctggcagccataggagtagcctgccacctactgtgaatgggtaccacgcatccgggacacccgcacatccacccgagacagctcacatgagcgtccgaaaatccaccggggattcgcagaatctgggtagttcttcaccgtccaaaaaacagagcaaggagaataccattacaattaattgtgtcacgttccctcaccccgacactatgcccgagcagcagcttctcaagcctaccgaatggtcctactgcgattacttctgggccgataagaaggatcctcaaggcaacggcaccgtagcagggttcgagctgctgctgcagaagcagctaaaaggcaaacagatgcagaaggaaatgagtgaattcattcgtgaaaggatcaagattgaagaggattatgccaaaaatcttgccaaattaagccaaaactctctggcctcccaagaggaggggagcctcggtgaggcctgggcgcaagtgaaaaaaagcctggccgatgaagctgaggtacacctcaagttctcagctaaacttcacagcgaagtagagaagcctctgatgaatttccgtgagaatttcaaaaaggacatgaaaaaatgcgaccaccacatcgcagaccttcgaaagcagctggcatcccgctacgcaagtgtggaaaaagccagaaaggcgctgaccgagcgccagcgcgatttggaaatgaagactcagcagcttgaaataaagcttagtaataagacagaagaggatatcaagaaagcacggcgaaaaagcacccaagctggggatgatctcatgcgatgcgtcgatctgtacaatcaagctcagagtaagtggtttgaagagatggtaacgaccacattggaactggagcgccttgaagtcgaacgcgtggagatgattcgacaacacctgtgccaatacacccagctgcggcacgagaccgatatgttcaaccagtcaacagttgaaccagtagatcagctgctgagaaaagtcgatcctgccaaagaccgcgaactgtgggttcgcgaacacaagactggtaacataagacccgtggatatggagatatag

SEQ ID NO: 225292 - DNA, 1251 bp, Artificial Sequence
  Description of Artificial Sequence: Synthetic coding sequence
atgaaacccggtatggtgcctcctcctcccggtgaagaatctcagaccgtgatactcccacctggatggcagagctacttaagtccccaaggcagaaggtactacgtcaacactacgaccaacgaaaccacatgggaaagacctagtagttcccccggaattccggcaagtcctggcagtcatcgttcttccctaccacccaccgtcaatggctaccacgcaagcgggacacctgctcaccctcccgaaactgctcacatgagtgtcaggaaaagcacaggggactcccaaaacttgggctccagctccccttcaaagaagcagagcaaggagaacacgattaccattaactgcgtaaccttcccacatcccgacactatgcctgagcaacaactcctcaaacctaccgaatggtcttactgtgactatttctgggcagacaagaaagatccgcaaggcaatggcacagttgccggtttcgagctgttgctgcagaaacagttaaaggggaagcagatgcagaaagagatgtctgaatttatccgagaacgcatcaaaatcgaagaagattacgccaaaaacctcgcgaagctgtcccaaaactcattggcatcacaagaagaaggatccctgggcgaggcttgggctcaagtcaagaaaagtcttgccgatgaggctgaagtacatctgaaattctcagctaagctgcactctgaggtggagaagccgctcatgaacttcagggagaactttaagaaggatatgaagaaatgtgaccaccacattgccgatcttaggaaacagctcgcgtccaggtacgcctctgtcgagaaagcaagaaaggccctcacagaacggcaaagagacctcgaaatgaagactcagcagctggagataaaactgtctaataagacagaagaggacataaaaaaagcgcgaaggaaatcaacccaggcaggggacgacctgatgaggtgcgttgacctctataaccaggcacagagcaagtggtttgaagagatggtgaccaccaccctggagctcgagcggctcgaagtcgagcgcgtggagatgattcgccagcacttgtgtcaatacacacaattgagacacgagacagatatgttcaatcaaagcactgtcgaacctgtggatcaacttctgaggaaggtcgaccccgctaaggaccgtgaactttgggttcgcgagcacaagaccggaaacattcgccctgtagacatggaaatttag

SEQ ID NO: 225293 - DNA, 546 bp, Artificial Sequence
  Description of Artificial Sequence: Synthetic coding sequence
atggttcctccaccaccgggagaagagagtcaaacagtcattcttcctcccggttggcaatcctacctgtcccctcagggccgaagatactatgtcaatactacgaccaacgagacaacatgggaacgcccttcttcaagtccaggtattccggcttcccctggttcacatagaagctcactccctcctaccgtaaacggctaccacgcgagtggaacacctgcacaccctccagagacagcccatatgtctgtcagaaaatccacaggcgactctcaaaacctcggctccagttctccctccaaaaagcagtcaaaggagaatacaattacagagttagagagactcgaggtggaacgggtagagatgatacgccagcatctctgtcaatacactcagctgcgacacgagaccgatatgtttaaccaatcaacagtggaaccggtggatcagctactccgcaaggtggaccctgccaaggaccgcgagctgtgggtgcgtgagcacaaaacaggtaacatccggccagtggatatggagatttag

SEQ ID NO: 225294 - DNA, 873 bp, Artificial Sequence
  Description of Artificial Sequence: Synthetic coding sequence
atgcccgagcaacagcttctgaagcctaccgaatggagttattgcgattacttctgggccgataagaaagaccctcagggaaatggcacggtcgcaggattcgaattgctccttcagaagcagctgaaaggaaaacagatgcagaaggaaatgtcggaattcatcagggagaggatcaagattgaggaggattatgccaagaacctggccaagctgtcccaaaattctctcgcttctcaggaagagggaagtctgggggaagcctgggcacaggtgaaaaagtctctggcagacgaggctgaagtgcatctgaagttttccgcaaaacttcactctgaggttgaaaagcccttgatgaatttccgggaaaatttcaagaaagatatgaaaaagtgcgaccaccatatcgccgacttacgcaagcagctggcgtccaggtatgcctccgtggagaaggccagaaaagcccttactgaaaggcagagggatctggagatgaaaacccagcagctcgaaattaagctgagcaacaagacagaggaagatattaaaaaagccaggcgtaaatctacacaagccggagatgacctgatgcgctgcgtggacctgtacaaccaggcacaaagcaaatggttcgaagagatggttaccaccaccctcgagctcgagcggttggaggtcgagcgcgtggaaatgatccgccaacatctgtgccagtacacacagttgagacacgagaccgacatgttcaatcagtccaccgttgagcccgtggatcagctgttgagaaaggtggatcccgcaaaggatcgagagctgtgggtgcgcgagcacaaaacagggaacataagacccgtggatatggaaatttag

SEQ ID NO: 225295 - DNA, 378 bp, Artificial Sequence
  Description of Artificial Sequence: Synthetic coding sequence
atgaagacacagcaactggagattaagctaagcaacaagaccgaagaggacatcaaaaaagcacgtagaaagtcaacacaagcgggtgacgatcttatgcgttgtgtagacctttacaatcaagctcagtccaaatggttcgaagagatggtaaccacaacattggagcttgaaagacttgaggttgaacgggttgaaatgataagacagcatttgtgccagtacactcagctgcgccacgaaacggacatgttcaaccaaagcaccgtagagcccgttgatcaattgcttcgaaaagtcgatccagcgaaggaccgagagttgtgggttagggagcataagacaggaaacattcgcccagtggacatggaaatctag

SEQ ID NO: 225296 - DNA, 1011 bp, Artificial Sequence
  Description of Artificial Sequence: Synthetic coding sequence
atgtcgaatatggagaattcttttgatgatgtgagttgtctgtctccccagaatctcggaagcagtagtcctagcaagaaacaaagcaaagagaacacaatcacaatcaactgcgtgacatttccacaccctgacaccatgcctgagcagcaattacttaaaccaaccgaatggtcatactgcgactacttttgggccgataagaaagacccacaggggaatggcaccgtggcgggtttcgaactgctcctgcagaagcagctcaagggcaagcagatgcaaaaagagatgagcgaattcattagagaacgtattaagattgaagaggactacgctaagaaccttgcaaagctgtcccagaacagtctggccagccaggaggagggctccctgggagaggcctgggctcaggttaagaaaagtctcgccgatgaggctgaggtccatctgaagttcagtgcaaaactgcatagtgaagtggagaagccattgatgaacttccgcgagaacttcaagaaggacatgaagaaatgcgaccaccatatcgcggacctgagaaaacaattggcctcccggtacgctagcgtagagaaggcacgaaaagcgttgaccgaaagacagagagatctcgagatgaaaacccaacagctcgaaatcaagttgagcaataaaacagaagaagacattaagaaagccaggcgcaaatcgacccaggctggcgacgacctcatgcgctgcgtcgatttatacaaccaagcccagagcaaatggttcgaggagatggtaacaacaacactagagctagaaagactagaagttgagagagtagagatgatcagacagcacctgtgccagtatactcagttacgacacgagactgacatgtttaaccaatccaccgttgagcctgtggatcagttgcttaggaaggtggatcctgccaaagacagagaattgtgggtgcgcgagcacaagacaggtaacataagaccagtcgatatggaaatttag

SEQ ID NO: 225297 - DNA, 1437 bp, Artificial Sequence
  Description of Artificial Sequence: Synthetic coding sequence
atggcgcctaagaaaaaggggaagaagggaaaagccaagggcaccccaattgtggatgggctggccccagaggacatgtccaaagagcaggtcgaggaacacgtctccaggatcagggaagaactggaccgcgaaagagaagagcgcaactacttccagttggaaagggacaagatccatacattttgggagatcactaggcggcaactggaggagaagaaggccgaactaaggaacaaggaccgggagatggaagaagctgaagagcggcaccaagtcgaaattaaggtctataagcagaaggtcaagcacctgctgtatgagcatcagaacaatctgaccgagatgaaggctgaggggaccgtggtgatgaagttagcgcaaaaggaacaccgaatccaagagagcgtccttaggaaggatatgagggcactgaaagtcgagctcaaggaacaggagctggcttctgaggttgtcgttaaaaacctgcgattaaaacacacggaggagatcacacgtatgaggaatgacttcgaaagacaggtgagggaaattgaggctaaatacgacaagaagatgaagatgctgcgggatgagctggatttgcgcaggaagacggagttgcatgaagtcgaagaaagaaaaaatggacaaatacataccctgatgcaaagacatgaagaggcctttactgatattaagaattactataatgatatcacccttaataatctcgccctcatcaactcattgaaggagcaaatggaagacatgcggaaaaaagaagatcacctcgaaagagagatggccgaggtcagcggtcaaaacaaacggcttgctgaccctctgcagaaagcaagggaggagatgtccgagatgcagaagcagcttgccaactacgaacgagacaagcagatattgctgtgtaccaaagcacggctgaaagttcgagagaaagagcttaaggacctacagtgggaacatgaagtcttggaacagagatttaccaaagttcaacaggagcgcgacgaactttacaggaaatttacagcagcaatacaggaggttcaacaaaagaccggcttcaaaaatttggtgctagaaaggaaacttcaagcactgtcggcagccgttgagaagaaagaggtccaattcaacgaggtcctagcagcctcgaacctggatcccgctgccctgacactagtttcacgcaaattggaagatgtgctggagagcaagaactccactatcaaggatctccagtatgaactggcccaggtttgcaaggcccataacgacctcctaaggacttacgaagcgaaactgctggcattcggaatccctctggataacgttgggttcaaaccactggagactgccgtgataggccagacactggggcagggaccagccggtctggtgggaacacccacttag

SEQ ID NO: 225298 - DNA, 1362 bp, Artificial Sequence
  Description of Artificial Sequence: Synthetic coding sequence
atgagtaaggagcaggtggaggagcacgtcagccggatccgggaggaactggacagagaacgagaagagaggaattattttcagctggaacgggacaaaatccatacattctgggaaatcacaagaaggcagttagaagagaagaaagcagaactcagaaacaaagaccgcgagatggaggaagcagaagagcgccaccaagtggaaatcaaggtctacaaacagaaggtgaagcatctgttgtatgagcatcaaaataatctgaccgagatgaaagccgagggtaccgtggtgatgaaactggcacagaaagaacatcggatccaagagagtgtcctgaggaaggatatgagggccctgaaagtcgaattgaaggagcaggagctcgcctcagaggtggtggtcaaaaacctgagactcaaacatactgaggagatcactagaatgcgcaatgatttcgaacggcaagtccgggaaatcgaggccaaatacgacaagaaaatgaagatgctgcgcgacgaacttgacctgcgcagaaaaactgagctccatgaggttgaagagaggaagaatggtcaaattcacaccctgatgcaacgccacgaagaagctttcaccgatatcaagaactactataacgacatcaccctcaacaatctggcactgatcaactcactcaaagaacagatggaggatatgcgcaagaaggaggaccacctggagcgggaaatggcagaggtttctgggcagaataagaggctggccgacccactgcagaaagctcgggaggagatgagtgagatgcaaaaacagctggcaaattatgagcgtgataagcagatattactctgcacaaaggccagactcaaggtgcgggaaaaagaactcaaggatttgcaatgggaacacgaagtactcgaacagaggtttaccaaagtgcagcaggaaagagatgaattgtaccgcaagttcactgccgctatacaggaagtgcagcagaagactgggtttaaaaatctcgtgttggagcgcaaactgcaagccctctccgccgctgtggagaagaaagaagtgcagtttaatgaggttctggctgctagcaatttagatccagccgcacttacactcgtgtccagaaagctcgaggacgttttagagagtaaaaattccacgatcaaggacctccaatacgagctggcgcaggtgtgtaaagcccacaatgacctcctcaggacatacgaagctaagctgctggctttcggtatccccctggataacgtcggattcaaaccgttggagactgccgtcatcggccagacactgggacaaggacccgctggactagtgggcacccccacctag

SEQ ID NO: 225299 - DNA, 525 bp, Artificial Sequence
  Description of Artificial Sequence: Synthetic coding sequence
atggcgccaaaaaagaaaggcaaaaagggtaaggcaaagggaactcccatagtcgatggcctggcacctgaagacatgtcaaaagaacaggttgaagagcacgtatcgagaattcgcgaagagttggaccgagaacgcgaggaacgcaattatttccagttggaacgagacaaaatacacactttttgggagatcacgcgccgtcaattggaagagaagaaggctgagcttcgaaacaaggatagagagatggaggaagcggaggaacggcaccaggtcgaaatcaaggtttacaaacagaaagtcaaacaccttctttacgagcaccaaaataatcttacagagatgaaggcagagggtaccgttgtgatgaagctggcacagaaggagcacaggatacaagagtccgtactgcgaaaagatatgagggctctaaaggtggagttgaaggaacaggagctcgctagtgaggtcgttgtcaagaacttgcgtctaaaacttaggccctctatgatcaggcgctag

SEQ ID NO: 225300 - DNA, 1149 bp, Artificial Sequence
  Description of Artificial Sequence: Synthetic coding sequence
atggtagaggaacacgtgagccggatccgcgaagaactcgatagggagcgcgaggaacgaaattacttccaactcgagcgggacaaaattcatactttctgggaaatcaccaggcgccaactagaagaaaagaaggccgaactgcgcaacaaggaccgcgagatggaggaagccgaagaacgtcaccaggtcgagatcaaggtgtataagcagaaagtaaagcaccttctgtatgaacaccaaaacaatttaaccgaaatgaaagccgaggggaccgtggtgatgaaacttgcccagaaggaacataggatccaggaatcagttctgcggaaagacatgcgtgcactgaaggttgagctgaaggagcaggaattggccagtgaggtggtggtgaagaatctaagactgaagcatactgaagagattacgcgcatgcggaacgacttcgaacgccaagtccgggaaattgaggccaaatatgacaagaagatgaaaatgttgcgggacgaactggaccttcgtcgaaaaactgagctgcacgaagtggaggaacgaaaaaatggacagatccacacactgatgcagaggcacgaggaagcctttaccgatattaagaactactataatgatatcacccttaataaccttgccttgattaactctctcaaggaacagatggaagacatgagaaagaaggaagaccacctggaacgagaaatggccgaggtgtccggccagaacaagaggttggccgacccactacaaaaggctagggaggagatgagtgaaatgcagaaacaactagcgaactacgagcgagataagcaaatactgctgtgcactaaagcgcgactgaaggtaagagagaaggagctgaaggacctgcagtgggagcatgaagtcttagaacagcgtttcactaaagtgcagcaggagcgggacgagctgtacaggaaatttactgccgctatccaagaagttcagcaaaagaccggatttaagaacttggtattggagagaaaattgcaggctctgtctgcggcagtggaaaaaaaggaagtgcagttcaacgaggtgctagctgcctcaaacctagatcctgccgcacttactctggtttccagaaaacttgaaacgttcttttgttag

SEQ ID NO: 225301 - DNA, 717 bp, Artificial Sequence
  Description of Artificial Sequence: Synthetic coding sequence
atgctgtgttgtatgagaagaacgaagcaggtggaaaaaaatgacgacgaccaaaaaattgaacaggacggaattaaaccggaggataaggcccacaaagccgcaactaaaattcaggcttccttcagggggcatattacgcgaaagaaactgaagggcgagaagaaagatgacgtccaggcagcagaagctgaggcaaacaaaaaagacgaggcccctgtcgccgacggcgtggaaaagaaaggggaaggaacgaccaccgcggaggccgctcctgcaacaggtagcaaacccgatgagccaggcaaggctggcgagactcctagcgaagagaagaaaggcgagggagatgccgcaactgagcaggcagccccacaggccccagcttcctccgaggagaaagccggtagcgctgaaaccgaaagtgcgactaaagcttctactgacaattctccgtcaagcaaggcggaggatgcacccgctaaagaggagcccaaacaggcggatgtgcctgcagccgttacagcggcagctgccactaccccagccgctgaggatgcagcagcaaaggcgacagcccagccacctaccgagacaggcgaatcttcccaggctgaggaaaacatcgaggccgtggacgaaactaagccgaaggaatccgccagacaggacgagggcaaggaggaagagccagaggccgatcaggagcacgcctag

SEQ ID NO: 225302 - DNA, 825 bp, Artificial Sequence
  Description of Artificial Sequence: Synthetic coding sequence
atgactaagtcttgcagcgagctgtgccatcccgctctgcactttttaccctgtcttggtggacttagaaaaaacctgcagagggcagtgcgcccaagcccctatagtctcggattcctgaccttttggatttctcgtgtcgaaaagaacgacgacgatcagaagattgaacaggacggtataaagcctgaagacaaagcccacaaggccgcaacaaagatccaggccagttttaggggccatatcacccggaagaagctcaagggggaaaaaaaagatgacgtgcaggccgcagaggccgaggccaataaaaaggacgaagcccctgtggctgacggggttgagaaaaagggcgagggaacaactacagctgaggccgcacccgcaactggctcaaagcccgatgagcccggaaaagccggagagactccttccgaggagaaaaaaggagagggcgatgcagcaacagagcaggccgctccccaggcccctgcaagttccgaagaaaaggcagggtccgctgagacagagtccgcaactaaagcttccacagacaatagtccttctagcaaagccgaagacgcgccagccaaggaagagccaaagcaggcggatgttccggcagctgttaccgctgccgctgctaccacccctgcagcggaggacgctgctgcaaaggccacagcccagcctcccacagagacaggggaatccagtcaagccgaggagaacatcgaagctgtagatgagactaaaccgaaagagtctgcacgacaagacgagggaaaagaagaggagcccgaagcagaccaggaacatgcatag

SEQ ID NO: 225303 - DNA, 1119 bp, Artificial Sequence
  Description of Artificial Sequence: Synthetic coding sequence
atgcctccaccccagcagggcccatgcggccaccacctgctgttactgctggccctacttctgccttcactgcccctcacaagagctccagtgcctcctggtccggctgcagcgctgctgcaggcactcgggctgcgggacgaaccacagggagcacctcggctccgtcctgtgcctccagttatgtggagattgtttcgcagaagagatccccaggagacccgcagtggctcacgacgcacatctcccggagttacccttcaaccctgccacgtggaagagctgggtgtcgccggaaacatcgttcgccatattcctgaccgcggagcgcctaccagggccagtgaacctgcctcagcagccggtcactgcccagagtggaccgtcgtttttgatctgtcggctgtagagcctgcagagagaccatcccgggctcgcctcgaacttcggtttgcagctgctgcggcagccgctcctgaaggcggatgggagttgagtgtggcccaagctggccagggggctggagccgaccccggacctgttctactgcgccaactggtgccggcactcggccctcccgtgcgtgccgagctgctgggggctgcttgggccagaaacgcgtcatggcctcgatcactccggctggctctcgcgctccgcccaagggcaccagctgcctgcgccaggttagccgaagcatccctacttctcgtgacgctcgacccacgcctgtgccacccactagccagaccacgccgagatgccgagcccgtgcttggaggtggccctggaggtgcttgccgggctcgacggctatatgtaagcttccgggaagttggttggcataggtgggttattgctccgaggggtttcctcgccaactactgccagggacagtgtgccttgccagtcgctctgtcaggctcaggcggtcctcctgcacttaatcacgcagtcctccgggctctcatgcatgccgctgcacccggagccgcagaccttccgtgttgcgtgcccgctagactttccccgatttccgtcctgtttttcgacaatagcgataacgtcgttcttcgccagtacgaggatatggttgttgacgagtgcgggtgtagatag

SEQ ID NO: 225304 - DNA, 1224 bp, Artificial Sequence
  Description of Artificial Sequence: Synthetic coding sequence
atggtgctcgccgctccgctgttacttggctttctgctcctggctttggagctgcgccctcggggtgaagcagcggaggggcctgctgccgctgcggctgcagccgcagcggctgcagccgcaggcgtgggtggcgagagatcatcgcggccagcgccatcagtggccccagaacctgacggctgtcccgtgtgtgtttggaggcagcactcacgcgaactccgactggaatcgattaagtcacagattctgagcaagctgaggctgaaggaggccccaaacatctcaagagaggtggtcaaacagcttctccctaaggctcctccacttcagcagatcttggacctccacgatttccaaggcgatgcactgcagccagaggacttccttgaagaagacgagtaccatgcaaccacagagactgtcatatcaatggctcaagaaaccgatcctgccgtgcagacagacggatcccccctttgctgccatttccatttctctcctaaagtaatgtttactaaagtcttaaaggcccaactgtgggtgtatctcaggccagtgcccaggccagccaccgtttacctccagattcttcgcttgaagccactcacgggtgaaggtacagctggcggaggtggcggaggtcggaggcacatacggatcaggtcgctgaagattgagctccatagccggtccgggcactggcaatccattgattttaaacaggtgctgcatagctggtttcgccaaccacaatcgaactggggcatcgagatcaacgcattcgaccctagtggtaccgacctcgcagttacatctctgggccctggtgctgaggggttacatccctttatggaacttcgggtgttggaaaacactaaacgctccagaagaaacctgggcctcgactgcgatgagcatagctctgaatcaaggtgttgcaggtatcctctgacagtggattttgaggcttttggctgggattggattattgcacccaagcggtataaagctaactactgtagcggtcagtgcgagtacatgtttatgcagaaatatccacacacacatctcgttcagcaggccaatcctagaggttcggctggtccatgctgcactcccacaaaaatgagccccatcaacatgttatactttaatgacaaacagcagatcatctacggcaaaatcccgggaatggtggtcgacaggtgcgggtgctcctag

SEQ ID NO: 225305 - DNA, 1143 bp, Artificial Sequence
  Description of Artificial Sequence: Synthetic coding sequence
taggccgctgctgcagctgcagctgccgcagcagcagctgccggagttggcggtgaaagatcctcccgtcccgcaccatccgtcgccccagaaccagacggatgcccagtctgcgtctggcggcaacactccagagaattacgtctggagagcataaagtctcagatcttgtcaaagctaaggctcaaagaagcgcctaacataagtcgagaagtcgtcaaacagttattgcctaaggcaccccctttacagcaaattctggatttacacgatttccaaggcgatgccttgcagcccgaggacttcctggaagaggacgagtatcatgcgactaccgaaaccgtgatcagcatggcccaggaaaccgaccctgctgtgcaaacggatggatcgcctttatgttgccactttcacttttcccccaaggtgatgtttaccaaagttttgaaagctcagttgtgggtgtaccttcggcctgttccaagaccggctactgtgtatctgcagattttgcggctgaaaccactgacaggggaaggtactgccggtgggggaggaggaggcaggcgccacatccgcattcgatccctgaagatcgagctgcattccaggtcaggacactggcagtccatcgatttcaagcaggtcctgcacagctggtttagacagcctcagagcaattgggggatcgaaataaatgcctttgatccctccggaactgacctcgctgtgacctccctgggccctggtgccgagggcctgcatcctttcatggagcttcgagtgcttgaaaacacgaagagatctaggcgaaatctgggattagactgcgacgaacactcatccgagtccaggtgctgtcggtaccccttgactgtggatttcgaggcctttggatgggactggataatcgccccaaaaagatacaaggctaattactgttctggccagtgcgagtatatgttcatgcagaagtacccccacactcaccttgtgcaacaggccaatcccaggggctctgccggtccctgctgtactccaacaaaaatgtctcctatcaacatgttatacttcaacgataaacagcaaatcatctatggcaagatcccgggaatggtagtcgaccgctgcggctgttcatag

SEQ ID NO: 225306 - DNA, 927 bp, Artificial Sequence
  Description of Artificial Sequence: Synthetic coding sequence
atgcctgggcaggaattgcggaccgttaacggatcccagatgctactagttttattagtcctctcgtggctgccacatggcggagcactgtctttagccgaggccagtagggcttcttttcccggacctagcgaactgcattctgaagatagcaggtttagggagctgcgaaaaaggtatgaggacctcctgacccggctgagagctaatcagagttgggaagattctaatactgatctagtgccagccccagcggtgcgcattctcactcctgaggttcggctcggctccggcggacatctccatctcaggatcagccgcgcagcgctaccagagggtctaccagaagctagcaggcttcaccgcgcattgttcagactctcccctacagcctctcggagctgggacgtgacgcgacccttgcggaggcaattgtcactggccaggccccaagcgcctgctcttcacttgaggttatcccctccaccctctcagtctgatcagcttctagctgagtctagtagcgccagaccccagttagagctgcacctgcgtccccaagccgcaagagggagacggagagccagggcgcgaaatggagaccattgcccactgggtcccggtcgatgctgtcgcctgcacacagtgagagcctcactggaggatcttgggtgggctgattgggtcttgtccccccgtgaggttcaagtgacgatgtgcattggtgcctgcccctcccagttcagggctgcaaacatgcatgcacagatcaaaaccagtctacataggctcaaacccgataccgtcccagcgccatgctgcgttcctgcatcctacaacccgatggtgttaatccagaagactgacacaggggtgagcctgcagacctatgacgatcttttggctaaggactgccactgtatctag

SEQ ID NO: 225307 - DNA, 927 bp, Artificial Sequence
  Description of Artificial Sequence: Synthetic coding sequence
atgccaggccaggagcttagaacagtgaatggctctcagatgctgctggtgctcctggtcctgagctggttgccccatggaggggcactctctcttgccgaggcaagccgggcttctttcccagggccttcagaactacacagcgaggactcacggtttagggagttaagaaagcggtatgaggatcttttgacccggcttcgggctaaccagagctgggaagatagcaataccgacctggtgcctgccccagctgtaaggatccttacccctgaggtaagactgggaagcggcggacacctgcatctgcgcatttcccgagccgcattgcccgagggtcttccagaggcctcgagactgcatagagcactgttccgactaagtcccacggctagccggtcgtgggacgtcacccggccactccgccgacagctaagcttggccagaccccaggctcctgcacttcatctcaggttgagccctcctccctcccagtccgaccagcttctcgctgagagtagctccgcgaggccacagctagagctccacttgaggccgcaagccgctagagggaggcgaagggccagagcccgaaatggagatcattgtcccctgggcccaggcaggtgctgccggctgcacacagtcagggcctctctggaagatctgggctgggccgactgggtactcagtccgagggaagtccaggttaccatgtgcatcggagcttgccctagccaattcagagccgctaacatgcatgctcaaatcaaaacttccctccaccgcctcaagccggatacggtgcccgctccctgctgcgtgccggcttcatataatcccatggtcctgattcagaagacagacactggcgttagcctccaaacatatgatgatctgctggccaaggactgccactgcatttag

SEQ ID NO: 225308 - DNA, 1290 bp, Artificial Sequence
  Description of Artificial Sequence: Synthetic coding sequence
atgtgccccggtgctttatgggtcgcactccccttgttgtcccttttggcagggtccctccaaggcaaacccctccagtcatggggcagagggtccgcaggaggaaacgcgcactcgccattaggcgtcccaggcggaggattaccagaacacacattcaacttgaagatgttcctggaaaacgttaaggtcgacttcctgcgctccttgaacctcagcggggtgccatctcaggacaagactcgagtggaacctcctcagtacatgatcgatctgtacaatcgctatacaagtgataaaagcacgactccggcttcaaatatcgtgcgaagtttctccatggaggacgcaatttccataaccgctaccgaggacttcccattccagaaacatatcctcctttttaacatatcgatcccaaggcatgagcagattacaagggctgaacttcgcctatacgtatcctgtcaaaatcatgtggacccgtcacatgatttgaagggtagcgtagttatctacgacgtactggacggaacggacgcctgggattccgcaaccgaaaccaaaactttcctggtttctcaggacatccaggatgagggctgggagaccttggaggtctcgtccgccgttaagcgctgggtgcgttcagacagcacgaagtcgaagaacaagcttgaggttaccgtggaatcccaccgaaagggttgtgacacgttagatatcagcgtgcctcccggaagcagaaatttgcccttcttcgtggttttctctaatgatcacagcagcggcacaaaagaaactaggctggagctacgcgagatgataagccatgaacaggagtccgtattgaaaaagctgtcaaaggacggctccactgaagctggcgaatccagccacgaagaagacacagacggacacgtcgcagctggatccactctcgcaaggcgcaagcggtccgctggagctggtagtcattgtcagaagacctcccttcgcgtcaacttcgaagacatcggatgggactcatggattatagctcctaaagagtacgaagcctatgagtgcaagggcggttgcttcttccccctagcggatgacgtgaccccgacaaagcatgcaattgtgcagaccctggtgcacctgaagttccccactaaggtaggcaaggcttgttgtgtcccaaccaagctgagccctataagcgtgctctacaaggacgacatgggggtccccacactcaagtatcactacgaggggatgtccgtcgccgaatgtggctgccggtag

SEQ ID NO: 225309 - DNA, 1095 bp, Artificial Sequence
  Description of Artificial Sequence: Synthetic coding sequence
atgctgcggttcctgccagacctggccttcagcttcctgttgatactggctctgggtcaagcagttcagtttcaggagtatgtctttctgcagttcctcggcctggacaaagcgccatcccctcaaaagtttcagccggtgccctacatcctcaagaaaatttttcaggaccgggaggctgctgctactacaggagtttcacgcgacttatgttatgtgaaagagctaggggtaagaggaaacgtgctgagattcctgccggaccagggctttttcctgtatcccaagaaaatatcacaagcctcatcctgcctgcagaagctgctgtattttaatttgtctgccattaaagaaagggaacagttgacactcgctcagctaggactcgacctcggcccaaactcctactataacctgggaccagagctggaacttgccttattcctggtacaggagcctcatgtctggggtcagacgacacccaaaccgggaaagatgtttgtcctccggagcgtgccttggcctcagggagcggtgcattttaatctgctggatgttgccaaagactggaacgacaacccaagaaaaaatttcggcctgtttctggaaatcttggttaaggaagaccgggactcaggggttaattttcaacctgaggatacatgcgccagactccgctgttctctgcacgctagccttctggttgtgactcttaatcctgaccaatgtcacccatcccggaagagacgtgctgccatccccgtgccgaagctatcatgtaagaacttatgccaccgccatcagctgtttatcaactttcgggacctgggctggcataaatggattatcgctccaaagggcttcatggcgaactactgtcacggtgaatgtcctttctccctcactatcagtttgaatagttccaactacgccttcatgcaggcgttgatgcatgctgtggaccccgaaatcccccaggcagtgtgtatccctacaaaacttagccccatttccatgctgtaccaggataacaacgataatgtgatcttgcgtcactatgaagacatggtcgtcgatgagtgtggctgtggctag

SEQ ID NO: 225310 - DNA, 1506 bp, Artificial Sequence
  Description of Artificial Sequence: Synthetic coding sequence
atgcgcctgcctaagctgttaaccttcctcctctggtatctcgcctggttggacctagagtttatatgcactgtgctgggcgctcccgacctgggccagagacctcaaggcactaggccaggactcgccaaggccgaagccaaagaaagacctcccctagcgcgaaacgtgtttaggccaggagggcactcgtatggcggtggtgccaccaatgctaacgctcgggctaaagggggaaccggtcaaacaggcggacttacacagccaaagaaagatgagcccaagaagctgccccctaggccaggcggacctgagcccaaaccaggacaccctccccagaccagacaagctactgctcgaactgtgaccccgaagggacagctgcccggtggaaaagccccacccaaggctgggtcggtgccatcatccttcctactaaaaaaggccagagagcctggtccacccagagaacccaaggaacccttcaggccacctcctatcactccgcacgagtacatgctgagcttgtaccgaaccttgtccgacgctgatcgtaaaggaggcaactcttcagttaagctcgaggccggactggcgaacacaattaccagtttcattgacaagggccaggacgaccggggtcctgttgtccgcaagcagagatatgttttcgatattagcgctttagagaaagacgggctgctgggcgcagaactgaggatccttagaaagaagccaagcgataccgccaaacccgcagcaccaggcggaggaagggctgcacagctgaagcttagctcttgcccaagtggccgacaaccagcctctctgctggacgtgagaagcgtaccgggacttgacggcagtgggtgggaggtgtttgatatttggaagctgttcaggaatttcaagaattcggcccaactgtgcctggagctagaggcatgggagcggggaagagccgtggatcttcggggactggggttcgacagagctgccaggcaggtccacgagaaggcactgtttttggttttcggaaggacgaagaaacgcgatttattttttaacgagataaaggctagatctgggcaggatgataagactgtatacgagtatttgttttctcaaagaagaaagcggcgtgcgcctctcgcgacacggcaggggaagcgcccaagtaaaaatctgaaggcaagatgctcaagaaaggctctccacgtcaacttcaaggacatgggatgggatgattggatcattgcccctttggaatacgaggccttccattgtgaagggctgtgtgaatttcccctgcggagccatctggagcccaccaaccacgcagtcattcagacccttatgaattctatggaccctgagtctacccctcccacttgctgcgtccccactcggctctcaccgatttctatcctgtttatcgactcagccaacaacgttgtgtacaagcagtacgaagatatggtcgtggagtcatgtgggtgcagatag

SEQ ID NO: 225311 - DNA, 1506 bp, Artificial Sequence
  Description of Artificial Sequence: Synthetic coding sequence
atgcggctgccaaaactgcttacatttcttttgtggtaccttgcctggctggatcttgagttcatttgtacagtgctgggcgcaccagacctcgggcagcggccacaaggcacacggcctggcttggcaaaagccgaagccaaagagaggccccctctggcacgaaacgtcttccgccctgggggtcactcttatgggggaggtgctactaatgctaacgccagggcgaagggcggtacaggccaaactggaggattaacccagcccaaaaaagacgagccaaagaagctcccacccaggccgggaggaccagagccaaagccaggtcacccccctcaaacgcgccaagcaaccgccaggaccgttaccccgaaaggacaactgccgggaggaaaggcccctcccaaagctggttcggtccctagcagcttcctgcttaaaaaggccagggaaccaggacccccacgggagccgaaggagccctttagaccacctcctattacgccacatgaatacatgctgagtctgtaccggaccctgtcggacgctgatcgtaaggggggtaattctagcgtgaaactggaggctggcttggccaatacaatcacctctttcatcgacaaaggtcaggacgatcgcggaccagtggtgcgcaaacaacgctacgtttttgacatttccgccctcgaaaaggacggtttgttgggagccgagctgcgaattctcaggaaaaagcccagtgatacagccaaaccggctgcccctggtggtggcagagccgctcagctgaagttaagctcgtgtccatctggtagacagcccgcttcgctgctagacgtgcggtccgtacccggtttggacggatccggatgggaggttttcgatatctggaaactgttccggaatttcaagaattccgcccagctttgtttggagctggaggcctgggagcgcggtagagctgtggatttacgtggactgggatttgatcgagccgcacggcaggtgcacgagaaagcgctgttccttgtcttcggacgcaccaaaaaacgtgatctctttttcaacgaaattaaggcacgctccgggcaagacgacaagacagtgtacgaatacctgttctcccaaagacgcaagcggagagccccattggccaccaggcaagggaagaggcctagcaagaacttgaaggcccgttgttcccgcaaggccttgcatgtgaactttaaggacatggggtgggacgactggatcatcgcacccctcgaatatgaggcctttcattgcgaaggcctgtgcgaattcccactgaggtcacatctcgagcctacaaatcacgcagttatccagactttgatgaattcaatggatcctgagtccacccccccaacctgctgtgtgcctacaagactctcaccgatcagtattctgttcatcgattcagctaataacgtagtgtacaaacagtatgaagatatggtggtggagtcttgcggctgcaggtag

SEQ ID NO: 225312 - DNA, 1368 bp, Artificial Sequence
  Description of Artificial Sequence: Synthetic coding sequence
atggacactcccagggtactccttagtgcggtctttttaatctctttcctgtgggatctgcctgggttccagcaggcgtccattagttcaagctcatcgagcgctgaattgggtagcacgaaaggcatgagatcacgaaaagagggaaaaatgcagcgtgcaccaagagactccgatgcagggcgtgagggtcaggaaccacagccacggccacaagacgaaccgagagcacaacagccacgggcacaggagccacctgggcgaggcccaagggtcgtcccgcacgagtacatgctgagcatataccgcacttactctattgccgaaaaattgggcatcaacgcgtcttttttccaaagcagtaagagtgcaaatacaattactagttttgtggataggggattggacgacctttcacacacaccactgagacgacagaagtacctgtttgacgtgagtatgctctctgataaagaggagcttgttggcgcagaactgaggctgtttcgccaagccccaagtgcaccatggggtccgcctgcaggccctctgcatgtccagctgtttccctgtttgtcccctttgctactggatgctcgcactctggatcctcagggagccccaccggctggatgggaagtcttcgatgtctggcaggggctgcgacatcagccgtggaagcagctgtgcttagaattgagagcagcctggggagaactcgacgccggagaggcggaggcccgagccagggggcctcagcagccgccaccgcctgatctaagatcgctggggtttggccgtagggtgaggccgcctcaggaacgtgccttgctagtggtgttcactcgcagccaaaggaagaatctcttcgcggaaatgcgggagcagttgggctccgccgaagctgccggaccaggcgctggcgctgaaggaagctggcctccgccaagcggcgctcctgacgctcgcccttggcttccgtctcctggtcgcaggaggcgaagaactgcatttgcttctagacacggcaagcgccacggcaaaaaatccaggttgaggtgctctaagaagccactccacgtcaatttcaaagagctgggatgggacgattggatcattgcgcctctggaatatgaagcctatcattgcgagggtgtttgcgattttcctctccggagccacctagagccgactaaccatgctatcatccaaactttgatgaattctatggaccccggatctaccccgccttcttgctgcgtgcccacaaaactgacaccaatatccatcctgtatattgacgctggtaataatgtggtgtataagcaatatgaggacatggtggtcgagagctgtgggtgcaggtag

SEQ ID NO: 225313 - DNA, 1062 bp, Artificial Sequence
  Description of Artificial Sequence: Synthetic coding sequence
atggatacccccagagtgcttttgagcgccgtgtttctgatctcttttttgtgggacctgccgggattccagcaggcaagcatatcctcatctagcagcagcgcggaactgggttccacaaaaggaatgcgcagccggaaagagggaaagatgcaacgggcaccaagagattctgatgccggtagagaggggcaggagccccagccaagaccgcaggatgagccgagggctcaacagccacgcgctcaagagccccctggcagggggccaagggtcgttcctcatgagtatatgcttagtatctaccgcacatattcaatagccgaaaagctcggtattaacgccagcttcttccagtcctccaaatccgctaacacaattactagtttcgtggaccgcggtctggacgatctgagtcacacacccctgaggagacagaagtacttattcgacgtctccatgcttagcgacaaagaggagctggtaggagctgaattgcgccttttccggcaggctccatccgccccatggggacctcccgcaggccctctgcacgtgcagcttttcccctgtctgtcaccactgttactggacgctagaaccctggacccacagggagctcctccagccggatgggaagtgttcgacgtttggcagggcctgcgccaccagccttggaaacagctgtgccttgagctgagagccgcttggggcgagttggacgctggagaagctgaggcacgggctcggggtcctcagcaaccccctccccctgatctgaggagcctgggtttcgggcgacgggtacgtccaccacaggagagggctctgctggtggtgtttacaagatcccaacggaaaaacctgttcgcccctggagtcagggggctctcactcagggggtgcatgcgtttgcccgcagccctcgcaccaggagcacaccagcctcgacatcaccctgacgctgatgagttgcacggtcctcggctccatcccgctcagctcctccgggctcatcagattgattcccaccagcactccatccacagaagagggcaatag

SEQ ID NO: 225314 - DNA, 816 bp, Artificial Sequence
  Description of Artificial Sequence: Synthetic coding sequence
atggatactccgcgagtccttctgtcagcagtgtttttgatttccttcctgtgggacctgccaggcttccagcaagcctccatctccagctcttccagttctgcagagctggggagtaccaagggaatgaggtcaagaaaagagggcaagatgcagcgagccccacgtgatagcgacgccggacgcgagggccaggagcctcagccgaggcctcaggatgaaccgcgagcccagcagccccgagcacaagagcccccaggtcggggaccgcgagtcgttcctcatgaatacatgcttagcatctaccgcacatattccatagcggagaaactcgggattaatgctagctttttccaaagctctaaatcagccaataccatcaccagttttgttgatagaggcctcgatgatttgtcacacactcctctcaggagacagaagtatctattcgatgtctccatgctgagcgacaaagaggagttagtgggcgctgagctgaggttattcagacaagccccatctgcgccttggggcccaccagcaggacctctgcacgttcagctttttccgtgcctttctcctctcctgctggacgcccgtacactggatcctcaaggggcaccaccagcaggctgggaagtcttcgatgtgtggcaaggcttaaggcatcaaccatggaaacagctgtgcctagaactccgcgcagctccgggtcccgctgagtcagggctgagacctgagggggcagcttcccctggggctggcccagctggaggaatccaccagattcctgcagctgcctgccccccaaactag

SEQ ID NO: 225315 - DNA, 1353 bp, Artificial Sequence
  Description of Artificial Sequence: Synthetic coding sequence
atggacttgtcggccgctgcagccctgtgcctgtggcttctgtccgcctgccgaccacgcgatggccttgaagcagctgctgtgctacgcgctgccggagccggtcccgtgcggtctcctggcggtggtggcggtggtgggggagggggacggacactagcgcaagccgctggcgctgccgctgtacccgctgctgcagtgccgagggcacgtgctgcccgacgcgctgccggtagtggtttccgcaatggcagtgtggtgcctcaccatttcatgatgtctctctaccggtcgctcgctggcagagcccctgccggtgccgctgccgtgagcgcaagcggccatggccgtgccgacactatcacggggttcacagatcaggccacccaagacgagtcggccgcagaaactggccagtcttttctctttgacgtgtcatctttgaacgacgccgatgaggttgtcggagccgagctgagggtgttgagacggggaagtccggagtccggacccggatcctggacaagtcctccgctgctgcttctgtcaacctgtcccggtgcggctagagctcccaggttattatactcccgcgcagccgagccactggtcgggcagcggtgggaggcttttgacgtggctgacgccatgcgcagacatagaagagaaccccgacctcccagagcattctgcctgttgctgagggctgtggcaggtcccgtgccatctccactagctcttcggagactcggttttgggtggcctggcggaggcggaagcgccgcagaggagcgcgcagtgttagttgtctctagtagaacgcagaggaaagagtccttattccgagaaataagggcacaggcccgagccctcggtgcagcactggcctccgagcccttaccagatccagggactggcaccgcatcacctagagctgtgatcggtggaagaaggcgtcggcgaacagccctggctggcactaggacagcacaggggtcaggcggaggcgctggcagaggccatggcaggaggggacgcagccgctgctcccgcaagcccctccatgtggattttaaggaattaggttgggatgactggatcatcgcccctctcgattacgaggcctaccactgcgaaggcctgtgcgactttccactccgcagccatcttgagccaacaaatcacgctatcatccagacgctgctgaatagtatggcgccagatgccgcacccgcaagctgttgcgttcctgccagactgtctcccatttccatcttatatattgacgctgctaacaatgttgtctacaaacaatacgaagatatggtcgtggaggcctgcgggtgccggtag

SEQ ID NO: 225316 - DNA, 1269 bp, Artificial Sequence
  Description of Artificial Sequence: Synthetic coding sequence
atgcctaggagctttctggtgaagtccaagaaagctcactcctatcaccagcctaggagtccaggaccagattattctctgcgcctggagaatgtgcccgctcctagtcgagcggattcaaccagcaatgccggaggggctaaagcagagcctagggacagattgagccccgaatcgcaactgacagaagcccctgaccgagcctcagcaagccctgattcctgtgaaggtagcgtttgcgaacgctcatctgaattcgaggatttttggcgtccacccagccccagcgccagtcccgctagtgaaaaatcaatgtgtccgtcacttgatgaagctcagccattccctcttccattcaaaccttatagctggtctggcctggccggatcagatctgagacacctggtccaaagttacaggccatgtggtgctctggaacgaggcgctggactgggtctgttttgcgagcccgctcctgaaccagggcatccagccgcactgtatggccctaaaagagccgctggcggtgcaggcgcaggggctccagggtcctgctctgctggggctggagcaaccgcgggacccggtcttggcctgtacggcgatttcggatctgctgccgctggcttgtacgagcggccaaccgccgctgccggtttactatatcccgaaagaggacatggactgcatgccgacaaaggggctggcgttaaggtggaaagtgaattgttatgtactcgactgttgctcggtggtggatcgtacaagtgcattaagtgctccaaggtgttttccactccccatggactagaggtgcatgttcggcgtagccactctgggacgagacctttcgcatgtgaaatgtgcggcaagactttcggccacgcagtgagcctcgaacagcacaaggcagtgcatagccaggagcggagtttcgactgcaagatttgtggaaagtctttcaaacgaagctcaacacttagcacacaccttttgatccattccgacacgaggccatatccgtgccaatactgcgggaagaggtttcatcagaaatctgacatgaaaaagcatacctttatccacaccggggagaaaccccataagtgtcaggtgtgcggaaaagcgttcagtcagtcttctaaccttattacgcatagtaggaagcatactggattcaagcccttcggatgcgatctgtgcggaaagggtttccagcggaaggtcgatcttaggcgccaccgggagacgcaacacggcctcaagtag

SEQ ID NO: 225317 - DNA, 1269 bp, Artificial Sequence
  Description of Artificial Sequence: Synthetic coding sequence
atgcccagaagtttcctggtaaaaagcaagaaggcccactcttaccatcagcccagatcccccggtccagattactcattgaggctggagaacgtccccgctccatctagggctgattcaactagtaacgcgggtggcgctaaagccgagcctagagaccggttgagcccagagagccagctcaccgaagctcccgatcgtgcctccgctagccctgactcctgtgaagggtcagtatgtgaacgcagtagcgagttcgaagatttttggcgaccgccatctccctctgcttcgccggctagcgagaaatctatgtgccctagtctggacgaagcacaaccctttcctctcccgttcaagccatactcttggagcgggctggcgggtagcgatttaaggcatctggtgcagtcataccggccttgcggggctttagagagaggcgcagggctcggactgttctgcgagccagcccctgagcctgggcaccctgctgcactgtacggacccaagagggccgcaggaggtgctggggcaggtgcccctggcagctgcagcgccggagccggtgcaacggctgggcctggcttgggcctttatggcgacttcgggtccgctgccgcaggcctctacgaacggccaacagctgccgctggtctgctctaccctgaaagaggccacggtctgcacgcagataagggggctggcgtcaaggtcgagagcgagctgttgtgcactaggctgctcctgggagggggttcatataagtgtattaagtgctccaaggtcttttctaccccccatggcctggaagtccacgtgagaagatctcactctgggacaagaccattcgcctgcgaaatgtgtggaaaaacgttcggccatgccgtgtccctggagcagcataaggctgtacactcccaagagaggtccttcgactgcaaaatctgtggaaagtcgtttaagcgctcatccactctatcaacccacttgcttatacactccgatactcgaccctacccctgccaatactgtggcaagaggtttcatcagaagtcggacatgaagaagcacacatttatccacaccggcgagaagcctcacaaatgccaagtctgtggaaaggctttttcccagtcctccaatctcattacccatagccgcaagcacaccgggttcaagccgttcgggtgtgacctgtgcggcaaaggcttccagcgaaaggtcgacctgaggaggcaccgtgagactcagcatggcttgaagtag

SEQ ID NO: 225318 - DNA, 1269 bp, Artificial Sequence
  Description of Artificial Sequence: Synthetic coding sequence
atgcccaggagtttcctcgtcaagtcaaaaaaggctcactcgtaccaccagcctagaagccccggtcctgactactctttgaggcttgagaatgtccctgcccctagtcgcgctgattcaacctctaatgccggaggagccaaggcggagcccagagatcggctgtccccagaatcgcaactcacagaggctcccgatcgagcgtctgcttctccagattcctgtgagggttcagtatgcgaaaggtctagcgagttcgaggacttctggagacctccaagccccagcgcctctcccgcatccgaaaaatcaatgtgcccgtctctggacgaagcgcagcccttccctctccccttcaagccctactcttggtcggggctggccggatccgatttaaggcatctggtgcaatcatacagaccctgtggcgcactggaacgcggtgccggattggggctgttctgtgaacctgctcctgaacccggtcaccccgctgccttatatggtccaaaaagagccgctgggggtgccggagcgggagcacccggatcatgctcggcgggagccggtgcaacagctggcccaggactggggttgtacggggatttcgggagtgctgccgctggtctgtacgagcgtcccacagctgcagcaggattgctgtatcccgaaagaggccacgggctgcacgcggacaagggcgctggagtgaaggtagagtcagaattgctgtgcacaaggttattgctcggcggtggtagctataaatgcatcaagtgttctaaagtgttttctacaccccacggccttgaggtccatgtaagacgctcccactccggaacccgccctttcgcttgcgagatgtgcggcaagacatttggtcatgcagtgtcccttgagcaacacaaagccgtccattcacaggagaggagttttgactgcaagatatgcgggaaatccttcaagagatcaagtactctgtcaacgcacctccttatacatagcgataccaggccctacccctgccaatattgcggtaagagatttcaccagaagtccgacatgaagaaacacacatttatccacacaggagagaaaccacacaagtgtcaggtatgcggcaaagcattcagtcagtctagtaacttaatcactcactcgcgtaagcacactggtttcaagcctttcggatgcgacctgtgcggcaaaggcttccaacgcaaggtagatttacggcgacaccgagagacacagcatggactcaaatag

SEQ ID NO: 225319 - DNA, 993 bp, Artificial Sequence
  Description of Artificial Sequence: Synthetic coding sequence
atgccaagaagcttcctcgtgaaaagcaaaaaggcgcatacatatcatcagccacgggtccaggaggatgagccattatggcctcctgcactcacacctgtcccgagagaccaagcccctagtaatagccctgtgctttcaacactctttcctaatcagtgcctggattggaccaacctcaagcgggagcccgagttggaacaagaccagaatcttgcccgaatggctcctgcccctgagggacccatcgtcctgtcaaggccacaggatggcgattctccccttagtgattcaccacccttttataaaccttcattttcttgggataccctggcaacgacatacggtcactcatatagacaggcaccttccacaatgcagtctgcttttctggagcactcggtgagcctctacggctctccgttggtgccttctacagagccagcactcgacttttcattgcgctactcccctggcatggacgcctatcattgtgtaaagtgtaacaaggtcttttccaccccacatggactcgaggtccacgtgagaaggtcgcattccggtactcgtcccttcgcatgtgatatttgcgggaagacgtttggacacgcggtaagtctcgaacaacacacgcacgtgcattctcaagaacgttctttcgagtgtaggatgtgtggcaaggccttcaagagaagcagtacactctctactcacctcctcattcatagcgacaccaggccatatccatgccagttctgcggcaaacgctttcaccagaagtcagatatgaaaaaacacacatacatacacacgggcgaaaaaccccacaagtgccaagtgtgtggaaaagcatttagccagagtagcaacctgattacacactccaggaagcacactggatttaaaccatttagctgcgagctctgtaccaaaggctttcaaagaaaggtggacctgcgtagacatagagaatcacagcataacctgaagtag

SEQ ID NO: 225320 - DNA, 993 bp, Artificial Sequence
  Description of Artificial Sequence: Synthetic coding sequence
atgccaaggagcttcctggtgaagtcaaagaaagctcacacgtaccatcagccccgagtgcaggaagacgagccgctttggcctcccgcattaacacccgtgccacgagaccaggcccctagtaattctccagtgctgtccactctattcccaaaccagtgcctcgattggacaaatctgaagagggagcccgaactggaacaggatcagaatctggccaggatggccccagcccctgaaggaccaatcgtgctgtctcggccacaggacggtgatagccccctgtcagattcccccccattctacaaaccatcgtttagctgggatacgttagctacaacttatgggcattcctatcgccaggcaccctccactatgcaatccgcatttctagagcatagtgttagtctgtacgggtccccgcttgtgccctcaacagaaccagcactcgattttagtctgagatattcccccggtatggatgcttaccactgtgtgaaatgcaacaaagtgttctccaccccacacgggctggaggtccacgtgcgaaggtcccatagcggaaccagacccttcgcgtgcgacatatgtggcaaaacctttggtcatgccgtctcacttgaacaacacacacatgtgcatagtcaggagagatcattcgaatgccgtatgtgtggcaaagcctttaaaagaagtagtacgttgtcaacacaccttctgatccactccgacacgaggccatacccatgtcagttctgcggcaaacgattccaccagaagtccgatatgaagaaacatacatatatccataccggtgagaagccgcacaaatgccaagtgtgcgggaaggcgttttcccagtcctctaatttgattacacactcccgtaagcacactggttttaagcccttctcctgcgaactgtgtacaaagggatttcagcggaaggttgatctgagacggcaccgcgaatcccagcacaacttgaaatag

SEQ ID NO: 225321 - DNA, 855 bp, Artificial Sequence
  Description of Artificial Sequence: Synthetic coding sequence
atgcccaggtctttcctggtgaaaagcaaaaaggcccatacctaccaccagcccagggtccaagaggacgagccgctgtggccaccggctttgacaccagtgcctagggaccaggctccaagtaattctcccgtgttatccacactgttccctaaccagtgtctggactggaccaacctgaagcgagaacctgagttagaacaggaccaaaacctggcaaggatggccccagctcctgagggtcccattgtcttgagtcggccacaggatggggacagtcctctttccgactccccaccgttctacaagccgagcttctcttgggacactctggctactacctacggtcactcataccgccaagcgccttccacgatgcaatctgcattcctcgagcactccgtctcactttatggcagccccctggtgcccagcaccgaacccgctctcgatttttccctccggtatagtccaggaatggacgcatatcactgtgtcaagtgcaacaaagaaagatcattcgagtgccgaatgtgcggtaaggcttttaaaaggtcttctacactttcaactcatttactaatacactctgacactcgtccctacccttgtcagttttgcgggaaacggttccatcaaaagtctgatatgaaaaagcacacgtatatccacacaggcgaaaagcctcataaatgccaagtctgcggcaaggcgttctcccagtctagcaacctgatcacacattctagaaaacatacaggctttaagccattctcttgtgagctgtgtacaaaaggattccagagaaaggtggacctgcgacgccatcgagagtctcaacacaatctgaagtag

SEQ ID NO: 225322 - DNA, 855 bp, Artificial Sequence
  Description of Artificial Sequence: Synthetic coding sequence
atgcctcgaagctttttagtgaagtcaaagaaggcacatacctaccaccagccacgggtgcaggaggacgaacccctatggccaccggctttgacccctgtgccgagagatcaggcgccatctaatagtcccgtgctctccaccctctttcccaaccaatgtctcgactggaccaatcttaaaagggagcccgaactggagcaggatcagaacctcgcgcgaatggctccagccccagagggaccaattgtactgtctcgtccacaggacggggactcccctctgagcgattcacccccattctacaagccctcttttagttgggacacccttgcgacaacatacggacacagttataggcaggctcctagcaccatgcaaagcgcgttccttgagcattccgtaagcctgtatggctccccgttggtcccgagtacggagccagctttagatttctcattaagatattcgcctgggatggacgcataccactgtgtgaagtgtaacaaggagaggagcttcgagtgtaggatgtgtggtaaggcgttcaaacggagctctaccctttcaacacacctgctcattcacagcgacacccgaccatacccatgtcagttctgcgggaagcgtttccaccagaagtccgatatgaagaagcatacctatatccataccggcgagaaaccccacaaatgccaagtttgcggtaaggccttcagccagtcatcaaacctgattacacacagtagaaagcacacaggcttcaagccgttctcctgcgaattgtgcacaaaggggtttcaaagaaaagttgacctgcggagacatcgtgaatcccagcacaatctcaagtag

SEQ ID NO: 225323 - DNA, 993 bp, Artificial Sequence
  Description of Artificial Sequence: Synthetic coding sequence
atgccacggagttttctcgtcaagtccaaaaaggcccacacttaccaccagcccagggtacaggaggacgaaccactgtggccccctgccttgacaccagtgccacgggatcaagcaccatcgaacagtcccgttttgtctacactttttcccaaccaatgcctggactggaccaacctaaaacgcgagcccgagctggagcaggaccagaaccttgccagaatggcgcctgctcctgagggacccatcgtcctgagcaggccccaggacggtgatagcccactcagcgactctccccctttctacaagccttctttttcttgggacacattggccacgacgtatggccactcctataggcaggcaccgagcaccatgcagtccgcttttctggaacattctgtgtcactgtacggatccccattggtgccgtcaacagaacctgctctcgatttctcgttgcggtactccccaggcatggatgcctaccattgtgtgaagtgcaataaagtgtttagcacaccccacggtctggaagttcacgtgagacgctctcactctggaacaaggccctttgcctgcgatatctgtggcaaaacctttggacatgccgtaagtctcgagcagcacacacacgtgcattcacaggagcggtctttcgagtgcaggatgtgcggtaaagccttcaaaagatcttcaactctcagtacccaccttctcatccacagtgataccaggccttatccctgtcagttctgcgggaagaggtttcatcagaagtcggacatgaagaagcatacttatatccacaccggtgaaaagcctcacaaatgtcaggtttgcggaaaggccttctcacagtcctctaacttgatcacacatagccggaaacataccggattcaaacccttctcctgtgagttgtgtacgaaagggtttcaaaggaaggtggatctgcgcaggcatcgagagagtcagcacaatcttaagtag

SEQ ID NO: 225324 - DNA, 855 bp, Artificial Sequence
  Description of Artificial Sequence: Synthetic coding sequence
atgccaagatcttttttagtaaagtctaagaaggcccacacatatcatcagccgcgagtgcaagaagatgagcccttgtggccccctgcgctgaccccggtgcctcgcgatcaggctccgtccaatagtcctgttctttcaactctctttcctaaccagtgccttgactggactaatctgaagcgcgagcccgagcttgaacaggatcagaatctggctcggatggccccagcacctgaaggtcctatcgtgctctctcgtccacaggacggcgacagtcccttatcagactcacctcccttttacaaacccagcttctcatgggatacccttgctaccacatatggacattcttacagacaggccccaagtactatgcaaagtgcatttttagaacatagtgtgtctctgtacggatcgcctctggtaccgagcacagaaccagccctggatttcagtcttcggtactcaccgggaatggatgcctatcactgtgtgaagtgcaataaagagcgcagttttgagtgtagaatgtgcggaaaagcctttaagaggtcatctactttgtcaacccacctgcttatccacagcgatacccgaccatatccttgccaattctgcggcaaaagattccatcagaagagtgacatgaagaagcatacttatattcatacaggggaaaaaccacataagtgtcaggtctgtggtaaggcgttctcccagtcaagcaacttgatcacacattccaggaagcacaccggtttcaagccattctcttgcgagctttgcactaaaggcttccagaggaaagttgacctgagacgacacagagaatcccagcataatcttaagtag

SEQ ID NO: 225325 - DNA, 1623 bp, Artificial Sequence
  Description of Artificial Sequence: Synthetic coding sequence
atgacaacctcccttcaggacggccaaagcgccgcaagtagagcagcggcaagagattcacccttggcagcccaggtttgcggcgcagcccagggcagaggcgacgcccatgatcttgcacccgcaccatggttacatgccagggcccttctcccccttcccgatgggacacgcggatgtgccgcagaccggagaaagaaaaaggatttggacgtgccagagatgccttcaatacccaatccattccctgaactgtgctgttcccccttcaccagtgtgttatccgccgacctgtttccaaaagcgaattcacgaaaaaagcaggtgatcaaggtttattcagaggacgaaacatccagggcactcgacgtccctagcgatatcacagctcgcgatgtgtgtcaactgctgattctcaagaatcattatatcgacgatcattcctggactcttttcgaacatctgcctcacattggcgtagagaggaccatcgaggatcatgaattggtgatcgaagtcctgtccaattggggaatagaggaggagaacaagctgtactttcgcaagaactatgcaaagtacgagttttttaaaaaccctatgtacttctttcctgagcatatggtctcttttgccaccgaaacaaacggcgaaataagtcccacccagattctacagatgtttttgagtagttcaacctatcctgaaattcatgggttcctgcacgcaaaggagcaggggaaaaaatcttggaagaagatttacttcttcttaaggcggtccggcctttacttctctactaaaggtacttccaaggaaccaaggcacttgcagttttttagcgagtttgggaactctgacatttacgtgtcactagctggcaagaagaagcacggcgctccaactaattatggattttgttttaaacctaacaaggccggtggccctcgtgatttgaagatgctctgcgccgaagaggagcaaagccggacttgttgggtgacagcaatcaggcttctgaagtatggaatgcaactttaccagaactacatgcatccttatcagggaagatcgggctgctctagccaatccatcagtcctatgcgcagtattagcgagaatagcctcgtcgctatggatttcagcggccagaaaagtcgggttattgagaaccccacagaagcccttagtgtggcagtggaggagggcctggcttggaggaagaagggatgcctgcgactgggcacacatggctcccccactgcctcctcacagagcagcgccaccaacatggcgattcatcgctcccagccctggttccatcataaaatatcgagagacgaggctcagagattgatcatccagcagggcctggtagatggcgtgttcctggtgagagatagtcagagtaatcccaaaacattcgttctgtctatgtcacacgggcagaagatcaagcatttccagattatcccagtggaagacgatggggagatgttccatactctggacgacgggcatacccgatttaccgatttgattcaactggtggaattttatcaactcaataagggcgtcctcccttgcaagcttaagcattactgcgccagaatagccctatag

SEQ ID NO: 225326 - DNA, 1362 bp, Artificial Sequence
  Description of Artificial Sequence: Synthetic coding sequence
atgtccctcagtgccaggcgtgtgacacttccggctattacgccaatcatcttacagaagcgggtgattaaggtttacagtgaagatgagacatcaagggccctggatgttccgtcagatatcacggcccgagacgtgtgtcagttacttattctgaaaaaccactacatcgatgaccactcttggaccctgttcgagcatctccctcatatcggggtcgaacgtacaatagaggaccacgaactggtgatcgaggttctttccaattggggtattgaagaagaaaataagctctacttccgcaaaaactatgccaagtatgagttttttaagaatcctatgtacttcttccctgaacacatggtcagctttgctacagaaacaaatggcgagataagtcccacacaaatcttgcaaatgttcctgtcatcctccacataccctgaaatccatgggtttctgcatgccaaggagcagggtaagaaatcttggaaaaaaatctacttttttctcaggcgaagcgggctgtacttcagtaccaagggaacctccaaggaaccccgtcacctgcagttcttcagcgaatttggaaattccgatatttacgtatctctcgcaggtaagaagaaacatggagctcctacgaattacggcttttgcttcaagcctaacaaggcaggaggtcccagggatcttaaaatgctatgcgctgaagaagagcagtcaaggacatgttgggtcacggccatccgactcttgaaatacgggatgcagttatatcagaactacatgcacccttatcaaggcaggtctggctgtagctctcaatccatcagtccgatgaggtctataagcgagaacagcctggtggcaatggacttcagcggccaaaagtcgagagtgattgaaaatccaactgaggccctgagtgtcgcagtcgaagagggtctcgcgtggaggaaaaaaggctgtctccggctgggaacccatggaagtccgaccgctagctcccaaagctctgccaccaacatggccattcatcggtctcagccttggttccatcacaagatctctcgcgatgaggcccagaggctgatcatacagcagggactcgtagacggcgtgtttctggttagggatagccaatcaaacccgaagacttttgtccttagcatgtctcacgggcaaaagattaagcatttccagatcatacctgttgaggatgatggcgaaatgtttcacactttggacgatggccacactaggttcactgacttgattcagttggttgaattctatcagctgaacaagggtgtgctcccttgcaagttgaaacattattgtgctcgcattgcactgtag

SEQ ID NO: 225327 - DNA, 1599 bp, Artificial Sequence
  Description of Artificial Sequence: Synthetic coding sequence
atggagctggacctctctccgccacacctgtcttcttcacccgaggatctgtgccctgctcccggaacaccacccggtacacctcgcccacccgatacccctctaccagaggaagttaaaagatcacagccccttttgatccctactaccggcagaaaactcagagaagaagaacgcagggccacttcgctaccctcgatccctaacccttttccagaattgtgtagccccccatctcaatcccctattctcgggggaccatcttccgcacggggattgctgccaagagatgctagtcgacctcatgtagtgaaggtttattctgaagacggtgcatgccgctcggttgaggtggcagccggagccaccgcaaggcacgtgtgtgagatgttagtgcagagggcccatgccctatccgacgaaacctggggattagtggaatgccatccgcatcttgccctcgagaggggtttagaagaccatgagagcgtggtcgaagttcaagctgcttggcccgttggaggcgattcccgctttgtcttcaggaaaaactttgcgaagtatgaattgttcaagagttcaccccatagcctgttccccgagaagatggtctccagctgtctagatgcccatacagggattagtcatgaggacctgatccaaaactttctgaatgctggcagtttccctgagatccagggcttcctgcagcttagggggagcggacgaaaactgtggaaaaggttcttttgtttcctacgccgaagcggcctctactatagtactaagggcacatctaaggatccgagacacctgcagtatgtagctgatgtgaacgaatcaaatgtctacgtggtaactcagggacgcaaactttacggaatgccaactgacttcggcttttgtgtcaaaccaaataaactacggaatggacataaaggcctccggatcttttgcagcgaggacgagcagagtcgaacgtgttggctagctgccttcagactgttcaagtatggcgtgcaactttacaagaactaccagcaggctcagagcagacatttgcacccaagttgcttggggtcaccacctctgcgtagtgcttcggataatactctagtagctatggacttttcaggacacgcagggcgtgtgattgagaatccaagagaggcgctgagcgttgcactagaagaggcccaggcctggagaaaaaaaacgaatcatagactgagcttgcccatgccagcttccgggacatcgctgagtgcagcaatccatcgcacccaactttggttccacggcagaatttcacgagaggagagccaacgactaatagggcagcaaggcctggtggacggcctcttcctggtgcgtgaatcgcagcgaaatcctcaaggatttgtgctatccctatgccacttgcagaaagttaaacactatcttatcctgccctctgaggaagaaggcagattgtactttagtatggatgacggccaaacaaggttcacagacctgctgcagctggtcgagttccaccagctgaatcgagggatcctgccttgcttgctgaggcactgctgcacaagagtggcactgtag

SEQ ID NO: 225328 - DNA, 1344 bp, Artificial Sequence
  Description of Artificial Sequence: Synthetic coding sequence
atggaactggatctcagtccacctcatctctcatcatcaccggaggatctctgcccagcccctgggacgccaccaggcactccacgaccccctgacacgcccctcccagaggaggtgaaacggagccaaccattgctgataccaacgacgggcagaaaattgagagaagaggaacgaagggccaccagcctacctagtatccccaatccatttccagagttgtgttctcccccaagccaaagccccattcttggcggtccatcatcagcacgtgggttgctgccccgagacgcgtcacggccacatgtggtcaaagtgtactctgaggacggcgcatgccgcagtgtggaggtggcagccggtgcaacagccagacatgtgtgtgagatgctggtccagcgagcccatgcgctcagcgatgagacctggggtctcgtcgagtgccacccacatctggccctggagcgcggacttgaggaccacgaatccgttgttgaggtgcaggctgcctggcctgtaggaggcgactccagattcgttttcaggaagaattttgctaagtatgagttgtttaagtcaagcccacattccctgtttcctgagaagatggtgagtagttgcctggatgcacacactggaataagtcacgaagacctcattcagaactttctaaatgcaggcagtttcccggagatacagggtttcttacagctccgcggttctgggcgaaagctttggaagcgattcttttgcttccttcgtagaagtgggctctattacagtaccaagggtacaagcaaggatccgagacatctgcaatacgtcgccgacgttaacgagtctaatgtgtatgtggtgacccaagggcgaaagctgtatggtatgccaaccgattttgggttttgcgtgaaacccaataaactcagaaatggccacaaggggcttcgaatattttgttctgaagatgaacagtctcgcacttgttggttggcagccttccggctgtttaaatatggagttcagctttataagaactatcaacaggctcagagcagacatctacatccaagttgcttaggaagtccacccctgcgatccgccagtgacaatacgctcgttgcaatggatttttcagggcacgcgggaagagtaattgagaatcctcgagaggcgctcagcgtcgccctggaggaggcacaggcttggaggaagaagaccaaccatcgcctatccttgccaatgcccgcaagcggcacctcactatccgctgcatgttcctggagcggaagagtctctggaaccccccgtgctttgagttcgctttgtgctacctgccgaaagtag

SEQ ID NO: 225329 - DNA, 1344 bp, Artificial Sequence
  Description of Artificial Sequence: Synthetic coding sequence
atggaactggatctgtcacccccacatctgtccagcagtcctgaggacctgtgtcctgcccctggaaccccgccaggtactcctcggcctccggacaccccactgcccgaagaagtcaagaggagccaaccgctcttgatcccaactactggtcggaagctgagagaggaagagcggagagcaacatctctgccgtccataccaaaccccttccccgagctgtgttccccacccagtcagagccccatactggggggtcccagtagcgcacgagggctcttaccccgagacgccagccgccctcatgtagtgaaggtgtattctgaggatggggcttgccgcagtgtggaggtcgctgcaggtgcaactgccagacatgtgtgcgagatgcttgtacagcgggcacatgctctatcagacgaaacctggggccttgttgagtgccatcctcatttggcattagagcgcggattagaagatcatgagagtgtggtcgaagtgcaggccgcatggcccgttgggggagacagtaggttcgtgttcagaaaaaacttcgctaagtatgagctgtttaaatctagcccccattcactgttccccgagaagatggttagctcctgtctcgacgcacacaccggcatctcacacgaggacctaattcagaactttcttaacgcaggctccttccccgagatccaaggattcctgcagttgagaggtagcggcaggaaactatggaagcgcttcttctgtttcctgagaaggagcggcctgtattatagtactaaagggacctctaaggacccccgtcacctgcaatacgtggccgacgtcaacgagtctaacgtctacgtggtcacacagggccgtaaattatatggtatgccaaccgacttcgggttttgtgtaaagccgaacaagttacggaatggccacaaggggttacgcatcttctgcagtgaggatgaacaaagcagaacctgctggctggccgcttttaggctctttaaatatggcgtgcagttatataagaactaccagcaggcacagtctcgccatctgcacccgtcctgcctgggctctccaccactacgatctgcctcagacaatactctggtggctatggacttttccggacacgccggacgagtcatagaaaaccctcgtgaagccctaagcgttgccctcgaagaagcccaggcatggcgtaaaaagactaatcatcggcttagcctgccaatgcccgcaagtggcacttctctctcagctgcatgtagctggagcgggagggtctccggcactccaagagccctgtcatccctgtgcgccacatgccgcaagtag

SEQ ID NO: 225330 - DNA, 1599 bp, Artificial Sequence
  Description of Artificial Sequence: Synthetic coding sequence
atggaactggacttgagccccccacatttgagcagcagcccagaagacctttgccctgctcctgggacccccccaggaacaccacggcctcctgatacacctctgcctgaggaagttaaacgatctcagcctctgctgataccgactacaggtagaaaactacgcgaagaggagcgccgtgccaccagcttgcctagcatccccaacccgtttcctgaactgtgctcccctccgagccagtctccaatcctggggggaccctcaagcgcaaggggcctgttgccaagagacgcaagtcgtcctcacgtggtgaaggtctattcggaagacggcgcttgtcgcagtgtggaggttgctgctggcgcaacggcgcgtcatgtttgcgaaatgttggtgcagcgagctcacgccctctcggatgagacctggggcttagtggaatgtcatcctcacctggccctggagagggggctggaggatcacgagtctgtggttgaggtgcaggccgcttggccagttggcggagacagccgtttcgttttcagaaaaaacttcgctaagtacgaattgtttaaaagcagtcctcactctctgttccccgaaaagatggtaagttcgtgcctggatgcacataccggcatcagccacgaggatctgatccagaacttcctaaatgcaggcagcttccctgagattcagggctttctgcagttgagaggttcggggcgtaagttgtggaaacgctttttctgtttcctgaggaggtccggcctatactattctaccaagggtaccagcaaagatcctagacatctgcaatatgttgctgatgtgaacgaaagcaatgtctatgttgtgacacaaggaaggaagctatatgggatgcctactgacttcggcttctgcgttaaaccaaataagctccgcaatgggcataaaggattaagaatcttctgttctgaggatgagcagtcccgtacctgctggctggctgcgtttcggctgtttaaatacggtgtccagctctacaaaaactatcaacaggcccaatctcgccatctccaccccagttgtctgggttccccaccacttcgctcagcgtctgataacaccctggttgccatggacttctccggtcatgcagggcgtgtcatagagaacccgagagaagcactgtcggtggccttggaggaggcacaggcctggcggaagaagactaaccataggctgtcactgcccatgcctgccagcggcacatctctttcagccgcaatccacaggacacagctttggtttcacgggcgaatatctcgcgaggagtcccaacggctgattgggcaacagggcctggtggacggcttatttctcgtgagagagtcacagcgcaacccccaaggttttgtgctgtcactctgccacctacaaaaagtgaagcattatttgatcctgccatctgaggaagaggggagattatatttcagtatggatgatggccagactagattcaccgacctcctgcagctggtggaatttcaccagttgaaccggggaatcctcccttgcctgttgcgccactgctgcactagagtggccctgtag

SEQ ID NO: 225331 - DNA, 1599 bp, Artificial Sequence
  Description of Artificial Sequence: Synthetic coding sequence
atggagttggatctgagtccgccacacctgtcttcatcaccagaagatttgtgcccagccccagggactcctccaggcacgcctcgtcctcccgacacaccattgccggaagaggtcaaacgcagtcaacctctgcttattccaacaactggtcgaaagctcagagaggaagaaaggcgcgcaacaagcttacccagcatcccaaacccatttcctgaactatgctcccccccttctcagtcacctatcttggggggtccaagctctgctaggggactattgcccagagacgcaagcagaccccacgttgtgaaggtgtactccgaggacggggcttgccggtctgttgaggttgccgctggcgctacagcgaggcacgtatgcgagatgctcgtccagagagcacatgcccttagtgacgaaacctggggtctggtcgaatgccacccacatctggccctcgagagggggctggaagaccacgagtcggtggtggaagtgcaggcagcatggccagttggaggcgacagccgatttgtgtttagaaagaacttcgccaagtacgaacttttcaagagttccccccatagcctttttcctgaaaaaatggtctcctcttgcctcgatgcccatacaggcatctcccatgaagacctcatacagaacttcctgaatgccggaagctttccagagattcagggatttctgcaattgagaggaagcggacgcaaactgtggaaaagatttttttgctttctgaggcgtagtgggctctattacagtaccaaaggcaccagtaaggatccaagacacttacagtatgttgcagacgtgaacgaaagcaatgtctacgtggtcactcagggcaggaagctctacgggatgcctaccgacttcggattttgcgttaaaccaaacaaactgagaaacgggcacaaagggctgagaattttttgctccgaagatgagcaaagccgcacctgttggctggcggctttccgactttttaaatatggcgtgcagttgtataaaaactaccaacaagcacaatccagacacctgcatccatcatgccttggcagcccgccacttaggtctgccagtgacaacaccctagtggcgatggacttcagcggtcacgcaggacgcgtaattgaaaaccccagagaggccctgtccgtggccctggaggaggctcaagcctggcgcaagaagacaaatcataggcttagtctgccgatgcctgcctcagggaccagcctgtctgctgccatacatagaactcaactgtggttccacggccgaattagtcgtgaagagtcacaacgtctgatagggcaacaggggctagtggacggcttgtttctggtgcgggagagccagaggaacccgcagggcttcgtactctccttatgccacctccagaaggtgaagcattatctcatactgccctcagaagaagagggacgcttatatttttcaatggacgatggccagaccaggttcacagatctgctgcaactcgtcgagtttcaccagcttaacagagggatcttaccttgcctcctgcgtcactgctgcacaagggtagccctctag

SEQ ID NO: 225332 - DNA, 1668 bp, Artificial Sequence
  Description of Artificial Sequence: Synthetic coding sequence
atgggcaaatggaggccaggacagggtcatacaacagggtctgtgaagccactgtcctgttcagatgcaatggagctggatttgtccccaccacacttgtccagctccccggaggacctgtgtccagcacccggtacacctcctggcacccctcgccctcctgacacacccttgccagaagaggtgaagagatcccagcccctgctgattcctacaactgggaggaagctgagagaggaggaacggagggcaacttctttgccttcaattccaaatccctttcccgagctttgtagccctcctagccaaagccctatcctaggcggacctagttccgctagaggcttactgccaagagatgctagtcggccacacgttgtgaaggtgtactccgaggacggcgcttgccggtctgtagaagtcgccgctggcgcaacagctcggcatgtgtgtgaaatgctcgttcaacgagcccatgctctgtctgacgaaacgtggggcctcgtcgagtgccatccccatctggcactggagcgtgggctcgaggaccacgaaagcgtggttgaggtgcaggcagcctggcccgtgggcggtgattcgcgatttgtgttcagaaaaaatttcgctaagtacgaacttttcaagtccagtcctcactccctctttcccgaaaagatggtatcgagctgcctggatgcccacactggcatctcacacgaggatttaattcaaaactttctcaacgccggatcgttccctgagatccaaggcttcctacagttgcgcggttcggggagaaagctgtggaagcggtttttttgctttctaaggaggtctggactctattatagtacaaagggaacttctaaagatccaagacacctgcagtacgtggcggacgttaatgagtctaatgtgtacgtagtaacccaaggccgaaagctgtatggaatgcctactgacttcgggttctgcgtcaagccaaacaagctgcggaacgggcataagggattacgcatcttctgctctgaagacgaacaatcccgaacatgttggctagcagcctttaggctgttcaaatacggtgtgcagctttataaaaactaccagcaagcccagtctcgacacctgcatccctcctgcctagggtccccgccactcagaagcgccagtgataatactcttgtcgccatggatttttcagggcacgcgggacgcgtaatcgagaacccaagagaggcactctccgttgcgctggaagaggcacaggcctggaggaagaagacgaatcaccgattgagtttacctatgccagcctctgggacaagcctgtccgccgctattcatcgcacgcagctttggtttcacggtcgaatcagccgggaggagagccagaggcttatcggtcagcagggcctagtcgacggtctgttcttagtccgcgaatcccaacgaaacccccagggctttgtgctgagcttatgccacttacagaaagtgaagcattatttgatcctgccctcagaagaggaggggcgtctttatttctctatggacgacggacagacaaggttcacagacctgctacagctcgtggagttccatcaacttaacagggggattctgccgtgccttcttcggcactgctgcactcgcgtggctctctag

SEQ ID NO: 225333 - DNA, 618 bp, Artificial Sequence
  Description of Artificial Sequence: Synthetic coding sequence
atggcagcacccggagagaggggacggttccacggaggcaatctttttttcctcccaggaggcgcacggtccgagatgatggacgatctagccaccgacgcgagagggaggggtgctggtaggagagacgccgcagcgtccgccagcacccccgctcaggcgccaaccagtgattcgccggtcgcagaagatgcctccaggcgcaggccttgccgcgcttgcgtggattttaagacgtggatgcgtacacagcagaagcgggatactaagttcagggaagattgccctcccgatcgtgaggagctggggaggcattcctgggccgtcctgcataccctcgctgcctactaccccgacttgcctacccccgaacagcagcaggatatggcccagttcatccatcttttctcaaagttctatccatgcgaggaatgcgccgaggacttgagaaaacggctttgtcgcaaccaccccgacacgcggaccagggcttgcttcacccagtggctctgccatcttcacaatgaggtcaatagaaaactggggaagccggacttcgattgttccaaggtagacgagaggtggcgcgacggatggaaggacggtagctgcgattag

SEQ ID NO: 225334 - DNA, 285 bp, Artificial Sequence
  Description of Artificial Sequence: Synthetic coding sequence
atgaggactcaacaaaagcgggatacaaagttccgcgaggattgccccccagatcgggaggaacttggcagacactcttgggcggtccttcacactctggccgcttactatccagatctccccacccctgagcaacagcaggatatggcccaatttatccacctgttctccaagttctatccgtgcgaggaatgcgccgaggacctgcgaaaacgactgtgcagaaatcacccagatacccgaactagagcatgctttacagtcgctgttcctcccgcacaatag

SEQ ID NO: 225335 - DNA, 1629 bp, Artificial Sequence
  Description of Artificial Sequence: Synthetic coding sequence
atgtcaccatgtcccgaggaggctgccatgcgcagagaggtcgtgaagcgcatagagactgtcgtcaaagatctgtggcccaccgcagatgtgcagatttttggatcattctctactgggctttatctaccgacttcggatatcgacctggtagtgttcggaaaatgggagagacctcctttgcagctgttggaacaggcgcttcgcaagcacaatgtggccgaaccatgtagcatcaaagtccttgacaaggccactgtccccattattaagttaacagaccaagaaacggaagttaaagtggatataagtttcaatatggagacaggcgtcagagctgctgaatttatcaagaactacatgaaaaagtacagcctccttccatatcttatactggtattgaagcagtttctcttacaacgggatcttaatgaggtttttaccggagggatttcttcttactccctcatactaatggccatcagcttccttcagctgcacccgcgtatcgatgctcgcagagccgacgaaaatctgggcatgctactggtggagtttttcgagctgtacggcagaaacttcaactatctgaaaaccgggatccggatcaaggaagggggagcgtatatcgccaaggaggaaatcatgaaagcgatgacatctggctatcggccaagtatgctgtgtattgaggaccctcttctgccagggaatgatgtggggcgtagcagttacggcgctatgcaggtcaagcaggtgttcgactacgcctacattgttctgagccatgccgtgtccccgcttgctcgatcgtaccccaacagggatgctgagtcgacgttgggacgcattatcaaggtcacacaggaggtcatagactatagaaggtggatcaaggagaagtgggggtctaaagcccacccaagtcctggtatggattctaggataaaaattaaagagcggattgccacgtgtaacggcgaacagacccagaatcgtgaaccggagtctccttacggtcagcgcctgaccctttccctatctagtccccagctgttgagcagcggctcatctgcttccagtgttagttccttgtcagggtccgacgtggactctgacacccctccctgcaccacgccaagcgtgtatcagtttagtttacaggccccagctccgctaatggctggcctcccgactgccctccccatgccctccggtaagccacagccaaccacatctcgaacccttatcatgaccaccaacaaccagacacgttttaccatcccacctcctacattaggagttgctcccgttccatgcagacaagccggagtggaaggtaccgctagcctgaaggctgtgcatcatatgagttctcctgctatcccttccgcttcacccaatcctctcagtagtccccacctgtatcacaagcaacacaacggcatgaaattgtctatgaagggcagtcacggtcacactcagggcggtggttacagcagtgttggcagtggaggggtgcggccacccgtgggcaatcgaggccaccatcagtacaaccggacagggtggagaaggaagaagcacacacacacacgcgactccctccccgtcagtctttcaaggtag

SEQ ID NO: 225336 - DNA, 885 bp, Artificial Sequence
  Description of Artificial Sequence: Synthetic coding sequence
atggatctgtggcaacttctcttgacacttgcactggcgggttcctctgacgctttctctggcagcgaagctacagcggcaatcctgtctcgcgctccgtggagtctgcagagcgttaacccaggtctaaaaaccaacagtagcaaggaaccgaagtttacaaagtgcagatcaccggagagggagacgttcagttgtcactggactgacgaagtccatcacggcaccaagaatctcggacccatccagctgttctacactcgcagaaacactcaggagtggactcaggagtggaaagagtgccccgactacgtatcagcgggagagaactcttgttacttcaatagttcttttaccagcatctggattccttactgtatcaagctcacttctaacggcggaaccgtggatgaaaagtgcttctcagtggacgaaatcgtacagcccgatccccctatcgcccttaattggactctgttaaatgtttcgttaaccggcatacatgcggatattcaggtcagatgggaagcccctcgtaacgccgacatccagaaggggtggatggtcctagagtatgaactccaatacaaagaagtaaacgaaacaaaatggaaaatgatggatcccatactgacaacgagtgttcccgtatactcgctgaaggttgataaggagtacgaagttcgtgtgaggtcaaagcaacgaaattccgggaattacggcgagttctctgaagtcctctatgtgacattacctcagatgtcccaatttacttgcgaagaagatttctactttccatggctccttataatcatttttggtatatttgggttgacagtgatgctctttgtgtttctgttcagcaagcagcagagccagaattag

SEQ ID NO: 225337 - DNA, 1851 bp, Artificial Sequence
  Description of Artificial Sequence: Synthetic coding sequence
atggacctgtggcagctattgctgaccctggccttagccggtagcagtgatgccttctcaggcagtgaagattccagtaaggagccaaaattcacgaagtgtcgttcgccggagagagagacttttagctgtcactggaccgatgaagtgcaccatggcactaaaaacctcggccctatccagctgttctatacacgcaggaatactcaggagtggacccaggaatggaaagaatgccctgactacgtgtctgcaggagaaaactcatgttacttcaactccagcttcacttctatatggatcccttactgtataaaactcacctcaaatggcggtaccgtggatgagaagtgcttttctgtggatgaaatcgtgcagcctgacccccctatagctctcaactggactcttctgaacgtctccttgactgggatccatgctgacattcaggttagatgggaggctcctcgtaacgccgatatccagaagggatggatggttctcgagtacgagctgcagtacaaggaggttaatgagacgaaatggaagatgatggatcctattctgaccaccagtgttccagtgtactctttaaaggtcgacaaagagtacgaggtcagagtgcggagtaagcaacggaattcggggaactacggcgaattcagcgaggtgctatacgtgactctcccacagatgagccagtttacatgtgaagaggacttctattttccttggctgctcattattatctttgggattttcggactcactgtgatgctctttgttttcttattctctaagcagcagaggatcaagatgctgatattacctccagtacccgttccaaagatcaagggaatcgatcccgacctgctgaaggagggaaagctggaggaggttaacaccatcctcgctattcacgattcttataaaccagagttccactcagatgacagttgggtggaatttattgaacttgatatagacgaacccgatgaaaagactgaggagagtgatactgatcgccttctttcatcagaccacgagaaatcccattcaaatttaggggtgaaagacggcgactccgggaggactagctgctgtgagcccgacatcctcgagacagacttcaacgccaacgacattcacgaaggtacatcagaagtagcccagcctcagcgtctaaagggagaggcagatctgctttgcctggaccagaaaaaccagaataactccccctatcacgatgcttgtcccgcaacgcaacagccctccgtgatccaagcggaaaaaaacaagccacagcctctcccaaccgagggcgctgagtcaacacatcaggctgctcatatccagttgagtaatccatcatctttatctaatattgatttttacgcacaggtgtctgacattaccccagccggttcagtcgtgttgtcccccggtcagaagaacaaagccggaatgagtcagtgcgacatgcatcccgaaatggtcagtctttgccaggagaatttcctgatggacaacgcttacttctgcgaggctgacgctaagaagtgcattcctgtggcccctcatattaaagtggaaagtcacatccaaccctctctgaaccaggaggacatttatattaccacggaaagcctgacaactgccgcaggcaggcctggtactggcgaacacgtcccaggctccgaaatgcccgtgcctgattatacttcgatccacatcgttcagagcccacaggggctgatcttgaacgcaacagcgcttcccctgcccgacaaggagtttcttagctcctgtggatatgtgtccaccgatcagcttaacaagataatgccctag

SEQ ID NO: 225338 - DNA, 1356 bp, Artificial Sequence
  Description of Artificial Sequence: Synthetic coding sequence
atggtccttgagtacgagctgcagtacaaagaggtgaatgagacgaaatggaaaatgatggaccccattctgacgacaagcgtgcctgtctactcactgaaggttgacaaagaatatgaagttcgggtgcgctccaaacagagaaacagtggaaattacggggagtttagtgaggtcctctacgtgactctgcctcaaatgtcacagttcacttgtgaagaggacttttatttcccttggctgttgattattatattcggaatatttggcctcacagttatgctgtttgtgttcctgttttcgaaacagcaaaggatcaagatgcttattcttccaccggtgcctgtacctaagattaaagggatcgaccccgacctgctgaaggagggaaagctggaggaagtgaataccatcctagcaattcacgactcatataagccagagttccactctgacgactcatgggttgagtttatcgaactggacattgacgaaccagatgaaaagacagaagagtccgacaccgatcggctgcttagctctgatcatgagaaatcacattccaacctgggcgtaaaagacggagattctgggaggaccagttgttgtgaacccgacatcctggagaccgactttaatgccaatgacatccacgaagggacttcagaggtggcgcagccacagagattgaagggcgaggcagacttattgtgtctggatcagaaaaatcaaaacaactctccctaccacgacgcctgtccagccacgcagcagcccagtgtcatccaggctgaaaaaaacaaacctcagcctctgcccaccgaaggagctgagtcaacacaccaggccgcacacattcagttatctaatcctagtagcctgagtaatatcgatttttatgctcaggtttccgacattacaccggctggctcagtggtgctatccccagggcagaaaaacaaagcaggaatgagccagtgcgacatgcatccagagatggtcagtctgtgccaggagaactttctcatggataacgcctatttttgtgaggccgacgcaaagaagtgtatacctgttgccccacacataaaggtcgaaagccatatccagccttcattaaaccaagaggacatctacatcactacggaatctctcacgactgccgcaggacgacccggtactggggagcacgtccccggatctgaaatgcctgtgcctgattatactagtatacacatagtccagtctccccaggggctgattctgaatgcaactgccctaccactcccggacaaagagtttctatcttcctgtggatatgtctccactgaccagcttaataaaattatgccttag

SEQ ID NO: 225339 - DNA, 327 bp, Artificial Sequence
  Description of Artificial Sequence: Synthetic coding sequence
atgccactttgggtcttcttctttgttatcctcacattatcaaatagttcacactgctccccaccgccaccccttacgcttaggatgaggaggtatgcagacgccatctttaccaacagttaccgcaaggtcctggggcagctgagtgccaggaaacttctgcaagatattatgtcacgccagcaaggtgaaagtaaccaggaacggggagcacgggcacgtctcggcaggcaggtggacagtatgtgggcagagcagaagcaaatggagctggaaagtatcctagtggcgctactccagaagcacagcagaaattcccagggctag

SEQ ID NO: 225340 - DNA, 324 bp, Artificial Sequence
  Description of Artificial Sequence: Synthetic coding sequence
atgccattatgggtgtttttcttcgttatactgaccctctctaacagttcccactgcagcccccctccacctttgactctgcgaatgcgcagatatgcagacgcgatattcacaaacagttaccgaaaagtgcttggccagctgagcgcccgtaaactgctacaggacattatgagtagacaacaaggtgaatctaaccaggagaggggcgcaagggcaagattaggcagacaagtggattctatgtgggctgaacaaaaacagatggaactagaatctattctcgtggctctcttacaaaagcaccgcaattctcaaggctag

SEQ ID NO: 225341 - DNA, 327 bp, Artificial Sequence
  Description of Artificial Sequence: Synthetic coding sequence
atgccactgtgggtcttcttttttgtcattctgacactgtcaaatagttcccactgtagtcctccgccaccattaacactgcggatgcgacggtacgcggatgcaatattcacaaactcttatcggaaggtgctgggacagctgtccgccaggaagctccttcaggatataatgtccagacaacaaggtgaaagtaaccaggaaaggggagccagggcccgattaggcagacaagtagattcaatgtgggccgagcagaagcaaatggagctcgaatctatcctggtcgccctgctccagaagcatagcaggaactcacagggatag

SEQ ID NO: 225342 - DNA, 1272 bp, Artificial Sequence
  Description of Artificial Sequence: Synthetic coding sequence
atggaccgaagaatgtggggggcacatgtattctgcgtgctaagtccactgcccaccgtgttgggacatatgcacccagagtgcgacttcataactcagctccgagaagatgaaagcgcctgcctacaggctgctgaggaaatgccgaataccaccttgggatgcccagcaacttgggatgggctgctgtgctggcccaccgccggatccggcgaatgggtgacattaccttgtcccgatttctttagccacttctcctcggagtcaggtgcagtgaagcgggattgtacaattactggctggtccgaacctttcccaccataccccgtcgcctgccctgtacctttggagctcttggctgaggaggaaagctatttctccacggttaagatcatttatactgttggccatagcatttctatcgtcgccttgttcgtggctatcaccatcctggtcgctctacggcgtttgcactgtcctcgaaactatgtgcacacccagctgtttacaacgttcatcctgaaggccggtgcagtgttccttaaagatgctgcattgtttcacagtgatgataccgatcactgttcattctcaaccgtgctgtgtaaagtatcagttgctgcctctcacttcgctaccatgactaatttcagctggctcctggctgaggctgtgtatctgaactgcctgctcgccagtacgtctcccagttcccgcagggctttctggtggttggtgctcgctgggtggggactcccagttctatttaccggaacttgggtgtcctgtaagttggctttcgaggatatcgcgtgctgggacttggatgacaccagtccatactggtggatcatcaagggcccaatcgtgcttagtgtgggggtgaatttcggacttttcctgaacattatccgcattctggttcgaaagttggaaccagctcaggggagcctacacacccagtcacagtactggagactctcgaagagtaccctctttctcattccgctcttcggaatccattacataatctttaattttctcccagataatgccggactgggaatccggctgcctctggaacttggtcttggctcctttcaaggtttcatcgtggcaatcctgtactgttttcttaatcaagaggttagaaccgagatctctcgaaagtggcatggccacgatcccgaactgctccccgcttggcgaacaagggccaagtggaccactccctcccgaagcgccgcaaaggttctgacaagcatgtgctag

SEQ ID NO: 225343 - DNA, 207 bp, Artificial Sequence
  Description of Artificial Sequence: Synthetic coding sequence
atggtcccaggcaccccaagtccattgctcggccgtggcaaagaattatggctcgagtccctggcatgcctacccggagctgtgaaaagagattgtaccatcacaggctggtcagagccattccccccatacccagtggcatgtcctgtgccactggagctcctcgcagaagaggggtgcccatgttcatctctggcaagaggctag

SEQ ID NO: 225344 - DNA, 438 bp, Artificial Sequence
  Description of Artificial Sequence: Synthetic coding sequence
atggtcccaggcaccccatctcccctgcttggtagaggtaaagagctctggctggagtccctagcctgcctgcctggtgccgttaaacgcgattgcacaattactggctggtctgagcccttccccccatatccggttgcatgtcccgtgccgctcgagctcctagctgaagaagagagttactttagcacagttaaaatcatctacacggtgggacactccatttctattgtggcccttttcgtcgctatcacaattctggtagccctacgcaggctgcattgtccacgaaattacgtgcacacccagttatttacaaccttcattctgaaggccggtgccgtttttctcaaagatgctgccctttttcacagtgacgacacagaccactgcagcttctccacagggtgtccctgttcaagcttggcacggggatag

SEQ ID NO: 225345 - DNA, 456 bp, Artificial Sequence
  Description of Artificial Sequence: Synthetic coding sequence
atgctgcccttcagcaccgctaccaccttaactacagcggcttcccctctggccgcacgagctctgcactggcatgtcggtgagctacagaccggcctgcgaggtcatagggtattagggccaggtcgtcacctcccattacttgtcgatcaccagagagctcactgtcctctaggacgcggtgagctctgggctttctcgcagtattacccacaccctggagaagagacaggtgcttcttctggccagccgccataccccgtcagcgtactggccagtttacaggtcgacaccttccctgatcctaccctgtggaactcactgcaccacttgcaactcccagcccgtcagtgctggcctggtcacccccctcctccaggtgctggaacaggcttcctgccgggtcttcactgctgccaccctctactgctgccccagccgcgtggcgaggattag

SEQ ID NO: 225346 - DNA, 1080 bp, Artificial Sequence
  Description of Artificial Sequence: Synthetic coding sequence
atggtgcccggtaccccgtctcctctcctcggtaggggtaaagaactttggctggaaagcctggcgtgcttgcccggagccgtgaaacgggattgtacaatcaccggctggagtgaaccttttccgccatatcccgtggcttgtccagttccattagagcttctggccgaagaggagtcgtacttctccacagttaagatcatctacaccgtaggccatagcatttccattgtcgcgctctttgtcgcgattaccatcttggtcgcactgagaagactgcactgccccagaaactatgtacacacacagctgttcaccacctttattctcaaggctggtgctgtgttcctgaaggacgcagccctgttccatagcgacgacaccgatcactgttcattctctaccgtcctatgtaaggtgagtgtggcagcatcccacttcgccacaatgacaaatttcagctggctgttggccgaagctgtgtacctcaattgcctcctcgcgagcacgagtccgtccagtagacgcgctttctggtggcttgtcctggctggttggggactgcccgtgctttttactggtacctgggtgagttgcaagctcgctttcgaggatattgcatgctgggacctcgacgatacatcaccttattggtggataataaaggggccaattgtgctgtccgttggagtcaattttggtctttttttgaacatcattagaatattagttagaaagctggagccagcccaggggtcactgcatacccagtcgcaatattggagattaagcaaatccaccctgtttttgattcctctctttggtatacattatataatctttaactttctgcctgataatgccggattggggatcagactgcctctggagttagggctcggcagttttcaggggtttatagtggcaattctatactgcttcctgaatcaagaagtgagaactgagatcagtcgcaagtggcacgggcacgatccagaactgctacctgcgtggcgcacaagggcaaaatggacgacaccttcaaggtctgccgcaaaggtcctgacaagtatgtgctag

SEQ ID NO: 225347 - DNA, 1101 bp, Artificial Sequence
  Description of Artificial Sequence: Synthetic coding sequence
atgtggaacgccacgccgtctgaagaaccaggctttaatctgactctagctgacctcgattgggatgcctcacccggaaacgactcactgggtgacgaactgttacagttgttccccgctcctctacttgccggtgtcactgctacctgcgtggccctcttcgtggttggtatcgcaggaaacctcttaactatgttggtcgtgagccgatttcgagagctaaggacaaccacaaatctatacctgtcgagcatggctttctccgacctgctcattttcttgtgtatgcctttggatctggtcagactgtggcaatatcgcccttggaacttcggtgatcttctctgtaagcttttccagtttgtctcggagtcctgcacttacgccaccgtgcttacgatcaccgcgctttcagtagagcggtacttcgccatatgttttcccctgcgcgcaaaggtggttgtcactaaaggcagagtcaagctcgttatcttcgtgatctgggccgtcgccttttgctctgccggtccaattttcgtgttggtgggcgtggagcatgagaacggcactgacccgtgggatacaaatgagtgcaggcctactgaattcgctgtgcggtcagggctattgacagtcatggtctgggtttcctccatttttttttttcttccggtcttctgcctgacagtactgtattctctgattggcagaaaactgtggcggagacgaaggggcgacgccgtggtgggggctagcttgcgtgatcagaaccacaaacagacggtgaagatgttagccgtggttgttttcgcattcatattatgttggctaccttttcatgtcgggaggtacctctttagtaagagttttgaaccaggctctctggagatcgcgcagatatcacagtactgcaacctcgtgagttttgtgctgttctacctgagtgcagccatcaatccgatcctgtacaacattatgtccaaaaaataccgcgtggccgtatttcgcctgttaggatttgaaccattcagccagcgtaaactgtccaccctgaaggacgagagtagtagggcctggacagagagttctatcaatacctag

SEQ ID NO: 225348 - DNA, 870 bp, Artificial Sequence
  Description of Artificial Sequence: Synthetic coding sequence
atgtggaatgcaactccctcggaagaaccgggtttcaacctgaccctggccgacctcgactgggatgcgagtccaggcaacgattcgttgggagacgagctcctgcaactgttccctgcacccttgcttgccggtgtcactgccacctgtgtcgcactcttcgtggttggaatcgccggtaacctgttgaccatgctggtggtgtcccggtttcgtgaactcaggactacgacgaacttgtacctgtcctcgatggcgtttagtgatttactgatttttctgtgcatgcccctcgacttggttcgcctttggcagtaccgcccttggaactttggggacctgctgtgcaaattgttccaatttgtgagcgaaagctgtacttacgccacagtgctcaccatcaccgctctgtcagtcgagaggtacttcgccatttgcttccctctgcgcgctaaggttgttgtcaccaaaggccgagtgaagttggtgatattcgtgatctgggctgtggccttttgctcggccggacctatttttgtcctggtgggggtggagcatgagaacggtacagacccctgggatacaaacgagtgccgcccaacagagtttgctgtacgaagcgggctgttgaccgttatggtatgggtttcctccatattcttttttcttcctgtattttgcttaactgtactctactcacttattgggaggaagctgtggcggagacgaaggggcgacgcggtggtgggagcctcactcagagatcagaaccacaaacagactgtgaagatgctgggaggctcacagcgggctctgcgcctgtccctcgccggtccgatacttagtctgtgtctgttaccttccctgtag

SEQ ID NO: 225349 - DNA, 666 bp, Artificial Sequence
  Description of Artificial Sequence: Synthetic coding sequence
atggcattcgtgaagtcaggctggctgcttcggcaaagcacaattctgaagcgctggaaaaagaactggtttgacctgtggtctgatggccatttgatctattacgacgatcagacaaggcaaaacattgaagataaggtgcatatgcccatggattgtattaacatccggacaggccaggaatgccgcgacactcagcctcccgacgggaagagtaaagactgcatgctgcagatcgtgtgccgggatggcaaaaccatttcactctgtgccgaaagtactgatgattgtctggcatggaaatttaccctgcaggactcgcggaccaataccgcatatgtggggagcgctgtgatgaccgatgagacgagcgtggtttcaagtccacccccatataccgcttacgccgcacctgccccagaggcctatggttacgggccttatggcggagcgtacccacccggaacccaggtggtgtacgctgccaacggccaggcctatgcagtcccatatcagtacccctatgcaggactatacggccagcagcctgccaatcaggtgattattcgcgagcgctacagggacaatgactccgatcttgccttgggaatgctggccggagctgcaacaggtatggcgctgggctcactgttctgggtgttttag

SEQ ID NO: 225350 - DNA, 1230 bp, Artificial Sequence
  Description of Artificial Sequence: Synthetic coding sequence
atgggcaacagctatgccggtcagctcaagaccacccgtttcgaagaggtgctgcataatagtatcgaagctagcctcaggtccaacaacctcgttcctcgccctatcttttcccagctgtatctggaagccgaacagcagcttgcggcactggagggaggatcccgcgtagacaacgaagaggaggaggaagagggtgagggtggtctggagacaaacggccctccaaatccatttcagctgcaccccctacctgaaggttgctgtacaacagatggtttttgccaggcaggcaaggacttacgcttagtttcgatcagtaatgaacccatggacgtgccagccggatttctccttgtgggcgttaagtctcccagcctgccagatcacctgctggtgtgcgcagttgacaagcggttccttcccgacgacaatggccataacgccctcctgggattcagtgggaactgcgtcggatgcggaaaaaaggggttttgctacttcactgagtttagtaaccatattaatctgaaactgaccacccagcccaagaaacagaagcatttgaagtactatctggtgcggaacgcacagggcactctcaccaagggacctctaatttgctggaaggggagtgagtttaggtccagacaaatccctgcctctacatgctcttcttccctctttcccgctctggagagcactgcagcctttccaagtgagccagttccagggaccaatccgtccattctcatgggtgcacagcaagccggacctgccagcgatcatccatcactaaatgcagcgatgggacccgctgtgttcaacggtaaagacagccctaagtgtcagcagttggccaaaaataacctgctcgccttgccccgaccttcggctcttgggatcttgagcaacagtggcccacctaaaaaaagacataaaggctggtctcctgagagtccgtcagccccagacggtggctgcccccaggggggtgggaacagagcaaagtacgagtcagcaggcatgagctgcgttccccaggttggcttggtcggcccagcatccgttacattccccgtggtagcatcaggcgagcctgtgtctgttcctgataacctgctgaagatatgcaaggctaaacccgtcatcttcaaagttttcgtgaatggagccacccagatggtcgccctgggccctgccgagccggcatccccacggtccttgtag

SEQ ID NO: 225351 - DNA, 1374 bp, Artificial Sequence
  Description of Artificial Sequence: Synthetic coding sequence
atgggtaattcttacgctggccagctgaagacgactcgattcgaagaagtcctccacaatagtattgaagcatctcttcggtccaacaacctcgtcccgagaccaatctttagtcaactgtatttggaggctgagcagcagctcgctgctctcgaagggggatctcgggtggacaatgaggaggaagaagaagagggtgagggaggtctggagaccaacggccctccaaacccatttcagcttcatcccttgcccgagggatgttgtacgactgatgggttctgccaggccggtaaggacctcagactcgtaagtatatctaacgagcccatggacgtccctgccggtttcctccttgttggtgtcaagagtccctccctccccgaccaccttctggtgtgcgccgtcgacaaacgtttccttccagacgataatggacacaacgctctgttgggtttcagcggaaattgtgtcggttgtggcaagaaggggttttgttacttcacagagtttagcaatcacataaatcttaaactcaccacccaacccaaaaaacagaagcatctgaagtactacctggtgcgcaacgcacaggggactctgaccaaaggccctctgatctgttggaagggatctgagtttcgaagtcggcagattccagctagcacttgctcttcttctcttttcccagcgttggagtcaaccgctgcctttcccagtgagcctgttcctggcacgaatcctagtatcttgatgggggctcagcaggctgggcctgcttccgaccatccttccttgaatgcagctatgggccctgcagtgtttaatggcaaggattccccaaaatgccagcagcttgcaaagaataacttgctagctttgccacgtcccagcgcgctggggatcctgagtaattccggacctcctaagaaaagacataaaggctggtcgcctgagagccctagtgctcctgacggaggatgtcctcagggcggaggaaacagagccaagtacgagtctgctggaatgtcctgtgtgcctcaggtcggtctcgtgggtccagccagtgtgacgtttcccgtggtggcaagcggcgagcccgtatcagtcccagataatctgttgaaaatctgcaaggcgaagcccgtgatctttaaaggccacggcaacttcccttatttgtgtggcaacctaaacgacgtggttgtgtccccgttactgtacacatgttaccagaattctcaaagtgtgtccagagcctacgagcagtatggagctagcgcaatacagcccatttccgaagaaatgcagttactgctcactgtgtactacctggtccagctggcacaccagatcaggaatccagatgtctag

SEQ ID NO: 225352 - DNA, 5849 bp, Artificial Sequence
  Description of Artificial Sequence: Synthetic coding sequence
atgggtaattcatacgcaggtcagctgaagacgacgagattcgaagaggtgttgcataactcaattgaggcctcactcagatctaacaatttggtgcctagaccaattttctcacagctgtacctggaggccgagcagcagctagctgcactggagggcggttctcgagtggataacgaggaagaggaagaggagggagaaggtggattggaaactaacggtccacctaatcctttccagctccatccattacccgaggggtgttgtacgacggatgggttctgccaagccggtaaagatcttcgactggtgtccatatctaatgagccgatggatgtacctgcaggcttcctccttgtcggcgtaaagagcccctcactcccagatcaccttctggtgtgcgcagtcgacaaacgattcctccccgatgataacggccacaatgctttgctcggtttttctggcaactgcgtgggctgtggtaaaaaaggattttgctactttaccgaattctccaaccacatcaacctgaaactgactacacagcctaaaaaacagaagcacctgaaatactaccttgtgaggaatgcacaagggactctgacaaaaggaccactgatttgctggaaggggtcagagttccgaagtcgccagatccccgcttcgacttgctcatcttccttgttccctgcactggaatccacagccgctttcccaagcgagccagtgcctggaacaaatccttcaatcctgatgggggctcagcaggccggaccggcatcagatcacccttcactgaatgccgctatggggccagccgtgtttaatggcaaagattcaccaaagtgccagcaattggcaaagaataacctccttgcactgccgcgaccctctgccctaggcatcctgtctaacagtggtccacccaagaagcgtcataagggatggtcgcccgagagcccatctgcaccagacggaggctgtccccagggtggaggcaacagggcaaaatacgaatccgccggaatgtcgtgtgtgccacaagtgggccttgtgggaccagctagtgtcacatttccggtggtcgcctcaggagaaccagtcagcgttcccgacaatctgctcaaaatctgcaaggcaaaaccagttatctttaaagggcacggcaacttcccatacttatgcgggaatcttaatgatgtggtcgtctcccccctgttatatacctgctaccagaactcacaatccgtgtctcgcgcttacgagcaatatggagccagtgcgattcaacccataagcgaggaaatgcagctcctcctgaccgtatattatcttgtgcagttggctgctgatcaggtaccactgatggaagatcttgagcaaattttcttgcggtcatggcgtgaatcccatctgaccgagatccggcagtatcagcaggctccaccccaaccctttcctcccgctcctagcgcagccgcaccagtgacatccgcccaacttccctggctggctagtctggccgcttctagctgtaacgactcggtccacgtaatagaatgtgcctactctcttgccgaaggcctcagtgagatgttccgacttctggtggaaggcaaactcgcgaaaactaactatgtcgtgatcatctgtgcatgccggagcgcggcaattgatagctgtatagcagttaccggcaaatatcaggccagaattctatctgagtccctcttaactcctgcagagtaccagaaggaagtgaattatgaactcgtgactggcaaggtggattcactgggtgctttcttttctacgctctgtccagagggggacattgatattctcctggacaaatttcatcaggagaaccagggccacatctcctcgtcccttgcagcatctagcgtgacaaaggctgctagcctggacgtgagcgggacccccgtctgtactagttataatttggaaccacatagcatccggccatttcagctggccgtcgctcagaaactcttgtcccatgtgtgtagcatagcagattcatctacacagaacctcgatttgggctcttttgaaaaagtggacttcttgatctgcatcccaccttcagaggtgacataccaacagactctcttgcacgtgtggcacagtggggtgttactggaattagggctcaagaaggagcacatgaccaagcagagagtggaacagtatgtgttgaagctagataccgaggcccaaactaaattcaaagctttcctgcaaaacagctttcagaatccacatacacttttcgtgctgatccacgaccacgcccattgggatctggtgagttccaccgtccataatctgtattcccagtctgatccttctgttgggttggtcgatcggcttctgaattgcagggaggtgaaggaagctccaaacattgtgaccctccacgttacaagctttccctatgctttacagactcagcacaccctgatctctccgtataatgagatccattggccagcctcttgctctaacggagtcgatctataccatgagaacaagaaatattttggcctgtctgagttcattgagtcaacgttgtccggtcacagcctcccgcttttacgatatgatagctctttcgaagctatggtgaccgccctcgggaaaaggttccctagacttcattccgccgtcatacggacattcgtgctcgtacaacactatgcggctgccctgatggctgtatcaggactgccccaaatgaaaaattacaccagcgtggagacactggaaatcacacaaaatctgctgaattcccctaagcaatgcccatgtggacacggactgatggtgctgctcagggtgccatgtagccctctggctgtagtggcgtacgagcggctcgcccacgtgagagccaggttagcactggaagagcactttgagattatcctaggctcaccttcctccggggtgacagtgggaaagcactttgtgaagcagctccggatgtggcagaagatcgaagacgtggaatggcgaccacaaacctatctggaactggagggcttgccgtgcattctcatcttctccgggatggacccacatggcgaatcattgcccaggagcctgaggtactgtgacttgcggctgatcaactccagctgcctggtgagaacagccttagagcaggaactgggtctcgctgcatacttcgtaagcaatgaggtgcctttagagaagggagctcgcaatgaggccctggagtcggatgccgagaaactatcatctaccgataatgaagacgaggagctcggtactgagggatctacttctgagaagcgctctcctatgaagagggaacgatcaagatcccatgactccgcctcttcgagcttgtcaagcaaagccagcggctctgctctcggaggcgagtcgagtgcgcagccgacagcactgcctcaaggagagcacgcaaggagcccacagcctagagggccagcggaggagggccgagctcccggagaaaagcagaggcctagagcttctcagggacctccctctgcaattagccggcatagtcccggaccgaccccccaacccgactgtagtctgagaacagggcagagaagtgtgcaggtgtctgtgactagctcttgtagtcagttgagttctagtagcggctctagcagctcctcagttgctccagcagctgggacttgggtgctgcaagcaagccagtgttcactgacaaaagcgtgtcgccagccccctatcgtgttccttccgaagcttgtgtacgacatggtcgtcagcacagatagcagtggccttccgaaagccgcaagtcttttgccttctccatcggtgatgtgggcctccagttttcggcctctactatctaagaccatgacctccactgagcaatccctttattatagacaatggactgtcccacgcccatctcatatggactatggtaatcgggcagagggccgagttgacggatttcacccaagacggctcctgctctcaggaccccctcagataggcaagaccggcgcttacttgcaatttttaagcgtactgtccaggatgcttgtgcgattgacagaggtggatgtttacgatgaggaagaaatcaacataaacttaagggaagaaagcgattggcactatttgcagctctcagatccgtggcctgacctggagcttttcaaaaagctacccttcgattacattattcacgatcccaaatatgaggacgcttctttgatttgttctcattatcaggggatcaagtctgaggatcggggtatgtcccgaaagcctgaagatctgtatgttaggcggcagacggctaggatgaggttgtcaaagtatgccgcatacaatacataccaccactgcgaacagtgtcaccaatacatgggtttccatccacgttatcagctgtatgagagtacattgcacgcctttgccttctcgtacagcatgcttggcgaagaaattcagctgcacttcatcatccccaaatccaaggaacaccactttgtattctcacagcccggtggacagctggagagcatgagattgcctctggtgactgataagtcacatgagtacataaagtcacccacgttcacaccaactactggcaggcacgagcacggactgtttaacctatatcacgccatggacggggcatctcacttacacgtattagtagttaaagaatacgagatggcaatctacaagaagtactggcccaatcacatcatgctggtgctaccttccatttttaacagcgccggtgtgggggcagcccatttccttattaaagaactctcctaccacaatctggaactcgaacgaaacagacaggaggagctcggcattaaacctcaggacatttggcccttcatcgtaattagtgacgatagttgcgtgatgtggaacgtggtcgatgtgaattcagccggagaaaggagtcgggagttctcctggagtgaacgtaacgtgtcactcaagcatatcatgcagcatatagaagcggctcccgatatcatgcattacgcccttctgggactgcgaaaatggtcatcaaagacaagggcgagtgaggtacaggagccttttagccggtgtcatgttcacaacttcattatactcaacgtggacctgacgcaaaacgtgcaatataaccagaacaggtttctgtgtgatgacgttgactttaatcttcgcgttcactcggccggtctgctgttgtgtcggttcaacaggtttagcgtgatgaagaagcaaattgttgtaggagggcacagatcctttcatattacctccaaggtgagcgacaatagcgccgctgtagtccctgcacagtacatttgcgcccctgactcaaaacatacatttcttgctgcacccgctcagttgctgcttgagaagtttctgcagcaccatagtcatctgttctttccgttgagcctgaaaaaccatgatcatcctgttttgtcggtcgactgttaccttaacttaggctctcaaatctcagtatgctatgtgtcctcccgccctcacagtctgaatatatcatgttccgatcttctgttcagcggtctcttgctctatctctgcgactccttcgtgggcgcttccttcctgaagaagttccacttcctaaagggcgcaaccttgtgtgtgatttgtcaggaccgttcctccctccggcaaactgtggtgaggctcgaactggaggatgaatggcaatttcgtcttcgtgatgagtttcagacagctaacgcacgagaagataggcccctttttttcctgaccggcaggcacatcta

SEQ ID NO: 225353 - DNA, 1188 bp, Artificial Sequence
  Description of Artificial Sequence: Synthetic coding sequence
atgactcttcgccgtctacgtaaactgcaacagaaagaggaggccgcagcgacgcccgatcccgctgcacggacgccagattctgaagttgcgccagccgctccagtgccgacccctggccctcctgctgccgctgcgacacctggacctccagccgacgagctctacgcagctttggaagattatcaccccgctgagctctaccgggctttagccgtgtcgggtggcaccctacccagacgcaaaggatctggattcagatggaagaacctatcccagagcccagagcagcaaaggaaagttctgacacttgagaaggaagacaatcagacattcggctttgaaattcagacctacgggctgcaccatcgggaagagcagcgagtggaaatggtaacatttgtctgtagagtccacgaatcttcccccgctcagttagcaggccttacaccaggtgacactatagcatcggtcaatggacttaacgtcgaaggcatacgtcatcgcgagatcgtcgacataattaaggcttcaggcaacgtgttgaggctagagaccctgtacggaacgagtattcgcaaggccgagcttgaggcgaggctccagtacctgaagcagaccttatatgaaaagtggggggagtacaggagcttgatggtgcaggagcagcgcttagtgcatggactcgtggtaaaggatccttcgatctacgacacactggagagtgttcgctcgtgtctatacggcgctggattattgccgggttcactgcctttcggtccactgctcgcagtcccaggcagacctagaggaggcgctcggagagctcggggagatgcagatgatgcagtataccatacgtgcttcttcggcgatagcgagccacccgctctgccccctccccctcccccagcgcgtgcattcggcccaggtccagccgagaccccagccgttgggcctgggcctggtccccgtgccgctctgtcacgctcggcctcggttcggtgtgccggacccggtggcggtgggggaggaggtgctcctggggcactgtggaccgaggcacgagaacaagctctctgcggccctggcctgaggaaaactaaataccgaagcttcaggcggagactgctgaaattcatccccggactgaatagatctcttgaggaagaggagtcgcagttatag

SEQ ID NO: 225354 - DNA, 759 bp, Artificial Sequence
  Description of Artificial Sequence: Synthetic coding sequence
atgaccttgctgcctagcaaaggcggagatacaatcgcctctgttaacggcctgaatgtcgagggaatccggcaccgggagatcgttgatatcattaaagcgtcagggaatgtcctgaggctggaaaccctgtacggcacttcaatcagaaaggccgaacttgaagccagacttcagtatctcaaacagaccttgtatgaaaagtggggagaatatcggtccctcatggtgcaggagcagagactggtgcatggcctagttgtgaaagatccaagcatctatgacactctagaatctgtgagatcatgcttatacggggctggcttgctccctggaagtctgcctttcgggccactgctggcggtccccggacggccacgcggaggagctcggagggcccgaggagatgcagacgacgcagtgtatcatacatgcttttttggggacagcgaacctcccgctctcccccctccccctcctccagccagggccttcggccctgggcctgctgagaccccggcagtagggccaggtccagggcctagagcggctttgagcagatccgctagcgtgaggtgtgccggtccaggcggagggggaggaggaggggcacctggggcattatggacagaggcacgagaacaagctctgtgtggcccaggcttgaggaagacgaagtaccgttctttcaggagaagattgctgaagttcatacctggactcaaccggagtttggaagaagaggagtcccagctgtag

SEQ ID NO: 225355 - DNA, 759 bp, Artificial Sequence
  Description of Artificial Sequence: Synthetic coding sequence
atgacactgttgccatcgaagggaggggatactatcgccagcgtcaatggtctgaacgtggagggaatcagacatagggagatcgtcgatataatcaaggcaagcggcaacgtactgagactggaaaccctgtatgggacttcgatccgaaaagctgagctcgaagccaggttgcagtaccttaaacagacgctctacgagaagtggggggagtaccgtagtcttatggtacaggagcaacggctggtccacggactggtggtgaaggatcccagcatatatgacacactcgaaagcgtccggagctgcctctacggcgctggactcctgcccggatctctaccttttggtcccctgctcgctgtccctggcaggccccgtggaggcgcacggagggcacgaggggacgccgatgacgccgtctaccatacctgtttctttggcgacagtgaaccacccgcactcccgcctccgccaccacccgctcgcgcttttggacccggtccagctgaaactcctgccgttgggccaggtcccggaccaagggcggctctcagccgctccgcttcagttcgttgcgccggacctggaggcggaggcggtggcggagcacccggtgctctttggacagaggctcgcgaacaagcgctctgtggacccggtcttcgcaagaccaagtatcggtctttccgacgcagacttctgaagttcatccctggtcttaacaggagcctggaggaggaggagagtcagctgtag

SEQ ID NO: 225356 - DNA, 654 bp, Artificial Sequence
  Description of Artificial Sequence: Synthetic coding sequence
atggcagcccagtgcgtgagattggcaagacggagtcttcctgccctggcattatccctacggccatcaccacgccttctgtgtacagctaccaaacagaagaacagtgggcaaaacctggaagaggacatgggacagagcgagcagaaggccgacccgcctgccaccgagaaaacgctgttggaggaaaaagtgaaattggaggaacagctaaaagaaacagtggagaaatacaaacgggctttggcagacacagagaacctaaggcaaaggagccagaaactggttgaggaagcaaagctttacggcattcaggccttttgcaaggatcttcttgaagtggccgacgttctggagaaggcaacccagtgcgtgcctaaggaagagatcaaagatgataatcctcacctcaaaaatctatatgagggtttggtgatgacagaagtacagatccaaaaagtattcaccaagcacggtctgctgaagcttaatcctgtgggtgccaagtttgacccatatgagcatgaagctctatttcatactcctgtggaggggaaagagcccggtactgtggccttagtgtctaaggtcgggtataaactgcatggaagaaccctgcgcccagctctggtgggggtagtgaaagaggcctag

SEQ ID NO: 225357 - DNA, 591 bp, Artificial Sequence
  Description of Artificial Sequence: Synthetic coding sequence
atggctgcccaatgtgtgagattggccaggagatcgctgccagctctcgctctatctctccggccttcacctcggctgctgtgtacggcaactaagcagaagaactccgggcaaaatctagaggaggacatgggacagtccgagcaactgaaagagactgtggaaaaatacaagagagctctggcagataccgagaacctacggcaacggtcacagaaactggtggaagaggccaagctatacggcatccaggctttttgcaaagacctgctggaagtggcggacgttctcgagaaagccactcaatgtgtacctaaggaagagattaaagatgacaatcctcacctgaaaaacttgtacgaaggcctggttatgactgaggttcagattcaaaaggttttcactaagcatggattgctgaagctaaacccagttggagccaagtttgacccctatgaacacgaagctctcttccacacacctgtagagggtaaagagcccggtactgtcgccctcgtgagtaaagttgggtacaagctccatggaagaacactgcgtccggctctggtcggggtagtcaaagaagcctag

SEQ ID NO: 225358 - DNA, 2880 bp, Artificial Sequence
  Description of Artificial Sequence: Synthetic coding sequence
atggcgcttctcgggaagcggtgcgacgtccccactaacggctgcggacccgacagatggaattctgcattcaccagaaaggacgagattatcacaagcctagtgtccgcactggacagtatgtgcagcgctttgtcgaagttgaatgctgaggtcgcatgcgtggccgtgcacgatgagtcggccttcgtcgtcggaacagagaaaggacggatgtttctgaatgcaaggaaagagcttcagtcggactttctgagattttgtcgcggtcctccctggaaggatcccgaggccgaacaccccaaaaaagtgcagcggggtgaggggggaggtcggtccctcccacggagttccctagagcatggatcggacgtttacctgctcagaaagatggtagaagaggtgttcgacgtgctgtattcggaagcgttggggagggcctcagtggttccattgccatatgaaagactgcttcgcgaacctggtctgttggccgttcagggcttacctgaaggcctcgcatttaggcgacccgctgaatacgaccccaaagcactgatggccattttggaacacagtcaccggatccgtttcaagctgaagaggccacttgaggacggaggcagagattcgaaagctttggtggaactcaacggcgtcagcctgatcccaaagggtagtagggactgcggtctgcatgggcaggcacccaaggtaccacctcaggacctgcctccaaccgcgacctcatcaagcatggccagtttcctgtattctaccgccctgcccaatcacgctattcgggagctgaagcaggaagccccatcatgccctctggccccttctgaccttggattgtcccgacccatgcctgagcctaaggccaccggggcacaggacttcagcgattgctgcggtcaaaaacccacaggcccaggtggaccgctgatccagaatgtgcacgcatccaaacgaatcctattttctatcgtgcacgataagtccgaaaagtgggatgcattcattaaggagacagaagatatcaatactctgcgagagtgcgtgcaaatcctgtttaactcccgatacgcagaggcactagggctggatcacatggtccccgttccctacaggaagatcgcatgcgatcccgaagcagtggagatcgtgggaattcctgataagattcccttcaaacgaccatgtacctacggcgtgcccaaactgaaacgaatcctcgaagagcgccactctatccatttcatcatcaaacgcatgttcgacgagcggatcttcacgggtaacaaatttacgaaggataccacaaagctggaaccagcctcacctcccgaagatacttcagcggaggtcagccgagccaccgtgctagacctagccggtaacgctaggtccgataaaggtagcatgagtgaggactgcgggccaggcacaagcggagagttggggggactgcgacccatcaagattgagcctgaagatctggatattatacaggttacagtccccgaccccagccccactagcgaagagatgactgatagtatgcccggacacctgccttcggaagactccggatatggtatggagatgctcactgacaaagggctgtctgaggatgcccgtcctgaagagcggcctgttgaagattctcacggcgatgttatcaggccactgcgtaagcaagtggagttgctgtttaatacaagatatgcaaaggcaattggaatctcagaacctgttaaggtgccatacagcaagtttctgatgcaccccgaagaactgttcgtggtcggcctgccagaaggcatatctctcaggcgcccaaactgtttcggtattgccaagttacgaaagatcctggaggccagcaactcaattcagtttgtaattaagcggccagagctcctgacagaaggggtaaaagagcccatcatggactctcagggcacagcatctagcctaggcttctccccgcctgccctgcctcctgaaagggactcaggagacccacttgtggatgaaagcctgaaacggcaaggcttccaagagaactacgacgcccgtctgtcacgcatcgacatcgccaatacattgcgggaacaggttcaagatctcttcaataaaaaatacggtgaggctctcggaatcaagtatcctgtccaggtgccctacaaacgaatcaagtccaatcctggtagtgtcatcatcgagggactcccccctggtattccatttcgtaagccctgtacgtttggctcacaaaatctcgaacgcatactggcagttgccgataaaatcaaattcacagtgactagaccgttccagggcctgattccgaagccagacgaggacgatgcgaacagattaggcgaaaaggtgatcctacgtgagcaggtgaaagagctgtttaacgaaaagtacggagaggctctgggcctgaataggcccgttttagtcccctacaagttgatcagggactcccccgatgccgtagaagtcacgggccttcccgacgatattccctttcgcaatcccaatacatatgatattcacagactggagaaaattcttaaggcgcgagagcatgtgcggatggtcattatcaaccagcttcagccctttgccgagatctgtaatgacgctaaggtgcccgcaaaagattcgtcaatccccaagcgcaagagaaagagggttagtgaaggaaacagtgtgtccagttcctcttccagcagttccagctccagctccaaccccgatagtgtggccagcgcgaatcaaatctcgctcgtgcagtggccaatgtacatggttgactatgcagggttaaatgtccagctgcctgggccattaaattactag

SEQ ID NO: 225359 - DNA, 2835 bp, Artificial Sequence
  Description of Artificial Sequence: Synthetic coding sequence
atggcccttctcgggaaacggtgtgatgtacccacaaatggctgtgggcctgaccgatggaattcagcgttcacaaggaaagatgaaattatcactagcctggtgtccgcactggactccatgtgttctgctctgagcaaacttaatgcagaagttgcttgcgttgccgtccacgatgagagtgctttcgtggtggggaccgagaaagggagaatgtttcttaacgcccgaaaggaactgcagagtgacttcctgcgcttttgtagagggccaccatggaaagatccagaggccgagcacccaaagaaagtacagcggggtgagggcggtggcaggtcccttccacgatcatcactggaacatggatccgatgtgtatcttctgagaaagatggtagaggaggtctttgacgtgctgtactccgaggcgctaggacgtgcctctgttgtccctctgccgtacgaacggctacttcgcgagcctggtctactcgccgtccaggggctccccgaaggcctggcattccgtcgacccgcagagtacgacccaaaggcactgatggccatcctggaacattctcaccgaatccggtttaaattgaaacgcccactcgaggacgggggaagggactctaaggctctcgtggagttaaacggcgtctccttgatccctaagggcagcagagactgcggacttcacggccaggccccaaaagtgcccccacaggacttgccccctactgccacctccagcagcatggcttctttcctatactcaacagcattacccaaccatgcaatcagagagctgaagcaagaagccccatcctgccccttggccccatctgatttgggactgtccaggccaatgcctgagccaaaggcaacgggtgcacaggatttcagcgactgttgtggtcaaaagccgacagggcctggtggccctctgattcagaatgtgcatgcctctaagcgcatattgttctcaattgtgcatgacaaatccgaaaagtgggacgcctttattaaggagacggaggacatcaacaccctgcgggagtgtgtacagatcttattcaactcaaggtatgctgaagccctcggcctcgatcatatggtccccgtgccatacaggaaaatcgcatgcgaccccgaagcagtcgagatcgtcggcattcccgataaaatcccattcaagagaccatgtacctatggagtccccaaactgaaacggattttggaagaaagacattcaatacactttataattaaaagaatgtttgatgagcggatattcaccggaaacaagttcaccaaagacactacaaaactggagccagcttcgcccccagaagatacctcagctgaggtgtcacgagctacagtactcgacctggctggaaacgccaggtctgataagggttccatgtcagaagactgcggccctggtacttctggcgaactgggcggactgcgccctataaagatcgagccagaggatctggacatcatccaggtgactgtgcccgacccatcaccgacttccgaagagatgactgatagcatgccagggcaccttccctctgaggattctgggtatggtatggagatgctcacagataaaggtttatccgaggatgcccgacccgaagagcgcccagtcgaggacagtcatggcgacgtaatcagacccctccggaagcaggtcgagttattgttcaacacaaggtatgcaaaagcaattgggatcagtgagccagtaaaggtgccttattctaagttcctgatgcacccagaggaactttttgtagttggactcccggagggtatcagcttgcgtcgtcccaactgttttggcatcgcaaagctgagaaaaatcctggaagcctccaactccatacagttcgttataaagaggcccgaattgttgacagaaggcgtgaaggaacctatcatggattcccaagagagagacagtggtgatccattggtcgatgagagtctgaaacgacaggggttccaggagaattatgacgcaagactcagtagaatcgacatcgctaataccctgagggagcaggtacaagacctgttcaataagaaatatggggaggcactcggcattaagtatcctgtccaggtcccttacaaaaggataaagtccaatccgggtagcgtgataatcgagggtcttccccctggtattcccttccgaaaaccctgcaccttcggcagtcagaacctagagaggatcctggcagttgccgataagatcaaatttacagttacccgtcccttccaggggctgatccccaagccagatgaagacgatgccaatcgactaggcgagaaagtcatcctgagagagcaggtgaaggagttatttaatgagaagtatggcgaagcactagggttgaaccgcccagtcctcgtgccttacaaactcatccgggatagcccagacgccgttgaggttactggactgccggatgatattccgttcaggaaccccaatacatacgacattcatcggctagagaagattctgaaggctagggaacacgtccgaatggtgatcattaatcaactccagccatttgcggagatttgcaacgatgccaaagtgccagccaaagacagctcgattcctaagaggaaaaggaagcgggtttcagaaggaaacagtgtttctagctcttcctccagctcctcttcctccagctctaacccggatagcgtagcctcagctaaccagatcagcctggtccagtggccgatgtacatggtcgactatgccggtctgaatgtccaacttcccggtcccctgaactattag

SEQ ID NO: 225360 - DNA, 2931 bp, Artificial Sequence
  Description of Artificial Sequence: Synthetic coding sequence
atggcgctgctgggtaaacgctgcgatgtgcctacaaatggatgtggccctgatagatggaactctgctttcacacgcaaggatgagattataacaagcctggtaagtgcgctggattccatgtgttccgcgctatctaaactgaatgctgaagtggcctgcgtggccgtgcacgacgaaagcgcgttcgtggtcggaacagaaaagggtagaatgttcctcaacgcaagaaaggagttacagtcagatttcctgcgattttgtctgtcagctgcacaacaccgggctgcaacgtctcaactggagggcagggtcgtgcgtcgcgtcctgacggtggcttccagagccctgtgtcctaccggcggacctccatggaaagaccctgaggcagaacacccaaagaaggtccaacggggagaggggggaggtcgctcactgccacgatcctccctcgaacacggttcagatgtgtacctgctaagaaaaatggttgaagaggttttcgacgtgctgtactcggaagccctgggcagagcaagcgtggttcccctgccctatgagagactgctccgcgagcccggactgctcgcggtacaggggctgccagagggcctagcgtttaggcgacccgctgaatatgacccaaaggcgctgatggcaatattggagcatagccacaggatcaggttcaaattgaagagacctctggaagacgggggaagagacagcaaggccctcgtggaactcaacggggtcagcctgattcccaagggcagcagagattgcggtctgcacggccaggcacctaaggtgccccctcaggacctccccccaacagccacttcctcctcaatggcctcctttctttactccaccgcgctaccgaaccacgccatacgagaactgaaacaagaagcacccagctgtccattagctcctagtgatctgggactcagccgccctatgcctgaacccaaggctacaggggcacaggatttttccgactgctgtggtcagaaacccaccgggccaggcggaccactgatccagaatgttcacgcgagtaaaaggatcctgttctcaattgtgcatgataaaagtgaaaaatgggacgcattcattaaagaaacagaggatataaataccttgcgggagtgtgtgcagatactgttcaattctaggtacgccgaggcattaggcctggatcatatggtgcccgtgccctaccgcaaaatcgcctgtgaccccgaggccgtggaaattgtgggcattcccgacaaaatcccgtttaagcgcccttgcacttacggggtccccaagctcaaacgaatattagaggagcgacactccatacatttcattatcaagcgcatgtttgacgagcgcatctttacaggcaacaagtttactaaagacacaaccaagctggaaccagcttcaccgccagaggataccagtgccgaagtttcaagggccacggtgctggacctggctgggaacgcgagatcagacaaaggcagtatgagcgaagactgcgggcctgggacctctggggagttgggaggtctccggccaataaagattgaaccagaggacctggacatcattcaagtcacggtgcccgaccccagtcctacctctgaggaaatgactgacagcatgccgggtcatctgccatcagaagacagcggttacggaatggagatgctcacggacaaggggctcagtgaggatgcccgaccagaagaaaggccggtcgaggatagccatggtgacgtgattcgcccactacgcaaacaggtggaactgctgttcaatacacggtatgcaaaggcaattggaatttctgaaccagtcaaggtcccctactctaagtttctcatgcatcctgaagaattattcgtggtgggattgccagagggcatctcgctgcgcaggcctaattgttttgggatcgcgaagcttcggaaaattcttgaagcgagcaattctatacagttcgttattaagagacctgagctgttgactgagggcgtcaaggaacccattatggattctcaggagagagactccggcgaccccttagtggatgagagcctgaagcggcagggcttccaggaaaattatgatgcgcgattgagccggattgatattgctaatactctccgagagcaggtccaggatctgttcaataaaaaatatggggaggctctgggtatcaaataccccgtccaagttccctacaagagaataaagagcaatcccggatccgttatcatagagggattgccccctggtattccattccgcaagccatgcacctttggctcccagaatctcgaacgtatactggcagtcgccgacaagattaaattcaccgtgacacggccttttcaaggccttatccccaagccggacgaagatgatgctaatcggctcggcgaaaaagtgatcttgagggaacaggtaaaagaactttttaatgagaagtatggcgaggccttgggattaaatagacccgttttagtcccatataagctgatcagggattctcccgacgcggtggaggtgacaggtcttcccgacgacatcccttttcgaaacccaaacacttacgatattcatcgcctggagaaaatcctcaaggccagggagcacgtgagaatggtgattatcaatcagctgcagccttttgctgagatctgcaatgacgctaaagtccctgcgaaagactcatcaatccctaagcgaaaacggaaacgcgtgtctgaaggtaactcagtgagctcctcatcctccagcagctccagcagcagctcaaaccctgattctgtcgcttccgccaatcaaatctctctggtgcagtggcctatgtacatggttgattatgctggactaaacgtgcaactgcccggacctctcaactactag

SEQ ID NO: 225361 - DNA, 609 bp, Artificial Sequence
  Description of Artificial Sequence: Synthetic coding sequence
atgagttgcgttccatggaaaggagacaaggcaaaatctgaatcactcgagttgcctcaggcagcccctccacagatataccatgagaaacagaggagggagttgtgtgctctccacgcacttaacaacgtattccaggattctaacgcgtttactcgcgacaccctccaggagattttccaaagactgagtccaaacacaatggtgacccctcataagaagtcaatgctgggcaatggcaactacgatgtcaacgtgatcatggcagccttgcaaacaaaaggctatgaagccgtttggtgggataagcggagggacgtgggtgttattgcgctgacaaatgttatgggattcatcatgaatttgcctagtagcctctgctgggggccactgaagctgcccctgaagcggcagcattggatatgtgtccgggaggtggggggagcgtactacaatctcgactctaaattaaagatgcctgaatggattgggggagagtccgagcttcgaaagtttttaaaacaccacctgcgaggaaagaactgtgaactgttattggtggtcccggaagaggtggaagctcatcagagctggagaacggacgtgtag

SEQ ID NO: 225362 - DNA, 1545 bp, Artificial Sequence
  Description of Artificial Sequence: Synthetic coding sequence
atgaaatggagactgcaagagggaaggggcgaagctgtctaccagatcggcgtcgaagacaatggtctcctggtggggctagcggaggaagagatgagggccagtttgaagaccctccaccgaatggctgaaaaggttggagcggatatcaccgtgctgcgtgaacgcgaagtggactatgatagcgacatgcctcgcaagattactgaggtactggtcagaaaagtgccggacaatcagcagttcctggatctcagggtggccgttctgggtaacgtggacagcggaaagagtactctgctgggcgtactgactcagggagagcttgataacggaaggggtcgagctcgcctcaacctgtttaggcacttgcatgagatccagagtgggagaacctcaagcattagctttgaaattctgggcttcaattccaaaggtgaggtggtgaattattcggactcgcggactgcagaggagatctgcgagagttcaagcaaaatgatcacgttcatagatcttgctgggcatcataagtacttgcacacaacgatttttgggctgacctcatattgccctgactgcgccctcctcctggtgtctgcaaataccggcattgctgggaccactagagagcacctgggtctagctctcgccctgaaagtgccgttcttcattgtcgtcagtaaaatagacttgtgcgctaagacaaccgtggagcgtaccgtgcgccagctggagagagttctgaagcagccgggatgccacaaagttcccatgctggttacaagcgaggacgatgccgtgaccgctgcccagcaatttgctcaatcgccaaatgtaacaccaatattcacattgagcagcgtctctggggagtcactcgatctgctgaaggtgtttttgaatatcctgccgccactgacaaattccaaagaacaggaggagctgatgcagcagctgacagagttccaggttgacgagatttatactgtcccagaggtcggaacggttgttggtggaacactgtcctccgggatatgtcgggagggcgaccagctcgttgtggggcctacagatgacggctgtttcctcgaattgcgggtatgcagcatacagagaaaccgctccgcctgtagggtcctgcgtgctggccaggccgctacccttgcattaggtgatttcgaccgggcactgttgcgaaagggtatggtgatggtctcccccgagatgaatccaactatctgttctgtcttcgaggccgagattgtgcttttgttccacgccacaacttttagacgtgggtttcaggtgactgtgcacgtgggtaacgtgcgccaaaccgcagtggtagaaaagatccatgctaaagataagctgcgaacaggcgaaaaggccgtcgtgcggttcaggtttctaaagcacccagaatacctgaaagtgggcgctaaactgctctttcgagaaggggttactaaaggcataggccacgtgaccgacgtgcaggccataaccgccggagaagcgcaggccaacatgggcttttag

SEQ ID NO: 225363 - DNA, 1809 bp, Artificial Sequence
  Description of Artificial Sequence: Synthetic coding sequence
atggatagtcgcgtgtccgagctgtttggcggttgctgtcggccaggtggcggacctgccgttggcggaaccttgaaagcaagaggcgctggtagtagcagcggatgcggtgggccaaaaggcaagaaaaagaacgggaggaacagaggtggtaaagccaataatcctccatatctccctcctgaggctgaagacggaaacattgagtacaaactgaaacttgtgaaccctagtcaatatcgcttcgaacatttggttacccaaatgaagtggagactccaagaaggacgaggcgaagctgtgtatcagatcggagtcgaagacaacggactgctcgtgggcctagcagaggaggagatgcgcgcttctctcaagactctgcaccgaatggctgagaaagtgggggcagatatcaccgtcctacgggagagggaggtggattacgattctgacatgcctcgcaagattaccgaagtgctcgtgagaaaggtgcctgacaatcagcaatttctcgatttgcgtgtagctgtcctgggaaatgtggattctggtaagtctaccctattgggagtgctgactcagggagagttagataatgggcgagggagggccagactcaatttgttccggcatctgcacgaaattcagagcggaaggacttcaagcatctcgtttgaaatacttggttttaattctaagggggaggtggtgaattactctgacagccgcacagcagaggaaatttgtgaatccagtagcaagatgattacatttatcgacctggccggacaccataagtacctgcacacaacaatattcgggctgacaagctattgccctgattgtgccctcctgttggtgtcggcaaacaccggcatcgcgggaaccacacgtgaacatctgggcttggccctcgccttgaaggtacctttctttatcgtggtgtccaaaatagacctgtgcgcgaagactactgtggaacgcacagtgagacagctggagagggtattgaagcagccaggttgccataaagtaccaatgttagtgactagcgaggatgatgctgtgacagccgcacagcagttcgcccaaagcccaaatgtgacccctatctttacattaagcagtgtgtccggcgagagcttagacttattgaaagtgtttctcaatatcttgccacctcttaccaacagcaaggagcaggaggaattgatgcagcagctcactgagttccaggtggatgaaatttacactgtgccggaagtaggaacagtggtgggagggaccctctccagcggtatctgccgggagggcgatcagctggtggtgggtcctactgacgatggctgcttcctggagctgcgcgtttgctctatccagcggaaccggtctgcatgtagagtattgcgggcaggccaggccgcaaccctggccctgggcgatttcgaccgagcactgttacgaaagggtatggtaatggtaagtcccgaaatgaacccaactatctgctctgtgtttgaagctgagattgttttgcttttccatgctacaaccttccgcagaggctttcaagtgactgtccatgtcggcaacgtgcgacagactgctgtggtagaaaaaatccacgccaaggacaagctcaggaccggagagaaagccgttgtgagattcaggtttctgaagcatccagaatatctgaaagtgggagcgaagctcctgtttagagaaggagtcacaaagggtattggccacgtgactgatgtgcaagcgattactgccggtgaggcacaggcaaacatgggattttag

SEQ ID NO: 225364 - DNA, 735 bp, Artificial Sequence
  Description of Artificial Sequence: Synthetic coding sequence
atgaagtggcgactccaggagggacggggtgaggccatctttaccctgtccagcgtgtccggggaaagtctggaccttctcaaggtttttctcaacatcctgccaccgctcaccaattccaaagaacaagaggagctcatgcagcagttgactgaattccaggtagacgagatctacaccgtgcctgaggtggggacagtcgtcggagggaccctgagcagcgggatctgtagagagggtgatcagctggttgtcggtccaacggatgatggctgtttcctcgagttgagggtgtgctcgatccagcggaaccggtccgcttgcagggtgctgcgtgcaggccaagcagccaccctcgccctgggtgacttcgaccgtgccttgctccgtaagggaatggtcatggtcagtcctgagatgaatccaaccatctgttccgtctttgaggcggagatcgtattacttttccatgctactacgttcaggcgtggctttcaggttacagtgcacgtaggcaatgtcagacagacagccgttgtggagaagatccacgcgaaggacaaattacgcacaggcgagaaggctgtggtaaggttccgctttctgaagcatcctgaatacctgaaagtcggtgccaaattattattcagagagggagttacaaaaggcatcggacacgtgacggatgtgcaagctatcacagcaggagaggctcaggctaatatgggattctag

SEQ ID NO: 225365 - DNA, 462 bp, Artificial Sequence
  Description of Artificial Sequence: Synthetic coding sequence
taggggatatgtcgagagggggatcagttggtcgtaggacctactgatgacggatgcttcctggagcttcgcgtgtgtagcatccaaaggaaccgctccgcttgtcgggttctgagagcagggcaggcagcaactttagccctgggggatttcgacagagccttgctccgaaaagggatggtgatggtgtctccagaaatgaatcctacaatctgctctgtcttcgaggctgagattgtgttgctctttcacgcaacaactttccgcagaggctttcaggttacggtccatgttgggaatgttaggcagactgcagtggtggagaagattcatgctaaggacaaattgagaacaggggagaaagcagttgctcgtgagcggggagtcctgtcagccacctgttcactcccaaccttctggcgcggtgcgaaactgggcgtcgctcgcaagggccagtcctag

SEQ ID NO: 225366 - DNA, 465 bp, Artificial Sequence
  Description of Artificial Sequence: Synthetic coding sequence
tagggaatctgtagagagggtgatcaattggttgttggtcccaccgacgatggctgtttcttggagttacgtgtctgctctattcagagaaatagatcagcgtgtcgtgtccttcgggcaggccaggcggcaacgctggccctaggcgatttcgacagagctctcctgagaaagggtatggtaatggtttcccccgagatgaatcctaccatttgtagcgtgtttgaggcagaaattgtgctcctctttcatgccacaaccttcaggaggggtttccaagtaaccgtgcatgtcgggaacgtccggcagactgcagtcgtagagaaaattcacgctaaggtgaggggtacatggccctcaatcagtcccgaagttcgcaaggaagggggtcttcctcaaactggccgagaactgttggatccaaccatgggaattaaacctcacctcggctgggtagccgcatag

SEQ ID NO: 225367 - DNA, 543 bp, Artificial Sequence
  Description of Artificial Sequence: Synthetic coding sequence
atgcagcagctgacagagtttcaagtcgatgagatttacaccgtaccggaagtggggaccgtcgtgggcggaacattgagttcaggcatctgcagggagggcgaccaacttgtggtgggtcctaccgacgatggttgctttctggagttgagggtttgtagtattcagcgcaatcgatctgcttgccgtgtgcttagggctgggcaggcggctactctcgcactcggcgatttcgatcgggctctactgcggaaggggatggtaatggtgagtccggagatgaaccctaccatttgtagcgtctttgaggctgagatcgttttgttattccacgctaccactttcaggagaggtttccaggtcactgttcacgttggaaacgtgagacaaacagctgttgtggagaaaatccacgcgaaggacaagctgagaactggcgagaaagcagtcgcaagggaacgaggagtcttaagcgccacgtgctctctgcccactttttggaggggcgctaagttgggtgtagcacgaaagggacagtcatag

SEQ ID NO: 225368 - DNA, 951 bp, Artificial Sequence
  Description of Artificial Sequence: Synthetic coding sequence
taacaagggggaggcgctcgcgaggaaaatacatcattcagatctagggatcccagggaggaaggccagaggttggactctcaggcagaggatgggaatattgagtataagctcaaactggtcaatccgtcacagtaccggttcgaacacctggtcacacagatgaaatggagactgcaggagggaaggggagaagcagtttatcagatcggggtagaagacaatgggctgctggtggggctggctgaagaagaaatgcgggctagcctgaagaccttgcatcgaatggccgaaaaagtaggcgcagatattacggtcctcagagagagagaagtagattacgatagcgacatgccgcgaaagattacagaggtactggtgcggaaagtgccggacaaccagcagtttttggacctgagagtagccgtactggggaatgtagattcaggtaaaagcactttactcggcgttctgactcagggggagctggacaacggcagaggcagggcgagactgaatttattccgccacttgcacgagattcagagcggccgtacatcaagcatcagcttcgaaattctgggctttaatagtaaaggggaagttgttaactatagtgattcccggacggctgaggagatctgtgaaagttcgtctaagatgatcaccttcatagatttagctggtcatcacaaatatctgcacacaacgatctttgggcttacatcatactgtccggattgcgcccttcttctggtctccgctaacactggcatagctggaaccaccagggaacacttggggctggctctggccttgaaggtccccttttttattgtcgtgtccaagattgacttatgtgctaaaactacggtggagcgaactgtccggcaattggaaagagttctaaagcagccagggtgccacaaggttccgatgttggtgacgtag

SEQ ID NO: 225369 - DNA, 684 bp, Artificial Sequence
  Description of Artificial Sequence: Synthetic coding sequence
atggactctcgagtcagcgaactcttcggaggttgctgtagacccggaggcggacccgctgtcggcggaaccctgaaggctcgtggagctggatcctcctcgggatgtggaggtcctaagggtaaaaaaaaaaacggacgaaatcggggaggcaaggccaataatccaccctatctgcccccagaggccgaggacggaaacatagaatacaaatacagattcgagcatctggtgacccagatgaagtggcggcttcaggagggacggggagaggcagtgtaccaaattggcgtggaggacaatgggttgctggtaggcctcgccgaagaggaaatgagggcttcactgaaaaccctgcaccggatggccgaaaaagtcggagccgacattaccgttcttcgcgagcgtgaggtggactacgactctgatatgccacggaaaataactgaagtgctggttaggaaagtgccagacaatcaacagtttctcgaccttagagtggccgtgctagggaacgtggactctggtaaatcaacactcctgggggtccttacgcagggggaactcgataacgggcgaggcagggcgagactaaatctttttcgccacttgcacgagatccagtcaggcagaacgtcaagtatctccttcgaaattctgggatttaattccaagggtgaatag

SEQ ID NO: 225370 - DNA, 1221 bp, Artificial Sequence
  Description of Artificial Sequence: Synthetic coding sequence
atggcccctgccagatgttttagcgcacgcctgaggacagtatttcagggtgttgggcactgggccctgagcacatgggccggactgaaaccttccaggctcctgcctcagcgagcctcgccgaggttactctcggttggcagagccgacttggccaagcatcaggagctgccagggaaaaagcttctgagcgagaagaagttaaagcggtatttcgtggactataggcgagtactcgtatgtggagggaacggtggcgcaggcgcatcctgctttcatagcgagccgagaaaggaatttgggggaccagatgggggtgacgggggtaacggcggtcatgtcatcctgagagtcgatcaacaagtaaagagtcttagcagcgttcttagtcgttaccagggatttagcggggaagacgggggtagcaagaattgtttcggcaggtcaggagctgtgttgtatattagggtcccagttggaaccctggtgaaggagggaggtagagtagtggctgacttgtcctgcgtcggggatgagtatattgccgctcttggaggggcaggagggaagggtaacagattcttcctggcaaacaacaacagggcgcctgttacttgtaccccagggcaacccggacagcaacgagtgctgcacctcgagctgaaaactgtggcccatgccggaatggtcggcttccccaacgccggaaagagctcacttcttagagccatatcgaatgcgagacccgcagtggcctcttacccattcaccacactgaagccacatgtcggcatagtccactatgagggtcatctgcagattgccgtcgccgacatccccggaataatccgcggagcacatcagaatcgcggactcgggagcgcttttctcagacacatcgaacgatgcagattcttgctgttcgtcgttgatttgtcccaaccagagccctggacccaggtcgatgatttgaagtacgaactcgagatgtatgaaaagggactgagcgcgcgaccccatgctattgtcgcgaacaaaattgacctgcctgaagcccaggccaatctttcccagctgcgagaccaccttggccaggaggtgatagtcctcagcgccctaaccggggagaacctggagcagctgttgcttcacttaaaggtcttgtacgacgcctacgcggaagccgagctgggacagggacggcaacctctgcgttggtag

SEQ ID NO: 225371 - DNA, 747 bp, Artificial Sequence
  Description of Artificial Sequence: Synthetic coding sequence
atggcacccgctcggtgctttagcgctcggctgaggaccgtctttcaaggcgtgggacattgggccctctctacatgggccggattgaaacctagtcggctgctgccccagagagcaagcccaagactgctgagcgtaggcagggccgaccttgctaaacaccaagagctccccggtaaaaagcttttatcagagaagaaactcaaacgatatttcgtggactaccggagggtgctcgtatgcgggggaaatggaggagccggtgccagctgtttccacagtgaaccacggaaggagttcgggggtcccgacggcggagatggcggtaatggaggtcatgtcattttgagagttgccgacataccaggaattattaggggcgctcatcagaaccgtggcctggggagtgcattcctgcgtcacattgaaagatgccgctttctgctattcgtagtggacttgtcacagcccgagccctggacccaagtcgatgacctaaagtatgagcttgaaatgtatgagaaaggtttatcagcacgccctcatgccatagtggcgaacaaaattgatttgcctgaggctcaggctaacctgagtcagcttcgtgatcacttgggccaggaggtaattgtcctaagtgcgctgactggcgaaaatctggaacagttattactgcacctgaaggtgctgtatgatgcttacgccgaggccgagttaggtcagggtcgtcagccactacgctggtag

SEQ ID NO: 225372 - DNA, 702 bp, Artificial Sequence
  Description of Artificial Sequence: Synthetic coding sequence
atggcaccagccaggtgtttctctgctcggctgcgaactgtgtttcaaggagttggacactgggcgctgtcgacctgggcgggacttaaaccatcccgactattaccacagcgggcatccccaaggttgctgtcagtcggacgcgcagaccttgctaaacaccaggagctcccaggcaagaagctgctctccgagaagaaactgaagcgctattttgtagactacagacgcgtcttagtctgcgggggtaatggaggggctggggcttcttgctttcactctgagcctcgaaaggagttcgggggtcctgatggcggagatggagggaatgggggacatgttatactgcgagtggatcaacaagtcaagtctctctccagcgtcctaagccgctatcaggggttctcaggggaggatggcggtagcaaaaactgcttcggccgatcgggggcagtgttatatataagggtccctgtgggaaccctggtcaaagaggggggacgcgtggtagccgaccttagttgcgtgggcgatgaatacattgcagctcttggcggtgccggagggaaggggaatcggttctttctggctaataacaaccgagcaccagttacatgcaccccaggccagcccggacagcaaagagtccttcatctcgaattgaagaccgtggcccatgctggcatggtcggctttccttag

SEQ ID NO: 225373 - DNA, 537 bp, Artificial Sequence
  Description of Artificial Sequence: Synthetic coding sequence
atggtcggattccctaatgctggtaagagttcacttctcagggccataagtaacgcgagacctgccgtcgcaagttacccttttactaccctgaaaccccatgtcggtattgtccattacgagggccatttgcagattgcggtagccgatatccccggaatcatcaggggagcacaccagaatcggggactggggagcgcttttctgagacacatagaacggtgccgattcctcttgtttgtcgtcgacctctctcaacccgagccttggacacaggtcgacgacttgaaatatgaactggaaatgtacgagaagggactttctgcgagaccgcatgctatcgtggctaataaaattgatctgcccgaagctcaggccaatctcagccagctgcgggaccatctaggacaggaggtcatcgttttgtccgctctaaccggcgaaaatctggaacaactcctgctgcatcttaaggtgctgtacgacgcttatgcagaggctgagctggggcaaggacgccaacctctgaggtggtag

SEQ ID NO: 225374 - DNA, 864 bp, Artificial Sequence
  Description of Artificial Sequence: Synthetic coding sequence
cggagtaacctgaagcgggacgtggcccatctttaccgtggggtgggcagccgctacattatggggtccggtgagtcttttatgcagctccaacaaaggttgctccgcgaaaaggaggccaagatcaggaaagcactcgacaggctgagaaagaagagacacctgcttcgtcggcagaggacccgtcgggaattccccgtgatctcggtggtcgggtatactaattgtggaaaaacaacgctgatcaaggcgttgacaggggatgcggcaatccagccccgtgaccagctgtttgcaaccctggacgtgaccgcgcacgccggaacattgccgtcgcgcatgaccgtgttatacgtggacactatagggtttttatcccagctgccccacggactgattgagagcttctcagctacattagaagacgttgcccacagcgatttgatactgcacgtgcgggatgtctcacacccagaggccgaactacagaaatgttccgtgctgtctacgcttcgtggcttgcagcttccagcgcctctacttgactcgatggtcgaagttcataacaaggtggacttggtcccaggctacagcccgacggagcctaacgtggttccagtctccgcgctcaggggtcacgggttacaggagctcaaggcagaacttgatgcggctgtgctgaaggctacaggtcggcaaattctcacgctacgcgtcagattggcaggggcacagctgtcatggctttacaaagaggccacagtccaggaggtggatgtgattccagaagatggggctgcagatgtgagggtcattatctctaattcagcgtacggcaagtttcgaaagctgtttcccggttag

SEQ ID NO: 225375 - DNA, 864 bp, Artificial Sequence
  Description of Artificial Sequence: Synthetic coding sequence
tgaagtaacctgaaacgagacgtcgcacatctgtaccgaggggtgggaagccggtatatcatggggtcgggagagtctttcatgcagctgcagcagcgtcttcttagggaaaaggaggcgaaaatccgtaaagccctggataggctgcggaaaaaaaggcatctgttaaggcgccagaggacgaggcgagagttccctgtgattagcgttgttggctacacaaactgcgggaagaccacactaattaaagccctgaccggcgatgctgcaattcagcccagggatcaactgtttgctacacttgatgtgacggcccacgcgggaacattacctagtcgcatgacagtgctgtatgtggataccatcgggtttctctcgcagctgccacatggcctgatcgagagtttctcggcgacacttgaagatgtggcacacagtgatcttattcttcatgttcgcgacgtttcccatcccgaggccgagttgcagaagtgctccgttctgtctactctcagaggactgcagcttcccgctccacttttggacagcatggtggaagttcataacaaagtggacctcgtcccaggatactctccaacagaaccgaatgtcgtccctgtatcagctttgagaggccatgggttgcaggagctgaaagcagagcttgatgctgccgtgctgaaggcaaccggacgccaaattttaaccctcagggtgcgcctcgctggtgcccagctgtcctggctctataaggaagccactgtacaggaagttgacgtgatacccgaagacggggctgctgatgtccgcgttataatcagtaattccgcttacggcaagttccggaagctgttccccggatag

SEQ ID NO: 225376 - DNA, 891 bp, Artificial Sequence
  Description of Artificial Sequence: Synthetic coding sequence
atgaccctcaataatgtaacgatgcgccaagggaccgtcggaatgcaaccacagcagcagaggtggtcaattcctgccgatggacgccacctcatggtgcagaaggaaccacatcagtatagccaccggaaccggcattcggccactcccgaagaccattgccggcgttcctggtcatcagatagcacagattccgtgatctcttctgagagtggcaacacctactaccgagttgtactgattggggagcaaggggtcggcaagagtacattggcgaatatttttgctggcgttcatgattcaatggactccgattgtgaagtattgggcgaagatacatacgaacgcactttgatggtcgatggtgaatccgcaaccataattctactagacatgtgggaaaataagggagaaaacgagtggctccacgaccactgcatgcaggtaggcgacgcatacctgatagtgtactcaatcaccgatagagcctcatttgagaaggcgagtgaactacgtatccaactccgcagagcgaggcagaccgaggacatacccatcattctggtgggcaacaaatctgacttggtgagatgtcgcgaggtcagcgtgagcgaagggagggcatgcgctgtcgtctttgattgcaagtttatcgagacctctgccgctgtacagcataatgtgaaagaattgtttgaaggaattgtcagacaagtccgtttgagaagagattcaaaggaaaagaatgaacgcagactcgcataccagaaaaggaaagagtccatgccacggaaagcccgtaggttctgggggaaaattgttgccaaaaataacaagaacatggcttttaagctaaaatcaaagagctgccatgatctgagcgtcctctag

SEQ ID NO: 225377 - DNA, 891 bp, Artificial Sequence
  Description of Artificial Sequence: Synthetic coding sequence
atgacgctgaataacgtcacgatgcggcaaggcactgtgggcatgcagcctcaacagcaacgatggtcgattcccgctgatgggcgacacttgatggtgcaaaaggaaccacaccaatattcacacaggaatagacacagtgccaccccagaggatcattgccggagatcatggagttctgacagcactgattctgtcatatccagtgagtccggaaatacctactaccgggtggtgctgatcggcgaacagggcgtgggcaagtcaacacttgctaacattttcgccggtgtacacgatagcatggattctgactgtgaggtcctgggtgaagatacgtacgagcgcacactaatggtggacggagaaagtgccactattatactgctggacatgtgggagaacaagggggagaacgagtggctccacgatcattgtatgcaggttggagatgcctaccttatcgtgtattccattacagatagggcttcgtttgaaaaggcttcggagctgaggatccagctcaggagagccagacagacggaagatatcccaatcattctggtcggcaataagtcagatctggtacgttgtcgcgaggttagtgtcagcgaggggagagcatgcgccgtggtctttgattgtaagtttatagaaacctccgccgctgtccagcataatgtcaaagaactcttcgaagggatcgtaagacaggttcgattgaggcgtgacagcaaggagaagaacgagagaagactggcataccaaaaacggaaggagtctatgcccaggaaggcacgcagattctgggggaaaatcgtggcaaagaataataagaacatggcttttaaactgaagagcaagtcctgccacgacctttcagtgttgtag

SEQ ID NO: 225378 - DNA, 282 bp, Artificial Sequence
  Description of Artificial Sequence: Synthetic coding sequence
atgacattaaataacgtaaccatgcgtcagggcaccgtgggtatgcagccccagcagcaaaggtggagcatccccgcagacggcagacacctcatggtccagaaggagccccaccagtattctcaccgcaaccgtcactccgcaactcccgaggatcactgtagaagaagctggagcagtgattctaccgactctgtgatctcttctgaatctggcaatacgtactacagggttgtgctgataggcgaacagggggtagggaagagcacactggccaactag

SEQ ID NO: 225379 - DNA, 927 bp, Artificial Sequence
  Description of Artificial Sequence: Synthetic coding sequence
atggttatggaaaagcccagcccacttctggttggccgagagttcgttcggcagtactacacacttctgaatcaggcccctgatatgctgcatcgcttttacgggaagaatagttcctatgtgcatggaggactggatagcaacggaaaacccgctgacgctgtctatggccagaaagaggttgaagaacccgaggagaggcaacagacccctgaggtagtaccagatgactccggaacattctacgaccaggctgtagtgagcaatgacatggaagagcatctcgaggagccagtggctgaaccggagcctgaccctgagcccgagcccgagcaggagccagtatctgaaatccaggaggaaaaaccgccacggccagaatcaaagcctgaaagccagattccgccacaacggcctcagcgcgatcagcgcgtgcgcgaacagcggatcaatattccccctcagcggggaccacggcctattcgagaagcgggagagcagggggatatcgaacctcggaggatggttcgtcatccagattcacatcagctgttcattggtaatctcccgcacgaagtggataagtccgagctgaaagacttcttccagagttacggtaatgtggttgagcttagaatcaactcagggggaaagctgcctaattttgggttcgtggtgttcgacgattcggagcccgtgcagaaggtgctttcgaatcgcccaattatgttccgtggtgaggtgaggttgaacgttgaggagaagaaaacacgtgccgcaagagaaggcgataggcgggataatcgcctccgcggtcctggcggtcctagaggcggtcttggcggtgggatgcgaggccctcccagaggaggcatggtgcagaaaccgggtttcggggtgggacggggactggcgccacggcagtag

SEQ ID NO: 225380 - DNA, 1401 bp, Artificial Sequence
  Description of Artificial Sequence: Synthetic coding sequence
atggttatggagaaaccgtctcctttgctggtcggacgagagttcgtccgtcagtactacaccctgttaaaccaggccccagatatgctgcatagattctatgggaagaactctagctatgttcacgggggtttggatagcaacggaaaacctgccgacgcagtctacggacaaaaagaaatacacaggaaggtgatgtcccagaacttcactaactgtcacacaaaaataagacacgtggatgctcacgccaccttaaacgacggcgtggtggtgcaggtgatgggcttgctgagcaacaacaaccaggcactgagaaggttcatgcagacctttgtgctggcccctgaaggttctgtggctaacaagttttatgtgcataacgatatcttcagataccaagacgaagtcttcggcggatttgtgactgagccccaagaggagtccgaggaggaggtggaagaacccgaagaacgccagcagaccccggaggtagtccccgacgacagtggaaccttttacgatcaggcagtggtgagtaacgacatggaagaacacctggaggaacccgttgctgagcctgagcctgacccggagcctgaaccagaacaggagccggtctctgagatacaggaagaaaagcccgaacccgttttggaggaaaccgcaccagaggacgcccaaaaatccagtagtccggcacccgctgatatcgcacagacggttcaggaagatcttcggaccttctcgtgggccagtgtgacgagtaagaacttacctccaagcggtgctgttccagtgacgggcatcccacctcacgttgtgaaagtccctgcctcgcaaccaaggccagagtcaaagccagagtcccagattccccctcagcgcccacaaagagatcagagggtccgggagcaaagaatcaacattccccctcagcgaggcccaaggccaattagagaagcaggggagcagggcgatatcgagccgagacgcatggtgcgccatccagatagccaccaattgttcataggaaatctgcctcatgaggtcgacaagagcgaactgaaagacttcttccagagttacggcaacgtggtggagctacgcatcaacagcgggggaaaactgccaaactttggcttcgtggtctttgacgacagcgagccagtacagaaggtgcttagtaaccgtcccattatgttccggggtgaggtcaggcttaacgtggaggaaaaaaagacaagggcagcacgtgaaggcgatcggcgagataatcggctaagaggacccggtggacccagagggggacttggaggcggaatgcgaggccctcctcgaggcggtatggtgcagaaacctggctttggagtcgggagaggcttggcgcctcgccaatag

SEQ ID NO: 225381 - DNA, 1401 bp, Artificial Sequence
  Description of Artificial Sequence: Synthetic coding sequence
atggtgatggaaaagccaagcccattactagtcggcagggagtttgtcaggcagtactacaccctgctcaatcaggcccctgacatgctccacagattttacggtaagaattcctcttatgtgcatggtggtctcgactcaaatggtaaaccagcggatgccgtttacggccagaaggagattcaccgaaaggtgatgagccaaaacttcacgaattgccataccaaaatccggcatgttgatgcacatgcaacactgaatgatggcgtcgttgtgcaggtcatgggcctgctatccaataacaaccaagccctccgccgtttcatgcaaacctttgtactggcacctgaagggtccgttgccaacaaattttatgtgcacaatgacattttcagataccaggatgaggtctttggtgggtttgtgactgaaccacaggaggaatcggaagaagaggtcgaagagcccgaagagcgccagcaaactcctgaggttgtgcccgatgacagtggaacgttttacgaccaagccgtggtctcaaatgatatggaggaacacctcgaagagcccgtcgccgaacctgaaccagacccggagccagagcctgagcaggagcctgtgagcgagatccaagaagagaaaccagagcccgtgttggaagagacggcgccagaagacgcccagaagtcctcctccccagcccctgccgacatcgcccaaaccgtgcaggaagacctacggacttttagctgggcatcggtaacctcaaagaaccttcccccttcaggcgctgttcccgtgaccggaatcccaccacacgtggttaaagtccctgcttcccaacccaggcctgagtctaaaccagaatctcagatccccccacagcgtccccagcgtgatcagcgcgtgcgcgagcagcgaattaatataccaccacagagggggcctcgcccaatcagagaagctggggagcaaggcgacatcgaacctaggcggatggtgaggcaccccgattctcaccagttatttatcggtaacctgccacatgaagtggataaatcggagctcaaggacttctttcagtcatacggtaatgtggtcgagctccggattaacagcggcggaaagcttcctaattttgggtttgtggtttttgatgattctgaacctgtccagaaagtgctatctaatcgccctatcatgttcaggggggaagtacggctgaatgttgaagagaaaaaaacccgcgctgctcgggagggggatcgtcgggacaaccggcttagagggccagggggtccaagggggggtctggggggtgggatgaggggcccaccacgagggggaatggtgcagaagcctgggtttggagtgggaagggggcttgccccacggcaatag

SEQ ID NO: 225382 - DNA, 318 bp, Artificial Sequence
  Description of Artificial Sequence: Synthetic coding sequence
atggttatggagaagccatccccacttctggtgggcagggaattcgtgaggcaatattacacgctgctcaaccaggcccctgatatgctgcatcggttttatggaaagaacagtagttacgtgcatggtgggttagactccaacggcaagccagcagatgctgtctacggccagaaggagattcataggaaggtgatgtcccagaactttaccaattgtcacaccaagatccgacatgttgacgcgcacgccacgctgaatgacggtgtggtggttcaagtgatggggcttctcagcaataacaatcaagcgctctag

SEQ ID NO: 225383 - DNA, 369 bp, Artificial Sequence
  Description of Artificial Sequence: Synthetic coding sequence
atggtcatggaaaaaccctctcccctcctggttggcagagagttcgtcagacagtactatacattgcttaaccaggcacctgatatgctccaccgattttatggcaaaaattcaagctacgtgcacggcggtctggatagcaacgggaaaccagctgatgccgtttacggccagaaagagattcatcgaaaagtgatgtcccagaatttcacaaattgtcatacaaagatccggcacgtggatgctcatgcaaccctgaacgatggcgtggtcgtccaagtaatggggctgcttagtaataataatcaagctttgcggagattcatgcagactttcgttctggccccagaatcattgaaaaagaaatag

SEQ ID NO: 225384 - DNA, 354 bp, Artificial Sequence
  Description of Artificial Sequence: Synthetic coding sequence
atggttatggagaaaccttcacccttactagtcggccgtgagttcgtgagacagtattatacgctacttaaccaagcaccagacatgttacacagattctacggcaagaacagcagctacgttcatggcggactggatagcaatgggaagccagccgatgccgtctacggacaaaaagagatccaccggaaagtaatgagccagaactttactaactgccacactaagattcgacacgtggacgcccacgccaccctaaatgacggggtagtggtgcaggttatgggactgctgtctaacaacaaccaggccctgagacgctttatgcagacgtttgtcctggctccagagtag

SEQ ID NO: 225385 - DNA, 369 bp, Artificial Sequence
  Description of Artificial Sequence: Synthetic coding sequence
atggtaatggagaagcccagtcccctcctggttggcagggaatttgttcgccagtattacacactgcttaaccaggccccagatatgcttcacaggttctacgggaaaaattcgtcctacgttcatggaggcttggatagcaacgggaagcccgctgatgcggtatacggacagaaggagattcatcggaaagtgatgtcacagaacttcacaaactgtcacaccaagatcagacatgtcgatgcccatgctacactgaacgatggtgtagtcgtacaggtgatggggttattgtctaataataaccaagccctgcggcgattcatgcagactttcgtcctggcccctgagtcactgaagaaaaagtag

SEQ ID NO: 225386 - DNA, 321 bp, Artificial Sequence
  Description of Artificial Sequence: Synthetic coding sequence
atggttatggaaaaaccttctcccctgctggtggggagagaattcgtccgtcagtactacacccttttaaatcaggcgccagatatgctgcatcgattctatggcaagaacagcagctatgttcacggtggcttggacagtaacggaaagccggctgatgcggtttatggtcaaaaagagatccacagaaaagtgatgtcacagaatttcacaaattgtcacaccaaaatcaggcatgtggacgcgcatgccactctcaatgatggagtggtggtacaggtgatgggcttattgtcaaacaataatcaggcgctccgttag

SEQ ID NO: 225387 - DNA, 855 bp, Artificial Sequence
  Description of Artificial Sequence: Synthetic coding sequence
atggaggaacacctcgaagagcctgtggcggagcctgaacctgatccagagccggagccagagcaggagccagtgagtgagatccaagaagagaagcctgagcctgtgctggaggaaacagcccctgaggacgcccagaagtcttcttcaccagctccggctgatatcgcccagaccgtgcaggaagatctgcgtacgttctcctgggcgtcagtcacgtccaagaacctccctccatcaggagccgtgccagtcaccggcatacctcctcatgtggtcaaggtcccggcatcccagccaagaccagaaagcaagccagagtctcagatccctccacaacggcctcagagagaccaaagagtacgggaacagcggattaacattcctcctcagcgcggaccacgtccaatcagggaggcgggagaacagggagatattgaaccaaggaggatggtccgccaccctgacagtcaccagctattcattggcaatcttccccacgaggtggacaaatctgagctcaaggacttttttcagtcttatggtaacgtggtggagctgaggattaatagtgggggaaaactgcctaactttggcttcgttgtttttgatgactccgagccagttcagaaagtactgtctaatcggccaattatgtttcgcggtgaggtcagactgaatgtcgaagagaagaaaacccgggctgccagggagggggatcggcgagataaccgacttagaggaccaggtggccctcgcggtggtctaggaggcggaatgagaggacctcccagggggggtatggtacagaagcccggtttcggcgtcgggaggggactggcacccagacaatag

SEQ ID NO: 225388 - DNA, 4359 bp, Artificial Sequence
  Description of Artificial Sequence: Synthetic coding sequence
atggtgaaattggacatccatacattggctcaccatctgaaacaagaacgcttgtacgtgaactcagagaagcaacttatccaacggctcaatgccgacgtcctgaagactgctgaaaaactgtacaggactgcctggatcgctaaacaacagaggatcaacctggacaggctgattatcacttccgcggaggcaagcccagccgagtgttgccagcacgccaagatcctagaagacacgcaattcgtggatgggtataagcagctgggctttcaggaaaccgcttacggcgaattcttgtcccgtctcagggagaacccgcgtttgatcgcttccagcctggttgctggggaaaaactgaaccaggaaaacacgcagtctgtcatctacacagtttttacctcgctgtacggcaattgcatcatgcaagaggatgagagctacctcctccaggtactgcggtacctcatcgaatttgaactcaaggagagtgacaatcccagaagactactcaggaggggaacctgcgcattcagtattctcttcaagctgttttccgaggggctgttcagcgccaagctgtttttgactgctacgttgcatgagcctatcatgcagctcctcgtggaggacgaagaccacttggagaccgacccaaacaaacttattgagcggttttcacctagccagcaggagaagctgttcggcgagaagggcagtgaccgctttagacagaaggtccaggagatggtggagagtaacgaagctaaactggtagccttggttaataaatttattggatatcttaaacagaacacctactgctttccgcactccttaaggtggattgtgtcccaaatgtacaagacgctatcttgcgtggacaggctagaggtgggcgaagtgagagctatgtgtactgatcttttgctcgcttgctttatctgcccagcagtggtgaaccccgaacagtatggcattatctccgatgctccaatcaatgaggtcgctcggtttaatcttatgcaggtcggaagactgctgcagcagctcgcaatgacaggcagtgaagagggggaccctagaaccaaatcttcgctgggcaagttcgataagtcttgtgtggccgcattcctggacgtggtcattggtggacgggctgtggaaacaccccctttatcgtccgtgaatttactggagggcctgtcccggacggtcgtgtacattacatacagtcagttaatcaccctggttaattttatgaagtccgttatgtccggtgaccaattgagggaggaccggatggccctggataacttgctagcaaatctacctccagccaagccgggaaaatcttcctctctggagatgacaccatacaacaccccccaattaagtccggctaccactcccgcaaacaaaaaaaaccggcttccgatcgctactaggagtcgcagccgtacaaacatgcttatggacctgcatatggaccacgaggggagctcacaggaaactatacaggaggtccaacctgaggaggtcctggtgatctccctcggcactgggcctcaacttacccctggaatgatgagcgagaacgaggtacttaatatgcagttatcagatggcggacagggagatgtgcccgtcgacgagaacaagcttcacgggaagcctgacaaaacactacgcttttctttatgcagcgacaacctcgagggcatctcagaaggcccttccaaccgcagcaattcagtgagcagtcttgatctggagggggagtccgtatcagagcttggtgctggcccttcgggcagcaacggggtcgaggcactgcagctgctggagcacgaacaggctactacacaggacaatctggacgacaaactgcgcaaattcgaaatacgtgatatgatggggctgacggatgaccgtgacatctctgagactgtttcagagacatggagcacagatgtgcttggcagcgatttcgatcccaacattgatgaggaccggttacaggagattgcaggcgcagcagccgaaaacatgctcggatctctactgtgtctgccagggtctgggagtgtactgctggacccctgcacgggttccacgatctcagagacgacttcggaggcatggtccgtagaggtgctcccaagcgactcagaggctccagatctgaagcaggaggagcgcctgcaagaactggaatcctgctccggccttggatccacatccgatgacactgacgtgagagaggtgagttctagaccaagcaccccaggcctgagtgtggttagtggcatcagcgcaacgtcagaggacattccaaataaaattgaggatctccgatctgagtgctccagtgactttgggggaaaggattcagtgacctctcccgacatggatgagatcacgcacggggctagtgctgttgtaaggcccaaagtccactacgcacgaccgagccacccccctcccgatccacctattctggagggtgctgtggggggtaacgaagccagattgccaaatttcggctctcatgtgttgaccccggctgagatggaagcattcaagcagaggcactcctatcctgaaagacttgtgagaagtcgctcatctgatattgtatcctctgtacgacggcctatgtcggatcccagctggaacaggcggccaggaaatgaggaaagggagctcccccctgccgctgctattggcgcaacatccctggtggctgctcctcactcctcatcatcctcaccttctaaggattcaagccggggtgaaacagaggagcgcaaggacagtgatgacgagaaaagcgaccgcaacagaccatggtggagaaagcgcttcgtgtcagcaatgcccaaggcgccaattccctttaggaagaaggagaaacaggagaaggacaaggacgacctggggcctgatcggttttctaccctaacggatgacccatctccaagattaagcgcgcaggcccaagttgcagaggatatcctggacaaataccgcaatgcaattaagagaaccagtccaagcgatggggctatggctaactacgagagtacgggcgacaaccacgaccgagatttgtcctccaaactgttgtaccatagcgataaggaagtgatgggtgacggtgagtcagcgcacgacagccctagggacgaagcgttacaaaacatctcggccgacgatctgccagacagcgcgtctcaggcagcacatccacaggactctgccttctcatacagagatgctaagaagaagctgcgcctcgctttatgctccgcggatagcgtcgctttccccgtgctcacacactcaacgcgcaacgggctgcctgaccatacagatccagaagataacgagatcgtgtgcttcctgaaggtccagattgctgaagcaatcaatctgcaggacaagaatctgatggctcaattgcaagaaacgatgaggtgtgtgtgcagatttgataacaggacctgccgcaagctgttagcctctattgccgaggattatcgcaagagagccccatacatcgcctacctgactcggtgcagacaagggctccaaactacccaggcgcatctggaaaggctactccagagagtgttacgggacaaagaagtggccaatcgatacttcactacagtgtgtgtgcgcctcctgttggaatctaaggaaaagaagatccgggagttcatccaggacttccagaaactaacagccgctgatgataaaactgcccaggtggaagatttcttacaatttctgtatggagcaatggcccaggatgtaatatggcagaacgcctctgaggagcagctgcaggacgcccagctggctatcgaacgtagcgtcatgaatcgtatcttcaaactggcattctatcccaaccaagacggggacatccttagggatcaggtcttgcatgagcacatccagagattgagcaaagtcgtaacagcgaaccaccgggcactgcagatccccgaagtatacctccgcgaagcaccctggccatccgcccaatcagagatacgaactatcagtgcatacaagaccccccgagacaaggtccaatgtattcttcggatgtgctctaccataatgaatcttctgtctctcgctaacgaagacagtgtgcccggtgcagacgacttcgtgcctgtgcttgtgttcgtcctgattaaggcaaatcccccatgcttgcttagcaccgtgcaatacataagcagcttctatgccagttgcctgtcaggagaggagtcctattggtggatgcagttcacagctgcagtggagtttatcaaaacaatcgacgaccgcaagtag

SEQ ID NO: 225389 - DNA, 1494 bp, Artificial Sequence
  Description of Artificial Sequence: Synthetic coding sequence
atggtgaagttagatattcacacactcgctcatcacctaaagcaggagagactctatgtcaactcagagaaacagctgatacagcgccttaacgcagatgttctgaaaactgccgagaaactctaccggactgcctggattgcgaagcagcaacggatcaatttagacagactgataattacttccgccgaagcctctccagccgagtgttgccagcatgccaagatcctggaggacacccaattcgtggatggatacaaacagctgggttttcaggagactgcttacggagagttcctctcaaggctgcgggagaaccccagattgattgctagttcgctagtggctggcgagaagctgaatcaggaaaacacccagtccgttatctataccgtcttcacctctttatacggaaattgtattatgcaggaggacgagtcttatctcctgcaggtcttgcgctatttgatagagttcgaattaaaggaaagcgacaaccctcgaagacttcttcgcagaggcacctgcgcattctctattctcttcaaactgtttagcgaaggcctattttctgccaagctgtttcttaccgcaaccctgcatgaaccgataatgcagctcttagtcgaggatgaggatcatctggagaccgatccaaataaactgatcgagaggttcagccccagccagcaagagaaactttttggtgagaagggaagcgaccgctttcggcagaaggtgcaggagatggtcgagagtaacgaggctaaattagtggccctcgtaaataagtttatcggctatctgaaacagaatacttattgcttccctcattctctccgctggatagtatctcagatgtacaagaccctgagttgtgttgaccggctcgaggtaggtgaagtgcgcgcaatgtgcactgatctgctattagcctgcttcatttgcccagccgttgtgaatccagaacagtacggcatcatcagcgacgcccctatcaacgaggtggctcgctttaatttgatgcaggtggggagattgttgcagcagcttgcgatgactggatctgaggagggagaccctcggactaagagctcattgggaaaatttgacaagtcctgcgttgctgcattcctggacgtagtaatcggtggccgagcagtggaaaccccaccactctcatctgtgaatcttctggaaggcctgtcccggacagtggtctacataacttatagccaactcatcacattagtgaatttcatgaaaagtgtgatgtctggcgatcagttgagggaagaccggatggcccttgacaatcttttagcgaacttacccccagccaagccgggtaaaagttcctcgctagagatgacaccgtataacactcctcaactcagtccagctaccactccagctaacaaaaaaaatcgtctgccgatcggaaaggagaacttctcatactggagcttcctcctcaacctgattttccattag

SEQ ID NO: 225390 - DNA, 4437 bp, Artificial Sequence
  Description of Artificial Sequence: Synthetic coding sequence
atggtgaaattggatattcacacactggctcaccatttaaagcaggagcggctgtacgtgaattcagagaagcagcttattcagcgactgaatgctgatgtactgaagacagccgagaagctatatcggacggcctggattgctaagcagcagaggatcaatcttgatcgcctgataattacgagtgctgaagcatcccccgctgaatgctgtcagcatgctaagatcctggaggatacacagtttgtcgacggatacaagcagttgggcttccaagagacagcctacggtgagtttctgtcacgcttacgggagaacccgaggctgatcgcttcaagtctggtggcgggtgagaagctgaatcaagagaatacacaatctgttatatacacagtgttcacctcactgtacggcaactgcatcatgcaggaggacgagagttaccttctgcaggtcctcaggtatctgattgagttcgaactgaaggagtccgataatccccgtaggctgctgagacgcggaacctgtgcctttagcattttgttcaagctgtttagcgagggactgtttagtgcgaaactgttcctaaccgccaccctccacgagcccatcatgcagctactcgtggaagatgaggaccacttagaaactgaccccaacaagctgatagagcgcttttcccccagccagcaggagaagctatttggtgaaaagggatccgaccggtttcggcagaaggtccaggagatggtggagtccaacgaggctaagctggttgccttagtcaacaagttcattgggtatctgaagcagaacacttactgtttcccccattctcttcgctggatcgtcagtcagatgtataagactctgtcctgcgtggaccgacttgaggttggagaggtgagagctatgtgcaccgatcttctccttgcttgcttcatttgtcctgcagtggtgaatcctgaacagtatggcattatctctgacgctccgattaatgaagttgcacggttcaatctcatgcaagttggcaggctcctccagcagctagccatgacagggtctgaagagggggacccccgtaccaagtcctcccttggtaaattcgacaagtcatgtgtggcggctttcctggatgtggtcattggaggcagggccgtcgagacccccccacttagttcagtgaacctgctggaggggctgagccgtactgttgtatatatcacttacagccagttgatcaccctggtgaacttcatgaagagcgtcatgagcggggatcagctgcgggaggacaggatggctctcgataatctgctcgctaacctcccccctgcaaaacctgggaagagctcctcactcgagatgactccatataacactccacagttgagccctgcaaccacccctgcaaataagaaaaatagacttcccatcgctacccgtagccggtcacgtactaatatgttgatggacctgcacatggatcatgagggcagctcacaggaaaccatacaggaggttcaaccagaagaggtcttggtgatttcactgggtactggccctcagcttactccagggatgatgagcgaaaatgaggtcctcaacatgcagctgagtgatggcggtcagggcgatgtcccggtcgacgagaataagctgcacggaaaacctgacaaaacccttcggttctcattgtgcagtgacaatcttgagggtatttccgaaggtccaagtaatcgttcaaactcggtcagctccttggacctggagggcgagtctgtcagcgagctgggggcaggtcccagcggcagcaacggggtcgaggccttgcagctgttggaacatgaacaagccaccacacaggacaatttagacgataagctgcgaaagtttgaaatccgtgacatgatggggctgacagacgatagggacatttcggagaccgtctctgaaacttggagcacagatgtattgggtagcgactttgacccaaatattgacgaagaccgcttgcaggaaatcgccggtgccgcagccgagaatatgctggggagcttactgtgcttgccaggatcagggtccgtgcttctggatccgtgcacagggtcaaccattagtgaaactaccagcgaggcttggtcagtggaggtcctaccatctgattcggaggcgccagacttgaaacaggaggagcgcctgcaggaactggagagctgttctggcctgggaagtacctccgatgatacagacgtcagggaagtttctagtagacccagcacgcccggattaagcgtggtgagcggcatcagtgcaactagcgaggatatccctaataagatcgaggacctgcggagcgaatgtagcagcgactttggtggtaaggacagtgtgacatcccccgacatggacgaaattactcacggcgcacatcagcttacttctcctccctctcagtcggaaagcttactggcaatgttcgaccccctgtcatctcacgaaggcgcttcagcagtcgtcaggcctaaggtccactacgccaggccctcacacccaccccctgatccacccatcctagagggcgctgtgggaggaaacgaagccaggcttccaaactttggtagtcatgtgctcaccccagcagagatggaagccttcaaacagcggcactcatatcctgagaggctggtgcggagccgatcatcagacatcgtctcgtctgtgagacgccctatgtccgatccttcatggaacaggagacctggcaacgaggaacgagaactccctcctgccgcagctatcggcgctaccagtttggtggcagccccacattcatcatcctctagcccttccaaagattcctctcgcggagaaactgaagaacgcaaggatagcgatgacgaaaagtccgacagaaacaggccctggtggagaaaacgctttgtctccgccatgccaaaggcgccaataccatttcgtaagaaggaaaaacaagaaaaggataaggacgatttgggacccgatcgattcagcaccctgacagacgatccttccccaaggctcagcgctcaggcacaggtggctgaagacatcctggacaaataccgaaacgccataaaacgtacatctccttctgatggcgctatggcaaactatgagtctactggcgataaccatgatagggatctttcctccaagctgttataccactctgacaaggaggtcatgggcgacggagagtcggctcacgacagccccagggacgaagccctccagaacatctccgcagatgaccttccagactctgctagccaggccgcacaccctcaggattcagctttctcttatcgcgacgccaaaaagaagctgcgcttagcactctgctcagccgacagtgtggctttcccagtgctgacccactcaactcgcaacgggctgccagatcatacagaccctgaagacaacgagatcgtgtgttttctgaaggtgcagatcgccgaggctatcaacctgcaggataagaatttgatggcacaactccaagaaaccatgagatgcgtatgtagattcgacaacaggacatgcaggaaacttcttgctagtatcgcagaagattataggaagcgcgctccatacattgcctatctcacccggtgcagacaggggttacaaacaacccaggcccaccttgagcggctcctgcaaagggtgctgcgtgataaggaagttgccaacagatattttaccacggtgtgcgtcaggctactgcttgaatcaaaagagaagaaaatacgggaattcatacaggattttcagaagctcacagcagctgatgacaagacagcgcaggtcgaggattttctacagtttctgtatggtgccatggcacaggacgtcatatggcagaacgctagtgaggaacagctgcaggatgcccagctcgccatagagagatcagtgatgaatcgtatctttaagctggcattctatcccaatcaggacggagacattttacgcgaccaagttctacatgaacatattcagcggctgagcaaagtagttacagcgaaccaccgcgcattgcagatcccagaggtttacctgagagaggctccctggccaagtgcccaatctgagattcgtaccatctccgcctacaagacacctagagacaaagttcaatgcatcttaaggatgtgctcaactatcatgaatctgctctccctagcaaatgaggattcagttccgggtgcagacgacttcgttcctgtgttggtgttcgtgctcatcaaagccaaccccccttgccttctttcaacagttcaatacatatcttcattttatgcctcctgcctcagcggggaggagagctactggtggatgcagttcaccgccgctgttgaatttatcaagacaattgatgacagaaagtag

SEQ ID NO: 225391 - DNA, 4464 bp, Artificial Sequence
  Description of Artificial Sequence: Synthetic coding sequence
atggtgaagttagacatacacaccctggcccatcatttgaaacaggaacgcctgtacgttaacagcgagaaacagctgattcagcgtctgaacgcagacgtgctgaagacggctgaaaaactgtaccggacagcctggatcgcaaaacagcagcgcataaatctcgataggctcatcattacgtcagcagaggctagtcctgctgaatgctgccaacatgccaagatcctggaggatacgcagtttgttgatgggtacaaacagctgggattccaggagaccgcatacggagagtttctctccagactccgtgaaaaccccagactgatcgccagctccctggtggctggagagaagctcaaccaggagaatactcagtcagtgatctataccgtcttcacaagtctctatggcaactgcatcatgcaggaagacgaaagttacttactccaggtccttagatacctgattgagtttgaactaaaagaaagtgacaacccaaggcgccttcttcgaagggggacatgcgcctttagtattctgttcaagctcttctccgagggcctgttttcagccaagctgttcttaactgccaccctgcatgaacccataatgcaactgttggtggaggacgaggatcatttggagacagaccctaataagctgattgagaggttctccccaagccagcaggagaagctgtttggagagaaaggtagcgacagatttcggcaaaaggtccaggaaatggtggaatcaaatgaggccaaattagtggctctggtcaataagttcatcggatacttgaaacagaatacttattgcttcccacatagtcttagatggatcgtatctcaaatgtataagactctgtcttgtgtggacagattggaagtcggcgaagtgagggcgatgtgtacagacttgttgctggcttgttttatttgccccgctgtcgtgaatcctgagcaatacggaattatttcagacgcgccaattaacgaagttgccaggttcaatttgatgcaagtgggcaggttactgcagcaattagcaatgacagggtccgaagagggagatcctcgaacaaagtcttcacttgggaagtttgataagagctgtgtagcagctttcctggatgtcgtgatcggaggcagagccgttgaaactcctcccctgtcctcagttaaccttctcgaaggtctttcacggacagttgtttatattacatatagtcagttgattactttagtgaattttatgaaatctgtgatgtcaggcgatcaactgagggaggatcggatggctctggataacctgctggctaatctaccccctgccaagccaggtaagtcatccagcctcgagatgacaccttacaatacacctcagctttcacctgctaccacaccagctaacaagaagaatcgattgcctattgcaaccagaagccgctctaggaccaatatgctcatggacttgcacatggaccacgaaggcagctcacaagaaacgattcaggaggtgcaaccagaggaagtgctcgttatttcactagggactggcccacaacttacaccaggaatgatgtcagagaacgaggtcctgaatatgcagctgagcgacggaggccagggtgatgtgcctgttgatgaaaacaagctccacggaaagcccgacaaaacacttaggtttagcctgtgcagtgataacctagaaggtataagtgagggcccttccaacaggtccaactcagtcagctctttggatctcgaaggggagagcgtctctgagctaggcgcagggccatctgggagcaacggagtagaggcccttcagctccttgagcatgagcaggcaactacgcaggacaacctcgacgataagcttagaaagttcgagataagggatatgatgggactgactgatgacagagatataagcgaaacggtgtccgaaacttggagcaccgacgtgctggggtctgacttcgatcccaatatagatgaagacaggctgcaggagatcgcgggagccgcagccgaaaacatgctgggcagcctcctctgtctgccaggaagtggttcggtgttactggacccttgtaccggcagtaccatatcagaaactacaagcgaggcatggtccgtggaagtgttgccatccgattccgaggccccagacctgaaacaggaggagcggctccaggaactggaaagctgctcaggactcggtagtacatctgatgacaccgatgtacgcgaggtgagttcgcggccatccactcctggactgtcagtcgtgagcgggattagcgctacttctgaagacattcccaataagattgaggatttacgcagcgagtgtagctcagatttcggtggaaaggattctgtaacctctccggacatggacgagataacacatgacttcctctatatcctccagccaaagcagcacttccagcacatcgaagccgaagctgatatgaggattcagctgagcagttcagctcaccagctgacaagccctccaagccagagcgagtctcttttggctatgttcgaccccctaagcagtcatgagggagcttctgccgtggttagacctaaagtacattatgcgaggccgtctcaccccccaccagatcctcctatcctcgaaggcgcagttggagggaacgaagcgagactgcccaatttcggctctcatgtgctcacaccagcggagatggaggccttcaagcagcggcattcatatccggagcgcttggtgcgatctcgatcttctgacattgtttcatcagttagaaggcccatgtccgacccatcctggaaccggcgacccggaaatgaggaaagggaactccctccagccgcagctattggcgctacaagcttagtcgcagcaccacattccagctcctcttcacctagcaaggacagcagccgcggagaaaccgaggagcgaaaagattcggacgacgagaagtctgataggaacaggccttggtggcgaaaaaggttcgtgtcagccatgccaaaggcgccaattccctttcgaaaaaaggaaaaacaagagaaagacaaggatgatcttggacctgatcgtttcagtactctcactgacgaccctagccccagattatctgcccaagcacaggtcgctgaggatattctagacaagtaccgcaacgcgatcaaacggacaagccccagcgacggtgcaatggctaattacgaatctaccgaagttatgggtgatggagagagcgcccatgatagtccacgggacgaagcgctccaaaacattagcgcagatgatctgcccgattctgcatcccaagcggctcacccgcaggattctgcctttagttaccgcgacgccaaaaaaaaactgaggctggccttgtgcagcgcagactccgtcgctttccctgtgctaacccactcaacaagaaatggactccccgatcatacagatccggaggacaatgaaatcgtgtgttttttgaaggttcagattgctgaagccattaacctgcaggataagaatcttatggcccaattacaggaaacaatgcgctgtgtttgtcggtttgataataggacgtgccgaaagctgcttgcgagcattgccgaggattatcgcaagcgcgctccctatattgcctacctgacccgatgccggcagggcttgcaaaccactcaggcccacctagagcggctcttgcagcgcgtgttgcgtgacaaggaggtggccaaccgttatttcacaaccgtgtgtgttcgactgctgttagagtccaaagagaaaaagatcagggaatttattcaggacttccagaagctgaccgccgctgatgataagaccgctcaggtcgaggacttcctacaatttttatatggcgcaatggcccaggatgtgatctggcagaatgccagcgaagaacaattgcaagatgcgcagctggccatcgagcggtctgttatgaaccgcatctttaagttagccttttaccccaatcaggacggagacattctgcgggaccaggtgctgcacgagcacatccaaaggctcagcaaggtcgtaactgccaaccaccgtgcactgcaaatacccgaagtgtacctgcgggaagccccttggccttcggcgcagtctgagatccggacaatttccgcatataaaactcctcgcgacaaagtgcagtgtatacttcgaatgtgttcaaccatcatgaacctgcttagtctggcaaatgaggacagtgtccctggcgctgatgacttcgtcccagttctggtgtttgtgttgattaaggcaaatccaccatgcctgttgtccacagtgcagtatatttccagcttctatgcatcctgtctctcaggtgaggaaagttactggtggatgcagttcaccgctgcagttgagttcatcaagacaatcgacgatagaaaatag

SEQ ID NO: 225392 - DNA, 2514 bp, Artificial Sequence
  Description of Artificial Sequence: Synthetic coding sequence
tgaaactgtattatgcaggaagatgagtcttacttgctgcaggtacttaggtatctgatcgagttcgagctgaaagaatcagataatcccagaaggcttctacgacgcggaacttgtgcattttcgattctgttcaaattgttctctgaaggtctgttctctgccaaacttttcctgaccgctaccttgcatgaacccatcatgcagcttctggttgaggacgaggaccaccttgaaaccgaccccaataagttgatcgaaaggttttcaccatctcagcaagaaaagctttttggagaaaaaggatctgatcgttttcggcagaaagtacaggagatggttgaatcgaacgaggcaaagttggtcgcactagtcaataaatttatcgggtacttaaagcaaaacacctactgttttcctcatagcttacgctggatagtctcacaaatgtacaagaccctgtcctgcgtggataggctcgaggtaggtgaagtccgtgccatgtgtactgacctgctgctcgcctgctttatttgccctgctgtggtgaatccagagcagtacggcatcatctcggatgcacccattaacgaggtcgccaggttcaatctcatgcaggtgggcagactgctgcagcagttggctatgacaggctccgaggaaggcgatccacgcactaagtcctctttggggaaattcgataaatcctgcgtggccgctttcctggacgtagtaattggtggtagagcggtcgaaactccacccttgagctctgtcaatctcctggaaggtctgtccaggaccgtggtgtacattacctattcccaactaattacactggtgaatttcatgaagtcagtaatgtccggggaccaacttagggaagataggatggccctggacaatcttctggctaacctgccacctgctaagcctgggaaaagctcgtccctggagatgactccctataatacaccccagctgagcccagccaccacgcccgctaataaaaagaaccgactgccaattgctactaggagtaggtcacgcacaaatatgcttatggacctacacatggaccacgaagggtcttcccaggagacgattcaggaggtgcagcctgaggaggttctggtgatttccttgggcacaggaccccaactcacccccggaatgatgtctgaaaacgaggttcttaatatgcagctgagtgatggaggccagggcgacgtgcccgtcgacgagaataagctgcacggcaagcccgacaaaaccctccgattttctctgtgcagtgacaacctggagggaatttccgagggaccatctaaccgctcaaattctgtgtccagtctggatttggaaggggagtcagtatctgagctgggcgcagggccttccgggagtaacggagtggaagctctccagctactggagcacgagcaggcaacaacccaggacaacctggatgacaaactccgtaagttcgaaattcgggatatgatggggctgacggacgaccgcgatataagcgagactgtgagtgaaacctggagcaccgatgtgctgggcagcgacttcgatcccaacatagacgaggataggctgcaggagatcgcaggtgcagcggcagaaaacatgctgggatccctcttatgtctcccagggagtggtagcgtcctgctggacccttgcacagggtccactatcagcgagaccacaagcgaagcttggtccgtggaagttctaccatccgactcagaggctcccgacttgaaacaggaggagaggctccaggagcttgaatcgtgctctggcctcggatctaccagcgatgatactgacgtgcgagaagtgtccagcaggccatcaacccctggactgtcagttgtgagcgggatctcagcaacttctgaagatattcctaataagattgaggaccttcgctctgaatgctcttcggatttcggcggtaaagatagtgtaacaagcccggatatggacgaaatcacgcatggtgcctcagctgtggttcggcctaaagtgcattatgctagaccttcccaccctcctcctgaccctcctatcttagagggggcagttggaggcaatgaagcacgtctgccaaacttcggcagccatgtgcttacgcccgcagagatggaagccttcaagcaaaggcacagttatcctgaaagacttgtccgaagccggtccagcgatatagttagttcagttagaagacccatgagtgatcctagttggaatcggagaccaggcaatgaggagcgcgaacttcctccagctgctgccattggggcaacgtcactggtagctgcaccgcacagtagttcaagctccccctcaaaagactcatctcggggagaaaccgaggaacgaaaagactctgacgacgagaagtctgaccgcaacagaccatggtggcgtaaacgttttgtttccgccatgcccaaagcgcctataccttttcggaagaaagagaagcaggaatag

SEQ ID NO: 225393 - DNA, 2493 bp, Artificial Sequence
  Description of Artificial Sequence: Synthetic coding sequence
tgattgcggaggggaacttgtgcatttagtattctctttaaactgttttccgagggactttttagcgcaaagttgtttttgaccgcgactctgcacgagccgattatgcagctcttagtcgaggacgaagaccatctggaaactgatcctaacaaactgattgagcgcttcagtcccagccaacaggagaaactctttggggagaaagggtccgatcgatttcggcaaaaggtgcaagaaatggtcgagtccaacgaggcaaagcttgtcgcgttggtcaacaaatttataggctatttgaagcagaacacatactgtttcccgcacagcctgcgctggattgtttctcaaatgtacaagaccctgtcatgcgtggatcgcctagaggtgggcgaggtgcgtgccatgtgtactgacctgctcctcgcttgtttcatctgccctgccgtggtaaatccagaacagtacgggatcatatcagatgctcctatcaacgaagtcgccagatttaatctcatgcaggtgggtcgacttttgcagcagctcgctatgacaggatctgaagaaggcgatcctcgcacgaagtcgtctctgggcaaattcgacaagagttgtgtggctgcttttcttgatgttgtgatcggcggaagggccgttgagaccccccctctctcaagcgttaaccttctcgagggactttctcgcaccgtcgtgtatatcacttatagtcagctcatcaccctggtcaacttcatgaagtcagtgatgagcggcgaccaactgagggaggacaggatggccctggacaacttgctggccaacttgcctccggctaagccagggaagtcctcgtctctcgagatgacgccatataacaccccccagctgtcccctgcaaccaccccagctaataagaaaaacagactgcctatcggccagcaacttgctgctatcactgcttgggacagttcagcaaccaatatcacttcccacattacagtggtaaccccctttgcgacccggagtcggtcccggacaaacatgctcatggatctccacatggaccacgaaggaagcagccaggagactatccaggaagtccaaccagaagaggtcctggtgattagtttgggtaccggcccacagctgaccccgggtatgatgtcagaaaacgaggtcctcaatatgcagctctcagatggtgggcaaggcgatgtgccagttgatgagaacaaacttcacggtccaagcaaccggtccaatagcgttagctcactggacctggagggcgagagtgtgtctgagcttggggctgggccatccgggtctaacggcgttgaagccctgcagctgttagagcatgaacaggcaacgacccaggataaccttgacgacaagctacgcaaattcgaaatacgggatatgatggggctcacagatgacagggacattagtgagacagtgtctgaaacatggtcaaccgatgtacttggctcagatttcgaccccaacattgatgaagatcgactgcaggagatcgcaggagccgcagccgagaatatgttggggtccctgctgtgcctacccggaagcggcagtgtgctcctggacccatgcacagggagcacgatctccgagaccacttcggaggcgtggtcagtcgaagtgctgccgtctgactcagaagcccctgatttgaaacaagaagagcgactgcaagagctcgaatcttgttcagggctcggttcaacatcggatgacaccgatgtgcgggaggtatccagtcgtccctctacccctggcctgagtgtcgtgagcggtatttccgccacctccgaggatatccctaataaaatagaagaccttcgcagcgaatgctcttctgatttcggtggaaaggacagcgtgacatctcccgacatggatgagataacccacggagcccatcaacttactagtcctcccagccaatcggagagcttactggctatgttcgacccgctttcatcacatgaaggggctagcgccgtcgtgcggcctaaggtccattatgccaggcctagccaccctcctccagatcctccaattctggaaggggcagtagggggaaatgaggctcgcctccccaattttggatcacacgtgttgacaccagccgaaatggaggcttttaaacagcgtcacagctaccccgagcggttggttagatcccggtcttcggacatcgtttctagtgtccgcaggcctatgtcagatccctcttggaacaggaggcctggcaacgaggaacgagagctccctcccgctgctgccatcggcgctacttcgctggtggccgcaccgcatagttcctcctcttcgcccagcaaggattcttcccgcggagaaactgaagaaagaaaagatagcgatgacgagaaatccgaccggaatcgcccatggtggcgtaaaagattcgtgtccgcaatgcctaaggcccctatcccattctag

SEQ ID NO: 225394 - DNA, 516 bp, Artificial Sequence
  Description of Artificial Sequence: Synthetic coding sequence
atggtccaatggcctcgcatgagttacggaaagacaagggtcatgaaccgcatcttcaagctcgcattctacccgaaccaagatggcgacatcctgcgcgaccaagtcctacatgagcacattcagcgcttatcgaaagttgttacagccaaccaccgggcacttcagatacctgaggtatatctccgagaggctccttggccttccgcacagtctgagattcggaccatttctgcctataaaacccctagagacaaagttcagtgcatcttacgtatgtgcagtactatcatgaatctgttaagcttggctaacgaggactcggttccaggagcagatgacttcgttcccgtgctggtgttcgtacttatcaaagctaaccccccttgcctcctgtccacagtgcagtatatcagtagcttttatgccagctgcttgtcaggcgaggaaagttactggtggatgcagtttaccgccgcagtcgagttcatcaaaacaatagatgaccgcaaatag

SEQ ID NO: 225395 - DNA, 354 bp, Artificial Sequence
  Description of Artificial Sequence: Synthetic coding sequence
atggtcaagctggacatccacaccctggcacatcacctaaagcaggaacgcttatatgtgaacagcgagaagcagctgatccagcggctgaacgccgatgtgctgaaaacagcggaaaagctctaccggactgcatggatcgcgaaacagcaacgcattaacttggaccgcctgataattacctcagccgaagcctcaccagccgagtgttgtcagcacgctaagatattggaagatacacagtttgtggacggatataagcagttaggttttcaggaaaccgcgtacggtgaattcctttcacggttgagagagaatccccgtctaatcgcatcctcactggtagcaggctag

SEQ ID NO: 225396 - DNA, 2967 bp, Artificial Sequence
  Description of Artificial Sequence: Synthetic coding sequence
atggttaagttagacatacataccctcgcacaccacttgaagcaggaaagactttatgtgaattccgagaagcagttaattcagcgcctcaatgcggacgtcctgaagactgccgagaaactgtaccgaaccgcttggatcgcgaaacagcagaggattaacctggatcgccttatcatcacatctgctgaggcctcacccgctgaatgctgccagcacgccaaaatccttgaggatacccagtttgtggacggctacaaacaactaggcttccaagaaacggcctacggcgagttcttaagccggctgagggaaaacccgagactgattgcgagttctttggtagcaggcgagaagcttaatcaggaaaacacacagtcagtcatttacactgtctttacttctttatacgggaactgcatcatgcaggaggacgagtcttatctgcttcaggtcctccgctacctcatagaattcgaattaaaagagagcgacaatcctagacggctcctgcggagaggtacatgcgctttctccattctgtttaaactcttctctgagggactgtttagcgctaaactgttcttgacagcaaccttgcacgaacctattatgcagcttttggtcgaagatgaagaccacctggaaacagatcccaataagctcattgagagattcagtcctagccagcaagagaaactttttggcgaaaaggggagtgatcggttcagacaaaaagtgcaggagatggttgaaagcaatgaggccaagctagtggcactagtaaacaagttcataggatacttgaaacagaacacctactgttttccccacagtctcaggtggatcgtttcacagatgtataaaacactatcttgtgtagaccgcctggaggtaggagaggtgcgcgctatgtgcacagacttactcttggcgtgctttatttgtcccgctgtggttaatcccgaacagtatggaataatttctgacgccccaatcaacgaggttgctagattcaacctcatgcaggtcggcaggttgttgcagcagcttgccatgaccggctctgaggagggcgacccaagaacaaaatccagtctcgggaagttcgacaagtcttgtgtggctgcctttttggacgtggttattggcggaagggcagtcgaaacccccccactgtcttccgtaaacctgctggagggactcagtcgtaccgtcgtgtacatcacctacagtcaattaatcactctggtcaattttatgaaatctgtgatgagcggcgaccagctgagagaagaccgcatggctctggataatttactggcaaatctgcctcccgcaaagcctggtaaaagctcgagcttagaaatgacgccatacaatacaccccagttatctccagctacaacccctgcaaacaagaaaaaccgtcttcccattgctacaaggagccgatctcgcaccaatatgttaatggatctgcacatggaccacgaagggtccagtcaggaaaccatccaagaggtccagcctgaagaggtgttagtgatttctctcggcactggcccacagctgacaccgggaatgatgtctgagaatgaagtcttgaatatgcagctgagcgacggtggtcaaggcgatgtgcccgtggacgaaaataaacttcatggaaagccggacaaaacactcaggttctcactatgtagcgacaatctggaaggcatttctgagggccctagcaatagatctaatagcgtgtcttctctggacctggagggagagtccgtatcggagctaggagcagggccaagtgggtccaatggagtcgaggctttgcagctcttagagcacgagcaggctacgacccaagataatttagacgacaagctgaggaaatttgagataagagacatgatggggctgacagatgacagagacatttccgagacagtttccgagacctggagcactgatgtattgggctctgactttgaccccaatattgacgaggaccgcctgcaggaaattgcgggtgctgcagctgagaacatgctgggatcactgctgtgtctgcccggatcaggttctgtgctgttggacccatgtactggcagtaccatctctgaaacaacaagcgaggcttggtccgtagaggtactgcccagcgactctgaggcacccgatctgaaacaggaggaaagattacaggaactcgagtcatgcagcgggctggggtcaactagcgacgataccgacgtcagagaggtgtcaagtcggccatcaacacccggactcagtgtggttagtggcatcagcgcaacctcagaagacattccgaataagatcgaggatctaagatctgagtgctcttcagatttcggcggtaaagactcagtcaccagccccgacatggacgagataactcatggcgctcaccagctcaccagccctccctcccagagcgagagtttactcgcgatgtttgaccctctttctagtcatgagggtgcatccgcagtggttaggcccaaagtgcactatgccagaccctctcacccacctcctgacccccctatccttgaaggggcagtaggaggcaacgaggccaggctccccaacttcggttcacacgtgctcacgcctgcagaaatggaagcctttaaacagcgccactcctaccctgagcggctggtcagaagccgatccagcgacattgtctcctcagtgcgccgacctatgtctgacccttcatggaataggcgaccgggaaatgaggagagggagcttcccccagccgcagccatcggggctacgtccctggtggccgctccacactctagcagttccagcccctccaaagacagcagtagaggggagaccgaggaaaggaaagatagcgacgatgagaagtccgaccggaataggccctggtggcgtaaaaggtttgtctctgcaatgccaaagtag

SEQ ID NO: 225397 - DNA, 4437 bp, Artificial Sequence
  Description of Artificial Sequence: Synthetic coding sequence
atggtgaagctcgacatccatacgttagcccatcaccttaagcaagaacgcctatacgtgaacagtgaaaaacagctgattcagcgcctgaatgcagacgtgctcaaaactgcggaaaagctttacagaacagcatggattgccaagcagcagcgcataaatctggataggctcataatcacttctgctgaagccagccccgctgagtgttgccagcacgccaagattctggaggacactcagtttgttgatggctacaaacagttgggatttcaggaaaccgcctacggggagttcttatcgcgattaagggagaaccctaggctgatcgcttcaagtctggtggctggggagaaactcaaccaggagaatactcagtccgttatatataccgtcttcacaagcctgtacgggaattgtatcatgcaagaggacgaaagctacctgctgcaagtactaagatatctcatcgagtttgagctgaaagaaagcgataacccacggagacttctgcgaagaggtacctgtgccttctctatcttgttcaaactgttctctgaaggacttttttcggcgaagctttttctgacagctaccctgcatgagccaattatgcaactgctggttgaggatgaggatcaccttgagacggatccgaacaagttaatagaacggttttctcccagtcagcaggagaagcttttcggcgagaaggggagtgatcgcttccgccagaaagtgcaagaaatggtagaatcgaacgaagccaagctggtcgcactggtgaacaagtttatcggatacctgaagcagaacacctactgctttccccacagccttcgatggattgtcagtcaaatgtacaaaacactttcctgtgttgatcggctcgaagttggggaagtgagggctatgtgcactgatctcttgctggcctgttttatttgcccagctgtggtcaatccagagcagtatggcatcatcagcgatgctcccatcaatgaagttgcaaggttcaacctcatgcaggttggcaggttgttacaacaactcgcaatgacgggatccgaggaaggggatccaagaacgaagagcagcctcggaaagttcgacaaatcatgtgtcgctgcattcctggacgtggtcatagggggaagagccgtggaaacccccccactgtcttccgtaaacctgctagagggactgagtagaaccgtggtgtacatcacctattcgcaactaatcacattggttaatttcatgaaatccgttatgagcggcgaccaacttagggaggatcgaatggcactggacaatctcctagcaaacttaccccctgcaaagccaggcaagtcaagctccctcgagatgacaccttacaataccccacaactttcccccgcaacaactcctgccaacaagaaaaacagactccctatcgcgacaagatcaagaagtagaactaatatgttaatggatttacacatggaccatgaaggcagttcacaggaaacgatacaggaagtgcagccagaggaagtgctggttatatcacttggaaccggccctcaactcactccagggatgatgtcggaaaatgaggtgctcaatatgcagctgtctgacggcggacagggcgacgtccctgttgatgagaacaagttgcatggcaaacctgacaaaaccctccgcttttcactttgcagtgataacctggagggaatttcagaaggcccatccaatcggagcaattcagtctcctcactggatttggagggtgaatctgtatctgagctcggtgccggaccttctggcagtaatggagttgaagcactacagttgctcgagcatgaacaggcaacaacccaggacaacctggacgacaagctgaggaaatttgaaatacgtgatatgatgggcttaactgacgaccgcgacatcagcgaaacggtatcggagacctggtctaccgacgttctcggaagcgatttcgatccaaatatagacgaagaccggctgcaggaaattgccggagccgctgcagaaaatatgctgggaagcctgctttgtttaccaggcagcggaagtgtcctgctcgacccttgcacggggagcactatttctgagacaacctccgaggcctggtcagtggaggtactgccaagcgactccgaagctcctgacctaaaacaggaagaaaggctccaggaacttgagagctgcagtggcttaggctcaaccagcgacgacacagacgtgcgcgaggtaagcagcaggccatcaactccaggcctctctgtggtatcaggaatttctgccacaagcgaggacatccccaacaagatagaagatctccgaagcgagtgcagcagcgactttggcggtaaggattccgtgacgtctccagacatggatgagataacccatggtgcgcatcagctgacctcacctccctcccagagcgagagcctcctagcgatgttcgaccctttaagctctcacgaaggcgcaagcgccgttgtccggcctaaggttcactatgccagacctagtcatccgcctcctgatccacccattctggaaggagccgttggcggtaacgaagccagattaccaaacttcggcagtcacgtgttgacccccgcagaaatggaggcttttaaacaacgtcattcctatcctgagcggctggtgcggagccgctcatcagacattgtctccagtgtgcgcaggccaatgtccgacccatcctggaacagaagaccgggaaacgaggagcgcgagctgccgccagcagctgccatcggggctaccagtcttgtcgccgcaccccacagcagttccagctccccctctaaggactcttcaaggggcgaaacagaagagaggaaagactccgacgatgagaaaagtgacaggaaccggccttggtggaggaagaggtttgtgtccgccatgcccaaagcccctatcccgttccgaaaaaaggaaaagcaggagaaggataaggacgacctggggcctgacaggttctccaccctcacagacgatccatcgccccgtctgagtgcacaggcccaggtggctgaggatatcctcgacaaataccgaaacgccatcaagaggacaagcccatctgatggcgcaatggctaactacgagtctacgggcgataatcacgatcgtgacctttccagcaagttgctatatcacagcgataaggaggttatgggcgacggcgagtcggctcatgactctccacgcgacgaggcactacaaaacataagcgctgatgacctcccggacagcgccagccaggccgctcacccccaagactcagctttttcgtatcgcgatgccaagaagaaattacggctcgcactatgttccgcggactctgttgcatttcctgttctgacccactctaccaggaacggcctaccggaccataccgaccctgaggacaacgagatcgtttgcttcctaaaagtccaaatagccgaagccatcaatctgcaagataagaacttaatggcgcaactacaggagacaatgaggtgcgtctgcagattcgataaccgaacttgtcggaaattgctcgcttctatcgccgaggattaccggaagcgggctccatatatcgcatacctaactaggtgtcgtcaaggcctccagacaacacaggctcatctggaacggctgctccagcgcgtgctcagggataaagaagtggccaatagatacttcactacagtgtgcgtgaggctattgcttgagtccaaagaaaaaaagattcgggagttcattcaggactttcagaaacttacagccgctgatgataagacagcacaagtcgaagatttccttcagttcctgtatggggctatggcacaggacgtcatctggcaaaacgcaagcgaggaacagttgcaggacgcacagctcgcaattgagcgcagcgtgatgaatcgtatttttaagctggctttttatcctaaccaggatggggatatattgagagaccaggtcctccacgagcatattcaaagactctctaaggtggtcacagccaatcaccgagctctccagatccctgaagtttatctgagggaggctccgtggccatctgcccagtcagaaatcagaaccattagcgcttataaaactccaagggacaaagtgcagtgtattctgcgcatgtgctccacaatcatgaacctcctttctctggccaatgaggactccgtgcctggggctgacgacttcgtaccggtcttagtcttcgtgctgattaaagcaaaccctccatgcttgctctcaactgttcagtacatcagctcattttatgccagctgtctcagtggggaagagtcctattggtggatgcaatttaccgccgctgtcgaattcatcaaaaccatcgatgacaggaagtag

SEQ ID NO: 225398 - DNA, 2271 bp, Artificial Sequence
  Description of Artificial Sequence: Synthetic coding sequence
atggtgaagctcgatatccacactttagcgcaccatctgaaacaagaacggctgtacgtgaacagcgagaaacagcttattcagagattaaacgcggatgtgctgaaaacagcagaaaaactgtaccgcaccgcatggatcgccaaacagcagcggataaacctcgaccggctaattatcacctcagccgaagcttctcccgctgagtgttgtcagcacgccaagatactggaggacacacagttcgttgatggatataaacagctgggcttccaagagaccgcttacggcgaattcctctcacggctgcgggaaaaccctcggttgattgcatccagtctagtggcgggagagaaactaaaccaggaaaatactcagtccgtaatttataccgtgttcacatccctttatggcaattgcatcatgcaagaagatgagagctacttactccaggtccttcgatacctgattgaatttgagcttaaagagtccgataaccctagaagactgctgcgcagaggaacatgcgcctttagcatattattcaagctattttctgaagggttattcagcgccaagctgtttttgacagcgaccctgcacgaacccattatgcaactgctcgtggaagatgaagatcacctagagacagaccctaacaaactaatcgagcgattcagtccttcccagcaggaaaagctgttcggggaaaagggctcagacaggtttcgccagaaagttcaggagatggtggagagcaacgaggcgaagctggtagcactggtgaataagtttattgggtatctcaagcaaaatacttattgtttccctcacagcctgcggtggattgtgagccagatgtataaaaccctgtcttgcgtcgacaggctggaggtcggcgaggtgcgggctatgtgcaccgacctgctactcgcctgtttcatctgccccgctgtagtcaacccagagcagtatgggatcatcagcgatgctcccatcaatgaggtagcaagatttaacctgatgcaggtcggtcgacttttacagcaactagccatgaccggttcagaagagggcgatcctaggacaaagagtagcctcggtaagtttgataagtcttgtgtggccgcttttcttgacgttgttattggaggcagggcggtggagacgccgccattgtccagcgtgaatttgctggaaggactgtccaggacagtggtgtacattacttactcccagctgataacactggtcaactttatgaagagtgtcatgtccggcgatcagctgcgtgaggaccgaatggcgctggacaacctgctggctaatcttccacccgcaaaacccggaaaaagttcctccctggaaatgaccccctacaatacaccgcagttgagcccagccaccaccccagccaataagaaaaatcggttacccatcgctacccgatcaagaagccggactaatatgttaatggatctgcatatggatcatgaggggagctcacaggaaacgattcaggaggtgcagcccgaagaagtgctagtgatctcccttgggaccggccctcagctgacccccggaatgatgagcgagaatgaagtgctgaatatgcagctgagcgacggaggtcagggagacgtgcctgtggatgaaaacaaactgcatgggaagcccgacaagaccctaaggttttctctgtgcagcgataacctggaaggcatctctgagggaccgagtaatcgctcaaactccgtatccagtctggatttagaaggagagagcgtctctgagttaggggctggtccaagtgggtctaatggggtcgaagcccttcaactgctcgagcatgaacaagcgacgacccaggacaatctggacgacaagttgcgaaaattcgagataagggatatgatggggttgaccgacgatagagatatcagcgaaaccgtctctgagacctggagcaccgacgtactcgggagcgacttcgacccaaacattgacgaggataggctgcaagagatcgcgggagctgccgcagagaacatgctcgggtcccttttgtgcctcccaggatctggctctgtcttactggatccgtgcaccggctctaccatcagtgaaaccacctccgaggcctggtccgtggaggtactgccttctgattccgaggctccagatctgaagcaagaagaacggttacaggagctggagagctgcagcgggctgggcagtacttctgacgataccgacgtgagagaggcatag

SEQ ID NO: 225399 - DNA, 921 bp, Artificial Sequence
  Description of Artificial Sequence: Synthetic coding sequence
atgggcggtcgtaaaatggctaccgacgaggagaatgtttatgggttagaagagaacgctcagtccagacaggagagcacgaggaggctgattctggtcggcaggactggtgccggaaagtcagctaccggaaacagtatcctggggcagcgcaggttcttcagtcgtctcggagccacctctgtgacaagagcatgcacaacggggtcgcgacgatgggacaaatgccacgtcgaagtagtagatacaccagatatcttttcttctcaagtgtccaagactgatcccggttgcgaggaacggggtcactgctacctgctttccgcacctggaccacacgcattactgttggtaacacagctggggaggttcaccgcacaggaccagcaagcagtccggcaggttcgcgatatgttcggggaggacgtactcaaatggatggtcattgtctttacccgcaaggaggatttggccggtggaagcttacatgattatgtaagcaacacagagaatcgggctcttagggagctcgtggccgagtgtggaggaagagtgtgtgcatttgataaccgcgcaacgggccgtgaacaagaagcccaggtagaacagctgcttgggatggtggaaggcctggtgctggagcataaaggcgcacattattcaaatgaggtttacgaattagcacaggtcctgcgatgggcgggtcccgaggagcgattacgacgcgttgccgagagggtcgctgcaagagtccagaggcggccttggggggcatggctaagcgcacggctgtggaaatggctgaagagtcctcggtcttggagacttgggctcgctttattgctgggcggagctctgttgttctgggttcttctccatcggcgatggagcgaagccgtggctgaagtggggcctgactag

SEQ ID NO: 225400 - DNA, 681 bp, Artificial Sequence
  Description of Artificial Sequence: Synthetic coding sequence
atgtcctgggttcaggccgcttcgcttattcagggcccaggcgataagggcgacgtgttcgacgaagaggcagacgaatcactgctggctcaaagggaatggcagtcaaacatgcagcggagggtgaaggagggatatagggacggaatagacgccggaaaggccgtcacactccagcagggcttcaatcagggatacaaaaaaggggctgaagtgattctgaactacggcaggctgcgcggaacattaagtgcattgctttcttggtgtcacctgcacaataacaattccacgctgatcaacaagattaacaatcttctcgatgcagtcggtcagtgtgaggaatacgtcctgaagcatctaaagagtatcacccctccgagtcacgttgtggacctcctggactccatcgaagacatggatttgtgccacgtggttcccgctgagaagaaaatcgacgaggccaaggatgagcgactgtgcgaaaacaatgctgagtttaataaaaattgttctaagtctcacagcggaatcgattgcagttatgttgaatgctgtagaactcaggagcatgctcactccgagaacccgtcccctacttggattctggagcagaccgctagccttgtgaaacagctgggactcagtgtcgatgttctgcagcaccttaaacagctgtag

SEQ ID NO: 225401 - DNA, 990 bp, Artificial Sequence
  Description of Artificial Sequence: Synthetic coding sequence
atggccgcacaatatggcagtatgtccttcaatccgagtacccctggcgcaagttacggcccagggaggcaggagcctaggaattcgcagttgaggatcgtcttggtagggaaaacaggcgcaggcaaaagcgcgacaggaaatagcattttgggccgtaaggtgttccactctgggactgccgcaaaatctatcaccaagaaatgcgagaagcggtcctcaagctggaaggaaacagagctcgtagtcgtagacactccaggaatttttgatactgaggtgcctaacgccgaaacaagtaaagagataattagatgtatattactaacgtccccaggaccacacgctctgctcttagtcgtgcccctgggcaggtataccgaggaggagcacaaagccacagagaagatactaaagatgtttggcgagagagcgcgatcgttcatgattctaatttttacaagaaaggatgatctgggggacactaatcttcacgattacctcagagaagccccagaggacatacaggatcttatggacatatttggcgatcggtattgcgcactgaataataaagccacaggagctgagcaggaggcccaacgcgcacagcttttgggcttgattcagcgggtggtgcgggaaaacaaggaaggctgctacaccaaccggatgtaccaaagggcagaggaggagatccagaaacagacacaggcaatgcaggagttgcatcgcgtagagcttgagcgggagaaagcacggatcagggaggagtacgaggagaaaatccggaaactggaggataaggtggaacaagaaaaaagaaagaaacagatggagaaaaaactggctgagcaggaggcccattacgcagtccgccaacaaagagctaggactgaagtggagtcaaaagatgggatactggaacttataatgacagcgctccagatcgccagctttatcctccttcggctcttcgctgaggattag

SEQ ID NO: 225402 - DNA, 786 bp, Artificial Sequence
  Description of Artificial Sequence: Synthetic coding sequence
atggcagcccaatatgggtctatgtccttcaacccttcaacccccggagcatcgtacggccctggacgtcaggagcccaggaacagtcaactccggatagtactagtgggcaaaacaggggctggtaagtccgcaacagggaacagtatcctgggacggaaagttttccatagtggaaccgcagctaagtctatcaccaagaagatcctgaagatgttcggcgagcgcgctaggtccttcatgattctcatctttactcgcaaggatgatttgggcgacacaaatcttcacgactacttaagggaggctccggaggacattcaggatctgatggacatttttggcgacagatactgtgccctgaataataaggccacaggggctgaacaagaggcacaaagggctcaactgctcggcctcatccagcgcgttgtgcgagagaacaaggagggttgctataccaacagaatgtaccagagggccgaagaggaaattcagaaacaaacgcaagcaatgcaggaactccaccgcgtggaactggagagggagaaggctcgaattagggaagagtacgaagagaaaattcggaagctggaggacaaggtcgagcaggaaaagcgcaagaagcaaatggagaaaaaattagccgaacaggaagctcattacgccgttaggcaacagcgggcacggacagaggtagagagcaaagatggcatccttgagttgattatgaccgctctgcagatcgccagtttcattctgttgcggctgttcgccgaggactag

SEQ ID NO: 225403 - DNA, 456 bp, Artificial Sequence
  Description of Artificial Sequence: Synthetic coding sequence
atggctgctcagtacgggtccatgtcatttaaccccagtacccccggtgcaagttatggtgagcgcgctttttctgccccacagacacgtttgcaggggggaccaggccgacaggaacccaggaattcacaacttagaattgtgctggtcggcaaaacaggtgcagggaagtcggcgacaggaaactccatcttaggaagaaaggtgttccacagcggaaccgccgctaagagcatcactaaaaaatgtgagaaacgttcatcctcctggaaagagactgagcttgtcgttgtcgatacacctggaattttcgacaccgaggtcccaaatgctgagaccagtaaggagattatcagatgcatcctgcttacctctccgggaccacacgccttgttactcgtggtccccctgggcagatacaccgaagaagagcacaaagccacagaaaaaatctag

SEQ ID NO: 225404 - DNA, 924 bp, Artificial Sequence
  Description of Artificial Sequence: Synthetic coding sequence
atgggaggcttccagcggggaaaatacggtactatggctgaggggaggtctgaggataacctcagcgcaacgccacctgcattgaggatcatcctggtaggcaagaccggctgtggaaaaagcgcaacgggtaacagcatcctaggacagcccgtgttcgaatctaaattgcgagcacagagcgtgacccggacgtgtcaggtcaaaaccggcacttggaacggccgtaaggtgttggtcgtggatacaccttctatttttgaatcacaggccgacacacaggaactgtacaaaaacattggagattgttacctgctgtccgcccctggaccacacgtcttgttactggtcatccagttgggaaggttcactgcgcaagatacagtcgcgattcgaaaggtgaaagaggtgtttggcacgggcgcaatgagacatgtggtaattctttttacacacaaggaggacctgggtgggcaggctctggatgactatgtggcgaacactgataactgtagcctgaaggatttggtaagggagtgcgagcgacggtactgcgcctttaataactggggaagcgtcgaagagcagaggcagcagcaggccgagctactcgcggtaatagagagactcggtagggagcgggagggctccttccacagcaatgatctttttctggatgcacagttattacaaaggactggcgcaggcgcttgccaggaagattatcggcaatatcaggcaaaagtggagtggcaggttgaaaaacataagcaggaactccgtgagaacgaatccaattgggcctacaaggccctgctgcgcgtgaagcacttaatgttattgcattatgaaatatttgtattcctccttctgtgtagcattttatttttcataatattcctcttcattttccactatatatag

SEQ ID NO: 225405 - DNA, 1032 bp, Artificial Sequence
  Description of Artificial Sequence: Synthetic coding sequence
atggagctgagtgcacccgctcatggaagctctctgacagcctccgcgcagccaccctctgttaccgctaccttggaagatcgggctcagcaacccttcctcgagagaatggggggtttccagcgcggaaagtatgggaccatggcagaaggacggtccgaggacaatcttagcgcaacccctcccgctctaagaataatcttggttggtaagacaggctgtggcaagtccgccactggcaattccattttaggtcagcccgtgttcgagagcaagctgcgtgctcagtccgtcactcggacctgccaggttaagactggcacttggaatggtcggaaagtgctggtagtcgacaccccttctatcttcgagtctcaggcagatacccaggagctctataaaaatataggcgattgttaccttctctccgctcccggtccacacgtgctccttttggtgatccagttagggagatttacagcccaggatacagtggctatcaggaaagtcaaggaagtttttggcaccggcgctatgcgccacgtggtaattttgtttacccacaaagaggacctcggcggtcaggcactcgacgattacgtggcaaacaccgacaactgttctctcaaggacctggtgcgcgagtgtgagcgccgttactgtgcttttaacaactgggggtctgtcgaggagcagcgccagcagcaggctgaattgctcgccgtgatcgagcgactgggtagagaaagagaaggttcatttcatagtaatgatctctttctggatgcacaattactccagcgcacaggagccggagcctgtcaggaggattacagacagtatcaagccaaggtggaatggcaggtcgagaaacacaaacaggagctgagggagaatgagtctaactgggcatataaggccctcctaagggtaaagcaccttatgctgcttcattatgagatttttgtgtttctacttttgtgctcgattctgttctttataattttcctctttatcttccactatatttag

SEQ ID NO: 225406 - DNA, 879 bp, Artificial Sequence
  Description of Artificial Sequence: Synthetic coding sequence
atggaggaggaggaatatgagcagatacctcaggaaaatcccccagaggaactctcgcaagaccccgtgcttgaactgtccggcggtttgagggaaaaagaacagaagacaccgaggcgcctcaggttgatcctgatgggcaaaacagggtcgggcaagtcagcgacaggaaactccatacttggcagggatgtctttgagtcaaaactgtccaccaggccagttacaaagacgtcacagcgcagaagtcgagagtgggcaggaaaggagcttgaagtcattgatactcccaatatcttgagccctcaggtgagccctgaggtggctgacgcgatatgtcaggccatagtgttgtccgctccaggcccacatgctgtgctcctggtcacgcagctggggaggttcaccgatgaggatcaacaggtggtgcgccgtttgcaggaagtgttcggcgtgggcgtcttaggtcacactatcctggtattcacacggaaggaagatctggcagggggttctcttgaggattacgtcagggagactaataatcaagccctggcctggctcgacgtgaccctggcaaggcggcattgtggttttaataaccgtgctcagggtgaagaacaggaagcccagcttagagaactaatggaaaaagtggaagcgatcatgtgggagaatgaaggcgactattactctaacaaggcctatcaatatacacagcagaatttccgtctgaaggaattgcaggagcggcaggtctcccagggccagggctccgaagatgtaccaggtgaggagagctggctcgagggcctgagccagattcagaaggagagcgaagaggctcatcgctgtcttctgggcaaagctgatctgtag

SEQ ID NO: 225407 - DNA, 1062 bp, Artificial Sequence
  Description of Artificial Sequence: Synthetic coding sequence
aaaccatggtactgggtgtcgtggtgctcaattgggcaggtttccctcttcttccttggatccgccctggcattaggcgagaacgtgcaaccgcatttacaaggttgcggcccacggatggtggctcagcgctggtttcaggggagatgttggtcctttaccatatgcccctgtagcctgggggtgcatccagaagcacctggcgatgataagatgggctacatgggtccctacccctctagtctttgtttcttgtggattttcctgggcctgcgtgaaaaggaacagaaaactcccaggcgactccgactgatcttgatgggtaagacagggtctggcaagagtgccacagggaatagtattctggggcgtgacgtgtttgaaagcaagctgagcacccgacccgtgacaaaaacttcccaaaggcggagcagagagtgggctggtaaggagctggaggtcatagacacaccaaatatactcagtcctcaggtgtcaccggaggtggctgatgccatctgtcaggcaatagtcctgtcagccccagggcctcacgctgttctgcttgtgacacagctgggaagatttacagatgaggaccagcaagttgtgcggcgtctccaggaggtatttggggtgggcgtgctgggccacacaatcttggtatttacccgtaaggaggatctggcaggagggagtctggaagactacgtgcgagagactaacaaccaggctctggcatggctcgatgtcacactggcacggaggcactgcggttttaacaaccgtgctcagggcgaggaacaggaagcacagctccgagagcttatggaaaaggtggaagccataatgtgggaaaatgaaggagattactactcaaacaaagcctaccagtatacccagcagaattttcgcctgaaagaattgcaggaacggcaggtgtctcagggccagggtagtgaggacgttcccggagaggagagctggctggaggggctatctcagatccaaaaagagtccgaggaggcgcatcgctgcctgctgggtaaggcagacctctag

SEQ ID NO: 225408 - DNA, 189 bp, Artificial Sequence
  Description of Artificial Sequence: Synthetic coding sequence
atggaagaggaggaatacgagcagatacctcaggaaaaccccccagaagaattgagtcaggatcccgttctggagttatccgggggattagccaggggcggaaggcgctatctgccttcgcatcgccttatccgcccacgcgctccacgaagggcacccggtgacactactgggcctgtacatggctag

SEQ ID NO: 225409 - DNA, 1266 bp, Artificial Sequence
  Description of Artificial Sequence: Synthetic coding sequence
atgcgatggattctgttcatcggggcactgatagggtcaagcatttgcggccaggagaagttcttcggcgaccaagtgctcagaattaatgtgaggaacggtgacgaaatcagtaaactgtcccagctggtgaacagcaacaacttgaaattgaacttctggaaatcccctagtagctttaacaggcccgtggatgttctcgttccctcagtgtctctccaagcatttaagagctttttacgctcacaaggcctggagtacgccgtcacgatcgaggatctgcaggccctattagataacgaggatgacgagatgcagcataatgaaggccaggagcgcagtagcaataatttcaactatggagcctatcatagcctggaggctatttaccacgaaatggataacatcgctgccgattttcctgacctcgcgaggcgcgtgaaaattggacacagttttgaaaaccgccctatgtacgttctcaaatttagtactgggaaaggggtgcggagacccgctgtgtggttgaatgccggtattcactctagggaatggatctcccaagccacagcaatttggactgctcgtaaaatcgtgtccgactatcagcgagatccagcgatcacttctattctggagaaaatggacatcttcctcttgccggtagccaatccggatggctacgtgtacacccagacccagaaccggctctggcggaaaacacggagcaggaatcctgggtcaagttgcattggtgccgaccccaaccggaattggaacgcctcgtttgccggaaagggagccagcgataacccgtgtagcgaggtgtaccacgggccacatgctaactccgaggtggaggtgaaaagcgtggtagactttatccagaaacacggaaacttcaaaggcttcattgacctccactcctattcccagctgttaatgtacccttatggttactctgttaagaaggcccctgatgccgaagagctggacaaggtggcccgactggccgctaaagccctggcttctgtgtctggaactgagtatcaggttggaccgacctgtaccactgtctaccccgctagcggctcttcaatcgactgggcatacgataacggcatcaagttcgcctttacttttgagttacgtgataccggcacgtatggctttcttctgccagcaaatcagatcatccccacagccgaggaaacctggctgggactgaaaacaataatggaacacgtgcgggataacttgtattag

SEQ ID NO: 225410 - DNA, 927 bp, Artificial Sequence
  Description of Artificial Sequence: Synthetic coding sequence
atggtgcactgttcgtgtgtgcttttccgcaaatacggaaacttcattgacaaactgcgcctgttcacccggggaggcagcggcggtatggggtacccccgtttggggggagaggggggaaaaggaggcgatgtttgggtggttgctcagaatcggatgacccttaaacagctcaaggatcgctatcctcgcaaacgcttcgtggcaggtgtaggagcaaatagcaagttccccaacgcaggaaaatcctcactgctctcttgtgtcagtcatgctaaaccggcaattgccgattacgcttttaccactttgaagcctgagctcggcaagattatgtacagtgattttaaacagatctcagtcgcagacctgcctggcctcatcgagggagcgcacatgaataaggggatgggccacaagtttttaaagcacatcgaacgcactcggcagctcctttttgttgtggatatcagtggatttcaactgtcgtcgcacacccagtacaggaccgcatttgagacaattattctgctgaccaaggaattggaactatacaaagaagaactgcagactaagcctgcactactggctgtaaataaaatggatctaccagacgcccaagataagttccatgagctgatgtctcagctgcagaaccccaaagatttcctccacttgtttgagaaaaatatgatccctgaacggacagtggagttccaacacattattccgatttccgctgtcaccggcgagggcatcgaagaactcaagaactgtatccgcaaatccctcgatgagcaggctaatcaagaaaacgacgcgctccacaagaaacagctgctcaacctgtggatctcagatacgatgagtagtacagaacccccttccaaacacgccgtgacaaccagcaaaatggatattatctag

SEQ ID NO: 225411 - DNA, 711 bp, Artificial Sequence
  Description of Artificial Sequence: Synthetic coding sequence
atgtctgcaccctctgccaccccaatattcgctccaggggagaattgcagccccgcttggggggcagctccagcagcctatgacgccgctgatacccacctgagaattcttggtaaacccgtcatggaacggtgggagacaccttacatgcatgctctcgccgctgctgcgagttccaaggggggaagggtgctcgaagttgggttcggcatggcaatcgccgcatctaaggttcaggaagcacccatcgatgaacattggattatcgaatgcaatgacggcgtgtttcagcgcctcagagattgggctccccgacagacacataaggtcattcccttaaagggtctgtgggaagatgtggcgcctaccctgcccgatggccatttcgatgggatcctgtacgatacttaccccctgtcagaagagacctggcacacccaccagtttaactttattaagaaccacgcctttagactccttaagcctggcggagtcctgacatattgcaacctcacatcctggggggagctcatgaagtcgaagtatagcgatatcaccattatgttcgaggagactcaggtgcctgcgcttctggaagccggttttcgtcgagaaaacattagaacggaggttatggccctggttccacctgccgattgccgttattacgccttccctcaaatgataactccactggtgacaaaaggctag

SEQ ID NO: 225412 - DNA, 810 bp, Artificial Sequence
  Description of Artificial Sequence: Synthetic coding sequence
atgagcgctcctagcgccacccccatttttgctcctggcgaaaattgctcccccgcatggggcgcagctcctgcagcttacgacgcagcagatacacatctcagaatcttaggcaaacctgtcatggagcgatgggaaacgccctatatgcatgcacttgcagccgctgctagcagtaagggcggaagagttcttgaggttggatttgggatggcaatcgcagcctccaaagtgcaggaggcaccgatcgatgagcattggatcattgagtgtaacgacggcgtctttcagcgcctcagagattgggctccacgccagacccataaggtcatccccctaaagggcctgtgggaggatgtggctcccaccctccccgatggacacttcgacggtatcttgtacgacacataccccctgagtgaggagacgtggcatacccaccagtttaactttattaagaatcatgcttttagactcctgaagcccggtggtgtgctaacgtattgtaatttgacttcatggggagagctaatgaaatctaaatactcggatataacaatcatgttcgaagtacgaccccctgaagtgcctcatgggagtcccggttccgacctaggttggggatgggagggggcagccggtgccactctgctgcctggcgagggacccttcctcacaccgtgggtgggatggaccgttctcgtccatcttgaaattaaggtgctgtgtctggcacagtggctgcccggagcagtcgcacaggtgtataatccatccactgttgagggacgcggaggccagatcgcctag

SEQ ID NO: 225413 - DNA, 1416 bp, Artificial Sequence
  Description of Artificial Sequence: Synthetic coding sequence
atgtgtgctgctcagatgccccctctggcccacatttttcgtggcactttcgtccattctacttggacatgccctatggaggtgctgcgggatcacctcttgggcgtaagtgactctgggaaaatcgtctttctggaagaagccagccagcaggaaaaactggctaaagagtggtgtttcaaaccctgtgagattagagaactgtctcaccatgagttcttcatgcccggactggtagatacacacatacacgctagccagtactcctttgccggaagttccattgatctaccacttctggaatggctgacaaaatatactttcccagctgagcatagattccagaacattgacttcgcagaggaggtctataccagggttgtgaggagaacgctaaaaaatgggactacaacagcctgctacttcgcaactattcacacggatagcagcttgctgctcgctgacataaccgacaagttcgggcaacgggcatttgtcggcaaggtgtgtatggaccttaacgacacatttccggaatataaggaaaccaccgaggagtcaatcaaggaaactgagcggtttgtgtcggagatgcttcagaaaaactatagtcgggttaaacccatcgtgacccccaggtttagtctatcctgtagcgaaaccttgatgggcgagctgggtaatattgccaagacccgcgatctccacattcagtctcacatctccgagaatagagatgaggtcgaggctgtcaaaaacctgtatccctcctataaaaactacacatccgtctacgacaaaaataaccttctgacaaacaaaactgtgatggcacatggctgttatttaagcgctgaagagttgaacgtcttccatgaaagaggggctagcatcgctcactgtccaaactcaaacttaagtctttcgtcaggctttttgaatgtgttagaagtgttgaaacacgaggtgaaaattggcttggggactgacgtcgctggcggttatagttacagtatgcttgacgcaatccgccgagccgttatggtttcaaacatccttctaatcaataaagttaacgagaagtctctgacactgaaagaggtctttaggctggcaaccctgggtggaagtcaggccctgggccttgatggcgaaatcgggaactttgaagtcggcaaagagttcgacgccattcttattaaccctaaggcaagcgactcccctatcgacttgttctatggcgacttctttggcgacataagtgaggctgtgattcaaaaattcctgtatctgggcgatgaccgaaatattgaggaagtgtacgtgggcggaaaacaggtggtgccattttcaagttccgtgaaggagactatccatctaccggcttcctccccccatccccctccctttccatag

SEQ ID NO: 225414 - DNA, 1365 bp, Artificial Sequence
  Description of Artificial Sequence: Synthetic coding sequence
atgtgcgccgctcagatgccgccactggctcacattttccgtggcacgtttgtgcattctacctggacgtgcccaatggaggtactgcgggatcatctgctgggcgtctctgactcgggaaaaatagtttttttggaagaggccagtcagcaggagaaactggcaaaggaatggtgttttaaaccttgtgaaattagggagctgagtcatcatgagttttttatgcctgggctagtggacacccatattcacgcctcgcaatactccttcgcaggaagctccatcgacctgccacttcttgaatggcttacaaaatacacttttccggcagaacaccgattccaaaacatcgacttcgcagaagaagtgtatacacgggtcgtgcggagaacactcaagaatggaaccaccacggcatgctatttcgccaccatccacaccgattccagtttgctcttagcggatatcacagataagttcggtcaaagggctttcgtgggcaaggtttgcatggatttgaacgacaccttccccgaatacaaagagactactgaagagtccattaaggagacggagcgctttgtgagtgagatgttgcaaaagaattattcacgcgtgaaacccattgtgaccccgcgtttctccctctcttgcagcgagacattaatgggagaacttggcaacatcgctaaaacacgggatctacatattcagtcacacattagcgagaaccgagacgaagttgaggccgtcaagaatctgtatcctagctacaagaattatacgagcgtgtacgataagaacaatctgttaacaaataagaccgtaatggcccatggctgttacctgtccgccgaggagctcaacgttttccacgaaagaggtgcctccatagcccattgcccaaattctaatctgtccctgtcctctggatttcttaatgtactggaagtactcaagcatgaagtaaagattggcttagggactgacgttgcagggggatactcgtactccatgcttgatgcgatccgccgtgctgtgatggtgagcaatatattacttattaataaggtcaatgaaaagagcctcacactgaaagaagtgttccggctggccacactgggcggtagtcaagcccttggcctggatggggaaatcggcaacttcgaggtaggcaaggaatttgacgctatactaatcaaccccaaggcttcagattccccaatcgacctcttttatggagacttcttcggagacataagcgaggccgtaattcagaagtttctttacctgggggatgatcgtaacatcgaggaagtgtacgtgggagggaaacaggtggttccatttagttccagcgtttag

SEQ ID NO: 225415 - DNA, 1182 bp, Artificial Sequence
  Description of Artificial Sequence: Synthetic coding sequence
atgtttttagaggaggcaagtcaacaggagaagttggctaaagaatggtgtttcaagccctgcgaaatacgggagctgtcgcatcatgaatttttcatgcctggcctggtggacacacacatccatgcttcccagtatagcttcgcgggttcgtccatcgatctccccctattggaatggctgacgaagtacaccttcccagctgagcaccggttccagaacatagactttgccgaggaggtgtacactcgggttgtcaggcgcactctgaagaatggcactacaaccgcctgttatttcgccacaattcacacagacagtagcctccttctggctgatattacagacaaatttggccagcgcgcatttgtggggaaagtctgcatggacctgaatgacacttttcccgagtacaaagagactacagaggagagtattaaagagactgagaggtttgtatccgaaatgttgcagaagaactcgcatattagcgagaatagggacgaggtggaggccgtgaaaaatttgtatccaagctacaagaactacacttctgtatacgataagaataacctgcttactaacaaaacagtgatggcccacggatgttacctcagtgcggaggaactgaacgttttccacgaaagaggggcttccatagcccattgcccgaacagcaatctgagcctgtcaagtggctttctgaatgtgttagaagtcctgaagcacgaggtaaaaattggactgggaaccgacgtggcagggggatattcttactctatgcttgatgccattcggcgagctgtgatggtgtccaacattctgctcattaacaaggtcaacgaaaagagtctgactctcaaagaggtattccggctggccactctagggggttcgcaggccctcgggcttgacggggaaatcggcaattttgaggtcggtaaagaatttgatgctatactgataaatcccaaggcctcagatagccccatcgacctgttctatggcgacttttttggggacatctctgaagcagtgatacaaaaatttctctatctgggggacgaccggaatatcgaagaggtgtatgtcggtggtaagcaggtggtgcccttcagctcctccgtgaaagagactatccacctgcccgcttcatctccacatcctccccctttcccgtag

SEQ ID NO: 225416 - DNA, 1233 bp, Artificial Sequence
  Description of Artificial Sequence: Synthetic coding sequence
atggaagtactgcgagaccacctgctaggagtatctgactcgggaaagatagtttttctggaggaagcgtcccagcaagaaaaactagcaaaagaatggtgttttaaaccctgcgagattagagagttaagccaccatgaatttttcatgcccggtctggtagacacgcacatccacgcaagccagtactcatttgctggctctagcattgatctgcccctattggaatggctgactaaatatacattccctgcagagcaccggtttcagaacattgactttgccgaagaggtctatacccgtgtagtgagaagaacccttaaaaacggaaccaccaccgcatgttatttcgccaccatccacacagactcgagtttactgctggccgacattacagataaatttggacaaagagcgttcgtgggtaaagtgtgtatggatctgaacgacaccttcccggagtacaaagaaaccactgaggagagcatcaaagagaccgaacgatttgtatccgagatgctgcagaaaaatagtcacatttcagaaaaccgggacgaagtcgaagctgttaaaaatctgtatccctcttataaaaattacacaagcgtttacgataagaacaatcttctgaccaataaaactgttatggcccatggctgctacctgtcagccgaggagctcaacgtatttcatgagaggggcgctagtatcgctcattgcccaaatagcaatttgtctcttagttcgggattcctaaatgtcctcgaggttttgaaacacgaggtgaaaatcggtcttggaactgatgtagcaggagggtattcatacagtatgttggatgccatacgacgagccgtgatggtcagtaacatattactgattaacaaggttaatgagaaatctctgacgctgaaagaagtgtttcggcttgcaacacttggaggctcccaggcattaggactagatggcgagatcgggaatttcgaggtcgggaaagaatttgacgctattctgattaatccgaaagcaagtgactcaccaattgacctcttctacggggactttttcggagatatatcggaggctgtcatccagaagtttctatatctgggagacgataggaatatcgaggaagtctacgtgggcggaaagcaggtggttccgttctcatccagcgtcaaagagactatccacctaccagctagttcccctcatcctcctcccttcccttag

SEQ ID NO: 225417 - DNA, 588 bp, Artificial Sequence
  Description of Artificial Sequence: Synthetic coding sequence
atgaccttgttccagaacactcggcgacccctgagaaatagatccaggaagctgagggactgtcacagtgtgactcaggccggagttcagtggcgagatctgtccagcctgaagccaccccctccggtatttaagcgattctcctgcctgagtctgccgagctcttgggactatcgatttgttagcgaaatgttgcaaaagaactactccagagtgaagcccattgtgaccccacgctttagtttgtcctgctccgagactctgatgggagagttagggaatatcgcgaaaacccgagacctccacatccagtcacacatatccgagaaccgcgatgaggtggaagccgtgaaaaatctctatccctcatataaaaattatacatcggtctacgataagaacaacctgctgacgaataagactgtgatggcccatggttgctatctgagtgcggaggagctgaatgtgtttcacgagcggggagccagcattgcgcattgtcctaactccaacctgagcctcagctccggctttctgaacgtccttgaagtactgaagcacgaggttaagatcggactgggaacctag

SEQ ID NO: 225418 - DNA, 540 bp, Artificial Sequence
  Description of Artificial Sequence: Synthetic coding sequence
gagcgcggtgcttctattgcacactgtcctaattctaacttgtctttgagctccggcttcctgaatgtgctcgaggtgcttaagcacgaagttaaaatcggattgggcaccgatgtggccggtggctattcttattcaatgctggacgcaataaggcgggctgtaatggtgtctaacattctgctcataaataaagttaatgaaaaaagtctgacccttaaggaagtgttcagactggccactttgggtgggtctcaggctctcggtctggatggagaaattggtaactttgaggtaggtaaagaatttgatgcgatcctgatcaacccaaaggccagtgactccccaattgatcttttttacggggacttttttggtgacatctcagaggctgtgatacagaagtttctgtatctgggcgatgatagaaacatcgaagaagtctacgtcggcggaaaacaggtggtgcccttttccagctcggtgaaagagactattcaccttccagcgtcgagccctcatccaccaccttttccctag

SEQ ID NO: 225419 - DNA, 1365 bp, Artificial Sequence
  Description of Artificial Sequence: Synthetic coding sequence
atgtgcgccgcacagatgccaccactggcacacatctttcgcggaacattcgtccatagcacctggacgtgtcccatggaggtcttgcgagatcatctgctgggagtttcagacagcgggaagatcgtcttcttggaagaagctagccagcaggagaaactcgcaaaagaatggtgtttcaagccgtgcgagattagagaattgagccaccatgagttctttatgcctggcctcgtggatacgcatatccacgcatctcaatattccttcgctggcagcagcatcgacctgccgttactggaatggcttactaaatacaccttccctgccgagcacagattccagaatatcgacttcgctgaggaagtatatactagagtggtcaggcggacactgaagaacggcactacaacagcctgttactttgcgacgatacatactgattcctcgctgcttcttgccgatatcactgataaattcgggcagagggcttttgtggggaaggtatgtatggatctgaatgatacttttcctgagtacaaagaaaccacggaggagtcgataaaggaaactgaacgcttcgtgagtgagatgttgcagaaaaactactcgagagtcaagcccattgttacaccgcgattcagcctgtcatgcagtgaaactctgatgggggagttggggaacatcgcaaagactcgcgatttacatatccagtcccacatctccgagaaccgggacgaagtcgaggcggtgaaaaatctgtacccgagctataagaattatacaagcgtgtatgacaagaacaatctccttactaataagacagtaatggcccatggctgctacctgtccgctgaggagttgaatgtgttccacgaaaggggagcatccatagcccactgccctaactcaaacctttcgctgtcttctggctttctaaatgtactcgaggtcctcaagcatgaggtcaagatagggctcggaactgacgtcgccggtggatactcatactctatgctcgacgctatccggagggccgttatggtttcaaacatcctccttattaacaaggttaacgagaaatccctaactctgaaggaggtttttcgcctggccacgctgggtgggtctcaggctttgggcctggatggggaaatcgggaactttgaggttggcaaagaattcgacgccatactgattaaccctaaggcatctgatagccctatagacctcttctacggggacttttttggcgatatatctgaggcagtgattcagaaatttctgtatttaggcgatgaccgcaatattgaggaagtgtatgtgggcggaaagcaagtcgttcccttttccagctctgtgtag

SEQ ID NO: 225420 - DNA, 1143 bp, Artificial Sequence
  Description of Artificial Sequence: Synthetic coding sequence
atgcctggactggtggatactcatatccacgcctcgcagtatagtttcgcgggatcttcgattgatctgcctctcctggaatggctgaccaagtatacctttcccgctgagcataggtttcagaatattgacttcgctgaggaggtctacactagagtggtgcgaaggaccctcaagaacggtacaaccaccgcctgctactttgctactattcacaccgactcaagcttactgctggccgatatcaccgataagttcgggcaacgagcattcgtcgggaaagtgtgcatggatctaaacgacacatttcctgagtataaggagactacagaggagagtattaaagagaccgaacgctttgtgagcgaaatgttacagaaaaactactctcgcgtaaaacctatcgtcaccccccgtttctccctgtcttgttccgaaactttgatgggtgaactcgggaatattgcgaagacacgggatctacacatccagtctcacatctctgagaatcgggatgaagtcgaagcggtgaaaaatctgtatccatcttacaagaactacacctccgtgtacgataaaaacaacctgctaacaaacaaaacggtgatggcacatggctgttatctcagcgctgaagagctcaatgtgtttcacgagagaggggctagcatagcccattgcccaaacagtaacctgagcttgagcagcgggtttctgaacgttctggaagtactgaagcacgaggtgaaaatagggcttggcaccgatgtcgcagggggatatagttactcaatgctggatgccatcaggcgagctgtaatggtctccaatattctgctgattaacaaggtgaacgagaaaagtttgacgctgaaagaagtctttaggctggccacactgggtggcagccaggctcttggactagacggagaaataggcaatttcgaagtcgggaaagagtttgatgctatcttaattaacccgaaagcctctgattctcccattgacctgttttacggagacttttttggggacatcagcgaagctgtgatccagaagtttttgtatctgggagacgatcgcaatatcgaggaggtttatgtcggcggaaaacaagtcgtgccattttcaagctctgtctag

SEQ ID NO: 225421 - DNA, 2082 bp, Artificial Sequence
  Description of Artificial Sequence: Synthetic coding sequence
atggcattgtgtaacggtgactccaagctcgaaaatgcaggcggagatctgaaggacggacatcaccactacgaaggggcagtggtgatcttggacgctggtgcacagtacggcaaagtcattgacaggagagtccgcgagctgttcgtccagagcgaaatctttcctctggagactcccgcatttgcaatcaaggaacaggggttccgagctattatcatttccggcggacccaactcggtctacgctgaagatgccccttggttcgaccctgccatcttcaccattggtaaacccgtcctgggtatctgttatggtatgcagatgatgaacaaagtgtttgggggtacagtccacaagaaaagcgtgagggaagacggcgtgtttaatattagcgttgataatacatgttctctctttcgcggactccagaaggaggaggtggtgctgttaactcatggcgactctgtcgacaaagtggctgacggattcaaggtggtggcgagatccggcaatattgtggctggaatcgcaaacgaatctaaaaaactttacggagcccagtttcaccccgaagtaggactgaccgagaacggcaaggtgatcctgaagaattttctttatgacatagcaggttgttccggcacattcacggtgcagaacagggaattagagtgcatccgcgaaatcaaggaaagggttgggacctccaaggtgttagtgttattgtcagggggagtcgattccaccgtttgcacagcccttctgaaccgggctttgaatcaagagcaggtcatcgcagtgcacatcgacaacggcttcatgagaaaaagagaatcccaatcagttgaagaggcgttgaagaaactcggcatccaggtgaaggtgatcaacgccgctcactctttctacaacggcactacaacactccctatttcagacgaggatcgtacaccaagaaaacggatttcaaagaccctgaacatgactactagccccgaggagaaaagaaaaataatcggcgataccttcgtgaagatcgccaatgaagtgattggagagatgaacctaaaaccagaggaagtattcctcgctcagggcaccctgcgcccagaccttattgaaagtgcatctctggtggccagcggcaaggctgaactgatcaagacccaccacaatgatacagagctgatccgtaaactgcgggaggagggaaaagtgatcgaaccactgaaggattttcacaaagacgaggttcgcatactaggaagggagctcggactccctgaagaactggtctctaggcacccgtttcccggaccaggtctggcaatccgagtaatctgcgcggaggagccttatatatgcaaagatttccctgaaactaataacatattgaaaatagttgcggactttagtgcatccgtcaaaaaaccacatacactgctgcagcgggtgaaggcatgcacaacagaagaagatcaggagaagctgatgcagattacatcgctacatagcctaaacgcctttctcctgccaatcaagactgtgggtgtccagggggactgtcgaagctacagttacgtgtgcgggatcagctccaaggatgaacctgactgggagtcattgatttttctggccagactgataccgcgaatgtgtcacaatgtgaacagagtagtatacatcttcggacctccagtgaaagagccacccaccgatgtgaccccgacattcctaacgacaggagtgctgtccacactcaggcaagccgattttgaggcccacaacattctacgggaatccggctatgcagggaagattagccagatgcctgtgattctgaccccactccatttcgatcgagatcccctgcaaaaacagccgtcctgccagcgttctgtagtgatccgcacattcatcacaagcgactttatgactgggatacctgcaacgcctggtaacgagatacctgtggaagtggtgctgaaaatggtaaccgaaataaaaaagattcccggaatcagccggattatgtatgaccttaccagcaagcctcctggcactaccgagtgggaatag

SEQ ID NO: 225422 - DNA, 1929 bp, Artificial Sequence
  Description of Artificial Sequence: Synthetic coding sequence
atgcttgaagaaactctgagaatggccactactaccattaaagagcaagggttcagagctattataatttccgggggacctaactctgtctatgccgaggatgccccttggtttgacccagccatatttaccatcggaaaaccagtgctgggcatctgttacggcatgcaaatgatgaacaaagtgttcggcggtaccgtgcataagaagtccgtacgtgaagatggcgttttcaacatcagtgtcgataatacatgtagcctgtttagaggtctacaaaaggaggaggtggtgcttttaacacacggtgacagtgtcgacaaggtcgcagatggtttcaaggtggtggctcgaagtggaaatattgtcgccggtatagccaacgagagcaaaaagctgtacggagctcagtttcatcctgaagtcggccttaccgagaatgggaaagtgatactaaagaatttcctgtacgatattgcaggctgctccggaactttcacagtgcaaaacagagaactggaatgcataagggagatcaaggagagggtgggtacaagcaaagtgctggttctactgtcagggggtgtcgatagcaccgtgtgtacagccctacttaacagggcgctgaatcaagaacaggtgatcgcagttcacatagacaacggattcatgcggaagcgcgaatcgcagagtgtggaagaagcattgaaaaagctgggcatccaagtgaaggttatcaacgcagcacacagcttctataatgggacaactacactgccaatctccgacgaggacagaacccctcgcaaacgcatcagcaagacccttaatatgaccacttcaccagaagaaaagaggaaaattatcggagacaccttcgtgaagatcgctaatgaggtgatcggcgagatgaacctgaaaccggaagaggtgtttctggctcaaggaactctcaggcccgacctgattgagtctgccagtctggttgcttcagggaaagccgaactcattaaaacccaccataatgataccgagctcatacgcaaactacgggaggaaggtaaggtgattgagcctctgaaggattttcataaggatgaggttaggatcttaggcagggaactcggtttaccggaggagctggtgtcccgccatcccttcccgggtccgggtctagctatccgggtcatctgcgccgaagaaccgtatatctgcaaggatttccccgaaactaacaacatactgaaaatcgtagcagacttctcagctagtgtgaagaagccacacacgcttctccagcgcgtgaaagcctgcacaacagaggaggaccaagaaaagctaatgcagattaccagtcttcactcactgaacgcatttttactccctatcaagacggtgggggttcaaggagattgtaggagctattcatatgtctgcgggatctcatccaaggacgagcctgactgggagtctttaatcttcctggccaggcttattcctcgtatgtgccataacgtaaatagagttgtatatatattcgggcctcccgtgaaagaaccacccacggatgtgacccccacctttctcactacaggcgtcctgagcaccttgcgccaagccgatttcgaggctcacaacattctgcgagagagcggctacgctggtaagatctcccagatgcctgtgatccttacccccctccatttcgaccgcgaccccctccagaagcaaccaagttgtcagagatctgttgtgattcgcactttcatcacaagtgactttatgacgggaattccggctacaccaggaaacgagatccccgtggaagtagttctgaaaatggttacggagatcaagaagattcccggaattagccggatcatgtacgacttaactagcaaaccgcctggaacaacggagtgggaatag

SEQ ID NO: 225423 - DNA, 2082 bp, Artificial Sequence
  Description of Artificial Sequence: Synthetic coding sequence
atggcgctctgtaatggtgatagcaagctggagaacgcaggaggagacttgaaagacggacaccatcactacgagggagctgtcgtgatccttgacgccggagcccagtatggcaaagttattgatagaagggtgcgggagctattcgtgcaaagtgagatcttcccactggagactcccgcttttgcaatcaaagagcagggctttcgagctattatcatttcaggaggccctaattccgtctacgccgaggatgccccttggtttgatccagcaatctttactatcggcaagcccgtcctgggtatctgttacggaatgcaaatgatgaataaggtcttcggagggactgtccacaagaagtcagtgagagaagatggagtcttcaacatctcagttgataatacatgcagcctgttccgcggacttcagaaagaggaggtcgtattgttgacccatggggattctgtcgataaagtggccgatgggtttaaagtggtcgccaggagtggcaatatagttgcaggtattgccaacgagagcaaaaagctgtacggcgctcaattccatccagaggttggtctgactgagaacggcaaggtcattctgaaaaactttttgtatgacatcgctgggtgctccggcacctttacagtacaaaatagagaactcgaatgcatccgcgagatcaaggaacgggtggggacaagcaaagtcctggttctcttatcaggtggggtagacagcacagtctgtactgcactactgaaccgcgctctcaaccaggagcaggtaatcgccgtgcatatcgataacggtttcatgcgaaagagggagtcccagtctgtggaagaggcattgaagaaattaggtatccaggttaaggtcataaatgctgctcacagcttttataacggcaccactacgttgccgataagcgatgaagatcggacaccccgaaagcgaatttccaagacattgaatatgacaacatcacccgaggaaaaaagaaaaatcataggggacactttcgtcaagatcgccaatgaagtcattggagaaatgaacctcaagccagaggaagtcttccttgcccagggtaccctccgcccagacctcatcgaaagcgcgagcctggtggcatcaggcaaggcagagctgattaaaacccaccacaatgacaccgaactgattcggaagctcagagaggagggtaaagttatagagcctctgaaggacttccataaggacgaggtccggattctgggcagagaactcggacttccagaggagctggtgagccgacaccccttccctgggcctggtcttgccatacgcgtcatctgtgcagaagaaccctatatctgtaaggacttccctgagaccaataatattctcaagattgtggccgatttcagtgctagcgtaaagaagccacacactctcttacagcgcgtcaaggcatgcactaccgaagaggatcaagaaaagctgatgcagataacatctttacacagcctcaacgcctttcttctccctataaagaccgtaggcgtccagggcgactgcaggtcttattcttatgtctgcggcattagtagtaaggacgagccggattgggagtcactgatcttcctcgcgaggctaatccccaggatgtgccacaacgtaaacagagtggtgtacatcttcggacctcccgtgaaggagccccctactgacgtgacgcctactttccttactacaggagtcctgtctacccttagacaggcagattttgaggctcataacatcctgcgggagtctgggtacgccggaaagattagccagatgcccgtgattctgacacccttacacttcgatcgtgatccactccagaagcagccgtcatgccaaaggtcagtcgtgatcagaacttttattacaagcgacttcatgacagggatcccagccacacctggcaacgagataccagtagaggtagtgctgaagatggtcacagagatcaagaaaatcccagggatcagcagaattatgtacgatctcacctcgaaaccccctggtacaactgagtgggagtag

SEQ ID NO: 225424 - DNA, 1146 bp, Artificial Sequence
  Description of Artificial Sequence: Synthetic coding sequence
atgagcggcgtcgttagaactcttagcagatgcctattaccagcagaggcgggaggggcaagggagcgcagagctggaagcggagccagagacgccgagcgagaggccaggcggaggagcagagacatagatgccctgctggctcgagaaagacgggctgtgaggcggctcgtgaaaattttactgctaggagcgggtgagtccggcaaaagcacgttcctgaagcaaatgcggatcatccacgggagggaattcgaccagaaggccctgctagagttcagggatacaatctttgataatatcctcaaaggttcccgcgtgctggtagatgccagggataagctgggtattccatggcagtatagcgagaacgagaagcatggcatgttcttgatggccttcgaaaataaggcagggctgcccgttgaacctgctacgtttcagctgtatgtgcccgctctgtccgctctctggagagattcgggtatccgggaagccttcagccgaagatctgagtttcagctgggcgaatctgtcaaatattttctggacaacttggacagaatcggccaactgaattactttccatctaagcaggatatccttcttgctaggaaggccaccaaaggaatagtagaacacgactttgtaatcaagaagatccccttcaaaatggtggatgtgggcggacagagaagccaaaggcaaaaatggttccagtgtttcgatggcataacgtccattctgtttatggttagcagttcggagtacgaccaggtccttatggaagatcggagaaccaaccgtctggttgagagcatgaatatctttgaaacgatagtcaataacaagctgttctttaacgtttcaattatccttttcttgaacaagatggatctgttggtggagaaggtgaaaacggtgtccattaaaaagcatttccccgatttcagaggcgatccccatcgcctggaagatgtccagaggtatttggttcaatgttttgacagaaagcggaggaaccgtagtaaacctctatttcatcacttcacgactgcaatcgataccgagaacgttcgctttgtgttccacgcggttaaggataccatcctccaagagaacttgaaggatatcatgctgcagtag

SEQ ID NO: 225425 - DNA, 702 bp, Artificial Sequence
  Description of Artificial Sequence: Synthetic coding sequence
atgatttatcctctgattgtactgccactttgcgccagctggcattggggcttgatccgcaaaggcatcgtgctcttttggggagagtcggtgaaatattttctggacaatctggaccgcatcggtcagcttaattactttccctccaagcaggatattctactggctagaaaggcaacaaagggtattgtcgagcacgatttcgttattaagaaaatcccctttaagatggtcgacgtgggaggccagaggagccagaggcagaagtggtttcagtgttttgacgggatcacctcaatcctcttcatggtatcatccagtgagtatgaccaggtcttgatggaggaccgtagaactaacaggttggtggagtccatgaacattttcgagaccatcgttaataataaattgtttttcaacgtttccattattttatttctgaacaaaatggacctattagttgagaaagtcaagaccgtctctatcaagaagcactttcctgatttcaggggcgacccccaccgtcttgaagatgtgcaacggtacctggtgcagtgtttcgaccggaaaagaagaaatcggtccaaacctctgttccatcacttcaccactgccatagatacagaaaatgtgcgattcgtcttccatgccgtaaaggacacaatactgcaggagaacctaaaagacattatgctgcaatag

SEQ ID NO: 225426 - DNA, 867 bp, Artificial Sequence
  Description of Artificial Sequence: Synthetic coding sequence
atgagaattattcacggtagggaattcgatcagaaggctttgcttgaatttagagacactatattcgacaatatcctgaaagggtctcgcgtgctcgttgatgccagagataagctcggaatcccctggcagtattctgaaaacgaaaagcacggcatgttcctaatggcttttgaaaataaggcaggactaccagttgagcctgctaccttccagctttacgttccagccctgtctgcgctctggcgggactccgggattagagaggccttcagccgcagatccgaattccagctaaattatttccccagtaaacaagacatcctgttggccaggaaggctactaagggtattgtggagcatgactttgtgatcaaaaagattcctttcaagatggtggatgtgggcggacagcgctcccagcgacagaagtggttccaatgcttcgacggtatcacttctatactgtttatggtgtcgtcaagtgagtacgaccaggtcctgatggaggaccgacggactaaccggcttgttgagtccatgaatatctttgagacgattgtcaacaataagctgttctttaacgttagcatcatcttatttctaaacaagatggacctgctcgtggaaaaagtcaagaccgtgtctatcaaaaaacattttcctgactttaggggcgacccccacagattggaggacgtacaacgatatctggtccagtgcttcgatcgaaaaaggcgtaatcggagcaaaccactgttccaccatttcactactgctatagacactgaaaacgtgaggttcgtatttcacgctgtgaaggatacgatcctacaggagaacctgaaggacataatgttacagtag

SEQ ID NO: 225427 - DNA, 1080 bp, Artificial Sequence
  Description of Artificial Sequence: Synthetic coding sequence
atgactcttgaatctatgatggcatgttgtctcagcgatgaggtaaaagagagcaagagaattaatgccgagattgaaaaacagcttcgtcgggataaaagagacgcccgacgagagctcaagctgctcctcctgggaacgggcgagtcggggaagtcaacttttatcaaacaaatgcgcatcatccacggcgcaggttatagcgaggaggacaagagaggttttacaaaacttgtctaccagaacatctttaccgcaatgcaggctatgatccgcgctatggaaacccttaaaattctttacaaatatgaacagaacaaggccaacgcactgcttatcagggaggtggatgtggagaaggtcactacatttgagcaccagtacgtgtccgccataaaaacactttgggaagatccaggaattcaggaatgctacgaccgccgtagagagtaccagctgtctgacagtgcgaaatactatttaaccgacgttgataggatcgccaccctaggctatctcccaacccagcaggacgtgctgagagtgcgcgtgcccaccactgggatcattgaatacccctttgatctggagaacattatatttcgtatggttgatgtgggtggacagcggtctgaacggcgtaagtggattcactgttttgaaaacgtgacatccatcatgttcttggttgcactctccgagtacgatcaggtgttggtggaatccgacaatgaaaatcggatggaagagtcaaaggcactctttcgaacaattatcacatatccctggtttcaaaacagctcagtgattctttttctgaacaaaaaagacctcctggaggacaaaatcctgtactctcatttggtagattacttccctgagttcgacgggcctcagcgcgatgcccaagcagcaagggagttcattttgaagatgtttgtggatttgaacccagattccgacaaaattatttacagccacttcacttgcgcaacagatacagagaacattcgcttcgtgtttgcggctgtcaaagatacaatcctgcaactgaatctcaaggaatacaacctggtctag

SEQ ID NO: 225428 - DNA, 1059 bp, Artificial Sequence
  Description of Artificial Sequence: Synthetic coding sequence
atggccgacttcctcccttcaaggtctgttctgagcgtctgcttcccgggatgcttgttgacatctggcgaagcagaacagcaaaggaagtccaaggagatcgacaagtgcttgagccgagaaaagacatatgtaaagcgccttgtcaaaattttattacttggtgctggcgaatctggcaaaagcacttattcaaatgtcatcaagggcatgcgggtgctggtcgacgcacgggagaagctgcacattccctggggagataactcaaatcaacagcacggagacaagatgatgtcttttgacacacgagcacctatggctgctcagggcatggtcgaaacacgagtattcttgcaatatctgcccgctattcgcgcactatgggcagattcagggatccaaaacgcctacgacaggcgtagggagttccagctgggagagtctgtcaagtattttctagacaaccttgacaaattaggtgaacccgattacattcctagccaacaggacattttgttggccaggcgtcctacaaaaggcatccatgaatatgacttcgagataaaaaacgtccctttcaagatggtggatgttggcggacaacgaagtgaaaggaaacgctggttcgagtgttttgattccgtgacgagtatcctgtttctggtttcaagctccgagttcgatcaggtcctcatggaggacagactgacgaatcgccttacagaatccctcaacatttttgagactatagtaaacaaccgggttttttccaacgtgagtatcatcctgtttctgaacaaaactgacctcctggaggagaaagtacagatagtctccatcaaagattatttccttgagtttgagggcgacccccattgtttgagggatgtgcagaaatttctcgtggaatgtttcaggaataaacggagggaccagcagcagaagcctttataccaccatttcacaacagcaattaacacagagaatatcagactggtgttccgagacgtcaaggacaccatactccacgacaacctgaagcaactgatgcttcagtag

SEQ ID NO: 225429 - DNA, 1134 bp, Artificial Sequence
  Description of Artificial Sequence: Synthetic coding sequence
atggccgatttcttaccatcgcgctccgtgctgagcgtctgttttcccggttgcctgctgacatcgggcgaagccgaacaacagcggaagagcaaggaaatagataagtgcctgtcccgggaaaagacgtacgtaaaacgccttgtcaagatccttttgcttggggctggtgagagcggaaagtccacatttttgaaacaaatgagaatcattcacggccaggattttgaccagagagctcgggaagagtttcgtcccacaatttactccaatgtaatcaaaggaatgcgggtgctggtagacgcacgagagaagctgcatatcccttggggtgacaattctaatcaacaacacggtgataagatgatgagtttcgacactagggcccctatggccgcacaggggatggtggaaaccagagttttcctgcaatatctgcctgcgattcgggcactgtgggcggatagcggcattcagaatgcttatgatcggagacgagaatttcaactgggggagtctgtgaagtattttctggacaacctggacaaactgggagaacccgactatatcccctctcagcaagatattctcttggcaaggagaccaaccaaaggaatacacgagtacgattttgagataaaaaacgtgcccttcaagatggtagatgtgggtggacaaagatccgagcgaaagagatggttcgagtgctttgacagtgttactagtatactgttcctggtgtcatccagcgaattcgatcaggtgctgatggaagacagactgaccaataggttgactgaaagtctgaatatcttcgagaccatcgtaaacaatcgcgtgttttcaaatgttagcattatcctgtttctgaataaaaccgacctgcttgaggagaaggtgcaaatagtgtcaattaaggattatttcctagaattcgaaggggaccctcattgtttgcgcgacgtgcaaaagtttctggtagaatgctttcgcaacaaacgccgagaccagcaacagaagccactataccatcattttacaacagcaatcaacactgaaaacattaggttggtgtttcgcgacgttaaggatactatccttcacgacaatttgaagcagctcatgctgcagtag

SEQ ID NO: 225430 - DNA, 849 bp, Artificial Sequence
  Description of Artificial Sequence: Synthetic coding sequence
atgagggtgttggtagacgccagagaaaagctgcatattccctggggcgacaatagcaaccagcagcacggcgataaaatgatgagctttgacacccgagcgcctatggcagctcagggaatggtggaaaccagggttttcctccagtatcttcctgctatcagggctctttgggctgactctgggatccagaatgcctatgatcgacggcgtgagtttcagttaggggagagtgtgaagtattttttagacaatctggataagctgggggaaccagactacattccctcacaacaggacatcctgttagcacggcgaccaactaaaggaatccatgaatatgactttgagatcaaaaatgttccatttaaaatggttgacgtcggtggccaacgatcagagcggaaaagatggtttgagtgctttgactctgtcacttctatactctttttggtgagctcgtccgagttcgaccaagtcctgatggaagaccggctaacaaatagactgacggaatctcttaatattttcgagactattgtcaacaaccgtgtgttctccaatgttagcataattctgtttctgaataagaccgatctcctggaggaaaaggttcagatagtgtccatcaaggactattttcttgagtttgagggagatccccattgtctgcgagatgtgcaaaagttcttagtcgaatgtttccgaaataaacgcagggaccaacagcaaaagcctttgtaccatcactttaccactgctattaataccgagaacattcgcctagtgtttcgtgatgtcaaggatactatactgcacgacaatctgaaacagctgatgctacaatag

SEQ ID NO: 225431 - DNA, 1068 bp, Artificial Sequence
  Description of Artificial Sequence: Synthetic coding sequence
atggccggatgttgttgcctgagtgcagaggagaaggagagccagcggatcagtgctgagattgagaggcagctaaggcgggacaaaaaagacgcaagacgggaattaaaactgcttctgttaggcaccggcgagagtggcaaaagtactttcatcaagcagatgaggattattcacggtagcggatactccgacgaagataggaaaggcttcaccaagctcgtgtatcagaatattttcaccgctatgcaggccatgattagagccatggacactctaagaatccaatatgtttgcgagcaaaacaaagaaaatgctcagatcattcgcgaggtggaggtcgacaaagtctcaatgttgagccgtgaacaggttgaggcgatcaaacagctctggcaggaccctggcatccaggaatgttacgaccggagacgggagtatcagcttagcgactctgcaaaatattaccttacagatatcgaccggatcgcaaccccttcatttgtgcccacgcagcaagacgttctgagagtccgggtgccaaccaccggcattatcgaatatccatttgacttggagaacatcatatttcggatggtggacgtgggagggcagagatctgagagaaggaagtggattcattgcttcgagtcagtgacctcaattatttttctagtggccctgtcagaatacgatcaggttcttgccgagtgcgataacgagaatcgaatggaagagtccaaggccctgtttaaaactataattacgtacccttggtttctgaattccagtgtaattttgttcctgaacaaaaaagacctgttggaagaaaagatcatgtacagccatttaataagctacttccccgaatatacagggcctaagcaggatgttcgggcagccagggactttattttgaagctttaccaggaccagaatcctgataaggagaaggtgatctactcccattttacttgtgctaccgatactgacaatattcgcttcgtgttcgctgcagtgaaagacaccatactccagctgaatctgcgagagtttaacttagtgtag

SEQ ID NO: 225432 - DNA, 1125 bp, Artificial Sequence
  Description of Artificial Sequence: Synthetic coding sequence
atggccaggagtcttacctggcgatgttgtccgtggtgcctgaccgaggacgaaaaggctgccgctagagtggaccaggagattaataggatccttcttgaacagaagaagcaagacaggggagagctcaagctgctgctgctcggcccaggcgaaagcgggaagagtaccttcattaagcaaatgagaataattcatggcgcaggttactcagaggaggagaggaaggggtttagaccgctcgtttatcaaaacattttcgtgtcaatgcgggctatgatcgaggctatggaacgactgcagataccctttagtcgacccgagagcaagcaccacgcgtccttggtgatgagccaagacccgtacaaagtcacaaccttcgaaaagaggtatgccgcagctatgcagtggctttggcgagacgccggtattcgagcctactacgaacgtagaagggagtttcacctgctggatagcgccgtttactatctgagccatctggagcgtatcactgaggagggatatgtgcctacggcccaagatgtactcaggtctaggatgcctaccaccggtattaacgaatactgctttagtgtacagaagaccaacctgaggatcgtggatgtgggaggacagaagtccgagcgtaagaagtggattcattgttttgagaacgtgattgccctaatctacctggcttcactgagtgaatacgatcagtgcctcgaagagaacaatcaggagaacagaatgaaagagtctcttgccttatttgggacaattctggagttgccttggtttaaatccacatctgtgattctgtttctaaataagaccgacatcctagaagagaaaataccaacctctcacctcgccacgtactttccgagcttccaagggcctaagcaggacgctgaggctgcaaaacgctttatccttgatatgtacactcgcatgtacacagggtgtgtggatggtccggagggcagcaaaaaaggagctcgatcccggcgactcttcagccactatacctgcgctaccgacacccagaacattcgcaaggtgtttaaggacgtgagagactctgtgctggctaggtatcttgacgagataaacctgctgtag

SEQ ID NO: 225433 - DNA, 1065 bp, Artificial Sequence
  Description of Artificial Sequence: Synthetic coding sequence
atgggctgcacactgagcgcagaggagagggccgctctggagcgttccaaggctatcgagaagaatctgaaagaggacgggatatcagcagccaaagacgttaaattactgctcctgggggcaggcgagtccgggaaatctactattgtcaaacagatgaaaattattcatgaagatggcttctccggagaggacgtcaaacagtataaaccggtggtctacagcaatactattcagagcttagctgctatcgtgagagccatggacaccttgggcatagaatacggagataaagagcggaaagctgatgccaaaatggtttgcgatgttgtatcccggatggaagacactgaacccttttctgctgagcttttatccgccatgatgcgactctggggcgactcaggcatccaggagtgtttcaaccgatcgcgcgagtaccagctgaatgattccgccaaatattacttggactcactcgacaggattggcgctgctgattaccaacctactgagcaggacatcttgcgcacgagggtgaagacaactgggattgtggagacccactttacatttaagaaccttcattttcgcctcttcgacgtgggaggccagcggtccgagcggaagaaatggattcactgctttgaggatgtgactgctattatattttgcgtagcgttgagcggctatgatcaggttctgcacgaagacgagaccactaacaggatgcacgaatctttaatgctctttgatagcatctgcaacaataaattctttattgacaccagcattattttgttcctcaacaaaaaagatttattcggagaaaagattaagaagagcccactgaccatctgcttcccagaatacacaggccctaatacctatgaggatgcagctgcctacattcaggcgcagtttgagtccaaaaacagatcacccaataaagaaatctactgccacatgacatgcgccacagacaccaataatattcaggtggttttcgatgcggtgacagacatcataattgctaacaacctgagaggctgcggcctatattag

SEQ ID NO: 225434 - DNA, 1065 bp, Artificial Sequence
  Description of Artificial Sequence: Synthetic coding sequence
atgggttgtaccctcagcgccgaagagcgtgctgctctggagaggtccaaagcaatcgagaagaacttgaaggaagatggcatatccgcggcaaaagatgtcaaactcctgcttttgggagcaggcgaatcaggcaagtctaccattgttaagcaaatgaaaattatccacgaagacgggttctcgggcgaagacgtcaaacagtacaagcctgtcgtgtactcgaataccattcagtccttggccgctatagtcagggcaatggataccctaggtatcgagtatggagacaaggagagaaaggccgacgccaagatggtgtgtgacgtcgtctctcggatggaggataccgaacctttcagcgctgaactgctgtcagctatgatgaggctgtggggcgattctgggattcaggagtgtttcaatcgcagtcgagagtaccagctgaatgacagcgcgaagtactatctagattctcttgatcgcatcggcgcagcagattaccaacccactgagcaagacatccttagaacccgagttaaaacaacaggaatcgtggagacacacttcacctttaaaaatctgcattttcgcctgtttgacgtgggtgggcagagaagcgagcggaaaaagtggattcactgcttcgaagatgtgacagcaattatcttttgtgtcgccctgagtggttacgatcaggtactgcatgaggacgagacaacaaatagaatgcatgagtctctgaagcttttcgacagcatatgcaacaacaagtggttcacagacacatctattatattgttcttaaataaaaaggatatcttcgaggagaaaattaagaagtcacctctgaccatctgcttccctgagtatacgggaccaagcgcctttactgaagcggtcgcttacatccaggcccagtacgaatccaagaacaagtccgctcataaggaaatctacacgcatgttacgtgcgcaaccgacactaacaatattcagtttgtgtttgacgcggtaacggacgtaatcatagccaaaaacctgcgcggttgcggtctctactag

SEQ ID NO: 225435 - DNA, 1146 bp, Artificial Sequence
  Description of Artificial Sequence: Synthetic coding sequence
atgggctgccttggcggaaattccaagacaacggaggaccagggcgtggacgagaaggaacggcgagaggccaacaaaaagattgagaagcaactgcaaaaggagcgactggcctataaggcgacgcacaggttgcttctcctgggagccggagagagcggtaaatctacaattgtcaaacaaatgcgaatcctgcatgttaacgggtttaatccggaagagaagaagcaaaaaattctggatattcgtaagaacgttaaggatgctattgtgactatagtctccgctatgagcaccattatcccccctgtgccccttgccaaccccgaaaatcagtttagaagtgattatattaagagcattgcccctatcacagacttcgagtacagccaagaatttttcgaccacgtcaagaaactgtgggacgatgagggagtgaaagcctgctttgaacggagtaatgagtatcaactaatagattgcgcccagtactttttagaacgaattgacagtgtgagtctggtcgattacacccccacagaccaggaccttcttaggtgcagagtactaacgtccggcatcttcgagacaaggttccaggtcgacaaagttaacttccatatgttcgatgtggggggacaacgggacgagcgccgtaagtggatacagtgtttcaacgacgtaactgctatcatatacgtggctgcttgtagctcatacaacatggtaatacgggaggataacaacactaacaggctccgcgagtccctggatttgttcgagtccatctggaataaccgttggctcagaaccatctctattatcttgttcctgaacaagcaggacatgctggcggaaaaagtgttagcaggaaagtctaaaatcgaggactacttcccagaatacgccaattatacggttccggaagacgcgacccctgatgctggggaggaccctaaggttacccgcgctaagttctttatccgcgacctcttcctgagaatctcaaccgccactggcgatggaaaacattattgctatcctcattttacatgcgctgtggatactgaaaatatcaggagagttttcaatgactgtcgcgacatcatccagagaatgcatctgaagcagtatgaacttctatag

SEQ ID NO: 225436 - DNA, 1377 bp, Artificial Sequence
  Description of Artificial Sequence: Synthetic coding sequence
atgggtctctgctactctctgaggcctctcctgttcggcggacccggtgacgacccatgtgcggcatcagagcccccagtcgaagatgcgcagccagcacctgcccctgctctggccccagtccgcgctgccgcacgcgataccgcccgaacactcctgccacgaggcggagaggggtcgcccgcttgtgctcgacccaaggctgataagccaaaggagaaaagacagcgaaccgagcagctcagcgccgaggaaagggaggccgcaaaggaaagggaggccgtcaaggaagcacgaaaagtgtcccggggtattgatagaatgctcagggaccaaaagagggatctgcagcaaacacaccgccttttactgttgggggcaggggaatctgggaagagtacaatcgtcaagcagatgagaatcctccacgtaaatggtttcaatccggaggagaaaaagcaaaagattttagacattcggaaaaacgtgaaggatgccatagtcacaatcgtaagtgcgatgagtaccattatccccccagtccccctagctaacccagagaaccagtttcgatcagactatataaagtcaattgcaccaatcaccgattttgaatatagtcaagaattcttcgaccatgtaaagaagttgtgggacgacgagggggttaaggcatgcttcgagcgcagcaatgagtatcaattaatcgattgcgcccaatattttctcgagaggatcgattctgtttcccttgtggattacacccccacagaccaggacctgctccgttgcagggtactgacatctggcattttcgaaacccggtttcaggtggataaggtcaactttcatatgtttgatgtaggcggtcagagagatgaacgcagaaaatggatccaatgcttcaatgacgtgaccgccatcatctacgtcgccgcttgtagtagctataatatggtgattagggaagataacaataccaatagactacgcgagagcctggacttatttgaaagcatatggaacaatcgatggctgcgcaccatatctatcatcttattcctgaacaagcaagacatgctggccgaaaaggttctggctgggaagtccaagatagaggattatttcccagagtatgctaactataccgtccccgaagacgccaccccagacgcgggtgaagaccccaaggtgaccagggccaagtttttcattcgagacctgttcctgcgaatcagcacagcaactggagatgggaagcattattgttacccacactttacctgtgccgtggatacagagaatatccggagagtgtttaatgactgccgcgacattattcaaaggatgcatctaaagcaatacgaactgctgtag

SEQ ID NO: 225437 - DNA, 1146 bp, Artificial Sequence
  Description of Artificial Sequence: Synthetic coding sequence
atgggatgccttggcggtaattcaaagaccaccgaggatcaaggcgttgatgaaaaggagaggagggaagcgaacaagaaaattgaaaagcagctgcagaaggagagattggcctacaaggctactcatagactgctccttctgggagcgggtgagtcaggcaagtccacaattgtcaaacagatgcggatcctgcacgtcaacggatttaaccctgaagagaaaaaacaaaagatcttagatatcagaaagaacgttaaagatgcaattgtcacgatagtgtccgccatgagtaccattatccccccagtgcctcttgcaaacccggaaaaccagtttcgtagcgattacattaagagcattgcccctatcaccgacttcgagtactcccaggaattttttgaccatgtcaaaaaattatgggacgatgagggggtgaaggcttgcttcgagcgctctaatgagtaccaactgatagactgcgcacagtactttctggagaggatagactccgtgtcactggtcgattacacaccaaccgatcaggatctactacgctgccgcgtactgacttctgggattttcgagacccgcttccaggtggacaaggttaacttccatatgttcgatgtggggggtcagagggatgagaggcgcaaatggatccaatgcttcaacgacgtgaccgcaattatttatgtggctgcatgttcatcatacaatatggtcattcgcgaagacaacaatactaaccgccttcgcgaaagtctggatctgtttgaatcgatttggaacaatcgttggctgcgaacaataagtatcatcctgttcctgaacaaacaggacatgttagctgagaaggtgctggccggaaagtcaaagatcgaggattacttcccagagtacgccaactatacggtccctgaggatgcaacccctgacgctggagaggaccccaaggtcacacgggcaaagttcttcattcgcgacctctttttgcggatcagtactgctactggagacgggaagcactattgttaccctcactttacatgcgccgtagacaccgagaatatccgccgagtgtttaatgactgcagagatatcattcagcggatgcatttgaagcagtacgagcttctgtag

SEQ ID NO: 225438 - DNA, 1146 bp, Artificial Sequence
  Description of Artificial Sequence: Synthetic coding sequence
atgggctgtctgggcggaaattcaaagacaaccgaggaccaaggcgtcgatgagaaagagcgtcgcgaagcaaacaagaagattgagaaacagctgcagaaggaaaggcttgcctacaaagcaacacacaggctacttctgctgggcgctggcgaaagtggcaagagcacaatcgtgaagcagatgagaatcctgcacgtgaacggcttcaatccagaggagaagaaacagaagatcctagatatcagaaagaacgtcaaagatgcaatcgttactattgtgagcgcaatgagcacaatcatcccacctgtgcccctcgcaaacccagagaaccagtttcggtcagactatatcaaatccatcgcccctataacagacttcgagtattctcaggagtttttcgaccacgtgaaaaaactgtgggatgatgagggcgtgaaggcatgctttgaacggtctaacgagtatcagctcattgattgcgcacaatactttctcgagagaatcgactcagtctccttggtggactacactccaactgatcaagatctgctccggtgtagggtcctcacgtctggaattttcgaaactcgatttcaggtcgataaagtgaattttcacatgtttgacgtcgggggtcaacgcgatgaaaggagaaaatggattcaatgcttcaatgacgtgacagccatcatctatgtggccgcttgctcatcctacaacatggtcatcagggaagataataataccaatagactccgggagtcactggacctgtttgagagcatatggaacaaccgctggcttagaacaatatcgatcattttgtttctgaataagcaggatatgctggctgagaaggtgctggctgggaaatctaaaattgaggactatttcccagagtatgctaattacaccgttccagaggacgccactcccgacgccggagaagaccctaaagtgaccagagccaagttctttattcgggatctgttcctgcgcatctcgactgcgactggcgacggtaagcactactgctacccacacttcacgtgcgctgttgacaccgagaacataaggagagtattcaacgactgccgggacataatacagcggatgcatctcaagcaatacgagttactctag

SEQ ID NO: 225439 - DNA, 525 bp, Artificial Sequence
  Description of Artificial Sequence: Synthetic coding sequence
atgttcgacgtgggcggacagcgagacgaaagaagaaagtggatacaatgcttcaacgacgttactgccataatctatgtggctgcatgttcatcctataacatggtgatccgcgaagacaataatactaaccgccttcgggaatctctagacctgtttgagtcaatttggaacaacaggtggcttagaaccatctcaataatactcttcttgaacaagcaagatatgctggcagagaaagtcctggccggaaaatcaaaaatcgaagactatttccccgaatatgccaactatactgtgcccgaggacgccacgcccgacgccggagaggatcctaaagtgactagggcgaaattcttcatccgcgacctgtttctccgaatctctacagctacaggcgacgggaagcactattgttaccctcacttcacctgcgcagtggacacagagaacattaggagggtcttcaatgactgtcgggacataatccagagaatgcatctgaaacagtacgagctgctgtag

SEQ ID NO: 225440 - DNA, 963 bp, Artificial Sequence
  Description of Artificial Sequence: Synthetic coding sequence
atgcggattctgcatgtgaatggctttaatcccgaagagaagaagcagaagatcctagatattaggaagaatgtgaaagatgccatcgtaacgattgtgtccgcgatgagtaccattatacccccagttccgctggctaatccagaaaatcagtttcgtagtgactatataaaatcaattgctccaatcacggattttgaatactcacaagagttttttgatcacgtgaaaaaactatgggacgatgagggcgtaaaggcttgctttgaaagaagtaatgagtatcagttaatcgattgcgcacagtattttctagaaaggatcgactccgtgtctttggtggactataccccaacagaccaggacctgcttagatgccgggtgctgacctctgggatctttgaaacccgcttccaggtggataaagtgaacttccatatgttcgacgtgggcggtcagcgggacgagcggcgaaaatggattcaatgcttcaacgacgtgaccgccatcatctacgttgcagcctgttcgtcatataacatggttatacgagaagacaataacaccaatcggctgcgggaatcactcgacctgtttgagagcatctggaacaataggtggttaagaactatctcaatcattctttttctgaacaagcaggacatgctcgctgagaaggtactggctggcaaatcgaaaatcgaagattattttccagagtatgctaattatactgtgcctgaggatgcaacgcctgatgcaggggaagatcccaaggtaactcgcgcaaaattctttatcagagatctttttttaagaatatccaccgctaccggcgacggaaagcactattgttacccccactttacatgcgcagtggatacagagaatatccggagagttttcaatgactgcagagacataatccagcggatgcatctaaagcaatacgagttgctttag

SEQ ID NO: 225441 - DNA, 1065 bp, Artificial Sequence
  Description of Artificial Sequence: Synthetic coding sequence
atgggttgtaccctgtccgcggaggacaaagctgccgtagagcgcagtaagatgatcgataggaatttacgcgaggatggtgaaaaagctgcacgggaggtcaagcttctgttgctcggagccggtgagagtggcaagagtacgattgtaaagcagatgaaaattatacatgaggcaggctatagcgaggaagaatgcaagcagtataaggctgtggtgtattcaaacaccatccaaagcatcatagctattatccgagcaatggggagactaaaaattgactttggcgactcggccagggccgatgacgctcgacagctttttgtgctggcaggggctgcagaagagggcttcatgaccgctgagttggctggagtgatcaaacggctgtggaaagattccggggtccaagcatgtttcaatagaagcagagagtatcagcttaatgattccgctgcctattatcttaacgaccttgacagaatcgcccagccaaactacatccctacccagcaggatgtgctgcggacccgggtaaaaactactgggatagttgaaacccattttacattcaaagaccttcactttaagatgtttgacgtgggcggacagcggagtgagcgaaagaagtggattcattgcttcgaaggcgtaacggccattattttttgtgtggcgttatctgattatgacctggtgctggctgaggacgaagagatgaataggatgcacgagtccatgaaactttttgattctatctgcaacaacaagtggtttactgatacttctattattctgttcctcaataagaaggatctgtttgaagaaaagatcaaaaagagcccactaacaatctgctaccccgagtacgctggaagcaatacctatgaagaagccgcagcgtatatccagtgccagtttgaagatcttaacaaaaggaaagacactaaagaaatctacacccacttcacatgtgcaacggatacaaaaaatgtccagtttgtgttcgacgcagtgactgacgtaattattaagaacaacttgaaggattgtggcctgttctag

SEQ ID NO: 225442 - DNA, 72 bp, Artificial Sequence
  Description of Artificial Sequence: Synthetic coding sequence
atgggctgcaccctgagcgccgaggacaaagcagctgtcgagcgaagcaaaatgatcgaccgcaatctctag

SEQ ID NO: 225443 - DNA, 909 bp, Artificial Sequence
  Description of Artificial Sequence: Synthetic coding sequence
atgaagattatccacgaggccggttattcagaggaggaatgtaaacagtataaggcggtggtttattccaacaccatacagagtatcatagctatcatccgggctatgggccgtttgaagatcgatttcggagactctgctagggcagacgatgctagacagctctttgtgctcgcaggcgctgccgaggaaggcttcatgacagccgagttggccggtgtgattaaacggttatggaaagattccggcgtccaggcctgctttaatcgaagcagagagtatcagctgaacgactctgccgcttactaccttaacgacctggatagaatcgctcagcccaactacatacccacacaacaggatgttctgcgcacaagggttaagacaactggcattgttgagacccattttacattcaaagacctccactttaagatgttcgacgtgggcggtcagcgctcggaaagaaaaaaatggatccattgttttgaaggggtgactgccattattttttgtgtcgccttgagcgattatgacctagtcctcgcggaagatgaggagatgaatcggatgcatgagtctatgaaattatttgacagtatctgcaacaacaagtggtttaccgataccagcatcatcctgttcctaaacaagaaggatctcttcgaggagaaaatcaaaaagtcccccctcaccatatgttaccccgaatatgcaggttccaacacatacgaggaagctgccgcatacatccagtgtcagttcgaagatctcaacaagcgaaaagataccaaagagatctacacacacttcacatgcgccacagataccaagaatgtgcagttcgtttttgacgcggtcactgatgtcattatcaaaaacaatctgaaggactgtgggctattctag

SEQ ID NO: 225444 - DNA, 1020 bp, Artificial Sequence
  Description of Artificial Sequence: Synthetic coding sequence
atggaatacgccggacacctacccgcaagctctgcccagggcactattctggcctgtacctcctgtacaggcgcaggcgaatctggcaagagcactattgtgaaacagatgaaaatcatccacgaggacgggtactccgaggaggaatgtcgccaataccgggctgtggtgtactcaaataccatccagtccataatggccatcgtcaaggccatgggcaatctgcagattgattttgccgacccttcaagggccgacgatgcaaggcagctgtttgctctcagttgcaccgcggaggaacagggcgtcttacctgacgacttgtcgggagtgatccgtaggctgtgggccgaccatggggtacaggcttgcttcgggaggagtagggagtatcagctgaatgactccgctgcctattacctgaatgacttggaacgtatcgcccagtctgattacataccaacgcagcaggacgtgctcagaacgcgggtaaagacgacaggaatcgttgaaacgcacttcacgttcaaggacctgcactttaaaatgtttgatgttggtggacagagaagtgagaggaagaaatggatccattgcttcgagggcgtgaccgccatcattttctgcgtggctctctctgcatatgacctggttttggcggaggacgaggagatgaatagaatgcatgagtctatgaagctcttcgactctatatgtaacaacaagtggttcactgacacaagcattatcctttttctgaataagaaggatttgttcgaagaaaagattacccactcccccctaaccatttgttttcctgaatacacgggcgctaacaagtacgatgaggctgcatcttatatccagtctaagttcgaggacctcaataaaaggaaagataccaaagaaatatatacccacttcacatgtgccaccgacaccaagaacgtgcagttcgtattcgatgcggtgaccgacgtcattatcaaaaacaacctaaaggactgcggcctgttctag

SEQ ID NO: 225445 - DNA, 1068 bp, Artificial Sequence
  Description of Artificial Sequence: Synthetic coding sequence
atgggttgcaccgtgtccgccgaagataaggctgccgctgaaagaagcaagatgatagacaagaatcttagggaggatggagaaaaggccgctcgcgaagtgaagctgctgctgttaggagctggcgaatccggaaaaagtaccattgtgaagcaaatgaagatcatccacgaggatggatactctgaggaggagtgccggcagtatagggctgtggtgtatagcaacactatccagtctattatggcaatagtcaaggcaatgggcaacctccagattgacttcgctgacccgtccagagccgacgatgcacgccaactgttcgcactttcttgtaccgctgaagaacagggcgttctacctgatgacctgtccggcgtgatccggaggctgtgggctgaccatggagtccaggcatgcttcggacgctcaagagaatatcaactgaacgacagtgctgcctactatctaaatgatctcgagagaattgctcaaagcgactatattcccacccagcaagacgttctgcggactagggtcaagacaaccgggatagtggagactcactttactttcaaggatctgcacttcaaaatgttcgatgtgggaggccagcgcagtgagaggaagaagtggatccactgcttcgagggtgtcacagcaataatattctgcgtggcactgtccgcatacgacctagtcctagccgaggacgaagagatgaatcggatgcacgagagcatgaaattattcgactccatttgcaataataagtggttcacggatacctcaatcatcctgtttcttaacaaaaaggacttgtttgaggaaaagattactcactctccgcttactatctgtttccctgagtacaccggcgcaaataagtacgatgaagccgcatcttatatccagtcaaagtttgaagacttaaataaaaggaaggatacaaaggaaatctatactcactttacctgcgctaccgacaccaagaacgtccagtttgtcttcgacgctgtgactgatgtgatcatcaaaaacaacctgaaggactgtggcctcttctag

SEQ ID NO: 225446 - DNA, 1020 bp, Artificial Sequence
  Description of Artificial Sequence: Synthetic coding sequence
atgaccgaaggggtcaaaactttaggatggaccaagcagaaaggcggttgtcactggggaaggtccgagggagcaggggaatccggcaagtcaacaatcgttaagcaaatgaaaatcattcacgaagacgggtactccgaggaggaatgtcggcagtaccgcgcagtcgtctactcaaatacaatacaatctattatggcaatcgtgaaagccatggggaatctgcagattgattttgctgatcctagccgggctgatgatgcccgacagttatttgcgctgtcatgcactgcagaagagcagggcgtcttgccagacgatttaagcggcgtgataaggcgcctctgggccgaccacggggtgcaggcatgcttcggcagatctcgcgagtaccagctgaacgactcagctgcctattatctcaacgacctagagagaattgctcagagtgactatatccccacacagcaggatgtgctgaggactcgcgtgaaaaccaccgggatcgttgaaacacactttaccttcaaggacctacactttaagatgttcgatgttggaggccagcggagcgagcgtaaaaagtggatccattgcttcgagggcgtgacagcaattatattttgcgttgctttatctgcgtatgatctggtactggcagaagacgaggaaatgaaccgcatgcatgagagtatgaaactgtttgatagcatctgcaacaacaagtggttcacggacaccagtatcatactgttcctcaataagaaggatctgttcgaggaaaagattacacactcccctcttaccatctgcttccctgaatacaccggtgcaaacaaatacgatgaagccgcttcatacatacagtccaagtttgaggacctgaacaaaaggaaggacaccaaagaaatttacacccattttacttgcgctactgatactaaaaatgtgcagtttgtgttcgacgccgtaaccgacgtgataataaaaaacaacctcaaagactgcggtctattttag

SEQ ID NO: 225447 - DNA, 912 bp, Artificial Sequence
  Description of Artificial Sequence: Synthetic coding sequence
atgaaaatcatccacgaggacggatattctgaagaggagtgccggcagtacagggctgttgtctactctaatacaatacagtcgattatggcaatcgtgaaagccatgggcaacctccagattgacttcgccgacccgagccgggcagacgacgctcgccagctctttgcactaagctgcactgccgaggagcagggtgtcctgcccgacgacctgagcggagttattcgcagactctgggcagatcatggagtgcaagcttgcttcgggcgaagtagagagtatcagctgaacgattctgctgcatattatttgaacgatctcgagagaatcgcccaaagcgattacataccaactcagcaggatgtcctgcggacgcgcgtaaagactacagggatcgtggagacccatttcacgtttaaggatctgcactttaagatgttcgacgtgggcggacagcggtctgaacgcaagaagtggatccattgttttgaaggggttactgccatcatcttttgcgtagcactgtctgcctatgaccttgtgctcgcagaggacgaagaaatgaaccgcatgcacgagtctatgaagctgtttgactccatttgtaataataagtggtttaccgacacatcaattatactctttctaaataagaaagacctcttcgaagaaaaaattactcatagccccctaacgatctgttttcctgagtatacaggcgcaaacaaatatgatgaggctgccagctacatccaaagcaagttcgaggaccttaataaacggaaagatactaaagaaatttacactcactttacatgcgcaacagatacgaagaatgtgcaatttgtgtttgacgcggtgacggatgtaatcataaaaaataaccttaaggactgtgggctgttctag

SEQ ID NO: 225448 - DNA, 957 bp, Artificial Sequence
  Description of Artificial Sequence: Synthetic coding sequence
atgcgcggtgcaggcgagtcaggcaagtctaccatcgttaaacagatgaagataatacacgaggacgggtacagcgaggaggagtgcagacagtatcgagcagttgtttattccaataccatacagtccataatggcgatcgtgaaagcaatgggaaacttgcaaatcgacttcgccgatccatcacgggcagatgacgccagacagcttttcgcactctcatgcacagccgaagagcaaggggtcttacccgacgacctgtcaggggtgataaggcgtctctgggccgaccacggagtgcaggcttgcttcgggcgttcgcgagagtatcagcttaatgactcggcggcttactacctcaatgatcttgagcggattgcccagtccgattacatcccaacacagcaggatgttttgcgcacacgggtcaagaccaccggcatcgtcgaaacccatttcactttcaaagacctgcatttcaaaatgtttgatgtgggtgggcaacggtcggaaagaaaaaaatggatccactgtttcgagggggtcactgcaatcatcttttgcgttgcactctctgcctacgacctggtccttgccgaggacgaagaaatgaatcgaatgcacgagtccatgaaactctttgactccatctgcaacaacaaatggttcaccgatacaagtatcatcctgtttctcaacaaaaaagatttgttcgaggaaaagataacacacagtccccttaccatctgtttcccggaatacacaggagccaataagtacgacgaagcagcttcttacattcagtccaaattcgaagacctcaacaagcgcaaagataccaaagagatttacacgcacttcacctgtgctaccgatacgaaaaacgtacaatttgtcttcgatgctgttacggatgtgataattaaaaacaatctgaaggactgcggattgttttag

SEQ ID NO: 225449 - DNA, 825 bp, Artificial Sequence
  Description of Artificial Sequence: Synthetic coding sequence
atggccatcgtcaaagctatggggaacctccagatagactttgccgaccctagccgcgcagatgatgcgcgtcagctgttcgctctgtcctgtacagccgaggagcagggagtgctgcccgacgatttatccggagtaatcagacgcttgtgggccgatcatggggtgcaagcgtgttttggtaggtcgcgtgagtaccagcttaacgatagcgccgcttactatctgaacgatcttgaaaggattgcgcagtccgactacattcccactcagcaggatgtgttgcgcacgcgagtgaaaactactggcattgtggagacccacttcacattcaaagatctgcatttcaagatgtttgacgtaggcggacagcgttccgagcgcaagaaatggatccattgttttgaaggagtaacagcgatcattttttgcgtggccctgtcagcatacgatctagtcctagcagaggacgaggaaatgaaccgaatgcatgagtctatgaagttattcgattctatttgcaacaacaagtggttcactgacaccagcatcatcctgtttttgaataagaaggacctgtttgaggaaaaaattacacatagccctctgactatatgctttcccgagtatacgggtgccaacaagtatgatgaggcagccagctacatccagtctaagttcgaagaccttaataagagaaaagatacgaaagagatctatacgcatttcacttgcgctaccgatactaagaacgtgcagtttgtgttcgacgcggttactgacgtcatcatcaaaaataatctgaaggattgcggactcttctag

SEQ ID NO: 225450 - DNA, 1086 bp, Artificial Sequence
  Description of Artificial Sequence: Synthetic coding sequence
atggggtgcaccgtgagcgccgaagacaaggccgctgcagaacggtccaagatgatcgacaaaaatttgagagaggatggcgagaaggctgcaagggaggtgaagcttctgctacttggggcaggagagagtggcaagtcaaccattgtgaagcagatgaagattattcacgaagatggttatagtgaggaagaatgtcgtcaataccgcgctgtagtgtactctaacaccatccagtctattatggccattgtgaaagccatgggcaacctccaaatcgatttcgctgacccatcaagggcggatgacgctaggcagctcttcgcactttcttgcacagctgaagagcagggcgtgctgcccgacgacttgtccggcgtcatcagacgtctgtgggctgaccacggtgttcaggcctgctttgggaggtcaagagagtaccagctcaatgattccgctgcttattacctgaatgatctggaaaggatcgcccagtccgactacattccaacccagcaggacgtgctgcgcacccgggtgaaaacaacagggatcgttgaaacgcacttcactttcaaagatctgcacttcaagatgtttgatgttgggggtcaaagaagcgagcgtaagaagtggatccattgctttgagggagtgactgccatcatcttttgtgtggccctgagtgcttacgaccttgtgttggccgaggatgaagaaatgaacagaatgcacgaaagtatgaaattattcgatagcatctgtaacaataagtggtttaccgacacctccattatacttttcctgaataagaaagacctcttcgaagagaaaattactcatagcccattgactatttgcttccctgaatataccggcgctaataaatacgatgaagcagcctcatatatccaatccaaatttgaagacctgaacaagcgcaaggacaccaaggagatttacacccacttcacgtgtgcaacagataccaaaagccggaagctgttccgcgagaattaccttaaactgagcgatcccgaccagcagccacccccagcgccactgccatccgatagcgtgccctag

SEQ ID NO: 225451 - DNA, 1065 bp, Artificial Sequence
  Description of Artificial Sequence: Synthetic coding sequence
atggggtgtaccctgagtgctgaagataaggccgcagtggagagatctaagatgatagaccgcaatctgcgggaggatggagagaaggcggcaaaggaggtcaaattactgctgctcggagctggtgagtctggaaaatctacaattgtgaaacagatgaagatcattcacgaggacggatattctgaagatgagtgcaaacagtataaagtagtagtgtattcaaatactatccagtcgattattgctatcatacgagccatgggcaggctgaagatcgatttcggggaagctgctcgcgctgatgacgccagacagctattcgtgctcgcgggatccgccgaggagggcgtcatgactccagaactggctggcgtgataaagaggttatggagggatggtggagtgcaagcttgtttttcccgtagcagggagtatcagttaaatgactctgcatcttattacctgaacgatctagacaggatctcccagtccaattatatacccactcaacaggatgtgttaaggacccgggtgaagacgacaggcatcgtcgagacacacttcacattcaaggatctctactttaaaatgttcgacgtgggaggtcagcggagtgagagaaagaagtggatccattgttttgagggcgtgacagctattattttctgcgttgccctgagcgattacgacctggtactggctgaggacgaggaaatgaaccgaatgcatgaatccatgaagctgttcgattccatttgcaataacaaatggttcaccgagacgtccatcatcctatttttgaataagaaggacctgttcgaagaaaagataaaacgatcaccactgaccatttgctaccctgaatatacaggtagtaacacatacgaggaggccgcagcatacatccagtgccagttcgaggatcttaaccgccgaaaagataccaaagagatctatacacactttacatgcgccacagacaccaagaacgttcagtttgtttttgatgccgtcacagacgtgatcatcaaaaacaatctgaaggaatgcggactctactag

SEQ ID NO: 225452 - DNA, 2652 bp, Artificial Sequence
  Description of Artificial Sequence: Synthetic coding sequence
atggccgaaaatagcgtgttgactagcacgacggggagaacctcgctcgctgattcttcaatcttcgacagcaaagtgacggagattagcaaagagaacttgttgatcggaagcacatcctacgttgaggaagaaatgcctcagatagaaactagggtcattctggtacaggaggccggtaaacaggaagagttgattaaagctctgaaagacatcaaggtgggattcgtgaagatggaatcagtagaggaatttgagggtttggacagcccggaattcgaaaacgtgtttgtcgtaacagacttccaggatagtgtctttaatgatctttacaaggccgactgtagggtcattgggcctcccgtcgtcctgaactgtagccagaagggcgaaccgctcccatttagctgcaggcccctttactgcacttcgatgatgaatctcgtgctgtgttttaccgggtttagaaagaaagaggagttggtcagactcgttaccctcgttcatcatatggggggagtgatacgaaaggattttaattctaaagtgacccacctggtcgctaattgcactcagggcgaaaagttccgcgtcgctgtgtctctgggaacccctataatgaagcccgagtggatatacaaggcgtgggagaggcggaatgaacaagacttctatgctgcagtagacgattttcgcaatgaattcaaagtacctccgtttcaggattgtatcctatcttttctgggattcagcgatgaagagaagactaacatggaagaaatgactgaaatgcaaggagggaaatacctgcctttgggcgacgaacggtgtacacatttggtggtcgaggagaacattgtgaaagacctcccgtttgaaccttccaagaaactctacgttgttaaacaagaatggttctggggaagtatccaaatggacgcccgtgccggtgaaaccatgtatctgtacgaaaaggccaatacacccgagctgaagaagtctgtctctatgttgagtttgaataccccaaactccaaccgcaaacgtcgcaggctgaaagagacactggcccagctttcaagagaaacagacgtgtctccgttcccccctaggaagcgaccctccgctgagcattcgttgtccattggaagtctgttggacataagtaatacgcccgaatccagcatcaactatggtgatacccctaaaagctgcaccaaatccagcaagagtagtaccccggtacctagcaaacaaagcgcccgttggcaggtggccaaagagttataccagaccgaatccaactacgtcaatatacttgcaactattattcaactcttccaagttccactggaagaagaaggccagcgtgggggtccaattctggcaccagaggaaatcaaaaccattttcgggtcgatccctgacatctttgacgtgcacaccaagatcaaggatgacttggaagacctgattgtcaactgggacgagagtaaatctatcggcgacatctttctgaagtactctaaggaccttgtgaaaacgtatccaccattcgtaaatttcttcgaaatgagtaaggaaaccattatcaagtgcgaaaagcaaaagccacgatttcatgcatttctcaagatcaatcaggcaaaaccagagtgtgggcgtcagtcgttagtggagttgctaattagaccagtgcagagattacccagtgtggcattactgctcaacgatctaaagaaacacacggcggacgaaaacccggataagtctaccttagagaaggccatcggctcactcaaagaagtcatgacacacatcaatgaagataagcggaaaacggaggcccagaaacagatcttcgatgtggtgtacgaggtcgatggatgtccagccaacctacttagctcccatcggtctctcgttcagcgcgtggaaacaattagtctcggcgaacacccgtgtgaccgcggtgagcaggtgacactgttcctgtttaacgactgtctagagatagcaaggaaacgccacaaggtgattggaaccttcaggtcaccccacggccagactcgtccaccggcttccttgaaacatatacatctcatgcctctctctcagatcaagaaggtgctggatatccgtgaaacggaagactgtcataatgccttcgctctcctggtgagaccccctacagagcaagctaacgtcctgctgagcttccagatgacaagcgatgaactgcctaaagagaattggcttaagatgctttgccggcacgtggccaataccatatgtaaagccgacgcagagaacctaatatacaccgcagacccagagtcgttcgaggtaaataccaaagatatggactctacattgtccagagcatctagagccatcaaaaagacctctaagaaagtgaccagagccttcagtttttccaagacccctaaaagggccctgagacgggcactgatgacatcccacgggtctgttgaaggtaggtcccctagctctaatgataagcacgtcatgtcaaggctgtctagcactagttcactagccggaatccccagtccgtctttggtgtcactcccaagtttttttgagcgacgatcccatacgctgtcccgcagcacaacccacctcatctag

SEQ ID NO: 225453 - DNA, 1053 bp, Artificial Sequence
  Description of Artificial Sequence: Synthetic coding sequence
atgggagcaggagctagcgcagaggagaaacacagtcgggagctggagaaaaaattgaaggaagacgccgagaaagatgcacgcacggtgaaattgttactcttgggagcaggtgaatccggcaagtctaccattgtcaagcaaatgaaaatcatacaccaggacgggtattctctagaggagtgtctagaattcatcgcaattatttatgggaacacgctccaatctattctcgccatagtccgggctatgaccactctcaacattcaatatggcgacagtgcacgacaggacgatgctcggaagctgatgcacatggctgacactattgaagaaggtacaatgcccaaggagatgagtgatattatacagcggctttggaaagactcagggatccaggcttgcttcgaacgggctagcgagtaccagctgaatgattccgcaggctactacctcagcgatttagagcgtctagtcacgccgggatatgtgcctacagagcaggacgtgctccgttcccgagtcaagaccaccggcattatcgagacacagtttagctttaaagatcttaattttagaatgttcgacgtcgggggacagagaagtgagcgtaagaaatggatccactgctttgagggcgtgacctgtattatcttcattgcggctttgtccgcttacgatatggtcctggtcgaagatgatgaagtcaacagaatgcatgagtccctacatctcttcaactctatttgcaatcaccggtacttcgctacaacttctattgttctttttctgaacaagaaggacgtattctttgagaagatcaagaaagcccatctgtccatatgctttccggattacgatgggccaaatacgtatgaggacgccggaaactacatcaaagtgcagtttctcgaactgaacatgagaagagacgtgaaggagatatattcccatatgacttgcgctacggacacccaaaacgttaaatttgtgttcgatgccgtcactgatataattattaaagaaaacctgaaggattgtggtttgttctag

SEQ ID NO: 225454 - DNA, 1065 bp, Artificial Sequence
  Description of Artificial Sequence: Synthetic coding sequence
atgggaagtggcgcttcagccgaggataaagagctggcaaaacgcagcaaggaattagagaaaaaactgcaggaggatgccgataaagaggctaagactgtgaagctgctgctgctaggggctggcgagagtggtaaaagcactattgtaaagcaaatgaagatcattcatcaggacggatactctcccgaagagtgtttagaatttaaggctattatctacgggaatgtacttcagagcattcttgccattatcagggccatgactacccttggcattgattatgcagaaccttcttgcgctgacgatgggcgtcagctgaataatctcgccgattccatcgaggaggggacaatgccccctgaactggttgaagtgattcgcaggttatggaaagatgggggagtacaggcgtgttttgaacgtgccgctgagtatcagttaaatgactctgccagttactatcttaaccagttggaaagaatcaccgaccctgagtatttgccttccgaacaggacgtgctgcgaagccgggtgaagactacagggataattgagacgaagttctccgttaaagatcttaactttagaatgttcgatgtcggaggccagaggtcagagcgtaagaaatggatccactgcttcgaaggcgtaacatgtatcatcttttgcgcagctctctcagcatatgacatggtcctggtcgaagatgatgaggtcaataggatgcacgagtcactgcacctgttcaattccatttgcaatcacaagttttttgccgctacaagcattgttttattcctgaacaaaaaagatctgttcgaggagaagattaaaaaagtccatttatccatctgcttcccagaatatgatggcaacaattcctacgatgacgccggaaattacatcaagagtcagtttttagacctaaacatgcggaaggacgtgaaagaaatctatagccatatgacttgtgccaccgacactcagaatgtgaaattcgtattcgatgcagtcacggatattatcattaaggaaaaccttaaagattgcgggctgttttag

SEQ ID NO: 225455 - DNA, 1068 bp, Artificial Sequence
  Description of Artificial Sequence: Synthetic coding sequence
atgggatgccgtcaatcctctgaggaaaaagaggcggcacgaagaagccgacggatcgacaggcacttgaggagcgagtcgcagcgccagcgacgcgaaataaagctacttctcctcggaacctctaatagtggtaagtccacgatagtgaagcagatgaaaatcatacattctggcggtttcaaccttgaggcctgcaaagagtacaagcccttaattatctataacgccatcgactctctaacacggattattagagcactggctgcgctgaggatagatttccacaaccccgaccgagcctacgatgccgtccagctgtttgcacttactggtccggcagagagtaaaggcgagattactccggaattgctcggagtgatgcgacgactctgggctgaccctggagcacaagcctgcttctccagatccagcgagtaccatctagaagacaatgcagcctattacctgaacgatttggaacgcattgccgcagcagattacatacccaccgtggaggatatcctgcgatcccgcgacatgactacaggcattgtcgaaaacaagtttacctttaaggagctcacattcaagatggtcgacgtgggagggcaaaggagcgaacgcaaaaagtggattcactgctttgagggggttacagcaatcattttctgcgtggagctctccgggtacgatctcaagctctatgaagacaaccaaacatctagaatggccgagtccctgcgtttgttcgactccatctgcaataataactggttcattaatactagcctcattctcttcctgaataagaaagacctgttggcagaaaagatccgacgcattccacttacaatctgtttccccgagtacaaaggtcagaatacctatgaggaagccgcagtgtacattcaacgccagttcgaagacttgaatcgaaataaagagactaaagaaatctacagccattttacctgcgctaccgacaccagtaacattcagttcgtgttcgacgccgttacggatgttattatccagaacaaccttaagtatatcggtctctgttag

SEQ ID NO: 225456 - DNA, 912 bp, Artificial Sequence
  Description of Artificial Sequence: Synthetic coding sequence
atgaaaatcatccactccggcggattcaatctggaagcgtgcaaagagtacaaaccgctgattatctacaacgccattgactctctgacacgcatcattcgagcccttgcggcactaagaatcgattttcataacccggatagagcttatgatgccgtgcaactgttcgctttgaccgggccagcagagagcaagggcgagataacaccagagttgctgggcgtgatgagaaggctctgggctgacccaggggctcaggcttgcttttccagaagctcagaataccatcttgaagataacgcagcctattatctgaatgatttggaacgaatcgctgcggctgattacatccctacagtagaggacatactgagatctcgcgatatgactacaggtatagtggagaacaagttcactttcaaggaactgacctttaagatggtcgacgtgggcggtcaacgatcagagcgcaaaaaatggatacactgttttgagggcgttacagccataatcttctgcgtggaactgtccgggtacgatctcaagttatacgaggacaaccagacatcacgcatggctgagagcctccggttgtttgactccatttgtaataataattggttcattaataccagcttgatactctttctgaataagaaggatctgctagccgagaagatccgcaggatccccctgaccatctgctttcctgagtataaaggccaaaacacatatgaggaagccgctgtctatatccagagacagttcgaggacctgaatcggaataaggaaaccaaagagatatattctcacttcacctgtgcgactgacacctctaacatacaattcgtgtttgacgcggtgactgatgtgataattcagaacaacttaaaatacatcgggttatgctag

SEQ ID NO: 225457 - DNA, 1188 bp, Artificial Sequence
  Description of Artificial Sequence: Synthetic coding sequence
atgtgcgaccagactttcttagtgaacgtatttggttcttgcgacaaatgctttaagcagcgggctttacggcctgttttcaagaaatcccagcagctctcatattgtagcacgtgcgctgaaatcatggccaccgaaggactgcacgaaaatgagacgctggcgagcctgaagtcagaggcggagtccctgaagggaaaactggaagaagagcgtgcaaaattacacgacgtcgaactgcaccaggtagcggagcgcgttgaggcccttggacagtttgttatgaagactcgacgcacgcttaagggacacggcaataaggtattgtgcatggattggtgcaaagataagcggaggatcgtgtcttcctcccaggatgggaaagtcatagtttgggactctttcacaacaaacaaagaacatgcggtaaccatgccatgcacttgggtgatggcgtgcgcctatgcaccgagcgggtgtgcgattgcatgcggaggactcgataacaaatgctcggtctaccctctgaccttcgacaaaaacgagaacatggccgcaaaaaagaagtcagtggcaatgcatactaactacctttcagcctgcagctttactaatagcgatatgcagattttgacggcatctggcgacggcacctgcgccctgtgggacgtggagagcggccagctgctgcagtctttccacgggcacggagcagacgtgctttgcctcgatcttgctcccagcgagacgggaaatacgtttgtgtccgggggatgcgataagaaggctatggtgtgggacatgcgcagcggccagtgcgtccaggctttcgagacgcacgaaagtgacatcaactccgtccggtactacccatccggggacgctttcgcatcaggctcggacgatgcaacatgccggctgtatgacctgagggctgatagggaggtggccatctactccaaggagtctatcatcttcggcgcttccagcgttgatttctcactgtccggaaggctcctgttcgccggttacaatgattacaccatcaacgtgtgggatgttctgaagggttcgcgggttagcatactctttggacatgagaacagagtgagtactctgcgggtgtcccccgacggcaccgcattctgcagcgggagttgggaccacacactgcgggtgtgggcctag

SEQ ID NO: 225458 - DNA, 1062 bp, Artificial Sequence
  Description of Artificial Sequence: Synthetic coding sequence
atggccacagaggggctgcacgagaatgagactttggcttctttgaaatctgaagctgagtctttgaagggtaagctcgaggaagagcgcgctaaactgcacgatgtcgaattgcaccaggtcgccgagcgcgtcgaagcactagggcagtttgttatgaagactcggcgaactttgaagggacacggcaacaaggtgttgtgcatggattggtgcaaagacaaaaggcgaatcgtctcgagctctcaagatgggaaggttattgtgtgggacagctttacaaccaacaaggagcatgccgtgaccatgccttgcacttgggtgatggcctgtgcctatgcccctagcggatgtgccatcgcatgtggagggcttgataacaagtgctcagtgtatccactgacgttcgataaaaacgaaaatatggcagcaaagaagaagagcgtcgccatgcacaccaactatctgagtgcctgtagtttcaccaatagcgacatgcaaattcttaccgctagcggcgatgggacgtgcgccctgtgggacgtggagtccggccaacttttgcaatctttccatggtcacggtgccgatgttctgtgtcttgacctggccccaagcgaaacagggaacactttcgtgtcaggagggtgcgacaagaaggctatggtgtgggacatgagatcaggccagtgcgtccaggcctttgagacccacgaatctgacatcaactccgttcggtattacccttccggggatgcgttcgcatctggtagtgacgatgctacatgcagactctacgaccttagggccgaccgagaagttgccatttattcaaaagaatccatcatttttggagcttcgagcgtcgacttctccctgagcgggcgtctgctctttgctggctacaacgactacaccatcaatgtgtgggatgtgcttaaggggtctcgcgtctcaatactgtttgggcatgagaatagagtctctacgctcagagttagcccggacggcacagccttttgctctggctcgtgggatcacactctccgagtttgggcatag

SEQ ID NO: 225459 - DNA, 852 bp, Artificial Sequence
  Description of Artificial Sequence: Synthetic coding sequence
atggctacggaggggctgcatgagaacgagacattggcttcattgaagagcgaggcagagagcctcaaagggaaactggaagaggaaagagccaaattgcatgatgtggagctgcatcaggtcgccgagagggtagaagccctcggacaatttgttatgaaaacccgcagaacattaaagggccacgggaacaaggtgctctgtatggactggtgcaaagacaagaggaggatcgtttcttcctcccaggacggaaaagtgattgtgtgggacagctttacaactaacaaaatcttgacagctagcggcgacggcacatgcgccctgtgggacgtggagtctggacagctgcttcagagtttccacggccatggcgctgacgtgctgtgtctggatctagccccatccgagacgggcaataccttcgtcagtgggggttgtgacaaaaaagctatggtttgggacatgagatcggggcagtgcgtacaggcatttgaaactcatgagagcgatattaactcggtcaggtactacccgtcaggagatgccttcgcctcaggttccgatgatgccacctgtagactctacgacctccgggctgatcgggaggtcgcgatctatagtaaggagagcatcatctttggagcctccagcgtggatttctctcttagcggacgactgctcttcgctggatacaacgactatactattaatgtgtgggatgtcttaaagggctcaagggtctccatcttgttcggacacgaaaatcgagtgtccaccttgcgcgttagccctgacggcactgcgttctgtagtggcagttgggatcatactctgagggtttgggcgtag

SEQ ID NO: 225460 - DNA, 582 bp, Artificial Sequence
  Description of Artificial Sequence: Synthetic coding sequence
atgtcgaagctgctcatcctgatcctcacagctagtggtgacggcacctgtgcactctgggatgttgagtctggccaactgcttcagtcattccacggacacggagcggatgttctgtgtttagacctggccccatccgagaccgggaacactttcgtctctggaggttgcgataaaaaagcgatggtctgggacatgcgcagtggccaatgtgtacaggcctttgaaacccacgaatcagatatcaacagcgtgagatattatccctctggtgatgcatttgcctccggatctgatgacgccacctgtcgcctctacgacctgcgcgctgacagggaagtcgcaatttacagcaaagaatccataatttttggagcttccagtgtggacttctctctgtcgggtaggcttctgttcgctggatacaacgactacacgataaatgtgtgggacgtgctaaaggggtcccgcgtgtctatcttatttggccacgaaaatcgggtttccactctgagggtttccccagatggaacagccttctgtagtggctcgtgggatcataccctgcgagtttgggcttag

SEQ ID NO: 225461 - DNA, 1023 bp, Artificial Sequence
  Description of Artificial Sequence: Synthetic coding sequence
atgtcagagctggaccagctgagacaagaggctgaacagctgaagaaccagataagggacgccaggaaagcctgcgccgatgccacgctctctcaaattaccaacaatatagatcccgtgggacggatccagatgcgaacaagaagaacccttcggggacacctggcaaaaatctacgctatgcattggggaactgactctagacttctggtgtccgctagtcaggatgggaagttgatcatctgggactcatataccacaaataaggtgcacgctataccactcagaagcagctgggtgatgacatgcgcttatgcaccatccgggaattatgttgcgtgtggtggattagataacatatgctccatctacaacctgaagaccagagagggcaatgtgagagtgtcgagagagttggctggccatacgggttatctgtcatgttgtcgatttctggacgacaatcagatcgtcacttcttctggggacactacatgcgctctgtgggacattgaaacaggacagcagacaacaacatttacaggccacactggagacgttatgtccctctccttagcacctgacacacgcttgtttgtgtctggggcttgtgacgccagtgccaaactttgggatgtccgcgagggaatgtgtcgccaaactttcacaggacatgaaagtgacataaacgccatctgctttttcccaaatggcaatgctttcgccaccggctccgacgatgcaacctgcaggcttttcgatttacgggctgatcaggaactaatgacctactcacacgacaacatcatctgtgggattacttcagtgtcttttagcaaatcaggcagattgttgctggccggatacgacgatttcaattgtaatgtctgggatgctctcaaggccgatagggccggtgtactggcaggacacgataatcgcgtgagctgcctcggggtcactgatgacggaatggcagtagcgacaggatcctgggactccttcctcaaaatctggaattag

SEQ ID NO: 225462 - DNA, 1023 bp, Artificial Sequence
  Description of Artificial Sequence: Synthetic coding sequence
atgagcgaactggatcaactgcggcaggaggcagaacagcttaagaatcagatccgcgacgccaggaaagcgtgcgccgacgcaaccctttctcagatcactaataacatcgatcctgtgggcaggattcaaatgcgtacccgaagaaccctgcgaggccatctcgctaagatctacgcgatgcattgggggacagatagtcgactactggtgtctgcatcccaggatggaaaactaattatctgggattcatatacaactaataaagtgcacgccattcctctgagatctagttgggtgatgacctgtgcctacgctccctcaggtaattacgttgcatgtggagggcttgacaatatttgttcgatctacaatctgaagactagggaggggaacgtaagagtgtccagagaactggcaggccatacgggctacctctcctgttgccgctttctggatgataatcagatagtaactagttcaggagacacgacctgtgccctgtgggacatcgagaccggtcagcagaccactacgtttaccggccacacaggtgacgtcatgtctctcagtctggctcctgatacccgcctgtttgtgagcggggcttgcgacgcttctgccaaactttgggacgtacgggagggaatgtgtagacagacgtttaccggccacgagtctgacattaacgccatctgctttttccccaacggcaacgcttttgcaactggttctgacgatgctacatgccgactgttcgatctgcgggcagaccaggaattaatgacgtacagccacgacaatatcatctgcgggatcacgagcgtaagctttagcaagagcgggagattactgcttgccggttacgacgatttcaattgtaacgtatgggatgcccttaaggcagaccgtgccggtgtcttggcaggccacgacaacagggtctcctgcctcggagtgacagatgacggaatggccgtcgcgactggctcttgggacagcttccttaagatttggaactag

SEQ ID NO: 225463 - DNA, 597 bp, Artificial Sequence
  Description of Artificial Sequence: Synthetic coding sequence
taaggctacctgagttgctgtagattcctcgacgataaccaaatcgtcacatcgtccggcgacaccacctgcgccctttgggacatcgaaactggacagcaaacaaccactttcacaggacacactggtgatgtgatgtctctcagcctcgcccctgatacaagacttttcgtgagcggcgcatgcgacgcatctgcgaaactgtgggatgtccgcgagggcatgtgtcgccagacttttacagggcatgaatctgacattaatgcgatttgttttttcccgaacggcaatgcattcgctactgggagcgatgacgctacctgtcgtctttttgatttgagggctgaccaggaactgatgacgtatagtcatgacaatataatctgtgggatcaccagcgtgagcttcagcaaatcaggacggctcttactggcaggctatgacgactttaattgtaatgtatgggacgcattaaaggccgatcgcgcaggcgtcctcgctggccatgacaacagggtcagttgtttgggggtgaccgacgacggaatggcagtcgctactggcagttgggattcattcctgaaaatttggaattag

SEQ ID NO: 225464 - DNA, 444 bp, Artificial Sequence
  Description of Artificial Sequence: Synthetic coding sequence
atgagtgaactggaccagcttagacaggaggccgagcagctgaagaaccagataagagacgctcggaaggcctgtgcggatgccacccttagtcaaatcacaaacaatattgatcctgtggggcgtatccagatgcgcacacgtcgaactctccgcggtcacctggctaaaatctacgccatgcattggggcacagactctcggttgctggtctcagcatctcaggatgggaaattgatcatttgggactcctacactaccaacaaggtacatgccatcccactaagatcctcgtgggtgatgacatgtgcctatgctccctcagggaactatgtcgcctgtggcggtctcgataacatttgctcaatctataatctgaaaacccgggaaggcaacgtgagagtgagtagggagcttgcgggacataccggcacctgtccctag

SEQ ID NO: 225465 - DNA, 327 bp, Artificial Sequence
  Description of Artificial Sequence: Synthetic coding sequence
atgtcagagctggaccagttacggcaagaggccgagcaattgaaaaatcagattcgggatgcccgaaaggcatgtgcagatgccactttgagccaaataacaaacaacatagaccctgtgggcaggatccagatgaggacccgcagaacactccggggacacttggcaaaaatttacgctatgcactggggcaccgacagccgtctcttggtgtctgccagccaggacggaaagctcataatttgggacagttatacgacaaataaggtccacgcgattcccctgcgctccagttgggtgatgacctgcgcgtatgcgccttcttag

SEQ ID NO: 225466 - DNA, 405 bp, Artificial Sequence
  Description of Artificial Sequence: Synthetic coding sequence
atgtctgagctcgatcaattaaggcaggaggccgaacagctcaaaaaccagattcgcattaccaataatattgaccctgtgggacgaatccagatgagaacgcgccgtactctcagaggccacctagccaaaatttatgcaatgcattggggcactgactctcgtctgttagtctctgcatcccaggatggcaagctgatcatttgggattcctacaccacgaacaaggtacatgccatccctttgcggagcagttgggtgatgacatgtgcctacgctccttctggtaactacgtcgcatgtgggggtctagacaatatctgtagcatttacaacttgaagacccgcgagggaaatgtgagggtttctagggagttagccggacacaccgggacatgcccatag

SEQ ID NO: 225467 - DNA, 723 bp, Artificial Sequence
  Description of Artificial Sequence: Synthetic coding sequence
atgacatgtgcctacgctcctagtggaaactacgtcgcctgcgggggacttgacaatatctgttccatctacaatcttaaaactcgggaggggaacgtcagggtgtctcgcgaactcgcaggacacactggatacttatcgtgttgtagattcctggatgacaatcaaatcgtaacctctagcggcgacaccacctgcgcgctctgggatatcgagactggccagcaaaccactacctttaccgggcatacaggagacgttatgtctctgagccttgcccctgacactcgtctcttcgtgagcggcgcttgtgacgcctccgcgaaactgtgggacgtgcgcgaggggatgtgccggcagacattcacaggtcatgaatccgatattaacgccatctgtttcttccctaacggaaacgcattcgccactggcagcgatgatgccacatgtcgtttgtttgacctgagggctgatcaagaattaatgacctattctcacgataacatcatctgcggaatcactagtgtgtcatttagcaaaagtggacggttgctgctggcaggctacgacgatttcaattgcaacgtctgggatgccttgaaggccgatcgggctggcgttctagccggtcatgacaaccgcgtgagttgtctgggtgttacagatgacgggatggcagtggcaacaggttcatgggattctttccttaagatatggaattag

SEQ ID NO: 225468 - DNA, 984 bp, Artificial Sequence
  Description of Artificial Sequence: Synthetic coding sequence
atgacagcaccatgcccaccccctccgcctgaccctcaattcgtgctccgcggaacccagagccctgttcacgctctgcacttctgtgagggcgctcaggcccagggtcgacccctactgttttcaggcagccaaagcgggcttgtacacatttggagcttgcagacacgaagagccgtcacaaccttggacggacacggtgggcagtgcgtaacatggctccaaaccctcccacaggggaggcagcttctctcccagggtagggatctgaagctctgtttgtgggacctggccgagggacgttctgctgttgtcgactctgtgtgtctggaatccgtcggattctgccgctcatccatcctcgcaggagggcagccacgatggacgctggccgtgcctggcaggggctccgacgaggtgcagatactggaaatgccaagcaagacttcagtgtgtgcactgaagccaaaggctgatgccaagctgggcatgccaatgtgcttaagattgtggcaggcagactgttcatctaggcctctgcttctggctggttatgaggacgggtccgtcgtcctgtgggatgtgtccgaacagaaagtttgtagtaggatcgcttgtcacgaagagccggtcatggaccttgactttgactcccaaaaggcaaggggcatctcgggaagcgcgggaaaagccctggccgtgtggtcactggactggcagcaagctttgcaggtccgtgggactcatgagctcactaatcctggcattgcggaggtgacgatccggcctgaccgcaaaattttagctactgccggttgggatcatcggatacgcgtattccactggcggacaatgcagccgttggccgttctcgcttttcactcagctgccgtgcagtgtgtcgcatttactgccgacggcctcctcgccgcagggagtaaagatcaacggatctctctgtggagcttgtaccccagggcctag

SEQ ID NO: 225469 - DNA, 984 bp, Artificial Sequence
  Description of Artificial Sequence: Synthetic coding sequence
atgacagcgccttgtcccccaccccctccggacccgcaattcgtgctcaggggaactcagagccccgtccatgccctgcacttctgcgaaggcgcacaggcccaaggcaggcctctgctgtttagcggctcccagagcgggctggtgcacatttggtcactgcagacacgtagggctgtcaccacattggacggccacggcggacaatgtgtcacatggctgcagaccctgccacagggaagacaattgctgtcccaggggagagatctgaagctgtgtctctgggaccttgcggagggcagaagtgccgtcgtagattccgtctgcctggagtctgtcgggttctgtcgcagctccattctagcaggaggccagccaaggtggacgctggccgtgccaggcagagggtcggacgaagttcagatattagaaatgccctctaagacttcagtgtgtgcactcaagccgaaagctgatgccaagctcggcatgccaatgtgtctgcgactctggcaagctgattgttcctctcgtcctttgctccttgctggatatgaagacgggagcgtggtgctgtgggacgtctctgagcaaaaagtctgttccaggatcgcttgccatgaagaacctgtcatggatctcgacttcgattcccagaaggcaaggggaattagtggttctgctggtaaggcactggcagtatggtccctggattggcaacaggctttgcaggtccgaggaacacatgagctcacgaacccaggaatcgccgaagtaaccattagaccagataggaaaatcttagcgactgcaggctgggaccatcgcattagagttttccactggcggaccatgcaacctctagctgtgctggcgttccattctgcggcagtgcagtgcgttgcattcacagccgacggtctcctggccgctggctccaaagatcagagaatctctctttggagtctgtatcccagagcttag

SEQ ID NO: 225470 - DNA, 639 bp, Artificial Sequence
  Description of Artificial Sequence: Synthetic coding sequence
atgactgcaccctgccccccacccccacccgacccacaattcgtgctcagagggacacaatctcccgtgcacgccctccacttctgcgagggcgcacaggcacagggcaggcctctcctgtttagtggcagccaatctggactagtgcacatatggtcattacagactagaagggctgtgactaccctcgacgggcacgggggacagtgtgtgacatggctgcagaccctcccccagggtaggcagctcctctcccaggggagagacctcaagctgtgtttgtgggatttggccgaaggcagatcagcggtggttgatagcgtctgcctggaatcagtgggattttgtcgttccagcattctcgctggcggacagcctagatggaccttagcagtgcctggtcgcggatctgatgaggtgcagattctggaaatgccaagcaagaccagcgtctgcgccctcaagccaaaggctgacgccaaactgggaatgcctatgtgcttgagactatggcaggcagactgctccagccgcccactactgctggccggttatgaggacggctcagttgtgctctgggatgtctctgagcagaaggtatgtagtcgaatcgcatgccacgaggagcctggtctctag

SEQ ID NO: 225471 - DNA, 1023 bp, Artificial Sequence
  Description of Artificial Sequence: Synthetic coding sequence
atgagtgagcttgagcagctgcggcaggaagccgaacagcttaggaatcagatcagagacgcgaggaaggcgtgcggcgattccacattaacgcaaatcactgctggcttggatcctgttggtcgtattcagatgcgcacccgaaggaccctgagaggccatttagctaaaatctatgcaatgcactggggaactgatagccgtctgctcgtttccgcctctcaggacggtaagttaattatttgggacagttacacgacaaacaaggtccacgctattcctctccggagtagctgggttatgacttgcgcctacgctcccagcggtaatttcgtggcctgcggaggtctggacaatatttgttcaatctattcacttaagacccgcgaaggcaatgtaagggtcagcagggagctacccggacatacaggctacttaagctgttgcaggtttctggatgataatcagatcattaccagctccggagatacaacctgcgcgctctgggatattgaaaccggccagcagaccgtgggattcgcaggccattcgggagatgtcatgtctctctccctcgcacccgacggcaggaccttcgtcagcggcgcatgcgacgcttccataaagctgtgggacgtgagagattccatgtgccgacaaacttttatcggccatgagtccgacattaatgctgtggctttctttccaaatgggtacgcctttacaactggatctgacgatgccacatgccgattgttcgatcttagagcggaccaagaactacttatgtattcccacgacaacatcatctgcggcattactagtgtcgccttttcacgatcgggcaggctgttgctggcaggatacgacgatttcaattgtaatatttgggacgccatgaaaggggatcgggctggcgtgctggctggccacgataatcgtgtctcgtgtctgggggtgacagacgacgggatggccgtggcgactggctcctgggactcctttctaaagatttggaactag

SEQ ID NO: 225472 - DNA, 1023 bp, Artificial Sequence
  Description of Artificial Sequence: Synthetic coding sequence
atgtccgaactagaacagctgcgacaagaggccgagcagttgcgcaaccaaattcgggatgccagaaaggcatgtggcgactccaccctgacccagataaccgccggtcttgacccggtggggaggattcagatgcgcaccagaagaacgctaagaggacacttagctaagatctatgctatgcactggggtactgactctcgactgttagtctccgcgtcacaggacggaaaattgattatctgggactcctatactaccaataaggtgcacgcgataccgctcaggtcctcttgggtgatgacttgtgcatacgctcctagtggaaactttgtcgcctgcggtggcttggacaacatttgctcaatttattcactcaagacccgggaaggcaacgtgcgggttagtcgagagctcccaggacacacagggtacctctcatgctgcaggtttttggacgacaatcagataattacctcctcgggagataccacctgtgctctgtgggacatcgagactggccagcagactgtggggttcgcaggtcacagcggcgatgtgatgagcctcagcctcgctccagacggcagaacattcgtgtctggggcttgcgacgctagcataaagctgtgggatgtgcgagatagcatgtgtagacagacctttattggccatgagtccgatatcaacgcggtcgctttcttccccaacggatatgcttttacaacgggatcggacgacgccacttgtaggctctttgacctgcgggcagatcaggaactgctgatgtattcccatgacaatattatctgtgggattactagcgtagcattctcacgcagtgggaggctgcttctcgcgggatacgatgattttaactgcaacatctgggacgccatgaaaggagatagagctggtgtactggcgggacacgacaaccgggtgagttgtctcggggttactgacgatgggatggcagtcgccacaggcagttgggatagctttctgaaaatttggaattag

SEQ ID NO: 225473 - DNA, 1023 bp, Artificial Sequence
  Description of Artificial Sequence: Synthetic coding sequence
atgtccgagctcgaacagctgaggcaggaggcagagcagctgaggaatcagataagagatgcaagaaaagcatgtggtgacagcaccctcactcaaatcactgcgggactcgatccagtgggacgaattcaaatgaggacaagaagaacgctaagaggccacctcgccaagatttacgcaatgcactggggcactgactccaggcttttagtcagcgcatcccaggatggtaaattaatcatatgggactcctacaccacaaacaaagtgcacgctatccccctgcgctcctcatgggtgatgacgtgcgcttatgctccctctggcaacttcgtggcctgcggaggtctggataacatctgttctatctattcactcaaaacaagagagggtaacgtgcgagtttcgagagagctgcccggacacaccgggtatctgtcatgctgtcgctttctggacgacaatcagatcatcacctcctcaggggatacgacttgtgccctctgggacatcgagactggccagcaaaccgttgggttcgctggccatagcggcgatgtaatgtctctcagcctggccccagacgggcgaaccttcgtgagtggtgcatgcgacgcctccatcaaattgtgggatgtcagggactcaatgtgcaggcagacatttatcggccatgagtctgatattaacgccgtggcctttttccccaatgggtacgcttttacgacgggatcagacgacgccacttgccgtcttttcgaccttcgcgctgaccaagaattactgatgtacagccacgacaatataatctgtggcatcacctctgtggcctttagtagaagcgggagactgttgcttgccggttatgacgattttaactgtaatatatgggatgcaatgaaaggtgacagagctggcgttctggccggtcatgataatcgggtatcatgtttgggtgttactgacgatggaatggctgttgcaacgggttcttgggactcattcctcaagatctggaattag

SEQ ID NO: 225474 - DNA, 459 bp, Artificial Sequence
  Description of Artificial Sequence: Synthetic coding sequence
atgtctgagctggagcagctgcgccaggaggctgagcaacttcgaaaccagattcgggatgccagaaaggcatgcggggactccacgctcactcagataaccgccggactggaccctgtgggccgaatccagatgcgtacacggaggacattacgcggacaccttgccaaaatatacgcaatgcactggggcacggattctagactcctggtttcagcttcacaggacgggaaactgatcatctgggacagttatacaacaaataaagtgcacgctatccctctccgaagctcttgggtgatgacttgcgcctatgccccaagtgggaattttgttgcttgcggcggtctcgataatatttgctccatttactctctgaaaacccgggaaggcaatgtacgcgtcagcagggagctcccaggccacaccggatatctgagctgttgcaggttcctgtag

SEQ ID NO: 225475 - DNA, 723 bp, Artificial Sequence
  Description of Artificial Sequence: Synthetic coding sequence
atgacgtgtgcctatgcaccgagtggtaattttgtcgcttgtggtggactggataatatctgctccatctacagcttgaagactagggaaggcaacgtgagggtaagccgggagctcccgggtcacaccggatatctctcatgttgtcgctttctggatgataaccagatcattacatcaagcggggacacaacctgcgcactgtgggatatcgagactggtcagcagaccgtaggctttgccggtcacagcggcgacgtgatgagccttagtctggccccagacggtcgaacatttgtttccggtgcatgcgatgctagcattaaattgtgggatgtgagagatagtatgtgtagacagactttcattggccacgagtccgatatcaatgccgtggcattcttcccgaacggatatgccttcactactggttctgatgatgcaacctgccggctgttcgatctgcgcgctgatcaggaacttttgatgtattctcacgacaatatcatttgcggcattacgtccgttgctttttcccgtagcgggcgactgctgctggccggatacgacgacttcaactgcaacatctgggacgcaatgaaaggcgatagggctggcgttttggcaggtcacgacaatcgagtctcatgcctcggggtaacagacgacggtatggctgtggccaccgggtcatgggattcttttctgaagatatggaattag

SEQ ID NO: 225476 - DNA, 891 bp, Artificial Sequence
  Description of Artificial Sequence: Synthetic coding sequence
atgcgtacccggcgtacgctgagggggcacttagctaagatttatgcgatgcattgggggaccgactcacggcttctggtttcagccagccaggatggtaaattaatcatttgggattcctacaccaccaacaaggttcatgctattcctcttcgatccagttgggtaatgacatgtgcttatgccccttctggaaatttcgtggcatgtggtggacttgacaatatctgctccatctacagtctgaaaacaagagagggcaatgtccgggtcagccgggaactcccgggacacacaggctacctctcttgttgccggttcctggacgacaaccagatcattacgagctccggagacaccacctgcgccctgtgggacatcgagacgggacaacaaacagtgggttttgccggacattctggcgacgtgatgagtctgtcacttgcaccagacggtaggaccttcgttagcggtgcatgcgatgcctctattaagctgtgggacgtcagggactctatgtgccgtcagacgttcatcggtcacgagtcggacatcaatgccgttgctttctttcccaacgggtatgcgttcactactggcagcgacgacgcaacatgccggctgttcgatcttcgagctgaccaggaactcctgatgtattcccacgacaatattatatgcggtattacatccgtggccttcagccgcagcggtagactgctattggctgggtatgacgattttaactgcaacatttgggacgccatgaaaggggaccgggctggcgtgttagcgggacatgataacagggtttcctgccttggagtcacagacgacggcatggcggtggcaaccggctcatgggattctttcctgaagatttggaactag

SEQ ID NO: 225477 - DNA, 723 bp, Artificial Sequence
  Description of Artificial Sequence: Synthetic coding sequence
atgacctgcgcttatgccccttccggtaactttgtggcctgtgggggactagataatatttgctccatctattcattaaagactagggaggggaacgttcgggtttcgagggaactgccaggacacacaggttacttgagctgctgcaggttcttggatgacaaccagattattactagcagtggcgacactacctgcgcgctgtgggacatagagacaggacaacagaccgtcggattcgccggacatagcggagatgttatgtcactgagtctggcccctgatggcagaacctttgttagtggggcttgtgacgcgagtataaagctctgggacgttcgggactccatgtgccgccagacttttattggccacgagtccgacatcaatgccgtggccttcttccccaacggctacgcatttactacaggcagcgatgatgccacgtgcaggctcttcgaccttcgggctgaccaggagctgttgatgtatagtcacgacaacatcatctgcggcatcacctccgtagcattctcccgtagtggtagactactattagccggatatgacgactttaattgcaacatctgggatgccatgaaaggcgatcgggctggcgtgctggcaggacacgacaaccgagtgtcctgtctgggcgtcactgatgacggcatggctgtggctaccggatcttgggacagctttttgaagatatggaactag

SEQ ID NO: 225478 - DNA, 699 bp, Artificial Sequence
  Description of Artificial Sequence: Synthetic coding sequence
atgagcgagctggagcagctccgccaggaagcagaacagttgaggaaccagattagggatgcacgaaaggcttgtggcgactcaactctgactcagataacagccggactcgatcccgtggggagaatccagatgcggaccagaaggacactgcgcggtcacttagcaaaaatctatgccatgcattggggtacagattcacgactactggtgtctgcctctcaggacggaaagctcatcatctgggattcctacaccacaaataaggtgcatgctataccactacggtcatcttgggttatgacctgcgcctacgccccatccgggaacttcgttgcctgcggcggactggataacatttgcagcatctatagccttaaaacacgcgagggaaatgttcgcgtgtcacgggagctacctggacacactggctacctcagttgctgtaggtttctggacgacaaccaaattatcacctccagcggagatactacctgcgcactttgggatatcgagaccgggcagcaaactgttggatttgcgggtcattccggcgatgtgatgtccctgtcactcgcgccagacgggaggacctttgttagcggcgcatgtgacgcctcaattaaactgtgggatgtgcgtgactctatgtgcagacagaccttcataggacatgagtccgatataaacgcagtctag

SEQ ID NO: 225479 - DNA, 891 bp, Artificial Sequence
  Description of Artificial Sequence: Synthetic coding sequence
atgcgcactagacgcactctcagggggcatctggccaaaatctatgcgatgcactggggcactgactcccgattactggtctcagcctcgcaggatggaaaattgataatctgggacagttacactaccaataaggttcacgcaatacccttgagaagtagttgggtaatgacctgcgcttatgccccatccgggaacttcgtcgcctgcgggggactggataacatctgcagcatatactcactgaagactagagaaggtaacgtgcgtgtgtctagggagctccccggtcacaccgggtatctctcatgctgccgctttttggatgacaaccagattataacctcaagcggggacaccacatgcgcgctttgggatattgagactgggcagcagaccgtaggtttcgccggacacagcggcgatgtcatgtccctgtctcttgctccagatggtcgaaccttcgtgtctggtgcctgcgatgccagtattaagctgtgggacgtgcgggatagcatgtgccggcagactttcattggccacgagagtgacattaacgcagtggcctttttccctaacggctacgcatttacaaccggttcagacgatgcaacctgtagattgttcgacttaagagcagaccaggaacttttaatgtatagccacgacaatattatctgtgggataacttctgtagcattttcgcggtccgggaggctgctgctcgcgggatacgatgactttaactgcaacatctgggacgccatgaaaggggatcgagcgggagtcctcgcaggacacgacaatcgagtgagctgcctgggtgtcacagacgacggaatggctgtcgccacaggctcctgggactcattcctgaagatttggaattag

SEQ ID NO: 225480 - DNA, 756 bp, Artificial Sequence
  Description of Artificial Sequence: Synthetic coding sequence
atgtccgaactcgagcagctgcgacaggaggccgagcagttaagaaatcaaattagggacgcacggaaggcatgcggcgactcaaccctcacgcagattaccgcaggcctcgatccagtgggcagaattcagatgcgcacaagacggaccctccgtgggcatttggccaaaatctatgctatgcactgggggaccgacagtagactacttgtatcggcttcgcaggatgggaagctgataatctgggattcctataccacgaacaaggtgcacgctataccattgagatcatcgtgggtgatgacctgtgcctacgccccttctggcaactttgtagcctgtggtgggctcgataacatctgttcaatctacagtctcaaaacaagggaagggaatgtaagggtgtctagggagctgcccggacatactggttacttgagttgctgccgcttcctggacgataaccagatcattacctctagcggcgatacgacctgtgcattatgggatatcgagacagggcagcaaacagtgggcttcgctggccacagcggcgacgtgatgtccttatccctggcaccggacggacgtacctttgtcagcggtgcttgcgacgcgtcgattaaactctgggacgtaagggattctatgtgcaggcaaacgtttatcggacatgagtctgatattaatgctgttgccttctttcctaatggttacgcattcacaacaggcagcgatgacgccacgtgtcggtag

SEQ ID NO: 225481 - DNA, 828 bp, Artificial Sequence
  Description of Artificial Sequence: Synthetic coding sequence
atgagcgccgaggtcaaagtgactggtcagaatcaggagcaatttttactgctggccaaatccgctaaaggcgctgccctggcgaccctgattcaccaggtgctcgaagctcccggagtctacgtgtttggcgagcttctagacatgcccaatgtcagggaacttgcggaatcagactttgcgtccacttttaggctgctgactgtgttcgcctatggcacctatgcagattatctcgctgaagcgcgtaatctccctccactgaccgaagcccagaagaacaaactgcggcacctctccgtcgtgactctagccgcaaaggtaaagtgcatcccgtacgcagtcctgttagaggcactggccctccgaaacgttcggcagcttgaggatctggtcatagaagctgtttatgccgatgtcctccgaggatcgctcgatcagagaaaccagcgcctcgaggttgactacagcataggtagggacattcagcggcaagacctgtcagccattgcgaggaccctccaagagtggtgtgtgggttgcgaagtagttctttccggtatcgaggaacaagtgtcaagggccaaccagcacaaggaacagcagctgggcctcaaacaacagatagaatcggaagtggccaatctgaaaaagaccatcaaggtcaccaccgccgcagctgcggcagcaacgtcgcaagatccagaacaacaccttactgagctccgcgaaccagccccaggcacgaatcaacgacagccatctaaaaaagcgtcgaagggtaagggcctgaggggtagcgctaagatatggtccaaatctaactag

SEQ ID NO: 225482 - DNA, 387 bp, Artificial Sequence
  Description of Artificial Sequence: Synthetic coding sequence
atgacgagtttattcgcccaggagatacggttgagtaagcgtcacgaagagatcgtgagtcagcgattaatgctgctgcagcagatggaaaacaagttgggcgaccagcacactgagaaagctagtcagctacagacagtggaaaccgcatttaagcgaaacctttctttactaaaagatattgaagctgcagagaaatccctgcaaacgaggatacacccactacctcgccctgaggtggtgtccctcgagacaaggtattgggctagcgttgaggagtatatccctaaatgggaacagtttctgttgggacgagctccctatcctttcgctgtagaaaatcaaaatgaagccgagaataccattcagaacgaagcacaaagatag

SEQ ID NO: 225483 - DNA, 1023 bp, Artificial Sequence
  Description of Artificial Sequence: Synthetic coding sequence
atgtccgaactcgagcagttgcgccaggaggcagagcagctgcgcaatcagatccaggatgcgaggaaggcctgtaacgacgcaaccctggtgcagatcacgtcaaatatggattccgtgggtcgcatacagatgcgcactcggcgtacactcagaggccatctggccaaaatctatgccatgcattggggctacgattctcgtctgctcgtcagtgcctcacaggatgggaagctcattatctgggacagttatacaaccaacaaaatgcacgcaattcctttgcggagcagctgggtgatgacctgcgcctacgctccctcagggaattacgtggcatgtggaggattggataacatttgttctatttacaacttaaagacccgggagggcaacgtccgggtgagtcgcgaattgccaggccacaccggctatctgtcttgctgtaggttcctggacgacagccaaatagtcacatccagtggggatactacttgcgcattgtgggatatcgagactgcccagcagactacgactttcaccggccacagtggggatgttatgagcctgtctctctcacccgatatgagaacgttcgtcagcggggcttgtgatgcctctagtaagctttgggatatccgcgacggtatgtgtcggcagtcctttaccggccatgtatccgatattaatgcagtgagcttttttccgaacggttatgcctttgctactggatccgatgacgccacttgtcggctctttgacttgcgtgcagatcaggagctattgctgtattcgcacgataatataatctgtggcataacctcggtggccttctccaaatccgggaggctgctactggccggatatgacgacttcaactgcaatgtctgggatactctgaagggagacagggcaggtgttctcgctggccatgataaccgggtgtcatgtctcggtgtcacagatgatggtatggccgtggctaccgggagctgggacagttttctcaggatttggaattag

SEQ ID NO: 225484 - DNA, 240 bp, Artificial Sequence
  Description of Artificial Sequence: Synthetic coding sequence
atgtctgaattggagcagctgcggcaggaggctgaacagcttagaaatcagatccaggacgccaggaaggcatgcaatgatgcgaccctcgtccaaataactagtaacatggactcggtgggcagaattcagatgcgcacacggaggacgctgaggggacatcttgcgaagatttacgcaatgcattgggggtacgatagcagattattggtcagtgcttcccaggatggcaagctgtag

SEQ ID NO: 225485 - DNA, 204 bp, Artificial Sequence
  Description of Artificial Sequence: Synthetic coding sequence
atggaggaatgggatgtgccacagatgaaaaaagaagtcgaatccttaaagtaccagctagctttccagcgggaaatggccagtaaaacaatccctgaactgctcaaatggattgaagacggcattcccaaggacccttttctgaaccctgatctaatgaaaaacaatccctgggtagagaaggggaagtgcaccatcctatag

SEQ ID NO: 225486 - DNA, 216 bp, Artificial Sequence
  Description of Artificial Sequence: Synthetic coding sequence
atggcatctaataatacagcaagtattgcgcaggctcgcaaactagtggagcagttaaagatggaggccaacattgatcgtataaaggtatctaaggccgcagcagacctgatggcctattgcgaggctcatgcgaaagaagatcctctcctcacgccagttccagcctccgaaaacccatttcgagaaaagaagttcttttgcgcaattttgtag

SEQ ID NO: 225487 - DNA, 309 bp, Artificial Sequence
  Description of Artificial Sequence: Synthetic coding sequence
atgcagggcaagctgcaaccccctatggaacgcgaggcacgggacggtgttcctagcgggaaagtcttcctcaaggacctttcttctactccgatggcctccaacaacacagccagcatcgcgcaggcaaggaagctggtcgagcagctgaaaatggaggctaacatcgacagaatcaaggttagcaaggcggctgccgatctcatggcatactgcgaggctcatgccaaagaggacccactacttacgcccgtgccagccagtgaaaacccattccgtgaaaaaaagtttttttgcgctattctgtag

SEQ ID NO: 225488 - DNA, 216 bp, Artificial Sequence
  Description of Artificial Sequence: Synthetic coding sequence
atggcctctaacaatacagcctcgatcgcccaggcacggaagttggttgagcaactcaagatggaggccaacatcgaccgcattaaagtctcaaaggctgccgcagatcttatggcctactgcgaagcacacgcaaaagaggatccattactgacgcccgtccctgcctctgaaaacccattcagagaaaagaagttcttttgtgccatcctatag

SEQ ID NO: 225489 - DNA, 216 bp, Artificial Sequence
  Description of Artificial Sequence: Synthetic coding sequence
atggccagcaataatacagcctctattgcgcaagccaggaaactcgtagagcagctcaagatggaggccaacatcgatcgcataaaggtgagcaaagccgctgccgacctcatggcgtactgcgaggcccatgccaaggaggatcccctcttgacgcccgtgccggcaagtgagaaccctttcagagaaaaaaagttcttttgcgcgatcctgtag

SEQ ID NO: 225490 - DNA, 216 bp, Artificial Sequence
  Description of Artificial Sequence: Synthetic coding sequence
atggcatccaataatactgcctctatcgcccaagcaagaaagttggttgaacagttaaaaatggaggcaaacatagatcggatcaaagtgtctaaggcggcagccgacctgatggcttactgcgaagcccacgctaaggaggaccctctgctgacacctgtacctgcatccgaaaaccccttccgggaaaaaaagtttttctgcgccatcctatag

SEQ ID NO: 225491 - DNA, 216 bp, Artificial Sequence
  Description of Artificial Sequence: Synthetic coding sequence
atggcctccaacaacacagcaagcatagcccaggcccgaaagctggtagagcagctgaagatggaggcaaatatcgatcgcatcaaagtttctaaagcagctgcagatctgatggcatactgtgaggcccacgcgaaggaggaccctttgcttacgcccgtccctgcgagcgaaaacccttttagggagaagaagttcttttgcgcaatactgtag

SEQ ID NO: 225492 - DNA, 333 bp, Artificial Sequence
  Description of Artificial Sequence: Synthetic coding sequence
atggtttatttgcaggccaagacacgcattccagagcacagaaaggtaacccagttgattaagtgttggtcaccagatctgaacccggtgtttctaaaagacctatcgtccacgccgatggcttcaaacaatacggcttccattgcacaagcgagaaaactggtggagcagctgaagatggaagccaacatagaccgtattaaggttagtaaagcggcagcagatctaatggcctattgtgaggctcatgctaaggaggatcccttgttgacccccgttcccgcatcagaaaatccatttcgcgagaagaagtttttctgtgccattctttag

SEQ ID NO: 225493 - DNA, 207 bp, Artificial Sequence
  Description of Artificial Sequence: Synthetic coding sequence
atgtccggtagctcttccgttgcagctatgaagaaggtggtccagcagcttagactagaggccggtctcaacagagtgaaagtatcacaggcagctgcggacttaaagcagttctgtctacagaacgcgcagcacgatccactacttacaggagtgagctcttcgaccaacccttttcggccacaaaaagtgtgctcttttttgtag

SEQ ID NO: 225494 - DNA, 207 bp, Artificial Sequence
  Description of Artificial Sequence: Synthetic coding sequence
atgagtggatcttcctccgtggccgcaatgaaaaaagtggtccagcagttgcgtctcgaggctggcctgaatcgtgtgaaggtgagtcaggccgctgctgatctgaaacagttctgcctgcagaacgcccaacacgatccattgctcacaggtgtctcatcatccacgaatcctttcaggccacagaaggtttgtagttttctgtag

SEQ ID NO: 225495 - DNA, 225 bp, Artificial Sequence
  Description of Artificial Sequence: Synthetic coding sequence
atgccggtgataaacatagaggatctgacggagaaggacaagctcaagatggaagtggaccagctgaaaaaagaagtcacgctggaacggatgcttgtaagcaaatgctgcgaagaggtgcgagactacgtcgaagagcggagcggggaggatcccctggtcaagggaattcctgaagataaaaatccttttaaggaactcaaaggaggctgtgttatctcctag

SEQ ID NO: 225496 - DNA, 225 bp, Artificial Sequence
  Description of Artificial Sequence: Synthetic coding sequence
atgcccgtcattaacattgaagatctcacagaaaaggacaagcttaaaatggaggtggaccagctcaaaaaagaggtgactcttgaacgcatgctcgtgtccaagtgttgcgaggaagtaagagattacgttgaggagaggagtggtgaagaccctttagtgaagggcataccagaggacaaaaacccttttaaagaactgaaaggaggctgtgtgatctcatag

SEQ ID NO: 225497 - DNA, 210 bp, Artificial Sequence
  Description of Artificial Sequence: Synthetic coding sequence
atggcccaggatctttccgaaaaagacctgttaaagatggaggtggaacagcttaagaaagaggtcaagaacactcgcataccaatctccaaagcagggaaagaaattaaagaatatgtcgaggctcaagcaggcaacgaccctttcctgaaagggatcccagaagacaagaacccgtttaaagagaaaggcggatgcctgatctcttag

SEQ ID NO: 225498 - DNA, 210 bp, Artificial Sequence
  Description of Artificial Sequence: Synthetic coding sequence
atggcgcaagatctgtccgagaaagatcttctgaaaatggaggtcgagcagctgaaaaaagaagtgaaaaacacacgaattccgatttcaaaggctggcaaggaaatcaaagaatacgtggaggcccaggccggtaacgacccttttttgaaaggcatccccgaggacaagaatccgttcaaagagaagggcggttgcttgataagttag

SEQ ID NO: 225499 - DNA, 210 bp, Artificial Sequence
  Description of Artificial Sequence: Synthetic coding sequence
atggcccaagatttatccgagaaagatctcctgaagatggaggttgagcagttgaaaaaggaggtaaaaaacaccaggattccgataagcaaagctggcaaagagatcaaggagtacgtggaggcccaggccggaaacgatccatttcttaaggggattcccgaagacaagaacccgttcaaagaaaagggcggatgtttgattagttag

SEQ ID NO: 225500 - DNA, 210 bp, Artificial Sequence
  Description of Artificial Sequence: Synthetic coding sequence
atggcccaagatctgtccgaaaaggacttgttgaaaatggaggtcgaacaacttaaaaaggaggtgaagaataccaggattcctatcagcaaagcaggtaaggaaattaaggagtacgtggaagcccaggcagggaatgatccttttcttaaaggaattcctgaggataaaaatcccttcaaagaaaagggaggctgccttatttcttag

SEQ ID NO: 225501 - DNA, 210 bp, Artificial Sequence
  Description of Artificial Sequence: Synthetic coding sequence
atggcccaggatctttcagagaaggacttactgaagatggaggttgaacagctcaagaaggaggttaaaaacacaagaattcccatcagcaaagccggaaaagaaatcaaagaatacgtggaagcacaggccggaaacgatccattcctgaaaggaatcccggaggacaaaaacccttttaaggagaaggggggatgcctgatatcttag

SEQ ID NO: 225502 - DNA, 1080 bp, Artificial Sequence
  Description of Artificial Sequence: Synthetic coding sequence
atgacgctggagtctatcatggcttgctgtctgtctgaggaggcaaaagaggccaggaggataaatgacgaaatcgaaaggcaactgagacgcgacaaacgcgatgccagacgcgaactaaagttgctgctcctgggcaccggcgagagcggcaagtcaacgtttattaaacagatgcgcatcattcacggcagtgggtattcagatgaagataaaaggggatttacaaagctcgtttatcagaatatctttacagccatgcaggcaatgatccgggcaatggataccttgaaaatcccgtacaagtatgagcacaataaagcacatgctcagctggtgagagaggtggatgtggagaaagtgtcagccttcgagaacccatatgtcgacgcgatcaagagcttatggaacgaccctggcattcaggagtgttatgatcgacgcagggaataccagctgtccgattccaccaagtattacttaaacgacttagaccgcgtggccgatccagcctatctgccgacccagcaagacgtgctcagagttagggtgcctactaccggaatcatcgaataccccttcgacttgcagagtgtgattttcagaatggtggatgtaggcggacaacgttccgagcgtcgcaaatggatccactgcttcgaaaatgtgacatcaatcatgtttcttgtggctctgagcgaatatgatcaagtactggtagaaagcgataatgagaaccggatggaggagtcaaaggccctcttccgtaccatcatcacctacccttggttccaaaacagtagcgttattctctttttaaacaaaaaggatctcctggaggagaaaataatgtattcccatcttgtggattatttcccagaatacgacgggccacagagggatgcgcaggctgcaagggagtttattctcaaaatgtttgtagacctcaatcccgattcggataagatcatatatagccacttcacgtgtgcaaccgacactgaaaatatccgatttgtctttgcggctgtgaaagacaccatcctgcagctcaatttgaaggaatacaacctggtatag

SEQ ID NO: 225503 - DNA, 474 bp, Artificial Sequence
  Description of Artificial Sequence: Synthetic coding sequence
atggttgatgtgggcggtcaacgaagcgaacgaaggaagtggatccactgtttcgagaacgttacatcaatcatgtttttggtagctctatccgagtatgaccaggtcttggtggaaagtgacaacgaaaataggatggaagaaagtaaagctctgtttcggacaatcatcacctacccctggttccagaacagctctgtcatcctgttcctaaacaagaaggacctactcgaagagaagattatgtacagtcacctagtggactacttccctgagtacgacgggcctcaaagggacgctcaggcggctcgggagtttatactgaagatgttcgtcgatctgaacccagacagtgataagattatctatagtcactttacttgtgccaccgacacggaaaatatccgctttgttttcgccgcagtgaaggacaccatactacagctcaatctgaaggagtacaatctggtgtag

SEQ ID NO: 225504 - DNA, 513 bp, Artificial Sequence
  Description of Artificial Sequence: Synthetic coding sequence
atgggggaacgctgggccgattcacagttagatagccggtctacacacggtacgggcgaatcagggaagagcacgttcattaagcagatgagaataattcacgggtctgggtactcggacgaggataaacgcggattcacaaagttagtataccaaaacatatttaccgccatgcaagccatgatcagagccatggatacattaaagatcccttataaatacgagcacaacaaggctcatgcccagctggtcagggaggtggacgtggagaaggtgtcagccttcgagaatccctacgtcgacgccataaaaagcctgtggaatgatcctggtatccaggagtgctatgatcgcaggagagaatatcaactgagcgattccacaaaatactatctcaatgatctcgatagagtggctgatccagcatacctacccacacagcaggacgtgttgcgggtgcgggtgcccactaccgggattatcgaataccccttcgacctacagtccgtgtag

SEQ ID NO: 225505 - DNA, 1824 bp, Artificial Sequence
  Description of Artificial Sequence: Synthetic coding sequence
atgccgaggaagaagcccttttcagttaagcagaaaaagaaacaattacaggacaaacgcgaaaggaagaggggccttcaggatggcctccggagctcctctaacagtcggagcgggagccgcgagcgacgggaagagcaaaccgacacttcagatggagaaagcgttacacatcatattcgcaggctgaaccaacagccctcccaggggctgggccctcggggatatgatccaaacaggtatcgcctacatttcgagcgcgactccagagaagaggtggaaagaaggaaacgggcagccagagagcaggtgctgcagccagtttctgccgagctgcttgaactggatattcgagaagtttaccagccgggaagtgttttggactttccgcgacgccctccttggtcctacgagatgtctaaggaacagctcatgagccaggaggaacgcagttttcaggattatctggggaaaatccatggggcttactccagtgagaaattgtcgtattttgagcataacctggaaacgtggaggcaactgtggagagtgctggagatgagtgacatcgtgctcctgattacggatattaggcaccccgttgtcaacttcccacccgctctgtacgagtatgtgactggagaacttggactagccctcgtcttggtgctgaacaaagtcgatctggcacccccagcgctggttgtagcctggaaacactatttccatcaacattacccccagttgcatgtggtgctgtttacctctttcccacgcgacccccgaacacctcaggatcctagttcggtccttaaaaagtctagaagacgaggccgtggctggacccgggctctcggcccagagcagttactcagagcttgtgaggccatcaccgtgggtaaggtggatctttcatcatggcgggaaaagatcgccagagacgtggccggagcgacttggggaaatggttccggtgaggaggaagaggaggaggacgggccagcagtgcttgttgagcagcaaactgattctgccatggagcccacggggcctacacaggagaggtacaaggatggggtagtgactattggctgtgtgggattccctaatgttggcaagagctcactgatcaacggactagtaggaagaaaggtagtgagtgtctcacgaacgcccggacatacccggtacttccagacctacttcctgacgcctagcgtcaagctctgtgattgtccaggccttatcttcccatcactgctgcctcgccagctacaggttctcgccggtatctatccaatcgcccagatccaggagccgtatactgccgtcggatacctggcttcacgcatcccagttcaggctttgctgcatctgcgtcaccccgaagccgaggatccatccgctgaacacccttggtgcgcatgggatatctgcgaagcctgggcggagaagcggggatataagaccgcgaaggctgctcgcaatgatgtgtaccgtgctgctaacagcctcctcagactggctgtcgatgggagactcagcttatgcttccacccaccaggctatagcgagcagaagggcacctgggagagtcatccagagactacagagctcgtggtactgcaggggagggtggggcctgccggagatgaggaagaggaggaggaggaagaactgtccagtagttgtgaggaggagggggaagaagacagggatgcagacgaagagggcgagggcgacgaggaaactcctacctctgctcctggctctagcctcgccggtcggaatccgtacgcactgctgggcgaagatgaatgttag

SEQ ID NO: 225506 - DNA, 1224 bp, Artificial Sequence
  Description of Artificial Sequence: Synthetic coding sequence
gtggtgaatttcccccctgctctgtatgagtatgttacaggcgaactcggcctcgctctcgtcctcgtgttgaataaagttgatctcgcccctcccgcactcgtggtcgcgtggaaacactacttccaccagcattacccccagctgcacgttgtgctcttcaccagctttccaagggacccccgtacacctcaggatccgagcagcgtgctgaaaaagtcacgcaggagagggaggggatggacgcgtgcactcggccctgaacaactcctaagggcatgtgaagccattactgtgggtaaggttgacctgtcatcatggcgggagaagattgctcgcgacgtggctggagctacctgggggaatggatctggggaagaagaggaagaagaagacgggccagccgtgttagtggagcagcagactgactcagcaatggagcccactggtcccactcaggagagatataaggacggggtggtgacaattgggtgcgtaggctttcccaacgtaggcaagagctctctgatcaatggactggtggggcgaaaagtagtatccgtctcgagaacaccaggtcacacaagatatttccagacctattttttgacaccgagtgtgaagctctgcgactgccccggattgatcttcccatcgttactgccacgccagttgcaagttttggcaggcatctaccccatcgcacaaatccaggaaccctacaccgccgtcggctacctggcatctcgcatacccgtacaggccctcctgcatcttaggcaccccgaagctgaggatccctctgctgagcacccatggtgcgcctgggacatctgcgaagcctgggccgaaaagcgcggatacaagactgcgaaagcagccaggaatgatgtataccgcgctgccaacagcctcctacgccttgccgtggacggccgtctgagtctgtgttttcaccctccgggttattccgaacagaaaggcacatgggaaagccaccccgagacgaccgagctagttgtcctgcagggtagagtgggcccagctggcgacgaggaagaggaggaagaagaggaattgtctagctcgtgcgaggaagaaggggaggaagatcgcgatgccgacgaagagggagagggggacgaggagactcctaccagtgcccctgggtcaagcctggcgggtaggaatccctacgccctgttaggagaggatgaatgctag

SEQ ID NO: 225507 - DNA, 1824 bp, Artificial Sequence
  Description of Artificial Sequence: Synthetic coding sequence
atgccccgaaaaaaacccttcagtgtgaagcagaagaaaaaacaactgcaagacaaaagggagcgcaaaagaggcttgcaagacggtctgcgatcatctagtaactctagatctggatcgcgagagaggcgcgaagagcagacggatactagcgacggtgaatccgtcacgcaccatatcaggagactcaaccagcagccctcacagggattgggaccgaggggatatgatccaaatcgctaccggctccacttcgaacgcgatagtcgcgaggaggtcgagcgtaggaagagggcagctcgggaacaagtgctgcaaccagtgtcagccgagctgctggagctcgacatccgagaagtgtatcaacccggtagcgtgctggattttccaaggagacctccatggtcctatgagatgtccaaggagcaactcatgtcgcaagaggagcgttcattccaggattacttaggaaagatccacggggcatattcctccgaaaaactgagttattttgaacacaatctggagacctggcgccaactttggagggtgttagagatgagcgatatcgttctcttgattacagacattagacatcctgtggtgaactttcccccagccctatatgaatatgttaccggcgagctaggcctcgctttagtactcgttttgaataaagtggacctcgctccacccgctttagtggtggcatggaaacactacttccaccagcactatccccagctccatgtggtactgttcaccagtttcccgagagacccacggacccctcaggaccccagctctgtccttaaaaaatctcggagacgagggagggggtggaccagagccctaggaccggaacagcttctgagggcatgcgaagcaataactgtgggaaaggtagacttgagctcctggcgcgaaaagatcgcacgggacgttgcgggtgccacctgggggaatggaagcggagaggaagaagaagaggaggatggaccagctgttctggtcgaacagcagactgattccgctatggagccaacaggtcccacacaggaacggtataaggacggggtcgtaaccattggatgcgtgggctttcccaacgtcggcaaaagttctctgatcaacgggttagtcggtcggaaagtagtttccgtgtccaggacccccggacatacccgttatttccaaacttacttcctgacaccctccgtaaaattatgtgattgtcctgggctaatttttcccagcctccttcccaggcagctgcaggttctcgccggtatctaccccatcgcccagatccaagaaccttacacagctgtaggatacctggccagccgaatccccgtccaggcacttctgcatctccgtcatcccgaagcagaggatccaagcgctgaacatccttggtgtgcttgggacatatgtgaggcgtgggcagagaaacggggttataaaaccgctaaagcggctagaaatgacgtgtaccgcgcagccaatagcttgctgcgattggcagtcgacggcaggctctccctgtgcttccatcccccaggatactctgagcagaaaggcacttgggaaagccatccggagacgacagaattggtggttctccaaggacgagttggtcctgcaggggatgaagaagaagaagaagaggaagagttatccagttcatgtgaggaggagggtgaggaggaccgggatgctgatgaagaaggtgaaggggacgaggaaacccctacatccgcaccgggatcttccctggccggacgcaacccatatgccctactgggggaagatgagtgctag

SEQ ID NO: 225508 - DNA, 795 bp, Artificial Sequence
  Description of Artificial Sequence: Synthetic coding sequence
atgggggagagagtgctgtggcccctgcgtgccggacagcactggaggcaccgaccattgcccgctggcctgcaggacggcctgcgctcatcaagcaattcacgatctggttcaagggaacggcgagaagaacagactgacaccagtgatggggagtccgtgacacatcatatacggcgtctgaatcaacagcctagccagggcttaggccctaggggatatgaccccaatcgctaccgcctgcatttcgaaagagactcacgtgaagaggtcgagcggaggaaaagggccgcacgtgaacaggtgctgcaaccagtaagtgcagaactgcttgaactggatattcgcgaggtgtaccagccaggctctgtgctagattttccacggagacccccttggagctacgagatgagcaaggagcagctgatgtcacaggaggagagatcctttcaggattacttgggtaagatccacggagcctattcatccgagaaattgtcgtatttcgaacataacttagaaacgtggagacagctctggcgggttctggagatgtctgacattgtattactcattacagatatacggcatcctgtcgtgaactttccccctgccctctacgagtatgtcaccggagagctgggactggcactggtgcttgtcctcaacaaggtagacttagctcctcctgctctcgtggttgcctggaagcactattttcatcagcattacccgcagctccacgtggtattattcaccagcttcccgagggaccccagaacaccccaagattag

SEQ ID NO: 225509 - DNA, 1824 bp, Artificial Sequence
  Description of Artificial Sequence: Synthetic coding sequence
atgcccaggaaaaagcccttctcagttaaacagaagaagaagcagttgcaagacaaacgggagaggaagcggggactgcaggacggcttgcgttctagttcaaattcaaggtccggaagccgggagcgacgcgaggagcagacggatacaagcgatggcgagagcgtaacacaccatattcggagactgaaccagcagcctagccagggactcggtccgagagggtacgacccaaatcgatacagattgcatttcgagcgggactctcgtgaagaagtggagagacgcaaacgcgctgcccgtgagcaggttttacagcctgtttctgctgaactcctcgaactggacatcagggaggtctatcagccaggcagcgtgttagatttcccgaggcgacctccatggtcctatgagatgtccaaggaacaactcatgtcacaggaggagaggagtttccaagattatctgggcaagattcacggtgcgtacagtagcgaaaagctctcttactttgaacacaatctcgaaacatggcgacagttgtggcgagtgctggagatgtccgacatcgtgttgctaataaccgatatacgccacccagtggtgaacttcccacctgcactctatgaatatgtaacaggagagctgggactggcccttgtgctagttctaaacaaagtggacctggctccacccgctcttgtagtggcttggaagcactatttccaccaacactatccccaactccatgttgtactttttacgagcttccctagagacccacggaccccccaggacccaagttccgtcctgaagaaatccagacgcagaggaagaggctggacgcgggcattgggcccagagcaactccttcgcgcttgcgaagcaatcacagtgggcaaggtggatttgtccagctggagggaaaagatcgcgagagatgtcgcgggtgccacatggggaaatggatccggagaggaggaagaagaggaagatggaccagcagtccttgtagaacagcaaacagattccgctatggagcccacgggacccacccaggagaggtacaaagacggcgtggtgaccatagggtgtgtggggtttccaaatgtgggaaagtcgtctttgatcaacggcctggtaggccgaaaggttgtcagtgttagtcggacacctggccacacacgttactttcaaacctacttcctaactccatcagttaaactctgcgattgtccaggccttattttcccttccttattaccacggcagctacaagtgctggctggtatctaccctattgctcaaattcaagaaccatacacagcagtggggtacctcgctagtcggatacccgtgcaggcactgctccatctacgacatcctgaggcggaagacccatcagcagagcacccctggtgtgcctgggacatatgcgaagcctgggctgaaaagcggggatacaaaaccgccaaagcagcgaggaacgacgtttaccgcgctgcgaattctcttctcaggttggcagtggacggcaggctctcgctctgcttccacccaccgggatattccgagcagaaaggcacttgggagtcccatcccgaaaccactgaactggttgtgctgcagggacgcgtcggcccagccggagatgaagaggaggaagaagaagaagagctgagttcctcatgcgaggaggaaggggaggaggaccgcgacgcagacgaagagggggaaggggatgaagaaacgcctacatcagcccctggatctagcctggccggtcgaaacccctacgcactgctgggtgaggatgaatgctag

SEQ ID NO: 225510 - DNA, 1290 bp, Artificial Sequence
  Description of Artificial Sequence: Synthetic coding sequence
atggaggcagcagtggtgctggaaatgtcggatatcgttttgttaattacagatattagacaccccgttgtgaatttcccccctgccctatacgagtacgtgaccggcgaactggggctggccctggtgctcgtgcttaacaaagtcgacctggcccctcccgctttagtagtggcctggaaacactacttccatcagcactacccacagttgcacgtagtgttattcacttccttcccaagggaccccagaacccctcaagacccctcctccgttctaaaaaagtcccggaggcggggacgaggctggaccagggccttgggccctgagcagcttttacgcgcttgcgaggcgataactgtcgggaaagtcgatctgagctcctggagagagaagatcgcacgggatgtggctggagcaacctggggaaacggctcgggggaggaggaggaggaagaggatggcccagctgttctcgtggaacagcagaccgactcagcaatggaaccaactggacccacccaggaaaggtataaggacggagtcgtgaccattggatgtgtggggttcccaaatgtgggcaaatccagtttgattaacggcctggttgggcgaaaggttgtctcagtgtcccgaacccccggtcacactcgctattttcagacatatttcctgacacccagtgtgaagctctgcgactgccccggtttgattttcccgagcctcttgcccaggcagctccaagtgttagcaggaatttatcccatcgcgcagattcaagagccttacaccgcagtggggtatctggcctctaggatcccggtgcaggccctgctccacctgcgccaccccgaggctgaggatccatctgcagagcacccttggtgcgcctgggacatatgtgaggcctgggctgagaaaagaggctacaaaactgctaaggccgctaggaatgacgtgtacagagctgcaaattccttgctgagactcgcagttgacggacgcctgtctctatgttttcatcctcctggatatagcgagcagaaaggaacctgggaaagtcaccccgaaactactgagctagtggtactgcagggtagagtcggacccgctggcgatgaagaagaggaggaagaagaggaactttcaagctcctgcgaggaggaaggtgaggaggaccgcgatgcagacgaagaaggagaaggtgatgaagagactcccacttcagctccgggtagctcacttgccggacgaaacccctacgcgctgctaggagaggatgagtgctag

SEQ ID NO: 225511 - DNA, 1824 bp, Artificial Sequence
  Description of Artificial Sequence: Synthetic coding sequence
atgcccagaaagaaaccattctcagtgaagcagaagaaaaagcagctgcaagacaagcgtgagagaaagcgaggactgcaagacggactacgcagttccagtaattcccgttctgggtcccgcgagcgaagagaggaacagactgacacaagcgatggcgaatccgtcacccaccacattcggcgactgaatcaacagcctagtcagggcctcggccctcgcggatatgacccaaacagatatagactgcacttcgagagggactcacgggaggaggtcgagaggaggaaaagagcagcacgagaacaagttttgcagcccgtgtccgccgagctgcttgagctggacattcgcgaagtttatcagccgggatctgtgctcgatttcccacgcagacctccatggtcttacgaaatgtctaaagaacagctcatgagtcaggaggaacggtctttccaagattatctgggtaaaattcacggggcttactctagtgaaaagctctcatacttcgagcacaatctggagacatggcggcagctgtggcgggtcctggaaatgtcagacatagtgctgttgataacagatatccggcaccctgtggtcaattttcctccagcgctgtacgaatacgtgaccggggagcttggcctggccctggttctcgtgttgaacaaagtcgacctggcacctcctgctcttgttgtcgcctggaagcactacttccatcagcactacccacagctgcacgtcgtgctcttcacatctttccccagagaccctcggacaccgcaagacccatcttcagtgttgaagaagtcacggcgtagaggaagaggatggacccgggcacttggtccagagcagttgttgagagcttgtgaggctattaccgtcggaaaggttgatctatcaagttggcgcgagaagatagcaagggatgtggccggtgctacctgggggaatgggtctggagaggaagaggaggaggaggatggccctgcagttctggtggaacagcagacggattctgccatggagcctacagggcctacacaggaacggtataaagacggggttgtcactatcggctgtgtgggatttcctaacgttggcaagagcagcttgattaatgggttagttggccgtaaagtagtcagtgtgtcaaggacgcccggtcacacccggtattttcagacttattttttaacccccagcgttaaactttgcgactgtccaggactgatattccccagcctcttacctaggcagttacaagtgctggctggtatctatcccatcgcccagatccaggagccttacaccgctgtgggctacttagcctcacgcattcctgttcaagctctactgcacctgcgtcatcctgaggccgaggatcctagcgcagaacacccctggtgcgcgtgggacatctgcgaagcctgggctgaaaagcggggatataaaaccgccaaggccgctagaaatgacgtctatcgcgctgctaactccctattgcgcctggctgtcgatgggcgattgagcctatgtttccacccacctgggtatagcgaacaaaaaggaacttgggaatctcaccccgagactactgaactcgtagtgctgcagggtcgggtgggacccgctggagatgaggaggaagaagaagaggaggagctgagtagcagctgcgaggaggagggcgaggaggatcgcgatgccgatgaggagggtgaaggcgatgaagagaccccaacatccgccccaggaagctcccttgccggaaggaacccctatgccctactcggggaggacgaatgctag

SEQ ID NO: 225512 - DNA, 1215 bp, Artificial Sequence
  Description of Artificial Sequence: Synthetic coding sequence
atgagtaaggaacagctaatgtcgcaggaggagcggtccttccaggattacttgggtaaaatccacggagcctattcgtctgagaagttgtcatatttcgaacataatctggaaacatggagacaactgtggcgggtcttggagatgtcagatatcgtgcttctgattaccgacataaggcaccccgtggtcaatttcccgccagccttgtatgagtacgtgaccggggaactgggacttgcactggtgttagtccttaacaaggtggatttggcccctcccgctttggtggtcgcctggaagcactatttccatcagcattatccccagttacatgtggttctgttcacgtcattcccaagggatccgagaacaccgcaggatccctcatctgttttaaaaaaatcccgcaggaggggcagaggttggaccagggcactgggaccagagcagctgctgagagcctgtgaggcaataaccgtaggaaaaggattcccaaatgttgggaagtcaagcttaattaacggcctggtcggcagaaaggtagtttctgtgtccaggacacccggtcacacacgctactttcagacatatttcttaaccccgtccgtgaaactctgtgattgtcctggcctgattttcccatccctcctacccaggcaattgcaagttttagccggtatataccctattgcccaaatccaggaaccctacacagccgtaggttacttggcaagcagaatcccggtgcaagccttgctccacctgcgacatccagaagccgaggacccatccgccgaacatccctggtgcgcttgggatatctgcgaagcatgggcagagaaacgtggatataagacagcgaaagcagccaggaacgatgtgtacagggccgctaactccttattgaggttggccgtcgacggtaggctctcactttgttttcacccccctgggtattctgagcagaaaggcacatgggagagccatccagaaaccactgagctggttgtcctgcaggggagggtgggccctgccggagacgaagaggaagaagaagaggaagaactgtcaagcagctgtgaagaggagggcgaggaagacagagatgcagatgaggagggagagggcgatgaggagaccccaacatcagccccaggctcatccctggcaggtcgcaacccttacgcactcctcggtgaggacgaatgctag

SEQ ID NO: 225513 - DNA, 795 bp, Artificial Sequence
  Description of Artificial Sequence: Synthetic coding sequence
atgggagaaagagtgctgtggccactgcgagccggacaacattggagacataggcccctgccagcaggattacaggacggcctccgcagctcatctaatagccggtctggatcacgcgagagaagagaggagcagacagatacttcagatggcgagtccgtgacacatcacatcagacggttgaaccagcagccttcccaaggcttgggtccacggggttacgaccctaataggtacagactgcattttgaacgggatagtagggaagaagtggagcggagaaagagggccgcaagggaacaagttcttcaacccgtgtccgccgaattactcgagctagatatcagggaggtctaccaacccggaagcgtgctggacttccccagaaggcctccttggagctacgaaatgtcaaaagagcagctgatgagtcaggaagagaggagctttcaggactacctgggcaaaatacacggcgcttatagttcagaaaaattatcttattttgagcacaacttagaaacctggagacaactatggcgagtgctcgagatgtccgatatagttctgctgattaccgacatacgtcacccagttgtgaatttcccacccgctctttatgagtacgttacgggcgagctggggctcgctctggttttggtcttgaacaaagtggacctggccccaccagccctggtggtggcctggaagcactactttcaccagcactatccgcaattgcacgtcgtcttgttcactagctttccacgcgatccaaggacaccccaggattag

SEQ ID NO: 225514 - DNA, 795 bp, Artificial Sequence
  Description of Artificial Sequence: Synthetic coding sequence
atgggcgaaagggtgctctggccactccgtgcagggcagcattggaggcaccgccctctacccgcaggactgcaggatggcctgagatcatcttctaactccagaagcggatctcgggagcggagagaagagcagactgatacctccgatggagagtctgtgacacaccacatacgaagactgaatcagcaaccctctcagggtctgggccctcgaggatacgaccccaacagatatcgtctgcacttcgaacgggactcgagagaagaggtggagagaaggaaacgtgccgctagagaacaagtcttacagcccgtctctgctgaactcctggaactcgacattcgcgaagtctaccagcccggtagcgtcctggattttccgcgacgtcccccttggagttatgaaatgagcaaggagcagctgatgtctcaggaagagcggtccttccaggattatctgggcaagattcacggagcatactcctccgagaagctgagctatttcgaacacaacctagaaacttggcgccaattgtggagggtgctggagatgtctgacatcgtcttattgatcactgacattcgacatcctgtggtgaattttcccccagcgctgtacgaatacgtgacgggggagctcggattagcgctggtgttggttcttaacaaagtcgacctggctcctccggctctagtggtagcttggaaacattacttccaccagcattatccgcagctgcacgtagttctgttcacaagctttccgagggacccacgcacaccccaggactag

SEQ ID NO: 225515 - DNA, 795 bp, Artificial Sequence
  Description of Artificial Sequence: Synthetic coding sequence
atgggagagcgagtcttatggccgctacgcgctggccagcactggagacaccgtcctctcccggcaggccttcaggatgggctgcgttcatcaagtaactcacgcagcggctcacgggaaaggagggaggagcagacagatacatccgatggcgagtccgtgacccatcatattagaaggttgaatcagcaaccctctcagggtctgggaccacgcggttatgaccctaatagatacagactccacttcgagagagattcacgcgaggaagtagaacgcaggaagcgcgctgctcgggaacaggtactccagccggtttccgctgagctcctggagctggacatcagggaagtgtaccagccgggatctgtcctcgatttcccaaggaggcctccctggtcctatgagatgagtaaggaacagctcatgtcgcaggaagagagaagctttcaggactatctgggcaagattcacggagcttattcaagtgaaaagctgagctacttcgagcataacttggagacctggagacagttgtggcgcgtcctggagatgtcggatatagtgttgctgataacagatattcggcatccagtcgtcaatttccctccagcactctatgaatacgtgaccggcgaactggggctggcactcgtactcgtcctgaacaaggtggatctggccccacccgctctggtagttgcctggaaacattatttccatcagcactaccctcagctgcatgttgtgttgtttacatccttcccacgcgatcccaggactccacaggactag

SEQ ID NO: 225516 - DNA, 1824 bp, Artificial Sequence
  Description of Artificial Sequence: Synthetic coding sequence
atgcccagaaagaaacctttcagtgtcaagcagaaaaagaagcagctgcaggacaagagggagagaaagcgtgggctgcaggatggcctgagaagctcttctaacagccgctcaggatctcgggaaagacgagaggagcagactgatacatctgatggggaatcagttactcaccacatccgaagactgaaccagcaaccttcacagggcttgggccctcgcggttacgacccaaaccggtatcgactacacttcgaaagggactcgcgtgaggaagtggagaggcgtaaacgggcagccagggaacaagttcttcagccggtctcggctgagctgctcgaactggacatacgcgaggtataccaacccggatctgtgctagacttcccacgcagacctccctggtcatacgaaatgtctaaggaacagctgatgtctcaagaggagcggtcttttcaggattatctcggaaagattcatggggcttacagctcagagaagctgtcatattttgagcacaacctcgagacctggcggcaactgtggagagtgctggaaatgtcagatattgtactactcattacggacattcggcaccccgtagtgaactttcccccagctctctacgagtatgtcacaggcgagttggggctggctcttgttctggtgctaaataaagtagacttggctcctcccgctctggtagtggcctggaagcattacttccaccagcattatccccaactgcatgtcgttctgtttacttcattcccaagagacccgaggacacctcaagatccaagctccgtcttgaagaagtcacggagaagggggaggggctggacccgggctcttgggcctgagcagctcttaagagcttgcgaggcaattaccgtaggcaaggtagaccttagcagttggcgggagaagatcgcccgagacgtggcaggggctacctggggcaatggctctggtgaggaggaagaggaggaggacggacctgccgtcctggtagaacagcagactgattcggccatggagcccactgggccaacccaagagcgatacaaggacggagtggtgacgatcggttgcgtggggttcccaaatgtgggcaagagctccttgattaatgggcttgtcggaaggaaggtggtttcagtgagcagaacccctggacatacccggtacttccagacatacttcctgaccccatctgtgaagctgtgtgactgccctgggctaattttcccatcacttcttccgcgtcagctgcaagttttggcaggaatttatcccattgcccagatccaggaaccttacacagcggtggggtatctggctagtaggataccggtccaagctcttctgcacctccgacaccccgaggccgaagacccatccgccgaacacccctggtgcgcatgggatatctgtgaggcctgggccgagaagagaggatataagacagctaaggccgcaaggaatgatgtgtacagagcagctaactcacttctgcggttggccgtcgatggcagactctcattgtgctttcatccgcctggatacagcgagcagaaggggacatgggagtcgcaccccgaaacgaccgagcttgtcgttctgcagggtcgagtcggccctgcaggcgatgaagaggaggaagaggaagaggaactatcgagctcctgcgaggaggaaggagaagaagacagggatgcagacgaagaaggtgagggggatgaggagacgccaaccagcgcgccagggtcatctctggctggtcggaacccttacgcgctgttgggggaagacgagtgctag

SEQ ID NO: 225517 - DNA, 1824 bp, Artificial Sequence
  Description of Artificial Sequence: Synthetic coding sequence
atgcccagaaagaagccatttagcgtgaagcagaaaaagaaacaacttcaggataagcgcgagagaaagcgcggtctacaggacggacttaggtcctcctcaaactctcggtcaggatcccgggagaggcgggaagaacagactgatacctcagatggcgaatccgtcacacaccatatccgaagattaaatcagcagccttctcagggcctgggccctagagggtacgaccctaatcgctacagacttcactttgaaagagactcccgtgaggaggtcgagaggcgaaaacgcgctgctcgggagcaggtcctgcagccggtctctgccgagctcctggagctggacatccgagaggtctatcaaccgggatcggttctggacttcccgagaagacctccctggtcttacgagatgagcaaagaacaactgatgtcgcaggaggaacggagcttccaggactacctgggaaagattcacggagcgtatagttccgagaagctgtcatatttcgaacacaatctggaaacctggcgccagctgtggcgtgttctcgaaatgagcgacatcgtactgctcatcactgatattcgtcaccccgttgtgaacttccctccggcactgtacgaatacgtaacgggggaactcgggcttgctttagttttggtgcttaataaggtggatctggcccctccagcccttgtagtcgcttggaagcactactttcaccaacattatccgcaacttcacgtcgtactcttcacatcgtttcccagggatcctcggacccctcaggacccctcatccgttttaaaaaagagccggaggcgcggtcgcggatggacacgtgccctcggaccagagcaacttttgcgagcttgtgaagccatcactgtagggaaggttgatctctcatcatggcgcgaaaaaattgcccgagatgtggcgggtgctacgtggggtaacggatcaggtgaggaagaggaagaagaggatgggcctgccgtgctggtggagcagcaaacagattcggccatggagccaaccggcccaactcaggagcgctataaagatggggtcgtgacgatcgggtgtgtcggatttccgaacgttggcaaaagctcacttataaatggccttgtcggtaggaaggtcgtgagcgtctcaagaactcctggacatactcgttattttcagacatattttcttacccctagtgttaaattgtgtgactgtcctgggctgatctttccttcattattaccacggcagctccaggtcctggctggcatatacccaatcgctcagatacaggagccttacacagccgtcgggtacctagcgagtaggattcctgtgcaggctctgttgcacctaagacaccctgaagcggaagacccctccgccgaacatccctggtgcgcctgggatatatgtgaagcttgggctgagaaacggggatataaaactgctaaagcggctaggaacgacgtctaccgtgccgctaattctcttttgcgtctcgctgtggacggcagattgtctctatgttttcacccacccggatacagcgagcagaaaggcacctgggaatctcatcccgagactaccgaactggtagtgctccagggccgagtgggtcccgctggggatgaggaggaagaagaggaagaggaactgtcctcctcttgtgaagaagagggtgaagaagaccgagatgcggatgaagagggagagggggatgaagagactcctacctctgccccaggatctagcctagccggaaggaacccctacgcgctgctgggtgaggatgaatgctag

SEQ ID NO: 225518 - DNA, 795 bp, Artificial Sequence
  Description of Artificial Sequence: Synthetic coding sequence
atgggagaacgcgttctatggcccctacgggctggccagcactggcggcatcgccctctgccagcaggcctacaggacggcttgcgctcctcgagcaattcaaggagcggctctcgtgagcgccgtgaggagcaaacggatacttcagacggtgagtccgtgactcaccatatcaggcgcctcaaccagcagccttcccaggggcttggccctagaggctacgatccaaacagataccgtctgcacttcgagagagatagtcgggaggaggtagagagaaggaagagagcagccagggaacaagtgttgcagcctgttagtgcagagttgctggaactggatattcgagaggtgtaccagccaggatctgtcctcgattttcctagacgtccaccctggagctacgagatgtccaaggaacagctcatgagccaggaggagagatctttccaggattacctggggaagatccacggggcttacagttcagagaaattatcctatttcgagcacaacctagagacttggcgccagttgtggagagtgctggagatgagtgatatcgtactactcattaccgacattagacaccccgtcgtcaacttcccacccgcactctacgaatacgtcaccggagaattgggtttggctttagtgctggtgctcaataaagtggacctcgctccgccagccttggtcgtggcttggaaacactacttccaccagcactaccctcagctgcacgtggtgctgtttacaagctttccacgggatcctcggacgcctcaggattag

SEQ ID NO: 225519 - DNA, 795 bp, Artificial Sequence
  Description of Artificial Sequence: Synthetic coding sequence
atgggagaacgagtgctgtggcccttgcgcgctggacagcactggagacatcgtccactcccagctggattacaggacggccttcgatctagttctaattctcgatccggatctcgagagaggagagaggagcagacagacacttcagacggggagagtgtaactcaccatatacgcagactcaaccagcagccaagccaagggctggggcctcgagggtatgatccaaaccgttatcggcttcattttgaaagggactcccgggaggaggtggagcgccgaaaacgagctgcacgtgagcaggtgctccaaccggtttctgccgagttattggagctagacattagggaggtctaccagcccggatcagtcctggactttcccaggaggcctccttggagctatgagatgtcaaaggagcagctgatgagccaggaggaacgctcattccaggattacctgggaaagattcatggggcatactccagcgaaaaactatcttatttcgaacataacctcgagacttggcgccaactctggagggtgctggaaatgtcagacattgttctgctcattacagacattagacacccagttgtgaactttccccctgctctctatgaatatgttaccggagagctcggactagctctggtcttagtcctcaataaggttgacctggcccctcctgccttggttgtggcatggaagcattacttccaccagcattacccccagctacacgtagtgctgttcacaagtttcccaagagacccacggacacctcaggactag

SEQ ID NO: 225520 - DNA, 1824 bp, Artificial Sequence
  Description of Artificial Sequence: Synthetic coding sequence
atgcctcgcaagaagccgttttcagtgaagcaaaagaaaaagcaactccaggacaaaagagagagaaagaggggcctccaggacggtctccgatctagttccaatagtagatcaggctctcgcgaaaggcgcgaagaacagactgatacgtctgacggtgaatcagtgactcaccatatccgtcggctcaaccagcagcctagccaggggctcggaccaaggggatatgatccaaatagatatcggcttcactttgaaagggacagccgcgaggaagtagaacgtcgcaagcgagccgcaagagaacaggtccttcagcctgtcagtgctgagctgttggaactggacatcagagaagtttaccagccgggttctgtgctggactttcctaggagacctccgtggagctacgagatgtcaaaagagcagttaatgtcgcaagaggaacggtccttccaagactacctaggaaagatccacggagcatacagtagcgagaagctgtcctatttcgagcacaatctggagacttggagacagctgtggagggtccttgagatgtctgacattgtgctgctgatcacagatatccgacatccagtggtgaacttcccccctgccctgtatgaatacgtgacgggcgagcttggtcttgccctcgtgctggtcttgaacaaggtagacctggcacctccagccctggttgtggcttggaaacattatttccatcagcactaccctcaactccacgtggtgctttttacgagcttccccagggatcctagaactccacaggatccctcttcggttctaaagaaatccagaagacggggacggggttggactagagcgttaggaccagaacagctcctgcgggcttgtgaagcgataacggtgggcaaagtcgatttgtcttcctggagggaaaagatcgcgagggatgtggccggtgccacctgggggaatggttctggtgaagaggaggaggaagaggatgggcctgctgtccttgtagaacagcagacagactctgcgatggagcccaccggccctacacaagagcggtacaaggacggggtagtcacgatagggtgcgttggattcccaaacgtggggaaatcgtccttaatcaatggcctggtggggagaaaagtagtgtcggtgagccgcacccccggacatactagatattttcagacatatttcctgaccccctccgtgaaactctgcgactgccctggactgattttcccctccctgttaccgaggcaactgcaagtccttgctggaatctacccaatcgcgcagatccaggaaccctatacggctgtcggatacctcgcctcacgaatccctgtccaggcacttctgcatctacgacatcctgaggccgaagatccgtcagctgagcacccgtggtgcgcatgggacatatgtgaagcttgggccgagaagcgtggatacaagacagccaaggccgcaaggaatgacgtgtacagagccgctaatagtctactgcggctcgccgtggacggcagactatcactttgctttcacccccctggatatagtgaacagaagggtacctgggaaagtcaccccgagaccactgaacttgtggttctccagggcagagttggaccagctggcgatgaagaggaggaggaggaggaggagttgagctcctcatgtgaagaagagggcgaggaagaccgagacgcagatgaggagggtgagggggacgaggaaacccccacctcggcacctggctcttccctggctggacgaaatccttacgctctgctgggggaggacgaatgctag

SEQ ID NO: 225521 - DNA, 201 bp, Artificial Sequence
  Description of Artificial Sequence: Synthetic coding sequence
gtggtgaactttccgcctgccctgtacgagtacgtgaccggtgagctgggcttggcactggttttagtactgaacaaggtggacctagccccaccagctctggtggttgcttggaagcactattttcatcagcattatccacagctacacgtcgtgctattcacgtccttccctagggaccctcgcactccacaagattag

SEQ ID NO: 225522 - DNA, 795 bp, Artificial Sequence
  Description of Artificial Sequence: Synthetic coding sequence
atgggggagcgcgtgctgtggcccctgagggccggtcagcactggaggcaccggccattgcctgcaggcctccaggatggactccgtagcagtagtaattcccgctctggctctcgggagaggagagaggagcaaacggatacgagcgatggcgagtcggtgacccaccacatcagacgtctcaatcagcagcctagccagggcctgggtccaaggggttacgatcccaaccggtatagactgcactttgaacgtgattcaagagaagaagtggagcgacggaagcgcgcagccagagagcaggtgctccagcctgttagtgcggagctactggaattggatattcgcgaggtatatcagccaggaagcgtcctggactttcccaggaggcccccttggagctacgaaatgtcaaaggagcaattaatgagtcaggaggagagaagcttccaggactacctcggcaaaattcatggcgcttactcgagcgagaaattaagttactttgagcataacctcgagacctggaggcagctctggcgagtgctggagatgtccgatatcgtactgctcatcaccgacatccgtcatcccgtcgttaatttcccgcctgctctatacgaatacgtcaccggggaattgggccttgccctcgtgctcgtgctgaataaggttgatctggcaccacccgcactcgtggtagcatggaagcattatttccatcagcactatccccaacttcatgtagtactgttcacctcctttccccgagatccccgaacgccacaagactag

SEQ ID NO: 225523 - DNA, 1215 bp, Artificial Sequence
  Description of Artificial Sequence: Synthetic coding sequence
atgagtaaggagcagttgatgtcacaggaggagcgcagcttccaggattatctggggaaaattcacggtgcctattcctctgaaaagctatcctatttcgagcataatttggagacatggcgccagttatggagggtgctcgagatgtccgacattgttctccttatcaccgacatccgacatcccgtggtgaatttccctcccgctctgtacgagtacgtcacaggcgaactgggccttgccttggtgctcgtgctgaataaggtggatctggccccacccgctctcgtggtcgcctggaaacattacttccatcagcactatccacaactgcacgtagtgcttttcacatccttccccagggaccctaggacccctcaagaccccagttccgtcctgaagaagagccgtagaagagggaggggctggacgcgcgctttgggtccagagcaactactgcgagcctgcgaggccattacagtcggaaaaggttttcccaacgttggcaagtcatcactgatcaacgggctcgttggccgtaaggtggtcagcgtttcccgcacaccaggccacacaagatacttccagacctatttcctgacaccgtccgtcaaactatgtgattgtcccggtctcatcttcccctcactgctgcctagacaacttcaggtgctggcgggaatctaccctattgctcaaatccaggagccatatacagccgtcggatacctggcctctcggattccagtgcaggctttactgcatctgagacacccagaggctgaagatccatccgccgaacacccctggtgcgcctgggacatttgtgaggcctgggcagagaagcgaggttacaagaccgctaaggccgctcggaatgacgtgtaccgggctgcaaacagtctcctgaggctcgctgtggacgggagacttagcctgtgctttcaccccccagggtactctgagcagaaaggcacatgggaaagccaccccgaaactaccgagttggttgttttgcaggggagggtgggcccagctggagatgaggaggaagaggaagaagaggagctttccagttcctgcgaggaggagggagaagaggatcgtgatgcagatgaggaaggggagggcgacgaagagacacccacctcggctccgggttccagcttggccggtcggaacccatacgcactccttggcgaggacgaatgttag

SEQ ID NO: 225524 - DNA, 789 bp, Artificial Sequence
  Description of Artificial Sequence: Synthetic coding sequence
atggagccgactgggcctacccaggaacgctataaggacggcgtagttacaattggctgtgtgggcttcccgaacgtcggaaagtcaagtctaatcaacggccttgtgggtcgcaaagtggtcagcgtttccaggaccccaggtcatactagatatttccagacatacttcctcacaccaagtgttaaactctgtgactgcccgggtctgatcttcccctcacttttgcccagacagctgcaggtcctggcagggatttatcccattgcacagatccaggaaccatatacagcagtagggtacctggcgagccgtatacccgtgcaggctctgctccacctgaggcatccggaagccgaggatccaagtgctgaacacccgtggtgcgcgtgggacatctgcgaggcttgggccgaaaaacggggatataaaaccgctaaggcagcaaggaatgatgtctaccgggcagcgaactcgcttctgcgcctcgctgtggatggcagactgtcactgtgcttccaccccccagggtactcagagcaaaaggggacttgggaatcccacccagagacaaccgagttagttgtgttacaggggagagtaggaccagccggagatgaagaagaggaagaggaggaagagctgagctcgagttgcgaagaagaaggagaagaagatagagatgcagacgaggaaggcgagggagatgaggaaacacctacttccgcacccggaagctccctcgctggccgaaatccatacgcactgctgggagaagacgagtgttag

SEQ ID NO: 225525 - DNA, 789 bp, Artificial Sequence
  Description of Artificial Sequence: Synthetic coding sequence
atggagcctaccggaccaacacaagagcgctacaaagacggcgtggtgactattggatgcgtaggcttcccgaatgtggggaagtcctcccttatcaacgggctcgtggggagaaaggtggtttcagtgagtcgtactccaggccacacaagatactttcaaacatactttttgaccccatcagttaaattgtgcgactgtcccggactgatctttcccagcctgcttcctaggcagctgcaagtgctcgccggaatttaccccatcgcacagatccaagagccttataccgctgtggggtaccttgccagcaggatcccagtgcaggcccttctgcacctgcgacatcctgaggcagaggatccctcagcagagcatccctggtgcgcctgggatatctgcgaagcatgggcagagaagaggggttataagactgcaaaagctgcaaggaatgatgtctatcgcgcagccaattcgctgctgcgccttgcagtcgacggacgccttagtctgtgcttccatccacccggttactctgaacagaagggaacctgggagtctcacccagaaacaacagaacttgtcgtgttacaggggagagttggaccagctggcgacgaagaagaggaagaggaagaagagttaagttcgtcctgtgaagaagaaggagaagaggatcgggacgccgacgaggaaggggaaggcgatgaagaaacaccaacgtcagctcccggaagtagcctggctgggagaaatccttacgctctgcttggggaggatgaatgctag

SEQ ID NO: 225526 - DNA, 1290 bp, Artificial Sequence
  Description of Artificial Sequence: Synthetic coding sequence
atggaagccgcagtggtgctggagatgagcgacatagtcctgttgatcacggatatccggcaccccgttgtgaattttcctccagctctgtatgagtacgttacaggcgagttggggctggcattggtgctagtgctaaacaaggtagatctggctcctcctgcccttgttgttgcatggaagcattactttcatcaacactaccctcaactgcacgtggtactgttcacatcgtttccgcgtgatccacgcactcctcaggatccctcatctgttttgaaaaagtctaggcgcagggggcgaggctggaccagagcgctgggcccagagcagctgttgagggcttgcgaggcaattactgtcggtaaggtggacctctcttcctggagagagaagatcgcaagagacgtcgctggcgcaacctggggcaacgggagcggcgaagaagaagaggaggaggacggacccgctgtgctggtcgagcagcaaaccgactccgccatggagcccactggacccactcaggaacgctacaaagatggggtcgtgacgataggctgcgtagggttcccaaatgtcggaaaaagtagtctcatcaacgggctcgtgggccgaaaggtggtcagcgtgtcccgtacgcccggacacactcgctactttcagacatactttctcaccccctccgtcaaattgtgcgactgtccaggactcattttcccaagcctactgcctcgacagctgcaagtacttgccggtatatatcctatcgcccagatccaagagccatacacagccgtcggttacctggcctcgagaatccccgtgcaggctttactgcatctgagacaccccgaggcagaagacccctccgccgagcatccttggtgtgcatgggacatctgcgaagcctgggctgagaagcgcggatataaaaccgccaaagcagccaggaacgatgtatatcgggctgccaatagcttgttgcggctggccgtggacggacggctgagcttgtgcttccatcctccagggtactctgagcagaagggaacgtgggaatcgcacccagagaccaccgaattagtggtgctgcagggcagggtagggcctgcgggagatgaggaggaagaggaagaggaggaactgagtagcagctgtgaggaggaaggggaggaggaccgggacgctgacgaagagggagaaggagacgaggagacacctacatctgccccaggaagcagcctggccggtcgcaacccgtacgccctgctcggagaagacgagtgctag

SEQ ID NO: 225527 - DNA, 1215 bp, Artificial Sequence
  Description of Artificial Sequence: Synthetic coding sequence
atgagtaaagaacagctgatgtctcaggaggaacgcagcttccaagattacctggggaaaatccacggggcttactccagtgagaagctgtcatattttgagcataacttggaaacatggagacagctgtggcgtgtccttgaaatgagcgatatcgtgctgctgatcacagacatacggcatccagttgtaaattttccgcctgccctttatgagtacgtgacaggagagttgggcctggcacttgtgttggtcctgaacaaggttgacctggcccctcccgcactggtggtcgcctggaaacactactttcaccagcactacccacaactccatgtcgtactttttacttcttttccgcgtgaccctcggaccccccaagatccttcctctgttttgaaaaagtcccggcgaagggggaggggatggaccagagcacttggccctgagcaactcctgcgagcctgtgaggctatcacagtgggcaagggattccccaacgttgggaaatccagcctgattaatggcctggtcggaaggaaagtcgtgtctgtctcaagaactcccggacatactagatatttccaaacatatttcctcacacctagcgtaaagctctgcgactgcccaggacttatctttccaagcctgctgcccagacagctgcaggtgctggccggtatataccctatagctcagatccaagaaccctataccgctgtggggtatttagccagcagaatccctgtacaggccctcctccacctacggcacccagaggccgaggacccatccgctgagcacccttggtgtgcttgggacatatgcgaggcctgggccgaaaaacgtgggtacaaaacggcaaaagccgcacgcaatgacgtctaccgcgcagctaattccttgctccgcctggcggttgatggcaggttgtctctgtgtttccaccctcccggttactccgagcagaagggaacatgggaatcccatcccgaaaccaccgaactggtggtgctgcaaggacgcgtgggtcccgctggtgatgaggaggaggaggaagaagaggagctctcttccagttgtgaagaggagggcgaggaagaccgcgatgccgacgaagagggcgagggcgacgaggaaacaccaacctccgctccgggtagtagcctcgcagggagaaacccctacgcgttactcggggaggacgagtgctag

SEQ ID NO: 225528 - DNA, 1215 bp, Artificial Sequence
  Description of Artificial Sequence: Synthetic coding sequence
atgtcaaaagagcagctgatgtctcaggaggaaagatcgttccaggactacctgggcaagattcacggagcctatagcagcgagaaactttcttacttcgagcataaccttgagacatggaggcagctgtggagggtgctcgaaatgagcgacatcgtgctgctgattactgacatcagacatcctgtggttaattttcctcctgctctttacgagtacgtgaccggggagctcggtctggctttagtgctggtattaaataaagttgatctggccccacccgcactggtagtggcttggaagcattatttccatcagcactatcctcagttgcacgttgtgcttttcactagcttcccaagggacccaagaactcctcaggatcccagcagcgtcctgaagaagtctcggcgtcggggacgaggatggaccagggcgttgggccctgagcagctgctgagggcatgcgaagccatcacagtcgggaaggggttccctaacgtgggtaaatcctctctgatcaacggtctggtgggtcgcaaagtggtgtctgtaagccgcactccaggacacaccaggtacttccagacctattttttaacaccctccgtcaagctctgtgactgcccgggactgatattcccctcactcttgccaaggcagttgcaggtcctcgccggaatctacccgatcgcgcagattcaggagccatacacggccgtggggtatttggcatccagaattcctgtgcaggcacttcttcacctaagacatcctgaagccgaggacccttctgctgaacatccatggtgcgcgtgggacatctgcgaagcctgggccgagaagagaggttataaaacagctaaagccgctagaaatgatgtataccgcgcagctaactctctactgaggctcgccgtcgacggcaggctgagtctgtgtttccatccacctggttactccgagcagaagggcacctgggaatctcaccccgaaaccacagagctggtggttttacaggggcgagtgggtccagctggcgacgaggaggaggaggaagaggaagagttaagctcttcttgtgaagaggaaggcgaagaggaccgggatgcagatgaggagggggaaggcgatgaggaaactcccacatccgctccagggtcctctttagcagggaggaacccctatgccctactgggcgaggatgagtgttag

SEQ ID NO: 225529 - DNA, 789 bp, Artificial Sequence
  Description of Artificial Sequence: Synthetic coding sequence
atggagcctactggaccgacacaagagaggtacaaggatggagtagttacaatcggatgtgttggctttcctaacgtaggaaagagctctctgattaacggtctcgtcgggcgtaaggtagtctctgtgtcacgcacacccggacataccagatacttccagacttactttttaacaccaagtgtgaagctctgtgactgccctggactgatctttccctcattactaccacggcagctgcaagttttggcgggaatctatcccatcgcgcagatccaggaaccgtatactgccgtgggatatctagcctcccggattcccgtccaggcactgctccacctgcgccatcctgaagctgaagatccaagcgcagagcacccgtggtgcgcctgggatatttgcgaggcttgggctgaaaaacgcggttataaaactgctaaggcagcccgtaatgatgtgtatcgggctgctaactcactgttgaggctcgccgtggacggtaggctcagcctttgcttccaccctcccggttactctgagcaaaagggcacttgggagagccaccctgaaacaacagaactagttgtgctacagggtcgggttgggcctgccggtgacgaagaggaggaagaagaggaggaattgagttcttcttgtgaggaggagggggaagaagatcgggacgcggacgaggagggggaaggagatgaggagacaccaacttcggcccctgggtcatcactcgccggtaggaatccctacgcactgcttggcgaggatgagtgctag

SEQ ID NO: 225530 - DNA, 1290 bp, Artificial Sequence
  Description of Artificial Sequence: Synthetic coding sequence
atggaagccgctgttgtgctggaaatgagcgatatcgttttgctgattaccgatatccggcatccagtcgtgaacttcccaccagccttgtatgagtatgtgaccggggaactgggccttgccctagtacttgtcctcaacaaagttgacttggcccctccagcgctggtggtggcttggaaacactacttccaccagcattatcctcaacttcacgtggtcttgttcacttcctttccgagagaccccaggacccctcaggacccctccagcgtgctgaagaagtcacgtcgccgaggcagggggtggaccagagccctcgggccagagcagctcctgcgagcttgtgaagccatcacagtgggaaaagttgacctgtcttcatggcgggaaaaaatcgctcgggatgtggctggagctacgtggggaaatggaagtggagaagaggaagaggaagaggacggccctgctgtgctggtggagcagcagacagattctgcaatggagcctacagggccaacccaggagaggtacaaggacggcgtagtaacaatcgggtgtgtgggattccccaatgttggcaaaagcagtctgatcaacggcttagtggggcgaaaggtcgtgtctgtttcccgaacacctggccacacgcgctactttcaaacatacttcctaaccccatctgttaagctttgcgattgcccgggtctgatcttcccctccctactgcccaggcagctgcaagtgctggctggcatatatccaatcgcccagatacaggaaccatacaccgcagtcggttaccttgcctcccggattccagttcaagctcttctccatctccggcaccctgaggcggaagacccgagcgccgagcatccatggtgcgcctgggatatctgcgaagcatgggccgaaaaacgtggatataaaaccgctaaggcagccagaaatgacgtgtatagagccgcaaattcgctgctacgcttagccgttgacggcagactttccctctgcttccacccaccagggtactccgaacagaagggaacctgggagagccaccccgagacaactgaattggttgtcctccaaggaagagtcggcccagccggagacgaagaagaagaggaggaagaagagctgagctcatcttgcgaggaagagggcgaagaggaccgcgacgccgacgaagaaggcgaaggcgacgaggagactcccacttctgcaccaggaagctctctagccggtcgaaacccctatgccctgctgggggaggacgaatgctag

SEQ ID NO: 225531 - DNA, 1290 bp, Artificial Sequence
  Description of Artificial Sequence: Synthetic coding sequence
atggaggctgccgtcgttctggaaatgtctgatatagtgcttctgatcaccgacatccgtcacccagttgtgaatttccccccagccctctacgagtacgtgaccggggaattgggacttgcgttggtgctagttctgaacaaggtggatttagcgcctcccgcactagtcgtggcctggaagcattattttcaccagcattatcctcagcttcacgtggtcttattcaccagtttccctcgtgacccccgaacacctcaggacccctcctctgtacttaagaagtcgcgtagacgaggaagaggctggacgcgcgctttaggacctgagcagctgctccgcgcatgtgaggccattacggttggcaaggtggacctgtcctcatggcgggagaaaatcgcgagagatgtcgccggagctacctggggaaatgggagcggagaggaagaagaagaggaagacggtcccgctgtcctagtggagcaacagacggactccgcgatggaacccaccggtccgacacaagaacggtataaggacggtgtggtgacaatagggtgtgttggcttcccaaacgtagggaaaagctcattaatcaacggactcgtgggcagaaaggtcgtcagtgtttctcgcacacccggacacaccaggtattttcagacctacttcctgacaccgagtgtcaagttgtgtgattgccctggactgatattcccttctctgctgcccagacagcttcaagtattggcaggcatctaccctatcgcacagatccaagaaccctacactgccgtgggctatctggccagtcgcattccagtccaggccttgctacatctgcgacaccccgaagccgaagatccttccgctgagcatccctggtgtgcttgggatatatgcgaagcctgggctgaaaagagaggttacaaaacagctaaagctgctaggaacgacgtttatcgcgctgccaactccctgcttcgcctggcagtggatggcaggctcagcctgtgcttccatccccctggatactccgaacaaaagggcacttgggagtctcaccccgagacaaccgagctcgttgtgctccagggcagagtgggtcctgccggtgatgaggaagaggaggaggaagaagagctgagctcaagctgtgaagaagagggcgaggaagacagagacgcagatgaggagggagagggggacgaagaaactcccactagcgcccctggatcttccctggccggtaggaacccatacgccctcctcggtgaagacgagtgctag

SEQ ID NO: 225532 - DNA, 789 bp, Artificial Sequence
  Description of Artificial Sequence: Synthetic coding sequence
atggaaccaacgggccctacccaagaaaggtataaagacggggtagtgactataggttgcgtgggctttcccaacgtgggaaagtccagtttgattaatggcctcgtgggacgcaaagtggtgtctgtgtcgagaacccctggacacactaggtacttccaaacatatttccttaccccctcggtgaagttgtgtgactgccccggacttatatttccgtccttactgcccagacaactacaagtgttggcaggaatatatcccatagcacagatccaagaaccttataccgctgtcggctatttggctagccgaatcccagtccaggcactgctccatttgcggcatcctgaagccgaggaccccagcgccgagcacccatggtgtgcatgggacatctgcgaagcgtgggctgaaaaacgcggatacaaaacagctaaggccgctaggaatgatgtttatagggccgctaattctctccttcgcctagcggtagatgggaggctctcgctttgtttccatcctccaggatattccgaacagaaaggaacttgggaatcacacccagaaaccacggagttggtcgtactgcaaggacgtgtaggaccagcaggggatgaggaggaagaggaggaggaagaactgagctcttcttgtgaggaggaaggagaggaagatagagatgcagatgaagagggggagggggacgaggagacccccacctcagctcctgggtcatccctggcaggcagaaacccatacgcactcttaggggaagatgagtgttag

SEQ ID NO: 225533 - DNA, 1215 bp, Artificial Sequence
  Description of Artificial Sequence: Synthetic coding sequence
atgtctaaagagcagctgatgtcccaagaagaacgcagcttccaggactatctcggcaagatccatggtgcttacagttctgagaagctttcctactttgaacacaacttggaaacatggaggcagctgtggagagttttagagatgtcagacatcgtgcttctgattactgatatccgccatccggtcgtgaatttcccacccgcactatacgagtatgtgactggcgaactgggactggcgttagtgttggtgcttaacaaagtcgacttagcgccacccgctctcgtggtcgcttggaaacactactttcaccagcattatccgcagctccacgttgtgctatttacgtctttccccagagaccctcgcacaccacaagacccctcatccgttctgaagaaatcgcggagaaggggcaggggctggacccgggcactgggcccagaacagctgttgcgagcctgtgaggcaataaccgtgggtaagggcttccctaatgtcggcaagagcagcctgattaatgggctcgtgggcagaaaggtagtcagtgtatcccggacccccggtcatactcgttactttcagacctatttcctgactccctctgtgaaactatgcgactgtccaggactgatcttcccctcactgctgccacgacagctgcaggtcctggctggcatttatccgattgctcagatccaagagccctatacggccgtggggtacctggcatctaggatcccggtgcaggcactcctccatctgagacatccagaagcagaagacccatccgccgaacatccatggtgcgcctgggacatctgtgaggcctgggctgagaagagaggctacaaaactgctaaggcggctcgcaacgatgtgtacagagccgctaactctctgctgcggctcgccgtcgatggacggctatccctttgcttccatcctccaggctattctgagcagaagggcacctgggaaagtcatcctgaaaccacagaattggtggtgctacagggccgagtcggtccagccggagacgaagaggaagaagaggaggaagaattaagttcttcatgtgaagaggagggcgaagaggacagggatgcagatgaggagggagagggagatgaagaaacccccacttctgcaccgggttccagcctggctggaagaaacccatacgcattactgggcgaagatgagtgctag

SEQ ID NO: 225534 - DNA, 1290 bp, Artificial Sequence
  Description of Artificial Sequence: Synthetic coding sequence
atggaggcagctgtagtgctggaaatgagtgatattgttttgctgataacagacatccgtcatcctgttgtgaactttcccccagcattgtacgagtacgtgaccggagagcttggtctcgctcttgttttagttctcaataaggtggatctagcgcctcctgcgttagtggtggcatggaagcactacttccatcagcactacccccaattgcatgtggtgctgttcacgagcttccctcgggaccccagaaccccccaggatccttcgagcgtgctgaaaaaaagtcgccgacgcggaaggggctggacgagggccctcgggcctgaacaactccttcgggcttgtgaagcaatcactgtcggcaaggttgatcttagttcctggcgggagaaaattgcccgtgacgtagcgggagccacatgggggaatggcagtggcgaggaggaggaggaggaggatggacctgccgtacttgtggagcagcagacagattccgctatggagcccaccggacccacccaggagaggtacaaggacggggtggttacaatcggttgtgtgggtttccccaacgttggcaagtcatctcttatcaacggcctcgtggggaggaaagtcgttagcgtgtcacgcacgcccggtcataccaggtacttccagacgtattttctgaccccgagcgtgaagctatgtgactgcccgggtttgatcttcccatccctgctgccaagacaacttcaggtcttggctggcatttaccctatcgcccagatccaggaaccctatactgcggtggggtatctggcatcccgaatacctgttcaagcactcctgcatctcagacatcctgaagctgaagaccctagtgcagagcacccttggtgcgcgtgggatatctgcgaagcttgggccgaaaagcgcggatataagaccgctaaagccgcaagaaatgacgtgtatcgagcagcaaacagcctgctaaggctggcggtggatgggagactgtcactgtgtttccatcctcccggttattctgaacagaaaggaacttgggagagccacccagagactacagagttggttgtgcttcagggcagagttggaccggctggtgatgaggaggaggaggaagaagaagagcttagtagttcatgcgaggaggaaggtgaagaagaccgtgacgccgatgaggaaggggagggcgatgaagaaacacccacgtcggcccctggctcgtcgctggcaggccgtaatccttacgccctcctcggagaggatgagtgttag

SEQ ID NO: 225535 - DNA, 1290 bp, Artificial Sequence
  Description of Artificial Sequence: Synthetic coding sequence
atggaggcagccgtcgtgctggagatgtctgatattgtgctgctcatcacggacataagacacccagttgtcaactttcccccagccctctacgagtacgtcaccggagagctaggcttagcactggtgctcgtgctgaataaggttgatctcgctccccctgctctggtggtggcctggaagcactacttccaccagcactacccacagctgcatgtcgtgctcttcacctcatttccacgagacccaaggactcctcaggatcctagttcagtgctcaaaaaatctcgtcgtcgcggacgcggttggactcgcgcactgggtccagaacagctgttgcgagcctgtgaggccattacggtaggcaaagtcgacctcagttcctggagggagaagatcgctcgggatgtagcgggtgccacttggggaaacggctccggcgaggaagaagaggaagaagatggtcccgcagtactggtcgagcagcagaccgactccgctatggagccgaccggccctacccaggagagatataaggacggagtggtcacaatagggtgcgtaggcttcccaaatgtgggtaaatcatctctgattaacggacttgtggggaggaaggtagtgtccgtgtctcgcactcccggtcacacaaggtacttccaaacttattttctcacaccttctgtgaagctgtgtgactgtcctgggctgattttccctagtctcctcccaagacagcttcaagttctcgccggtatttatccaatagcgcaaatccaggaaccctacactgctgtgggctacttagccagtagaatacccgtccaagcactgctgcacctgcgacaccccgaggccgaggacccatcagcagaacatccatggtgcgcgtgggacatttgcgaggcctgggccgagaaaagaggatacaaaactgctaaggcggctaggaacgacgtttatcgcgctgccaacagcttgctccgcttggccgtggatgggcgactttctctatgctttcatccgcctggctatagtgaacagaaaggtacctgggagtctcaccctgagacaacagagctggtggtcctgcagggaagggtgggcccagcaggggacgaagaggaagaagaggaggaggagctgtccagcagttgtgaggaggagggcgaagaggatcgagatgcagacgaagagggcgagggcgacgaggagaccccaacgagtgcccctggctcaagtttggcagggaggaatccctacgcactcctcggggaagacgagtgctag

SEQ ID NO: 225536 - DNA, 789 bp, Artificial Sequence
  Description of Artificial Sequence: Synthetic coding sequence
atggaacctacggggcctacacaggagcgttacaaggacggcgtcgttacaatcggctgtgtcgggttcccaaatgttggcaaatcaagcctcatcaatgggctggttggaaggaaggtggtgtctgtgagccgcactccagggcacacccgctatttccagacgtacttcctgaccccctctgttaaactgtgtgattgtcctggtcttattttcccttcgctgctgccaagacagctgcaggtgttggctggtatctatccgattgcacagattcaagaaccatacactgcggtggggtacctcgcgagtaggattccagtccaggcactgctgcacttgcgacatcctgaggctgaggacccatctgctgagcacccctggtgtgcctgggatatctgtgaagcatgggccgaaaagcgcggttataagaccgctaaggccgcaagaaacgatgtttacagagccgctaacagtttacttcgcttagccgtcgatgggcgattatccctgtgttttcatccgccaggctactccgaacagaaaggcacctgggaatcacaccccgagaccacggagctagtggtgctacaaggtcgggttggccctgctggcgatgaggaagaggaggaggaggaagagttgtcaagcagctgcgaggaagaaggagaagaggatcgggacgccgacgaggaaggggagggcgacgaggagacacctaccagcgcccctggaagctcactcgcagggaggaatccatatgctctcctgggagaggatgagtgttag

SEQ ID NO: 225537 - DNA, 1290 bp, Artificial Sequence
  Description of Artificial Sequence: Synthetic coding sequence
atggaagccgctgtggtcctggagatgagcgatatcgtgctgctgatcaccgacataaggcatccagtagttaactttccacccgctctgtatgagtacgttaccggggagcttggcctggctttggttctggtgttaaacaaggtggatctcgccccaccggcactggtcgtggcctggaagcactacttccaccagcattacccccagctccatgtcgtgctgtttacatcatttccacgcgatccgaggactccccaggacccctcctcagtgttgaaaaaaagcaggcgcaggggtcggggatggacacgagctcttggtccagagcaattgttacgcgcatgtgaagcaatcaccgtaggcaaggtcgaccttagctcatggcgtgagaaaattgcacgcgacgtggcaggtgcgacctggggaaatggtagcggggaggaggaagaggaagaggatgggccagcggttttagtggagcagcagactgactccgccatggagccaaccggcccaacccaggagagatataaagacggcgtggtgactattggttgtgtaggatttccaaatgtagggaagagtagccttataaatggcctggtaggacgtaaggtggtttcagtgagtcgaacccccggtcacactagatacttccagacctattttttgacccccagcgtgaaactttgcgattgtcctggcctgattttccctagtctgctcccacgccagctccaggtgcttgctgggatttacccaattgcccagatccaggaaccctatacagccgtggggtatctcgcgtctaggatacctgtacaagcccttcttcatcttagacatccagaggccgaggacccttctgcggaacacccatggtgcgcgtgggatatttgtgaagcttgggcagaaaagagaggatataagacagccaaggcagccaggaacgacgtctaccgagctgctaactccttattaagactggccgtggacggacgcctgagcctgtgctttcatcctcctgggtattcggaacagaagggaacatgggagagtcatcctgagacaacagaattagtggttctgcaggggcgagtgggaccagcaggtgatgaagaggaggaggaggaggaagagttgtcatctagctgcgaggaagagggggaagaggaccgcgatgctgatgaagaaggtgaaggcgacgaagagaccccaacctctgccccaggctcaagtctcgcgggtcgaaatccatatgctctgctcggtgaagatgagtgttag

SEQ ID NO: 225538 - DNA, 1215 bp, Artificial Sequence
  Description of Artificial Sequence: Synthetic coding sequence
atgagtaaagagcagctcatgagccaggaagaacggagcttccaagattaccttggcaagatccatggggcttactcttctgaaaagctatcctatttcgagcataacctggaaacatggcggcaactctggcgtgtactggagatgtctgacatagtactgttgatcaccgatatacgtcatccggtagtgaactttccccctgccctctatgagtatgtcaccggcgaacttggcctggcactcgtgcttgtgctgaataaagtggatcttgcccctcccgcactggtcgttgcatggaagcactactttcaccagcactatcctcaactccatgtggttctgtttacatcatttcctcgtgaccctcggaccccgcaggacccttcatctgtcttgaaaaaatctcggaggcgcggaagaggatggactcgggctttgggcccagaacagctgctccgcgcttgtgaggcaatcactgtggggaaaggtttccctaacgttggaaagtcatcattaattaatggtctagtcgggaggaaagtggtatctgtgagccggactcccggtcatacaaggtactttcagacctacttcctgacaccaagcgtcaagctgtgcgactgcccgggactgatttttccttccctgctgccccgacagttgcaagttctggcgggaatatatcctatagcccagattcaggaaccttacaccgctgtcggctatctcgcaagccgtatccccgtgcaggctctcctgcacttgcgacatcccgaggctgaggatccctctgcggagcacccttggtgtgcctgggacatctgcgaggcctgggccgagaagaggggctacaagacagcaaaagccgctaggaacgacgtataccgcgcagcgaatagcctcctgagactggcggtagacgggagactgagtctttgctttcacccacctggatactcagagcaaaagggaacttgggaaagccaccccgaaactactgagctcgtcgttctgcagggtagagtgggcccagcaggtgacgaggaagaagaggaggaagaggagcttagctcatcctgtgaggaggagggggaagaggatagggatgccgatgaggagggcgagggagatgaggagactccaactagcgccccagggtcatccctcgctggcaggaacccctacgcgctgctgggcgaagatgaatgctag

SEQ ID NO: 225539 - DNA, 1215 bp, Artificial Sequence
  Description of Artificial Sequence: Synthetic coding sequence
atgtccaaagagcagcttatgtcacaggaagaacgcagttttcaggactacttaggaaaaattcacggtgcctactcttcagaaaaactctcatacttcgaacacaacctggagacctggcgccagctgtggcgcgttctggaaatgagcgatattgtcttattaataacagatattcggcaccccgtggtcaattttcctcccgctctatatgagtacgttacaggggagcttggattggcactagtgttggtcttgaacaaggtagatctggcccctccagctcttgtggttgcatggaagcactattttcaccagcactatccccagttgcacgtcgtgcttttcacaagtttcccccgagatccacggaccccccaggacccctcctcagttctgaaaaagagcaggcggaggggacggggttggacccgagcgttgggtcccgaacagcttctcagagcttgcgaggccattactgtgggtaaaggctttccaaacgtcggaaagagttcgttaatcaacggccttgtcggtcggaaagtcgtgtccgtgagccgcactccgggacatacccggtatttccagacttattttctgacccccagtgtaaagctgtgtgattgtccagggctcatcttcccctccctgttgcccagacagctgcaggtgcttgccggaatctaccctatagctcagatccaggagccctacactgccgtggggtatctggcttcccgaatccctgtgcaggcactcctgcacctcaggcaccccgaggccgaggaccccagtgctgagcatccatggtgcgcatgggacatctgcgaggcttgggcagagaaaagggggtacaagacagcaaaggccgctagaaacgacgtgtatcgtgcagcaaactccctgcttagactggccgtcgatgggagactttctctgtgctttcaccccccaggttattctgaacaaaagggcacttgggaaagccatcctgagacgaccgaattggtggtcctacaagggagagtcgggcctgcaggtgatgaagaggaagaggaagaggaggaactgagctcaagctgcgaggaggagggggaggaggatcgagacgccgacgaagagggcgaaggagacgaagaaaccccgacttctgctcctggatcttccctcgccggacgaaatccctacgcgttattaggggaagacgaatgttag

SEQ ID NO: 225540 - DNA, 789 bp, Artificial Sequence
  Description of Artificial Sequence: Synthetic coding sequence
atggaacctaccggtccaactcaggaacggtataaagatggagtagtgaccatcggctgcgtcggctttccgaatgttggcaagtctagcctgatcaatgggttggtgggcagaaaggtggtgtcagtgtctcggactccagggcacacgagatacttccaaacatatttcctcaccccctccgtgaaactgtgtgactgtcctggcctcatcttcccttcactactcccgagacaactccaagtcctggcgggaatatatcccatcgcacagatccaggagccttacacagcggtgggatatctggctagtcggattcctgtccaagccctactccatctccgccatcccgaagccgaggaccccagcgcagaacatccttggtgcgcttgggatatctgcgaagcgtgggcggagaaaagaggttacaagactgcaaaagctgctagaaatgatgtgtatagagcggcaaatagcttgttaaggctggccgtggacggacggctctcattgtgctttcacccaccgggatattctgagcagaaaggaacgtgggaaagtcaccctgagacaaccgaacttgtcgttctgcagggtcgagtgggccctgcaggcgacgaagaggaggaagaagaggaggaactttccagcagctgcgaggaggagggcgaagaagaccgggacgcggatgaggagggcgagggtgacgaggagaccccaacaagcgcccctggcagttctctggcgggacgaaacccctacgcacttctcggagaagatgagtgttag

SEQ ID NO: 225541 - DNA, 2196 bp, Artificial Sequence
  Description of Artificial Sequence: Synthetic coding sequence
atggtgaagcccaagtacaaggggcgttccactatcaatccatctaaggcctcaactaatcccgacagggtacagggagccggaggacagaacatgagagaccgcgctacaattcgaaggcttaacatgtatcggcagaaagagcggaggaattctcgaggaaagattatcaagcctctgcagtatcaatcaacagtggccagcggtaccgtcgcaagagtcgagcccaatattaaatggttcggtaatacccgggttattaagcagtcaagccttcaaaagttccaggaggaaatggacacagtgatgaaggatccatacaaggtggtgatgaagcagtctaaattacccatgtcattgctccatgaccgaatacgccctcataacctaaaagtgcacattctggataccgaatcgttcgagaccacatttgggcctaagtcccaacggaaacggcctaatcttttcgccagtgacatgcagagcttgattgagaacgccgagatgtctacagagtcctatgatcaaggaaaggatcgggatctcgtgacagaagatactggggtgcggaacgaagctcaggaggagatttacaagaaagggcaatccaaaaggatttggggcgagctgtacaaagtgatcgactcatcagatgtcgtggtgcaggtgctggacgcccgagacccaatgggaacacggtcacctcacatagagacttatctaaagaaggaaaagccctggaagcatctcatcttcgtgcttaacaagtgtgatttagttccaacgtgggccacaaaacgatgggtcgctgtgctgtcacaggattatcccacattggcgttccacgcctcgctgaccaaccctttcggaaaaggggcattcatacagctattgaggcagttcgggaagctgcacaccgacaaaaagcagatcagtgtgggctttataggctacccaaacgtaggtaaatccagtgtcattaatacactcagaagtaaaaaagtgtgcaatgtcgcaccaatcgcgggagaaaccaaagtttggcagtacataacactgatgagacgcatcttcctgatcgactgcccaggcgttgtctacccttcggaagacagcgagaccgatattgtgcttaaaggggttgtgcaggttgagaaaatcaaatcccctgaggatcatattggagctgtactggaacgcgcaaagccagagtacattagtaagacttacaagattgatagctgggaaaacgcagaggatttcctcgaaaaactcgctttccgtacggggaagctactgaaaggaggcgagccagacctacagaccgtgggtaaaatggtgctcaacgattggcaacggggtcggatccccttcttcgtgaaaccacccaacgcggagcctttagttgcccctcaactgctgccctcatcatctctcgaggtcgttccagaggcggctcagaataaccctggcgaggaggtgaccgaaactgccggagaagggtcagaatcaatcatcaaggaggaaaccgaggagaatagccattgcgatgccaacaccgagatgcagcagatcctgacccgggtacggcagaactttgggaaaatcaacgtcgtgccacagttcagtggtgatgatctagtgccagtggaggtgtcagatttagaggaggagctcgaaagcttttcagacgaggaagaggaggagcaagaacagcagcgcgatgatgcggaagaaagctcctccgagcctgaggaagagaatgttggcaacgacaccaaagctgtcattaaggcattagacgagaagatcgccaagtatcagaaattcctcgataaagctaaggccaaaaaattctccgctgtgcgtataagtaaggggctgagcgagaaaatcttcgcaaagccggaagagcagagaaaaaccctggaagaggatgtggatgatcgggctcccagcaagaaggggaagaagagaaaagcccagagggaagaggaacaggagcactccaataaggctccccgagcactgacatcaaaggagcgcaggcgagcggtgagacaacagcgccctaagaaagtgggagtcagatactatgaaacccacaacgtaaagaacaggaacaggaataaaaagaagacaaatgactctgagggacagaaacataaacggaagaaatttagacagaaacaatag

SEQ ID NO: 225542 - DNA, 579 bp, Artificial Sequence
  Description of Artificial Sequence: Synthetic coding sequence
atgcagtccttgattgagaacgctgagatgtccacagagtcatatgatcagggaaaggatagggatttagtcactgaggatacaggggtccggaatgaggcccaggaagaaatctacaagaaaggccagagtaagagaatctggggcgagctttacaaagtaatcgacagctcagatgtggtggtccaggtgctagatgcaagggaccctatgggaactcgtagccctcatattgaaacgtatctcaaaaaagagaaaccatggaaacacttaatttttgtcctgaacaagtgtgacctagtacctacctgggccactaagagatgggttgcagtactttcccaggactatcctacactggcctttcatgcgtcactgacaaacccttttgggaaaggagcgtttatccaactcttgcgccagttcggtaagttgcatacagataaaaagcagatcagtgttggatttatcgggtatcccaacgtgggcaagtcctcggtgataaatacccttagaagcaagaaggtgtgcaacgtcgcccctatcgcaggagagaccaaggtgtccatcctgctctag

SEQ ID NO: 225543 - DNA, 1614 bp, Artificial Sequence
  Description of Artificial Sequence: Synthetic coding sequence
atgacttgtcataaaaggtacaagatccagaagaaggttcgtgaacatcataggaagttgcgaaaagaggcaaagaaacgcggacataaaaagccacggaaagatcccggagtgcctaacagtgcgccttttaaggaagctcttctgcgcgaagctgagctccggaaacaacgactggaggagttaaagcaacaacaaaaactggaccggcaaaaggagctcgagaaaaagcgcaagttagagacaaaccctgatatcaaaccttcaaacgttgagccgatggaaaaagaatttggtttgtgcaagaccgaaaataaggcaaagtcagggaaacagaacagtaaaaaactgtattgccaggagttgaagaaggttatcgaagcgtctgatgtggtattagaggtcctggatgcgagagacccgctaggatgcagatgtcctcaggtggaggaggcaatcgtccagtcgggccagaaaaagctggtgctgattctgaacaaatccgatttagtgccaaaagaaaacctggagtcatggttaaattacctcaaaaaggaactcccaactgttgtgttccgcgcttccaccaaacccaaggacaagggcaaaatcactaaaagagtaaaagccaagaaaaacgctgccccatttcggtctgaagtctgtttcggcaaggaagggttgtggaaacttcttggaggctttcaggagacttgcagcaaggctattagggtgggtgtgatcggattcccaaatgttggcaaatcaagcattattaactcgctgaagcaggaacagatgtgcaacgtgggagtttctatgggtctgacccgatctatgcaggtggtccccctggataagcagatcactatcatcgactctccctcattcatcgtgtcacctctgaatagttccagtgcccttgcactcaggagtcctgcgagcatagaagtcgtgaaacctatggaagccgcttccgccattttgagccaggccgatgccagacaggtcgtgctcaagtacaccgttcccggttaccgtaatagcctcgaattttttacagtgctggcgcagcggcgaggtatgcaccagaaagggggtattcctaacgtggaaggggcagccaagctgctgtggtccgagtggacaggcgcatcccttgcctattattgccatccgcctacctcctggaccccccctccgtatttcaacgagagcattgtggtagatatgaagtctgggttcaacttggaagaacttgaaaaaaacaacgcccaatcgatacgcgctataaagggtccccatttggccaactccatcctctttcagtcctcgggactgacaaatggtattatcgaagagaaagacattcatgaagaactcccaaagagaaaggaacgcaaacaagaggagagggaagacgataaggactctgaccaggagacagtcgacgaggaggtggatgaaaacagctcaggaatgtttgcagctgaagagaccggtgaagccctgtctgaagaaaccaccgccggagagcagtcaaccagatcctttatcctggataaaattattgaggaggacgacgcttatgattttagcactgactacgtttag

SEQ ID NO: 225544 - DNA, 1650 bp, Artificial Sequence
  Description of Artificial Sequence: Synthetic coding sequence
atgaagagaccaaagctgaagaaagcatctaaaagaatgacctgtcataagagatataagatacagaagaaagttcgcgaacatcaccggaagctgcgcaaagaggccaaaaaacgtgggcacaagaagcctagaaaggaccctggtgtgccaaacagcgccccatttaaggaggctctgctgcgcgaagctgaactgcgcaagcagcgcctggaggagctcaaacagcaacagaaactcgaccggcaaaaggagctcgagaagaagagaaagctggaaactaatcccgatattaaaccttcaaatgtggagcccatggaaaaggaatttggcctgtgtaagacagagaataaagcaaaaagcggtaaacagaactccaagaagttgtattgtcaggagctcaaaaaggtgattgaggcgtccgacgttgtgctagaggtcctggacgccagagatccgttaggttgcagatgcccccaggtggaagaggcaattgtccagtcaggccagaagaaactggtgctcatcttgaataaatcagacttggtacctaaggagaacctcgagtcatggctgaattacctgaagaaggagcttccgactgtagtgttccgagcctccacaaaaccgaaagacaagggcaaaataacgaaaagagtcaaggctaagaaaaatgcagcaccctttcgctcagaggtgtgtttcggtaaagaaggtctgtggaagttactgggtggcttccaggaaacatgctccaaagccatccgcgttggcgtcattgggttccctaatgtgggcaaatcctcaattatcaatagccttaagcaggaacaaatgtgcaacgtgggagtcagtatggggctcacccgcagcatgcaagtggtacctcttgataagcagatcactatcatcgattcccctagttttattgtgtctcctttaaattcctccagcgctctggctctgcgatcccctgctagtatcgaggtggtgaagccaatggaggctgcatcagccatactctcgcaggctgacgccagacaggttgtactgaagtacaccgtccccggttaccgtaatagcctggaattttttacggtgctggcccagagaagaggaatgcatcagaaaggcggaatcccaaatgtcgagggggctgctaagttgctgtggtcagagtggactggggctagcctagcctactactgccacccccctactagctggactcccccaccgtatttcaatgagagcatcgttgtggatatgaagtctggattcaacctcgaggagcttgagaagaataacgctcagagtatcagggccatcaaaggtccacacttagccaactccatcttgttccagtcctctgggctgacaaatggaattattgaagagaaggatattcacgaagagcttccaaaaagaaaagaacgcaagcaagaagagagagaggacgacaaggatagtgatcaggagaccgttgacgaggaagttgacgaaaatagttcagggatgtttgcagctgaggagacgggtgaagccctgtcagaagagaccacagcaggagagcaaagtactaggtcttttattctggataagattatcgaggaagacgacgcctatgacttttcaacagattatgtgtag

SEQ ID NO: 225545 - DNA, 291 bp, Artificial Sequence
  Description of Artificial Sequence: Synthetic coding sequence
atgacctgccacaagagatacaagattcaaaagaaggtccgcgagcaccacagaaagttaagaaaagaagccaagaagcgtggccataagaaacccaggaaggaccctggagtacccaactctgcacctttcaaagaggccctcctgcgggaggctgagttaagaaagcaacgacttgaagaactgaaacagcagcagaaactcgatcgccagaaagagcttgagaagaagaggaaactggaaaccaaccccgacattaaaccatccaatgtggaacccatggagaagtag

SEQ ID NO: 225546 - DNA, 408 bp, Artificial Sequence
  Description of Artificial Sequence: Synthetic coding sequence
atgacttgtcacaagaggtacaagatccagaagaaggtgcgggagcaccataggaagctgaggaaagaggccaagaagaggggtcataaaaaacctcgcaaggatcccggagtcccaaatagcgcaccgtttaaagaggctcttctaagggaggccgagcttcggaagcagcggcttgaggaactgaagcagcagcagaagttggacaggcagaaagaactcgaaaaaaaacggaaactagagaccaatcctgatatcaagccatcaaacgtggagccgatggagaaggaatttggtctttgcaaaacagagaacaaggctaagagtggaaagcagaacagcaagaagctgtattgccaggagttgaagaaggtgatcgaggcgagcgatgtggtactagaagtgtag

SEQ ID NO: 225547 - DNA, 417 bp, Artificial Sequence
  Description of Artificial Sequence: Synthetic coding sequence
atgaagaggccgaagcttaagaaggcatccaaaagaatgacctgccataaacgatataagatacagaaaaaggtgcgcgagcatcaccgcaagcttcggaaagaagccaagaaaagggggcataagaaaccacgaaaggaccctggtgtccccaactctgcaccttttaaggaggctctcctgcgcgaggctgaactacggaaacagcggctggaagagctgaaacagcagcagaagctagacagacagaaagaactcgagaaaaagaggaaactggaaaccaatcccgacataaagccatccaacgtggaacccatggaaaaggagtttgggttatgtaagaccgagaataaagctaaatccgggaaacagaatagcaaaaagctctactgccaggagctgaagaaagtctcatag

SEQ ID NO: 225548 - DNA, 1038 bp, Artificial Sequence
  Description of Artificial Sequence: Synthetic coding sequence
atgcctaggatcgacgccgacctgaagctggatttcaaggacgtactgctgcggccaaagcgatcgtctctcaagtcacgcgcagaggttgacctggaaaggacctttacctttcggaattccaaacagacatactccggcatccctattattgtggcgaatatggatacagtgggtaccttcgagatggccgcagttatgagccaacactccatgttcactgctatccacaagcattactcgctagacgattggaaactatttgccacaaaccacccagaatgcctccagaacgtggcagtcagcagcgggtctgggcagaacgatttagaaaagatgaccagtatcctagaggctgtgccccaagtaaagttcatttgcttggatgtggccaatggctactctgaacactttgttgagttcgttaaactggttagggctaagttcccagagcatacaattatggctggcaatgttgtgaccggcgagatggtggaagaacttatcctgtccggagcagatattattaaagtaggcgtgggacctggcagcgtttgtactacgaggaccaagacgggcgtaggctatccgcaactttccgcagtgatagagtgtgccgatagcgcccacgggctgaaaggtcatattatcagtgatggcggttgcacatgtccgggagacgtcgctaaggcgttcggtgctggagccgacttcgttatgctgggtgggatgttcagtggccacacggagtgcgcaggagaagtattcgagcggaacggacgtaaattgaagctcttctacggcatgtcttcagatacagccatgaataaacacgcaggtggggtcgcagagtacagggcgagcgaaggcaaaacagtcgaggtaccctacaagggagacgtcgaaaatactattcttgatatcttggggggactcaggtctacctgtacatatgtgggggctgccaaactgaaggagttgtctagaagagcaacttttatccgggtaactcagcaacataatactgtgttttcttag

SEQ ID NO: 225549 - DNA, 1230 bp, Artificial Sequence
  Description of Artificial Sequence: Synthetic coding sequence
atgccccatatcgataatgacgtcaaactcgacttcaaagatgtactcttgcgccctaaaagatcaacgctcaaaagcagaagcgaggtggacctgaccaggagcttttctttcaggaactctaagcagacatactcaggcgtcccaattattgccgctaatatggacaccgtgggaacgttcgaaatggcaaaagtcctttgcaaattctcactgttcacggccgtccacaagcattactcgctggtccagtggcaggagttcgctgggcagaacccagactgcttagagcacttggcggctagctcaggcaccgggtctagcgacttcgaacaactggaacagatactcgaggccatccctcaggttaagtatatatgcctcgacgtcgccaatggctactccgagcacttcgttgagttcgtgaaagatgtccgcaaacgcttcccccagcataccatcatggccggtaacgttgtcacaggcgaaatggtggaggagcttattctctccggcgctgatataatcaaagtaggcattggcccagggtctgtgtgtacgacgaggaagaagaccggggtggggtatccacagctaagcgctgtaatggagtgcgctgatgccgcacacgggctgaagggtcacatcatttccgatggcggttgctcttgcccgggtgacgtggccaaagcattcggggctggggcagatttcgtgatgcttggaggaatgttggccggacacagcgagtccggcggagaactgatcgaaagggacggtaaaaagtataagctcttctatggaatgtcgtcagaaatggctatgaaaaaatatgccggtggagtcgcagagtaccgatacgtgtggcgcccaagatcattggtcatcgtgtggcgccagaatagttggctgttacggggagggtggtactctagccagcgctccatggtgaaccgtggctccatgctgggcagtgtcgaaaagagtctcggtctccggaaccctgaaggggaagacaacaaagtattccccacattgcgtgcctcagagggaaagacagttgaggtgcccttcaagggagatgtagagcacacgattcgtgatatccttggaggcatccggtcaacttgcacgtatgttggggcagcaaagctaaaagagctgtcgcggcgaaccacatttattagagtaactcagcaggtgaacccaatcttttccgaggcttgctag

SEQ ID NO: 225550 - DNA, 1047 bp, Artificial Sequence
  Description of Artificial Sequence: Synthetic coding sequence
atgcctcacatagataatgacgttaagttagactttaaggacgttttgttgcggccaaaacgctctacactgaaatccaggtccgaggttgacttaacccggtcattctctttccggaactccaagcagacatacagcggtgtgccaattattgctgccaatatggatacggtgggaactttcgagatggcaaaagtgctctgcaaattttcactgttcaccgcggtccacaaacactattcccttgtacaatggcaggagttcgcaggccagaatccggattgcctggaacatctggctgcttctagcggaaccgggtcatcagatttcgagcagttggagcagatccttgaagccatcccacaagtcaaatatatttgcctggacgtggcgaatgggtacagcgagcattttgtggaatttgtgaaagatgtgagaaagcgctttcctcagcataccattatggcaggaaacgtggtaactggggaaatggttgaagagctcatcctgtcaggcgcagatatcattaaagtgggaatcgggccaggctcagtgtgcaccactaggaaaaagactggagttggctacccacaactctccgcggttatggaatgcgctgacgccgctcatggtctgaaaggccacattatcagcgatggcggttgtagctgtcctggagatgtggcaaaggcattcggcgctggagccgactttgttatgcttggcggaatgctggcgggtcacagcgaaagcggaggtgagctcattgagcgcgacggcaagaagtacaaactcttttatggaatgagcagtgagatggccatgaagaagtacgcaggtggtgtggctgagtaccgggcaagcgaggggaagacagtggaagttcctttcaagggcgacgtggagcacactatccgcgatatactggggggaatccgcagcacctgcacgtacgttggggctgccaagcttaaagagcttagtagacggaccacattcatccgggtgacccagcaggtgaatcccattttttctgaggcttgttag

SEQ ID NO: 225551 - DNA, 1047 bp, Artificial Sequence
  Description of Artificial Sequence: Synthetic coding sequence
atgcctcatatagacaatgacgtaaagctagattttaaagatgtactccttcgacctaaacgctccaccctcaaatccaggagtgaagtggatcttacacgctcttttagttttcgaaactccaagcagacttactctggagttcctatcatcgctgccaacatggatacagtgggtaccttcgaaatggcaaaagttctatgtaagtttagtctttttacagccgttcacaaacactacagtttagttcagtggcaggagttcgccggtcaaaatcccgactgcttggagcacctggcagcctcatctgggactgggtcgagtgattttgaacaactcgagcagatcctggaagccatcccccaggtgaagtacatctgtcttgacgtcgctaacgggtactcggaacatttcgtagaattcgtgaaggacgtgcggaagaggtttcctcagcatacaataatggctgggaacgtggtgaccggagagatggtagaggaacttatcctgtccggcgcagacatcattaaggtcggaatcggacccggtagcgtatgcacaacaagaaaaaagaccggggtcgggtacccccagctctctgccgtcatggagtgcgctgatgccgctcacggactaaagggacacataatcagtgacggaggatgtagttgtcccggagacgtcgcgaaagcatttggggcaggggcagactttgtgatgttaggtggaatgttggccggtcactccgaaagcgggggagagctgattgagagagatggcaagaaatataaacttttctacggtatgtcctcagaaatggcaatgaaaaaatacgcaggcggtgtggccgaatatcgcgcttcagagggaaaaactgtggaagtgccgtttaaaggggacgtggaacatactataagagatatcttggggggaatcagatctacctgtacctacgtgggcgctgcgaagcttaaggagctgtcgcgccgtaccactttcatccgggtcacccagcaggtcaaccctatattttcagaggcatgctag

SEQ ID NO: 225552 - DNA, 1101 bp, Artificial Sequence
  Description of Artificial Sequence: Synthetic coding sequence
atgacatcgtgtctccctgctctgcggttcatcgcaactccacgcctttccgccatgccccacatagataacgatgtaaagctggacttcaaggacgttctcctcaggccaaagcgatcgacgcttaagtccagatcagaagtcgaccttactcgtagcttttccttccggaactccaagcagacttacagcggcgttccaattatcgctgccaacatggacacagtgggtacttttgagatggccaaagtgctgtgtaagttttcactctttaccgcggtccataagcactatagtctggttcagtggcaagaattcgctgggcagaatcccgattgcttggagcatttggccgcatcctcgggcacagggagctccgactttgaacagctggaacaaatcttggaggctattccccaggttaagtacatttgcttggatgttgccaacgggtacagtgagcactttgtggaatttgtaaaagatgtgcggaaaagatttccacagcataccatcatggctggcaacgttgtgaccggcgagatggtggaggagcttatcctgtccggcgctgacattatcaaggttggaatcggcccaggctcagtctgcactacccgcaagaagacgggcgtcggatacccgcagctgagtgcagtgatggaatgtgcagacgcggctcatggactgaagggccatatcatctctgacgggggatgctcatgccccggagacgttgccaaagcattcggggctggggctgatttcgtgatgctgggaggaatgttggccggacattctgaatctggcggtgagctaatcgagcgggacggtaagaagtataagctgttttatggaatgagttccgaaatggccatgaagaaatacgcgggaggagtggcagagtaccgggcatcagaaggaaaaaccgtcgaggtccccttcaaaggtgacgtagagcacacaatccgcgatatcctgggcggtattagaagtacctgcacctacgtgggtgctgcaaagcttaaggagctttcacggcgaactacatttattagggtgacccaacaggtgaatcccattttcagcgaagcatgctag

SEQ ID NO: 225553 - DNA, 1047 bp, Artificial Sequence
  Description of Artificial Sequence: Synthetic coding sequence
atgccacacattgacaacgacgtcaaactggacttcaaagacgtactgctgcgcccaaagaggtctaccctcaaaagcagatctgaggtagatctaactcgctcgttctctttccggaacagcaagcaaacatacagtggcgtgcctatcattgcggcaaacatggacacggttggaactttcgagatggccaaggtgctctgcaaattctctctcttcacagcagtgcacaagcattacagtctggtccaatggcaggaattcgctggtcagaacccggactgtctcgagtccatttggctccccgctcaggcacaggcgctgctcactctctcgagttggaatagatcctggaaactgtttcctaggaaatacatctgtctggacgtggctaatgggtactccgagcatttcgtggagttcgtgaaagacgtgaggaagcgtttcccacaacacaccataatggctggtaacgtggtcaccggagaaatggtggaagaactgatcttgagcggcgctgacattatcaaagtaggaataggccctggatcggtttgcacaactcgaaagaagacaggagtgggctatcctcaactttccgctgtaatggagtgcgccgacgctgctcacggactgaagggacacattatttccgatggagggtgttcttgcccgggtgatgttgctaaagcattcggggctggagccgatttcgtgatgcttggtgggatgctcgctgggcacagcgaaagtgggggagagctgattgagcgagatggcaaaaaatacaaactgttctatgggatgagcagcgaaatggccatgaagaaatatgccggtggtgtagcagagtaccgagcttccgaagggaagaccgtcgaggtccccttcaagggagacgtcgaacacactatccgagacattttgggtggaattcgatctacatgtacatatgtcggggcagcaaagctaaaggaactatcccgcagaaccaccttcataagagtgacacagcaggtgaacccgattttcagcgaagcctgctag

SEQ ID NO: 225554 - DNA, 1047 bp, Artificial Sequence
  Description of Artificial Sequence: Synthetic coding sequence
atgccacacatcgacaatgacgtcaagctcgatttcaaggatgtgctgctcaggccaaagcgaagtacactcaaatcgcggtctgaggtggatctgactaggtcattctcatttcgcaattcaaagcaaacgtattctggtgttccaatcattgccgctaatatggataccgtgggcacattcgagatggccaaggttttatgcaagttttctctgttcaccgccgtgcacaagcattactctctggtgcagtggcaggagttcgctggccagaaccccgattgcttggagcacctggccgctagctccggaacaggctcctcagatttcgagcagttggagcagatactcgaagctatccctcaggtgaagtacatatgccttgacgttgcaaacggatactctgagcatttcgttgagtttgtgaaggacgtgaggaaacgcttcccacaacatacaatcatggccggaaacgtcgtcaccggtgagatggtagaggaactaatcctgtccggagcagacatcatcaaggtcggtatcggcccagggagcgtgtgcacaactcgcaagaagaccggggtcggctacccacagttgtcagctgtcatggagtgcgccgatgcagcgcatgggctcaaaggacacattatcagtgacggcggatgctcatgccccggagatgtcgccaaggcctttggagccggtgcagatttcgtgatgctgggtgggatgcttgccggacatagtgagtctggcggtgaattaatcgagagagacgggaaaaagtataagctgttttacggcatgtcctctgaaatggccatgaagaagtacgctggaggggttgctgagtatagggctagcgaggggaaaaccgtggaagtgcccttcaaaggggacgtggagcacacaataagagatattctaggcggaatcagaagcacttgtacctacgtcggtgcagccaagctgaaagagctctcccgtcgcaccactttcatcagggtgacgcagcaggtgaaccccattttttctgaggcctgttag

SEQ ID NO: 225555 - DNA, 1779 bp, Artificial Sequence
  Description of Artificial Sequence: Synthetic coding sequence
atggcaagcgaaatccacatgaccggcccaatgtgcctgattgagaatacaaatggaaggcttatggcgaatcctgaggcactgaagatcctgtccgccattactcagcctatggttgttgtggctatcgtgggtctttataggaccggaaaatcttacctgatgaacaagcttgcgggaaagaagaagggtttttcgctcggtagcacagtgcaatcacataccaagggtatttggatgtggtgcgtgcctcatcctaagaagccaggccacattcttgtcttgctggatactgaagggctcggggatgtagaaaaaggggacaaccagaacgatagttggatattcgccctagccgtcctgctgagttctacctttgtttataattccattggaacaattaaccaacaagctatggatcagctgtattacgtcaccgagctgactcaccgcataaggtcaaaatcttctcccgatgagaatgaaaacgaggttgaagattcagctgacttcgtgagtttttttcccgatttcgtttggacacttcgcgatttcagcctggacctggaagcagatggacaacccttgactcccgatgagtacttgacatattccttaaagttaaagaagggcacgtcccagaaagatgaaaccttcaatttaccacgactttgtatccggaaattctttcctaagaagaagtgcttcgtgttcgacagaccagtccaccggagaaaacttgcccaactcgaaaaactgcaagatgaagagctggacccagagttcgtccagcaagtcgctgatttttgctcctatatcttcagcaactcaaaaaccaagacattatccggaggtatccaggtcaatggccctagactcgaatctctggttcttacctatgtcaatgcaattagcagcggggaccttccgtgcatggaaaacgccgttttggcactcgcacagatcgagaactcagcagccgtgcagaaagccatcgcccactatgagcaacagatgggccagaaagtgcaattgcccaccgagactctgcaggaattacttgacctccacagagattccgagagagaggcgatcgaagttttcattcgatccagcttcaaggatgtggaccacctctttcagaaggagttggctgctcagctggagaagaagcgggacgacttctgtaagcagaatcaagaggcctcctcggaccgttgctccgctctcttgcaagtgatcttcagccccctggaagaagaagtgaaggctggaatttactcaaagcccggtgggtaccggttgtttgtgcagaaattgcaggatctcaagaagaaatattacgaagaacctagaaagggaatacaggctgaggagatcctgcagacttacctcaagtctaaagagagcatgactgatgctattctccagacagaccaaacactcacggagaaagagaaggagattgaggttgagcgagtgaaggctgaatctgctcaggcttctgcgaagatgttgcaggagatgcagcggaagaatgagcagatgatggagcagaaggaacgctcgtaccaggagcacttgaaacagctaactgagaaaatggaaaacgatagagtacagttgctaaaggaacaggaaaggaccctggcactcaagctgcaagaacaggagcagctcctgaaggaaggtttccaaaaggaatcgaggattatgaagaacgaaattcaggatttgcagactaagatgaggcgcaggaaggcttgtaccatcagttag

SEQ ID NO: 225556 - DNA, 1668 bp, Artificial Sequence
  Description of Artificial Sequence: Synthetic coding sequence
atggtggtggtggccattgtggggctgtaccgcacgggaaagtcctacctgatgaataaactggccggaaagaaaaaagggttcagcctcggttctactgtgcaaagtcacaccaagggaatttggatgtggtgtgtgccgcatccgaagaagcccggacacatactggtactccttgataccgagggcctgggagacgtcgaaaagggcgataaccaaaatgacagctggatcttcgctttggcggtactgctgtcctccacctttgtttacaattcaataggcaccattaaccagcaagctatggatcaactctattacgtgaccgagctcacccacaggatccgctccaaaagctcgcccgacgaaaacgagaatgaggttgaagatagtgccgactttgtgagtttttttccagacttcgtgtggacattacgggactttagcctggaccttgaagctgacggccaacccttgacaccagatgagtacctcacctatagtctgaagctgaaaaagggaacctcccagaaagacgagacctttaacctgccaagactctgcatcagaaagttcttccccaagaaaaagtgctttgtctttgatagaccagtccatcgcaggaagcttgctcagctagaaaagctgcaggacgaggagttagaccccgagtttgtccaacaggtggctgacttttgctcttacatattttcaaacagcaaaacgaagactctgagtggcggtatacaagtgaacggtccccgattggagagtttggtgctgacttatgtgaatgctatcagtagcggagatctcccctgcatggagaacgccgtgctcgcattagcgcagatcgagaacagtgcagcggtgcaaaaagcaattgctcattacgaacagcagatgggacaaaaggtacagctccccaccgaaaccttgcaagaactcctggatcttcaccgtgacagcgagcgcgaggctattgaggtgttcatcagatcatcatttaaagacgtggatcacctgtttcagaaggaattggccgcacagctggagaagaaacgcgatgatttctgcaagcagaaccaagaggcttccagcgataggtgctccgcccttctccaggtgatcttttccccacttgaggaggaggtgaaggcaggaatctacagtaagcccggagggtatcgactgttcgtacagaaactgcaagatctgaagaaaaagtactacgaggagcctcggaagggtatacaggccgaagagattctgcagacttatctgaaaagcaaagagtccatgaccgacgcaattctgcaaactgaccagaccctcaccgagaaagagaaggagatcgaggtggagcgagtgaaggcagaatccgcccaggcatctgcaaagatgctgcaggagatgcagcgcaagaacgagcaaatgatggagcagaaggaaagatcatatcaggaacatctgaaacagctgacagaaaagatggaaaacgaccgcgtgcagttgctcaaggagcaggaacgaacactggcgctaaagctacaagaacaggaacaactgttgaaggaaggattccagaaggaatctcggatcatgaagaacgaaatccaggatcttcaaactaaaatgcggagaagaaaggcatgtaccatctcctag

SEQ ID NO: 225557 - DNA, 1776 bp, Artificial Sequence
  Description of Artificial Sequence: Synthetic coding sequence
atggcccctgagattaacttacctgggccaatgagcctcatcgacaataccaagggtcagctggttgttaatcccgaggccctgaagatcttaagcgcgattacccagcctgtggtggtggtggccatcgtgggactctataggactggcaaatcctacctgatgaacaaactagctgggaaaaaaaacgggttctcactgggctctacggtcaagtcacacaccaaagggatctggatgtggtgtgtaccccaccccaagaaaccagagcatacgttagttctccttgacacagagggcttaggtgacatagagaaaggcgacaatgagaatgacagttggattttcgccttagccattttacttagctcaacatttgtctacaactcaatgggtaccatcaatcagcaggccatggatcaacttcactatgtcacagagctaacagatcggatcaaggcaaactcctcgccaggaaacaacagcgtagacgactcagccgacttcgttagctttttccctgccttcgtgtggacactgcgagatttcactttggaattggaggtagacggggagccgatcactgctgacgactatcttgagctcagtctgaagttaaggaaggggaccgataaaaagagtaagagctttaatgaccctagactgtgcattcggaagttcttccctaaaagaaaatgttttgtcttcgattggccagcccctaaaaagtacttggcccacctagaacagctgaaggaggaagagctgaatccagactttattgaacaggtggcagagttctgcagttacatcttgtctcactctaacgtgaagacgctgtccgggggtattcccgtaaacggacccagactcgagtcactggtcctgacatatgttaatgccatttccagtggggacctgccctgtatggaaaacgccgtgctggcactagcccaaattgaaaactccgccgcagtcgaaaaagcaatcgcccactacgagcagcaaatggggcagaaagttcaacttcccaccgagaccctccaggagcttctcgatctccatcgcgactctgagagggaagccatcgaggtctttatgaaaaactccttcaaggacgtggatcagatgttccagaggaagctcggggctcagttagaagcacgcagggatgacttttgtaaacagaatagcaaagcaagttcagattgctgtatggctctgctgcaagatatatttggaccattggaagaggatgtgaagcagggcacattttctaaacctgggggatatcgcttgttcacccagaaactgcaggagctcaagaacaagtactaccaggtcccaagaaaggggatacaggccaaggaagtcttgaagaagtatctggaaagcaaggaggatgtcgccgatgcattacttcagactgaccagtcgctatccgagaaggagaaagcaatcgaggtggagaggatcaaggcagagagtgctgaggccgcaaaaaaaatgcttgaggagatacaaaaaaagaacgaggagatgatggagcagaaggaaaaatcctatcaagagcatgttaaacagctgactgagaagatggaaagagatagagcccaactgatggccgagcaagaaaaaactctagcccttaagctccaggagcaagagcggcttctgaaggagggctttgaaaatgagtccaaaaggctccaaaaggacatctgggatatacagatgcggagcaaatcgctggaacccatttgtaacatattatag

SEQ ID NO: 225558 - DNA, 1776 bp, Artificial Sequence
  Description of Artificial Sequence: Synthetic coding sequence
atggccccagagatcaatttacccggacctatgagccttatcgataacacgaaaggccagttggtggtgaacccagaggctctgaagatcctgagcgcaatcactcagcccgttgtggtcgttgccatagtgggactctacaggactgggaagtcgtacctgatgaacaaactagccggtaagaaaaacggcttctcccttggtagcaccgtaaagagtcataccaaaggaatctggatgtggtgcgtgccccacccaaaaaaacctgagcacaccctcgtgctgctggatacagagggccttggggacattgaaaaaggcgataacgagaatgatagctggatctttgccctcgccatattgctgtcaagcacatttgtatacaattcgatggggacaattaatcaacaggctatggaccagcttcattatgtgacggagcttaccgacagaatcaaggctaatagtagtcctggaaataatagcgtggatgacagcgcagacttcgtttccttcttccctgcctttgtctggaccctaagagattttactttggaacttgaagtggatggagagcctatcacagcagacgactatctggagttgagtttgaagctgaggaagggcaccgacaagaaatctaagtcctttaatgatccacgtctctgtattcgcaaattcttccccaaacgaaagtgcttcgtgttcgactggccagccccaaaaaagtacctcgcgcatctcgaacagttgaaagaagaggagctcaatcccgactttattgaacaagtggccgaattttgcagctacatcctgtcacactctaacgtaaagaccctgtccggcggtattcccgttaatgggccacggctggagtcactggtgctgacctatgtgaacgcgatttctagcggggatttaccttgcatggagaacgcagtcctggcactggcccagatcgaaaacagcgccgcagttgaaaaagctattgctcactatgagcagcagatgggacagaaggtgcagcttcccacggaaacactacaggagctgctggatctgcaccgagactctgaacgtgaggctatcgaggtcttcatgaagaattccttcaaggacgtggatcagatgtttcaaagaaaactcggcgctcagctcgaggctagacgcgacgatttttgcaaacagaactctaaggcttcgtcagattgttgcatggcactgctccaagatatttttgggccacttgaggaggacgtgaagcaggggactttttccaagcccggaggataccggctttttacgcagaagctccaggagttgaaaaacaaatactatcaagtccctcgcaagggcatccaggccaaggaagtactgaaaaagtacctcgagtctaaagaagatgtcgccgatgctctattgcaaacggaccagagcctgagtgagaaagaaaaagccatcgaagtggagaggattaaggcagagtccgctgaggccgctaaaaagatgcttgaggagattcagaaaaagaacgaggaaatgatggaacaaaaagagaagtcctatcaggagcatgttaaacaactgaccgagaaaatggagagggaccgggcacagctgatggccgagcaggaaaaaaccctggctctcaaactgcaggagcaggagaggcttctcaaggaaggctttgagaatgaaagtaaacggctccagaaggatatctgggacatccagatgcggagcaagtcattggagccaatttgtaatattctttag

SEQ ID NO: 225559 - DNA, 1323 bp, Artificial Sequence
  Description of Artificial Sequence: Synthetic coding sequence
atggcaccagagatccacatgacgggacccatgtgcctaattgagaatactaatggtgaactggtcgccaaccccgaggcacttaaaatattaagtgcaatcacccagccagttgtggtggtagcaattgtcgggctctacagaacagggaaaagctacctcatgaataaactggccggtaaaaataagggattttcccttgggtcaacagtaaagtcacacaccaagggcatttggatgtggtgtgtcccacacccaaagaagccagaacacaccttggtgctgttggataccgagggactgggtgatgttaagaaaggcgacaaccagaacgactcctggatcttcacactggccgtcttattgagctctacacttgtgtacaattcaatgggcaccattaaccagcaagctatggaccaactgtattacgtgacggagctcacccataggatcagaagcaagagttctcctgatgaaaatgaaaatgaggactctgccgattttgtgtccttcttccctgactttgtctggacgctccgggatttctccctggacttagaggctgacgggcagccactgacccctgacgagtatcttgagtattcactcaaactgacccaggggacatctcaaaaagacaagaattttaacctgcctcggctgtgtatccggaagttttttcctaaaaagaagtgtttcgtctttgacttgccaattcaccgtaggaaacttgcacagttggagaaacttcaagatgaggaactcgatcccgagtttgtgcagcaagtcgcagacttttgctcttatatctttagcaattcaaagaccaaaacactgtctggcggaattaaggtgaacggccctcgtttggagtccctggtgcttacttacattaacgctatatccagaggcgacttgccctgcatggaaaatgccgtgctggcgctcgctcagatagaaaatagcgcagctgtgcaaaaggctatcgcacactacgaccaacagatgggacagaaagtgcaactgcccgctgagaccctacaagagctcttggaccttcaccgcgtgagcgagcgcgaggccaccgaggtctacatgaaaaattcattcaaggacgtggaccacttgttccagaagaagcttgcagctcagctagacaagaaaagggacgacttttgcaagcagaaccaagaagcaagttctgataggtgctccgccctcttgcaggtcatcttctcacctctcgaggaggaggtgaaagctggcatatacagtaaaccaggcggatactgcctgtttatccaaaaactgcaagactag

SEQ ID NO: 225560 - DNA, 1788 bp, Artificial Sequence
  Description of Artificial Sequence: Synthetic coding sequence
atggctccagagatccacatgacggggccaatgtgcctgatcgagaacacgaacggcgaactcgttgcaaatcctgaggccctgaaaatactgagtgcgataactcaacccgtcgtggtcgtcgctattgtaggtctttataggactggtaaatcctacttaatgaacaaactggccggaaaaaataaagggttctctttagggtcaaccgttaagtctcacaccaaaggaatatggatgtggtgcgtgcctcaccccaaaaagcccgagcacactctggtccttttagataccgagggccttggagatgtgaaaaaaggagacaatcagaacgactcttggatattcactctggctgtgttgctttcgtcaacactggtgtacaactcgatggggaccatcaatcagcaggcaatggaccaattgtactatgtgactgagcttacccataggattcgaagcaaaagctctcctgatgagaacgaaaacgaagattctgccgactttgtaagtttctttcccgattttgtttggaccctgagggattttagtttagacctagaggctgatggacagccattgacccctgatgagtatctcgagtactctctcaagcttacccagggtacctctcagaaagacaagaatttcaacctcccaaggctgtgcatccgaaaatttttcccaaagaaaaaatgctttgtatttgacctgccgatccacaggaggaagctggcccagctagagaagcttcaagacgaggagctcgaccccgagtttgttcagcaggtggctgatttttgctcttacatcttttcaaacagcaagaccaagaccctgtccggtggaatcaaggtcaacggtccgcgtctggaaagcctggtgcttacctacattaacgccatctcccgcggtgatctgccctgtatggagaatgccgtactggccctggcccaaattgaaaatagcgcagctgtccagaaggctatagcgcactacgaccagcagatgggtcaaaaggtgcagcttcccgctgaaacgctccaggaactcttggatctgcatcgagttagcgagagagaagcaaccgaagtgtacatgaaaaatagcttcaaggatgtcgaccatcttttccagaaaaaactggccgcacagttggataaaaagagagatgatttctgtaaacagaatcaagaagccagtagcgacaggtgttctgcactgctccaggtcatcttctccccgcttgaagaggaggtcaaggctggtatatattccaagcccggtggatactgcctctttatccagaagctccaggatctagagaaaaagtactatgaggagccgcgtaaaggcatacaggcagaggaaattctgcagacttacttaaagtcaaaggagtccgtaacggacgccattctgcagaccgaccagatcttgacagaaaaagagaaggagatcgaagtggagtgtgtcaaggccgagtcagcccaggcatccgccaagatggtcgaggagatgcagatcaaataccaacagatgatggaagagaaagagaaaagttaccaggaacatgtgaaacagctaactgaaaagatggagagagagcgcgctcagctcctggaagagcaggaaaagaccctaacaagcaagctgcaagagcaagccagggtgctcaaggagagatgccagggagagtccacccagctccagaatgagatccagaaacttcaaaaaacactcaagaagaaaaccaagagatacatgagccataagctgaaaatatag

SEQ ID NO: 225561 - DNA, 1692 bp, Artificial Sequence
  Description of Artificial Sequence: Synthetic coding sequence
atggccccagagatccacatgaccggccctatgtgtctcatcgagaataccaacggcgagttggtggcgaatcctgaggcgctcaagatactcagcgctattacacaacccgtggtggtcgtcgcgatcgtgggtctatatcgaacaggtaagagctacttgatgaacaagctcgccggaaagaacaagggattctcacttggatccactgtcaaatcgcatactaaagggatatggatgtggtgtgtgccccatcctaaaaaacctgagcataccctggtgcttttagacacggagggcctgggagacgtgaagaaaggcgataatcagaacgattcttggatcttcactctggccgtcctgctaagcagcacattggtctacaactcgatgggcacaataaaccaacaggcaatggaccagctttactacgtgacggagctgacccaccgcatcagatcaaagtcatctcctgacgaaaacgagaatgaggatagtgccgacttcgtgtccttctttccagattttgtttggactctccgagacttctccctagacctggaggccgacggccagcccttaacgcccgacgagtaccttgagtacagcttgaagctcactcaaggtaaccggaagctggcacagctggaaaagttgcaggacgaggaacttgaccccgagttcgtgcaacaggtggccgacttttgcagttacattttcagcaactctaaaacgaagactctgagcgggggaattaaagtgaatggacctagactggagagcctggtgctcacatatataaacgcaatctcgaggggggatctgccatgcatggagaacgcggtcttggcactcgcacagatagagaacagcgctgccgtccagaaagccattgcacactatgatcagcagatgggtcagaaggttcagctccctgcggaaactctgcaggaactccttgatttgcatcgggtgtctgagagggaggccaccgaggtgtacatgaagaattctttcaaggacgtggaccacctgttccagaaaaaactggccgctcagctcgataaaaagagagatgatttctgcaaacagaaccaagaagcatcttcggatcggtgttctgcgctgctgcaggttatcttcagtcccctggaggaagaggtgaaagccggaatctatagtaaacctggtggatattgtctgttcattcaaaaactgcaagatctggagaaaaagtattacgaagagccaagaaaaggcattcaggctgaagaaattctccaaacctacctgaagtctaaggagagcgtcactgacgcgatcttacaaactgatcagatactgaccgagaaagaaaaggagatagaagtggagtgtgtgaaagctgaatcagcacaggccagcgcgaaaatggtggaggaaatgcaaatcaaatatcagcagatgatggaagagaaggagaagtcctatcaagaacacgtcaagcagctgaccgagaaaatggaacgcgagcgtgcccagctgctggaagagcaggagaagacacttacctcaaaattgcaggaacaggccagagtccttaaggagcggtgtcagggtgaatctacgcagttgcagaacgaaatccagaagctgcaaaaaacgcttaagaagaagaccaagaggtatatgtcacataaactgaaaatatag

SEQ ID NO: 225562 - DNA, 414 bp, Artificial Sequence
  Description of Artificial Sequence: Synthetic coding sequence
caagatgaggagctggaccctgaatttgtgcaacaggttgctgatttttgctcctacatcttcagcaactctaagacaaagacactgagcggcggaatcaaggctgaagaaatcctgcaaacatacctcaaatcgaaggagtccgtgaccgatgccatcctacaaacagaccagattttgactgagaaggagaaggaaatagaagtggagtgcgtcaaagcggaatccgctcaggctagcgctaagatggttgaggaaatgcagatcaagtatcaacagatgatggaagaaaaggaaaagtcctaccaggagcatgtgaagcagctcaccgagaaaatggagagggaacgagcccaactgctcgaagagcaggaaaaaaccctgacgtctaaacttcaggtatctaagtgttag

SEQ ID NO: 225563 - DNA, 1923 bp, Artificial Sequence
  Description of Artificial Sequence: Synthetic coding sequence
atgggcgagcgtaccctgcatgctgcggtacccacccctgggtacccagagtccgaatctatcatgatggcccctatttgtctcgtcgagaaccaggaagagcagctcacagtgaacagcaaagctctggagatcttagacaaaataagtcagcccgttgttgtcgtggccatcgtcgggctatatcgaaccgggaagtcgtacttaatgaaccggttggccggaaagaggaacggtttccctctcggttccactgtgcaatcagaaaccaaagggatttggatgtggtgcgttccacacttgagcaaacccaatcatacgcttgttctactggacactgaggggcttggtgatgtagaaaagtctaaccccaaaaacgatagctggatctttgctctagccgtgttgctgtccagcagctttgtatacaactccgtctccaccattaaccaccaagcgctcgaacaactccactatgtgaccgaacttgcggaacttatcagggctaaatcctgcccgagacccgacgaggccgaggattcatctgagtttgcctccttcttccctgatttcatctggaccgtgagagactttaccttggaactcaaactggacggcaacccgattaccgaggatgagtatttggagaacgccctgaagctcattccaggtaagaaccctaaaattcagaactccaacatgcctagagagtgtatcagacatttctttcgaaagcggaagtgcttcgtatttgaccgccctaccaacgataagcagtacctgaaccacatggatgaagtgcccgaggaaaatttggagcgccatttcctcatgcaatctgataatttctgctcttacatcttcacacacgccaaaacaaagacgctgcgtgagggaatcatcgtgacggggaagcggctcgggaccctagttgtcacctatgttgatgccattaatagcggggcagttccctgcttagaaaacgccgtgactgctctcgcccagctggagaaccccgcagccgtgcagagggctgcagatcattactcacagcagatggcgcagcaactcaggctgcccactgatacactgcaggagctgctggatgtgcacgctgcttgcgaacgagaagcaattgctgtgttcatggagcattcatttaaagacgagaatcacgagtttcagaaaaagctggtggatactattgaaaaaaagaagggggacttcgtcctccaaaacgaggaggcctcagccaaatactgccaggccgaactaaagcggctcagtgaacacctcaccgagagtattctccgaggcatattctctgttcccggtggacataacctttacctcgaggagaaaaagcaagtggagtgggattacaagctggtgccaaggaagggggtgaaagccaacgaggtattgcaaaattttcttcagtctcaggtggttgtggaggaatccatccttcagtctgataaagcactgacggcaggtgagaaagccatagcagctgaaagggctatgaaagaagcagcagagaaggagcaggagctgctgagggaaaaacagaaggagcagcagcaaatgatggaggcccaggaacggagctttcaggaatatatggcacagatggagaagaagctggaagaggaacgggagaacctgctgcgggagcatgaaaggctactgaaacacaaactcaaagtccaagaggaaatgctgaaagaagagtttcaaaaaaaatctgagcagctcaacaaggaaatcaatcagctgaaggaaaaaattgaaagcaccaagaatgagcagctgcgactgctgaaaatactggatatggcgagcaacattatgattgtgacattacccggtgcctccaaattgttgggtgtagggacgaaatacttagggtcgaggatctag

SEQ ID NO: 225564 - DNA, 1761 bp, Artificial Sequence
  Description of Artificial Sequence: Synthetic coding sequence
atggcgctggaaatccatatgagcgacccgatgtgcctgatagagaactttaatgagcagctgaaggtgaatcaggaagctttggagattctgtctgctataacccaaccagttgtggttgttgcgatcgtaggattatacaggacaggtaagagttaccttatgaacaagctggcaggcaagaacaaggggttcagcgtcgcttctacagtgcagtcacatactaagggtatttggatctggtgcgtacctcaccccaactggccaaatcacacccttgtcctgctggataccgaagggctcggtgatgtggagaaagctgacaacaagaacgatattcagatcttcgccctagctctgctgctttccagcaccttcgtctataatactgtcaacaagattgatcaaggggctatcgaccttctccacaatgttacggagctcacagaccttcttaaagctcgtaattctccagatttggaccgcgtggaagacccagcagacagtgcaagttttttccccgatttggtgtggacccttcgcgacttttgtctaggtttagaaatagacgggcagcttgtgacacctgacgagtatctagagaattcactgaggcccaagcaggggagcgaccaacgagtccaaaacttcaacctacctagattgtgcatccaaaaatttttccccaagaaaaagtgttttatatttgacctgccggcacaccagaagaagcttgcacaattagaaaccttgccagatgacgagcttgagccggagtttgtccagcaagtgacggagttctgcagttacatattctctcattctatgaccaagaccctgccaggtgggattatggtcaatgggagtaggcttaagaacctcgttctgacctatgtcaatgcaatctcgtcaggcgacctcccctgtattgagaacgcagtcttggctctcgctcaaagggaaaatagcgccgctgtccagaaggctattgcacattacgatcagcagatgggccagaaggtgcagctgcccatggagacacttcaggagctgctggatcttcaccggacatccgagcgcgaggcaatcgaggtgttcatgaagaactcttttaaagacgttgatcagagcttccagaaagaattggaaactctgctggatgcaaagcaaaatgacatctgcaaaaggaacctggaggcttcttcagactattgttccgcacttcttaaagatatcttcgggcctctagaagaggcagtgaagcagggtatttactctaagcctggcggacataacctattcatccaaaaaaccgaggagcttaaggctaaatactaccgcgagccccgaaaaggcatccaagctgaggaggttctgcagaagtatctgaagagcaaagaatccgtctctcacgccattttacagactgaccaggcactcacggagacagagaagaagaagaaggaagcccaagtaaaggcagaagcagagaaagcagaggcacagagactggcagctatccaacgccagaatgagcaaatgatgcaggagcgagagcggctgcatcaggagcaggtaaggcaaatggaaattgctaaacagaactggcttgcagagcaacaaaagatgcaggaacagcagatgcaagagcaggccgctcagctaagcactacgttccaggcccagaatcggtcactgctgtcggagctgcagcacgctcagcgcacagtgaataatgacgacccatgtgttttgctttag

SEQ ID NO: 225565 - DNA, 1761 bp, Artificial Sequence
  Description of Artificial Sequence: Synthetic coding sequence
atggctttggagatccacatgtcagatccgatgtgtctgattgagaatttcaacgaacaactcaaagttaaccaggaggctctggagattctatcagccattactcaaccagtggtagtagtcgccattgttggattataccgcaccggaaagtcctatctgatgaacaagctggccggaaagaacaaaggcttttcagtggcttccaccgtgcagagtcacacaaagggcatttggatatggtgcgtgccccacccaaattggccgaaccacactttggtcttactggacaccgaaggcctgggcgatgtggagaaggcagataataagaatgacatccagatttttgccctcgcactgttattatccagcacgttcgtctacaacacagtgaataaaattgaccagggcgcaattgatctgctgcataacgtaactgagctgactgatctgctcaaggccagaaattcccccgatctggatagagtcgaggatcctgctgactctgccagttttttccctgacctagtctggactctccgcgacttctgtttaggactcgagatcgatggccagctggtcacccccgatgagtatctggaaaactcgctgcgtcctaagcaaggatctgatcagcgggtgcagaatttcaacctccccaggctgtgtattcagaagttcttccctaagaagaagtgctttatttttgacttgcccgcacatcagaagaaactggcccaacttgaaactctgccagacgacgagcttgagccagagtttgtgcagcaggtaacggaattttgttcatatatattttcacacagcatgaccaaaacgctgcccggtggcatcatggtgaacggctctagactgaaaaatcttgtactcacctacgtgaatgcaatctcctctggtgatctaccatgtatcgagaatgccgtgctggccctggcccagagggaaaatagcgcagcagtccagaaggctatcgcccactacgaccaacagatgggtcagaaggtacaactgcctatggagaccctgcaggaacttctggatctgcaccgcacgagtgagagagaagcaatcgaagtctttatgaagaacagctttaaggatgtcgaccaatccttccagaaggagttggagacgcttctcgacgccaaacagaatgacatctgcaaacggaacctcgaagcctctagcgactactgctcggcgctgctgaaggacatttttggtcctctcgaggaggctgtgaaacagggaatttactcaaaacccggagggcacaatctgtttatacaaaagactgaagagctaaaggccaagtactacagagagcccagaaagggcatacaggccgaagaagtgctacagaagtacttaaaaagcaaagaatccgtcagccacgcgattctgcagacagaccaggcattgactgagacagagaaaaagaaaaaggaggctcaggtgaaagctgaagctgagaaggcggaagcccagcggctcgcggcaatccagcgccagaatgagcagatgatgcaggaaagggagcggctacaccaggaacaggttaggcagatggagattgcaaaacagaactggctcgccgaacagcagaagatgcaagagcagcagatgcaggagcaggccgctcagctcagcaccactttccaggcccagaaccggagcctactttccgagctgcagcacgctcagcgcaccgtgaacaacgacgacccttgcgtactgctttag

SEQ ID NO: 225566 - DNA, 1452 bp, Artificial Sequence
  Description of Artificial Sequence: Synthetic coding sequence
atggcactcgagatacacatgtccgatccgatgtgccttatcgagaacttcaatgaacagcttaaagtaaaccaggaggctttggaaatactgagtgccatcactcagcctgttgtagtggtggctatcgttggattgtacaggacggggaagagttacctcatgaacaagctggctggaaagaataagggcttcagtgtggcttccaccgtccaatcccataccaagggaatttggatttggtgcgtcccccaccccaattggcccaatcacacactagtgctcctggacactgaggggctcggcgacgtagagaaagccgacaacaagaacgacattcaaatctttgcactagcacttttgctgtcatctaccttcgtgtataacaccgttaacaagattgaccagggggctatcgaccttctgcataacgtgacagaattgacagatctgctgaaggcccgaaacagtcctgacctggatagagttgaggatcccgctgattccgccagctttttccctgacttagtgtggactcttcgggatttttgcctgggcctggaaatcgatggccaacttgtgacgccagacgaatatttggagaactcactgagaccaaagcaggggagcgaccagagagtgcagaatttcaatcttcccagactgtgcattcaaaagttttttccgaaaaagaagtgttttatctttgatctgcccgcacaccagaagaaactcgctcagctggagacactaccagatgatgaactcgagcctgagtttgtgcagcaagtcaccgagttttgcagttatatattcagccacagtatgacaaagaccctgcccggtgggattatggtcaacggatcaagactcaagaaccttgtgttaacttacgtgaacgccattagttccggagacctcccttgtatcgagaacgcagttttagctcttgctcagagggagaattccgcagctgtgcagaaagctatagcgcactacgatcagcagatgggccagaaggtacagctccccatggagaccctccaggagctgctggacctgcaccgaacgtccgaacgggaggctatcgaggtcttcatgaagaacagctttaaagacgttgaccagtcctttcaaaaagagctggaaacgctgcttgacgcgaagcagaacgacatctgtaagagaaacctagaggcttcttctgattattgctctgctctcttaaaggacattttcggtccgctggaagaagcagtcaaacagggaatttacagtaaacctggcggtcacaacctgttcatccaaaagactgaagagctcaaagccaaatactatcgggaacccaggaaaggaatccaagccgaggaagtgttgcagaagtaccttaaatccaaggaaagcgtgtcccatgccattcttcaaaccgaccaggccctgactgagacctag

SEQ ID NO: 225567 - DNA, 1917 bp, Artificial Sequence
  Description of Artificial Sequence: Synthetic coding sequence
atggcctcggagatccacatgccaggtcccgtatgtttaacagagaacaccaaaggacacctggtcgtgaattcagaagccctcgaaatcttgagcgctattacacagccagtggtggtggtagctatcgtggggctctaccgcacagggaagagttacttgatgaacaaactcgccggaaagaataagggattcccgttgggctgtaccgtgaaatctgagactaaggggatctggatgtggtgtgtgccgcaccctagcaagcctaaccacacactgatcctcctggacacagaagggctgggcgacatggagaaatccgaccccaagtccgacagttggatctttgccctggcagtactgctatcttctagctttgtttacaacagtatggggactattaaccatcaagccctcgagcaactgcattatgtgacagagttaacggagctcatacgggcaaagtcatgcccaagacccgatgaggtcgaggactcatccgagttcgtcagcttcttccctgactttatttggacagtgcgcgattttacgttggagctcaagcttgacggccatccaatcaccgaagatgagtatctcgaaaacgccctgaaactaataagcggcaagaatccccaaatccagaattcaaacaagccacgggagtggatacggcattttttcccaaaacaaaagtgcttcgtctttgaccggccaattaacgataagaaactattactccacgtggaggaggtccgggaggaccagctggactcgaacttccagatgcagtctgaaaatttttgtagttacatttttactcacgcaaagactaaaaccctgcgggagggtattctcgttacaggcaatcggctgggaatgctggtcgagacctatctggatgcaatcaatagcggagctactccctgcctcgaaaacgccatggcagtgctcgctcagtgcgaaaattccgcagctgtccagagagccgcaaatcactacagtcagcagatggcccagcaggtccgcttccccaccgacacgttgcaggagttgctcgacgtacatgccgtgtgtgaaagggaagcaattgcggttttcatggagtactccttcaaggacaaatcccaggagtttcagaagaaactggttgatacaatggaaaagaaaaaggaggatttcgtgctccagaacgaggaggcttctgccaagtactgtcaggcagagctcaagaggctgtcggagctgctaactgaaagcatcagcagaggaaccttcttcgtgccgggaggccacaatatttacctggaagctaagaagaagattgaacaggactacactcttgtacctcggaagggcgtgaaggccgatgaagtgttgcagagttttctccaaagccaggtggtcatcgaggagtctatcctacagagtgataaggccttgacagcaggcgaaaaggccattgccgctaagcaggctaaaaaggaggcagcagaaaaggagcaggaactgctgcgtcaaaaacagaaggagcagcagcaaatgatggaagcacaagagcggagttttcaggaaaatattgcccagctcaaaaagaagatggaaagggaacgtgaaaactacatgcgcgaactgcgcaagatgttgagccataaaatgaaagtgctggaagagctcctgacagaaggctttaaggaaattttcgaaagcttgaacgaggagatcaatagactgaaggagcagatagaggccgcagaaaacgaggaaccttcagtcttttctcagattctcgatgtggccggaagcatttttattgcagcacttcctggcgctgcgaagttggtggacctgggtatgaagattctgtcatctctgtgtaatcgtctgcgcaatccaggaaagaaaattatttcatag

SEQ ID NO: 225568 - DNA, 1902 bp, Artificial Sequence
  Description of Artificial Sequence: Synthetic coding sequence
atggagtctgggccaaagatgctggccccagtgtgcctggtcgagaacaataacgagcagcttcttgttaatcagcaggccattcaaatactggaaaaaatctcccagcctgtagtcgttgtcgccattgtgggtctttatagaaccggaaaaagttatctaatgaaccatctagctggacagaaccacggatttccattgggcagtaccgttcagagcgagaccaaagggatttggatgtggtgcgtcccccacccgtcaaagccaaaccacactcttgtcctgctggatactgagggactgggtgacgttgagaagggcgaccccaagaatgacagctggatctttgcactcgccgtgctgttgtgcagcacctttgtttataatagcatgagcaccattaaccaccaagctctcgagcaactgcactacgtgaccgaactcacagagctgataaaagccaagagctctccgcgaccagatggtgtggaggattcaaccgagttcgttagtttttttcctgacttcctgtggacagtgcgggacttcactctcgaattgaagttgaacggccatcccatcactgaggacgagtatttggagaatgccctgaaactcattcagggaaacaatcctcgggtgcagacttccaactttcccagagaatgcatacggaggttcttcccaaagcgtaaatgctttgtgtttgacaggcctaccaacgataaggacctgctggcgaatatcgagaaggtcagtgaaaagcagcttgaccctaaattccaggagcagaccaacatcttctgtagctatatctttacacatgcaagaactaagaccctacgagagggcatcactgtcactggaaaccgtttgggcactctcgcagtgacatacgtcgaggccattaattcgggcgctgtgccttgcctggagaatgctgtgatcaccctggcccagcgggagaactcggctgctgtacagcgtgccgctgactattatagtcaacagatggcgcagagagtcaaactccctaccgatacactacaggagctcttagatatgcatgccgcttgtgagcgggaagcaattgccatctttatggaacacagctttaaggatgaaaatcaggaatttcagaaaaagttcatggaaaccactatgaacaagaagggggatttcctgctgcaaaacgaggagagtagcgtccagtattgccaggctaagctaaatgagctgagcaagggattaatggagtccattagcgccggatctttctccgtgcctggaggacacaagctgtatatggagactaaagagcgcatagagcaggattattggcaggttccgaggaaaggcgttaaggcaaaggaagtattccaaaggtttctcgagagtcagatggtgatcgaagagtctatactgcagtccgataaagcactgaccgacagggaaaaggccgtggccgtggatcgtgcaaagaaggaagcagccgagaaggaacaggagctgttgaagcagaagctgcaggagcagcagcaacaaatggaagcacaagataaatcccggaaagaaaacatcgcccagctcaaagagaaactacagatggaacgcgaacacctgcttagggagcaaataatgatgctggagcatacacagaaggtacagaacgattggctgcacgagggatttaaaaagaaatatgaagagatgaatgccgagatttcccagttcaaaagaatgattgatacaacaaaaaatgacgataccccctggattgccaggactcttgataatctcgcagacgagctgaccgcaatactgtctgctcccgcaaaacttatcggccacggcgtgaaaggagtgagttcgctcttcaaaaagcataaactccccttctag

SEQ ID NO: 225569 - DNA, 1512 bp, Artificial Sequence
  Description of Artificial Sequence: Synthetic coding sequence
atgtccacaattaaccaccaggctctggaacagttgcattacgtgacagagctgaccgagctgatcaaagccaagtctagcccgcgtccagatggcgtggaggattccaccgagtttgtgagtttctttcccgacttcttgtggaccgtaagggacttcacgctggagttgaaactgaatggccatcctataacagaggatgagtaccttgagaacgccctgaagctcatccagggaaataatcctagagtgcagacttccaatttccctcgggagtgcatccggaggttttttcctaagcggaagtgtttcgtgtttgacagacctaccaatgacaaggatctcttggccaacatcgaaaaggtgtccgagaagcaattggacccaaaattccaggaacagacgaatatcttttgttcatatatttttacacacgctcggaccaagacactccgagaaggcattactgtaacaggtaaccggctgggcaccctcgccgtgacatacgttgaggctattaattccggagccgtgccttgtttagaaaatgccgttatcaccctggcccagagggagaacagcgctgcagtgcagcgggctgccgactattactcacagcagatggcccagcgggtaaagctgcccaccgacacactgcaggagcttctggacatgcacgcagcctgtgagcgagaggcaattgctatcttcatggagcatagctttaaggatgaaaaccaggagttccaaaagaagtttatggagacaacaatgaacaaaaagggggattttcttctgcagaacgaggagtcttctgttcaatactgccaagccaagctgaacgagctatcaaaaggtctcatggagagtatctccgctggaagcttttcagttcccggaggacataagctgtacatggaaactaaagaacgaattgaacaggattattggcaggtccccagaaaaggcgtgaaagccaaggaggtattccaacggtttttagagagtcagatggtcatcgaagaaagtatcctgcagtccgataaagcactgacagatagagagaaggccgtggctgtcgacagggccaaaaaggaagcagctgagaaggagcaggagctcttgaagcagaagctgcaggagcagcaacagcagatggaggctcaggataagtctcgcaaggaaaacatagcccaacttaaagagaagctgcagatggaaagggaacacctgctacgtgaacagattatgatgctcgagcacacccaaaaagttcagaatgactggctccatgaaggtttcaaaaaaaagtacgaggaaatgaacgcagagatcagccagtttaaacggatgatcgataccacaaaaaatgacgacactccttggatagctaggactctggataacctcgcggacgaattgaccgcgatcctgtcagctcctgctaaacttatcggccacggggtcaagggagtcagttctctgttcaaaaagcacaagctgcccttttag

SEQ ID NO: 225570 - DNA, 1815 bp, Artificial Sequence
  Description of Artificial Sequence: Synthetic coding sequence
atggagtccggcccaaagatgcttgcccctgtatgtctcgttgaaaacaacaacgaacagcttttagtgaatcagcaggctatccaaatcttggaaaagatttcccaaccagtggtggtggtggcaattgtgggcctctaccgaaccggaaagagctacttgatgaaccaccttgctggacagaatcacgggtttccattagacactgaagggcttggtgatgtggaaaaaggagaccctaaaaacgatagctggatattcgcccttgccgtgctgctgtgcagcaccttcgtttacaactcgatgtccaccattaatcatcaagcgctggaacagctccattacgtgacggaactgacggaactgatcaaggcaaaatcctctcctcgtccagacggagtggaggactcaactgagtttgtgtctttcttcccggacttcctctggactgtcagagattttacacttgagcttaaactcaacggacatccaatcacagaggacgaatatctggagaacgccttgaagctgattcaagggaataacccgcgtgttcagacctcgaacttccccagagagtgtattcgtcggttttttcctaaaagaaaatgcttcgtgttcgaccggccaaccaacgacaaagatctgctggcaaacatagaaaaagtatctgagaaacagctggaccctaagttccaggaacagaccaatatcttctgctcatacatatttacccacgcacgaacgaagactctgcgggaaggtataacggtgacaggaaaccgcttgggaacactcgccgtcacttacgtggaggccattaactctggggcagtaccatgcctggaaaacgctgtgattactttggcccagagggagaactctgcagccgttcagagagcggctgactactattcccaacaaatggcgcagcgcgtgaaactacctacggacaccttacaggaactgctggatatgcatgcggcttgtgagcgcgaagctattgcaatttttatggaacattcatttaaagatgagaaccaggagttccagaagaagtttatggaaaccaccatgaacaagaagggcgactttctccttcagaacgaagagagcagtgtgcagtattgccaggcaaaactgaatgaattatcaaagggactcatggagagtatcagcgccggtagcttttcggtccccggaggccacaaactgtacatggagactaaggagagaatcgagcaggactattggcaggtcccacgtaaaggggtgaaggctaaagaggtatttcaaagatttctagagtcacaaatggtcatcgaagagtcaatcctgcagtctgataaagccctcaccgaccgggagaaagcagtggccgtcgaccgagctaaaaaagaagctgcagaaaaggaacaggaactactgaaacagaagctccaagagcagcagcagcagatggaagctcaggataaatcccgcaaagagaacatcgcgcagctcaaagagaagctgcagatggagcgcgagcacctgctgcgcgaacaaattatgatgttggaacacacccagaaagtgcaaaatgactggctccatgagggatttaaaaaaaagtacgaggagatgaacgcggagatttctcagttcaagcggatgatcgacactacaaagaacgacgacaccccctggattgccagaacattagataatctggccgacgagttaactgccatcctgagtgcgccagctaagctgatcggtcatggagtaaagggagtgtccagtttgttcaaaaaacataaactgcctttttag

SEQ ID NO: 225571 - DNA, 1299 bp, Artificial Sequence
  Description of Artificial Sequence: Synthetic coding sequence
atgaagtcaacgaaaccttctctctcaccgagcaaaccccaaagtagtctggtcatccccacgagcctgttttgtaagacatttccctttcatttcatgttcgataaggacatgaccattctgcagtttggaaacgggataaggcggctcatgaacagaagggacttccaggggaagccgaattttgaggagtatttcgagatcttgacacccaaaatcaatcagaccttttcgggcatcatgaccatgctgaatatgcagtttgtggtcagagttaggcgatgggataattcagttaaaaagtcatctcgagtcatggatctgaaaggccagatgatctacattgtagaaagctctgctatactgtttctggggtctccatgtgtggaccggttagaagactttacgggaagggggctctatctgagcgatatccctattcacaatgcgctgcgggacgttgtgctgatcggcgaacaagcgagggcccaagacgggctgaagaaacgtctggggaagctgaaagcgacccttgaacaggctcaccaggctctggaagaggagaagaaaaaaacagtcgaccttttgtgtagtatttttccctgcgaagtggcccaacagctgtggcagggtcaggtggtacaggcaaagaagttcagcaatgtcacaatgctgttctccgacatagtggggttcacagctatttgttcccagtgctctccactgcaggtgataaccatgctgaatgcactttacactcggtttgatcagcaatgcggcgagctcgatgtatacaaggtggaaaccataggcgacgcctactgcgtggcagggggtctccataaagaaagcgacactcacgcggtgcaaattgccctgatggcacttaagatgatggagctgagcgacgaggtgatgagtcctcacggggaacctattaagatgcgaatcggactgcacagcggcagtgtgttcgctggagtcgtgggtgtgaaaatgcctcgatattgtctgtttggtaacaatgtcactctggcaaataagtttgagagctgctccgtgcccagaaagattaacgtgagtcccactacttacagactgctgaaggactgccccggtttcgtctttacaccacggagtagagaagagttacctccaaacttcccgagtgaaataccaggaatttgccactttttagacgcctatcagcaaggcaccaacagcaagccttgctttcagaaaaaggacgtggaagatggtaatgctaacttcctggggaaagcaagtggtatagactag

SEQ ID NO: 225572 - DNA, 1875 bp, Artificial Sequence
  Description of Artificial Sequence: Synthetic coding sequence
atgttctgcactaaactgaaagacctaaagatcacaggagagtgtccatttagcctactggccccaggccaggtgccaaatgaatcctctgaagaggccgctgggtcttctgaaagctgcaaggcaactgttccaatatgtcaagatatccccgaaaagaatattcaagagtccttgcctcagaggaagacatctaggagccgcgtgtacttacacacactggctgagtccatttgtaaactcatttttccagaattcgagcgcctgaatgtggcactgcagaggactcttgccaaacacaagattaaggagtcccgcaagtcattggaacgcgaggactttgagaagacaatcgccgaacaggcagtggccgctggcgtcccagtcgaagtcattaaggagagcctcggcgaagaggtgttcaagatctgttacgaagaagatgaaaatatacttggagtggtcgggggaactctcaaagatttcctcaatagtttcagtaccctgctgaagcagtcatcccactgtcaggaggcgggaaaaaggggcaggcttgaggacgcaagcatactatgcttagataaggaagatgacttcttacatgtatactacttcttccccaaaaggaccacgtctctcattctccctgggataattaaggccgcagcacatgtgctgtacgaaactgaagtagaggtgagtctgatgccaccctgtttccacaatgactgctctgaatttgtaaatcagccctacctgttgtattctgtgcacatgaaatccactaagccatcgttatcccctagcaagcctcaatcttctttagtcatccccacttctctcttttgcaaaacctttccctttcacttcatgtttgacaaagatatgacaatactgcagttcggaaacgggatccgacgactgatgaatcgcagagatttccagggcaaacccaactttgaggaatactttgagattcttactcctaaaattaatcagacctttagcgggatcatgactatgctgaacatgcagtttgtggttcgcgtgcggaggtgggataactccgtcaagaaaagctcccgggtgatggatcttaagggacagatgatttacatcgttgaaagttcagctatcttgttcttgggaagtccgtgcgtggaccgtctcgaggactttactggtcgcggtctgtacctgtctgacattccaatccacaatgcattgcgggatgtagtgctcatcggtgaacaagccagggcccaggacggcctgaagaaaagactaggaaagttaaaagccaccctggagcaggcccaccaggctctcgaagaggaaaagaaaaaaaccgttgatttgctgtgttccatcttcccctgcgaggtcgcccaacaattatggcaggggcaagtggtgcaggccaagaaattttccaatgtaacaatgctattctccgacatagtgggctttaccgctatctgcagccaatgtagccctctgcaagtgatcacaatgcttaatgcattatacacaaggtttgaccagcagtgcggggagctcgatgtatacaaagtagagactatcggtgacgcatattgtgttgctgggggactacataaggagtccgacacgcatgccgtccagatcgcattgatggcattgaagatgatggaattgagtgacgaagttatgtctcctcatggtgagcccatcaaaatgaggatcggtttgcacagcggctctgtgtttgccggagtggttggcgtgaagatgcccagatattgcctgttcggaaataacgtcactctggcaaataagttcgaaagctgcagcgtcccacggaaaataaatgtttctcctactacatatcgctag

SEQ ID NO: 225573 - DNA, 2292 bp, Artificial Sequence
  Description of Artificial Sequence: Synthetic coding sequence
atgtcccgtaggaaaatcagcagcgaatctttcagttccctgggtagtgactacctcgaaacttcccccgaggaagagggtgaatgtcctctaagtcgtctgtgctggaacgggagtcgctcaccccctggacccctggagccatcaccggcagctgccgcagcagccgctgctcctgccccaacccctgccgcaagcgcagcagccgcagctgcaaccgcaggcgctcgcagagtgcagcgtcgcaggagggtgaatctagattccctgggcgagagcatcagcaggctgactgcgccttccccacagacaatacagcagaccctgaagaggacgttgcagtactatgaacaccaagtcattggatatagggacgccgaaaagaatttccacaacattagcaacaggtgttcttacgccgatcactccaacaaggaagagatcgaggacgtgtcaggcatcttacagtgcactgccaacatcctcgggctgaagttcgaagaaatacaaaagcgtttcggagaggagtttttcaacatatgcttccacgagaatgagagagtactgcgcgctgtgggcggtacgctgcaagatttctttaacggtttcgatgccctactggaacacatccgcaccagcttcggtaaacaagccacccttgaaagcccttccttcctgtgtaaggagttaccggaaggaacattgatgctgcattactttcacccacaccatatcgtgggcttcgctatgctgggcatgatcaaggctgccggaaaaaaaatataccggcttgatgtggaggttgagcaagtggctaatgagaaattgtgctctgacgtgtccaatccagggaactgcagctgccttaccttcctgattaaagaatgcgagaacacaaatatcatgaagaatcttccacaagggacctcccaggtccctgccgacctcaggatctcaattaatacattctgtcgggcattcccttttcacctcatgttcgatccatcaatgtccgtgcttcagttgggggagggactgaggaagcaactcagatgcgatacgcataaagtgctaaagtttgaagactgtttcgaaatcgtctcacccaaagtcaacgcgacttttgagcgagtcctgctccggctgtctacaccatttgtgatccggactaagcctgaggcaagtggctctgaaaataaggacaaagtgatggaggttaagggccagatgattcatgtgcctgaatccaatagcatcctgttccttggttccccttgcgttgataagttggacgaattaatgggacgtggcctgcatttaagcgatatccccatccatgatgccactcgagatgttatcctggtgggtgagcaggcgaaagctcaggacggcttgaaaaagcgtatggacaagctcaaggccacactcgagagaactcatcaagctttggaagaagaaaaaaaaaaaacagtcgacttgctctacagcatatttccaggagacgtagcccagcaactgtggcagggacagcaggtccaggccagaaaattcgacgacgtcacaatgctgttcagtgatatcgttggattcacagccatctgtgcccagtgcacccctatgcaggtgatctcaatgctcaacgagctatatacccggttcgaccatcaatgcggtttcctagatatttacaaagtagagaccataggcgatgcttactgtgtggcggcaggattacatcgtaagagcttgtgtcacgccaagcccattgccctcatggctctgaagatgatggagctgagtgaagaggtcttgactcccgatgggaggccaattcagccacagagatccgaactcctattcagctttccagtgtcgatacagctagtcccggaccagcatcagtccgagacagatctgggcaccgagaaaatgagaatagggatacattcaggctcagtactggccggtgtggtgggtgtccgcatgcctcggtactgcctgtttggaaataacgtgaccctggcatccaagttcgagtctggttcccaccctcggagaatcaacgtttcccctaccacataccagcttctaaaaagagaagagtccttcaccttcattcctcgcagccgcgaggagctgccagataactttcctaaagagatccctggcatttgttattttctggaagtgaggacaggtccgaaacccccaaagccatctctctcctcgtcgcgaatcaagaaggttagttacaacatcggtaccatgttcctgagggagaccagcctctag

SEQ ID NO: 225574 - DNA, 2199 bp, Artificial Sequence
  Description of Artificial Sequence: Synthetic coding sequence
atgagccgacgcaagatctcatctgaatctttttctagcctagggtcagactatctggagacctctcctgaagaagagggtgaatgccctttgtctcggctgtgctggaacggtagcagatccccgccagggcctctcgagcctagccctgctgcagcagcggctgctgcagctcccgctccaactccagcggctagcgccgctgccgcagcggctaccgcaggggctcgacgcgtgcagcggcgaaggcgcgtgaacctcgactccctcggcgaatcaatttcacggctgactgcccctagcccacaaactatccagcagacactgaagcgcacactacagtactatgagcatcaagtcatcggataccgcgatgctgagaagaacttccataatatctctaaccgttgctcatacgcagaccattctaacaaggaggaaatcgaagatgtctcggggatcctgcagtgcaccgcgaacattttgggacttaaatttgaagagatccagaagaggttcggggaggaatttttcaacatttgtttccacgaaaatgagagagtgctcagggccgtgggcggaaccctgcaggacttttttaacggatttgacgccctactggagcacatccggaccagtttcggtaagcaggcaaccttagaatctccatccttcctgtgcaaggaacttccagagggcacgcttatgctgcattactttcacccccatcatattgtgggctttgcgatgctcggcatgatcaaggccgcagggaaaaaaatataccggctggatgtggaagtggagcaggtcgccaacgagaagctgtgctccgacgtcagcaaccctggcaattgtagctgcctgactttcctgatcaaagaatgtgagaatacgaacattatgaagaacctgccacaaggaacctcgcaggttcccgcagatctgcgcattagtatcaatacattctgcagagccttcccatttcatcttatgtttgatccatctatgagcgtcctgcagctgggagagggcctccgcaagcagttacgatgtgatacccataaagtgctgaaatttgaggattgctttgagatcgtgtccccaaaggtgaatgcgaccttcgaaagagttcttttgaggttgtccactccattcgtgatccggacaaagccagaagcctccggatctgaaaacaaggataaggtgatggaagtgaaaggtcagatgatacatgtccccgagagcaattctattctgtttctgggaagtccatgcgtagacaagctggacgagctgatgggtaggggtcttcacctgtctgatattcctatccatgacgccaccagagatgttattctggttggagagcaggccaaagcacaggacggtctgaagaaacggatggacaagttaaaggctacactggagaggactcatcaggccctggaggaggaaaagaagaaaactgttgacctcctctactccatctttccaggagatgtggcccagcagctatggcagggacagcaggtgcaggctcggaaattcgacgacgtcacaatgctgtttagtgatatcgtggggtttaccgctatttgtgcacagtgcacccccatgcaagtgattagcatgttgaatgagttatacactagattcgatcaccagtgtggcttcctggacatctacaaggtagagactatcggagacgcatactgtgttgccgctggcttacacaggaagtcactgtgccatgccaaacccatcgctctcatggccctcaagatgatggagctctctgaggaagtactcacccccgatggacgacccattcagatgcgaatcgggattcattctggcagcgtcttagctggagttgtcggagtccggatgcctcgctactgtctctttggaaataatgtgaccctggcgagcaagttcgaatctggctctcaccccaggagaatcaacgtgtcgcctacgacttaccaattgctcaaacgcgaggagagcttcacattcatacccaggtcccgagaggaacttcccgacaactttcccaaagagataccgggtatctgctatttcttggaagtgagaacaggtcctaagccacctaaaccatcactctccagtagccggatcaaaaaggtgtcctacaacataggaaccatgtttttgcgggagacgtcactgtag

SEQ ID NO: 225575 - DNA, 2073 bp, Artificial Sequence
  Description of Artificial Sequence: Synthetic coding sequence
atgttctgtacgaagctaaaagatcttaaaattactggtgaatgtcctttttcgctgctggctcccggacaggtccctaacgagtcaagcgaggaagccgctggcagtagcgaatcttgtaaagccaccgtgccaatttgtcaggatatcccagagaagaatattcaggagagcctgccccagcgcaagacttctcgcagcagagtgtatctccacaccctagctgaatccatctgcaagctgattttccccgagtttgagcgcctgaacgtagcattacagaggactcttgccaaacacaaaattaaggagtccagaaagagcctagagagagaggattttgaaaagacgatagccgaacaggccgtagccgctggcgtgcctgtggaagtgatcaaggagtctttgggcgaggaggtgtttaaaatttgctatgaagaggatgaaaacatcctcggggttgtgggtggaacactgaaagactttctcaactcttttagcactctgctgaagcagagttcccactgtcaggaggctggtaaaaggggcagactggaagatgcatccatactgtgtctcgataaagaagacgattttctgcatgtatactactttttccccaaacgaacaacctcactcatcctgcctggtataatcaaggcggctgcccacgtgctgtatgaaactgaggtggaagtttcgctcatgcccccatgctttcacaatgattgctctgaattcgttaaccagccgtatctgctctatagcgtgcacatgaagagcacaaaaccatcacttagcccaagcaagccacagtccagcctggtcatccctacaagcctcttttgcaagacatttcctttccacttcatgttcgataaggatatgactatactccagtttggcaacgggatcaggcgtcttatgaatagacgcgactttcagggtaagccaaatttcgaagaatatttcgaaatacttactcccaaaattaaccagacatttagcggcatcatgaccatgctgaatatgcaatttgtggtgagggtccggagatgggacaactcagtgaaaaaatcctccagggtgatggatctcaagggccaaatgatttatatcgtcgaaagtagtgctatactgttcctcgggtctccttgcgtggatcggctcgaggattttacggggaggggtttgtacttgtccgatattcctattcataacgccctccgtgacgtggtgctgattggtgagcaagctcgggcacaggacggactcaagaaacgactgggcaagttgaaagcgacattggaacaggctcaccaggctttggaggaggaaaagaagaaaaccgtcgacctgctttgttcaatttttccgtgcgaggtggctcagcagctgtggcagggccaggtggtgcaggcaaaaaagttctcaaacgtgaccatgctgtttagcgatatagtgggatttaccgctatttgtagccaatgctctcccctgcaggtgatcactatgctaaacgccctgtacacccgcttcgaccaacagtgcggcgagctcgacgtgtacaaagtcgagacaatcggtgacgcctattgcgtggcaggaggactccacaaagaatcagacacgcacgcggtgcagatcgctttaatggcactcaagatgatggaactgagtgatgaggttatgagtccacacggggagccgattaagatgcgcatcggtctccatagtgggtctgtatttgcaggtgttgttggtgtgaagatgcctaggtattgcctgttcggcaacaacgttacgcttgccaataagtttgagtcttgctccgttcctcgcaagattaacgtgagccccacgacatatcgtctcctgaaggattgccccggtttcgtgttcactccacgttctcgcgaggaactgcctccaaacttcccgtccgaaataccaggaatttgtcacttccttgacgcataccaacagggcaccaatagcaagccctgttttcagaagaaagatgtcgaagatgggaatgctaacttcctggggaaggcaagcggtattgactag

SEQ ID NO: 225576 - DNA, 2073 bp, Artificial Sequence
  Description of Artificial Sequence: Synthetic coding sequence
atgttctgcactaagttgaaagatctcaagataaccggagagtgcccattcagcctcctcgctccaggccaggtgcccaacgagagcagcgaggaggccgcaggttcatccgaatcatgtaaggccaccgtccccatctgccaggacatccccgagaaaaacatacaggagtctctccctcagaggaagacgtcccggtctagagtctacttgcatactttggctgaatccatctgtaagctgatcttccctgaatttgaacgactcaatgtcgccctccagcgaaccctggccaagcacaaaatcaaggagagcagaaaatcactcgagcgcgaggatttcgagaaaactattgctgagcaggcagtcgctgccggagtgccggtggaagtcatcaaggagagtctgggcgaggaggtctttaagatttgctacgaggaagacgagaacatccttggcgtggtgggcggtactctgaaggattttctcaacagctttagtaccctgctaaaacagtcgtcccattgtcaggaagcgggaaaaaggggtaggctcgaggatgcgtctatattgtgcttggacaaggaagacgatttcttacacgtgtactacttcttccccaagaggaccacatctctcattcttcccggtatcatcaaggcagccgctcacgttctatacgaaaccgaagttgaagtaagcctgatgcccccatgcttccataacgactgtagcgaatttgtgaaccaaccatatctgctgtactccgttcatatgaagtcaaccaaacccagcctctcgccaagtaagccccaatcctccctggtgatccccaccagcctcttttgcaaaacgttccccttccattttatgttcgataaggatatgacgatcctacagttcggcaacggtatccgtcgcttgatgaacaggcgggatttccaggggaagccaaactttgaggaatacttcgagatccttactcctaagattaaccagacattctccggaatcatgaccatgttgaatatgcagtttgtcgttcgggtcaggaggtgggacaattccgtcaagaagtcttcacgggtcatggacctgaaggggcaaatgatctatatcgtggaaagctccgcaatacttttcctaggctccccatgcgtcgatcggctcgaagactttaccggaaggggactgtacctgagtgatattccaatccataatgcgcttcgagacgtggtattaatcggggagcaagcacgtgctcaagatggccttaagaagcggcttgggaagctgaaggctaccctcgagcaggcccaccaagctctcgaagaggagaagaaaaaaacagtggacctgctgtgcagcatcttcccgtgtgaggtcgcacagcagctgtggcaggggcaggtcgtgcaggccaagaagtttagtaacgtcaccatgctctttagcgatatcgtaggcttcaccgcgatatgcagtcagtgcagccctttacaggttatcacgatgctcaacgccctctacactagatttgaccagcagtgcggtgaattggacgtgtataaagtggagaccataggtgacgcatattgtgtcgccggtggtttgcacaaggaaagcgacactcacgccgtccaaatcgcgctcatggcgctcaagatgatggagctaagcgatgaggtcatgagccctcacggcgaacccatcaagatgaggattggcttgcacagcgggagtgttttcgccggtgtcgtaggggtgaaaatgcctcgctactgcctgttcggaaataatgtgactctcgctaataagtttgagagctgcagtgtgcccaggaagatcaacgtctcaccaactacctatcggctgctcaaagattgcccaggattcgtctttacgccccgttctcgtgaggagctccctccaaactttccatcagaaattcccggaatctgtcacttccttgacgcctaccagcagggaacaaacagtaaaccttgtttccaaaaaaaggacgttgaggacggcaacgcgaattttctgggaaaagcttctggaattgactag

SEQ ID NO: 225577 - DNA, 2073 bp, Artificial Sequence
  Description of Artificial Sequence: Synthetic coding sequence
atgttttgcacaaagcttaaggacctgaagatcactggggagtgcccatttagcctactggcccctggccaggtaccaaatgagtccagtgaggaggccgctggcagttctgaatcctgcaaggccaccgttcccatctgccaagatatccccgagaagaatattcaggaaagcctcccacagcgaaaaacctcaagatcgcgggtctatttgcacacactggcagaatccatctgcaagcttatttttcctgagttcgagagattgaatgtagcactgcaacgcacactggctaagcacaaaatcaaggagtcccggaaaagccttgagagggaagacttcgaaaagactatcgctgaacaggccgtcgctgctggggtgccggtggaggtaatcaaagaaagcctgggagaggaggtgttcaaaatttgttacgaagaggatgagaacatcctgggcgttgtgggcggaacacttaaggattttctcaattcatttagcacactgctaaaacagtcatcccactgccaggaggcgggtaagaggggacgcctggaggacgcctccatactttgtcttgataaggaggacgattttctgcacgtgtactacttctttcccaaacgtactacatcactcatcctgcccggaattatcaaggctgctgcccatgttctatatgaaactgaggtggaagtttccctcatgcccccttgcttccacaatgattgctccgagtttgtgaaccagccttatcttttgtacagcgtgcacatgaaaagcaccaagcccagcctgtcaccatcaaaaccacagagctccctggtcatcccaacctctttgttttgcaagacatttccatttcatttcatgttcgataaggatatgactattctgcagttcggcaacggcatcagacggctgatgaacagaagagactttcagggaaagccaaattttgaggagtactttgaaatcctgacgcccaaaattaatcagaccttcagcgggatcatgactatgctcaatatgcagttcgtggttcgagtgcggagatgggacaattctgtgaagaaatcctcccgagtgatggatctgaagggccaaatgatttacattgtggaaagctctgccattctgttcctgggaagcccctgcgttgaccgcctggaggacttcaccggaagagggctctacctgtcagatatacccatacacaacgccctccgtgacgtggtcctgattggagaacaagcaagagctcaggacgggttgaagaaaagattgggaaaactgaaggctactctggaacaggctcatcaagccttggaagaagaaaagaaaaaaactgtggatctgctttgtagtatcttcccctgtgaggtggctcagcagttatggcaggggcaggtggtacaagctaaaaaattctctaatgtgactatgcttttctccgacatcgttggctttactgccatatgttctcaatgctccccgttgcaggtgattactatgctaaacgcactctatacacgattcgatcagcagtgtggcgaacttgatgtttataaggtagagaccatcggagacgcctattgtgttgcaggaggcctgcacaaagagtccgatactcacgccgtgcaaatcgccctcatggccctcaaaatgatggaactctcagacgaggtgatgagcccacatggagagcctataaaaatgcgtattggtcttcacagtgggtcagtgttcgccggtgtggtaggggtgaaaatgcccaggtactgcttatttgggaacaatgtgactctcgctaacaagttcgaaagctgttccgttcccagaaaaattaatgtgtctcctacaacttacaggctgttgaaggattgcccaggctttgtattcacacctaggtcccgagaggagctaccccctaactttccaagcgaaatcccaggtatctgccacttcttagacgcatatcaacaggggacgaactcaaaaccctgtttccagaaaaaagacgtggaggacgggaacgccaactttttaggaaaagccagtggcattgactag

SEQ ID NO: 225578 - DNA, 2073 bp, Artificial Sequence
  Description of Artificial Sequence: Synthetic coding sequence
atgttctgtactaagctgaaagatctgaagattactggcgagtgtccctttagccttctcgctccaggtcaagttcctaacgagagctcagaggaagcagccggttcatccgagtcatgcaaggccactgttcccatctgccaggatatcccggaaaagaacatacaggagtccctccctcagcgtaagacatcccgttctagagtgtacctgcatacactggccgaaagcatatgcaaacttatattcccagaattcgagaggctcaacgtggcgctgcagcgcactctagccaagcataaaataaaagaatcacggaaaagcctcgagcgtgaagacttcgagaaaactattgccgagcaggccgtggcagccggagttccagtcgaggtaattaaggagagcctgggagaagaagtgtttaaaatttgctacgaggaggacgaaaacatccttggagtggtcggaggcactcttaaagactttctaaactcttttagtacacttttgaaacagtcctcccactgccaggaggctggcaagagggggaggctggaggacgcctctattttgtgcctggataaagaagacgattttctacatgtttattacttctttccaaaacgtacaacctctctgatcttacctggcataatcaaggcagccgctcacgtgctgtatgagacagaagtcgaagttagcctgatgccgccttgttttcacaacgattgctccgaatttgttaatcaaccgtacttactctattcagtccatatgaaaagtacaaaaccatctctaagcccgtcaaaacctcagtcctccctggtcatacctacaagcctgttttgtaagacctttcccttccacttcatgttcgataaggacatgactattctgcagttcggcaatggcatacgcaggctgatgaatagacgggactttcaggggaagccaaatttcgaagagtacttcgagattctaacccctaagataaaccaaacgttttcaggcatcatgactatgttaaacatgcagtttgtggtccgggtgcggcgttgggacaacagcgtgaagaaatctagcagggtgatggatttgaaagggcagatgatttacatcgttgagtcaagcgccattttgttcctggggagcccatgcgtggatagactcgaggatttcactggaaggggcctttacctctccgacatccccatacataacgctttgagggatgtggtacttatcggagagcaagctagggcccaggacggtctgaagaagagacttgggaagcttaaggccacattggaacaggctcaccaggctctggaggaggagaagaagaagacggtagatcttttatgtagcatttttccctgtgaggtcgcacagcaactttggcaggggcaagttgttcaagctaagaaattctctaatgtcactatgctcttctctgacatagtgggctttacagccatatgttcccagtgctcgcctctgcaagtgatcaccatgttgaatgccttgtacactaggtttgatcagcagtgtggcgaacttgatgtgtataaggtagaaaccattggcgatgcatactgtgtagcaggtgggctgcataaggaatccgatacccatgccgtgcagattgcgctgatggcactgaaaatgatggaactctcagatgaagtgatgagtccacatggcgaacctatcaagatgcggattgggctgcacagcggctccgtcttcgcaggcgtcgtcggtgtgaaaatgccaagatactgtctgttcggaaacaacgtgactctggccaataagtttgagtcttgcagtgtgcccagaaagattaatgtgtctccaactacctacaggctcttgaaggactgtccaggattcgtgtttaccccccgatcacgggaagagctgccccctaactttccaagcgaaattcctgggatctgccacttcctcgacgcataccagcagggcactaatagcaagccatgtttccaaaagaaggacgtggaggatggcaatgcaaacttcctagggaaagcttccgggattgactag

SEQ ID NO: 225579 - DNA, 2073 bp, Artificial Sequence
  Description of Artificial Sequence: Synthetic coding sequence
atgttctgcaccaaactcaaagacctcaagattactggggagtgtccgttttctctactggcaccagggcaggtgcccaatgagtcttcggaggaagcagccggaagctcggaatcatgtaaagccaccgttcctatctgccaggatattcccgaaaaaaacatacaggagagccttcctcagcgaaagactagtcgatcacgtgtctatctgcacacattggccgaatctatatgcaaacttatttttcccgaatttgaacgcttgaacgtcgctttgcagagaacgctcgcaaagcacaagatcaaggagagccgcaaatcactggagagagaagatttcgagaagacaatcgccgaacaggcagtcgccgctggcgtgcccgtggaagtgataaaggagtccttgggagaggaggttttcaaaatttgttacgaggaagatgaaaacatcctgggtgtcgtaggaggaacactcaaagattttcttaatagtttctccacattgctaaaacagtcatcacactgccaggaagccggaaaacgcggaagattagaagacgccagcatcttatgcctggataaggaagatgactttctgcatgtttactatttcttcccaaagcggacgacatctctaattctgcctggcatcattaaggccgctgcccatgtgctgtacgagactgaggtcgaggtctctttaatgcctccctgcttccacaacgactgctcagaatttgtgaatcaaccttatctgctctattctgtgcacatgaagtccacaaagcctagtctcagtcccagcaagccacagagtagtctggtgattcccaccagcttgttctgtaagacatttccgttccactttatgttcgacaaggacatgacaatcttgcagttcgggaatgggattcgcagactgatgaacagacgcgattttcaggggaaaccgaacttcgaggagtactttgaaatcctgactcccaagattaatcaaacgtttagcggaattatgacgatgctaaacatgcaattcgtggtaagagtgagacggtgggacaatagcgtgaaaaagtcctctagagtgatggacctgaaaggccaaatgatttacatcgtagaatcatccgcaatcctttttctgggcagtccttgtgtggaccgcctggaggatttcaccggccgagggctttatctcagcgacatcccgattcacaatgcccttagagatgtcgtactgatcggagaacaagctcgagcacaggacggactcaaaaagaggctgggaaagctgaaggcaaccttggagcaagcccaccaggccctggaagaggaaaagaaaaagacagtcgatcttctatgttccatattcccctgtgaagtcgctcaacagctgtggcagggacaggtggttcaggctaagaagttctccaacgtgacaatgcttttttcagacatcgtggggtttaccgccatctgctctcagtgctctcctctgcaggtgatcaccatgctcaatgccctgtacaccaggtttgaccagcagtgtggagagcttgacgtctataaggtggagaccatcggtgatgcctactgtgtggcgggtggcttacacaaggaaagcgacacacatgccgtccagatagcccttatggccctaaagatgatggagctgagcgatgaggtcatgtctccacacggggaacccatcaaaatgcggatcggactgcacagcggctccgtttttgccggagtagtgggggttaagatgccgcgatattgtttatttggcaataatgttaccttggccaacaaattcgaatcctgttccgtgccacgcaagattaacgtttcccccacaacatatcgtctccttaaggattgtccagggtttgtgttcacacccagatctcgagaagagctaccacccaacttccccagcgaaatccctggaatctgtcattttttagatgcctaccagcaggggacaaacagcaaaccttgttttcagaagaaagacgtggaagacggaaatgccaacttcttgggcaaagctagtggcatcgactag

SEQ ID NO: 225580 - DNA, 1860 bp, Artificial Sequence
  Description of Artificial Sequence: Synthetic coding sequence
atgtacggctttgtgaatcatgcccttgagttgcttgtcatccggaattacggcccagaggtgtgggaggatattaagaaggaagcccagctggacgaagaggggcagtttctggtcaggattatctatgacgatagcaaaacctacgacctagttgcagcagcttccaaggtcctaaacctcaacgctggcgagatcctccaaatgtttgggaaaatgttcttcgtgttctgccaggaaagtgggtatgacacgatcttacgggtcctaggaagcaacgttagagaattcctgcagaatctcgatgctctccatgaccacctggcaacaatctatccgggaatgagagcgccatcttttcgctgcaccgacgccgagaagggaaagggcctgatcttgcattactacagcgagcgagaagggctgcaggacatcgtgatcggtatcatcaaaacggttgcgcaacaaatccacgggaccgaaatcgacatgaaagtgatccaacagcgtaacgaggagtgtgaccatacacagtttttaatcgaggagaaggagtccaaggaagaagacttctacgaggaccttgaccggttcgaggaaaatggaacccaagagtccaggatttctccttatacattctgcaaggccttcccttttcacataatttttgaccgtgatcttgtggtgacgcagtgcgggaacgctatttacagagtcctgcctcagctgcagccaggtaattgctccctgctgagcgtgttttctctagtcaggccacacatcgatatctcttttcatggtattctgagtcacattaacaccgtcttcgtcctgcgaagcaaagaggggctgcttgatgtagagaagttagagtgcgaagacgagctgactggaaccgagatatcgtgcctccgccttaaaggacagatgatttacctgcccgaagctgactcaatccttttcctctgctccccttcagtgatgaatcttgatgatcttacgagacgagggctgtatctgtctgatattcccctgcatgacgccacccgtgacctcgtgctgctgggcgaacagttcagggaagagtataagttaacccaagagctggagatcctcactgatcggcttcaactcaccctccgggctctcgaggatgagaaaaagaaaaccgataccctcctgtactctgtgctgccaccctccgtagccaacgaactccgacataagcggccagtgcctgctaaacgctacgataacgtgactattttattctccggcattgttgggttcaacgctttctgcagcaaacatgcctccggcgagggcgctatgaaaatagtgaacctcctgaacgatctctacacacgtttcgacactctcaccgattcacggaagaatccgttcgtgtacaaagttgagaccgtcggtgataagtacatgacagtgtcaggtcttccggagccctgcatccatcatgctcgctctatctgtcacttggcattggacatgatggagattgccggacaggtacaggtcgacggagaatctgtccagataacaattggaattcacacgggggaggtggtgaccggcgtaattggccagcgtatgccaaggtattgtttgtttggaaatacagtgaacctaaccagcagaaccgagactacaggcgagaaagggaagattaacgtatccgaatacacttataggtgcctcatgtcccctgagaacagcgaccctcagtttcatctggaacacagagggcctgtctctatgaagggaaaaaaggagccgatgcaagtgtggtttctgagccgaaagaatactggaactgaggaaaccaaacaggacgacgactag

SEQ ID NO: 225581 - DNA, 1656 bp, Artificial Sequence
  Description of Artificial Sequence: Synthetic coding sequence
atgtttggtaaaatgttttttgtattctgtcaggagtcgggatacgataccatccttcgcgtcctcggctctaatgttagagagttcttacaaaacctggacgcactgcatgaccacctggcaacaatatacccaggaatgagagctcctagctttagatgcaccgacgcagaaaaggggaaaggactcatcctccactactattctgaacgggaaggcctccaggacatcgtcattgggataatcaagaccgtggcccaacagatccacggaactgagatcgacatgaaagttatccagcagagaaatgaggaatgcgaccacactcaatttcttattgaggagaaggagtctaaggaagaggacttctacgaggatctggatcgattcgaagagaacggcacacaggagtcgagaatcagtccatacaccttctgtaaggcatttcctttccacataatctttgacagagacctcgtggttactcagtgtggtaacgctatttatagagtgctgcctcagctccagccgggaaactgttcccttctttccgtcttcagcctcgtccgccctcacatagatattagttttcacgggatcctgtctcacatcaacacggtgtttgtgctgcggtcaaaagaaggactcctggacgtggaaaagctcgagtgtgaagatgagctgacaggcactgagataagctgcctgcgattaaagggccagatgatctacctgccagaggccgattcaattctcttcctgtgctccccttccgtaatgaacctagatgacctgactcgcagaggcttgtacctttccgatattccgctgcatgacgccactcgcgacctcgttctcctaggagagcaatttcgcgaggaatacaagcttacacaggaactggagattctcactgatcgcctccagctcaccctgagagcgctcgaagatgagaaaaagaagacggacaccctgttgtattccgttctgcccccttccgtggccaatgagcttcgacataaacgacctgtgcccgctaaaagatatgataacgtgactatcttatttagtgggatcgtaggattcaatgctttctgctccaagcacgcttcgggggaaggcgcaatgaaaattgtcaatctgctaaatgatctttatacccggttcgataccctgaccgattcaagaaaaaatccttttgtatacaaagttgagaccgtgggggacaagtacatgacagtctccggcctcccagaaccttgcatccaccacgcccgttctatctgccacctagctttagacatgatggagatcgcgggacaggtccaggtcgacggcgagtcagtacagatcacaatcgggatacacaccggcgaagtggttacgggcgtgatcggacagagaatgccaagatattgcttgtttggtaacaccgttaacctcacttccagaacagagaccaccggcgaaaaggggaaaatcaatgtgtcagagtacacatatagatgtctgatgtcacccgagaactcggatccacaatttcacttagagcaccggggtccggtgtctatgaaagggaagaaggagcccatgcaggtctggtttctgtccagaaaaaacacaggaactgaagaaaccaagcaggatgacgattag

SEQ ID NO: 225582 - DNA, 1800 bp, Artificial Sequence
  Description of Artificial Sequence: Synthetic coding sequence
atgctgatgtgttttatcaaagaggcgcagttagatgaggaaggccagttcttagtcagaataatctatgacgactcaaagacatacgatctcgtggccgcagccagtaaggtgctgaatttaaacgccggagagatcctccagatgttcggtaagatgttctttgttttttgtcaggagagcgggtacgatactatcctgagggtgctaggttctaacgtgagagagttcctgcagaacttagatgcattgcatgatcacctcgccactatttaccccggtatgagagctccgagttttcggtgtaccgatgctgagaagggcaagggcctgatcctccactactattccgaacgcgaggggctccaggatatagtaatcgggatcattaagactgtggcccaacaaattcacggcacagagatcgatatgaaagttatccagcagcgcaatgaggagtgcgaccatacccagtttctgatcgaagaaaaagaaagtaaggaggaagatttttacgaggacctggatagatttgaagaaaatggaacacaggagtccaggatcagtccttataccttctgtaaggccttccctttccacataatttttgaccgtgacctggtggtgacccaatgcggaaacgcgatttatcgcgttctgccacagcttcagcccggaaattgctcactccttagcgtgttcagccttgtgcgaccccacatagatatctcctttcatggaattctgagccacataaataccgtgttcgtcttgcggtctaaagagggtctcttggacgtcgagaaactggaatgtgaggatgagctgactggcaccgaaatctcatgtctgagactcaagggccaaatgatttatctgcctgaagcggattcaattctgttcctgtgcagcccctcagtcatgaacctggacgatctgactagaagagggctgtacctgtccgacatccctctgcatgacgcaactagggacttagttctcctgggcgagcagtttagagaggaatacaaattaactcaagaactggaaatcctaaccgacaggctgcaactgaccttgagggcactagaagacgagaaaaagaagacagataccctgctttactcagtgttgccaccttccgtggcaaacgaactgcggcacaagcggcctgtgcctgccaagcgctacgacaacgtgaccatccttttctcggggatcgtcggctttaatgctttttgtagcaagcatgcctcaggtgagggcgctatgaagatcgtaaacttattgaatgacctctacaccagattcgacacgctcacagattctcgcaagaaccctttcgtgtacaaggtggaaacagtgggggataagtacatgaccgtgtctggacttcccgaaccctgcatacatcacgctaggtctatttgtcacctggccttggacatgatggagatagcaggacaagtccaggtcgatggagaatcagtacagattactatcggcatacacaccggcgaagtcgtcactggcgtaatcggtcagagaatgccgaggtactgtctgttcggtaataccgtgaatttaacttccagaactgaaacgactggtgagaagggaaaaataaacgtgagtgaatatacctacaggtgcctcatgtccccggagaactccgatcctcaattccatctcgaacataggggccctgtctcgatgaaggggaagaaagagcctatgcaggtttggttcctgagccgtaagaacacaggcacagaggaaaccaaacaggacgacgactag

SEQ ID NO: 225583 - DNA, 1656 bp, Artificial Sequence
  Description of Artificial Sequence: Synthetic coding sequence
atgtttggcaagatgttttttgtgttttgccaagagagtggttacgatacaattctgcgcgttctcgggagcaacgttagggagtttctgcagaacctggatgcactgcatgatcatctggccaccatatatcctggcatgagggccccatcatttcgttgtacagatgctgagaagggtaaagggttgattttgcactactatagtgagcgggagggattacaggacatcgttattgggattattaagacagttgcgcagcagattcatggaaccgaaattgatatgaaagtgatacagcagagaaacgaagagtgcgatcacacccagttcctgatagaggagaaggaatccaaggaggaagacttttatgaggatctggaccggttcgaagagaacggaacccaagagtccaggatcagtccctataccttttgcaaggccttccccttccatattattttcgatcgggatctcgtggttacacaatgtgggaacgctatatatcgggtcctgccgcaattgcagcctggcaactgttccctcctgtccgtcttttctctggtgagaccacatatcgacatctcattccacgggatcctgtcccatatcaacacagtatttgtgttacgcagtaaggaaggcctgctcgatgtcgagaaattggagtgcgaggacgagctgacggggaccgagatctcttgtctgcggctgaaagggcagatgatttatctcccggaggccgatagcatcctgtttctttgcagcccatccgtgatgaacctcgacgacctgacacggcgtgggctgtatctctcagatataccacttcacgatgccacaagagatctggtgttgttgggggagcagtttagagaagagtataaattaactcaggaattagagattctgacagaccgattacagctcaccctgagggccctcgaagacgaaaaaaagaagacggacactctgttatacagcgtattgccaccaagcgttgctaacgagttgcggcataagcggccagtcccggcaaagcgctacgataatgttacaatcctgttctccggaatcgttggtttcaacgcattttgcagcaagcatgcttcgggggaaggagccatgaagatcgtcaacttactgaacgatctttatacaagatttgatacactgaccgattcgagaaagaatccgtttgtttacaaagtcgagactgtgggcgataagtatatgaccgtatcagggctgccagaaccgtgtattcatcatgcgcgttctatctgccatttagcgttggatatgatggagatcgctggacaggttcaggttgacggagaatccgtacagattacaatcggtattcataccggtgaggtcgtgacaggagtgatcggtcagaggatgccgaggtactgccttttcggcaacactgtaaacctgacctcccgcacggaaacaactggagaaaaaggcaaaattaatgtgagcgaatacacatataggtgcttaatgtcgcccgaaaactctgatccccagttccatctggagcacagaggccctgtgtctatgaaaggcaaaaaagaaccaatgcaggtgtggttcctcagtaggaagaacacggggacagaagagaccaagcaggacgacgattag

SEQ ID NO: 225584 - DNA, 3222 bp, Artificial Sequence
  Description of Artificial Sequence: Synthetic coding sequence
atgaagaccctgctcctcgacctggccttgtggagtctgctgtttcagcccggatggctttccttcagtagccaggtgtcgcaaaattgccacaacggttcctacgagatctccgtactgatgatgggcaactctgcattcgccgagcctctgaaaaacctagaggatgccgttaacgaggggctcgagatcgtgcgcggtcgacttcagaacgctgggctgaatgtgactgtcaatgccaccttcatgtacagcgatggactgattcataatagcggcgactgtcgatcgtcaacctgcgaaggactcgatctgctgcggaagattagcaatgcgcagaggatgggttgcgtgctaatcggcccatcctgtacgtattctaccttccagatgtacttagacactgaactttcctaccccatgattagcgccggatcatttgggctctcttgcgattacaaggagacattgactaggctgatgagcccagccaggaaactgatgtacttcctggtaaacttctggaagacaaatgacctaccctttaagacatacagttggagtacctcatacgtttataaaaatggcaccgagacggaggattgtttctggtaccttaacgccctcgaagcatctgtctcctactttagccacgagcttggattcaaagtcgtgctccgccaagataaagaatttcaggacatactgatggatcacaacaggaaaagtaacgtgattattatgtgtggcggtccagagttcctgtataagctgaaaggagacagggcggtggccgaagacatcgttatcattttagtcgacctgttcaacgatcagtattttgaggacaatgtgacagccccagattatatgaagaatgtattggttctgactctcagtcctggtaattccctcctcaatagcagttttagccgcaatttgtccccgaccaaaagggatttcgctctggcctacctgaatggaatacttttgttcggtcatatgctgaagatctttctggagaatggcgaaaacataacaactccaaagtttgcccatgctttcaggaacttgaccttcgaggggtacgacgggcctgtgactctagacgactggggggacgtcgacagtacaatggttttgctctacacctctgtggacacgaagaagtacaaggtactgctgacctacgatacacacgtaaataagacataccccgtggacatgagtcccactttcacttggaaaaattccaaattgcccaacgatattaccggacgaggaccccaaattcttatgattgccgtctttaccttaaccggcgctgttgtgttgttgctgcttgtcgcccttctcatgttgcgcaaataccggaaggactacgaactgaggcagaagaagtggagtcatattccacctgagaatatttttcccctcgaaaccaatgagactaaccacgtgtctctgaagatcgacgacgacaagcgcagagataccatacagcggctgcgccaatgcaagtacgataagaaacgggtcatcttgaaggatttaaagcacaatgacggcaacttcacagaaaagcagaagattgaactgaacaagctgttgcagatcgattactacaacctgacaaaattttacgggactgtgaaactcgatacaatgatcttcggcgtcattgagtattgtgagagaggatccctcagagaggtcctcaatgataccatttcatatcccgatggcacctttatggattgggaatttaagatttctgtactgtacgacatagccaagggcatgagttacttgcatagttctaagacagaagtccacgggcgtttgaagagcacgaactgtgttgtggatagccggatggtggttaagataaccgactttgggtgtaactctattctaccaccgaaaaaggatttatggactgcccctgagcatcttcgacaggcaaatatctcccagaagggggatgtctactcctatgggatcattgcccaggaaataattctgcgcaaggaaactttttataccttgagctgtagagatcgcaacgagaaaatttttcgggtggagaactccaatggtatgaagcctttccgcccagaccttttcttagaaacagcagaagagaaagagctggaagtatacttgctggtgaaaaactgttgggaggaggaccctgaaaagcggcctgactttaaaaagatcgagacaaccctcgccaaaatatttggactatttcatgatcaaaaaaacgaatcttacatggacaccctgatcagacggctgcaactctacagtcggaatctcgagcacttggtggaggagcggacgcaactatataaggcggaacgggatcgggctgatagattgaactttatgttactgccgcgtctggtggtcaagtcactgaaagaaaaggggttcgtggaacccgaactttacgaagaagtcactatatatttctcggatatcgtgggcttcacaacaatctgcaaatacagcacccctatggaggtcgtagacatgcttaatgatatttataaaagcttcgatcacattgttgaccaccacgacgtgtataaagttgagacaattggggacgcctacatggtcgcatcaggcctgccaaagcgaaacggcaaccgacatgctatagacattgccaagatggccctagagatcctttctttcatggggacgttcgagttggagcacctgccaggcctacccatctggatccgaatcggcgtccacagcgggccttgtgctgccggagttgtggggatcaaaatgcccaggtattgcctgttcggggatactgttaacaccgcctcacgcatggagagtactggtcttcctctgcggatccacgtgtcgggatctacaatcgccatcttgaagcgcaccgagtgccagtttctctacgaggtgcgcggtgaaacatacctgaagggtagaggaaatgagacaacatactggctcaccggaatgaaggatcagaagttcaacctccccacaccacctaccgttgagaaccagcagagactgcaagccgaattttcagatatgattgccaactccctgcagaagcgtcaagccgctggcatccgctcccagaagcctagacgcgtcgctagttacaaaaaaggaactctcgaatacttgcaactcaatactacagacaaggagtccacatatttctag

SEQ ID NO: 225585 - DNA, 3312 bp, Artificial Sequence
  Description of Artificial Sequence: Synthetic coding sequence
atgactgcgtgtgcacgccgtgcgggaggcctccccgatccaggcctgtgtggaccggcttggtgggccccttcattgcctcgattacccagggcactgccaaggcttcccttgctgcttctgctgttgttgttgcagcctccggctttgagtgctgtatttacagttggcgtgctgggcccttgggcttgcgacccaatctttagccgcgctcggcctgacctggcggcacgactggctgcagccaggctcaatagagacccagggctcgcgggaggaccaaggtttgaggtagctctcttacccgaaccctgtcgaacccctgggagtctgggcgcagtttcaagcgctctcgcaagagtttcgggactggtcggaccagtcaatcctgctgcctgtagacctgcagagctgctggcggaggaagcgggaatcgctcttgtcccttgggggtgtccttggacccaggctgagggcactacagctccagccgttactcccgctgcagacgccctttacgctctcctgagagcgttcggatgggcgcgagtagcccttgtgaccgctccacaggacctgtgggtagaggccggtcgttctttgtccacagcattgagggctagggggctgcccgttgcctctgttacgagtatggagcctctggacctctccggagcccgagaagctctgagaaaggttcgagacggacctagggtgaccgccgtgataatggtcatgcattccgtcctgttgggcggagaagaacagcggtatctcttagaagccgcagaggagctgggtttaaccgacggaagtttggtgttccttccatttgacacgattcactacgccctctctccaggtccggaagcactcgccgctttggcaaatagctcccagctcaggcgcgctcacgatgccgtcctgacactgacgcggcattgtccatccgagggatcggtgctcgacagtctgagaagagcccaggaacgaagagagttacccagtgacttgaacctacaacaggtttcacctctgttcggaactatctacgatgccgtgttcttgctggctcgaggtgtagccgaagcacgggctgcggctggcggaaggtgggtaagcggggcagcagtagctcgacatattagagacgcacaggtgccaggcttctgcggagacctcggcggagacgaggagccacctttcgttttgctggatactgacgcagccggagataggctgttcgccacctacatgttagaccctgcgagagggtcattcctttcggccggtacccggatgcattttccaagaggcggttcagccccaggacctgaccctagttgttggttcgaccccaacaatatctgcgggggtgggctggaacctggcctggtgttcctgggattcctgttggtagtcggaatgggactggccggagccttcttggcacattacgtgcggcatcgtctgctgcacatgcagatggtgagtgggccaaataaaatcatactcacagtggatgatataacctttctgcatccacacggtggaacaagccggaaggtggctcaaggaagtcggtcctcactgggtgcacgctctatgtcggacatacgttccggaccctcccagcacttggacagcccgaatataggagtgtatgaaggcgaccgagtgtggcttaaaaagttccccggagaccagcacatcgccatccggcctgcaacgaaaaccgcatttagcaaactgcaagagctgcgtcatgagaacgtcgctctgtatcttgggctgtttctggccaggggagcagagggccctgccgcattgtgggaaggaaatttggcagttgttagcgaacactgtacacggggatctctccaggatctcctcgctcagcgggagatcaaactcgattggatgtttaaaagcagcctattactggatctgatcaaaggaattaggtatctccaccaccgaggggtggcccacggtagactgaagtccagaaactgcattgttgacggcagatttgtgttgaagattactgaccacggccacggaaggttgctggaggctcagaaggttctgccagagccaccccgagccgaggaccagctgtggacagcccctgaacttttgcgcgatcccgcactggagcggagagggactctcgcaggtgacgtcttttccctcgccattattatgcaggaagtagtgtgtcgatctgctccatacgctatgctcgaactgactcctgaagaggtagtgcagcgcgtcagatcccccccacctttgtgccgcccacttgtcagtatggatcaggctccagtggaatgtattctgctgatgaagcagtgctgggcggagcagccagagctgcgccctagcatggatcacacatttgacctgttcaaaaacattaataaaggcaggaaaactaacatcatcgactccatgttgcggatgcttgagcaatatagctccaatctcgaagacttaatcagggaacgcacagaggagctggaactggaaaagcagaagacggacaggctgttaacccagatgctccctcccagtgtggcagaagccctgaaaacagggacacccgtggagccagaatactttgagcaggtgacactgtatttttctgacattgtggggtttacaacaatctccgcgatgagcgagcccatcgaggtggtagacctccttaatgacctctacactttatttgacgcaatcatcggtagccacgacgtgtataaggtggagactattggcgacgcttacatggtggcgagtggactgccacaaaggaacggccaacgtcacgctgccgagatcgcaaacatgagcctggacattctttctgctgtgggcacttttcggatgcgccacatgcccgaggttcccgttcgcattagaatagggctgcatagcgggccatgtgtggccggtgtcgtagggcttactatgcccaggtattgtttgttcggcgacacggtgaacacagcctcacgtatggagtcaacaggactgccctacagaatacacgtgaatctatccaccgttggcattctcagggctctggactccggctaccaagtagagcttcggggtagaaccgagttgaaaggaaaaggagccgaggacactttttggctggtcgggagacggggatttaacaagcccatacccaaaccaccagatctgcagcccggttcatccaaccacggtatatccctacaggaaataccccctgagcgtcgtcgcaagttagaaaaggctagaccaggacagttttcctag

SEQ ID NO: 225586 - DNA, 594 bp, Artificial Sequence
  Description of Artificial Sequence: Synthetic coding sequence
atgaggaaataccgcagccattggagtcaaggcgatcgggagggttaccagagacgctccaactattacgagggaccacatacttctcacagcagccccgctgaccggactagggaggaagtggtaacaccaactctgcctgagcatactgctacgcgttcacagatggctactagcctggacttcaagacttatgtggatcaagcatgtagagccgcagaagagttcgtcaatatctattacgagactatggacaagcggcgacgggcactgacccggttgtacttggacaaggccactttgatttggaatggaaacgcggtatccgggctggatgccctcaataacttcttcgataccttgcctagttctgaatttcaggtgaacatgcttgattgtcagcctgtgcacgaacaggccacacagtctcagacaaccgtcctcgtggtgacttctggcacagtaaagttcgatgggaataagcaacacttcttcaatcaaaatttcctgcttaccgctcaaagcacgccaaacaacacggtatggaaaatcgccagtgactgtttcagattccaagactggtcaagttcctag

SEQ ID NO: 225587 - DNA, 606 bp, Artificial Sequence
  Description of Artificial Sequence: Synthetic coding sequence
atgggtaacgtaatggagggcaaaagtgtggaggaactgtcatcaaccgagtgccaccaatggtataagaagttcatgactgaatgcccttccgggcagttgactctgtatgagttccggcagttcttcggccttaaaaacttgtctccatccgcgagccagtatgtcgagcagatgtttgagactttcgactttaacaaggatgggtatattgacttcatggaatatgtggccgcactgtccctggtattgaagggcaaagttgagcaaaaattgcgatggtactttaaactgtacgacgtggatggtaatggctgtatcgacagggatgagcttttaacaatcattcaggccattcgggctattaacccatgttccgatacaactatgaccgctgaggagttcacagacaccgtgttctctaagatcgacgtaaatggggatggcgagctgagcctggaggagtttatagagggggtccagaaagaccagatgctgcttgatacccttaccagatcgctcgatctgacccggatagtaagaaggctgcagaacggggaacaggacgaggagggagccgacgaggctgcagaagccgcaggttag

SEQ ID NO: 225588 - DNA, 606 bp, Artificial Sequence
  Description of Artificial Sequence: Synthetic coding sequence
atgggcaacgtgatggagggtaagtcagtggaagaactttcaagtactgaatgccaccagtggtacaagaaatttatgaccgagtgccccagcggacagctgaccctttatgaatttagacagtttttcgggctcaagaacctgagcccatctgcatcccagtacgtagagcagatgttcgagacatttgacttcaataaagatgggtacattgattttatggaatatgtggctgcccttagccttgtgctcaaaggaaaagtcgaacagaaacttcggtggtactttaagctatatgacgttgatgggaacgggtgcatcgaccgggatgagctgctgacaataatacaggccattcgcgctattaacccatgttctgacactacaatgacagcagaggagtttaccgatactgtcttcagtaaaattgacgtgaatggcgatggcgaactgtctctagaagagttcatagaaggcgtgcaaaaagaccaaatgctcctggatactctcaccaggagcttagacctgacccgcattgtgagacgactgcagaacggcgaacaggacgaagaaggagccgatgaggcagcagaagcggcaggctag

SEQ ID NO: 225589 - DNA, 618 bp, Artificial Sequence
  Description of Artificial Sequence: Synthetic coding sequence
atggagggcaagagcgttgaggagctgagcagcactgaatgccatcagtggtacaagaagttcatgacagagtgcccaagtggacagttgaccttatacgagtttcgccaattctttggcctgaagaacctttctccaagcgcttcacagtatgttgaacagatgtttgagacttttgactttaataaggatggctatattgatttcatggaatacgttgcagccctgtctttggtgctcaaaggaaaagtggagcagaaactgagatggtatttcaagctctacgacgttgacggaaacggatgcatagatcgggatgaattactcaccatcatccagtttccacaccagtaccagaagactgcaatccgtgctattaacccatgcagtgacaccacaatgactgccgaggaatttaccgataccgtcttctccaaaatcgatgtcaacggagacggggagctgtctttggaagagttcatcgaaggcgtgcagaaagaccagatgctgcttgatacgcttactcggagtttggacctgactcggatcgttcgcagactacagaatggcgaacaggacgaggagggcgcagatgaagctgcagaagcagcaggatag

SEQ ID NO: 225590 - DNA, 606 bp, Artificial Sequence
  Description of Artificial Sequence: Synthetic coding sequence
atgggcaacgtgatggagggaaagtcagtggaggaactgagctcgactgagtgtcaccaatggtacaaaaaatttatgacagagtgtccgtccggtcaactaacgttgtacgaatttcggcagttttttggcttaaagaatctgtcccccagcgcatcccagtacgttgagcagatgtttgagacattcgatttcaacaaagatgggtatatcgacttcatggaatacgtggcagcccttagcctggttctgaaaggaaaggtagagcaaaagttacggtggtacttcaagctgtacgatgtggatgggaatggctgtattgatcgtgacgagttgttgacaatcatccaggctatcagggctattaacccctgtagcgacaccaccatgactgccgaggaattcacagacaccgttttcagcaagatcgatgtgaatggagacggagaactctctttggaggagttcatcgaaggcgtccagaaggatcagatgctcctcgacacattaactcgttcattggatcttaccagaatcgtacggaggctccagaacggcgagcaggacgaagagggagccgacgaggctgcagaagcggcaggatag

SEQ ID NO: 225591 - DNA, 267 bp, Artificial Sequence
  Description of Artificial Sequence: Synthetic coding sequence
atgggcaatgtgatggagggaaagagtgtggaagagctaagtagcaccgagtgtcatcagtggtataagaaattcatgacggaatgcccttcgggccagctgactctctatgagtttcgacagtttttcggcttaaaaaatttaagcccatccgcgtcccagtacgttgaacagatgtttgagacctttgactttaacaaagacggttacattgactttatggagtatgtggccgctctgagcctcgtgctcaagggcaaggtgtag

SEQ ID NO: 225592 - DNA, 606 bp, Artificial Sequence
  Description of Artificial Sequence: Synthetic coding sequence
atgggaaatgtaatggagggcaaaagcgtcgaagaactgtcttcgacagaatgccatcagtggtacaaaaaatttatgactgagtgcccatctgggcagctgacgctatacgagttcagacaattttttggcctgaagaacctgagtcccagtgcaagccaatatgtggaacagatgttcgagacttttgacttcaacaaggacgggtatatcgattttatggagtacgtagcagccctcagtttagtgcttaagggcaaggtcgagcagaagcttaggtggtactttaaactctacgacgttgacggaaatggatgcattgacagggatgaacttctgactattatacaggcaattcgagcgatcaacccttgcagcgataccacaatgaccgcagaagagttcactgatacagtgttcagtaaaatcgatgttaacggagacggtgaactgagcctcgaggagttcatagaaggagtgcagaaggatcagatgctgttagacaccctcactcgctcattggatctgactcgtatcgtgagacggcttcaaaatggagagcaagacgaggagggtgcagacgaggccgctgaagccgcaggctag

SEQ ID NO: 225593 - DNA, 1020 bp, Artificial Sequence
  Description of Artificial Sequence: Synthetic coding sequence
atggaccagaataattcactcccaccatacgcccagggcctggcgagccctcagggcgcaatgacccccggaatcccaatcttcagtcccatgatgccatatggcacaggactgacccctcagccaatacagaacaccaacagcctgtctatcctggaggagcagcaacggcagcaacagcagcagcaacagcagcagcagcagcagcagcagcagcagcagcaacagcaacagcaacagcagcagcaacagcaacagcagcagcagcagcagcagcaacaacaggcagttgcggctgcagcggtgcagcagtctacgtcacagcaggcaacgcaaggaactagcggacaggcacctcagcttttccatagccagacgttaacaaccgccccactgcctggcaccacccccctctacccttccccaatgacaccaatgacccccatcaccccagcaactccagcatctgaaagttctggaattgtgccgcagctgcagaacattgtttccacagtgaacttaggttgcaagctggaccttaagaccattgcactgcgagcgcgaaacgctgagtacaatccaaaacgcttcgccgcagtcataatgagaatacgagagcccagaacaacagccttaatctttagttccggaaagatggtctgcaccggtgccaaaagcgaagaacagagccgcctggccgctcgcaaatatgctagagtcgtgcagaaactcggcttccctgccaagtttctggactttaagatccagaatatggtgggaagttgcgatgttaagttccccattagactggaaggactcgtgctgacacatcagcagttctctagctacgaacccgagctctttcctggtctaatttaccggatgatcaaaccacggattgtacttctcatctttgttagtggcaaagtggtcctcactggagccaaagtccgagcagaaatttacgaggcttttgaaaatatctacccaatcttaaaagggtttcgcaaaactacatag

SEQ ID NO: 225594 - DNA, 519 bp, Artificial Sequence
  Description of Artificial Sequence: Synthetic coding sequence
atgggccaggaattctcgtgggaagaggcggaagctgccggtgaaattgacgttgctgagttacaagagtggtacaaaaaattcgttatggagtgcccctccggcacgttgtttatgcatgagtttaagcgattcttcaaagttaccgatgatgaggaagcctcccagtatgtggagggcatgttcagagctttcgacaaaaacggcgacaacaccattgactttctcgagtacgttgccgctcttaacctcgtgctcagagggacccttgagcacaagctcaagtggacctttaagatctacgacaaggacggcaacgggtgtatagacagactagagctactcaatatcgtggaatgtcggagagagctgcaaaccgagcagggacagttactcacacccgaggaggtggtggacaggatttttctattagtcgacgaaaacggtgacgggcagctgtctctcaatgagtttgtagagggtgccagaagagataatttgttaatgcccaccctgtag

SEQ ID NO: 225595 - DNA, 630 bp, Artificial Sequence
  Description of Artificial Sequence: Synthetic coding sequence
atggggaacggaaaatctattgccggtgaccaaaaggcagtgcctacccaggaaacacacgtctggtacaggacctttatgatggaatacccttccggcctccagaccttacatgagttcaagacacttttagggctacagggcctgaatcagaaggcaaataaacatatcgatcaggtgtataatacgtttgacactaacaaagatggctttgtcgattttctcgagttcatcgccgctgtgaacctgataatgcaggagaagatggaacaaaaactgaagtggtacttcaaactgtacgatgcagatggaaatgggtccatcgataaaaacgagcttctcgatatgtttatggccgttcaggctctcaacggtcagcagaccttgtctccagaggagtttatcaatctcgtgttccacaaaatcgatatcaacaatgacggcgaattaacattggaggaatttatcaacggcatggccaaagaccaggatctgctggagatcgtttacaagtcttttgatttctccaatgtcctcagagtcatctgcaatggaaaacagcccgacatggagacagacagctctaaatcaccagataaagcaggactgggcaaggtgaaaatgaaatag

SEQ ID NO: 225596 - DNA, 591 bp, Artificial Sequence
  Description of Artificial Sequence: Synthetic coding sequence
atggggaatgggaaaagcatcgcaggagaccaaaaggctgttcctacacaggaaacccacgtttggtatcggacttttatgatggagtatccttcaggattacagaccctacacgagtttaagacacttctcggcctgcaggggctcaaccaaaaggctaacaaacacatcgatcaggtatataataccttcgacactaacaaagatggatttgtcgacttcctagagtttatcgctgccgtaaacctgattatgcaggaaaagatggaacagaagttaaagtggtacttcaagttatacgacgctgatgggaacggcagcatcgataagaatgaactgctggacatgttcatggcagtgcaggcactcaacggacagcaaaccttgagtcctgaagaatttatcaacctcgtgttccacaagatcgatattaacaacgacggcaatggggctaccctgtattggatcacctttcccacgaagggcatcgattttaggcgtatataccagtggcacggcaagcggtccggatcccccggtgactgccttcaagaactgcggctgcttcaatgtgcggaatcaaatctgtag

SEQ ID NO: 225597 - DNA, 348 bp, Artificial Sequence
  Description of Artificial Sequence: Synthetic coding sequence
atgaacgcgtttctgctgtcggccctctgcttgcttggggcatgggctgcgttggccggaggagttacggtgcaggatggcaacttcagcttttctctagagtccgttaagaaactcaaagacctgcaggaaccacaggagccgagagttggtaagctcagaaacttcgcccctatccctggcgagcctgtcgtgcctattctctgcagtaaccccaacttccccgaagagcttaagccactctgtaaagagccaaatgctcaggaaattctccagagattagaggaaatcgctgaagacccaggaacgtgtgagatctgtgcctacgccgcttgcacagggtgttag

SEQ ID NO: 225598 - DNA, 339 bp, Artificial Sequence
  Description of Artificial Sequence: Synthetic coding sequence
atgggatgtcgcgctgcctctggccttcttccgggtgtggccgtcgtgcttctgcttctcctgcaatccacccagagcgtctatatccagtatcagggttttcgggttcagctcgagagtatgaaaaaactcagtgacttggaggcccagtgggcgccttccccgcgtcttcaggctcagtctttgttgccagccgtctgccaccaccccgcattacctcaggacttgcagcccgtttgcgcatctcaggaggcatcatccatcttcaagactcttaggaccattgctaatgacgactgtgaactgtgcgtgaatgtcgcctgtacaggatgtctttag

SEQ ID NO: 225599 - DNA, 594 bp, Artificial Sequence
  Description of Artificial Sequence: Synthetic coding sequence
atgtcaggacctcgccctgtcgttctgtctggaccgtctggcgcagggaaatctacactgctgaaaagactgctgcaggaacacagtggtatattcggctttagcgttagccacacgactcgcaatcccaggcccggtgaggagaatgggaaagactactactttgtgacccgcgaggtcatgcagagagacattgccgctggtgattttattgagcatgccgagttttccggcaacctatacggaactagcaaagtcgcagtgcaagccgtgcaagccatgaacaggatctgtgtgctggatgtagacctgcagggggttaggaacattaaagccacagatttgcgacccatctatatctcagtgcaaccaccctctctgcatgtcctggagcaacggcttcgccagcggaacacagaaaccgaagagtctttagtgaaacggctggcagcagcccaggcagacatggagagctccaaggaacctggattatttgacgtagttataatcaacgattcccttgatcaggcttacgctgagctgaaagaagctctgagcgaggaaattaagaaagctcagcggaccggagcctag

SEQ ID NO: 225600 - DNA, 594 bp, Artificial Sequence
  Description of Artificial Sequence: Synthetic coding sequence
atgtctggcccaaggccagtagtccttagcggaccgtcaggggctgggaaatccaccctgctcaaacgattattgcaagagcatagtggaatctttgggtttagtgtgtcacatacaactagaaacccacggcctggcgaggaaaacggtaaggactactactttgttacacgggaggtaatgcagcgggatatcgccgctggagacttcattgagcacgcagagttttctgggaacctgtacggaacgtccaaagtcgcggtgcaggccgtgcaggccatgaataggatatgtgttctcgacgttgatctccaaggcgtgcggaatattaaagcgacagacctgcgcccaatttacatatctgttcagccaccatcactgcatgtcttggaacaacgtctccgacaacgcaatacagagacagaagagagtctggtgaaacggctagctgcagcccaggccgatatggagtccagcaaggaaccagggctgttcgatgtcgtgattataaacgacagtcttgatcaggcctatgccgagctgaaagaggcactatcagaagagatcaaaaaggcacagcgcacaggcgcttag

SEQ ID NO: 225601 - DNA, 594 bp, Artificial Sequence
  Description of Artificial Sequence: Synthetic coding sequence
atgtctggacctagacccgttgtgctatcagggccttccggcgcaggaaagagtaccttgctgaagcgactgctccaggaacactccggtatatttgggttctcagtgtcccatacaacaagaaatcctcgacccggagaggagaatggtaaagattactacttcgtgactcgtgaggtgatgcagcgggatattgccgcaggagattttatcgagcatgcagagtttagtggcaatctctacggaactagcaaagttgccgtacaggcagtccaagcaatgaatcggatctgcgtgctagatgtagacctccagggagtgaggaatataaaggccactgatcttcggccaatctacatttccgtccagcctccttcactgcacgttctggaacaacgactccgtcaacgcaacacagagacggaagagtcactcgtcaagagactcgccgcagcccaggctgacatggaaagtagcaaggagcccggactttttgacgtggtcataattaacgactctttggaccaggcatacgctgagctcaaggaggccttgagcgaagagattaagaaggcgcaacggactggcgcatag

SEQ ID NO: 225602 - DNA, 600 bp, Artificial Sequence
  Description of Artificial Sequence: Synthetic coding sequence
atgtcaggtccccgacctgtcgtgctgagcgggccaagcggggctggcaaaagcacactgttgaaaaggctgctgcaggagcactcaggtatcttcggattcagcgtatcacgagaatcccgcgcacttgtcgagggataccacgaagaaccggaggcaaggaggggcgagcggcaaagggaggttatgcagagagacatcgccgctggtgacttcatcgagcacgccgaattctccggtaatctgtacggcacatccaaggtggccgtccaggcagtgcaggctatgaacaggatatgcgttttagacgtggatctccagggggtgagaaacattaaggcgactgaccttcgtccgatctatatatccgtgcaaccaccctcactgcacgttctggagcagcggctgcgccagcgaaacaccgaaaccgaggagtccctggtgaagagattagccgctgcacaagcagacatggaaagttcgaaggaaccaggcctgttcgatgtggtgattatcaacgacagtctggaccaggcttacgcagagcttaaggaggccctcagtgaggaaattaaaaaggcccaacgcaccggcgcttag

SEQ ID NO: 225603 - DNA, 729 bp, Artificial Sequence
  Description of Artificial Sequence: Synthetic coding sequence
atgagtggcccacgtcccgtagtgttgagcggcccatccggggctggcaagtcaacgctgctcaagcggttgctgcaggaacacagcgggatttttggctttagcgtgtcacataccactcggaaccctcgcccaggcgaggaaaatggtaaggattattattttgtgacacgagaagtcatgcagcgggatattgcagccggagactttattgaacacgctgaattttctggcaacctgtacggaacgagcaaagttgctgtacaggctgtgcaggcgatgaaccggatttgtgtgttggacgtcgacctgcaaggagttagaaatattaaggcaaccgatctccggcctatctatatttcagtgcagccccctagtctgcacgtgctgagattacggcagcgcaacaccgagaccgaagagagtcttgtcaaaaggcttgccgctgcacaggctgacatggaaagtagcaaggaacccggactcttcgatgtggtcatcattaacgattctctcgatcaagcttatgccgaactgaaagaggctctgtcggaggtcggcccttcactgtgcctgccgggtcaaggccctcggggaggcctgggcgcacgtcccctgctgtcaatgagaccactacgcaaatcgaggaaactcaagggacctgccccagaggcttgttgccttttctccgcccctagggcccatacgggccctggtcagcagcactag

SEQ ID NO: 225604 - DNA, 657 bp, Artificial Sequence
  Description of Artificial Sequence: Synthetic coding sequence
atgttaaggcgccctctagctgggctggctgcagcagccctggggagagctcctcccgatggaatgagtggtccgcgaccagtggttttgtccggcccatctggcgcaggcaaatctactttactcaagcgcctactgcaggaacatagcggaattttcggcttctctgtgtctcacacgactagaaatcctcggccaggagaggagaatggcaaagattattatttcgtcacgcgagaagtgatgcagcgcgacatcgcagcaggcgactttatcgagcacgcagaattttccggaaacttgtatggaacttccaaggtggctgtccaggctgttcaggccatgaaccgcatttgcgttctggacgtggatttgcagggggtgcggaatatcaaggccacagacttgcggcctatttacatctctgtacagccaccctcactgcacgtactcgaacagcgactccggcagaggaacacggagaccgaagagtccctggtcaaaaggcttgcagctgcccaagctgacatggagagcagccctgccggactggagagctgtcccaccgccgctgtaagaacagccgcagggcagtcacctgcttgtcttatgtggtcaagtctcaccacagcatggacacgcccaacccaatcctag

SEQ ID NO: 225605 - DNA, 594 bp, Artificial Sequence
  Description of Artificial Sequence: Synthetic coding sequence
atgtctggaccgaggcccgtagtgctgtctggaccctcaggagcagggaaatccacattgctgaagcgactgctccaggagcattctggcattttcggattctctgtgtcgcacactaccaggaacccaaggccgggagaggaaaacggcaaagattattactttgtgacccgcgaagtgatgcagcgggatatcgctgccggagatttcattgagcatgccgagttttccggcaatctatacggcacatcgaaggtggccgtccaggccgtacaagccatgaaccggatttgtgttctggacgtagatcttcagggcgttaggaatatcaaggccacagacctgcggcctatctatatctcagtgcagccaccgagccttcacgtcctcgagcagaggctccgacagaggaatactgagaccgaggagagcctggtaaagcgactcgcagccgctcaggctgacatggagagtagtaaagaacctggcctctttgacgtggtcattatcaacgatagccttgaccaggcctatgcagaactcaaagaagccttaagtgaggaaatcaaaaaggcacagagaactggggcatag

SEQ ID NO: 225606 - DNA, 726 bp, Artificial Sequence
  Description of Artificial Sequence: Synthetic coding sequence
atgcttcgcagacccttggctggtcttgcagccgctgccttgggaagggcacctccggacggcatgtcggggcctaggccagtggtgctgtctggaccgtccggcgcaggtaaatcaacgctgctgaagaggctcctgcaggaacatagcggtattttcgggttctccgtgtctcacacaactaggaatcccaggccaggggaggagaatggcaaagactattatttcgtgaccagagaggtgatgcagcgagacatagcggcaggtgactttattgaacacgccgaattcagtggcaatctgtatggcacaagcaaagtggccgttcaagctgtgcaggctatgaatagaatctgtgtcttggatgtggatctgcagggcgtgaggaacattaaagccacagacctgcgcccaatctacatctctgttcagcctccgtccttacacgtcctcgaacaaaggttaagacaacgaaataccgagaccgaggagagcttggttaagcgcctggctgcggctcaagcagacatggaatccagaaaccaggaaagctcaaaggataggcggctgagattggccgtttgcagtcgacaccccggaccgatccaggaccagggctcctccatagagccgcctccttggcaagctatacgtcagctgtgtgcacttgggcaacacgtggaatggcgtcgctgctgcccatgcggctggaatattctcggatag

SEQ ID NO: 225607 - DNA, 594 bp, Artificial Sequence
  Description of Artificial Sequence: Synthetic coding sequence
atgagcggcccaagacccgtggttttgagcggtcctagcggggctggcaagtcaacccttctgaagcgtctcctccaagagcacagtggaatatttggcttttcagtgagccatactactagaaaccctcgtccgggtgaagaaaacgggaaggactattattttgtgacgagagaagtaatgcagagggatattgccgcaggcgatttcattgagcacgccgagttttcaggtaatctgtacggtacatccaaggtggcggtacaggccgttcaggccatgaaccgcatctgtgtgctggacgtcgatctgcagggggtccggaatatcaaggcgaccgacttacgtccgatatatatttctgtccaacccccttccctgcacgttctggagcaaagactgcgtcaacgcaatactgaaacagaggagagcttggtaaaaaggctcgccgcagcccaggccgacatggagagttcgaaagagcccggactgtttgatgtggtcatcattaacgacagccttgatcaagcgtacgccgagctgaaagaggcgttgtctgaggagatcaagaaggcccaaagaactggggcttag

SEQ ID NO: 225608 - DNA, 657 bp, Artificial Sequence
  Description of Artificial Sequence: Synthetic coding sequence
atgctccgcaggcctctcgctggtttggcggcagctgctctcggcagggcacccccagacggaatgagcggaccacgtcccgttgtgctgagtggccctagcggcgcaggcaaaagtaccctgctaaaacggcttctgcaggagcatagcggcatctttggattctcggttagccacaccacgcggaacccgcgacccggagaggaaaatggaaaagattactacttcgtgactcgcgaagtgatgcagcgagatatcgctgcgggtgatttcatcgagcatgcagaattttcaggtaacctgtatggtacgtcgaaagtggccgtgcaggccgtgcaggcaatgaacaggatctgtgtgcttgacgtggaccttcagggcgtgagaaatattaaggccactgatctgcggccaatatacatatctgttcagccacctagcttacacgtgttggagcagaggctgcgacagcggaacacagagaccgaggaatccctcgtgaagcggctcgcagccgcacaggccgatatggagtcgtccaaggagcctggcctgtttgatgtggtcattatcaacgattctttggaccaagcatacgctgagctaaaggaggcgctgagcgaagagataaagaaggcccagcgcacaggcgcttag

SEQ ID NO: 225609 - DNA, 762 bp, Artificial Sequence
  Description of Artificial Sequence: Synthetic coding sequence
atggccggaagccagaaagaggaaataatgccacctcagcagggtgtgccttttcaggagtccgggtgttggggatcgatgggcgcacaatccagagagaggtcaggcagggaccacagcggcacctggatctgtgccggtggttcacaggaaacttttcacctgggcgctcccgtggagaccacctgcctagctggaatgagcggacccagaccagtcgtgctctccggaccctccggcgctgggaagtctaccctgctgaagcggctacttcaggagcacagtggcatcttcggcttcagtgtgtcccataccactcgcaatcctcgccctggtgaggagaacggaaaggactattactttgtgacacgtgaagtcatgcaaagggatatcgcggctggagatttcattgagcacgcggaattcagcggaaatttatacggaactagcaaggtggccgtccaggcagtacaggccatgaatcgcatttgcgttctagatgtggacctgcagggagtgaggaatatcaaagccacagacctgcgcccaatctatatctcggtgcagccaccatcacttcatgtcctggagcagcgacttaggcagaggaacacagaaaccgaggaaagtctggtgaagagattggctgcggctcaggcagatatggaatcttccaaggagcctgggctttttgacgtcgttattataaacgactccctagatcaagcttatgctgaacttaaagaagccctgtcggagtag

SEQ ID NO: 225610 - DNA, 516 bp, Artificial Sequence
  Description of Artificial Sequence: Synthetic coding sequence
atgtctggtcctcgtccagtggtgttgtcaggtccttctggtgccggtaaaagcaccttactgaaacggcttctccaggaacattccggcattttcggcttcagcgtctcccgtgaatcaaatacaacaaggaacccgcgtcctggcgaggaaaacggaaaagattactactttgtaacccgcgaggttatgcagagggatattgccgctggtgattttatagagcatgctgaattttccggcaatctctatggaaccagcaaggtggccgtgcaggccgtgcaggcaatgaatagaatttgtgtcctggacgttgaccttcagggcgtaagaaatattaaagccactgatcttaggcctatctatatctctgtgcagcccccaagcctgcatgttcttgaacaaagactacgacagaggaacaccgagactgaagaatccctggttaaaaggctggccgcagcccaggcggacatggagtctgaaatcaagaaggcgcaacggactggagcctag

SEQ ID NO: 225611 - DNA, 819 bp, Artificial Sequence
  Description of Artificial Sequence: Synthetic coding sequence
atggcgggatctcaaaaagaagaaatcatgcctccgcagcagggcgtgcccttccaagaatctggatgctggggctctatgggagctcagagcagagaacgaagcgggagggaccatagtggtacctggatttgcgccggtgggagtcaggagacattccatcttggggctcccgttgagacaacctgcctggctgcgtcactgctgactcctcgacatgtgggtcctcaggcatgtggggctgaacgggcattcgggtcctgggaggagcatcctgctgaagaggccgctcctggtgctcaaagacacctatggctgcagagggttccatatcacgaggaacccgaggcaaggcggggagaaaggcagagggaggttatgcagagagacatcgcagcaggggatttcattgaacatgccgagttcagcggcaatctgtacgggacctccaaggtagccgttcaggcagttcaggctatgaaccgcatatgcgtgctggacgtcgaccttcagggggtccgcaatattaaagctacggaccttagacctatttatattagcgtacagcctccatccttacacgtacttgaacaacgcttgagacaacgcaatacagagacagaagagagtctggtcaaaagacttgcggctgctcaggccgatatggaatcaaggaaccaagaatctagcaaagatcggcgactgcgtctagcggtgtgttctcgtcaccccggacctatccaggatcagggatcaagtatcgaacccccaccatggcaggccatccggcagctgtgcgctttaggccagcatgtctag

SEQ ID NO: 225612 - DNA, 654 bp, Artificial Sequence
  Description of Artificial Sequence: Synthetic coding sequence
atgctgagaagacctttagccggactcgcagccgctgcgttgggcagagcacctccagacggcatgagtggacctagacccgtcgtgcttagcgggcctagcggagcagggaagtcaactctgctgaaacgcctgctgcaagaacactccgggatattcggtttcagtgtcagtcacaccactaggaaccccaggcctggtgaagagaacgggaaggattactactttgtgacaagagaggtcatgcagagagatatagcagcgggtgacttcattgaacacgccgagtttagcggcaacttgtacgggaccagcaaggtggcggtgcaggcggtgcaggcaatgaacaggatatgcgtgcttgatgtggacctgcaaggggtacgtaatattaaagctaccgacctgcgcccaatttatatatctgtccagcccccatctctgcacgtactggaacagcgtctacgccagcgaaatacggaaacagaagagagtctggttaagcggctggccgcagcccaggccgacatggagagctctaaagagccaggtcttttcgatgttgtcatcatcaacgacagtcttgatcaggcttacgccgagctgaaagaggcattgtcagaagagataaagaaagcccagcggaccggttag

SEQ ID NO: 225613 - DNA, 915 bp, Artificial Sequence
  Description of Artificial Sequence: Synthetic coding sequence
atgaaccgggctttttcccgaaagaaagacaagacatggatgcacactccggaggccctgagcaaacacttcatcccctataacgctaagttcctaggatctactgaggttgagcagcctaaaggaactgaagtggtgcgcgatgccgttcgcaagctcaaattcgcccgacacattaaaaaaagcgaggggcaaaagatcccgaaggtggagctacagatctccatatacggggttaagatcctggagccaaaaacaaaagaagtgcagcataactgccaacttcaccgaatcagcttctgtgccgatgacaagacggataagagaatcttcaccttcatttgtaaagattccgaaagcaataagcacctctgctacgtctttgattctgaaaagtgcgctgaggaaatcacactgacaatcgggcaggcattcgatctggcctacaggaaattcctggaatccggcggtaaagatgtcgagacacgaaagcaaatcgccggtctccaaaagaggatccaagaccttgaaaccgaaaacatggaattaaagaacaaggtgcaggacctcgagaatcagctgcgcattacacaggtgtctgctcctcccgctggctctatgacgcccaaatctccaagcactgacatatttgacatgattcccttttctccaatctctcaccagtcaagcatgcctacacgcaatggtacacagccacctcctgtcccctctagatccaccgagattaaaagagacctgtttggcgcagagccatttgaccctttcaactgcggggctgccgatttcccccctgatatccagtccaaactggatgagatgcaggagggatttaaaatgggactgacattggaggggactgtgttctgcctcgacccactggattctaggtgctag

SEQ ID NO: 225614 - DNA, 915 bp, Artificial Sequence
  Description of Artificial Sequence: Synthetic coding sequence
atgaatcgtgctttcagccggaagaaagacaaaacgtggatgcacacaccagaggctctctccaagcatttcattccctataacgccaagtttctgggcagcacagaggtagagcagcccaagggcacagaagtggtgagagacgcagtgaggaagctgaaattcgcgaggcatataaagaaaagcgaggggcagaaaatacccaaggtggagctgcagatctctatttacggagttaagatactggagccgaaaactaaggaggttcaacacaattgccagctccatcggatttccttttgtgccgatgataaaacagataaacggatcttcacatttatttgtaaagatagcgagtctaacaaacacctgtgttatgtcttcgacagcgaaaagtgcgcggaggaaataaccctcaccatagggcaagcctttgatctggcataccgcaagttcctggaaagcggtgggaaagacgtcgaaactagaaagcagattgcaggtttgcaaaaaagaattcaggacctagagaccgaaaacatggaactcaagaataaagtacaagacctggagaaccagctccgcattacacaggtgagcgctcctccagctggttccatgacccccaaatcccctagcacagacatcttcgatatgatcccattctctccaatttcccaccaatcaagtatgcccacaagaaatggtactcagccgccacctgtaccctctagatcaacggaaataaaacgggacctgtttggtgctgaaccattcgatccgtttaattgcggggcagccgacttccctcccgacatccagagcaagctggatgaaatgcaggaaggctttaaaatgggactaaccttagaagggactgtcttctgtctagacccactagactcaaggtgctag

SEQ ID NO: 225615 - DNA, 915 bp, Artificial Sequence
  Description of Artificial Sequence: Synthetic coding sequence
atgaacagagctttcagcagaaagaaggataagacatggatgcacacccctgaggcactctccaaacatttcataccctataatgccaaattcctgggctctactgaagtggagcaaccgaagggaactgaggttgtcagagatgctgttcgtaagctgaagtttgctcggcatatcaaaaaaagcgagggtcagaaaatacctaaagtggaactgcagataagcatatacggcgtgaaaatcctcgagcccaagacaaaagaggtgcagcacaactgccagctgcataggatcagcttttgtgccgatgacaaaacagacaagcgcatctttactttcatatgcaaagacagcgagagtaacaaacatctgtgctacgtgttcgatagcgagaagtgtgccgaggaaatcactctgaccattggccaggcttttgatcttgcctaccggaaattcctcgaatctggcggtaaggacgtagagactcgtaaacagatcgctggtctccaaaaacgaatacaggacctcgagacagaaaacatggagcttaaaaacaaggtgcaggacctagagaatcagctcaggattacacaggtttccgctccaccagccggttctatgactcctaaatcaccaagtaccgacattttcgacatgatcccctttagtcctatctctcaccaatccagcatgcccactaggaatgggacgcaacccccacccgtaccctcacggtccaccgaaattaaaagggatctcttcggggctgagcccttcgatccgttcaattgtggcgcagccgacttccctccggatatccagtcaaagctggatgagatgcaggaaggtttcaaaatggggctcacactcgaagggaccgtgttttgcctggaccccctggactctagatgttag

SEQ ID NO: 225616 - DNA, 504 bp, Artificial Sequence
  Description of Artificial Sequence: Synthetic coding sequence
atgaatcgagcatttagtaggaagaaggataagacgtggatgcatacacctgaagccttgtcaaagcattttataccgtacaatgcgaagtttctcgggtccacagaggtggaacaacctaagggcacagaagtagtccgtgatgctgtgcgaaaactgaagtttgccaggcatattaaaaagtcagaaggccagaaaatcccaaaagttgaactgcagatcagcatttacggagtcaagatactggaacctaagaccaaagaggtgcagcacaattgtcagctgcacaggatctccttttgcgccgatgataaaactgacaagcgtatttttacattcatctgcaaagacagcgaaagtaacaagcacctctgttatgtgttcgacagcgaaaagtgtgtatcgataccggatgtggtgggctggttcgtgctgttctataagcctgggatcgtgctcttattagcccttgctaagtacttgaaaatgaacaactttttgtag

SEQ ID NO: 225617 - DNA, 915 bp, Artificial Sequence
  Description of Artificial Sequence: Synthetic coding sequence
atgaaccgcgctttctctagaaaaaaagataagacctggatgcacacccctgaggccctttctaaacactttatcccctacaacgccaaatttctgggatcgactgaggtggaacaacccaagggcaccgaagtggttcgggatgcagtgaggaagctcaaattcgccagacatattaaaaagagtgaaggtcagaaaatcccgaaagtggagctgcagatcagtatctatggtgtgaagattctggagcccaagacaaaagaggtgcagcacaactgtcagctacatcgcatatcattttgcgcagacgataaaacagataaacggatattcaccttcatatgtaaggactccgagtccaataaacacctgtgctatgtgtttgactctgagaaatgcgccgaggaaatcaccctcactatcggacaagctttcgacctcgcatataggaagtttctggaatcggggggtaaggacgtcgagactagaaaacagattgccggactgcagaagcgcattcaggatctggaaaccgaaaacatggagctcaagaacaaggtacaagacctagaaaaccagctgagaattacacaggtgagcgcaccgcctgccggatcaatgacgcccaaatctcctagtacagacattttcgacatgataccatttagtccgatttcacaccaatcgtcgatgcctacgagaaacgggacccagcccccacccgtccccagtcgctcaacagagattaagcgggacctatttggagccgaaccgtttgatccatttaactgtggcgctgcagatttcccacccgatattcagtcaaaactagacgagatgcaagagggattcaagatgggcctaaccctggaggggaccgtcttttgcctggaccctctggactcaagatgctag

SEQ ID NO: 225618 - DNA, 207 bp, Artificial Sequence
  Description of Artificial Sequence: Synthetic coding sequence
atgaatcgagctttctcacgaaagaaagataaaacgtggatgcacacccccgaggcactgagcaagcacttcatcccctataatgcgaagttcctgggttcaaccgaagtagagcaaccaaaggggaccgaagtggtgagagacgccgtgcgaaagctgaaatttgccaggcacattaagaaatcggaagggcaaaagataccatag

SEQ ID NO: 225619 - DNA, 504 bp, Artificial Sequence
  Description of Artificial Sequence: Synthetic coding sequence
atgaatcgtgccttttcacgcaagaaagataagacctggatgcatacccctgaagccttgtccaaacatttcatcccatacaatgccaagtttctgggttccacagaggtggagcagccgaaaggtaccgaggttgttagggacgcagtacgcaaactgaagttcgcaagacacatcaaaaaatcggaaggccagaaaataccaaaagtcgaactgcaaatcagcatctacggcgtgaaaatcctggaaccgaaaacgaaggaagtacagcacaactgccagctgcatcgaatttctttctgtgccgacgacaagacagacaagaggatcttcactttcatttgtaaagactcagaaagtaataaacatctgtgttacgtattcgatagcgaaaaatgtgttagtattcccgatgtagttggatggtttgtacttttttataagccaggaattgtgctgcttctcgccctagccaaatatcttaagatgaataactttttgtag

SEQ ID NO: 225620 - DNA, 585 bp, Artificial Sequence
  Description of Artificial Sequence: Synthetic coding sequence
atgaccgaaaatagcactagcgccccagccgctaagccaaaacgagctaaagcttctaagaaatcaacagatcacccaaaatactcagacatgatcgttgcagcaatccaagctgagaagaaccgagctggcagttccaggcagagcatccagaaatacatcaagtctcactacaaggttggcgagaatgcagatagtcagattaagctcagcataaaaaggctggtgacgacaggtgtactgaaacaaaccaagggagtcggggcttctggttcatttcgccttgcaaagagcgacgaacccaagaaaagtgttgcattcaagaagacaaaaaaagagatcaagaaggtggccactccaaagaaggctagtaagcccaagaaggccgcttccaaagctccaaccaaaaagcctaaggcaaccccagtcaagaaggccaaaaagaagctggccgcaactcccaaaaaggccaaaaagcccaaaaccgtcaaagccaaacctgtgaaagctagcaagcccaaaaaagcaaagccagtgaagcctaaggcgaagagttcagcaaagagggctgggaaaaaaaagtag

SEQ ID NO: 225621 - DNA, 534 bp, Artificial Sequence
  Description of Artificial Sequence: Synthetic coding sequence
atgacagaaaagtctacggaccatccaaagtactcagatatgattgtcgccgcaatccaagctgaaaagaatcgtgctggcagctccaggcagtccattcaaaagtacatcaagtcacactataaagtaggggaaaatgctgacagtcagataaaactgtcgattaagcgtctggtgacgacaggcgtccttaagcagacaaagggtgttggggcatctggaagcttccgtcttgcgaagagcgatgagcctaagaaatctgttgccttcaaaaagaccaagaaagagattaagaaagtagccacgcccaaaaaggccagtaaaccaaaaaaagctgcatcaaaggctcccaccaaaaaacccaaagctaccccagtgaagaaggcgaaaaaaaagctcgccgctacgccaaagaaggcaaagaaacctaagaccgtaaaggcaaagcctgtgaaggccagcaaacctaagaaggccaagcctgtgaagccaaaggccaaatcatccgctaaacgggctgggaaaaagaaatag

SEQ ID NO: 225622 - DNA, 411 bp, Artificial Sequence
  Description of Artificial Sequence: Synthetic coding sequence
atggctcggactaaacagacagcgagaaaatccaccgggggtaaagctcctcggaagcagcttgcaaccaaggccgctagaaagtccgccccttccaccggaggagtgaagaaaccgcataggtatcggcctggcaccgtggctctcagggaaattcgcaggtaccagaagagtaccgaattactgattagaaaattgccattccagcgtcttgtcagggaaatcgcacaagatttcaaaacagatttgaggttccagagtgccgctatcggagctcttcaggaagcttccgaggcctacctcgtcggcctgttcgaggatactaacctctgcgcgattcatgcaaaacgggttaccataatgccaaaggatatacagctggctcgaaggatccgcggagagcgggcttag

SEQ ID NO: 225623 - DNA, 372 bp, Artificial Sequence
  Description of Artificial Sequence: Synthetic coding sequence
atggccagaaccaagcagacagccagaaaaagcaccggaggtaaggcccctcgcaaacagcttgctaccaaggcggctaggaagtctgctccaagcactgggggagtcaagaaacctcacagataccgaccagggacagtggctctgcgcgaaattagacgttaccagaaatctactgaacttttaattaggaaactgccgtttcagaggctggtgagggagattgcccaggacttcaaaacagacctgcgatttcagtccgctgccattggtgccctgcaggtcaaatggtgggtggggaggttgagagtgtgcatacccgtcgtttaccaggagcagtttcaaatagtcgcttgtgcttacatcatctag

SEQ ID NO: 225624 - DNA, 411 bp, Artificial Sequence
  Description of Artificial Sequence: Synthetic coding sequence
atggcccgaacaaaacagacagccagaaaatcgacaggcggaaaagctcctcgcaagcagctggccaccaaggccgcaagaaagagcgccccttctactggtggagttaaaaaacctcatagataccgcccaggaacagtggccctgagggagatccgcagatatcaaaagtctaccgagctgctgattagaaaattaccatttcagagactcgtgcgtgagatcgctcaggacttcaagaccgacctgagattccaatccgccgcaatcggggctctgcaagaggctagtgaggcttacctagtggggctgttcgaggacacgaacctgtgtgcaattcacgccaaacgagttaccataatgcccaaggacatccagttggctcgcaggatcaggggcgagagggcgtag

SEQ ID NO: 225625 - DNA, 411 bp, Artificial Sequence
  Description of Artificial Sequence: Synthetic coding sequence
atggcacggacgaagcagacagccaggaagtcaacgggcggaaaggctccccgaaagcagctagccacaaaggccgctcggaagagtgcaccttccaccgggggagtcaagaaaccccaccgatatcgtccgggtaccgtcgccttgcgcgagatcagaaggtaccagaagagcaccgagttgctgataagaaaactcccattccagaggctcgtgagggaaattgcacaggattttaagaccgacctacggttccaaagtgctgcaatcggtgccctgcaggaagcgtctgaagcatatctggtgggactttttgaggatactaatttgtgtgcgatccacgcgaaacgggtcactatcatgcccaaggacatccagcttgcacggagaatccgcggagaacgtgcctag

SEQ ID NO: 225626 - DNA, 411 bp, Artificial Sequence
  Description of Artificial Sequence: Synthetic coding sequence
atggcgaggaccaagcaaactgccagaaaatccaccggtggcaaggctcctaggaagcagttggccacgaaagcggctcggaaatctgcaccaagcacaggaggcgtcaagaaacctcatcggtaccgccctgggactgtggccctacgagagatcaggagataccagaagtctacggagttgctgattcggaaattacctttccagagacttgttcgagagatcgctcaagacttcaagacagacctgcggttccaatcagctgctataggcgcattacaggaggcctctgaggcgtacctcgtggggttgtttgaggataccaatttatgcgcaatccacgctaaacgagtgaccattatgccaaaggacattcaacttgccaggcgaataaggggtgaacgcgcttag

SEQ ID NO: 225627 - DNA, 1047 bp, Artificial Sequence
  Description of Artificial Sequence: Synthetic coding sequence
atgcctgacgaactgacggagccaggtcgggctacgccggcaagggcatcatcatttctgattgaaaatctcctcgctgcggaggccaaaggagccggtcgcgctacacagggcgacggctctcgggaagatgaagaagaagacgatgatgaccctgaagatgaagatgctgagcaggcacggcgacgtagacttcagagacgcaggcaactgctggccggtactgggcctggcggtgaagcgcgtgcacgtgccctcctgggcccaggcgcactcgggttaggacctcgcccaccgcctgggcctggtcctcccttcgcgctgggttgcgggggtgccgcacgatggtatcctagagcgcacggagggtacggtggcggattgtcacctgacacttcagaccgcgattctccagaaacgggagaggaaatgggacgcgcagaaggcgcatggccaagaggtcccggacccggtgccgttcagagagaggcggcagagttagctgccaggggacctgccgcaggcacagaagaggccagtgagctggctgaagtaccagctgctgctggagagaccagggggggagtgggcgtcggaggaggccgaaaaaagaagactagaacagtcttctctaggtcacaagtatttcagttagaaagcacctttgatctcaaaagatacctgtcatcggccgaaagagccggacttgctgctagcctgcagctaaccgagacacaagtgaagatctggtttcaaaatcgccgtaacaagtggaagaggcagctcgcagccgaacttgaagctgccagcctgagtccaccaggagctcagcggctcgtgagggtgccggtgctgtatcacgagtctccaccagccgcagcagctgcgggacctcccgcaaccctgccgtttcccctggcacctgcagcccctgcgcctccacctcctctgctcgggttttccggggcactcgcctaccctctcgctgcatttcccgctgctgcctccgtgcctttccttcgggctcagatgcctggcctggtgtag

SEQ ID NO: 225628 - DNA, 822 bp, Artificial Sequence
  Description of Artificial Sequence: Synthetic coding sequence
atgggaagcaaggaagacgctggaaaagggtgtccagcggctggtggagtttcttcttttactattcagtctattctggggggaggtccaagcgaagccccacgggagccagtgggatggcccgctagaaaaaggtcactgtcggtctcttcagaagaagaggagccggacgacgggtggaaggcccctgcttgcttctgtcctgatcagcatggacctaaggagcagggccctaaacaccacccacctattccttttccctgcctgggcaccccaaagggaagcggaggctccggacccggtgggcttgagaggacccctttcttgagtccatcacattccgacttcaaggaagaaaaagagcgtttgctcccagccggatcaccaagccccggaagcgagcgaccaagagatggcggtgccgaaaggcaggccggtgctgcaaaaaagaagacacgcaccgtgttttcacggtcacaagtatatcagctggaatccacatttgacatgaagaggtatctgtcttcctcagagcgggcttgtctggcctcctcgctacagttgactgaaacacaggtgaaaacctggtttcagaacagaaggaataagtggaaacggcagctaagcgccgagctagaggctgccaatatggcccacgcaagcgctcaaactttagtgtcaatgccccttgtctttcgagactcctctctactccgagtacccgtgccccgtagcctagccttccctgctccactttactacccagggtccaacctttcggcgttacccctgtacaacctgtataataaactggactattag

SEQ ID NO: 225629 - DNA, 1074 bp, Artificial Sequence
  Description of Artificial Sequence: Synthetic coding sequence
atgccggaacctggccctgacgcggcaggcaccgctagtgctcagccccagcccccaccaccccctccaccggctcccaaggagagccccttctcaatcaagaacctgctgaacggcgatcaccaccgccctcctccaaagccacaaccgcctccccgtaccctgtttgccccagcttcagcggctgctgctgccgctgcagcggctgccgctgcggctaaaggcgcactggaaggcgctgcaggatttgcactgagtcaggtgggcgatcttgcattccctaggttcgaaatacccgcacagaggttcgctctgccagcccactacctagaacgctcgcccgcttggtggtacccatatactcttactcccgcaggaggacatttgcccaggccagaggccagcgagaaggcattactacgggatagcagccccgcttccggtacggatcgagactccccagagccactgctaaaggcagaccctgaccacaaggagctggacagcaaaagccctgacgagatcattctggaggaatctgatagtgaagagtccaaaaaggaaggggaagctgcccctggggctgctggagcaagcgtcggcgcagccgcagccactcccggagcagaagactggaaaaagggagctgaaagcccagaaaaaaaacccgcatgccgaaagaaaaaaaccagaacagtgtttagccggagccaggtgttccagttggagagtacatttgatatgaaacgctatctgtctagcagcgagcgggctggactggccgcttctctccatcttacagaaacgcaggtgaagatctggttccaaaatagacggaacaaatggaagcgacagctcgccgcagaacttgaggctgccaatctgagccacgctgctgcgcaacggattgtgcgggttcccattctgtaccacgagaattcagctgctgagggcgctgcagccgctgctgccggagctcccgtacccgtgtctcaaccattgctgaccttcccccatcctgtgtactatagtcatccggtcgtctcttccgttcccctgctgcggcctgtgtag

SEQ ID NO: 225630 - DNA, 3405 bp, Artificial Sequence
  Description of Artificial Sequence: Synthetic coding sequence
atggagtctactccaagttttctcaaaggaactcccacatgggagaaaaccgcgcctgagaatggcatcgtcagacaggagcccggtagtcctccgagggacggcctccatcacgggcctttgtgcctgggggaacctgctcccttttggagaggcgtgctttccacacccgactcttggttgccccctggatttccacaggggcctaaggacatgctgccgctcgttgaaggtgaagggcctcagaacggagaacgaaaagttaactggctaggatctaaggagggtctgaggtggaaggaagctatgttgacacacccgttagcgttttgcggcccagcgtgtcctccacgatgtggccctctgatgcctgagcactctggaggacatcttaagtctgatcccgtcgccttcagaccctggcactgtccattcttgctggaaactaagatcttggagcgggcaccattttgggttcctacgtgcctacctccatacctggtgtccggattacctcctgaacacccatgcgattggcccctgacacctcacccttgggtgtactctgggggacaaccaaaggtgcctagcgccttctcgctgggctcaaaaggtttctactataaagacccgtcgataccgagactggcaaaggagcccctagccgctgctgaaccaggcttgttcgggttgaattccggaggccacctgcagcgcgctggggaagccgagaggcctagcttgcaccagagggatggcgagatgggagctggaaggcaacaaaacccttgccccctctttctgggtcagcccgacacagtcccctggacatcctggcccgcttgtccacccggactcgtgcacacgctgggcaacgtgtgggccggaccaggagatggcaatttaggctaccagcttggtcctccggcaactcccagatgccccagtcctgaacctccagttactcaacgcggatgctgttcgtcttatccccctaccaaagggggtgggctgggcccttgcggcaaatgtcaggaaggcttggagggcggtgcaagcggtgcatctgaaccaagcgaagaggtcaataaggcatctggaccccgagcgtgtcctccctcccaccatacgaaacttaagaagacctggctgactagacattctgagcaatttgaatgcccgagaggctgtcctgaggtggaggaacgccctgtcgcgcgtctgagggccttaaaacgtgccggaagtcctgaggtccagggcgctatgggctctcctgccccaaaacgaccgccagatcctttccctgggactgccgaacagggtgcgggtggatggcaagaggtgcgcgacacttcgatcggaaataaggatgtggattcaggccagcacgatgagcaaaaaggcccacaggatggacaagccagcttgcaggatcccggactccaggatatcccttgcctggcccttcccgcaaagttggcccagtgtcagtcttgtgcacaggcagcaggagaaggtggcggtcacgcctgccattctcagcaggtgcggagatcccccctgggcggagaactgcagcaggaggaagataccgccactaattcttccagtgaagaaggtcctggatcaggacctgatagtaggctgagcaccgggctagctaagcatctgctgtccggtctgggagaccggctttgccggttgctccgacgcgagcgggaggcactggcctgggcacagagagaaggacagggcccagcagtgacggaggattctcccggaattcctcgctgttgttcgcgctgtcatcatggactttttaacacgcactggcgttgtccgcgttgctcacatagactatgtgttgcttgcggaagagtggcaggtacaggtcgcgcaagggaaaaggcgggatttcaggagcaaagcgctgaggaatgtacacaggaggctgggcacgctgcatgctcacttatgctcacacaattcgtttccagccaggcactggctgaactgtcaacggccatgcatcaggtctgggttaagtttgatatcagaggtcattgtccctgtcaggccgatgccagggtctgggctcctggggacgcaggccagcaaaaagaatccactcaaaagacaccaccaacaccacagccatcctgtaatggcgatacacacaggactaagtctattaaggaagaaacaccggactccgccgagaccccagcagaggatcgcgcaggacgcggtcccctgccctgcccgtctttatgcgagctcctggcatcaaccgcagttaaactctgcctggggcacgagcgcatacatatggcttttgccccagttacccctgctctcccgtcagacgacaggattacgaacattctggactctataattgcccaggtcgtagaaaggaagattcaagaaaaggcactgggacccggtcttagagccggtcctgggctcaggaagggtctgggactgcctctctctccggtcaggcctcgtctccctccccctggagcactcctgtggctgcaggagccacaaccatgccctaggagagggtttcacctctttcaagagcattggcggcagggacagcctgtactggtgagcggtattcagcgcacactgcaaggcaacttgtggggcactgaggcgttaggggcactgggagggcaggtgcaggccctgagcccgctgggaccgcctcaacctagctccctcggctctactacgttttgggaaggtttttcttggccagaacttaggccaaaatcagatgaaggaagtgtgctcctgctgcaccgcgctttaggtgatgaagacacaagcagagtcgaaaatctggccgcttcactgccactgcccgagtattgcgcactgcacggcaaattaaacttggccagttacctgcctcctgggctggctttgcggcctctcgaacctcagctgtgggcagcatatggggtttcccctcataggggccacctcgggacgaagaatctctgcgtggaagtggcagacctcgtctccatcctcgtgcatgctgatacgcccttgcctgcctggcacagggctcagaaagacttcctgtctgggctcgacggcgaggggttgtggtctcctggatcccaagtctccaccgtgtggcacgtctttagggcccaggatgctcagcggattcgacggtttctgcagatggtgcagggtctggtgtccaccgtgtctgtgacacagcatttcctcagccccgagaccagtgccctttctgctcagttgtgccaccaagggcctagcctgcctcccgattgtcacctgctctatgctcagatggattgggcagtgtttcaggctgtgaaagtggcagtaggcaccctgcaggaagccaagtag

SEQ ID NO: 225631 - DNA, 3570 bp, Artificial Sequence
  Description of Artificial Sequence: Synthetic coding sequence
atggaatctactcctagctttcttaaagggactcctacatgggagaagaccgcgcctgaaaacggaatcgtgaggcaggaacccggttccccccctagggatgggctccatcacggacccctttgcctgggcgaacccgctccattctggcggggtgttctatcaacccccgatagttggctccctccaggcttcccacaggggccaaaggacatgctgcccctggtggaaggcgagggtcctcagaacggagaacggaaagtgaactggttgggttcaaaggaagggcttaggtggaaggaagcgatgttgactcacccgttggccttttgcggccctgcatgcccaccgaggtgcggacccctgatgcccgaacatagcggagggcatctgaaaagtgacccagtggcattcagaccttggcattgcccgtttttactggagacaaagatcctggaaagagctccattttgggtgcccacttgtctgcccccttatctggtgagcggattaccacctgagcatccctgtgactggccactcactcctcacccatgggtgtacagtggtggacagccaaaggtcccgagcgcgttcagtctgggaagcaaggggttttactataaagatccttccatccccagactcgcgaaagagcctttggctgccgctgaacctgggctctttgggcttaacagtgggggtcacctccagcgggctggggaagccgaacggccatctctacatcagcgtgacggcgagatgggggcaggcagacaacaaaatccttgtcctttattccttgggcagccagacacagtcccatggacctcctggcctgcgtgtcccccagggcttgttcacaccctcgggaatgtgtgggcagggcctggcgacggtaacttgggctaccagctgggacctcctgcgacacccagatgtcccagccccgaacccccagtaactcaaaggggatgttgcagtagctatcccccaacaaagggtggaggtcttggaccgtgtggcaagtgtcaagaagggctggagggaggggcttctggggcttcggagccctcagaagaagtgaacaaagcaagcgggcctagagcctgcccgccaagccatcacaccaagctgaagaaaacctggctaacacgccattcagagcagttcgaatgccctcgcggttgccccgaggttgaggagcgtcctgttgcaaggctcagagcactgaaacgcgctggctcacccgaagtgcagggcgctatgggctctcctgcaccaaagagacctcctgaccctttccctggaaccgccgagcaaggagcgggagggtggcaggaagtccgcgacacatccattgggaataaagacgtcgattccggccagcacgacgagcagaaggggccacaggacgggcaggcaagtttacaagatccaggactccaggacataccgtgtttagcgctgcctgctaagctcgctcagtgtcagagctgtgcacaggctgccggagagggaggaggacacgcatgccattcgcagcaggtacgaagatcccctcttggaggcgaactgcagcaggaggaagacactgctactaattcatctagcgaggagggacctgggtcaggtcctgatagtcgcctctccacggggctggccaaacacctacttagcggactgggtgatcggctttgtagattgctccggagggagcgagaagccctcgcttgggctcaaagagaggggcagggcccagccgtaactgaagactcccccggaattccgaggtgctgctcgagatgccaccacggcctttttaatacgcattggagatgtcctcgctgcagccacagactctgtgtggcttgtggcagggtggctggcactggtagggcacgcgagaaagcaggcttccaagagcaatccgccgaggagtgcacacaggaggccggacacgcggcatgctccctgatgctgacacagttcgtgtcgtcccaagctctcgctgagctaagcacagccatgcatcaggtgtgggtcaagtttgacatcaggggccattgtccatgtcaggccgatgcgagggtttgggcacccggtgatgctggccagcagaaggaatcaacgcaaaagacccctccgactccccagccaagctgcaatggagatacccacagaacgaaatctataaaggaggagacacccgacagcgctgaaactcctgcagaggaccgcgctggccgagggcctttaccctgtccgtctctgtgcgaactgttagccagcacggccgtcaagctctgcctgggacatgaaaggatacacatggcattcgcccctgtaacaccagcgctgccgagtgatgataggattaccaatatcttagattccatcattgctcaggtggtagagcggaaaatccaggaaaaagctctgggccctggcctaagggccggtcctggcttgagaaagggcctgggattacctctctctcctgtgcggccaagacttccgccacctggagccctcctatggctgcaagagccgcagccttgcccccgtagaggcttccatctgttccaggaacattggaggcaggggcaacccgtcctggtgtctggtattcagagaaccctccaggggaatctatggggaacagaagccctgggcgctctcgggggacaggtccaggctctatctccactgggccctcctcagcctagtagcttgggcagcactacattctgggaggggttttcctggcctgaactgagacctaaatctgatgagggcagtgtgcttctcctccacagggcactgggcgatgaggatacttccagagttgaaaatctggctgccagccttccacttccagaatactgcgctcttcacggcaagctgaacctcgcctcctatctcccgccagggcttgccctgcgcccactggaacctcaactgtgggccgcttacggcgtgtcacctcaccgaggccacctaggcaccaagaacctctgcgtggaggttgcggaccttgtgtcaattctcgtacacgcagatacccccctcccagcctggcaccgggctcagaaggatttcctctctgggctggacggggagggcctgtggagccctggttcacaggtcagcacagtgtggcacgtcttcagggctcaagatgcacaaaggatccggagattccttcagatggtgtgtcctgcaggtgcaggtgcactggaacctggggcaccaggcagctgctacttagacgcaggcctgcgcaggcgtctacgcgaagagtggggggtctcctgctggacgctgctccaggccccaggggaggcagtcctcgtgccagctggcgcacctcatcaagtgcaaggcttggtttccactgtcagcgtgactcagcactttctgtcaccggagactagcgccctgtcagcgcaattgtgccatcagggcccatcacttcccccagactgtcatctgctgtacgcacagatggattgggccgtgttccaagccgtgaaggtcgccgtcgggacgctgcaggaagctaaatag

SEQ ID NO: 225632 - DNA, 1410 bp, Artificial Sequence
  Description of Artificial Sequence: Synthetic coding sequence
atggctagccccagggaacttacacaaaacccccttaagaaaatttggatgccttacagcaacggtcgcccagcgttgcacgcatgccagaggggtgtctgtatgacaaactgtcccacactcatcgtgatggtcggtttgcccgctaggggcaagacgtatataagcaagaaactgactcgctacctaaattggataggagtgcccacgagggagttcaacgtgggacagtacaggagagatgtggtaaaaacatataaatcattcgagtttttcctgccagataatgaagaaggcctgaaaattagaaaacaatgtgcattggctgctctgcgggacgtgaggagatttctcagtgaagaagggggacatgtggcagtattcgatgccacaaacaccacccgtgagagacgcgctacgatctttaatttcggcgaacaaaacggctataagacattctttgtggagtcgatctgtgtcgatcccgaggtgattgcagccaatattgtgcaggtaaagctcgggagcccagactatgtcaatagagattcagacgaggcaacggaggatttcatgaggcgaattgaatgttatgagaattcatacgaaagcctggatgaggacctggatcgggatctgtcatacatcaaaatcatggacgtgggccaatcatacgttgtgaatcgcgttgcggatcacatccagagtcggatcgtctactatctgatgaatatacatgtcacccctcgcagcatttacttatgccggcatggggaatcagagctgaacctcaagggtcgcataggaggcgaccccggtttgtccccaagggggagggagtttgccaagagcttagctcagttcatctctgaccagaacattaaggatctgaaggtatggaccagccaaatgaagcgtacaatacaaaccgcagaggcccttggcgtgccttatgaacagtggaaggtgttgaatgagatcgatgccggtgtatgtgaggaaatgacttatgaggaaatccaggacaattatcccttagagtttgctctcagagaccaggacaagtataggtaccgctatcccaaaggagagtcatacgaggacctggtgcagcgactcgagccagtgattatggagctggagcgccaggagaacgtcctcgttatctgtcaccaggctgtgatgaggtgcctcctggcctactttctggataaagcagccgaacagttaccttacctgaagtgccccctgcacaccgtgctaaaactgacccctgttgcctacggatgcaaggtggagagcatcttcctcaacgttgccgctgttaacactcatcgcgatcgccctcagaacgttgacatttcccgccctcccgaagaagcgctcgtcacagtgcccgctcaccagtag

SEQ ID NO: 225633 - DNA, 522 bp, Artificial Sequence
  Description of Artificial Sequence: Synthetic coding sequence
atgggccttccgaggcgagctggcgacgcggcagagttacgaaaatcactgaaaccactgctggagaaacggagacgagccaggatcaaccaatccctgtctcagctgaaagggttgattctgcctctgcttgggcgagagaacagtaattgtagcaagctggagaaagctgatgttttagaaatgaccgtgaggtttctccaggagctccccgcttcatcatggcctaccgccgctcctcttccttgcgattcatatagggaggggtacagcgcttgcgttgctcggctggctagagtgcttcccgcttgccgcgtgttggaacctgctgtttcggctaggctgctggaacacctgtggcgtcgcgcagcatctgccaccttggacggtggcagggccggagattctagtggtccatctgcacccgctcccgcacccgcttcagccccagagcccgctagcgcacccgttccgtccccaccttcccccccatgtgggcctggcctatggcgcccttggtag

SEQ ID NO: 225634 - DNA, 231 bp, Artificial Sequence
  Description of Artificial Sequence: Synthetic coding sequence
atgggtctcccccgacgcgcaggggatgccgcagagctgagaaaaagccttaagcctcttctagagaagagaagacgtgcacgcatcaaccagtccctgtcccagctgaaggggctgatcttacccctcctcggacgggaggacgcctccggatggcacacgtggctacctctccatgcccagaattgctttctcctttatatccaggcccctgaacagcccccagcttag

SEQ ID NO: 225635 - DNA, 231 bp, Artificial Sequence
  Description of Artificial Sequence: Synthetic coding sequence
atgggccttcctagacgtgccggagatgcggcagagcttagaaagtcattgaagcctctgttagagaagcggaggagagctcgcatcaatcagagcttatcgcagttgaaagggttgatccttcctcttcttgggagagaagatgcctcgggctggcatacctggcttccattgcacgctcagaattgttttttgttatacattcaggcaccagagcagccaccggcatag

SEQ ID NO: 225636 - DNA, 561 bp, Artificial Sequence
  Description of Artificial Sequence: Synthetic coding sequence
atggagaaaaagcggagggctaggatcaacgtgagcctggagcagttgaagtcgctgcttgagaaacactactcgcaccagatacgaaaaaggaagctggagaaagccgacatccttgaattatctgtcaagtatatgaggtcgctccaaaattccttacagggactttggccagtgccgcgtggtgccgaacagccatcaggctttcgatcgtgcctcccaggcgtctcccagctgttgaggcgaggggacgaggtgggctctggcctgcgatgccctctggtgcctgagagcgcagctggtagcacaatggattctgccggtctaggtcaggaggcaccagctctttttaggccatgcaccccggcagtgtgggcccctgctcctgccgcagggggtccacggagcccccctcctttactcctgctgcccgaatctcttccgggaagcagcgcttctgtgcctcccccacagcctgcctcttccagatgcgccgagagtcctggcctgggactgagggtgtggcgtccttgggggagcccaggagacgacctcaactag

SEQ ID NO: 225637 - DNA, 666 bp, Artificial Sequence
  Description of Artificial Sequence: Synthetic coding sequence
atggccgcagatacccctgggaagccaagcgccagtcccatggcaggagctccggctagtgcttcaagaacacctgacaagcccaggtctgctgccgagcaccgcaaatctagcaagcccgtgatggagaaaaggcgaagggcgagaatcaacgaaagtctcgctcagctgaagacactcattctcgatgctctgcgaaaggagtcttcacggcactcaaaattagaaaaggccgatattctggagatgaccgtccgccacttgcgaagtctcagacgagtccaggtcacagccgctctgtctgctgatcctgctgtcttggggaaatatagagctggcttccatgagtgccttgccgaagtgaatcggttcttagctggctgtgagggcgtgcccgctgacgttaggtctcgcttgctgggccacctagccgcttgcctgcggcagctaggcccttctcggaggcccgcttccctgagccctgccgcacctgccgaagccccagctcccgaagtgtatgccggtagacctctgctgccttcactgggtggcccttttcctctgttggcccctcccttactgcccggactgacacgtgcactgccagcggctcctcgagctggcccacagggacctggtggcccttggaggccctggttgcgctag

SEQ ID NO: 225638 - DNA, 744 bp, Artificial Sequence
  Description of Artificial Sequence: Synthetic coding sequence
atggcagccgacactcccggaaaaccttccgctagtcctatggctggggcaccagcttcagcgtccaggacgcccgataaaccccgtagcgccgctgaacacaggaaggtgggcagccgtcccggtgtgcggggtgcgacaggcggaagggagggcagggggacccagcctgtccctgacccgcagagctctaaacctgttatggagaaaaggcggagagcacgcattaacgagagtttagcgcaactgaagacactgatcctcgatgcattgagaaaggagagcagcagacactccaaactagagaaggccgacattctggagatgacagtacggcatctgcgaagcttacgcagggtacaggtcaccgcagcactgagcgccgacccagccgtgcttgggaagtacagagccggattccatgagtgcctcgctgaggtgaatcggtttctggccggatgtgaaggagtcccagctgacgtcaggagccggcttctgggacatctcgcagcctgcctccgccagctcggcccttccagacgacccgcttcacttagtcccgcagcacccgcagaagcacccgctcccgaggtttacgccggtcgaccactcctcccaagcctaggaggaccattccctctgctagccccacctttattgcctggcctcacgcgcgcactaccagctgccccaagggcgggtcctcaggggccaggcggtccatggcggccatggctccgctag

SEQ ID NO: 225639 - DNA, 501 bp, Artificial Sequence
  Description of Artificial Sequence: Synthetic coding sequence
atggctccatctaccgtggccgtagagctactaagccccaaggaaaaaaatagactaaggaaaccagtggtagaaaagatgcgcagggacagaattaacagcagtattgagcaactcaagctgcttttggaacaagagtttgctcgacaccagccaaatagcaagctcgaaaaagccgacatcctcgagatggctgtgtcctacctgaagcactcgaaggcattcgtggccgctgctggccctaagtccttacatcaagattacagcgaaggttacagctggtgcttgcaggaggcagtacagttcctcactttacacgcagcatccgacacacagatgaagctgctctaccactttcagcgccctcccgcagcacccgcagccccagccaaggaacctaaagctcccggagccgctccgcctcccgcacttagcgctaaagcgactgctgccgctgccgctgctcaccagccagcctgcggcctgtggaggccgtggtag

SEQ ID NO: 225640 - DNA, 675 bp, Artificial Sequence
  Description of Artificial Sequence: Synthetic coding sequence
atggcaccccctgccgctcctggacgcgatcgagtgggccgagaagatgaagatggatgggaaaccaggggcgatagaaaggcaaggaagccactggtcgagaagaagaggcgcgcacgcattaacgagtctctccaggagctgaggcttctactagccggagccgaggtccaggcaaaactggaaaatgcagaggtgctcgagctgacagtgaggcgagtgcaaggagtgctccgcggacgggctcgcgagagagagcagctgcaggccgaagcttctgagcgcttcgccgctgggtatattcagtgcatgcacgaggtccatacattcgtctcgacttgtcaggccatagacgcaacggttgcggcagagttgctaaatcacctcctcgaatccatgccattgagggaggggagttcttttcaagatctcctgggcgatgcactggccggacctccacgcgcaccaggaagaagcgggtggcctgcaggcggagctccgggttccccgatcccatcaccgcctggacctggcgacgacctgtgcagtgacctggaggaggcccctgaggccgaactgtcccaggccccagcagaaggccctgatctcgtgccagctgcccttggatccctcactacagcacagatagccaggagcgtttggcggccttggtag

SEQ ID NO: 225641 - DNA, 645 bp, Artificial Sequence
  Description of Artificial Sequence: Synthetic coding sequence
atggcccctcccgcagccccaggccgtgatcgtgtaggccgagaggatgaggatggatgggagacacggggagaccgcaaagccaggaaaccactagtcgagaagaaaaggcgtgcacgcataaacgaatctcttcaagagttgagattgctgctggcaggagccgaagttcaggccaaactggagaacgcagaggtgcttgaactgactgtgaggagagttcaaggcgtcctgcggggaagggcccgtggtgagtggcgccgtgggggaagaggcagaagacctcgcgcacctgtcacacccgctcgtaggcgtacatcgttaccagcccctctgagctgtcggagacggggtttgccgccagaacagggagcccctcccaggcttctaggagagccacgaccccgtggtccaggcggacttgggcatgccgtggccgcacacagagcaggacgtggatctctgccccctacccttggacccagagcaagggctgccgcagggggaagtgagagagccttgaggtgtagactgcatccagtgcacgctaggggtgcacacgtgcgggtgcacgtgccaggacatcgacgctaccgccgttgtagggcccctgagcctagtgccagagtgcacgccgctgcttag

SEQ ID NO: 225642 - DNA, 669 bp, Artificial Sequence
  Description of Artificial Sequence: Synthetic coding sequence
atggcccctcccgctgcccctggcagagaccgggtcgggcgtgaagacgaggatggttgggaaacccgcggtgaccgtaaagccaggaagccgctcgtcgaaaaaaaacgcagggctcggattaacgagagcctacaagagctacgcctgctgttagcaggtgcagaggctaaactggaaaatgctgaagtgctcgagcttacggtgaggagggtccagggagtgctgcgaggtagggctagggagcgcgagcagctccaggctgaggctagtgagaggtttgccgcaggatacatccagtgcatgcacgaagtgcacacattcgtttccacctgccaggctattgacgcaacagtggccgctgagctgctgaaccacctacttgagtctatgcccctacgggaaggttcttctttccaggatctcttaggtgatgcccttgcaggacctcctcgcgcacctggcagaagcgggtggccagcagggggagccccagggagccccatcccaagccctccaggcccaggggacgatctgtgcagcgatttggaggaggcccctgaggcagaattgagtcaggctccagccgaggggccagacctggtccccgctgcactaggctccctgacaaccgcccagattgcaagatctgtctggcgcccatggtag

SEQ ID NO: 225643 - DNA, 678 bp, Artificial Sequence
  Description of Artificial Sequence: Synthetic coding sequence
atggttaccagagatcgcgcagagaaccgcgacgggcctaagatgctaaagcctctggtagagaagcgaagaagggatcgaatcaaccgaagtcttgaagagctgcgactgctgttgctagagagaaccagggaccagaatttacgcaatcctaagctggagaaggcggagattctggaatttgcagtgggctacctgcgagaaagatcaagggtggagcccccaggcgtgccgagaagtcctgtgcaggatgccgaggcactcgcaagttgttatctctctggattccgggagtgtctgctgcgcttagcagcattcgcacacgacgccagccctgctgctcgggcacagttgttctcagctctacacggataccttagaccaaagcctcctagacctaaacccgttgaccccaggccacctgcacccagaccttctttagacccagctgcccctgcactgggcccagccctgcatcagcgccctcctgtccatcaagggcaccccagtcccagatgcgcatggagcccctcactgtgctctcctcgggctggagattcaggggcaccagcaccgttgaccgggctactacccccacctccaccaccccacagacaggatggggcacccaaggccccactgccaccacctccggctttctggcgcccatggccttag

SEQ ID NO: 225644 - DNA, 693 bp, Artificial Sequence
  Description of Artificial Sequence: Synthetic coding sequence
atggttacgcgggatagggcagaaaacagagacgggcctaagatgttgaagcctctggtggagaagcgtagacgcgaccgcatcaaccgctccttagaagaattaaggctgctgctactggagagaacccgggatcagaatctgagaaatcccaagctcgagaaagcagagatcctggaatttgcagttggatatcttcgtgaacggtcccgcgtggaacccccagcagcggctgcaccaggtgtccccagatctcctgtccaagatgctgaggcccttgcatcgtgctacctgagcggtttcagggagtgcctacttcgactcgcagctttcgcccacgatgcctcacctgcagcaagagcgcagctctttagtgccctccatggttatctgcggcctaaacccccacggcctaaaccagtggacccgaggccccctgcgcctcgccctagcctggatcctgctgctcccgctcttggtcccgcactgcaccaaaggccacctgtacaccaggggcacccctctccacgttgtgcttggagtcccagtttgtgctctcccagagccggtgacagcggagctcccgcaccactcactgggctgctcccccctccaccaccaccccatcgccaggatggtgctccaaaggcacctcttccccctcccccagcattctggcggccatggccctag

SEQ ID NO: 225645 - DNA, 1014 bp, Artificial Sequence
  Description of Artificial Sequence: Synthetic coding sequence
atgaaacgcccatgtgaagagacaactagtgaatccgacatggacgagacaattgacgtggggagtgaaaacaattactccggccagtccaccagctccgtgattaggctgaactcacctactacgacctcccaaattatggctcgaaagaaaaggcgagggatcatcgagaaaagaaggagagataggataaataattctctctccgagctcagacgactggtgcctaccgccttcgagaaacaggggagcgccaaactcgaaaaggctgaaatattgcagatgaccgtggatcacctgaagatgttgcaggccaccgggggtaaagggtactttgacgcccacgcactcgcaatggacttcatgagcatcggatttagggaatgcctgacagaggtggctcggtatctgtcgagtgtggaagggctggatagttcagaccctctgagggtgcgccttgtgtcgcatctatcaacatgtgcgactcagcgggaggctgcagcaatgacttccagtatggcccaccatcaccaccccctgcacccacaccactgggccgctgccttccaccacctgccagctgccctgttgcagcccaatggtctccatgcgtctgagtcaaccccctgtaggctgagtacaacctcagaggtgccccctgcacatggtagcgcgctcctgacggctaccttcgcccatgccgatagcgctcttcgtatgcctagcacgggatccgtagccccatgtgttcctcccctgtccacttctctcctttcccttagtgctactgtccacgcagcggctgctgccgctacggccgctgcacacagtttcccgctgtctttcgctggggcttttcccatgctgccaccaaacgctgccgctgccgtggcggctgccaccgcaatctcaccaccactgagtgtgtctgccacatcatctccacagcagacatcttcggggacaaacaacaagccttaccgcccatgggggacagaggttggggcattctag

SEQ ID NO: 225646 - DNA, 876 bp, Artificial Sequence
  Description of Artificial Sequence: Synthetic coding sequence
atggcacggaagaagcgacgcggaattatcgagaagaggcgcagggataggatcaataacagtctgagtgaactgcgccgactggtccccacagcgttcgagaagcaagggagcgctaaattagaaaaagccgaaattctgcagatgaccgtggaccacttaaagatgctccaagccacggggggtaaagggtacttcgacgctcacgctttggccatggacttcatgtctatcggctttcgggagtgtctgactgaggtggcaagatacctgagctcagtggaaggtctcgactcctccgatcctttgcgggtcaggctcgtctcccatctgtccacgtgcgctacgcaaagggaagcggctgccatgacctccagcatggcacaccaccaccacccgttacatccccaccattgggctgctgctttccaccacctgccagcagcgcttctgcagcccaatggcttacacgctagcgagtctaccccttgccgtctgagcaccacttcggaagtgcccccagcgcacggttccgccttgctaaccgccacatttgcacacgcggacagcgcattacgcatgccatccaccggatccgttgcgccttgcgtgccgcctcttagtacctctcttctttcactcagtgccaccgttcatgcagccgcagcagcagccaccgccgcagcacactcctttcctctttcctttgccggtgcattccctatgctgcctcctaacgctgccgctgcagttgccgcagccaccgctatttcccctccattgtctgttagtgccaccagcagcccacagcagacaagctctgggaccaacaacaaaccatatcgaccctggggcactgaagtaggtgccttttag

SEQ ID NO: 225647 - DNA, 1221 bp, Artificial Sequence
  Description of Artificial Sequence: Synthetic coding sequence
atgtccgccttgggtgctgtgatcgccctgctgctctggggccagctatttgccgtggatagcgggaatgatgtaactgacattgccgacgacggatgtccaaaaccccctgaaatcgctcatggctacgttgaacactcagtacgttaccagtgcaaaaattactataaactgaggactgaaggagacggcgtctatactctgaacgacaagaaacagtggatcaacaaggctgtgggcgataagttgcctgagtgcgaggccgacgatggctgccccaaaccccctgagatcgctcacgggtacgtagagcactcagtgaggtaccagtgcaagaattattacaaacttcggacagaaggcgacggtgtttataccctcaataatgagaaacagtggattaacaaagccgtcggcgataaattacctgaatgtgaggccgtctgcggaaagccaaagaacccagcaaaccccgtgcagaggatcctgggaggacatctcgatgccaaagggtcatttccatggcaggctaaaatggtcagtcatcacaacctgactaccggggctactttgataaatgagcaatggttgctcacaactgcgaagaacctgttcttgaaccactctgaaaatgctactgctaaggatatagctccaacgctcaccctgtacgtcgggaaaaaacagttggtcgagatagagaaagtcgttttgcatcccaattacagccaggttgacattggactgatcaagctcaaacagaaagtgtcggtgaacgagcgtgtaatgcctatatgccttcccagcaaagactatgccgaagtcggcagggtgggatatgtttccgggtggggaaggaatgcaaacttcaaatttactgaccatttgaaatacgttatgttacccgttgccgaccaagatcagtgtattagacattatgaaggtagcactgtacctgaaaaaaagacaccaaaaagtcccgttggtgttcagcccattctaaatgaacacacgttctgtgctgggatgagtaagtatcaggaggatacgtgctacggagatgccggatcggcatttgccgtacacgatctagaggaggacacatggtacgctacgggcatcctttctttcgacaagtcctgcgcggtagccgaatacggcgtatacgtgaaagtgacctctattcaggactgggtgcaaaaaaccatcgctgagaattag

SEQ ID NO: 225648 - DNA, 1149 bp, Artificial Sequence
  Description of Artificial Sequence: Synthetic coding sequence
gtgtacgcctgtgtgtgtgtctgtgtgtacatgcacgtgtgcgtggacgcctgtatgtgttgtgaggctggccgactggcattccacagttccttgtcttccttatgctccgccttaggcgcagtaatcgccttgctgttgtggggccagttgtttgccgtggacagcggtaacgatgtgaccgacattgctgatgacggttgtcccaagccgcctgaaatcgctcatggctacgtggaacactcagtgagatatcagtgcaagaattattacaaactccgcacagagggcgatggagtgtacacattaaatgacaaaaaacaatggattaacaaagccgttggagacaaactgcccgagtgcgaagccgtgtgtgggaagcctaagaacccggcaaatcccgtccagagaatcttgggaggtcacttggatgcaaagggttcattcccctggcaggcgaagatggtcagtcatcacaatctgacaaccggggcaacactaatcaacgaacaatggctgctcactaccgccaagaacctgttcttgaaccactctgagaacgcaacggcgaaagatattgcgccaacgctcaccctgtacgttggcaaaaaacaattggtggagattgagaaggtagtgctgcaccctaattactctcaggttgacatcgggctcattaaactaaagcaaaaggtgtccgtcaatgaacgtgtgatgcctatctgcctgccctccaaggattacgccgaagtcgggcgtgtgggctacgtgagcggatggggcaggaatgccaatttcaagttcactgatcacctgaagtatgtgatgcttccagtggctgatcaagatcagtgcatacgacactatgagggatcaactgtgccagagaaaaaaacacccaagtcacctgtgggggttcagcctatcctgaatgaacacacgttctgcgccggaatgtccaagtatcaggaggacacttgttacggtgacgccggaagcgcgttcgccgtacatgacctcgaggaggacacatggtatgcaactggtatcctgtcatttgataagtcgtgtgcggtggctgagtatggcgtctacgttaaggtaactagcattcaggactgggtacagaagactatagcagagaattag

SEQ ID NO: 225649 - DNA, 1044 bp, Artificial Sequence
  Description of Artificial Sequence: Synthetic coding sequence
atgagtgcactcggtgcagtgatcgcccttctcttgtggggccagctctttgcagtggactccgggaatgacgtaacagacattgctgatgatgggtgccctaagccgcctgagatcgcccacgggtacgtggagcactccgttaggtatcaatgtaaaaactattacaaactcaggacagagggggacggggtctataccctcaacaacgagaagcaatggattaacaaagctgttggtgacaagttacctgagtgcgaggccgtatgtgggaaaccgaaaaatccggctaaccctgtccagcgcatcctgggtggacatttggatgcaaaaggctcattcccatggcaggctaaaatggtctcccaccacaacctgaccacgggcgctacactaatcaatgaacaatggctgctaaccaccgccaagaacttgttcctgaatcacagtgaaaacgcgactgctaaggacatagctcccactctcaccctgtatgtcgggaagaaacaattggtggagatcgaaaaagtagttctccacccaaactattcccaggtggatatcggactcatcaaactaaagcaaaaggtctctgtcaatgaaagggtcatgcccatctgcctccccagcaaggactatgcagaggtgggcagagtcgggtatgtgagcggctggggtcgaaacgctaactttaaatttactgatcacttgaagtacgttatgctccccgtggcagaccaggaccagtgtattaggcactatgaggggtcgaccgtacctgagaagaagactcctaagtccccagtgggggtccagccgattctgaacgagcacacattctgtgcaggtatgtctaagtaccaggaggatacatgctatggtgacgctggatccgctttcgctgtgcacgacctggaggaggacacctggtacgctacgggtatcttatctttcgacaaaagttgtgcagtagcagagtatggcgtgtacgttaaagtgactagcatccaagactgggtgcaaaagactatagcagaaaactag

SEQ ID NO: 225650 - DNA, 846 bp, Artificial Sequence
  Description of Artificial Sequence: Synthetic coding sequence
atgtcacggatctcccaaatgactgccgcacggtccccaccccgactgcatatggctatgtggtccaccagatttgcgacgagtgtccgaactaatcccgtgcagcggatactggggggacatcttgacgctaaagggtcatttccctggcaggcaaaaatggtgagtcaccacaatctgacaacaggcgctaccctgatcaacgagcagtggctattgacaacagctaaaaacctttttttgaatcactccgaaaatgcaaccgctaaagacattgcaccaacactcaccctgtacgtgggcaagaaacaactcgtggaaatcgagaaagtggtgctgcacccaaattatagccaggttgatataggcctcatcaaactaaaacagaaggtgagcgtaaatgagagagttatgcctatttgcctaccttcaaaagattatgctgaagtaggtagggtgggatacgttagcggatggggcaggaatgcgaattttaaattcactgatcacctgaagtatgtaatgctgcctgtggccgaccaggaccagtgcatccgccactacgagggatccacagtgcctgagaaaaaaacaccaaaatccccggtgggagttcaaccaatcttgaacgaacacacattttgtgccggtatgagcaagtatcaggaggatacatgttacggcgatgcagggagtgcatttgctgttcatgatctcgaagaggacacctggtacgccacaggcattctgtcattcgacaagtcttgtgctgtggctgagtatggggtctacgttaaagttacgagcatccaagattgggtgcaaaagacaatcgctgagaactag

SEQ ID NO: 225651 - DNA, 552 bp, Artificial Sequence
  Description of Artificial Sequence: Synthetic coding sequence
atgtcagccgctcgcgagtctcacccgcatggtgtgaagcgcagcgcttccccggatgacgacctgggcagttcaaattgggaagcagccgaccttggcaacgaagaacgcaagcaaaagttccttcggctgatgggagctggcaagaaagagcatacaggccgactggtaataggtgatcataagtcaacaagtcatttcagaacaggcgaagaagacaagaagatcaacgaggaactggagtcccagtaccaacaaagcatggacagtaagctctccggccgttacagaaggcactgcggtcttggattctctgaagtagaggatcatgatggagagggggacgtggcaggggatgatgacgacgacgatgatgattccccagatcccgagagtcctgacgacagcgagtcggacagcgagagtgaaaaggaggaatcggctgaggagctccaggctgcggagcacccagacgaagtcgaggaccccaagaacaaaaaggacgctaaatcaaactacaaaatgatgttcgttaagtcttctgggtcctag

SEQ ID NO: 225652 - DNA, 1047 bp, Artificial Sequence
  Description of Artificial Sequence: Synthetic coding sequence
atgagtgacctgggagccgtaattagccttcttctatgggggcgtcagttgttcgctctctacagcggcaatgatgtgaccgacatcagcgacgacaggttccctaagccccctgagatagctaacggttacgtggagcatctgtttcgatatcagtgcaagaactattacaggctgcgcacggagggcgatggtgtgtacaccctgaacgataagaaacagtggataaacaaggccgttggcgacaaattgccagagtgtgaggccgtatgtgggaagcctaaaaatcctgctaaccccgtccaaaggatcctgggcggtcacctggatgccaagggttcttttccctggcaagctaaaatggtcagtcatcataatctgacaactggggcaactttgataaatgagcagtggctccttaccaccgcaaaaaatctattcctgaatcactccgagaatgctaccgcaaaggacatcgcccctacactaactctgtacgtcgggaaaaagcagctggtagagattgagaaggttgtcctccacccgaactaccaccaggtggacatcggcctgataaagctgaagcagaaggtgctggtgaacgaaagggtcatgcctatctgtctaccctccaaaaattatgcagaagttggcagggtggggtacgtgagtggatgggggcagtccgacaatttcaaactcactgaccatctcaaatacgtgatgcttccggtggccgatcagtacgactgtataactcattacgagggaagcacttgtcccaagtggaaagcacctaagagcccagtgggagtccagcctattctgaacgagcacacattttgcgtcggaatgagtaaatatcaggaagacacttgttatggcgatgcagggtctgcgtttgcagttcatgacctcgaggaggacacatggtacgccgcaggcattctaagttttgacaagtcttgcgccgtggccgagtacggtgtctacgtcaaagttaccagcatccagcactgggttcaaaaaaccatagctgagaactag

SEQ ID NO: 225653 - DNA, 1047 bp, Artificial Sequence
  Description of Artificial Sequence: Synthetic coding sequence
atgtccgatcttggcgctgtcatcagcctgttgctatggggcagacagctgttcgccctttacagcggcaatgacgtaaccgatatctccgacgacaggtttccgaagccccctgagattgccaatggctacgtcgagcacttattccgatatcaatgcaaaaactactacaggctccggaccgagggagacggcgtgtatacgctgaacgacaagaagcaatggatcaataaggcggtgggagataaacttcctgaatgtgaagccgtatgtggtaaaccaaagaatcccgctaatccagttcaaaggatcctcggcggacatttggacgccaaagggtcttttccatggcaggccaagatggtctcccatcacaatctgacaaccggagccactctgattaacgagcagtggctcctgacaaccgcaaagaacctattcctcaatcactcggaaaatgctacagccaaagacatcgccccaacgttgactctgtacgtgggcaaaaaacagctggtcgagattgagaaagtcgttctacacccaaactatcatcaggtggacattggcttgatcaaattaaaacagaaagtgctggtaaatgaaagagtgatgcctatctgtctgcctagcaagaactacgcggaagtcgggcgagtagggtatgtgtccggttgggggcagagcgataactttaagcttaccgatcacctcaagtatgtaatgctgcccgtcgcagatcagtatgattgcattacccattatgagggttccacctgtccaaagtggaaggccccaaagagtccggtgggcgttcagcctatcctcaacgagcatacgttctgtgtcggaatgagcaagtatcaggaggatacctgctatggcgacgccggatccgcttttgcagtccatgacttggaggaggacacctggtatgccgctggaatattaagcttcgataagagctgtgctgtggccgagtatggcgtttacgttaaggtgacttccatccaacattgggttcagaaaaccattgcggagaactag

SEQ ID NO: 225654 - DNA, 615 bp, Artificial Sequence
  Description of Artificial Sequence: Synthetic coding sequence
atggcagctgccaacccttgggaccccgctagtgctcctaatggggctggattggtgcttggccactttattgcttctggaatggtcaatcagaagaatctcgagattgagctgctcaagcttgaaaaggacaccgcagacgtggtgcacccctttttcctcgcccaaaagtgtcataccctgcagagtatgaataatcacctggaagcggtgctgaaggaaaagcgctccctgcgccaacggctccttaagcccatgtgccaagaaaacctgcccatcgaggccgtgtaccatcgctatatggttcatctgctcgaacttgcagttacattcatcgagcggttagaaactcatctggaaacgatcaggaatatcccccaccttgccgcaaatctaaagaaaatgaaccaggctcttgcgaagatggatatcctcgtgaccgagacggaagagctcgctgaaaatattcttaagtggagaaagcagcagaacgaggtatcctcttgcattcccaaaatactggccgaagagtcttacctctacaagcatgacattattatgccaccactgcccttcacttctaaagttcacgtgcagacaatcaacgctaagtag

SEQ ID NO: 225655 - DNA, 837 bp, Artificial Sequence
  Description of Artificial Sequence: Synthetic coding sequence
atggaacctcaggaagagcgagagacccaggtggctgcatggctcaagaagattttcggagaccaccccatcccccagtacgaagtgaacccccgaactacagagatccttcaccacttaagcgaacgcaatcgcgtgcgtgatagggacgtctatctggtgattgaggatttgaaacagaaagcctcagagtatgagagcgaagccaagtacctccaggatctactgatggaatccgtcaattttagtccagcaaacctatcctccacaggctccaggtacctaaacgccctagtcgactccgccgttgcgctggaaactaaagacaccagcctggcttcgttcatcccggctgtaaacgacctgactagtgatctgtttcggacaaaaagcaaaagtgaggaaatcaaaatcgaattagagaagctggaaaaaaatctgacagccactctcgtcctagaaaagtgtctgcaagaagacgtcaagaaggccgaactgcacctttccacagagagggctaaggtcgataatcgcagacagaatatggactttttgaaggccaaatcagaggaattccgatttggtattaaagcagcggaagaacagctttccgcccgtggtatggatgcaagcctgagtcaccagagcctcgttgccctcagcgagaaactagctagactgaagcagcagaccatacccttaaagaaaaagcttgaatcctacctggacctcatgcctaacccgtctctggcccaggtaaagattgaggaggccaaacgggaactcgactccatcgaggccgagctgacacgacgtgtcgacatgatggaactttag

SEQ ID NO: 225656 - DNA, 708 bp, Artificial Sequence
  Description of Artificial Sequence: Synthetic coding sequence
atggccgctgccaacccctgggatcctgccagcgcccctaatggggcaggcctggtcctcggtcacttcattgcctcaggcatggtcaatcaagagatgctgaacatgagtaaaaagactgtgtcatgctttgttaattttactcgtctgcagcagataaccaacatccaggcggaaatttaccagaagaacctcgaaatagagctgcttaagctcgagaaagatacagcagatgttgtccatcccttttttctagcccagaaatgtcatactctgcagtccatgaataatcatctagaagcggtcctgaaggaaaaaagaagtctcaggcagcggctgctgaaaccaatgtgccaggagaacctgcccatcgaagccgtttatcatcgatatatggtacacttgcttgaactggcagtaacttttattgagagactggaaacacaccttgagacaataaggaacattccccacctggctgccaatctgaaaaagatgaatcaggccctcgcaaagatggacatcctcgtgacagagacagaagagctcgctgagaacatcctgaaatggagaaaacagcagaacgaagttagctcatgcattcctaagatccttgcagaggagagttacctttacaagcacgacattattatgccgcctctgcctttcaccagcaaggttcatgtgcaaacgattaacgccaaatag

SEQ ID NO: 225657 - DNA, 615 bp, Artificial Sequence
  Description of Artificial Sequence: Synthetic coding sequence
atggccgctgctaacccctgggaccctgcgtcggcccctaatggtgccggactggttctcggacattttatagctagcgggatggttaaccaaaaaaatttggagattgaactgctgaaactggaaaaagacactgctgatgttgtacaccctttttttctcgcacagaaatgtcacacacttcagtccatgaataaccatctggaggccgtgcttaaggagaaacgttcactgcgccagaggctgctgaagccgatgtgtcaggagaatctaccgatcgaagcagtgtatcatagatacatggtccatttgttggagctggcggtgaccttcattgaacgactggaaacccaccttgagaccatccggaatatcccgcatcttgctgcaaacctgaagaaaatgaatcaggccctcgccaagatggatattcttgtcactgaaactgaggaactggccgagaatatcctgaagtggcgaaagcagcaaaatgaagtgtcttcatgcattcccaaaatactcgccgaggaatcgtacctttacaaacatgatattattatgccacccctaccattcacctcaaaagtccatgttcagacgattaatgccaaatag

SEQ ID NO: 225658 - DNA, 1812 bp, Artificial Sequence
  Description of Artificial Sequence: Synthetic coding sequence
atgtcctgcgggaatgagtttgtagaaaccctgaagaaaattggctacccaaaggctgataatttgaacggagaagacttcgactggctgtttgaaggtgttgaagatgagagtttccttaagtggttttgcgggaacgtgaatgagcagaacgttcttagcgaacgcgaactggaagcgtttagtatactccagaagagtggaaagccgatcctggagggagctgcccttgacgaagccctgaaaacctgtaagacgtcggacctcaagactccccgtttggatgacaaggagctggaaaagctggaggacgaagtccagaccttactcaaattgaaaaatctgaaaattcagagaagaaataagtgccagttaatggccagcgtaacctcacataaaagtctaagattgaatgcgaaagaagaggaggctaccaaaaagctgaaacagtctcaggggatattgaatgctatgattacgaagatctccaatgagctgcaagcactcaccgatgaggttacccagctaatgatgttctttcgccattccaatctcggacagggcacgaaccccctggtttttttaagccagttcagcttggaaaagtacctgagccaagaggagcaatctaccgcagctttgactctttacactaagaagcagtttttccagggcattcacgaggtagtggagagcagtaacgaggataatttccagctattagatatccagaccccgagtatttgcgataaccaggaaattctggaggagcgtcgcctcgaaatggcccgactgcagctggcctacatatgtgcacagcaccagctcatccacctcaaggcaagcaattcctcaatgaagagttccataaaatgggccgaagagagcctccatagcctcaccagtaaagccgtcgacaaggaaaatctggacgccaagatctcatcgctgacctctgaaattatgaagttggagaaagaggtgacccagattaaagaccgatctctgccagctgttgtccgagagaatgcacagttgctgaatatgccagtcgtcaagggagatttcgacctacagatcgctaaacaggattattatactgctaggcaggagctggtactcaaccagctgattaagcagaaagcctctttcgagctgctccagttgagttacgaaatcgaacttcgcaaacaccgcgatatttataggcaactggagaatctggttcaggagctgtcccagagcaatatgatgctttataagcagctcgaaatgttgactgatccatctgtgtctcagcaaattaatccccgaaatacaattgacaccaaggattactccacacaccggctgtatcaggtgttggagggtgaaaacaagaaaaaggagctattcttgacccacggcaatttggaggaggtggctgagaagctgaaacagaatattagcctggtgcaggaccagctggccgtgtccgcccaggagcactctttcttcctgagcaagagaaataaagatgtcgacatgctgtgtgacacattgtatcagggtggcaaccagttacttctgtccgatcaggagttgacagaacagtttcacaaagttgagtcccagcttaataagttgaaccatttgcttaccgacatactcgccgacgttaagacaaagcgaaagacactggcaaataataaactccaccagatggagagggagttttatgtctactttctgaaggacgaggactacctaaaagatatcgtggagaatctggaaactcagagtaagattaaagctgtgtccctggaagactag

SEQ ID NO: 225659 - DNA, 1812 bp, Artificial Sequence
  Description of Artificial Sequence: Synthetic coding sequence
atgagctgcggtaacgaattcgtggaaacacttaagaagataggctacccaaaagccgacaatctgaacggggaggatttcgactggctgtttgaaggagtagaagacgagagcttcctgaagtggttctgtggaaacgttaacgagcaaaatgtcttgagcgagagagaattagaggcatttagtatcctgcagaaatccggaaagcctatcctggagggagccgctctggacgaggcactcaagacctgtaagaccagcgatcttaagactccaaggttagatgataaagaattggaaaagctggaagatgaggtgcagaccctattgaagttgaagaatctcaagatccagaggaggaacaaatgccaacttatggcaagcgtaacgtcccacaaatccctgcggttaaacgctaaagaagaggaggccacaaagaagcttaagcagtcgcaaggcattttaaacgccatgatcacaaagatcagtaacgagctgcaggctctcaccgacgaagtcacccaattaatgatgttctttcggcatagcaatctgggacaggggaccaatcccctggtttttctctcccagttttctctcgagaaatacctgtctcaagaggagcagagcacggctgccttaaccctctatacaaaaaaacaattctttcagggaatccacgaggtcgtcgagagcagcaatgaggataacttccagctgttggatatccaaaccccgagcatctgtgacaaccaggagatactcgaggagcgtcgccttgagatggccagactccaactcgcctacatttgtgcccagcaccagctgatccatctgaaggctagcaactcctctatgaaatcctcaatcaagtgggcggaggagagccttcacagcctgacttccaaggccgttgacaaggaaaatttggatgctaagattagtagcctgacatcagagatcatgaaattggagaaagaggtcacacagatcaaggatcgtagccttcccgcagtcgtccgagagaacgcccaattgctgaatatgcctgtcgtgaagggcgacttcgatttgcagatcgccaagcaggattactatacagcaagacaggaacttgtcttgaatcagctcatcaagcaaaaagcgtcattcgaactgttgcaattgtcttatgaaattgagctcagaaaacaccgtgatatttaccgacaacttgaaaacttagtccaggagttgtcacagtccaacatgatgctctataagcaactcgagatgctgactgatccatcagtgtcccagcagataaatcctcgaaacactattgacactaaagactattccacgcaccgactgtaccaagtgctggaaggggaaaacaaaaaaaaagagctcttcttaacacacggcaacctggaagaagtggctgaaaagctgaaacagaacattagtctggtgcaggaccaacttgcggtttccgcccaagagcattctttttttctgtccaaaagaaataaagatgtcgacatgctgtgcgataccctgtaccagggaggcaaccaactgctgctgtccgatcaggagcttaccgagcagtttcataaggtggaaagccagttaaacaaactgaatcacctgcttactgatatcctagctgacgttaagacaaagcggaaaaccctcgcaaacaacaaactccaccagatggagagagagttctacgtctacttcctgaaagacgaggattatttgaaagatattgttgaaaacctggagactcagtcgaagatcaaagctgtttcgcttgaggattag

SEQ ID NO: 225660 - DNA, 33 bp, Artificial Sequence
  Description of Artificial Sequence: Synthetic coding sequence
atgagttgcgggaacgaatttgtggagacatag

SEQ ID NO: 225661 - DNA, 102 bp, Artificial Sequence
  Description of Artificial Sequence: Synthetic coding sequence
atgagttgcgggaatgagttcgtggaaacattgaaaaagatcggctacccaaaagccgataacctgaacggagaagatttcgactggcttttcgaagggtag

SEQ ID NO: 225662 - DNA, 456 bp, Artificial Sequence
  Description of Artificial Sequence: Synthetic coding sequence
atgggcaagcgacctaatctgctcgctttgcagctctcagactcaaccctggcagacatcatcgccaggctgcaggccggacagaaactgtctggctcgtccccgtttagtagcgccttcaattctctctcactcgataaagagagtggactgctcatgtttaaaggagacaagaagccgcgtgtctgggtcgttcctactcagctgcgtagagacctgatcttttcagtgcacgacatcccactgggcgctcaccaaaggccggaagagacttataaaaaactgcgtttgttgggttggtggcccggaatgcaggaacacgtgaaagattattgtcgttcctgcctcttctgtattcccagaaacctaattggaagtgagcttaaagtgattgagtctccaccagcatccgtgctgcgaggtcagggtgtatgcaacaggagcggaaccagatag

SEQ ID NO: 225663 - DNA, 957 bp, Artificial Sequence
  Description of Artificial Sequence: Synthetic coding sequence
atggcatctggggatttttgcagtccgggagaaggaatggagatcctgcaacaggtgtgtagcaaacagttaccaccctgcaacctttctaaggaggatttacttcaaaacccatacttcagcaagctgcttctgaatttatctcagcacgtcgacgagtcgggattgagtctgactctggccaaggaacaggcgcaggcttggaaggaggtgcgacttcacaagacaacatggttgcgttcagagattctccaccgcgtgattcaggagttgcttgtagattactacgttaaaatccaggatacaaacgtgaccagtgaagacaaaaaggattttgtttggatgcgcgctcgattacagcaggaggtggaagagcagctgaagaaaaaatgctttacactattgtgttattatgaccccaattcagatgcagacagcgagactgtaaaggcggcaaaagtctggaaactcgccgaggtgttagtaggggagcagcagcagtgtcaggacgcgaaatctcagcagaaagagcagatgttgctgttggagaagaagtcggcggcttattctcaagtgttgctgcggtgcctgacactgctccagagactgctgcaggagcataggctcaagacccagtcggagttggataggattaacgcacaatacctcgaagtgaagtgcggggctatgatcctgaagttgaggatggaagagttgaaaatcctcagcgacacttataccgtggagaaagtcgaggttcaccggctgattcgcgatagacttgagggagcgatccacctgcaggaacaggacatggaaaactctagacaggtgttgaatagttacgaggtcttgggtgaggagttcgacagacttgtgaaggaatacactgtattaaaacaggctaccgagaacaagcgctgggctttgcaagagtttagcaaggtctatcgttag

SEQ ID NO: 225664 - DNA, 714 bp, Artificial Sequence
  Description of Artificial Sequence: Synthetic coding sequence
atggctagcggggatttctgcagccccggagagggcatggagatcctgcagcaagtgtgttctaagcagctgcctccttgtaatctctcaaaggaagatctcctccagaacccttattttagcaagctgctgctaaacctaagccagcacgtggacgaaagcggactttctttaacacttgctaaggagcaggcgcaggcctggaaggaggtgcggcttcacaagacaacatggctgcgctcggaaatactgcaccgggtcatacaggaattgttagttgactactacgtcaagatccaggatactaacgtgaccagtgaggacaaaaaagttctgctgcgctgtctgacgctcttgcagagactgctgcaggagcataggctgaagacacaatctgagctcgacagaatcaatgcccagtatctcgaggttaagtgcggcgcaatgatacttaaactacgaatggaggaactcaagatactgagcgacacctatactgtggagaaggtggaggtgcatcgactgataagggatcgactcgagggcgcaattcaccttcaagagcaggatatggaaaatagtaggcaggttctgaatagctatgaagtgctgggagaagaatttgatagacttgtgaaggagtataccgtgctcaaacaagccaccgagaataaacgctgggcgttgcaggagttctcgaaggtttacagatag

SEQ ID NO: 225665 - DNA, 714 bp, Artificial Sequence
  Description of Artificial Sequence: Synthetic coding sequence
atggcctccggcgacttctgttctccgggtgagggaatggagattcttcagcaggtctgctcaaaacagctgcctccctgtaacctgtccaaagaagatctcctgcagaacccctacttttccaaactccttcttaacttgtcacagcacgtcgacgaatccgggctgtcactgaccttggccaaagagcaggctcaggcctggaaagaggtccgactccacaagactacttggttgcggagtgaaatcctccatagggtgatccaggaacttctggtggactactatgtgaaaatacaggacaccaatgtgacatcagaggacaagaaggttctgttgaggtgtctgactctcttacagagactcctgcaagagcataggctcaagacccagagcgaactggatcgaatcaacgcccaatacctcgaggtgaagtgcggcgctatgatcctgaagttgaggatggaggagttgaaaatcttgagcgacacttacaccgtggagaaggtagaagtacatagactcatccgagaccgacttgaaggcgctatacacctccaggagcaggacatggagaactcacgccaggtgctcaactcttacgaggtcttaggagaagagttcgatagactggtgaaagaatacaccgtgctgaaacaggccacagaaaacaagaggtgggcactgcaggaatttagcaaggtgtaccgatag

SEQ ID NO: 225666 - DNA, 720 bp, Artificial Sequence
  Description of Artificial Sequence: Synthetic coding sequence
atgcgtttgctcggcccttctcaagagagagagattccacccctgcttggcttagagaaggctgatctgttagaattgatgccactatcagaagacttcgtatggatgagggcaaggctacagcaggaagtggaggagcagttgaagaaaaaatgttttactctgctctgctactatgacccaaattcagacgcagactcagagaccgtgaaggccgctaaggtttggaagttggccgaagtgttggtgggtgaacaacagcagtgtcaggacgccaagtcccagcagaaggagcagatgctcctcttagagaagaaaagcgccgcttacagccaggttctgctgcgctgtctcacactgctgcaacgacttctccaggagcaccggctgaagacgcagtcagagctggaccgtatcaacgcccaatatctggaagtcaagtgcggcgcaatgattctgaagttgaggatggaagagctgaagatactgtccgatacttacactgtggagaaggtcgaagtgcacagactcattcgcgatcgcctagaaggggcaattcatctccaggagcaggacatggagaacagtaggcaggtgctcaatagctacgaggtccttggcgaggaatttgaccggttggttaaagagtacacagtgctgaagcaggccacggagaataaacgatgggctctgcaggagttcagcaaagtctaccgctag

SEQ ID NO: 225667 - DNA, 1092 bp, Artificial Sequence
  Description of Artificial Sequence: Synthetic coding sequence
atggcgagcggggacttctgcagccccggtgaggggatggagatcctgcaacaggtgtgttccaaacaactgcccccttgcaatctgagcaaggaagatcttctgcagaatccctacttttcaaaacttctgttaaacttatcacagcatgtggacgaaagcgggctttccttgactctggcaaaagagcaggcccaggcctggaaggaggtaagactccataagactacctggctacggagcgagatcttacatagggttatccaggaattattagtggattactacgtcaagatccaggacacaaatgtcacatcagaagataagaaattccatgagaccctggagcagagacttttggtcaccgagttgatgcgcctgctggggcctagccaggagcgggaaatcccccctttgctggggctcgaaaaggccgatctgctagagctaatgcccctgagcgaggacttcgtatggatgagggcaagactgcagcaagaagtagaggaacagcttaagaagaagtgtttcaccctcctatgttactacgaccctaattcagacgccgactcagagaccgttaaagcagctaaagtttggaagctggcagaggttctagtcggtgagcaacaacaatgtcaggacgcaaagtcacagcaaaaggagcagatgctgctactcgaaaagaaatctgccgcttactcacaagtcctgctcaggtgcctgactcttctgcagcgtctcctgcaggagcatcgcctgaagacacagtccgaactggataggataaacgctcagtacctcgaggtcaaatgtggggcaatgattctaaaattaaggatggaggagttaaagatcctcagtgacacgtacactgtcgagaaggtggaggtgcaccgacttatccgtgacaggctggagggcgctattcatctgcaggagcaggacatggaaaacagccgtcaagtgctgaatagctacgaggtcctgggtgaggagtttgatagactcgtcaaggagtacaccgtcttgaagcaggcgaccgaaaataagcggtgggctttacaagagttttcaaaggtgtatcgctag

SEQ ID NO: 225668 - DNA, 54 bp, Artificial Sequence
  Description of Artificial Sequence: Synthetic coding sequence
atgcggcttttaggcccatcacaggagcgggaaattccccctctactaggttag

SEQ ID NO: 225669 - DNA, 564 bp, Artificial Sequence
  Description of Artificial Sequence: Synthetic coding sequence
atggcatccggcgacttttgctctcctggcgagggaatggaaatcctccagcaggtgtgcagcaaacaactcccaccatgtaacctatctaaggaggatctgttacagaacccttatttctccaagcttctacttaacctatcccagcacgttgatgagagcggattatcacttactctagcaaaggaacaggcccaggcgtggaaggaggtccgacttcacaagacaacttggctccgttccgagatactgcaccgggtcattcaggagttgctggtggattactatgtgaagattcaggacaccaatgtgaccagtgaagataagaaatttcacgaaacactcgaacagcgactcctggtcaccgagctgatgcgactgcttggcccatctcaggaaagagagatacctcccctgctggggttggaaaaagctgatctgctggagcttatgcctctaagcgaagattttgtgtggatgcgcgcacgacttcagcaggaagtggaagagcaactgaagaagaagtgctttacgctgctgtgctattacgacccaaacagctag

SEQ ID NO: 225670 - DNA, 840 bp, Artificial Sequence
  Description of Artificial Sequence: Synthetic coding sequence
atggcctctggcgacttttgttcgcctggggagggcatggagatattacagcaggtttgctcaaaacagctccctccatgtaacttgtctaaggaagacctccttcagaacccatatttttctaagctgttactgaatttgtctcagcacgtggacgagagcggactgtctttgactttggccaaagaacaagcccaggcatggaaagaggtccgcctccacaagacaacatggctgaggagcgaaatcttacatagagtaatccaggagctcctagtagactattacgttaaaattcaggacaccaacgttacaagcgaggataagaagttccatgaaacactcgagcagcgcttgctggtgacggagcttatgagactgttggggccatctcaggaaagggagattccccctctcctaggacttgaaaaggcggaccttctggagctgatgcccctgtctgaggatttcgtttggatgagagctcgcctgcagcaggaagtcgaggagcagctaaagaagaagtgctttacactgctttgctattacgatccaaactcagatgcagatagcgaaacggtgaaggctgctaaagtgtggaagcttgcagaagtgttggtgggagaacagcaacagtgccaagacgcaaaatcccagcagaaagagcagatgctactgttggaaaaaaaatcagcagcatattcccaggtgctgctgcgttgtctcacacttctccagagactgctgcaggagcatcgcctgaaaacccaaagcgagctcgacagaatcaacgcccagtatctagaagttaagtgcggggcaatgatactcaaattatag

SEQ ID NO: 225671 - DNA, 957 bp, Artificial Sequence
  Description of Artificial Sequence: Synthetic coding sequence
atggcctccggtgatttctgctcccctggcgaaggcatggagattctgcagcaggtgtgcagtaagcagttgccaccatgtaacttgagtaaagaggacctgctgcagaatccgtacttcagtaagctcttattgaatctgagccagcatgttgacgaaagcggtttaagcttgaccttggccaaagaacaggcccaagcatggaaggaagtcagactgcataagaccacttggttgagatctgagattctccaccgagtaatacaagagctgttggtggattattacgttaaaattcaggacaccaatgtgacttctgaagacaaaaaagattttgtatggatgagggccaggctgcagcaggaagtggaggaacagttgaagaaaaagtgttttactctgctctgttactacgaccctaacagcgatgcagactccgaaacggtgaaggccgctaaggtatggaagctcgccgaggtgctggtgggagagcaacagcaatgtcaggatgccaagtcccaacaaaaggaacagatgctcctgctggaaaagaagagcgctgcatacagccaggtcctcctgagatgtttgacacttctgcaacggctgctccaagagcatcgtctgaaaacccaaagtgagctcgaccggataaatgcccaatatctggaggtgaaatgcggggctatgattcttaaactgcgtatggaagaactaaagatcctgagtgacacttataccgtcgaaaaagtggaagtacaccgactgattagagataggctcgagggtgctattcatctccaagagcaggatatggaaaactcgcgccaggtgcttaactcctatgaggtgctaggagaagagtttgacagacttgtgaaagagtataccgttctgaaacaagctactgagaacaagcgatgggctctgcaggagtttagcaaggtgtataggtag

SEQ ID NO: 225672 - DNA, 957 bp, Artificial Sequence
  Description of Artificial Sequence: Synthetic coding sequence
atggccagcggagacttctgttcacccggtgagggtatggagattctgcaacaggtgtgtagcaaacagctccccccttgtaatctctcgaaggaagatctgctccaaaacccatattttagcaaactgctgcttaacctttcccagcatgtcgacgaatcaggactgtcactgaccctggccaaagagcaagcccaggcctggaaggaagtccgcctgcataagacaacctggttaagaagtgagatcctgcaccgggtgatccaagagctgctggtagattactatgtaaaaatccaggatacgaacgttacctcagaagacaaaaaagactttgtgtggatgcgagcaagactacagcaggaggtagaagaacagctgaagaagaaatgctttacgcttctctgctactacgatcccaactcggacgccgacagcgaaaccgtaaaggccgcaaaggtctggaaattagccgaggtcttggtcggagagcaacaacagtgccaggacgccaaatctcagcaaaaagagcagatgctgctgctggaaaagaaatccgctgcatacagtcaggttctcctgaggtgcctgactctgcttcagaggctgttacaagaacatcggctgaagacccagtcggaactggacaggataaacgcccagtacctcgaagtgaaatgtggtgcgatgatccttaaattaaggatggaggagttaaaaattttaagcgatacctacacagtggaaaaagtggaagttcatcggctgatccgggaccgactggagggagccattcacctacaggaacaggacatggaaaattctcgacaggtcctcaattcctacgaagtactgggagaggagtttgaccgattggttaaagagtacacagtcctcaagcaggccaccgagaacaaacgatgggcgctccaggagtttagcaaggtgtatagatag

SEQ ID NO: 225673 - DNA, 483 bp, Artificial Sequence
  Description of Artificial Sequence: Synthetic coding sequence
atggcaagcggagacttttgcagtcctggagagggtatggaaatactccagcaggtatgctccaagcagctgccgccttgtaatctgtcaaaagaggatttgctgcagaacccgtatttctctaaactcttgctgaatctgtcacagcatgtggacgagagcggtctgagtttgacactggctaaagagcaggcacaggcctggaaggaggtccggctccacaagacaacatggctgcgctccgagattctccatcgagtgatacaagagctcctggtggattactatgtgaagatccaggacactaatgtgacctccgaggacaagaaattccatgaaactttggaacaaaggctgctggtcaccgaactgatgcgactcctgggtccaagccaggagagagagattccccctctattgggtctcgagaaagcagacctgctcgaactgatgcccctgagtgaggattttgtttggatgtag

SEQ ID NO: 225674 - DNA, 1902 bp, Artificial Sequence
  Description of Artificial Sequence: Synthetic coding sequence
atggaactagcccaggaggcgagggagctgggttgttgggccgtcgaagagatgggcgtacctgttgcagctagagctccagaatccactctccggaggctgtgtttaggtcaaggcgctgacatttgggcctacatcttacagcacgtgcattcgcagaggacagtcaagaaaattcgcggaaacttgctgtggtacgggcaccaagacagcccccaggtcaggcgtaaactggaattggaggccgctgttacgagactgcgggcagagattcaagagctggaccagagcctcgagcttatggaacgagatactgaggctcaggacactgccatggaacaggcgcgacaacacacccaggatactcagcgccgagcccttctgctcagggcacaggccggtgccatgagacgccagcagcacaccctgagggatcctatgcagaggctgcagaaccagctgagaaggctgcaggacatggagcggaaggccaaggtggatgtcacttttggtagcttgacctccgcagccctcggactggagcctgtggtccttagagacgtgcggacggcttgtacgcttcgagcgcagttcctgcaaaacttattgcttcctcaggccaagcgaggttcactcccaacccctcatgacgatcactttggtacgagctatcagcagtggttgtcgagcgtagaaactttgctcactaaccacccaccaggccacgtgctcgcggcactggagcacctggcagctgagcgagaggcagagatccggagcctgtgtagcggcgacgggcttggcgatacagaaatttctaggccccaggccccagaccagtcggatagctctcaaacattgccgagcatggtccacctgattcaggagggctggcgcactgtcggagtactggtgtctcagcgctccacacttctgaaagaacgacaggtcctgacacagcggctccaaggattggtggaggaagtggagaggcgagtgctgggtagctcagaaagacaagtgcttatcctcggactaagaagatgttgtttgtggacagaactgaaggccctccatgatcagtcacaggaactccaggatgctgcaggccatagacagctcctgcttagggagctgcaggctaagcagcaaaggatcctccactggcgtcagcttgtagaggaaacacaggagcaagttcgactgttaatcaagggaaattcagcatcaaagacaaggttgtgcaggtccccaggtgaggtgctggcactggtgcagcggaaagttgtaccaacattcgaggcagttgctcctcagagccgagagctgttgagatgtctggaagaagaggtcagacatttgcctcacattctgctgggaactttgctgcggcataggcctggggagctgaagcctttgccaactgtgctgccgtctattcatcagttgcacccagcaagtcccaggggatctagctttatcgctctctcccataagctgggactgcctccaggcaaggcctccgagctgttgctgcctgctgccgctagtctccggcaagacctactcctccttcaggaccagcgttctctgtggtgttgggatctcctgcacatgaagacctcattacctcctggactccccacccaagagttactgcagattcaggcgagccaagagaagcagcagaaagagaatctgggacaggccctcaagcggctggaaaaactgttaaagcaagctctggaacggatacccgaactgcaagggatcgtgggtgactggtgggagcagcccggacaggctgccctcagtgaagaattatgtcaaggtctctctctcccccagtggagactgagatgggtgcaggcacaaggcgctctacagaagctgtgctcctag

SEQ ID NO: 225675 - DNA, 873 bp, Artificial Sequence
  Description of Artificial Sequence: Synthetic coding sequence
atggagctcgcccaggaggctcgtgagctgggttgttgggccgtggaggagatgggcgtcccagttgcagccagagcccctgagagtactcttagaaggctctgtcttggacaaggcgctgacatctgggcctatatactgcagcacgtgcacagccagaggacagtcaagaagatccggggaaatttactctggtacgggcaccaagacagtcctcaggtccgacgcaagttggaactggaggctgcagtgactcgtctgcgtgctgagatccaagaattggaccaatccctggagctgatggaaagggacacggaagcacaggacaccgccatggagcaggcaaggcagcatacacaggacacccaacgtagggctttattgctgcgagctcaggccggagccatgaggcgacaacaacacaccctgcgcgacccaatgcagcgcctgcaaaatcagctccgcaggctgcaggatatggagcggaaggcaaaggtcgatgtaaccttcggctctttgacaagcgcagctcttggccttgaaccagtggtgctgcgggatgttcgaaccgcctgtaccctgcgggctcagtttctgcagaatctcctactgccacaggctaagcgcggatccctccccacaccgcacgacgatcactttggtacatcataccagcagtggctctcctcagtcgagacgttgttgacaaatcacccgccaggccacgtcctggcagctcttgaacacctcgcagccgagagggaggccgagatccgcagcctgtgttcgggcgacggactaggagatactgagatttctagacgagccggagggctgtgggtttgttggtctccttctggtgcgccatcttag

SEQ ID NO: 225676 - DNA, 2409 bp, Artificial Sequence
  Description of Artificial Sequence: Synthetic coding sequence
atgaagtatataaagagcaattcaaagaacagctcccatcattttgtcgagacttttaacattaaaccacaggatttgcacaaatgtatcgctcgatgccacttcgccaggtcccggttccttcagatcctgcaacggcaggattgcgtgacccagaaatatcaggagaatgcccagctgtcagtgaagcaggtccggaatctgcggagtgagtgcatcgggctggagaatcaaatcaagaagatggaaccttatgacgatcattctaacatggaggagaaaatccaaaaggtacgcagcttgtgggcttctgtgaatgagacacttatgtttttggagaaggagcgcgaggtggtgtccagcgtgctatccctggtgaaccaatacgccctggacggaaccaacgtggccataaatataccccgacttcttctcgacaagatagagaagcagatgtttcagttacatatcggtaacgtgtacgaagctggtaaactgaacttgttgactgtcatccagctgctcaatgaggtcctcaaagtgatgaaatacgaaaggtgccaggctgatcaagctcgccttacagttgatcttcactatctggaaaaggaaacaaagttccagaaagaacgcttgagcgatcttaagcatatgcgctaccggattaaagacgacttgaccaccattcggcattcggtggtggaaaaacaaggggagtggcataaaaagtggaaggaatttcttggcctgagcccctttagtctcattaaaggatggacacctagtgtggatcttttaccccctatgtcaccgctgtctttcgaccccgcttcagaggaggtatacgcgaagtccatcctgtgtcagtatcctgcctctctgcccgatgctcacaagcagcacaatcaggagaatgggtgccggggagactcggatacattaggcgcactacacgatctggcaaattctcctgcgagctttctgtcacagtctgtgtcttctagtgacagaaatagtgtcaccgtgttggagaaagacactaagatggggactccaaaagagaaaaatgaagctatttccaagaagatccccgaatttgaggtggagaatagtcctctgtcggacgtagccaaaaacaccgaatcttctgccttcggcggtagccttcccgcaaaaaagagtgatcctttccagaaggaacaggatcaccttgtcgaggaggtcgcacgtgcagtgctgagcgattccccccagctgagcgagggcaaagaaatcaaattagaggagctcattgacagcctggggtctaatcctttccttacaagaaatcaaattccaagaactcctgagaacctcattactgagatccgctcttcttggagaaaagcgatagagatggaagagaatcggaccaaggaacctattcaaatggatgctgagcatcgcgaggtgctgcctgagtccctccccgtcctccataaccaaagggaattttctatggcagactttctgctggagaccacagttagtgatttcggtcaaagtcatttaaccgaggaaaaggtgatctccgactgcgagtgcgtgccccaaaagcacgtgttaacctctcatattgacgagccccctactcagaaccagtccgatctgctgaataagaaggtgatctgcaagcaggacctggaatgcttggcgttcaccaagttaagcgagaccagccggatggaaacattctccccagctgtcgggaatcgcattgacgtaatgggcggaagcgaagaggaatttatgaaaattctggaccacttggaagtgtcctgtaataagcccagcacaaataagacgatgctttggaactcatttcagatcagcagcggtatcagcagtaaatcttttaaagacaatgactttggtatccttcacgagaccctcccagaggaggtaggacacctctcctttaatagctcttcgtcatccgaggctaatttcaagctggagccaaattctcccatgcatggcggaaccttgctcgaggatgttgtcgggggtcggcaaactaccccggagagcgacttcaacctgcaggccctgcggagccggtacgaggcgcttaaaaaaagtttaagtaagaaacgggaggagagttacttgtcaaattctcagactccggagcggcacaagccagagctctctcccaccccacagaatgtccagacagatgacaccctgaatttcttggatacctgtgacttacacaccgagcatataaagcctagccttcgcaccagcataggggaaaggaaacggagcctgtccccactgatcaagttctcacccgtcgagcagcggcttcggaccaccatcgcttgtagtctgggtgaactgcccaaccttaagggtaaggtttag

SEQ ID NO: 225677 - DNA, 2868 bp, Artificial Sequence
  Description of Artificial Sequence: Synthetic coding sequence
atgagctcagcctctgtaaccgcttttgagaaagagcatttatggatgtacttgcaggcactgggattcgaaccgggacccgcaaccatcgcgtgcggcaaaatcgtcagtcatacccatctcggcgtcaatatgttcgacaaattgaaccgggatgccttccatattatttcctattttttgttccaggtcttggatcaaagcttgacaaaggaggtatttaaattctgttggccgcctttcgaccagaaatctgatacagaatttcggaagcattgctgcgagtggattaaaagaatttccggagagtgtggctctagcttcccccaggtagtgggcagcctgttcctcagccccggtggacctaagtttattcacttaatgtatcacttcgctcgattcgtggccatgaaatatattaagtccaattctaaaaatagctcacatcacttcgtggaaaccttcaatattaagcctcaggacttacacaagtgtatcgcaagatgccattttgccaggtctcgatttctacagattctccaacgccaagactgcgtcacgcagaaataccaggaaaacgcccagctttccgtgaaacaagtccgaaatcttagatctgagtgcattggcctggaaaaccagatcaaaaagatggaaccctacgatgaccactcgaacatggaggagaaaattcagaaagtgagatctttgtgggcgtcagtgaacgaaacacttatgtttttggaaaaggaaagagaagtcgtttcgagcgtgttatctctggtcaaccagtatgcgctcgatgggacgaatgtcgccatcaatatcccgagactgctgctggacaaaatagagaaacagatgttccagctacatatcggcaacgtgtacgaagccggtaaattaaatctactgactgtcatccagctactcaacgaggtgctgaaagtgatgaaatatgaacgatgtcaggcagaccaggcacgcctcacggtcgacttgcattatttggaaaaggagacaaaattccaaaaagaaagactgtcagacctgaagcacatgcgttacagaattaaagatgatttgaccacaatcagacattccgtggtcgaaaagcagggggagtggcataaaaaatggaaagagttcctggggctgtcgcccttcagtctgatcaagggctggactcccagtgttgatttactaccccctatgtcccctttgagcttcgacccggctagtgaggaggtgtacgccaaaagcatcctttgccagtacccagcgtccctgcctgacgcccacaaacagcataatcaggagaacggctgtaggggcgactctgacacactcggagcacttcatgatcttgccaactcaccagcatcgtttctgtcccaatcggtaagtagctccgatagaaacagtgtcaccgtattagagaaagatactaaaatgggcacaccaaaagagaaaaacgaggcaatctccaaaaagatccccgagttcgaggtcgagaatagccccttgagtgacgtagctaaaaacaccgaatctagtgctttcggaggttcacttcctgcgaaaaagtctgacccctttcagaaggaacaggatcacttagtggaagaggtcgccagagcggtcctgtctgattctcctcaactgagcgaaggcaaggaaattaagctggaagaactgatcgactcattggggagtaaccccttccttacccgcaatcagatcccacgtacccctgagaacctaatcacggaaataagaagcagttggcgcaaggccatcgagatggaggagaaccgcacgaaggaacctattcagatggacgctgaacacagggaggtgctgcccgaatccttgcccgtgttgcacaatcagcgtgaattttctatggccgattttctcctggagactacagtctccgacttcggacagtctcatctgaccgaagagaaggtgatcagcgactgtgaatgcgtaccgcagaaacacgtcctgacgtcgcacatcgacgagcctccaacccagaatcaaagtgatttgctgaacaaaaaggtgatctgcaagcaggacctcgagtgcctggccttcacaaagttgtcagaaacttctagaatggagacattctcacctgcggtgggcaatcgtatcgacgttatgggcggttcggaggaggagtttatgaaaattctggatcatctggaggtgtcatgcaacaaaccatccacgaacaaaacaatgctctggaactcctttcaaatttcaagcggtatctcgtcaaaaagttttaaagataacgacttcggaatcctccacgagacactgccagaagaggtaggccacttgagcttcaacagctccagtagctctgaggctaactttaagctcgaaccaaattcacctatgcatggcggtactttgctggaagacgttgtggggggtcggcagaccactcctgagagtgacttcaacttgcaggccctgcggtcacggtatgaagccctgaagaaatccctgtccaagaaacgggaggagtcatacctgtccaattctcagacccctgaaagacacaaaccagagctgagccccacccctcagaatgtgcagactgatgataccttgaatttcctggacacctgcgatctccatacggagcacatcaaaccgagtttgcggaccagcatcggggaaagaaaacggtctctgtcccccctaattaaatttagtcccgttgagcagcgtttgcgtactacgattgcttgttccctgggtgaactacctaatctgaaggaggaagacattctgaataaatcccttgatgccaaggaacctccttccgacttaactcggtag

SEQ ID NO: 225678 - DNA, 552 bp, Artificial Sequence
  Description of Artificial Sequence: Synthetic coding sequence
atgggtacgcccaaagagaaaaacgaagcaatatcaaaaaagatccccgagtttgaggtggagaatagcccactgagtgacgtggccaaaaatactgaaagctcagccttcggagggagcctcccagctaagaaatccgaccctttccaaaaagagcaagatcacttggtcgaagaagtcgctcgcgcagtattgagtgactcgcctcagctgagcgagggcaaggagataaagctggaggagttgatcgatagtctgggcagcaacccgtttctgacgaggaaccaaatacctcgcactcctgaaaatctgattactgaaatcagatccagctggaggaaagctatcgagatggaagagaacagaacaaaggaacctatccagatggacgctgagcatagagaagtacttccagagtccctgcctgtgctgcataaccaacgcgaattctcgatggctgattttttgctggaaaccaccgtgtcggacttcggacaatcgcatctgacagaagagaaagtgatatccgattgcgaatgcgtgccccagtag

SEQ ID NO: 225679 - DNA, 1077 bp, Artificial Sequence
  Description of Artificial Sequence: Synthetic coding sequence
atggccggacaggacgctggttgtgggagggggggagacgattactcagaagatgagggagactcctccgtgtccagagccgcagtggaagtctttggtaagctgaaagatctgaattgcccattcttagaaggcctatatatcaccgagcccaagacgattcaggagctcttatgctcaccctcggaataccgattagaaatactggaatggatgtgtacaagagtctggccctctctgcaagataggttctcctcattgaagggagttccgacagaggtgaagatacaggagatgactaaactcgggcatgagctaatgttatgcgctcctgatgatcaggaacttctcaaaggttgcgcgtgtgcccagaaacagctgcacttcatggatcaactgttagacaccattagatccctgacgatcggttgttcttcatgcagctctctcatggagcactttgaagacaccagggaaaagaatgaggcgctactcggggaactattcagtagtccccacctccaaatgttgctgaacccagaatgtgatccttggccgctggacatgcagcctcttttaaataaacagtctgatgactggcaatgggctagtgcttctgcaaagtccgaggaagaggaaaaattggccgaacttgctcgccaactgcaggagagcgcagcaaagttgcacgcactgaggaccgagtacttcgcccaacatgagcaaggagcagccgctggagccgcagacatttctacactggaccagaaattgcgtctggttacttctgatttccaccagttaatcctggcctttctccaagtgtatgacgatgagctgggtgagtgctgccaacgccctggcccagatctccacccttgcggccctatcattcaggcaacacaccagaacctgacgtcctattcccagctgttgcaagtggtgatggcagttgcagacacaagcgcaaaagccgtggaaacagtaaaaaagcaacagggagaacaaatatgctggggaggatcttcctcggttatgagtctggccaccaaaatgaacgagctgatggaaaaatag

SEQ ID NO: 225680 - DNA, 1284 bp, Artificial Sequence
  Description of Artificial Sequence: Synthetic coding sequence
atggggggtgctagactgggcgcaagaaacatggcagggcaggacgctggctgcggacgtggaggcgatgattactcagaggatgaaggggattcctctgtgtccagagccgctgtggaggttttcggaaagctcaaagatctgaactgcccattcctcgagggcctctacattactgaacccaagacgatccaggaacttctgtgtagtccttccgaataccggttagagattctggaatggatgtgtacccgggtctggccctccctacaggaccggttctcaagccttaagggagtgcctaccgaggtgaagattcaggagatgaccaaactcgggcatgaattgatgctgtgcgccccagacgatcaggagctgcttaaagggtgcgcctgtgcacagaaacagctccactttatggaccagctgttggatacgatcagatctctgacaatcggctgttccagttgttcgagccttatggaacactttgaagatactagggagaagaacgaggctctcttgggagagttatttagttcgccacacctgcagatgctgctaaaccccgaatgcgacccctggccattggatatgcagcccctgcttaataaacagtctgatgactggcagtgggccagcgccagcgctaagtccgaagaggaggagaagctagcggagctggcaaggcagctccaggaatcggctgccaagctgcatgcactccggaccgaatacttcgctcagcatgagcagggcgctgccgctggggcagcggacataagcaccctcgaccaaaagctgcgactcgtgacaagcgattttcatcagctgatactggcctttcttcaggtttatgatgatgaattgggggaatgctgtcaacggcctggccctgatctccacccctgcggccctatcatacaagcaacgcatcagaatttgacctcctatagccaaattcctcgtggacaacctaagaaacccgctttggtaaccatgacgacggtaccaacctgcgccacattgcctcttgcacagggattcagagacgtgcacttcggatttctgtccgaacgtttaagggcctttcagcccctcactggctggagttgtgaaacccctagatccggcatgttactccaggttgtgatggccgtggccgatacatccgccaaggccgtcgaaactgtgaagaagcagcaaggtgagcagatctgttggggtgggagctccagcgttatgagtcttgccactaaaatgaacgagctcatggaaaagtag

SEQ ID NO: 225681 - DNA, 1107 bp, Artificial Sequence
  Description of Artificial Sequence: Synthetic coding sequence
atgggcggtgcaagattaggagctagaaacatggcaggacaagatgcgggatgcggccgtggaggagacgactactccgaggacgagggagactcatcggtctctcgtgctgctgtggaggtgttcggtaaattaaaggacctaaattgcccatttcttgaaggcttatacattactgagcccaagacgatccaagagctcctgtgtagtcctagtgaatatcggttagagatcctggagtggatgtgcactcgagtgtggccttctcttcaggatcgcttttcctccttaaaaggggtgccaacagaggtgaaaatccaggaaatgacgaaacttggtcatgagctgatgctgtgtgccccagacgaccaggaattactcaagggctgtgcctgtgcacaaaagcagctgcattttatggatcagctacttgacactattcgctcactcaccatcggctgctccagctgcagctctcttatggagcacttcgaagatacaagagagaagaacgaagcccttcttggggaactgttttcaagccctcacctgcagatgttgctaaatcctgagtgtgatccttggccactcgacatgcaacctctcctgaataagcagtccgatgattggcagtgggcgtccgcatctgccaaatccgaagaagaggagaaacttgccgaactggctaggcagcttcaggagtcagcagccaaacttcacgccctacggacagaatactttgctcaacatgagcagggcgcagccgcaggagccgctgatatcagcacattggaccaaaaactcaggttggtgacgtcagactttcatcagctgattctggcttttctgcaagtctacgacgacgaactgggtgaatgctgccagcgccctggtcctgaccttcacccctgtggacctattattcaagctacccaccagaacctcacatcctacagccagctgctgcaggttgttatggccgtggccgatacgtccgctaaagcagtagaaactgtgaagaaacaacaaggagagcagatctgttgggggggaagcagctctgttatgagtctggcaactaagatgaacgagttgatggagaaatag

SEQ ID NO: 225682 - DNA, 411 bp, Artificial Sequence
  Description of Artificial Sequence: Synthetic coding sequence
atggaccagctgctcgacactataaggtcactgactatagggtgcagttcttgttccagtcttatggagcacttcgaggatactcgcgagaaaaatgaagcacttcttggagagctgttttcctcgccccacctacagatgctgttaaatcctgagtgtgacccatggccgttagacatgcaaccactcctgaacaaacagagcgacgactggcaatgggcctctgcctctgccaaatcagaggaggaggagaaactggccgaactggccagacagctgcaagagtccgcagctaagttacatgctctaagaactgaatctaccactactagctgggcttctgccgcatccgcccaggcactgacgagtacacgggctgccccttcttctcgaccacggacaagaatctag

SEQ ID NO: 225683 - DNA, 516 bp, Artificial Sequence
  Description of Artificial Sequence: Synthetic coding sequence
atggtcaaacgaagacgttcgccagctttgggagaagaaaggttcagccccagctctattctgcatccacgcctaccactggtactcttgggcactcgggtgcctctgtccggtggcggacccggagagccggatcagggacggtctgccccatcctggaagagtttggcctctacacatcatcatagccgacccgcagctggcgcaacccccgcaaggccagccactcagtcacagcttggacctttcgctcctccgcttccgggagtacggccagcacctttccccgctgttgaggtcttcggcaagctcaaagatcttaattgcccattcctggagggtctttatatcactgagcccaagaccatccaggagctgctctgttcccccagcgagtaccgtctggagatcttggaatggatgtgtacccgggtgtggccctccttgcaggataggttcagctctctgaaaggcgttcctacagaagtgaaaatccaaggacttctggccggatag

SEQ ID NO: 225684 - DNA, 1233 bp, Artificial Sequence
  Description of Artificial Sequence: Synthetic coding sequence
atggccgatagcagcgggcgtggagccggtaaaccagcaacaggaccaactaacagcagtagtgccaagaaaaaggataaaagggtccaaggcggaagagtcatcgaatcccgctaccttcagtatgagaagaaaacaacccagaaggcccctgcgggagatggaagccagacccggggtaagatgtctgagggtggacgaaaaagctctcttcttcagaaatcaaaggctgattcttcaggcgtaggaaaaggtgacctgcaatccacgttattagaaggacacggcactgctcctcccgacctcgacctcagtgccatcaatgataaatcaatagtgaaaaagactccgcagttggctaagactatttctaaaaaacctgagagcacgagcttcagcgccccacgtaagaaatcaccagatcttagtgaagccatggagatgatggagagccagactctattactgactctgctgagcgtcaagatggagaacaatctagccgaattcgaacggagggccgagaaaaatctgctcataatgtgtaaagagaaggagaaattgcaaaaaaaagctcacgaactcaaacgcaggctgctgctgagtcagagaaaacgcgaactggccgacgtgctggatgcccagatcgaaatgctgtccccttttgaggccgtagcaaccagattcaaggagcaatatcggacattcgccaccgcgctcgatactaccaggcacgagcttccagtccggagcatccatttagagggagatggacaacagctgcttgatgctctgcagcacgagttagtgaccacacaacggctgttgggcgagctggacgttggcgactccgaggaaaatgttcaagttcttgaccttttatctgagctgaaagatgtcaccgctaaaaaagacttagagctgcgtaggtccttcgcacaggtcctggaactgagtgccgaagccagcaaggaagctgctctggcaaatcaggaggtctgggaggaaactcagggcatggctccaccaagtcgttggtatttcaaccaggactcggcctgccgcgaatccgggggagccccaaaaaacactcccctgtctgaggatgacaatcctggcgctagctccgcccctgctcaggcaacctttatatcaccttccgaagacttttcttcatcctctcaggctgaggtcccaccgtcactgtcgaggagcggaagagatctgtcctag

SEQ ID NO: 225685 - DNA, 1230 bp, Artificial Sequence
  Description of Artificial Sequence: Synthetic coding sequence
atggcagacagcagtggcagaggagcaggaaagcctgccacgggcccaacaaactcaagttctgccaaaaaaaaggacaaaagggtacaggggggtcgggtcattgagagcaggtacctgcagtatgaaaagaaaaccacccagaaggcgccagctggcgatggctcccagacacgtggcaaaatgagcgagggaggccgaaagtcctccctgctgcagaagagtaaggattccagtggggtggggaaaggcgatctgcagtcgaccctgttagagggacatgggacagcaccgccagatctcgacctgagcgctataaacgataagtcgatagtgaagaaaacgccgcagctggctaagaccatatctaaaaagcctgagtccaccagtttcagtgcaccacgcaagaaaagtcccgacctgtccgaggcaatggagatgatggagtcacagaccctgttgctgactttgctgtcagttaagatggagaataatcttgccgaattcgaacgccgagctgaaaagaacttgctcatcatgtgtaaagagaaagagaagctccagaaaaaggctcacgagcttaagcgtagattactgctgtctcagcgtaagcgcgagctagcagacgtgctcgacgcccagatagagatgctctcaccttttgaagccgtagctactcgattcaaagaacagtataggacgtttgccacggccctcgacacaacaagacatgaactgccagtccgatcaattcacctggagggcgacggtcagcaattgctcgacgccttgcagcacgaactagtcaccacacagaggctgctgggcgagctggacgtgggggacagcgaagagaatgtccaggttctggacctgttgagcgagctgaaagatgttaccgcgaagaaggacctcgagctaagaagaagtttcgcccaagtgctcgagctgagcgctgaggcctccaaggaggcggctctggccaatcaggaagtatgggaggagacccagggcatggcgcctcccagcagatggtatttcaatcaagactcagcctgtcgcgagtcaggaggtgcccctaagaacacacctttgtccgaggacgacaaccccggtgccagttccgctcccgctcaagccacgttcatttcgccttctgaagacttcagcagctccagccaggcagaggtgcctcccagtctttctcgtagcggacgcgatctcagttag

SEQ ID NO: 225686 - DNA, 1899 bp, Artificial Sequence
  Description of Artificial Sequence: Synthetic coding sequence
atggccagacataggaatgtgcggggatacaactacgacgaggactttgaggacgatgacttgtacggacaaagtgtcgaagacgactattgcatctcccctagtacagccgcacagttcatttacagcagacgagacaaaccgtctgtggagccagtggaggagtatgattacgaagatctgaaggagtcctcaaactctgtcagtaatcaccagctgtccggctttgaccaagccaggctgtatagctgtctggaccacatgcgcgaagttctaggcgacgccgtacccgatgaaatcctgatagaagcggtgctcaagaataaattcgatgtccagaaggctctgagcggggtgttggagcaggacagggtgcagagtctgaaggataaaaacgaagccaccgtgagcaccgggaagattgccaaaggggttctgttttccagctccgaagtgtcagctgacaacgtccagtcatcgtatccacaatcagccaaccacttggattattcaagcaagccctttgattttgcctcctccgtgggcaagtacggtctgagccacaattccagtgtgccaacccactgtctgctgcacagaaagaagaaactggatacgcgcaagtcagagaagaaactagagtcttgcaagctgactaaagaactgtctcttgctaacttgattcatgacatgtctagggatagctgtgaaagtcaaccctccgtgcgactgtcttccaccgattctctggagagcttgctctcaaaaaatctggacgctgatctactccggccacacgcctccgaatgtatttctaaggacgactcagcattcaaggaaattcccgatctgaagactattatcatcaagggcacaaccccaaataactccttgtacatccagaacaactctctctcagattttcagaatattcctgtccaagatagtctcggttctagcaataaccccctgtatttaactagtagcctggaaaacatgaccgtggacaatctgaatgccagtaaggagaccgaggttggcaacgtttcactggttgaacagtccgccaaaaatcataccttcaagaatgacaatctccagtttagccagtgcgaaagtccaagcctcacggaactgtttcaagagcataaagagaacaatatatcccagtgctttacactgtcagacctgtgcaaccaatctagcgcttcttttactgatctgtctctagggtccttccctctcagccagctcgccaatcgttgccaatcctctcccggaataagcgaactaactggatcgttgagtagcttggcctttcacaaagcaagccccacacgcgacctcgagaatctgtcgctcagcgagctgatcgccgaaactatcgatgtggacaattctcagattaagaaggagtcattcgaagtttccttaagcgaggtacggtcccctggtatcgattctaacatagacctatccgtcctgatcaagaaccctgactttgttcctaaacctgttgtggacccatcgattgccccttcctctagaacaaaagtactgtcgtcaaaactgggcaaaaacagcaattttgctaaagataataagaaaaacaacaaagggtctctcacgagaaagcctccattttccctgtcctggacaaaagctctcgcagccagaccgagcgcctttgccagcacactgtgtcttcgctacccactaaaaagttgtaagcgtcggacactggacttgtacaaaacatttctctacagccgccaggtgcaagatgtgaaagacaaggagatatctcctctcgtagccataacgccgttcgatttcaagtcagcatctccagacgatatcgtgaaagctaatcaaaagaaggcctttacgcgggagtag

SEQ ID NO: 225687 - DNA, 1563 bp, Artificial Sequence
  Description of Artificial Sequence: Synthetic coding sequence
atgacggtttccgggaagaagcagaccatggggttcgaagtgcccggagtgagcagcgaggagaatgggcacagcttccatacgcctcagaaggggcctccaatcgaagacgctatcgccagcagcgacgtgctggaaacagctagcaaatcggctaacccgccacatacaattcaggccagcgaggaacaaagtagtacccctgcaccagtgaagaagtccggtaagctgagacagcagatcgacgtcaaggctgagttggagaaacggcaggggggtaaacagctgctgaatctggtcgtcatcgggcacgtggacgccggtaaaagtacactgatggggcacatgctgtacctgcttggtaatattaataagcggacaatgcataagtatgagcaggaatcaaaaaaagcaggcaaagcctccttcgcttatgcttgggtgctggatgagacaggcgaagagagagaaaggggtgttacgatggacgtgggcatgaccaagttcgaaaccaccaccaaagtgatcacattgatggacgctccaggtcacaaggactttataccgaatatgatcaccggcgctgctcaggccgatgtcgccgtcctggttgtggatgcctctaggggcgaatttgaagcaggattcgagactggtgggcagactcgtgagcatggcttgttagttcggagcttgggcgtcacccaactcgctgtggccgtgaataaaatggatcaggttaattggcagcaggaaaggttccaggagatcacgggaaaattagggcattttctcaaacaggctggcttcaaagaatcagacgtaggcttcatccccacctcgggcctgtctggcgagaaccttattacacgaagccagtcctctgagctgacaaagtggtataagggcctctgtcttcttgagcaaatcgattcctttaagccaccccagcgtagcattgacaagccctttagactgtgtgtttccgacgtgttcaaggaccaggggtcaggattttgcatcacgggcaaaatcgaggcgggttacatacagaccggggacagattacttgcaatgccacccaacgagacttgcactgtgaagggcattacactccatgacgaacccgtcgactgggcagctgccggagatcacgtgtctctgactctcgtaggcatggatatcattaaaatcaacgtgggctgtattttttgcggcccaaaagttccaattaaggcttgcacacgctttcgcgctcggatcttaatattcaatatagagattccgatcaccaagggcttcccagtcctactccactaccagactgtcagcgaacccgctgtcatcaagagattgatctctgtgcttaacaagtcaacaggagaggttacaaagaagaagccaaaattcttgacgaaaggacaaaacgcgctggttgagttgcagactcagaggccaattgcactagaactatataaggatttcaaggaactgggccgttttatgctgagatacggtgggagcacaattgccgctggggttgttacggaaattaaggagtag

SEQ ID NO: 225688 - DNA, 1929 bp, Artificial Sequence
  Description of Artificial Sequence: Synthetic coding sequence
atggctcgccacagaaacgttaggggctataactatgatgaggacttcgaagacgatgatctgtacggccagtcagtcgaagatgattactgcatcagcccatcaaccgcccgattgtactcttgtctggaccatatgcgcgaggtgctgggtgacgctgtgcccgacgaaatcctcatcgaggctgtgctgaaaaacaagttcgacgtacaaaaggccctgtccggtgtgttggagcaggatcgggttcagtcactgaaagataagaacgaggccacagtgagtacagggaaaattgcaaagggaaaaccggttgactctcagacctctagatctgaaagtgagattgtgccaaaggttgccaagatgaccgtgtccgggaagaagcagacaatgggattcgaggtgcccggagtatcttcggaagagaatggacacagctttcacaccccacagaaagggcctcccattgaggacgccatcgcctcatccgacgtactcgagactgcgagtaaatccgccaatccacctcatactatacaagccagtgaagaacaaagctccaccccagcccctgtcaaaaaatccgggaagctcagacagcagattgatgtaaaggctgagctcgaaaagaggcaaggaggcaagcaattactcaatctggtagttattggccacgtagatgccggtaagtctaccctgatgggacacatgctctacctgcttgggaacattaataagcgaaccatgcacaaatatgagcaggagtcgaaaaaggcgggtaaagcttcttttgcttatgcatgggtcctggatgagacaggagaggagcgagagcggggagtgaccatggatgttggaatgaccaagttcgaaactaccaccaaggtcatcactctgatggacgccccaggacacaaggatttcattcccaatatgatcactggcgcagcccaggcagacgtggccgtgctagtagtggatgctagcagaggcgagttcgaagccggatttgaaactggcggacagaccagagagcacggtttgttggtcagatctcttggggtcacacagctggccgttgccgtgaacaagatggaccaggttaactggcagcaagagaggttccaagagataaccggaaagctgggacatttcctaaaacaggctggcttcaaggaaagtgatgtgggattcattccaacctcaggtctgagcggggagaacctcatcacacggagtcagagctctgagttgaccaaatggtataaaggcctgtgtttgctggagcagattgatagcttcaaaccaccgcaaaggagtattgataagccgttcagactctgcgtgtccgacgtgtttaaggaccaggggtccggattttgtatcaccggcaaaattgaggctggctatattcagacaggtgaccggctcctcgctatgccaccgaacgagacctgcacggtcaagggcataaccttgcacgatgaaccagtcgactgggcggcagccggtgatcacgtctcgctgacgctggttggaatggacatcatcaagattaacgtgggctgcattttctgcggacctaaggtccccatcaaggcttgcacaaggtttcgtgctaggatcctgattttcaacattgaaattccgattaccaagggtttccccgttctcctgcactatcagacggtgagcgaacccgcagtaatcaagcgtctgatctcagtcctgaacaagagcactggagaggtgactaagaaaaagccaaagttcctcaccaaagggcagaacgcactcgtggagctgcagactcagcggcctattgccttggagctgtacaaagactttaaggagctcggcagatttatgttaagatatggcggaagcactattgcagcaggcgtcgtgaccgaaatcaaagagtag

SEQ ID NO: 225689 - DNA, 2055 bp, Artificial Sequence
  Description of Artificial Sequence: Synthetic coding sequence
atggctagacacagaaacgttcggggatacaactacgatgaggatttcgaagacgacgatctatatggccagtctgttgaggacgactattgcatctctccgtcaaccgctgcccagtttatttattctcgcagagacaagccttccgtggaaccagtcgaggagtacgattatgaggacttgaaggaatcttccaattctgtgagtaaccaccagttatcgggctttgaccaggctcgcttgtattcttgtctggatcacatgagagaggtgttaggtgatgctgtgcctgatgaaattctaatcgaagctgtgctgaagaataagtttgatgtccaaaaggcactgtccggggttcttgagcaggatcgagtgcagtcactcaaggacaagaacgaagccacagtctccaccggcaagatcgctaagggaaaaccagtggattcccaaacttcacggagcgaatcagagattgtgcccaaagtcgccaagatgacagtgtccgggaagaagcagactatggggttcgaggttccaggagtgtcctcggaggagaatggtcactcattccatactcctcagaagggcccacccatagaggacgctattgccagtagtgacgtcttagagaccgcctcaaagtctgccaacccacctcacaccatccaggcgagtgaggaacaaagctccacccccgctccagtgaagaaatcaggcaaactgaggcagcagatcgatgtgaaagcagagttggaaaagagacagggcggaaagcagctgctgaacctggtggtgatcgggcacgttgacgctggcaagagcaccctaatgggacatatgctgtatcttttgggcaatattaacaagcggactatgcacaaatatgaacaggaaagcaaaaaggcaggtaaggcctcttttgcatacgcatgggtcctcgacgaaaccggagaggagagggagagaggcgtcacgatggacgttggtatgaccaagtttgagaccaccactaaggtgattaccctcatggacgcccctgggcacaaagatttcattccaaacatgataacgggtgcggcacaggcagacgtggcggtgctggtggtggacgccagtcggggtgagttcgaggcgggtttcgagactgggggtcaaacacgtgagcacggcctgttggttcggtctctaggggtcactcaactcgcggtggcggtaaataaaatggaccaggttaattggcagcaagaacggtttcaagagatcacaggcaaactggggcactttctcaaacaggccggatttaaagagtccgatgtgggcttcattcccacttctggtctttccggagagaatctgatcacccgctctcagtcttctgaactaacgaagtggtataagggcctctgtctgttagaacagatcgatagttttaagccgcctcagaggagcatcgacaaaccctttcgcctttgtgttagcgatgtgttcaaggatcaaggtagcggtttctgtataactggcaagatcgaagccggatatatccagaccggcgatcgactcctggctatgcccccaaatgaaacctgcacggtaaagggcatcactttgcacgacgaacctgttgattgggcagcagccggtgatcatgtttcattgacactggtcgggatggatattattaagatcaatgtgggctgtattttttgcggcccaaaggtgcctataaaggcttgtactcgcttccgcgctagaatactaatatttaatattgaaatcccaattaccaaaggatttcccgtcctgcttcactaccaaacagtgtcagagcccgctgtgataaagagactgatttctgtgctgaataaatcaactggcgaggtcaccaaaaaaaagcctaaatttctcaccaaagggcagaatgcactggttgaactccaaacacagagacctatcgctttggagttgtacaaggacttcaaggaactggggaggttcatgctacgctacggtggatctaccatcgccgcaggggttgtcacagagatcaaggagtag

SEQ ID NO: 225690 - DNA, 1227 bp, Artificial Sequence
  Description of Artificial Sequence: Synthetic coding sequence
atgggccatatgctttatctgttgggaaatattaacaagagaactatgcacaagtacgagcaggagtctaagaaggccggtaaggccagctttgcttacgcgtgggtgttggatgaaacaggagaggagagggagcggggagtgacgatggatgttggaatgaccaaatttgagacaacaaccaaggtcatcacacttatggatgcccctggccataaagactttattcccaatatgatcacaggtgctgcacaggccgatgttgcagttctggtagtggacgcttccagaggggaattcgaggcaggatttgaaactggcggacagacacgggaacatggtcttctggtgcggtctcttggcgtcacccaactcgccgtggcagtgaacaagatggaccaagtaaattggcagcaggaacgctttcaggagattaccggaaagctgggccattttctgaagcaagccggttttaaagagtccgatgtcggctttattccaacctcgggcctgtctggggagaacttgatcacaaggtcccaaagtagcgagctcactaagtggtacaagggactgtgtctgctggagcagatagactccttcaagccgccacagagatcgatcgataagccttttcgattatgcgtttccgatgttttcaaagatcagggaagtggattttgtatcacgggaaaaatcgaagctggctacatccagacgggagaccgacttctggccatgcccccaaacgaaacatgcaccgtaaagggaatcactctgcatgacgagcccgtggattgggctgccgcaggggaccacgtgagtctgacactggtgggcatggacatcatcaagatcaacgtgggatgtatcttttgtggacccaaggtgcccatcaaggcgtgtacaagatttagggctcgcatcctcatttttaacatcgaaattccaattactaaaggctttcccgtactgttgcactaccaaacagtgtccgagcctgctgtgatcaaacggctcatcagcgtgctgaacaagagtaccggcgaggtgaccaagaaaaagcccaagttcttaaccaaggggcagaatgcccttgttgagttgcagacacagcgaccaatcgccttggagttgtataaggacttcaaggagttgggcagattcatgctcagatatgggggaagcacgatcgccgctggagtcgtgaccgagattaaggagtag

SEQ ID NO: 225691 - DNA, 840 bp, Artificial Sequence
  Description of Artificial Sequence: Synthetic coding sequence
atgtcactatttgacctgtttcgcggattcttcggcttcccgggtccaaggtcacaccgcgacccattctttgggggaatgactagagacgaggatgatgacgaagaagaggaagaggaggggggtagttggggacggggaaacccaaggtttcacagccctcaacacccacccgaggagtttgggtttggcttcagtttttcccctggtggcggaattaggttccacgataattttggcttcgacgatctggtgcgcgattttaactcaattttcagcgacatgggtgcctggactctcccttcccaccctccggagctccccggacctgagtcagaaacaccaggcgaacgcttgagggagggacaaacccttcgggattccatgcttaaatacccagattctcaccaacccagaatctttggaggtgttttagagtccgatgcgagatcagaatccccacagccggctcctgactggggttcccagagaccttttcaccggtttgatgacgtttggccaatggatcctcatcctcgaactcgggaggacaacgatctggacagccaagtatctcaggagggcctgggccctgtgctgcaaccccagcccaagtcgtattttaaaagtatctcagtcaccaaaattaccaagccagatggcatagtggaagagagacggacagtagtcgatagcgagggcagaacggagactactgtaactaggcacgaagccgacagttcccctaggggcgaccctgaatcgcctaggcccccagcccttgacgatgcattttccatactggatctgttcctgggacgatggttccgtagccgctag

SEQ ID NO: 225692 - DNA, 696 bp, Artificial Sequence
  Description of Artificial Sequence: Synthetic coding sequence
atgtctctctttgatctcttccggggtttttttgggttccccggaccccgaagcttttcaccaggcggtggtatccggtttcacgataactttggattcgatgatctggttcgcgactttaatagcatcttttcggacatgggcgcttggacactcccctcccaccctcccgagctgccgggtccggaatccgaaacaccaggggagaggctccgggagggccagaccctccgagactcaatgctaaaataccccgattcacaccaaccacgaattttcggaggggtgcttgagtccgatgcaaggtctgagtcacctcagccagcgccagattggggatctcagagacccttccacaggttcgacgacgtttggccgatggacccccaccctcggacccgggaggataacgatctcgattctcaggtgtctcaggaaggccttgggccagttctgcagcctcagccgaaaagctacttcaaatctatctcagttaccaagatcaccaagcctgacggcatcgttgaagagagaagaactgtcgtggactccgagggcagaaccgagaccactgttacccgtcacgaggctgacagtagccctagaggggatcccgagagtccccgtcctcccgctttagacgacgctttttcgattctcgacctctttctgggcaggtggtttcgctccagatag

SEQ ID NO: 225693 - DNA, 864 bp, Artificial Sequence
  Description of Artificial Sequence: Synthetic coding sequence
atgagtctgttcgacctctttcggggattctttgggttcccgggacctaggtctcatcgcgacccctttttcggcggaatgacaagagatgaggacgacgatgaggaagaagaggaggaagggggatcctggggcaggggaaacccacgctttcattctcctcagcacccaccagaggagtttggattcggattttcctttagccccggtgggggtattcggttccatgataactttgggtttgatgatctagtcagggacttcaattcaattttcagcgacatgggggcatggacgctgccatcccatcctccagctaatacctgtcacctctcggcggagctgcctgggccagaatcagagacccccggagaacggctccgggagggtcagacgctccgggactccatgcttaagtaccccgacagccaccagccgagaatatttgggggtgtcctggagagcgacgcacgctccgagtccccacaacctgcacctgattggggcagtcagagaccctttcatcgattcgatgacgtttggccaatggaccctcatccgagaactcgggaggacaatgatctcgacagtcaggtctctcaagaaggtttagggcctgtcctccagccacaacccaaaagttactttaagtccatttccgtcaccaagatcactaagcccgacgggatcgttgaggagcgaagaacagtggttgattcggaaggacgcacggagacaacagtgacacgccacgaagccgatagctcacctaggggtgaccctgagagtcctcgcccaccagctctcgatgatgcctttagtatcctggatttatttctgggccgatggttccggagtcgttag

SEQ ID NO: 225694 - DNA, 1179 bp, Artificial Sequence
  Description of Artificial Sequence: Synthetic coding sequence
atgcaatcccccgctgtattggtgacctccaggagactccagaatgcccacacgggtttggacctgactgtgccccaacaccaagaagtcagggggaagatgatgtccggacacgtggagtatcagatcctggtcgtcacccgccttgcagcgtttaagagcgcaaaacaccggccagaggacgtggtgcaattcctggtatcaaagaaatatagcgagattgaagaattctatcaaaaactctcatctagatatgccgctgcctccctcccaccactgccccgaaaggttttgtttgtgggcgaatccgacatccgggaacggagagccgtgttcaacgagatcctgcgatgtgtgtcgaaagacgcggaactggcgggttctcccgagctgctagagttcctaggcactcggtcccccggagctgctggcttgacatcccgggactcttccgtgttagacggtactgactcccaaactggcaacgatgaggaggccttcgatttttttgaggaacaggaccaagtggctgaagagggtccgcctgtccagtcattaaaaggcgaggatgcagaagaatccctcgaagaagaagaggctctggacccactgggcataatgaggtctaagaaacccaaaaaacatccaaaggttgctgtgaaggcaaagccatctcccaggctaacaattttcgacgaggaggtcgatccagatgagggcctgtttggacctggcaggaagcttagccctcaggacccctctgaggacgtcagtagtgtggacccactcaaactttttgatgaccccgatctagggggtgccatacctctcggagactctcttttattgcccgctgcgtgcgagagtggcggtccaacacccagcctcagccaccgtgatgcaagcaaggagctgtttagagtggaggaggatctggaccagatcctaaatttaggggcagagcccaagcctaagccacaactaaagccaaagccgccagttgcggcaaaaccggtaatacctcgtaaacctgctgttcctcccaaggcagggcctgctgaggcagttgctggacagcagaagcctcaggagcagatccaggctatggacgagatggatatcttgcaatacatccaggaccacgacacacccgcacaggctgctccctccctgttttag

SEQ ID NO: 225695 - DNA, 654 bp, Artificial Sequence
  Description of Artificial Sequence: Synthetic coding sequence
atgtctctggtgggcggttttccacatcacccagtggtacatcatgagggatacccttttgccgctgccgcagctgccgctgctgccgcagccgcatcccgctgctcccatgaggagaacccatacttccacggatggctcattggccaccccgagatgtccccccctgattactccatggccctctcctactcccctgaatatgcctccggtgcggcagggctggaccattcacactatggtggtgtgcccccaggcgctggtccccctgggctgggtggtccaaggccggtgaagcggagaggtacagccaacaggaaagagcgcaggcgcacccaaagcataaatagtgccttcgcggagctacgggaatgcataccaaacgtgcccgctgacaccaaactgtcaaagattaaaaccctccgtttggccacatcctacatcgcttaccttatggacctcctggctaaggatgaccagaatggggaagcggaggcctttaaagccgagattaaaaagactgacgtgaaggaagaaaagagaaagaaagagctgaatgagattctgaagtcgacggtgtcctcaaatgataaaaagaccaaaggcagaaccggctggcctcagcatgtatgggcccttgagttgaaacaatag

SEQ ID NO: 225696 - DNA, 561 bp, Artificial Sequence
  Description of Artificial Sequence: Synthetic coding sequence
atgtcccttgttggtggcttccctcaccatcctgttgtgcaccatgaaggatatccctttgccgctgctgcagcggcagctgccgctgctgcagctagtagatgcagccatgaagagaacccttacttccacgggtggctcattggacatccggagatgagtcctcctgattactccatggccctgagttattccccagaatacgcgtccggaaccgccaatcgcaaggagagacgacggacccagtctattaattccgcctttgcagaactgcgtgaatgcatccctaacgtcccggcagacaccaagctgtccaaaattaagaccttgagactggcaacgagctacattgcctacctgatggacctcctagcgaaagacgatcagaatggcgaggccgaggcgtttaaagctgagattaagaaaacagacgtcaaagaagagaagcgtaaaaaagaactgaatgaaatcctgaagtcaaccgtctcctctaatgataaaaagaccaaaggacgcacagggtggcctcagcacgtatgggccctggagcttaaacagtag

SEQ ID NO: 225697 - DNA, 498 bp, Artificial Sequence
  Description of Artificial Sequence: Synthetic coding sequence
atgtcaccaccggactattcaatggctctttcttacagccccgagtatgccagcggggctgccggactcgatcatagccattacggaggcgtgcctcccggagccggaccgcctggattgggcggtccacggcctgtcaaacgccgaggaaccgccaacagaaaggagagaagacgcacgcagtcaatcaatagcgcatttgccgagctgcgcgaatgcataccgaatgtcccagctgatacaaagctgagcaaaattaaaacattaaggttagctacttcctacattgcttatctgatggacttgctggcaaaggacgatcagaatggcgaggcagaagcttttaaagccgaaatcaagaagactgatgtgaaagaagagaaaagaaagaaagagcttaatgaaatactgaagtctaccgtctccagcaatgataaaaagaccaagggtcgcaccggttggcctcagcatgtatgggctctcgaactgaagcagtag

SEQ ID NO: 225698 - DNA, 2577 bp, Artificial Sequence
  Description of Artificial Sequence: Synthetic coding sequence
atgtccgtggtaggcctggatgtaggatcacagagctgctacatagccgtcgccagagccggtgggatcgagaccattgcaaacgagttctccgaccggtgtactcctagcgtgatatcatttgggtctaagaatcgcaccattggcgtcgcagccaagaatcagcagatcactcatgccaataataccgtgtcgaactttaaaagatttcacggacgcgcatttaatgaccccttcatccagaaagagaaggagaatctttcttacgatttggtacccctcaagaacggaggagtgggcattaaggttatgtacatgggcgaggagcatctgttcagcgtggagcagattacagccatgcttttgacaaagctaaaagagaccgctgaaaacagtttaaaaaaaccagtgaccgattgcgtcatttcggtccctagctttttcacggatgctgaacgcagatccgttctcgatgctgctcaaatcgtagggctcaactgcctgagactgatgaatgatatgacagccgttgctctgaattatggtatctataagcaggacctcccgagtctagatgagaaacctagaatcgtggtgtttgtggacatggggcatagcgcctttcaggtgtcagcgtgtgcattcaacaaggggaagctgaaggtccttggcacagctttcgatccgtttctgggaggaaagaatttcgatgagaaactggttgaacacttttgcgccgagttcaaaacaaaatacaaactagatgccaaatccaagatccgagccctcctgaggctgtaccaggaatgtgaaaagttaaaaaaactgatgtctagcaacagcactgatcttccacttaacatagagtgcttcatgaacgataaggatgtgagcggaaagatgaatcgctcccagtttgaggagctctgtgccgagctactgcaaaaaatagaagttcctctctatagcttgctggagcagacccatctaaaggtggaagatgtcagtgctgtggaaatcgtggggggagctacacgaataccggctgtgaaagagcgaattgctaagttttttggaaaggatatctccaccacgttaaacgccgacgaggccgtggctcgtgggtgtgccttgcagtgcgccatcctcagtccagccttcaaggtgcgcgaatttagtgtaactgacgccgtgccattccccatatcattgatctggaatcacgatagcgaagacacagaaggtgtccacgaggtgttttctcggaatcacgcagcccctttctcgaaggtcttgacctttttgcgacgtggcccatttgagctggaagccttttattctgatccccagggagtcccctaccctgaagctaagatcggacgcttcgtagtccagaacgtttctgcccagaaggacggagaaaagtcacgggtcaaagtcaaggtacgtgtgaacacacacggtatctttacaatcagcaccgccagcatggtggagaaggtgcccactgaagaaaacgagatgtcatcagaggcagacatggaatgtctaaaccagcggcctcctgagaaccccgacacggacaagaacgtccagcaggataactctgaggccggtacccagcctcaggtgcagaccgatgctcagcagacatcccaatctcccccatccccagagctgacttcagaggaaaacaagatcccagatgccgataaagccaatgagaaaaaggtagatcagccccctgaggccaagaagccgaagattaaggtggtgaacgtggagctcccaattgaggccaacctggtatggcagttgggaaaggatctgctgaacatgtatatcgaaactgagggtaagatgattatgcaagacaaattagaaaaggaacgaaacgatgccaaaaatgcagtggaagagtacgtatatgaattccgagacaaactgtgtggaccttacgaaaagttcatatgcgagcaggaccatcagaactttttaaggcttttgacggaaaccgaggactggctgtatgaggaaggcgaggaccaggcgaagcaagcttacgttgataagttggaggagcttatgaagattggtacccctgtgaaggtacgattccaagaggccgaagagcgccctaaaatgtttgaagaattggggcagcgcctgcaacactatgccaagattgccgctgacttcaggaataaagacgaaaaatacaatcacatcgacgagtccgagatgaaaaaagtggagaaatcggtgaacgaagtgatggaatggatgaacaacgtaatgaatgctcaagccaaaaagagtctggaccaggaccccgtggtcagggcacaggaaattaagacgaaaatcaaagaactgaataatacctgtgagccagtggtcacacagcccaaacccaagattgaatcacctaagctggaaaggacgccaaatgggccaaacatcgacaagaaggaggaagacttagaagataaaaataactttggtgcggagccacctcaccagaatggcgagtgctatcccaatgaaaaaaattctgttaatatggacttagattag

SEQ ID NO: 225699 - DNA, 414 bp, Artificial Sequence
  Description of Artificial Sequence: Synthetic coding sequence
atgtttgaagagttaggccagcgactgcaacactacgccaagatcgccgctgactttcgcaacaaagacgaaaaatacaaccacatagatgaaagtgagatgaagaaggtcgaaaagagcgttaatgaagtgatggaatggatgaataacgtgatgaacgcccaggccaagaaatctctcgatcaagaccccgtggtgcgagcacaggaaatcaagaccaaaataaaagaactgaacaacacctgcgaaccagtagttacccagccaaaacccaaaatcgagagtccaaaacttgaacggacgcccaacggtccaaatatcgacaaaaaggaagaggaccttgaggacaagaacaacttcggggctgagccaccacaccagaacgactcgtgtggcattgtgaactcatattag

SEQ ID NO: 225700 - DNA, 2034 bp, Artificial Sequence
  Description of Artificial Sequence: Synthetic coding sequence
atgtacatgggcgaagagcatctgttcagcgtggaacagatcaccgccatgctgctcacaaagctgaaagagacggccgaaaatagcctcaagaaacccgtcacagactgtgtcatttcagtgctcgggaccgcctttgacccctttctggggggaaaaaatttcgacgagaagttggtcgagcacttttgcgcagaattcaaaacgaaatacaaactggatgccaagtcaaagataagagccttgctcagactttaccaagagtgcgagaagttgaaaaaacttatgagctccaattccactgacttgccactcaatatcgagtgcttcatgaacgacaaggacgtttctggcaagatgaaccggagtcaattcgaagagctgtgtgcagagctgttgcagaagatcgaggtacccctgtacagtttactggagcaaacgcacttgaaggtcgaagatgtcagcgcagttgagatcgtcggcggagccactaggatacctgcagtaaaagagaggattgctaaattctttgggaaggatatttcaactaccctcaacgcggatgaggccgttgcaagaggttgtgctcttcagtgcgccatcctctctcctgcttttaaagtgcgggaattcagtgtgacagacgcggtacccttcccaatatcactgatttggaaccacgattccgaggacacagaaggagtccacgaggtgttcagcaggaatcatgctgcccctttctccaaagtccttacctttctccggaggggcccttttgagctggaggctttttactccgatccacagggtgtgccttacccagaagccaagatcgggcgatttgtggtacagaatgtgtcagcacagaaggacggtgagaaatcacgagtaaaggttaaggttcgcgtgaacactcacggaatcttcactatctcgaccgcgtctatggtggagaaagtaccaaccgaggaaaatgagatgagcagtgaggccgacatggaatgcctcaatcaacgtccccctgagaatcccgacactgataaaaacgtccagcaggacaactctgaagcagggacgcaaccccaggtgcagaccgacgcccaacaaacctctcagtctccccctagcccggagctaaccagtgaagagaacaaaattcccgatgctgacaaagcgaacgaaaaaaaagttgaccagcctcccgaggccaagaaacccaaaataaaggtagtcaatgtggagctcccaattgaggccaaccttgtgtggcagctcggaaaggacctgttgaacatgtatatcgagacagagggtaagatgatcatgcaggacaagctcgagaaggagcggaatgatgccaagaacgccgttgaagagtatgtctatgagttcagggacaagctgtgcgggccatatgaaaagttcatttgtgaacaagatcaccagaacttcctgcgtttgcttacagagaccgaggactggctgtatgaggagggagaggaccaggcgaaacaagcatacgtagataagctggaggagctgatgaagatcggcacaccggttaaggtgcgatttcaagaggccgaggaaagaccaaagatgttcgaggaactcggccagcgcctgcagcattacgcgaagatcgctgcagatttcaggaataaagacgagaagtacaaccatatagatgagtcggagatgaaaaaggtggagaagtctgtcaacgaggtgatggagtggatgaataacgttatgaatgcccaagccaagaaatctctggaccaggatccagtggtgcgcgctcaggaaattaagaccaagattaaagaactgaacaacacttgcgagcccgtcgtcacgcaaccaaagcccaagatagaaagtccgaagctggagcgaactcccaatggccctaacattgacaagaaggaagaggatctggaagacaaaaacaatttcggtgctgagccacctcatcaaaatggtgagtgttatcctaacgagaaaaatagcgtgaatatggatctggactag

SEQ ID NO: 225701 - DNA, 1920 bp, Artificial Sequence
  Description of Artificial Sequence: Synthetic coding sequence
atggccagggagagaccctgtagatgtcacggcaacggtggacgctccccaggaacgggctgtcctctgggtaggatattcccagagggatcacggaggaggaagagaaaatggcacgttgaaggcccagtggaagctccccgaaacgggcagaccccccgtgctggagcggagcgcggtcaaggacgtaagagacgacaagagaagcaggctggtggcatcgaaaccatcgccaacgaattctctgacagatgtaccccttccgtgatctctttcggctctaaaaacagaacaataggggtcgccgctaagaatcagcaaattacccacgccaacaacacagtctccaattttaagcggtttcacgggagagcttttaacgatcctttcattcagaaagaaaaggagaacctttcgtacgatctggtgcctctgaagaatggaggtgttggaatcaaggtcatgtatatgggggaagagcatctcttctccgtggaacagatcactgccatgctcctgacaaaactgaaggaaaccgccgagaattctcttaagaaacccgtgactgactgcgtaatatccgtgcccagttttttcacagacgcggaaagaaggagtgtgctggacgctgcacaaatcgtcggccttaactgcctccgtctgatgaatgacatgacagctgtcgcgttaaactatggtatctacaagcaggacctgcctagcctggacgaaaaacctcgcatcgtggtttttgttgacatggggcactctgcattccaggtgtcagcatgtgcctttaataaggggaagctcaaagtgctgggtacagcattcgatccttttcttgggggaaaaaattttgacgagaagctggtggagcacttttgcgccgagtttaaaactaagtataagctggacgcaaagtcgaaaattcgcgctttattacgcctgtatcaggagtgtgaaaagctcaaaaaactcatgtcctcaaactccacagacctacctctcaatatcgaatgtttcatgaatgataaggatgtatccggtaagatgaaccggtcccagtttgaggagctctgtgccgagctgctccaaaagatcgaagtgcctttgtatagcttactcgagcagacacacctgaaagtggaggatgtctctgcggttgaaatagtgggcggtgcaacaagaattcctgcggtgaaggagagaattgcgaagtttttcggcaaggatatctccaccactctgaatgctgatgaagctgtagcacggggatgcgccctgcaatgtgcaatcttgtctccggctttcaaggtgcgggagtttagcgtcaccgatgctgtacccttcccaatttctttgatctggaaccatgacagcgaagataccgagggagtgcacgaagtgttcagtcggaaccacgccgctccattttcaaaggtgctcacttttctccggcgtggcccatttgagctggaggctttttacagtgacccccagggggtgccatacccagaggccaaaattgggaggtttgttgtgcagaacgtcagcgcccagaaggacggggagaagagtagagtgaaagtgaaggtccgggtgaacacccacggcatttttaccataagtaccgcttccatggtggagaaggtgcctaccgaggaaaacgaaatgtcctccgaggcagacatggagtgcctcaaccagcgtccgcctgaaaatcctgatacagacaagaatgtccagcaggacaactccgaagcaggaacacagccccaggtgcaaaccgacgcacagcagaccagccagagcccgccttctccagaactaacatccgaagagaacaaaatccctgacgccgacaagcagatgaaaaagaaactcactagccttcagaaattgaaatcaccgaagtag

SEQ ID NO: 225702 - DNA, 2583 bp, Artificial Sequence
  Description of Artificial Sequence: Synthetic coding sequence
atggctaccgccgctgtccttagggggccagcagcccattgggtcgaatcgttccagaaagccagagaggaggggagtggctcaggcacctggaggggtcggtggcgacgcaggtctgtgatctcttttggcagcaagaaccgcacaattggtgtcgcagctaagaaccagcagataacccatgctaataacactgtttctaactttaagagattccacggtcgggcattcaatgacccctttatccaaaaggagaaagagaatctaagctatgatttggtgccactaaagaacggcggagtgggcatcaaggtgatgtatatgggtgaggagcacctcttcagcgttgagcagattaccgccatgctcctcactaaactcaaggagaccgcagagaactcactcaagaagcccgtgaccgattgcgtgatctccgtgcccagcttttttacagatgctgaaaggcgatcagtactggatgctgcgcagatcgtggggctcaattgcctgcgtttgatgaacgatatgaccgcagtggcactgaattatggcatatataaacaggatttaccttccctcgacgagaagccacggattgtggtctttgtggatatgggtcacagtgccttccaagtctcggcatgcgccttcaataaggggaaactcaaagttttgggcaccgcattcgatccatttctcggcggaaagaactttgacgagaagctggtggagcacttctgtgccgagttcaagactaagtataaactcgacgccaagtctaaaatccgggctttactgcgactctaccaggaatgtgagaagctcaagaaacttatgtcttcgaacagcacagacctgccacttaacatcgagtgcttcatgaacgacaaggacgtctctggcaaaatgaataggtctcagttcgaagaactctgcgccgagctgctgcagaaaatcgaggtgccactgtattcgctcctggaacagacacaccttaaagttgaagacgtcagcgcagtggaaattgtgggcggagcgacccgcatccctgctgtcaaggaacgaattgccaaattttttggaaaagacatctcgaccaccttgaatgcagatgaggccgttgcccgaggttgtgcacttcaatgcgcgatcctgagccctgcctttaaggtgagggagttctctgtgaccgatgccgtcccctttcctataagcctgatctggaaccacgactccgaggacacagaaggcgtgcatgaggtattttctagaaatcatgctgcccctttctctaaagttttgaccttcctgcggcgaggaccgtttgagctggaagcattctacagtgacccacaaggggtcccgtaccccgaggcaaaaatcggaagattcgtggtgcaaaatgtttcagcgcaaaaagacggcgagaaaagtcgggtgaaagtgaaagtgagagtgaatacccacgggatttttactatttccacagcctcgatggttgagaaggtcccgactgaggagaacgaaatgtcgtctgaagctgacatggaatgtctgaaccagcgaccgccagagaaccctgatacggataaaaatgtgcaacaggacaattccgaagcgggtacccagccccaggtgcagacagacgctcaacagacgagccagtctccccctagtcccgagcttacttcagaggagaacaagatccccgatgccgacaaagccaacgaaaagaaggtagaccaaccacccgaggctaaaaagccaaaaattaaagtggttaatgtggagcttcctatcgaggcaaacctggtctggcagttaggcaaggacctgttaaatatgtacattgagacagaggggaagatgataatgcaggacaagctggaaaaagagcgcaacgacgccaaaaacgccgtggaggaatacgtctatgaattcagagacaaactgtgcggcccatacgaaaagttcatttgtgagcaggaccaccaaaacttcctcaggttgctgaccgaaaccgaggactggctgtacgaagagggggaggaccaagcgaagcaggcctacgtggacaagcttgaggaactgatgaaaattggtaccccggttaaagtacgatttcaggaagctgaggagagaccaaagatgtttgaagagcttggacagagactccagcactatgctaaaatcgcagctgacttcagaaacaaagacgaaaagtataaccatatcgatgagtcagagatgaagaaggtggagaaatctgtaaatgaagtcatggaatggatgaacaacgtgatgaacgcccaggcaaaaaaatctctggaccaggatccagtcgtccgggcacaggaaattaaaacaaagatcaaagagctgaataacacttgtgaacccgttgtgacacagcctaaacccaaaattgaatcgcctaaactagagaggacaccaaacgggcctaacattgataagaaggaggaggacctggaggataagaataacttcggagccgaacccccacaccagaacggggagtgttaccccaacgagaaaaacagtgtcaatatggatcttgattag

SEQ ID NO: 225703 - DNA, 582 bp, Artificial Sequence
  Description of Artificial Sequence: Synthetic coding sequence
atggattcgactttagctgtgcaacagtatatccagcagaacattcgagccgattgttctaacattgataaaatcctcgagccaccggaaggccaggacgagggcgtgtggaagtatgaacacctcagacaattttgcttagaactgaatggactggctgtgaagctacagtcagagtgccaccctgatacctgcactcagatgacagctactgagcagtggatcttcttatgcgccgctcataagacgcctaaggagtgcccggctattgattacacacggcatacactggacggggctgcttgtctcttgaatagtaacaagtatttcccatctagggtcagcatcaaggaaagtagcgtcgccaagctcggcagtgtgtgcagacggatctacaggatcttcagccacgcgtatttccaccaccgtcagatcttcgacgagtacgaaaacgaaactttcctatgccacaggttcactaagtttgtgatgaagtataatttgatgtctaaggacaacctgatcgtgccaatactggaagaagaagtacaaaatagcgtttcaggcgaaagcgaagcatag

SEQ ID NO: 225704 - DNA, 306 bp, Artificial Sequence
  Description of Artificial Sequence: Synthetic coding sequence
atggcgggtcaggctttccgcaaattccttcccctcttcgacagggtgctggtcgaacgcagcgctgcggagacagtcactaaagggggtatcatgctgccagagaagagccagggaaaagtgctgcaggccacggttgtggctgttgggagcggtagcaaggggaaaggtggggagatccagccagtgtctgtgaaagtcggtgacaaggtgctccttcctgagtatggcggaaccaaggtggtgctcgacgataaagtgtgcaagctcaataactcaaagaaaaagagcgacatctgtaactag

SEQ ID NO: 225705 - DNA, 144 bp, Artificial Sequence
  Description of Artificial Sequence: Synthetic coding sequence
atggggggagaaattcagccagtttcagtaaaagtaggcgataaggtcctgctgccagaatatgggggaacaaaagtcgtccttgacgacaaggactacttcctgttccgggacggtgatatccttggcaagtatgtggactag

SEQ ID NO: 225706 - DNA, 591 bp, Artificial Sequence
  Description of Artificial Sequence: Synthetic coding sequence
atggcagatggccaaatgccattctcttgccactaccccagcagactgcgtcgagatccattcagagatagccccttgagttctcggctcttggacgatgggttcggaatggatccgttcccagacgacctcacagccagctggcccgattgggctctgccacggctgtcttcagcttggcctgggaccctgcggtcaggaatggttcctagggggcctacagctaccgccaggttcggggtgccggcagaaggcagaacccctccacccttcccgggagagccatggaaggtctgtgtaaatgttcactcatttaagcctgaagaacttatggtcaaaaccaaagacggttacgtcgaggtctcaggcaaacacgaagaaaagcagcaggaggggggaattgtgagcaagaattttacaaagaaaattcagttgccagcagaggttgaccccgtcacagtgttcgcatctctgagccctgagggattgctgatcattgaagcacctcaagttcctccatactctacttttggtgagagcagctttaataatgaattaccacaggatagtcaggaagtcacttgcacatag

SEQ ID NO: 225707 - DNA, 453 bp, Artificial Sequence
  Description of Artificial Sequence: Synthetic coding sequence
atggcaaaaataatcttacgccacctaatagaaatacccgtgcgatatcaagaagaattcgaggccagagggcttgaggactgtaggctggatcacgcgttatatgcactcccaggcccaactattgtcgacttgagaaaaacccgggctgcgcaatctccccctgtggatagcgctgccgaaaccccccctcgggaaggtaagtcccattttcagattctgttagacgttgtccagttcctgccagaagacattataattcagacctttgagggttggttgttgatcaaagcacagcacgggacccggatggacgaacatggcttcatttctagatcctttacgaggcaatataaactcccagacggagtggagattaaggacctgtcagccgtgttgtgtcacgatggaatcctggtggtagaggtaaaagatcccgtggggacaaaatag

SEQ ID NO: 225708 - DNA, 513 bp, Artificial Sequence
  Description of Artificial Sequence: Synthetic coding sequence
atgagtcacaggacatcttccactttccgggctgaacgttcatttcattccagcagctcatctagctcatcctctacatcatccagcgcctccagggccttgcctgcacaggatccacctatggaaaaagcattgagcatgtttagcgatgacttcggcagcttcatgcggccacattcagagcctctcgccttcccagccaggcctggtggggcaggtaatataaagaccctcggggacgcttatgaattcgctgtcgacgttcgcgacttttcccctgaagatattatcgtgacaacaagcaataatcacatcgaggtgcgcgctgagaagttagccgctgacggcacagtgatgaacacctttgcccataagtgtcagcttcctgaggacgtggacccgaccagtgtgacctcggccttaagagaagatgggtctctaacgatccgggctcgcaggcatccccatactgaacatgtgcagcagacgttccgtaccgaaataaagatatag

SEQ ID NO: 225709 - DNA, 792 bp, Artificial Sequence
  Description of Artificial Sequence: Synthetic coding sequence
atgtctggatgtgaactatcaccattaggactgagagttggcctgtccgcaggcccagctcacgggaggcgattcccggctccttcgggaccctggcggggtctcaacctagcctcacgtcagggcgcaggcccaaaacctcgcgatagtaggccgtacaaggccgcagccgtcggagcctggcatgcccgacctgaagcctgtgcgcacactttgagctgccctgccttggccagactaggtagggctaggcggcgaccttggatgagtcaccgaacgtctagcacattccgtgcagaaagaagcttccactctagtagctcctcttccagtagctcaaccagctcaagcgcttctcgcgcactgcctgcacaagacccccctatggaaaaggctctgtctatgttctcagacgattttgggtcttttatgaggccccatagcgagccactcgctttccccgctgcgcatccaacagcgagacccggaggggcagggaacattaagacactaggggacgcatacgaattcgccgtggatgtgagggacttctctcccgaggatataattgtgactacttccaataaccatatcgaggtacgcgcagagaagctggccgctgatgggacggtgatgaacaccttcgctcataaatgccagctcccagaggatgtggatcccacatccgtaaccagcgcccttcgggaggatggttccctgactattagggcacggcgtcacccacatacggagcacgtgcagcaaaccttccggaccgaaattaaaatatag

SEQ ID NO: 225710 - DNA, 528 bp, Artificial Sequence
  Description of Artificial Sequence: Synthetic coding sequence
atgtctcaccgcacaagctcaaccttcagggccgagcgatctttccattcctcttcaagctcgtcaagttcaagcaccagcagcagcgccagtcgcgcactgccagcccaggatccacctatggagaaggcgctaagcatgttctccgatgacttcggtagtttcatgcgccctcattccgagccacttgcttttccggcagcccatccgaccgcgaggcccggaggagcgggtaatattaaaacactgggggatgcctacgaattcgccgtcgacgtccgagactttagcccagaggatatcatagttacgacaagcaacaaccacattgaggtccgtgccgagaagctggcagccgacggtaccgttatgaatacctttgcccacaaatgtcaattgcctgaagacgtggaccctacgagtgtgaccagcgcacttcgagaggacggctccctgactatacgggcaagacggcacccccacactgaacatgtccagcagaccttccggactgaaattaaaatctag

SEQ ID NO: 225711 - DNA, 207 bp, Artificial Sequence
  Description of Artificial Sequence: Synthetic coding sequence
atgtcacataggaccagtagcacgttcagggctgagagaagcttccacagcagcagttccagttcgagtagtagtacttcaagctccgccagcagggcattgccagcacaggaccccccaatggagaaggctctaagcatgttttctgacgacttcggaagctttatgcgccctcatagtgagcccctcgcctttcctggcaagtag

SEQ ID NO: 225712 - DNA, 1722 bp, Artificial Sequence
  Description of Artificial Sequence: Synthetic coding sequence
atgctgcggctgccaaccgtgttcagacagatgcgccctgtttcgcgtgtactggcacctcatcttacccgagcctacgccaaagacgtcaaatttggcgcagatgccagggccttaatgttacagggagttgatttgctcgccgatgcagtcgccgttaccatgggacccaaagggaggactgtgatcatcgaacagtcatggggaagccccaaggtgacaaaagatggagtgacagtcgccaaatctattgacctcaaagacaagtataaaaacatcggagccaagttagtgcaggacgtggctaataacacaaatgaagaggccggtgatggtaccactactgctactgttctggcccgttccattgctaaggagggcttcgaaaagatcagtaaaggagcaaacccagttgagattcgtcggggtgttatgttggcggttgatgccgttatagccgaacttaagaagcaatcgaaacccgtcacaaccccagaggaaatagcacaagttgcgacaattagcgctaacggggacaaggaaataggcaacatcatctctgacgcgatgaaaaaagttggcaggaagggcgtaattactgtgaaggatggtaagaccctgaatgacgaactggagatcatcgaaggcatgaaattcgataggggttatattagcccttactttatcaacactagcaaagggcagaagtgtgaatttcaggacgcctacgttctgctatctgaaaaaaagatttcttcgattcaaagcattgtgcctgctctggagattgctaacgcccatcgaaagcctctcgtgattatagccgaggacgtggacggggaagcactcagcactttggtactgaacaggttgaaggtaggacttcaggttgtggcggtgaaggcacccggtttcggcgataaccgaaagaatcagctcaaggacatggccatcgctacgggcggtgccgtattcggcgaggaaggtctcaccctcaacctggaggacgtccagccacacgatttgggcaaggtcggcgaggtgattgtgactaaagatgacgctatgctcctcaaaggaaagggtgacaaagctcaaattgaaaaacgaatacaagaaatcattgagcagctggacgttactaccagcgaatacgagaaggaaaagcttaatgagagactggcaaagctgagcgatggtgttgccgtgctgaaggtgggcggaacaagcgatgtcgaagttaatgaaaagaaagatagagtcacggatgcacttaatgctacccgggctgcagtggaggagggaatcgtgcttggaggcggttgtgcactactgcgatgtatcccagccctggattcgttgacaccagccaacgaagatcagaaaatcggcattgagattatcaagcggaccctgaagattccagctatgactatagctaaaaacgccggagtggagggaagtttaattgtggagaagattatgcaaagttccagtgaagttgggtacgatgctatggccggagatttcgtgaatatggtagagaaggggattatcgaccctacgaaagtcgtgcgcacagccctgctggatgcagctggggtcgcctctcttctcacaacggccgaggtagtcgttacggaaataccaaaagaagagaaggaccctggaatgggcgctatgggagggatgggaggaggcatgggcggtggcatgttttag

SEQ ID NO: 225713 - DNA, 1722 bp, Artificial Sequence
  Description of Artificial Sequence: Synthetic coding sequence
atgctgcggctcccaactgtgtttcgccaaatgaggccagtgtctagagtcttagccccacacttgactagagcgtatgctaaagacgttaagtttggagctgacgcaagagctctcatgctccaaggagtcgacctgttagctgatgccgtggccgtcacgatgggacccaaaggcagaacagttatcatcgaacagagttggggctctccaaaggtgacaaaggacggcgtcaccgtagctaaaagcattgatcttaaggataaatataagaacattggcgctaagctggtgcaggatgtcgcgaacaatactaacgaggaggcaggtgacggtaccaccacagccaccgtactcgccagatccatcgcaaaggagggattcgaaaaaatctcaaagggggctaatcccgtggagatccgtcgaggtgtgatgctcgccgtggacgcggtcatcgctgagttgaaaaagcagagtaagcctgtcaccacaccggaggaaattgcacaggtggccactatttccgctaatggagataaggagattggcaacataataagcgatgccatgaaaaaggttgggagaaaaggggtgataactgtgaaggatggcaagacacttaacgacgagctcgagatcatcgaaggaatgaaattcgatcggggatacatttcaccctatttcatcaatacctcaaagggtcagaaatgcgaattccaggacgcctatgtactgctctctgaaaagaagatttccagtattcagtcaatagtgcccgctctggagatcgctaacgcgcaccggaagcctctcgtcataatagccgaagacgtcgacggggaagcattatcaactctggtactgaatcgactgaaggtcggtcttcaagtggtcgcagttaaggccccagggtttggggacaacagaaaaaaccaactgaaagacatggccatcgcaactggcggagcggtgtttggggaagaggggctcactctgaacctggaagatgtccagccccatgacttggggaaggtaggagaagtaatcgtgaccaaagacgatgctatgttactcaagggaaagggcgacaaagcacagattgaaaagcgcatacaggagataatcgagcagctggacgtcacgacttcagagtacgagaaggaaaaactgaatgagaggctggctaaactctcagatggtgtagcagttctgaaggtcggtggcactagcgacgtggaggtgaatgagaagaaagacagagtcacagacgccctcaacgcaaccagggctgctgtcgaagaaggcattgttctggggggaggttgcgcccttcttaggtgcatccccgctctggacagtctgactcctgccaatgaggatcagaaaattgggatcgagatcatcaagcgtacgcttaagatccctgcaatgaccattgccaagaatgcgggtgtggaaggatccctgatagttgagaagatcatgcagtctagctctgaagttggatatgatgcgatggcaggagacttcgtaaacatggtcgagaaaggtataatcgatccaacaaaggttgtgaggaccgcactcctagacgcagccggtgtagcaagtctgctgacaacggctgaggtggtcgtaacagagattccgaaagaggaaaaagacccgggtatgggtgccatgggcggaatggggggtggaatgggtggcggtatgttctag

SEQ ID NO: 225714 - DNA, 177 bp, Artificial Sequence
  Description of Artificial Sequence: Synthetic coding sequence
atgttacgactgcccacagtatttcggcagatgcgcccagtctctcgggtccttgccccacatctgactcgtgcatatgccaaggacgtgaagttcggagccgacgcaagagcccttatgctgcaaggcgtggacctcctggcagatgctgtagctgtgactatgggcccaaagtag

SEQ ID NO: 225715 - DNA, 285 bp, Artificial Sequence
  Description of Artificial Sequence: Synthetic coding sequence
atgttgagattgccgacagtcttcagacaaatgcgtcctgtttcccgcgtgctggcaccccatctgacccgtgcgtatgcaaaggatgtcaaattcggggctgacgcgagggcacttatgttgcaaggcgtggatctcctggctgatgctgtagccgtgaccatgggacccaagggaagaacagtcatcatcgagcagagctggggttctccgaaggtaaccaaggacggtgtgaccgtcgcgaagtctattgatctgaaggacaagtataagaacataggctag

SEQ ID NO: 225716 - DNA, 705 bp, Artificial Sequence
  Description of Artificial Sequence: Synthetic coding sequence
atgcttcgcctacccaccgtgttccgacagatgaggcccgtaagccgcgtgctggcccctcatctgacgcgtgcctacgccaaggatgtaaaattcggcgctgacgccagagctcttatgctgcaaggagtggacctgttggctgacgcagttgctgtaacaatgggccctaagggtaggaccgtgatcattgaacagtcttggggcagccccaaggttacaaaagatggcgtaactgtggccaagagcatagacctgaaggacaagtataagaatattggcgctaagctcgtccaggacgtagcgaataatacaaatgaagaagcaggagacggcaccacgacagccactgtgctagcgcgttcaattgccaaggaaggctttgagaaaatctcgaagggcgctaaccctgtagaaatacgcaggggcgttatgttggcggtcgatgccgtcatagccgaactgaagaaacagtctaaaccagtgaccacccccgaagagattgcgcaggtagccaccataagtgccaatggggacaaggagatcggaaacatcatatctgacgcgatgaagaaagttggcagaaagggtgtcataacagacggaaaaaccttgaacgatgagcttgagatcatcgaggggatgaaattcgaccggggttacatttctccctattttataaacaccagcaaagggaagaattag

SEQ ID NO: 225717 - DNA, 252 bp, Artificial Sequence
  Description of Artificial Sequence: Synthetic coding sequence
atgcttcgccttccaaccgtctttcggcaaatgaggcccgtttctcgggtgctggccccacacctgacacgggcttatgcaaaggacgttaagtttggcgcagatgcacgggcactcatgctgcagggggtggacctgcttgcagatgccgtggccgtgacaatgggacctaaaggaagaacggtgattattgaacaaagctggggttcccccaaggtgacgaaggacggcgtcacagttgctaagtcctag

SEQ ID NO: 225718 - DNA, 666 bp, Artificial Sequence
  Description of Artificial Sequence: Synthetic coding sequence
atgctgagattacccacggtcttcagacagatgagaccggtctccagagttttggcaccccaccttacacgcgcttatgccaaggatgtgaagttcggggctgacgccagggctctcatgttgcagggtgttgatcttctcgccgacgcagtggctgtgactatggggcctaagggcagaaccgtcatcattgagcagtcctggggctcgcctaaagtgacgaaagacggtgtgaccgtggccaagtccatcgatctgaaagacaagtacaaaaatatcggcgctaaattagtgcaggacgtcgcgaacaatacaaacgaagaggccggtgacggaactacgaccgctactgtgctggcacgctccattgcaaaagaaggatttgagaagattagtaagggggctaatcccgtggaaattcggagaggcgtgatgctcgcagtcgacgctgttatcgcagagctgaagaaacagagtaagcctgtaacaaccccggaggaaatcgctcaggtggcgaccattagcgccaacggcgataaggaaattgggaacatcataagtgacgctatgaagaaagtgggtcgcaagggagtgatcaccgtgaaagacggcaaaaccctgaacgatgagttggagatcatcgagggcatgaaatttgaccggtag

SEQ ID NO: 225719 - DNA, 738 bp, Artificial Sequence
  Description of Artificial Sequence: Synthetic coding sequence
atgctggcggtagatgccgtgattgccgagctgaagaaacagtccaagcccgtaacgacacctgaggagatcgctcaggttgcaaccattagcgcgaatggggataaggaaataggcaatatcatttctgatgctatgaagaaagtcggcaggaagggtgtgataacagtaaaggacggtaagactttgaacgatgagttggagatcatcgagggcatgaagtttgaccgcggatatatatctccttatttcatcaacacaagcaagggacagaagtgcgaatttcaggatgcttatgtgcttcttagcgaaaagaaaatctcgtccattcagagtatcgtcccggcattggaaattgcaaacgcccatcggaagcctctcgtgattattgccgaggatgttgacggagaggcattgagcacgcttgtgctaaataggctcaaagttggccttcaggtggtggccgtgaaggcccctgggtttggcgataacaggaagaatcaactgaaagacatggctatcgctacgggaggcgcagtgtttggcgaggaaggcctaacactcaacctcgaggacgtgcaaccccacgacctgggcaaggtgggcgaagtgatagtcaccaaagacgacgccatgctgctcaagggtaagggagataaagcccagatagagaagcggatacaggagatcatagaacagctcgatgtcaccacgtctgagtatgaaaaagagaattag

SEQ ID NO: 225720 - DNA, 477 bp, Artificial Sequence
  Description of Artificial Sequence: Synthetic coding sequence
atgctgcgccttcccaccgtttttcgccagatgcgacccgtgtcgcgtgtcttagcccctcatctcactcgagcctacgcaaaggatgtgaagttcggggctgacgccagggccctcatgctgcaaggggtagatctgctcgctgatgccgtggccgtgaccatgggccctaaggggaggactgtgatcatcgagcaatcctggggtagtcctaaggttactaaagatggcgtaacagtcgctaaaagcattgatctgaaggacaagtataaaaatatcggagcaaagttggttcaagatgtggctaacaataccaatgaggaagcaggagacggtacgactaccgccaccgtgctggccagaagtattgctaaggaaggttttgaaaagatttccaagggcgcaaatccagtcgaaattagacgtggtcgtaacgtgtgctgccatcactctgtgctgaacttttcagtcctctag

SEQ ID NO: 225721 - DNA, 2061 bp, Artificial Sequence
  Description of Artificial Sequence: Synthetic coding sequence
atgctagccgtgcctgaaatggggttgcaggggctgtatatcgggtcttcaccagaaagatcaccagtccccagcccacccggtagtcctcgaactcaggagagctgcggaattgccccactgacgccgtcacagtctccgaaaccagaggtccgcgctccacagcaggcttctttttctgttgtggttgcaatcgattttggaaccactagttccggctacgccttttccttcgcctccgacccagaagccattcacatgatgagaaagtgggaggggggagacccaggcgtggcacatcagaagactccaacctgtttgctgctcaccccagaaggcgcattccacagctttgggtacactgctcgtgactattaccatgaccttgacccagaggaggcccgtgattggttgtacttcgagaagttcaagatgaagatccactccgccacagacctaacactcaaaacccagctggaagctgtgaatgggaaaactatgcctgccctggaagtgttcgcccatgcactgcggttttttagagagcacgcccttcaggagctgagagaacagagccctagtctccctgaaaaggatacagtgcgatgggtgctgacagtgcccgcaatttggaagcagcctgctaagcaatttatgagggaggccgcatacctggctggactggtttcccgcgaaaatgctgaacagctgctgatcgcactagaacctgaggccgcaagcgtctattgcaggaagttaagactccaccagctcttggaccttagtggtcgggcacccggtgggggtagacttggtgaacgcaggtccatcgactcctcattcaggcaggccagagagcagctgaggcggtccagacactccaggaccttcctggtcgagagtggggtgggcgagctctgggcagagatgcaggccggagaccgatacgtcgtggcagactgcgggggtggcaccgtcgaccttaccgtgcaccagctggagcagcctcacggcacactgaaggagttatataaggcctcgggtggtccctatggcgcagtgggagtcgacctcgccttcgagcaactcctgtgcagaattttcggcgaagattttatagccacctttaagagacagcgacctgctgcctgggtagacctgaccattgctttcgaagcgaggaagaggactgccggtcctcaccgggctggcgctttgaatatttcactccctttttccttcatcgatttttatcgcaagcagcgagggcataatgtggaaacagccctgcgaaggtcaagcgtgaatttcgtcaaatggagctcacaaggcatgctgagaatgagctgtgaagcaatgaatgagttgtttcagcctaccgtaagcggcatcatccaacatatcgaggctcttctcgcccgacccgaagtccagggcgttaaactgctgtttcttgtaggtgggtttgccgaatctgctgttctgcagcatgccgtccaggctgcccttggagcccgaggattgcgggtggtggttccacacgacgtgggacttacaattcttaaaggggcagtgctttttggccaagccccaggcgtggtgcgggtccgcagaagtcctttgacctatggggtaggcgtgctcaacagatttgttccgggaagacatcctcccgagaagctgttagtccgggacggaagaagatggtgcactgacgtgttcgaacgctttgtggcggctgagcagagtgtggccctcggtgaagaggtccggagaagctattgccccgctcggcctgggcagcgaagggttctcataaacctatactgctgtgcggcagaggacgctagattcatcaccgacccaggggtgagaaaatgtggagctctcagcttagagttggagcccgctgattgtgggcaagacaccgcaggggctcccccagggagaagggaaatccgcgctgctatgcagtttggagacacggaaattaaggtaaccgccgtcgacgtgtcaaccaatcggagcgttcgcgcttccatagacttcctgtctaactag

SEQ ID NO: 225722 - DNA, 1803 bp, Artificial Sequence
  Description of Artificial Sequence: Synthetic coding sequence
atgatgcgaaaatgggaaggaggagacccgggtgtcgcccatcagaagacccctacttgcttgcttcttacccccgaaggcgcattccattcctttgggtacacagccagggactactatcatgacctggatccggaggaggctcgtgactggctgtatttcgagaaatttaagatgaaaattcactccgccactgaccttactctgaagacacagcttgaggctgtgaacgggaaaaccatgcccgctttggaggtgttcgcgcatgcactgcggttttttcgcgagcacgccctgcaagagttgcgtgagcagagcccaagtctccctgagaaggacacagttcggtgggtgctgactgtcccagcgatttggaaacagcccgcaaagcaattcatgagagaagccgcttacctggccggactggtgagtcgcgaaaacgcagagcagcttttgattgcgctggaacctgaggcagcctcagtttactgtagaaaactgaggttacaccagctgttggatctctcgggtcgagctcccggtggcggacgacttggggagagacgttcaatcgactccagcttccgtcaggcgagagaacagctgaggcggtcccgacatagtcgcacattcctcgtggagtccggcgtgggcgagttatgggcggagatgcaggcgggagatcgttacgtcgtcgctgactgtggcggtggcaccgttgatctcactgtccaccagctcgagcagcctcatggcaccctcaaggagctatacaaggcttcgggcggtccctacggcgcagtcggagtggatctcgcttttgagcagctgctttgccgaatattcggtgaggattttatcgctacttttaaaaggcagcgacccgcagcttgggtggaccttactattgcatttgaggcacgcaaacggactgccggacctcacagggccggtgccctgaatatcagcctgcccttctcttttattgatttttataggaagcaacgtggtcacaatgtggagaccgccctgagaaggtcgtccgtcaactttgtcaagtggtccagccaggggatgctacgtatgtcctgtgaggccatgaacgaactgtttcaacccactgtctcgggcatcatccagcatattgaagccctgctcgcccgtcctgaagttcagggagtcaagctgttgtttttagtgggaggatttgcagagagcgcagttcttcagcacgctgtccaggcggcactgggagcccgaggtctccgggtcgttgtacctcacgatgtggggttaacaattcttaagggcgcagtgctgtttggacaggcaccaggcgtggtgagagtaagaaggtctccgctgacctatggagtcggtgtcttgaacaggtttgtccccggacgccacccccctgaaaaattgctcgttcgcgatggtcgtaggtggtgcacggatgtgttcgagcggtttgtggccgcagagcaatccgtggcattaggcgaggaagtccggagaagttattgtccagcacgacctggccagcggcgtgtcttgattaatctatactgttgcgcagctgaggatgcacggtttataaccgaccccggtgtccgcaagtgtggtgcactgtccttagaactggagcccgctgactgcgggcaagatactgccggagcaccacccggacgaagggagatccgggctgcgatgcagtttggggacaccgaaatcaaggtcactgccgtagacgtgtcaaccaaccggtccgttagagcgagcatcgacttcttgtccaactag

SEQ ID NO: 225723 - DNA, 1563 bp, Artificial Sequence
  Description of Artificial Sequence: Synthetic coding sequence
atgccggctctggaagtgtttgcccacgccttgaggttcttcagggaacacgcattacaggaactgagagagcaatcaccctcactgccagaaaaagatactgtcagatgggtattaaccgtgccggcaatctggaaacagccggcaaaacaatttatgagggaagctgcctacctggcagggctggtgagcagggagaacgccgagcagctattgatcgctttagaacctgaggcagcttcagtctactgccgaaaacttcgcctgcatcagctgctcgacctttcaggacgggcacctggcggaggtcgcctaggagagcggagaagcattgactcctcgttcagacaggccagagagcagctgaggcgcagcagacatagtcggacatttctcgtcgagtcaggcgtgggtgaactctgggcagagatgcaagcaggtgatagatacgtagtcgccgactgtggcggtgggaccgttgacctgaccgttcaccaattggaacaaccccacggtaccctgaaggaactctataaggcatcagggggaccttacggtgcggtgggggttgatctggcgttcgaacagttgttgtgtcggatcttcggcgaagacttcattgccacgttcaagaggcagaggcccgcagcgtgggtagacctgaccatagcttttgaagccaggaagcggacagccggtcctcatcgagcaggtgcgctgaatatatccctgcccttttcattcatcgacttctaccgcaagcaacgtggacacaacgtcgagaccgcactccgccgttcatcggtcaattttgtgaagtggtcgtctcaaggcatgctcaggatgagctgtgaggcgatgaatgaactttttcaaccgaccgtttccggcattatacaacacatcgaggccctgctggctcgtcctgaggtgcagggagtaaagttgctgttcctggtgggtggattcgcagaatcagcggtcctgcagcatgcagtgcaggcagcgctgggagcgcgaggtctccgtgtggtcgtgcctcatgacgttggactgactattctgaaaggggcagtgctgtttgggcaggctccaggggtggtcagggtgcgcagatcccccctgacctacggcgtgggcgttttaaaccgctttgtacccggacgccatccccctgagaagctcctcgttagagacggacgcagatggtgtacagacgtgtttgaaaggtttgtggcagctgagcagtcggtggccttaggcgaggaggtgaggaggtcctattgccctgccaggcctggccagcggcgagtgctgatcaacctgtattgttgtgccgcagaagatgcacggttcataactgatccgggagtcagaaaatgcggagctttgtcactggagctagagcccgctgactgcggccaggacaccgccggagctccacctggccgtcgggaaatacgcgctgctatgcagttcggagatactgagattaaggtcaccgccgtggatgtatctactaaccgctccgtgcgggcaagcatagattttcttagcaactag

SEQ ID NO: 225724 - DNA, 2028 bp, Artificial Sequence
  Description of Artificial Sequence: Synthetic coding sequence
atggctgataaagaggcgggaggaagcgatggtccacgagagacggctcccaccagcgcttattcgagtcccgcacgtagcctaggagataccggtattacccccttgtccccatctcacattgtcaacgacactgatagcaacgtgagcgagcaacagagtttcctggttgtggtcgcagtagactttggaacaacatcatccgggtacgcttattcctttactaaggagccagagtgtattcatgttatgcgccgttgggaaggcggtgatcccggtgtttcaaaccagaagacgccaacaactattttgctaaccccagaaagaaagttccactcttttggctacgctgcgcgagacttctaccacgatctcgatcctaacgaggccaaacagtggctctacctggaaaagtttaagatgaaacttcacacgaccggcgatcttactatggataccgacctgaccgcagctaatggcaagaaggtgaaggcactggaaatatttgcctatgctctacagtattttaaagagcaagccctcaaagagttatcggaccaggccggaagcgagtttgaaaactcagacgtccgctgggtgatcaccgtccctgctatttggaagcaacccgctaagcaatttatgagacaggccgcttaccaagctggcctggccagtcccgagaactctgagcaacttatcatcgcactggagccagaggccgcttccatctactgccgaaagctgcgcttgcatcagatgatcgagctaagtagcaaagcggcagtaaacggctactctgggagcgatacagtgggcgctgggttcactcaagctaaggaacacattaggaggaaccgccagagcaggacgtttctggttgaaaacgtgataggtgagatatggtctgaattggaagagggcgataagtatgtggtggtcgactctggcggtggcaccgtggacctaacggtccaccagatacgcctacccgaaggccaccttaaagagttgtacaaagcgaccggcggaccttatggctcactgggcgtggattatgagttcgagaaactgttatacaagatttttggcgaagatttcattgaacagttcaagataaagaggcctgccgcttgggttgatcttatgattgcattcgagtcacggaagagagccgctgcacctgacagaactaatccactcaacataactctgccattcagtttcatcgactattacaagaagtttagggggcacagcgtggagcacgcattgaggaagtccaacgtcgacttcgtcaaatggagctctcaaggcatgctccgtatgagtcccgacgcaatgaacgctctgttcaaacccacaattgatagtatcattgagcacctgcgcgacctgtttcagaaacctgaggtgagcacagtgaagtttcttttcttggtgggcggttttgcggaagccccacttctgcagcaggctgtgcaggctgcattcggagaccaatgcaggatcatcattccgcaagacgtgggcctcacaatcttaaagggggctgtcctgttcggccttgatcctgccgtcattaaggtccgccgaagcccactgacgtacggcgtaggggttctgaatcgttatgtcgaaggcaagcaccctcccgagaagctcttggtaaaggacggtactcggtggtgtaccgacgtcttcgacaagtttattagcgcggatcagagcgtggctctcggggaattggtgaaacgctcctacaccccagcgaagccaagccagctggttatcgtaataaacatttactcttccgagcacgacaacgtgtctttcattactgatcccggtgtgaaaaaatgcggtaccctgcgcctcgacttaaccggaacctctggcacggccgtccctgccaggcgggagattcaaacactaatgcaattcggggacacagagattaaggcaacagctattgacattgcaaccagtaaaagcgtcaaggtagggatagatttccttaattattag

SEQ ID NO: 225725 - DNA, 819 bp, Artificial Sequence
  Description of Artificial Sequence: Synthetic coding sequence
atgagaagcctggacctggcaagtcagctgttgcggaatcagatcgtcaccgacccagacaatctcatggaggatgccgcatgggctaaacactgtgaccaaaatcttgtggcttctgatgccccaggcgaagaaggcactggcattctgaagagcaagagaacccaggccgctgaccatcaacctatcctgaagacagtaaaggcatcagacgaagactgccagctccggatatccgatcggatccgcgagacttcggacttggaagatagctgggacgagtcctccggggctggctgtagtcaagggacacctagttattcatccagtcacagtcttttccgcggagccgtggcaccatgccagtcctctcccatggcaagattgggcgtgtcaggggagccctccccatgcactagcaccaacaggtccacacccggagtggcctctacacctcaaacacccgtgtccagcagcagagcagggtttgtctcaggcggtgaccggccactgacatcggagcctcccccaaggtgggctcgcagaagaaggcgatcagtggccaggacaattgcagccgaactggccgaaaataggaggctggcccgagagctgtcaaaacgggaggaggagaaattggataggttaattgctataggtgaggaggcctctgcccagcaggacaccgctaacgaattaaggagggacgctgtgatcgccgtccggaggctcgcaactgctgtagaggaggccaccggggcttttcaactggggttagagaaactgctgcagcggctgatcagcaatacaaagtcatag

SEQ ID NO: 225726 - DNA, 1530 bp, Artificial Sequence
  Description of Artificial Sequence: Synthetic coding sequence
atggcagccattggagtccacttaggctgcacatccgcctgcgtcgccgtttacaaggacggcagggcaggagtggttgctaatgacgctggagacagggttacccctgccgtggtcgcgtattctgagaacgaggaaattgtgggcttggcggcaaagcagtcaaggatccggaacatttcaaacacggtcatgaaagttaagcagattctaggcagatccagctctgacccccaggcccagaaatatatcgcagaatccaaatgtcttgtcatagagaaaaacggaaagttgcgctacgaaattgatacaggggaggaaactaagttcgtgaacccggaagacgtcgctcgcctgatcttctccaagatgaaggaaacagcccacagcgttctaggcagcgatgctaacgatgtggtgattaccgtaccattcgacttcggcgagaagcaaaagaacgcactcggcgaagccgctcgagcggctggatttaatgtgcttaggcttatacatgagccatctgccgcactcctggcgtatggaattggtcaggacagtcctaccggtaaatctaatatcctggtcttcaagctcggaggcacgtctctaagtctctcggttatggaagttaattcaggaatctatagggtcctgtccaccaacacagacgataacatcggaggagcgcactttacggagactctggctcagtatttggcttcagagtttcaacgctccttcaaacatgatgtgagaggcaatgctagagctatgatgaaattgaccaattctgctgaagtggccaagcatagcttgagtaccctcggaagtgctaactgtttccttgacagtctatatgaaggccaagattttgattgtaatgtgtctcgcgctaggttcgaattactgtgctctcctctttttaataagtgcattgaggccataagagggctcctggatcaaaacggattcactgctgacgacataaataaagttgtactctgcggcggaagcagtcgcatcccgaaactgcagcagctaatcaaggacctttttcctgccgttgagctgcttaattctatccccccagacgaggttatacccatcggggcagccattgaagctggaattttaatcgggaaggagaacttgctggtggaggactctttgatgatcgaatgctccgccagggacatacttgtcaagggggttgacgaatccggggcatccagattcaccgtgctctttccatcgggaactcctctgcctgcaaggcggcagcataccctccaggcccctggctccatatcatctgtctgtttagagctctacgagagcgatggcaagaatagtgccaaggaggaaacgaagttcgcccaggttgtcctgcaagacctggacaaaaaggaaaatggacttcgtgatatcttagctgtccttacaatgaaaagagatggatcattgcacgtgacgtgtaccgaccaggagaccgggaagtgtgaggcgatctccattgagatcgcaagttag

SEQ ID NO: 225727 - DNA, 432 bp, Artificial Sequence
  Description of Artificial Sequence: Synthetic coding sequence
atggccgctatcggagttcatctgggttgtacatcagcgtgtgtggccgtctacaaggatggtagagccggtgtggtggcaaacgacgccggagatagagtcactccagccgtggtcgcctacagcgaaaacgaggagatcgtcggcttggcggcaaagcagtctaggatccgaaatatcagcaacacagtcatgaaggtgaagcaaatcctaggccgaagggtcctctccagagatcctcagctgcagcagctacctcagccattccagcggtgcagttgttctctctcggagcaaccacacgggcagactggttgcgtgcggggagcccagccacttcaccaacatcagcctcagcactcctgggggagcctccacactgcagactccagcctccttttcgaaagttggttttgcttctggtggggctag

SEQ ID NO: 225728 - DNA, 387 bp, Artificial Sequence
  Description of Artificial Sequence: Synthetic coding sequence
taggcttgtgtagccgtttataaggatggccgagccggagtggtcgctaatgacgccggagatagagtcacccccgcagtggtcgcctatagtgagaatgaagaaatagtgggtcttgctgctaagcagtctaggatccgtaatattagcaacacagtcatgaaggtgaaacaaattctcggcaggagttcctctgatcctcaagctcagaagtacattgccgaatcgaagtgtctggtgatcgagaagaatggcaaactgcggtacgagatcgatacaggggaagagactaagttcgttaatccagaagacgtcgcacgcttgatattcagtaaaatgaagggagcttattcaccctggagccaatctaactcagaggacggctag

SEQ ID NO: 225729 - DNA, 1926 bp, Artificial Sequence
  Description of Artificial Sequence: Synthetic coding sequence
atggcgaaggccgcagctatcggaatcgacctgggcactacctatagttgtgtgggagtctttcagcatgggaaggtcgaaattattgccaatgaccagggaaaccgcacaacaccaagctacgtcgcctttacagatacagagaggctgattggagacgctgccaagaatcaagttgctttgaacccgcagaacaccgtctttgacgccaaacgccttatcggcagaaaattcggtgatccagtcgtgcaaagtgatatgaaacattggcccttccaagtgattaacgatggcgacaagcccaaggtacaagtcagctataagggagagacaaaggcattctaccccgaagagatctcttccatggtgctcaccaagatgaaggaaatcgccgaggcctatctcggttacccagtaacaaacgctgtcatcactgtacccgcatacttcaatgatagccagcgccaggccaccaaggacgctggggtcatagccggtctgaatgtgttgcgtatcattaacgagccgacggctgcagcgatcgcctatggcctggacaggacaggcaagggagaaaggaatgtgctcatattcgatctcggaggcggaactttcgacgtttcaatcctcacaatcgacgacggaatatttgaggttaaagcgaccgccggagatacacatctaggcggtgaggactttgacaaccgtctcgtgaatcatttcgtcgaagaattcaaaagaaagcacaagaaggatatctctcagaataagagagcagtgcggcgtctccgaactgcttgtgagagagcaaaacgcactttgtcttcctcaactcaggcaagtctggaaattgactctttatttgaaggcattgatttctacaccagcattactcgggctcgctttgaggaactttgcagtgacttgtttagatctaccctcgagccggtggaaaaagcgcttcgggatgctaaactcgataaggcccagatccatgatctcgtcctagtggggggttccactaggatccctaaagtacagaaactattgcaggacttcttcaatgggcgagacctcaataaatccatcaaccctgacgaggctgtggcctacggggcagccgtacaagccgcaatcttaatgggtgacaagtctgagaatgtgcaggacttgctcctgttggatgtggccccacttagcctcgggctggagaccgcaggaggcgtgatgactgctctgattaagaggaactctacaattcccacaaaacagacccagatattcactacatactctgacaaccagccaggtgtcctgattcaggtctatgagggagagcgagcaatgacaaaggataataatctgctgggtcgatttgagctctcaggaataccacccgcaccaagaggagtcccgcaaatcgaagtaaccttcgatattgacgcgaatggcattctgaacgtgaccgccaccgataagtccacaggcaaggcgaacaaaatcaccatcactaatgacaaggggcgactgagtaaggaagaaatcgagcggatggttcaagaggccgaaaagtacaaggcagaagacgaggttcagcgggagcgcgtgtcagctaagaatgctttggaaagttacgctttcaacatgaaatctgccgttgaggacgaaggcttaaagggtaagatctcggaggcagacaaaaaaaaggttttggataagtgccaggaagtaatttcttggctcgacgcgaacactctggccgaaaaagacgagtttgagcacaagagaaaggagctcgaacaggtgtgtaaccccatcatcagcgggctttatcaaggagccggaggtcctgggccaggaggcttcggagcccagggaccaaagggcggtagcggaagtggtcccaccatcgaagaggtggactag

SEQ ID NO: 225730 - DNA, 1431 bp, Artificial Sequence
  Description of Artificial Sequence: Synthetic coding sequence
atggcaaaggctgccgcaatcggcattgacttggggaccacctattcctgcgttggagtgttccagcacggtaagggcgaacgtaatgtgctgattttcgacctgggaggagggacatttgatgtcagcatactcaccatcgatgatgggatttttgaggtgaaggccaccgccggtgatacccacttgggtggggaagacttcgacaacagactcgtaaaccattttgttgaagagttcaaacggaagcataagaaggacatatctcagaataaaagagcagtgagacgactgcgcacagcctgcgagcgagccaaacgcacactgagttctagcacccaggcatcactcgaaatcgacagcctgttcgaggggatcgatttttatacaagtatcacacgagcaagattcgaagaactctgttcagaccttttcagatccactttggaacctgtcgagaaggccctgcgcgatgcaaagctggataaggcccagatccacgacctggttctcgtcggagggtccactagaattccaaaagtccagaagctgcttcaagatttcttcaacggtagagacctgaataagagcatcaacccggacgaagccgtcgcctacggagcagccgtacaggctgctatcctgatgggagataaaagcgaaaacgtgcaggatttgcttctactggatgtggccccactttccctgggcctggagacagccggtggagtcatgactgccctgatcaagcggaactctacaattccaaccaagcagacacaaatatttacaacctactcggacaaccaaccgggtgtgctgattcaagtttatgagggagaacgggcaatgacaaaagataacaatcttttgggcaggtttgagctgagcggcattccaccggctcctagaggagtcccgcagattgaggtgacctttgacattgacgctaatggaatcctgaatgtgacagctacagacaagtctaccgggaaagctaacaaaataactattaccaatgacaaaggccgactcagcaaagaggagatcgagagaatggtccaggaggccgagaaatacaaagccgaagacgaggtccagagagagcgagtcagcgcaaagaatgcgctcgaaagttacgcattcaatatgaaatctgccgtagaggatgagggactgaaaggcaagattagcgaggctgataagaagaaagtacttgacaaatgccaggaggtgatctcctggctggatgcaaatactctagctgaaaaagatgagtttgaacacaaacggaaggagctggaacaggtgtgcaatccaataattagtggcctataccagggagctggagggcctgggcctggtggattcggcgctcagggcccaaaaggtggatccggctcaggcccaactattgaggaggtggactag

SEQ ID NO: 225731 - DNA, 1431 bp, Artificial Sequence
  Description of Artificial Sequence: Synthetic coding sequence
atggctaaggcggcagcaattggcattgacttaggcaccacttacagctgtgtgggcgttttccagcacgggaaaggggaacgaaatgtactgattttcgatcttgggggagggacatttgacgtttccatactcacaattgacgacgggatattcgaagtaaaagcaaccgcgggagacactcacctgggtggtgaagattttgacaacagactggtgaaccattttgttgaggaattcaagcgcaaacacaaaaaagatatcagccagaacaaacgagcggtgcgaagactgaggactgcatgcgaaagagctaaaagaactctgagttcgagcactcaggcatctctggagattgattctctgttcgagggtatcgatttctacacctccatcacccgggctagatttgaggagctttgctccgatctttttaggagtaccttggaaccagtggagaaggctctccgagatgccaaactggataaggcccagattcacgatctagtgctggtgggagggtcaactcggatccctaaagtccaaaagttattgcaggacttctttaatggacgggatttaaacaaaagcatcaatccagacgaagcggtggcatatggcgctgcggtccaggctgcaattctgatgggagacaaatcggagaatgttcaggatttgctcctgctagacgtggccccactgtctctcggtcttgagactgctgggggtgtgatgacagccctgataaagcggaattccaccattccgactaaacagacacaaatttttaccacctattctgacaaccagcccggagtgctgatccaggtgtatgagggagagcgagccatgactaaagacaacaaccttctcgggcgatttgagttgtctggaatacctcccgcacccagaggcgtaccacagattgaggtgacattcgacatcgatgccaatgggatcttgaatgtgactgctacagataaatcaacaggcaaagctaacaagattaccatcactaatgacaaagggagattgtcgaaggaggaaatcgaacggatggtccaggaggcggaaaaatataaggcagaggacgaggtgcagcgcgagcgcgtgagcgcgaagaatgctctcgaaagctacgcattcaacatgaagagcgctgtagaggacgagggcctgaagggcaaaatatccgaggctgataaaaaaaaagtgctggataaatgccaggaggtgatctcctggctcgacgccaacaccctggctgagaaagatgagtttgagcacaagcgcaaagagttggagcaggtttgtaatcccattatcagcgggttataccaaggggctggaggacccggacctgggggattcggcgcacagggacccaagggcggttccgggtctggtccaacaattgaagaagtggactag

SEQ ID NO: 225732 - DNA, 1926 bp, Artificial Sequence
  Description of Artificial Sequence: Synthetic coding sequence
atggccaaggcagccgctattggaatcgatctggggacaacttattcttgtgtgggggtcttccaacatggtaaggtggagatcatcgccaacgatcaagggaatcgcactactcccagttacgtggcatttacggacaccgaacggcttatcggcgatgctgccaaaaatcaggttgccctgaacccccagaataccgtgtttgatgctaaaaggctgatcggtcgcaaatttggagatcccgtggttcagtctgatatgaagcactggccatttcaggtgattaacgacggtgacaagccgaaagtccaagtttcttacaagggagacactaaagctttctaccctgaagagatcagttcaatggtgctgaccaagatgaaagagatagcagaagcctatttaggctacccagttactaacgcagtcattaccgtgcctgcctatttcaacgacagccaacgacaggctaccaaggatgctggtgtcatagcaggtctcaacgtcttgagaataatcaatgagccgaccgcggctgccatagcttatggcctggaccggactggtaagggcgagcgcaacgtcttaatatttgacctaggtggtggcacattcgatgtgtctatcctgactattgacgacggtatcttcgaagttaaggccaccgcgggtgatacgcacctcgggggagaggatttcgacaacagacttgtgaatcactttgtggaggagttcaagcgcaaacataagaaggacatcagtcaaaacaagcgggctgtccggagacttcgaaccgcctgtgagagagcaaaaaggaccctgagttcgtccacacaggctagcctagagatagactccctgttcgaggggatcgacttctacacgagtatcaccagggcccgttttgaggaactgtgctctgatctgtttcgcagtacactggaaccagtggagaaggccctaagagacgcaaaattggataaagcacagatccacgacctggtgctggtgggcggttccactaggatccccaaggtccagaaacttctccaggatttttttaacggcagggatttaaacaagagcatcaaccctgatgaggctgtagcctacggagcagcagtgcaggctgctattttgatgggagataaaagcgaaaacgtgcaagacctgctattgcttgacgtggcacctctttcgcttggcctcgagacagccggaggggtgatgacggccctgatcaaacggaatagcaccattccgacaaagcagactcaaatcttcacaacatactccgataatcagccaggggtactgatacaggtgtacgaaggcgaaagggctatgacaaaagataataatttacttggcagattcgagctgagcgggatccctccagcccctcggggtgtgccgcagatagaggtgaccttcgatatagacgccaatggtatcctcaatgtgacagcaactgacaaaagcactggtaaggccaataaaattacgataactaatgacaaggggaggttgagtaaggaagagatcgaaagaatggttcaggaggctgaaaagtacaaggctgaggatgaggtccagcgggaaagagtgtccgctaagaatgctcttgagtcgtatgcatttaacatgaagtcagcagtcgaggacgaaggcttgaagggtaaaatatccgaggccgacaagaaaaaggtgcttgataagtgtcaggaggtgatttcttggcttgatgccaatactctggcggaaaaagatgaatttgaacacaagcgcaaagagctggagcaagtgtgcaatcccataattagcgggttatatcaaggcgctggcggacctggaccaggaggtttcggcgctcagggaccgaaaggcggatctggttcgggacccacaattgaagaggtggattag

SEQ ID NO: 225733 - DNA, 1431 bp, Artificial Sequence
  Description of Artificial Sequence: Synthetic coding sequence
atggcaaaggcggctgccatcgggattgacctagggaccacttattcctgcgtgggagtgtttcagcatggcaagggcgaaaggaacgtgctgattttcgatctggggggaggtacttttgatgtctccatcttaactatcgatgatggaatctttgaagttaaagccacagccggagatacccaccttggcggtgaggacttcgacaataggctggtgaaccactttgtggaagagtttaaacgaaagcataagaaggacattagccagaacaagagagcggttcgccgactgcggactgcttgtgagagggccaagaggactctctcttcctccacccaggcctctctcgagattgactctttatttgagggcattgacttctatacaagtatcacccgcgcacgtttcgaggaactgtgttccgatcttttcaggtccaccttagaacccgtggagaaggctctgagggatgccaagttagacaaagcccagattcatgacttggtactagttgggggtagtacgcgcatacccaaggtccagaagcttctacaagatttttttaatggacgagatctgaacaagtccatcaaccccgatgaagccgtggcctacggagctgcagttcaggccgcaatcttaatgggggacaaatctgaaaacgtgcaagacctactgctgctcgatgtggcgcctctttcattgggtctagaaaccgcgggtggtgtcatgacagccctgataaagagaaattctaccatcccgacaaagcaaacccagatttttactacatactccgataaccagccaggggtgcttatccaggtgtacgagggggaaagagccatgacaaaggataacaatctgctgggccgttttgagctaagcggaattccccctgcacctaggggagtgccccaaatcgaagtgacgtttgatatcgatgctaatggcattctaaacgtcactgctaccgacaaaagtacgggtaaggccaataaaatcacaattactaacgacaaagggaggttatctaaggaggaaattgagcggatggtacaggaggccgagaagtacaaggctgaagacgaagtgcagagggagcgtgtttccgccaaaaacgcgttggaaagttatgcattcaacatgaagtcggcagtggaagacgaggggctgaagggcaagatctccgaagccgataaaaagaaagtgctggacaaatgccaggaggtgattagttggttggatgcgaatacactcgcagagaaggatgagttcgagcacaagcggaaggagctcgaacaagtgtgtaatcccatcatctcgggtctgtaccaaggggcaggcggacccggacccggtggattcggggcacagggccctaagggcggatcagggagtggacccacgatcgaagaggtcgactag

SEQ ID NO: 225734 - DNA, 1926 bp, Artificial Sequence
  Description of Artificial Sequence: Synthetic coding sequence
atggccaaagccgcagccatcggcattgacttggggacaacttacagctgcgtcggggtgtttcaacacggcaaggtcgagatcatcgccaacgatcagggcaaccgaaccacccccagctacgtggcctttacagacactgaaagactgatcggcgatgctgccaaaaatcaagtggctcttaatccccagaacacagtttttgacgctaaacgcctaatcggaagaaaatttggagaccccgtagtacagagcgatatgaagcattggcctttccaggtcattaatgatggagacaagcctaaagtgcaggtgtcctacaagggtgaaaccaaggccttctatccagaggagattagtagcatggtgctcaccaaaatgaaagagatagcggaggcctacctgggctatccagtgactaatgcagttatcactgtacctgcctattttaacgacagccaacgacaggcgaccaaggacgctggcgtaatagccggacttaatgttttgagaatcattaacgagccaactgccgcagccatcgcttacggactcgacagaactggcaaaggtgagaggaacgtgctgatctttgatctcgggggagggaccttcgacgtgtccatccttactatcgacgatgggatctttgaagtgaaggcaaccgctggtgatacccacctgggtggagaagacttcgacaatagactggtaaaccatttcgttgaagagttcaagcggaaacacaagaaagatatcagtcagaacaagagggctgtcagaaggcttagaactgcctgcgagcgtgccaaaaggacgttaagcagctctacccaggcctcactagagatcgattctctgttcgagggtatcgacttctatacctccattacaagggctcgcttcgaggaattatgttccgacctgttccgctccacactcgaaccagtcgagaaggctctcagagatgccaaattagacaaagcgcagatccacgacctagtgcttgtgggtggaagtactaggatacctaaggtgcagaaattgctccaggattttttcaatggcagagatctcaataagtccataaaccccgacgaggccgtcgcctacggagccgctgtgcaggccgcaattcttatgggagataagtcagagaacgtgcaggacttgctccttctggacgtggcaccgttgtccctgggactggaaaccgctggcggagtgatgacagctctcattaaacgtaactccactattccaaccaagcagacgcagatcttcacaacctatagcgataatcagcccggagtgcttattcaagtttatgagggcgagcgggctatgaccaaagataacaatctgctaggtcgattcgagctcagcggaatacccccagccccaagaggcgtgcctcagatcgaagttaccttcgacatagatgctaacggaattctaaacgtgaccgcaacagacaagtctactggtaaggccaataaaatcaccatcaccaatgataaaggccgtctctccaaagaagaaatagagcgtatggtacaggaagcagaaaaatacaaggccgaggatgaagttcaacgcgagcgagtctcagcaaaaaatgcacttgaaagctatgccttcaacatgaaatccgccgttgaagacgaggggctgaagggcaagatctcggaagccgataagaaaaaggtgttagataagtgtcaggaagtgatatcctggttggatgcaaacacgttggcagaaaaggatgaatttgaacataagcggaaagaattggaacaagtttgtaatccgatcatctccggattgtaccagggagcgggaggcccaggaccaggagggtttggagcccagggcccaaaaggaggctctggcagcggacctactatagaagaggttgactag

SEQ ID NO: 225735 - DNA, 1926 bp, Artificial Sequence
  Description of Artificial Sequence: Synthetic coding sequence
atggcaaaagccgctgctatcgggattgatctcgggaccacatattcctgcgtgggagtttttcagcacggtaaagtagaaataatcgctaacgaccaagggaacagaacgacccctagctacgtggctttcactgacacagaacggcttataggggatgcagccaagaaccaggtggcactcaacccacagaacacggtcttcgatgcaaaaagacttattggtagaaagtttggcgatccagtagttcaatccgatatgaaacattggccttttcaggtgattaatgacggagacaaacctaaagtacaggtgtcctataagggcgagacaaaggctttctacccagaggaaatttcttctatggtgctgacgaagatgaaggaaatcgctgaggcttacctggggtacccggtaactaacgctgtgatcaccgtccctgcctactttaacgatagtcagcggcaggctactaaagatgcaggggtgatcgctggactgaatgtgttacggataatcaacgagccaactgcagcagccattgcctatggtctggatcggacgggaaagggggagagaaacgtgctgatttttgatctagggggaggcaccttcgacgtaagtatcctgaccatagatgacggcatttttgaggtaaaggccactgctggtgatacacatctgggcggtgaagactttgataacagactagtgaaccactttgtcgaggaatttaaacgcaaacacaagaaagacatttcccagaacaagcgggctgttcgtcgccttaggactgcatgtgagcgggcaaagagaacgcttagcagttccactcaggcgtctctggaaatcgactctctttttgaggggatagatttctacacgagtatcacgcgggcacggttcgaagaactgtgttcagacctatttcgatctaccctggagccagtggagaaagcgttgagggatgccaagctggataaagctcaaatccacgatctggtgttggtcggtgggagtacacggatccctaaggtgcagaaacttctacaggatttttttaatggaagagacttgaacaaatcgatcaatccagatgaagcggtagcctacggagctgctgtgcaagcagctattcttatgggcgacaaatcagagaacgtccaggatctgcttctgctggacgtggctccgttgtctctaggattagaaacggccggaggcgtgatgaccgcactgataaagaggaacagtaccataccgactaagcagactcagatttttacaacctacagcgacaaccagcccggagtgttaatccaggtgtatgagggggaacgcgcaatgacgaaggataacaacctactgggacgattcgagctgtcaggcattccacctgctcccagaggggtcccacaaattgaggtgacctttgatattgacgccaacggaatcctgaacgtcacagccacagataagtcaaccgggaaagcaaacaaaatcaccatcacgaatgacaaggggaggctgtctaaagaagaaattgagcggatggtgcaggaagccgagaaatacaaagcagaggacgaggtgcagcgagagcgcgtgtcggcaaagaatgctctggaaagttatgctttcaatatgaagtcggccgtagaagacgaaggcttgaagggcaagattagtgaggccgacaagaaaaaggtgcttgataagtgccaggaggttatttcctggctagacgctaataccctcgctgagaaagacgagttcgaacacaagcgtaaggaactggagcaagtctgcaatccaataatcagtggactctaccagggggcaggaggtccgggacctgggggattcggagcccagggtcctaaaggagggtctggttccgggcctactattgaggaagtcgactag

SEQ ID NO: 225736 - DNA, 699 bp, Artificial Sequence
  Description of Artificial Sequence: Synthetic coding sequence
atggcgaaagcagctgcaattggtattgatctgggaaccacatactcttgcgtgggcgtgtttcaacatgggaaggtagaaataattgccaacgatcagggcaataggacaaccccaagttacgttgcgttcaccgacaccgaacgcctcatcggggatgcaggtgtcattgccggtttgaacgttctgaggattatcaacgagccaaccgccgctgccatcgcttatggcctagacaggacaggcaaaggggagcgtaatgtattaatctttgatctgggcggtggcacttttgatgtgtctatcttgaccattgatgacggtatcttcgaggtaaaagcaaccgcgggagatacacacttggggggagaagactttgacaaccgcctggtcaaccatttcgtcgaggaatttaaacggaagcacaagaaagatatctcccagaataagcgtgccgtgcggaggcttcgtacggcgtgcgagagagccaagcggaccctgagcagtagtacccaggcttctttggaaattgattccctgtttgaaggaatcgacttttacacttccatcacaagggctagatttgaagagctttgctccgacctctttagatccacccttgagcctgtggagaaggccccacctgctagtccgaggtgccgctcctgctgtcgcactagttctaccggcgcaacatag

SEQ ID NO: 225737 - DNA, 1926 bp, Artificial Sequence
  Description of Artificial Sequence: Synthetic coding sequence
atggcaaaggccgctgcaatcggaattgacctgggaacaacttactcatgcgtgggggtttttcagcatggaaaggtggagattatcgcaaatgaccagggtaatcggacaaccccgagctatgttgctttcacagacaccgagagactcataggggacgccgctaaaaaccaagttgccctgaacccccagaatacagtgtttgatgctaagagacttatcggcagaaaattcggcgaccccgtggttcagagtgatatgaaacactggccttttcaggtgattaatgacggggacaaaccaaaagtgcaagtgtcttataagggggaaaccaaggccttttacccagaagaaatctcttctatggttctcactaagatgaaggaaattgccgaagcctacttgggttatcctgtgactaacgcggttataaccgtacccgcttactttaatgattcacagaggcaggccaccaaggatgccggtgtcatcgccggattaaacgtgcttagaattatcaacgaacccacggccgcagccattgcgtatggtctggacaggacaggcaagggggaaaggaacgttcttatcttcgatcttggagggggtactttcgatgtcagcattttaactatcgacgatggtatctttgaagtaaaggccacggctggcgatacccacctagggggagaagactttgataaccgcctcgtgaatcacttcgtcgaggagttcaaaagaaaacataagaaggatatatctcagaacaaacgtgccgtacgcagactaaggacggcctgtgagagggccaagaggaccctgtcttcctcaacccaagcctctctggaaattgatagtctgtttgaggggatcgatttctacaccagtattacaagggccagattcgaggaactatgcagtgatctatttaggagcactcttgaacccgtggaaaaggcactccgggatgccaagctcgacaaagctcagatccacgacctggtgcttgttggtggatccactcgcatccccaaagtgcagaagttgctccaggacttttttaatggacgtgatttgaacaagtctatcaatcctgatgaggccgtggcatacggcgcagccgtgcaggccgctattctcatgggagacaagagcgagaacgttcaggatcttctgttgctcgatgtcgctcccctcagtctgggactcgaaaccgccggtggggttatgacagcactaatcaaacgaaatagcaccatcccgaccaaacaaacccagatctttacgacttacagtgataatcagccaggcgtgctgattcaggtctatgaaggagagagagccatgactaaagacaataacctgcttgggaggttcgagctgtctggcattccacctgcacctaggggcgtaccccagatcgaggtaacatttgatatcgacgccaatgggatcctaaatgtcaccgctactgataagtccaccggaaaggccaataaaattaccatcactaacgataagggacggctttctaaggaagaaatcgaacggatggttcaggaagccgaaaagtacaaggcggaagatgaggtgcaacgcgagagagtgagtgccaagaacgcccttgaaagctatgcattcaatatgaagtctgctgttgaagacgaggggcttaagggtaagatatccgaggcagataaaaaaaaagtgttggacaagtgtcaagaggtgattagttggctagacgcaaataccctagctgaaaaggacgaattcgaacataaacgcaaagaactggaacaggtgtgtaaccctatcattagcgggctgtatcaaggcgcaggcggaccagggccaggaggatttggagcccaaggccctaagggtgggtctgggtctggtccaacgatagaagaagtggactag

SEQ ID NO: 225738 - DNA, 1431 bp, Artificial Sequence
  Description of Artificial Sequence: Synthetic coding sequence
atggcaaaggccgctgccatcgggattgatttgggtactacttatagttgcgttggggtgttccagcacggaaaaggagagaggaacgtgctgatttttgatttaggtggtgggactttcgatgtaagtatcctgaccatcgacgatggtatctttgaggttaaggcaacggccggagatacgcacctcggaggtgaagatttcgataataggcttgttaatcatttcgtcgaggaattcaagcgcaagcacaaaaaagatatttcccagaacaagcgcgcagtgagaagactaaggactgcttgtgagcgagcgaagcggaccctgagctccagtactcaggcaagtctcgaaattgactcgttattcgaaggaatcgacttttataccagtattaccagggctcgcttcgaagaactgtgctccgacctctttagaagtacattggaacctgtagagaaagcactccgagatgcgaagctcgataaagctcaaatccatgacctagtgctcgtgggcggttccacacgcatccctaaggtgcagaaactcctgcaggacttttttaacgggagggacctgaacaaatccatcaaccccgacgaggcagtggcctacggcgctgccgtgcaggcagcaatcctgatgggcgacaaaagcgagaacgtgcaagacctgttgctcctggacgtggccccactcagccttggacttgagacagctggcggagtgatgaccgcactaattaagcggaactctactatcccgactaaacagactcagattttcaccacctatagtgacaaccaaccaggagtgctgattcaagtctacgagggggaacgagccatgactaaggataataatttactaggaaggtttgagctgtcaggcattccccctgcaccccgaggagtgcctcagatcgaagtgaccttcgacattgatgccaatggaatcctgaatgtcacagccaccgacaagtcaacagggaaggccaacaaaatcacaattaccaacgacaaaggccgacttagcaaggaagagatcgaaagaatggtccaagaggctgagaagtacaaggccgaggacgaggtgcagcgagagcgcgtaagcgccaaaaatgccttagaaagctacgctttcaacatgaagtcagccgttgaagatgaaggccttaaaggaaagataagtgaagctgataaaaaaaaggttctggataagtgtcaggaggtgatatcctggctggacgccaatacactcgctgaaaaggacgaattcgagcacaaacgaaaggagctcgagcaggtatgcaaccctatcatctctggcctctatcagggtgctggtgggcctggcccaggcggttttggggctcagggtccaaagggtgggtccggctctggtcctactatagaagaggtagattag

SEQ ID NO: 225739 - DNA, 1431 bp, Artificial Sequence
  Description of Artificial Sequence: Synthetic coding sequence
atggcaaaagcagctgctatcggaattgatcttggtaccacatactcttgtgtgggggttttccagcatggtaagggtgaacgcaacgtgctgatttttgacctaggtggaggcacttttgacgtttcaatcctgacaattgacgacgggatctttgaagtcaaggctaccgccggtgatactcatctgggcggagaggactttgataatcgtctggttaaccattttgttgaggagttcaaacgaaagcataagaaggacattagccagaacaagcgcgctgttcggaggttaagaactgcatgtgagcgtgccaagaggacactgagttcctcaacccaggctagtctcgaaatagactctctcttcgagggtatagatttctatacgtcgatcactagagctcgcttcgaggaactctgtagcgatctgtttcgctccacgctggagcctgttgaaaaagcactgcgcgatgcaaagctggacaaagcgcagatccatgatctcgtgctcgtgggcggttccacccggatccctaaggtccagaagctgcttcaggatttttttaatgggagggacttgaacaaaagcattaacccagacgaggcagtcgcgtacggcgcagctgtccaggctgctattctgatgggagataagtcagaaaacgtgcaggatctgcttttgctcgatgtggccccactgtctttgggactagaaaccgccggaggcgtgatgactgctctgatcaagaggaactctaccatcccaacaaagcagacacagatcttcacaacctactctgacaaccaaccgggtgtcctcattcaggtctatgagggcgaaagagccatgaccaaagataacaatttactggggaggtttgagctatcaggcattcctcctgctccaaggggggtcccccagatcgaagtgaccttcgacatagatgcaaacggcattctcaacgtgacagcaaccgacaagagcacagggaaggcgaacaagattaccatcacaaatgataagggcagattgagcaaagaggagattgagcggatggtgcaagaagcagagaaatataaagctgaggacgaggttcaacgggagagagtgtctgccaagaacgccctggaatcttacgcgtttaatatgaagtcagctgtggaggacgaggggctgaagggcaaaatcagtgaagctgacaaaaaaaaggtgctggacaagtgtcaggaagttatctcatggttagacgcgaatacgctagctgaaaaggatgagtttgagcacaagaggaaagaactggaacaggtttgtaatcccattatttccggtctgtaccaaggagctggtgggcctggccctgggggattcggagctcaaggtcctaaggggggaagtggctctgggcctactatagaggaggtcgactag

SEQ ID NO: 225740 - DNA, 1653 bp, Artificial Sequence
  Description of Artificial Sequence: Synthetic coding sequence
atggccaaggccgcagctattggcatcgatctgggcacaacctactcctgtgtgggtgtctttcagcacggcaaggtgcagatttcatcgatggtgctgactaagatgaaagaaattgctgaggcatatctgggctatcctgtcacgaacgctgtaattaccgtgcctgcctattttaacgatagccaacggcaagctaccaaagatgctggcgttattgcaggcctcaatgttctcaggattatcaacgagcccaccgcagccgcaatcgcatatggattggatcggaccggcaaaggagaaaggaacgtgttaatcttcgacctgggcggtggtacgtttgatgtaagtatacttacgatagatgacgggatttttgaggtcaaggcgactgccggtgacacccatctcggaggtgaggacttcgataacaggctggttaaccatttcgtcgaggagtttaaacgcaagcataaaaaggatattagccagaacaaaagggccgttaggcgacttaggacagcttgtgagagagccaaaagaaccttatcttcctctactcaggcctctctagagatcgacagtctgttcgaaggcatcgatttttatacaagcattacacgagccaggtttgaagaattatgcagcgatctgttcagatcgacactcgaaccagtagaaaaggctctgagggatgctaagctcgacaaggcccagattcacgaccttgtccttgtaggcggttcaacgcgcattcccaaggttcagaagctgctccaggacttctttaacggcagagatctaaataaaagcatcaatcctgatgaagcagtagcctacggggcagccgtgcaggcagccattttaatgggcgacaaaagtgagaatgtccaggacttgctgctgttagatgttgctccccttagtctcggcctcgagacagccggaggtgtgatgaccgcactgatcaaacgcaattctacaatcccaactaagcagactcagattttcactacctacagcgataaccagccaggcgtgttaattcaggtgtacgaaggagagagagccatgactaaggataataatctgctaggtaggtttgaactgagcggaatccccccagcccctcgcggtgtgcctcaaatcgaagtgacttttgatatcgatgcaaatggcattctgaatgtaaccgccactgacaagagcacagggaaggcaaataagataacaatcaccaatgacaagggacgcctctcgaaagaggagattgaaaggatggtacaggaggccgagaaatataaagccgaagacgaggttcaacgggaaagagtctccgccaaaaacgccctagagtcctacgctttcaatatgaagagcgcagtcgaggacgaggggctgaaagggaaaatctcagaggctgataagaaaaaagtgttggataagtgccaggaagtgatcagctggcttgatgcaaacacacttgcggaaaaggacgagtttgagcacaagcgaaaggaactcgagcaggtctgcaaccctatcatctctggcctctaccagggagccggagggccaggccctggcggattcggtgcacaagggcctaaagggggaagcggttcaggccctacaattgaggaggtagattag

SEQ ID NO: 225741 - DNA, 1872 bp, Artificial Sequence
  Description of Artificial Sequence: Synthetic coding sequence
atggccaaagctgccgctattggcatcgaccttggaacgacctatagctgcgttggggtcttccagcatggtaaggtcgaaatcatcgctaatgatcagggaaatcggactaccccatcctacgttgctttcacagacactgagagattgattggcgatgctgctaaaaaccaagtcgccttgaaccccgtggtgcagagcgacatgaagcattggccattccaggttatcaatgatggagacaagcccaaggtccaggtctcatacaaaggcgagaccaaggctttctatcccgaggaaatttcttctatggtgcttactaagatgaaagagatagcggaggcctatctgggttatccagtcacaaacgccgttattaccgtccccgcatattttaacgattcccagaggcaggctactaaggacgccggtgtgattgccggtcttaacgtgctaagaatcataaacgagccaacagccgcagctatagcttacggcctagacaggacggggaaaggcgaaaggaacgtgctgatattcgacctaggcggaggcacctttgatgtcagcatattgacaatcgacgacgggatcttcgaggtaaaggcaacagccggagatacccacttgggtggcgaggactttgacaaccgactggtaaaccattttgttgaggaattcaagagaaaacacaagaaagatatttcccagaataagcgggcagtcagacgcctgcgcacagcctgcgaacgtgcgaaaaggacgttatcctcctcaacccaggcttcacttgagatcgattccctctttgagggtatcgacttctacacatccattacccgcgctaggttcgaagagctttgctcagacttgttccgctccaccctggaaccagtcgaaaaagcacttcgagatgcaaagctagataaggcccagatacacgatttggtactggttggtggatctacccgcatcccaaaggtccagaagctgctgcaggatttcttcaacggtcgcgacttaaataagtcaatcaaccccgatgaagctgttgcctacggggcagctgtgcaggccgcaatcctgatgggcgacaaatcagagaacgtccaagacctgctgctccttgacgtagccccactttctctagggctggaaacagctgggggagtcatgacagccttaattaagaggaattcaacaatcccgacgaagcagacccagatttttactacctactctgacaaccagcccggagtccttatccaagtgtatgagggtgagcgggctatgactaaagataacaacctgctcgggcgtttcgaactttctgggatacctcccgcacctcgaggggtgccccagatcgaggtgacattcgatattgatgcgaatggtattctgaacgtgaccgctacagacaagtctactggcaaggcgaataagatcaccattaccaatgataaaggacgcctctctaaagaggagatcgagcgcatggtgcaagaggccgagaaatacaaggcagaagacgaagtacagagggaaagagtgtctgctaaaaacgctctcgaaagctatgcctttaatatgaagagcgccgtggaggatgaaggcttgaaaggcaaaatcagtgaggcggataagaagaaggtccttgacaagtgccaagaagtgatcagctggctggatgccaatacactggctgaaaaagacgaattcgaacataagcgcaaagaacttgaacaggtgtgcaatcccatcatttccggactatatcagggtgccggtggccctggccctggcggatttggtgctcaggggcctaagggcggaagcggttccggccctacaatcgaggaggtcgactag

SEQ ID NO: 225742 - DNA, 1653 bp, Artificial Sequence
  Description of Artificial Sequence: Synthetic coding sequence
atggcaaaggctgcagccatagggattgaccttggtacaacatactcttgtgtgggcgtcttccagcacgggaaagtgcagattagcagcatggttctcactaagatgaaagagattgccgaagcctatctcgggtacccagtgaccaatgcagtgatcacagtgcctgcatattttaatgacagccagcgacaggctacgaaggatgcaggagttatcgcaggactgaacgtcctccgcatcatcaatgagccaaccgcagccgcaatagcatacggcttagaccggaccgggaaaggcgaaagaaacgtccttatttttgatctgggcggaggaacgtttgacgtcagcattctaacaattgacgatggcatttttgaagtcaaagcaactgccggtgacacccatcttggcggagaagacttcgataataggcttgtgaatcactttgtcgaagaatttaaacggaagcataaaaaggatatttctcagaataagagggccgttcgccgtctccgcaccgcatgcgagcgcgcaaagcggaccctgtcctccagtacacaagcctctttagaaatcgatagcctgttcgagggtattgatttttataccagtatcaccagggcaagattcgaagagctgtgtagtgacctgttccgctcgactctagaaccggtcgagaaagccttacgggacgcgaaactcgataaagcacaaatacacgatctcgttctggtgggcggttcaactagaatccccaaggttcagaaattgctgcaggacttcttcaacggcagagacctgaacaagtctatcaatccagatgaggccgtagcctacggcgcagctgtccaggctgctattctgatgggagataaaagcgagaatgtccaggacctcctgctcttagacgtcgctcccctcagcctcggactggagaccgctggaggtgtgatgacagccctcatcaaaaggaattctactatccctaccaagcagactcagatttttacaacctacagcgacaatcagcccggagttctcattcaggtttacgaaggtgagcgcgctatgacgaaagacaacaacctcctgggaaggtttgaactgagtggtatccctccggcacccaggggcgtcccacagatagaagtgacattcgacatagacgctaatgggatacttaatgtgacggccaccgacaagagtactggcaaggccaataaaatcaccatcaccaatgataaggggagactgtcaaaagaggagattgagcgcatggtgcaggaagcagagaaatacaaggccgaagatgaggtccagcgtgagcgcgtgtctgccaagaacgcgctagaaagttatgccttcaatatgaaatcagccgtcgaggatgagggccttaagggtaagatttctgaggcagacaaaaagaaagtgctggacaagtgccaggaggtcatctcttggctggatgcaaatactctcgccgagaaagatgagtttgagcataaaaggaaggaattggagcaggtgtgcaaccccataatatctggcctgtatcagggggcaggcggacccggacccggaggtttcggcgctcaaggccctaaagggggttccggtagcggcccaacaatagaagaggtggattag

SEQ ID NO: 225743 - DNA, 1653 bp, Artificial Sequence
  Description of Artificial Sequence: Synthetic coding sequence
atggcaaaggccgcagcgataggaattgacctgggaactacatactcgtgcgtgggcgtattccagcatggcaaagtgcagattagcagcatggtgctgacgaaaatgaaagagatcgctgaagcctatctgggttaccccgtcactaatgccgtcattacagttcctgcttacttcaatgactctcaaaggcaggccacaaaggacgcaggtgtcatagctggcttgaatgtactgcgaatcatcaacgaacctaccgccgctgctattgcctatggactcgaccgcactggcaagggagagagaaacgtgctgatattcgatctgggtggcggaaccttcgacgtgtctatcctgacgatcgatgacggtatcttcgaggtaaaggccaccgccggagatacccacttgggcggtgaggactttgataaccgcctggtgaatcattttgttgaagagttcaaacgtaagcacaaaaaagacatttctcagaacaagcgcgctgtcaggcgcctccgcactgcatgcgaacgggcaaaacgcacactaagttccagtactcaggcctcattggaaatagacagcctcttcgaagggatcgacttttacacttctattacacgcgcacgctttgaggaactctgcagcgatcttttcaggagcactctggaaccagtcgaaaaagcattacgagacgcaaagttggacaaggctcagattcacgatcttgtccttgttggaggtagtacacgcatccccaaagtacaaaagctgctacaagacttcttcaacggcagggatttaaacaagtcgattaatcccgatgaagctgtggcttatggagcagccgtgcaagctgcaatactcatgggagacaaatcagagaatgtacaggacctgctgcttctggatgtagcccctttgtctctgggcctagagacggctggaggtgtaatgaccgcgcttattaagagaaatagtaccatcccaacgaagcaaacgcagatctttacaacttacagtgacaatcagcccggtgtattaatccaagtatatgaaggagagcgcgcaatgacaaaggataacaaccttctgggaaggttcgagctgagcgggatccctccggctccgcgtggggtgcctcagattgaggtgacctttgatatagacgccaacggaatccttaatgtgacagctaccgataaatcaactggcaaagccaataagataaccatcacaaacgacaaaggtagactgagcaaagaggagatcgagcgcatggtgcaagaagcagagaaatacaaggccgaagacgaagtgcaaagagagcgggtatcagcgaagaatgccctggagtcttacgcattcaacatgaagtctgctgttgaggacgaaggcctcaaggggaaaattagcgaagctgataagaagaaagtgctggacaagtgtcaggaagttatttcatggctggacgccaacactctggcagagaaggacgaattcgagcataaaagaaaagagctggaacaggtgtgcaatcccattatttccggtctgtaccaaggcgcaggtggccctgggcctgggggttttggcgctcagggcccaaaaggcggttcggggtccggtccgacaattgaggaggtcgattag

SEQ ID NO: 225744 - DNA, 1653 bp, Artificial Sequence
  Description of Artificial Sequence: Synthetic coding sequence
atggcgaaagccgctgccatcggaattgacctgggcacgacttactcttgtgtgggggtattccaacatggcaaggtccaaataagcagtatggtgctgaccaagatgaaggaaatagctgaagcctacctgggctatcctgtgaccaacgctgttatcaccgtacctgcttacttcaatgactcccagagacaagctacgaaggatgccggagtcatagctggactgaacgtgctcaggatcatcaacgagccaactgctgccgctatagcttacggactggaccgaacaggcaaaggagaacgaaacgtgctgatcttcgatctgggcggtgggactttcgatgtgagcatccttactatcgatgacggcattttcgaagttaaggccaccgctggcgacacccacctgggaggggaagacttcgacaaccgcttagtgaaccatttcgtggaggagtttaagcgaaaacacaagaaagatatctctcagaacaaacgtgccgtgcgtcgcctgcgaacggcttgtgagcgcgctaagcggactctttcaagctccactcaggcatcactcgagatcgattccctgttcgaagggattgatttctatactagtataacccgcgcaaggttcgaggaactctgtagtgacttattccgcagtaccctggaaccagtggaaaaggccctccgggatgctaagttagataaagcccaaatccacgacctggtcctagtgggaggctcaacgcggattcccaaagtccagaagttactccaggacttcttcaatgggagggacctcaacaaatccatcaacccagatgaggccgtcgcctacggagcagcagtgcaagcggctatcctcatgggcgataagagcgaaaatgtgcaggacctcttactacttgatgtggctcccctgtcccttgggcttgaaaccgctgggggtgtgatgaccgcgctgattaaacgaaacagtactatcccaaccaagcagacacagatatttactacatatagtgacaatcagcctggtgtactgattcaggtgtatgaaggtgagagggcaatgaccaaggataacaacctgttagggagattcgagttgagcgggatacctccggctccacgcggagttccacagatcgaagtcacgtttgacattgacgccaacgggatccttaatgtcaccgctactgacaaatccactggcaaggcaaacaagatcactattactaatgataaaggcaggctgagtaaagaagagatcgagcgaatggttcaagaagccgagaaatacaaagcagaggacgaggtgcaacgcgaaagagttagtgcaaagaatgctctggagagttacgcttttaacatgaagtccgctgtggaggacgagggactcaagggcaagatttccgaagcagataaaaaaaaggtgctggataaatgtcaagaggtgatttcctggctggacgccaatactttggctgaaaaagacgaatttgaacacaagaggaaggagctggaacaagtgtgcaatcctatcataagcggtttataccaaggcgcagggggaccaggcccaggaggcttcggggcacagggcccaaaaggcggttctggctcaggacccacaattgaggaagtcgactag

SEQ ID NO: 225745 - DNA, 699 bp, Artificial Sequence
  Description of Artificial Sequence: Synthetic coding sequence
atggcaaaagccgcagcaatcggtattgacctggggaccacctattcttgtgttggcgtttttcaacatgggaaagttgagattatcgcaaatgatcaaggaaacagaaccaccccctcttacgtggcctttaccgataccgagagattgattggtgacgccggagtaatcgctggtttgaacgttctgaggattataaatgagcccacagccgcagccatcgcatacggtctggaccggactggtaaaggcgagagaaacgtattaatctttgacttgggcggaggaactttcgatgtgtctattcttacaatcgacgatgggatctttgaggtaaaagccaccgcgggagacactcacctgggtggtgaagatttcgacaacagactcgtcaaccattttgtggaagaattcaaaagaaaacataagaaggacattagccagaataagagggccgttcgacgcctcaggacggcatgtgaacgcgcaaaacggacgctcagttcctcaactcaagcctcactcgagatcgactctctcttcgaagggatagatttctatacatctatcacccgggcaaggttcgaggagctgtgcagcgacctgttccggtctacccttgagccagtagagaaggcaccaccagctagcccgcgatgtaggtcttgttgtcggacatcttccactggagccacatag

SEQ ID NO: 225746 - DNA, 1653 bp, Artificial Sequence
  Description of Artificial Sequence: Synthetic coding sequence
atggccaaggcggctgccatagggatagatctgggcacaacatatagctgtgtgggagtgtttcagcacggcaaggtccagataagttctatggtgcttactaaaatgaaagaaatcgccgaagcttatttaggctatcccgtgaccaacgccgtgatcacagtcccagcatacttcaacgactcccaacgccaggctaccaaggacgcaggcgtgattgccggattaaatgtccttagaatcatcaatgagcccacagcagctgcaatagcgtacggcttagaccgcaccggtaagggagagaggaatgtgctcatatttgatttgggcggtggcacgtttgacgtgtctatcctgacaattgacgacggcatctttgaggttaaggctactgccggagacacacacttagggggtgaagatttcgataatcggctggtcaatcacttcgtggaagaattcaagcggaaacacaaaaaagacatctctcagaataagagggccgtgcgccgactgcggactgcatgcgagcgtgcaaagcgaacactgtcttcttctacccaggctagcctagaaatcgactctcttttcgagggcattgatttctatacctctatcacaagggcacgtttcgaggagctgtgtagtgacttgtttcgatccacgttagagcctgttgaaaaagccctgcgcgacgccaagctcgacaaggcacaaattcacgacctcgtcctagtagggggttccacccggataccaaaggtgcagaaactacttcaggacttctttaatggacgcgacctgaacaagtccattaaccccgacgaagctgtcgcctacggggcagcagtccaggctgcgattctgatgggagataagagcgagaacgtgcaagaccttctgctcctggatgtcgctccattgagtctcgggctggaaaccgccggtggagtgatgactgccctcatcaagcggaattcgaccattcctaccaagcagacccagatttttacaacttactctgacaatcagccaggggtcctcatccaggtgtatgagggcgagcgagcaatgacaaaagataacaatctgctcgggaggttcgagctctccggaatcccccctgcgcctcgcggagtccctcaaatcgaggtgacattcgacatcgacgcaaacggcattttgaatgtgactgccacagataaatctaccggtaaggctaacaaaatcactattacgaacgacaaaggtaggctctctaaagaagaaatcgagaggatggtgcaagaggccgaaaagtataaagccgaagacgaggtacagagggagcgcgtgagcgctaaaaacgcacttgagtcctatgcctttaatatgaaaagcgctgtggaagatgagggactaaaggggaagatctccgaagccgacaagaagaaagtccttgataaatgccaggaggtgatatcatggctggatgccaacactcttgctgagaaagatgagttcgagcataaacggaaggagctggagcaggtttgcaatcctataatttcaggcctgtaccaaggcgcagggggacccggacctggcggattcggcgctcaaggaccgaaggggggtagcggtagcggacccacaatcgaggaggtggactag

SEQ ID NO: 225747 - DNA, 699 bp, Artificial Sequence
  Description of Artificial Sequence: Synthetic coding sequence
atggctaaggcggctgccataggcattgacctgggtactacatactcttgcgttggcgtctttcaacacggaaaagtcgaaatcatcgccaatgaccaaggaaaccgcacgactccgtcatacgtcgcttttacagacaccgaacgcctaataggtgacgccggtgtgatagccggactgaacgtattgcggattatcaacgaacccaccgcagccgctattgcctacggcctggatcgcacaggtaaaggggagcggaacgtgcttatttttgatttaggcggaggtaccttcgacgtatcaatactgacaattgacgatggcattttcgaggtgaaagccacagccggagacacacacctgggcggtgaagatttcgataaccgacttgtaaaccattttgtggaagaattcaagcggaagcataaaaaagacatctcacaaaacaagagggcagtccgccgactgcggaccgcatgtgagcgagctaagcgtaccctttcctcctctactcaggcctctctagaaattgattccctctttgaaggcattgacttttacacctcgatcacaagagctcggttcgaggagctgtgctcagatcttttcagaagcaccctcgaaccagtagagaaggctcccccagctagtcctcgctgccggagctgttgccgcacctctagtacaggggctacatag

SEQ ID NO: 225748 - DNA, 699 bp, Artificial Sequence
  Description of Artificial Sequence: Synthetic coding sequence
atggctaaagctgcagctataggaatcgatttaggaactacttattcctgcgttggagtgttccagcatgggaaagtcgaaatcatcgctaacgatcagggaaataggaccaccccttcctatgtggcttttaccgataccgaaagactgatcggagacgcgggtgttatcgccggtcttaacgtgctcaggattatcaacgagccgactgccgcagcaatcgcctacggcctggaccggacaggtaagggggaaagaaacgtgttgatcttcgacctgggcggtggcaccttcgatgtgtccatcttgactattgacgacggcatctttgaggtaaaagctacagccggagacacacatctgggaggcgaggattttgataacagactcgttaaccacttcgtggaagaatttaagcgcaaacataagaaggatatctcccagaacaagcgggctgtacgccgtctgcgtaccgcctgtgagagagctaaacgcaccctgtcctcctccactcaggccagtctagagatcgactcgcttttcgagggaattgacttttatacgagcattacccgggcacgatttgaagagctgtgttcggatctattccgctccacacttgagcccgttgaaaaagcaccacccgcaagtccaagatgccgcagttgttgcaggacctcgtcaaccggcgctacctag

SEQ ID NO: 225749 - DNA, 699 bp, Artificial Sequence
  Description of Artificial Sequence: Synthetic coding sequence
atggccaaagcggctgcgatcggcatcgatctggggaccacatatagttgcgtgggtgtgtttcaacatggaaaggtcgagatcattgcaaacgaccagggaaatagaacaacaccttcctacgttgctttcaccgacactgagcgactaattggagacgccggtgttatagccggactaaacgtgttacggattattaatgagcctacggcagccgcaatcgcctatgggctcgacagaacagggaaaggagagcggaacgtgctgatattcgatctgggcggtggtacatttgatgtgagtatccttactattgatgacggaattttcgaagttaaggctaccgccggagatactcacctgggcggagaggacttcgataacaggctggtgaatcattttgtggaggagtttaaacggaaacataaaaaggacatttcacaaaacaagcgggctgtacgccgtctgaggaccgcctgcgagagagctaagcgcaccctgagctcttctacacaagcttcgctggagatcgattcactgtttgaaggcattgatttttatacatcaatcacgcgcgcacggtttgaggaactctgttccgatttgttccgttccaccttggagcccgtagaaaaggcaccaccagcatctccacgatgtcggtcctgctgccgcacttccagtacaggtgcaacatag

SEQ ID NO: 225750 - DNA, 1926 bp, Artificial Sequence
  Description of Artificial Sequence: Synthetic coding sequence
atggcaaaagcagccgctatcgggattgacctcggaacgacatacagctgtgtgggcgtctttcaacacgggaaggtcgaaattattgctaacgaccaaggtaaccgcaccactccctcatatgttgcctttaccgatactgagcgcctcatcggcgacgccgcaaagaaccaggtggccctcaaccctcaaaacaccgtgttcgatgccaagcgcctaatcggaagaaaatttggcgaccccgtcgtgcagtccgatatgaagcattggccatttcaggtaattaacgacggggacaaacctaaggtgcaagtatcatacaagggagaaaccaaggccttttaccctgaagagatttcgtccatggtgctgactaagatgaaggaaatcgcggaagcctacctgggatacccagtgaccaatgctgtaattacagttcccgcatacttcaatgacagccagcgacaggctactaaagacgccggtgtgattgccggactcaacgtgctcaggattattaatgagcccaccgcagcagctattgcctatgggctggataggactggcaagggagaaagaaatgtgctcatatttgatttggggggtggaacgtttgatgtgtccattttaactatagatgacggtatctttgaggttaaggcaaccgcgggtgatactcacctgggaggagaggattttgacaaccgcctcgtaaatcattttgtggaagagttcaagcgcaaacacaagaaggacatttcgcaaaacaaaagagccgtgagacggcttaggaccgcttgcgagcgcgcaaagcggacactttcatctagtacacaagccagcttagaaatcgactctctgtttgagggaattgatttttatacctcaattactcgagctaggtttgaggagctttgtagtgacctgttcaggagcaccttagaacctgtcgaaaaggcactccgcgacgcgaaactagacaaggcacagatccacgatttagtactcgtcggaggatctacccgtatccctaaggtgcaaaaacttctccaggatttttttaatggccgtgacttaaataagtccatcaatcctgatgaagccgttgcctatggggcagctgttcaggccgctatcctgatgggcgacaagagtgagaatgtgcaggatctgctgctgctcgacgttgctccgctcagcctggggctggaaaccgctggaggagtgatgacagcactgattaaaaggaactctaccatcccgaccaagcagacccagatattcacaacatatagtgataaccaacctggcgtgctcatccaggtttatgaaggggagagagcaatgacaaaggataacaacttgctggggcgatttgagttatcagggatcccaccagcacccagaggtgtccctcagatcgaggtaacgtttgatatcgatgccaatgggatacttaacgtgacagccacagataagtccaccggcaaggcgaacaagatcactattactaatgacaagggaaggctctctaaagaagagatcgagagaatggttcaggaggccgagaagtataaggcagaggacgaggttcaaagggagcgggtgtcagccaaaaacgccctggaaagctacgccttcaacatgaagagtgccgtggaggatgaagggctgaagggcaagatctccgaggcagataagaaaaaggttctagacaagtgccaggaggtgataagttggctggacgccaacactctggccgagaaagacgagttcgaacacaagaggaaagagctggaacaggtttgcaaccccattataagcggactgtaccaaggcgcaggcggacccggacctgggggatttggagcgcaagggcctaaaggtggtagtggaagcgggccaaccattgaagaggtggactag

SEQ ID NO: 225751 - DNA, 1926 bp, Artificial Sequence
  Description of Artificial Sequence: Synthetic coding sequence
atggccaaagccgctgccataggaatcgacctgggcacaacttactcgtgtgttggagtgtttcaacacggtaaagtggagattatcgccaatgatcaggggaaccgaactacaccctcatacgtggccttcacagacaccgagagactgattggtgacgccgcaaagaatcaggtggccctgaacccccagaatacagtgtttgacgccaaacgtctgatcggacgcaaattcggcgaccccgtggttcagagcgacatgaagcactggccgtttcaggtgatcaacgatggcgacaaacctaaggtccaggtgtcatataaaggggagacaaaagctttctatcctgaagagatttcctccatggtcttgactaaaatgaaagagatcgcagaggcgtacctgggctatcctgtcaccaatgccgtcattacggtgccagcatatttcaacgacagccagcgccaggctactaaggacgccggtgtgattgccggtctgaatgtgctgcgcattatcaatgagcctacagctgccgcaattgcctacggcctggaccggacgggaaaaggcgagcggaatgtgctgattttcgatctcgggggaggaacctttgatgtctctattctcaccatcgatgatggcatcttcgaggtcaaggcgacggcaggcgatacccacttgggcggagaagacttcgacaaccggctggtgaaccactttgtggaggagttcaagcggaagcacaagaaggacatcagccaaaacaagagggcagttcgcagactacgcacagcttgcgagcgagccaaacgcaccctttcaagttcaacgcaggccagtttagagattgacagtcttttcgaggggattgacttctatacctcaattacccgagctcgctttgaggagttgtgctcggacctgttccgcagtactctcgaacccgtcgagaaggcgcttcgcgatgctaagttggacaaagcacagatccatgacctcgtactggttggaggctctacaaggattcctaaggttcaaaaactcttgcaggactttttcaacggacgggacttaaataaatcaattaacccagacgaagccgtcgcctacggcgcagcggtacaggccgcaattcttatgggtgacaagagcgagaacgtccaagatctgctgctgttggatgtggctccactttctcttggcctggagactgccggtggagtaatgaccgctctcataaagcggaactctacgatacctactaaacaaacccagattttcacaacatactcagataaccagccgggagtcttaattcaggtctacgaaggcgagagggccatgacaaaagataacaacctgcttggaagatttgaactcagtggcatcccacccgctcctagaggggtgccccaaatcgaggtgacattcgacattgacgctaacggaattctcaacgttacagccacggacaaaagcacgggaaaagctaataagatcaccattaccaacgacaaaggtcggttatcaaaggaggagatcgagagaatggtgcaggaggccgagaagtacaaggctgaagacgaggtgcagagggaaagggtgtcggctaaaaacgctttagaatcatacgcctttaatatgaaatccgccgtcgaagatgaaggattaaaaggaaagatttcggaggcagataaaaagaaagtgctggataagtgccaggaagttatttcatggttggacgctaacacacttgccgagaaagatgagtttgaacacaaacggaaggaattggagcaggtatgtaatcccatcattagtggcttgtaccagggggctgggggacctggtccaggagggtttggtgcccaggggcctaagggaggatccgggagcggccctaccattgaggaggtggattag

SEQ ID NO: 225752 - DNA, 1926 bp, Artificial Sequence
  Description of Artificial Sequence: Synthetic coding sequence
atggctaaggccgcagcaattggtattgatctcggcacaacgtactcatgtgtaggagtttttcagcacggcaaggtagagatcatagctaatgaccaggggaaccgaacgactccctcttatgttgcgttcaccgatacggagagacttatcggggatgccgcaaagaaccaggtggctctcaatcctcaaaatactgttttcgatgcgaaaagactcatcggccgtaagtttggagatcccgtagtccagtctgacatgaaacactggccattccaggtgattaacgacggtgacaaacctaaagtgcaggtgtcgtacaagggcgagactaaggccttctacccagaagagatatcttctatggtactaactaagatgaaagaaattgccgaagcatacctcggctaccccgttaccaacgcggtcattacagttccagcttatttcaacgactctcagagacaagcaactaaggacgcaggtgtaattgcaggcctgaacgtgcttaggatcatcaacgaaccaacagccgcagccatcgcttacggcctcgatagaactggaaagggcgaaagaaacgtgctgatattcgatttggggggtggtacatttgatgtgagcattctgacaatagacgacggaattttcgaggtcaaagctactgcaggggacacccacctgggaggggaagatttcgacaaccgtttggttaaccacttcgtggaggagtttaagagaaagcacaaaaaggatattagtcagaacaaaagggctgtgaggcgattgagaaccgcatgcgaaagggcaaagaggaccctgtctagttctacacaggcttcactagagatcgactctcttttcgagggaatcgacttctataccagcataactagagctcggttcgaagaactatgcagtgatttatttagaagcactctcgagccagtcgagaaggccttacgcgacgccaagctcgataaagcgcagattcacgatctggtgctggtgggcggatccactagaatcccaaaggtgcagaagctgctgcaggatttcttcaatggcagggaccttaacaagtccataaatcccgacgaagcagtcgcctatggcgcagcagtccaggctgccatccttatgggggacaagtcagagaatgtacaggaccttctactgctcgacgtggcgccactgagcctgggtctcgagacggcaggaggcgtgatgactgctctgataaaacgtaattccaccatcccaaccaagcaaactcagatcttcaccacctacagcgacaaccagccgggagtcctgattcaggtctatgaaggagagcgcgcaatgacaaaagacaataacctattaggacggttcgagctgagcgggatccccccagctccaagaggcgtgccacagattgaggtgaccttcgacatcgatgctaacggtatcttaaatgtcactgctacggacaaaagtactggtaaggccaacaagattactattacaaatgataaaggccgtcttagcaaggaagagatagaacgtatggtgcaggaggccgagaagtacaaagcggaggacgaagtacagagggagcgcgtgtccgcgaagaacgctttagagagctacgctttcaacatgaagagcgccgtggaagatgaaggactaaaaggcaagatttctgaggctgacaaaaagaaagtgctggataagtgccaggaggtgatttcctggttggacgctaacaccctggctgagaaggatgagttcgagcataagagaaaagagctggagcaagtgtgcaatcccatcatctctggcttgtaccagggagcgggaggtcctggtcctgggggattcggtgctcaagggccaaaaggagggtccggttctggccctacgattgaggaggtggattag

SEQ ID NO: 225753 - DNA, 699 bp, Artificial Sequence
  Description of Artificial Sequence: Synthetic coding sequence
atggctaaggcggcagctattggcatcgatttgggcactacttattcctgtgtgggagtgtttcagcacggcaaagtggagattatcgcaaacgaccaggggaaccgcaccacaccttcttacgtggcctttaccgacaccgagcggctgattggcgatgcgggagtgattgctggcctgaacgtgctcaggatcatcaacgaaccaactgccgctgcgatcgcttacggactggatcgaaccggaaaaggagaaaggaatgttctaatcttcgatctggggggtggtacctttgatgtctctatactgacaatcgacgatggaatcttcgaggtgaaggctacagctggcgacacccacctgggtggagaggactttgacaaccgactggttaaccactttgtagaggagttcaaacggaagcacaaaaaggacatttctcagaacaaacgggctgttcgcaggctgcggaccgcatgtgaaagagcgaagagaacgctctccagttctacgcaggccagtctggagatcgacagtctgtttgagggaattgatttttatacctctataacacgagctcgcttcgaggagctctgtagcgatctgttccgatccacccttgaacctgtggaaaaggccccaccagcttcaccacgttgccggtcgtgctgcagaacatcttcaactggtgctacctag

SEQ ID NO: 225754 - DNA, 1926 bp, Artificial Sequence
  Description of Artificial Sequence: Synthetic coding sequence
atggctaaagctgccgcaatcggtatcgatctggggacaacctattcctgtgtgggcgtttttcagcacggaaaggtggaaataatagctaatgaccagggaaaccgcaccacgccctcttacgtggcttttactgatactgagcgcctcattggggacgctgctaagaaccaagtggccctgaatcctcagaataccgtattcgatgctaaaagactaattggtaggaaatttggtgacccagtggtgcagtcggatatgaaacattggcccttccaagttatcaatgatggcgataagcccaaggtgcaggtgtcctacaagggtgagacaaaggcattttatccggaggagataagctccatggttctgacaaagatgaaggaaatagcggaagcgtatctggggtatcctgtgacaaatgctgtgattacagtgccagcatacttcaatgactcacagaggcaggcaaccaaggacgctggggtcattgctggccttaatgttctgagaatcattaatgagccgaccgctgccgcaatcgcttatggcctagacagaaccggaaagggagagaggaacgttctcatcttcgatctggggggaggcacattcgacgtttctattttgacgattgacgacggcatcttcgaggtcaaggccaccgccggtgatacacacttagggggagaggattttgataacaggctggtgaatcactttgttgaggaatttaaacgcaagcacaaaaaggacatcagccagaataaaagggcagtgcggcgtctgcggactgcctgtgagagggctaagagaactctcagctcaagcacacaagcaagtctagagattgactccctctttgaagggattgacttctatacaagcatcacaagggcacggtttgaagagctgtgctcagatctgtttcgatcaactctcgaaccagtggaaaaggcgctgcgcgatgccaaactggacaaagctcagatacacgatttagttctggtgggaggttcaacccgcattcctaaggtgcaaaagctgctccaggacttcttcaatggcagggatctgaacaagtccatcaatcccgatgaggccgttgcctacggagctgctgtgcaagctgccatcctaatgggcgataagtccgaaaacgttcaagatttgctgctgctcgacgtggccccactgtcactgggtctggagacggcaggtggcgttatgacagccctgatcaaaagaaattccacgatccccacaaagcagactcagatctttaccacctacagtgacaatcagccgggagtgctgatccaagtgtacgagggtgagagagcgatgaccaaggataataacctgttgggcagattcgagttgtcgggaatccctccggcaccaagaggcgtgcctcagatcgaagtcactttcgatatagatgcaaatgggatcttgaatgtcactgccactgacaagtccaccgggaaggccaataagataactattactaacgacaaaggtcgcttgagtaaagaggagatcgagcgaatggtgcaggaagcagagaaatataaggccgaggacgaggtgcagagagaaagagtatccgctaaaaacgcactagagagttacgcctttaatatgaagtccgccgtggaagacgaagggctgaaaggcaagatcagtgaggccgacaagaagaaggtgcttgataaatgtcaagaggtgattagctggctcgatgccaacaccctagccgagaaagatgaatttgagcataagcggaaggaactggagcaggtatgcaaccccattatcagcgggctttatcaaggggcagggggtcctggccctggaggttttggtgctcagggtcccaagggcggatcaggctctggccctactatcgaagaagtggattag

SEQ ID NO: 225755 - DNA, 1926 bp, Artificial Sequence
  Description of Artificial Sequence: Synthetic coding sequence
atggctaaggccgcagcgattggcattgacctgggcacaacttactcttgcgtgggcgtgttccaacatggcaaagttgagattatcgctaacgatcagggcaaccgaacgacaccatcctatgtggccttcactgacactgaaagactaatcggggatgccgcaaaaaaccaggtggccctcaatcctcagaacacggtatttgacgccaagcgcttaataggaagaaaatttggtgatcccgtcgtccagtctgacatgaaacattggccatttcaggttataaatgatggcgataagcctaaagtgcaggtttcatataagggggagactaaggctttctatcccgaggagatctctagcatggttttgacaaaaatgaaagaaattgcagaggcatacctgggctaccccgttaccaacgccgtgataaccgtcccagcttatttcaacgacagccagcggcaggcaacaaaggacgccggagttatagcgggactgaatgttcttcgaattatcaacgaacctacggcagctgccattgcctacggcctcgaccgcaccggcaaaggtgagaggaatgtgctcatattcgacctcggtggcggaacctttgacgtgtcgattctgaccatcgacgatgggatttttgaagtcaaggctactgcaggggacacccacctgggaggtgaagatttcgataatagactggttaaccactttgttgaggaatttaaacggaaacacaaaaaagatatctcccagaataaacgagccgtgaggaggttacgcacggcttgtgaacgcgctaagagaacattgagctcaagtacacaagcgtcattagagatagacagcctcttcgaggggattgacttctatacttcgattacacgggcacgattcgaagagctgtgctctgatctgtttcgaagcaccctggaacctgtggaaaaagccctgcgagacgccaagttggataaagctcagatccatgatcttgtcctggtcggagggtccacccgcatccccaaggtgcagaagctgctgcaggatttctttaatggacgcgaccttaacaagtctattaaccctgatgaggccgtggcttacggtgccgcagtccaggcagcaatacttatgggcgataagtcagagaacgtgcaggacttactgttgctggatgtcgctccactgtcactcggtttggagactgccggtggggtaatgactgccctgatcaagcgtaattccaccattcctactaagcagacgcaaatattcaccacctactcagataatcagcccggagtgttgatccaggtttatgagggggagcgggcaatgaccaaggacaacaacttactcggcagatttgaactgtccggcattccccctgctccccgtggggtgccacagatcgaagtgacttttgatatcgatgcaaacggcatactgaacgtgaccgctacagacaagtccacggggaaagccaataagatcaccatcacaaacgacaagggcagattaagcaaagaggaaatagagagaatggtgcaggaagccgaaaagtataaagctgaggacgaagtgcagcgcgaacgagtgtctgccaagaacgcactggagagctatgccttcaacatgaaatccgccgtggaggatgaggggctgaagggcaagatcagcgaggctgataagaagaaggtactggacaagtgtcaagaagtaatatcctggttagatgccaatactctcgccgagaaagacgagttcgaacataagcggaaagagctggaacaggtgtgtaaccctatcatcagtggcctgtatcaaggggctggtggcccaggaccaggagggtttggggctcagggaccaaaaggaggaagtgggtccggccctacgatcgaggaagttgattag

SEQ ID NO: 225756 - DNA, 2127 bp, Artificial Sequence
  Description of Artificial Sequence: Synthetic coding sequence
ctgaggtcctgctgtgagggccctctccgcttgagtcgagtgacacccgctgtaccacggctgtctcgggcaaatctgtgcgggtgccggcacagacgggtcgagtttcccgctttccgaaggacggagctcctgagccggataccctcagccgtttcctctccacagtcccagtctggggcacaccggcaggggaccgggatggctaaggcagctgccatcgggatagatttgggaactacgtacagttgtgtgggcgttttccaacacggtaaggttgaaatcattgctaacgaccagggaaataggacaactccctcttatgtcgctttcaccgataccgaacggttaatcggagacgccgctaagaatcaagtggcactgaatccacagaatacagtcttcgacgccaagcgcttaataggaagaaaattcggcgacccggttgtccagtctgacatgaaacattggccgtttcaagtgattaacgacggcgacaagcctaaagtgcaggtttcttacaagggagagaccaaagctttctatccggaggaaattagctctatggtgctgacaaaaatgaaggagattgcagaggcttacctgggctaccctgtcacaaacgctgtaattaccgtgcctgcttacttcaacgactctcaaaggcaggccaccaaagacgctggagtgatcgccggattgaacgtgctgagaatcatcaatgagcctacagccgcagcaatcgcctatggtctcgaccggactggcaaaggcgaaagaaacgttttgatctttgacctgggaggcggaacattcgacgtctccattttaacaatagatgatggcatcttcgaggtgaaggcgaccgccggtgacacccacctggggggtgaagattttgataaccgccttgtcaaccactttgtggaagagttcaagaggaaacacaagaaagatatttcacagaacaagagggctgttaggcgtctcaggacagcttgcgaaagggcaaagagaacactttctagctctacacaagctagtctggaaattgactccctgttcgagggcatcgacttttacacatcaatcacacgagctagatttgaggagctgtgtagcgatctgttccgctctacattggagcccgttgagaaggctctgcgagacgcgaaattggacaaggctcagatacatgaccttgttcttgtgggcggttccacacggattcccaaggtccagaagcttcttcaggacttcttcaacggcagggacctcaataagtccataaacccagacgaagctgtggcttatggagccgcagtccaagcggctattctcatgggagacaagtctgaaaacgtgcaggatttgctcttgctcgacgtcgctcctctttctctaggcttagaaacggcaggaggagtgatgacagccttgattaagagaaactccaccatccccacaaaacagacgcaaatttttacaacctattcagacaaccagcccggtgtgctgattcaggtgtacgagggggagcgtgctatgacaaaagacaataatctactcgggaggtttgagctgtccgggatccctcccgctcccaggggagtacctcaaatcgaagtgacgttcgatatagacgcaaacggaatattgaatgtcaccgccactgataagagcaccggaaaagcaaataagataacaataaccaacgacaaagggaggcttagcaaagaagagatcgagaggatggttcaggaagccgagaaatacaaggctgaagatgaggtacaaagggagcgcgtttccgcgaaaaatgccctggagagttacgcattcaacatgaaatcagccgttgaggatgaagggctgaaaggcaagatctcggaggcggataaaaagaaggtccttgataagtgtcaggaagtaatcagctggctggacgccaacactctggccgaaaaagacgagttcgaacataagcgcaaagagctcgagcaggtttgtaatcccattatcagcggactgtatcagggcgctggcggtcccggaccaggaggctttggtgcgcaaggtcccaagggaggatcaggctctgggcctaccatcgaggaggtggattag

SEQ ID NO: 225757 - DNA, 1653 bp, Artificial Sequence
  Description of Artificial Sequence: Synthetic coding sequence
atggccaaagctgctgctatagggattgatttaggtactacttactcttgcgtgggcgtgtttcagcacggtaaggtgcaaattagctccatggtcttgactaaaatgaaggagatcgcggaggcctatctgggataccctgttaccaacgcagtgatcaccgtcccagcatacttcaatgacagtcagagacaggctaccaaagatgctggggtgatcgctgggttgaacgttctgaggattattaacgaacccacagcagcagccatcgcctatggccttgatcgaacagggaagggcgagcgaaatgtgctaatctttgatcttggcggtgggaccttcgacgttagtattttgaccatcgatgatggcattttcgaagtgaaggcaacggccggagatacgcacttagggggagaggattttgataatcggctggtgaaccacttcgtagaggaatttaaacggaagcacaaaaaggacatatcacagaacaagagggccgtgagacgccttcgaacggcgtgtgagagagccaaacgaacactgtcgagctctacacaggcatctctggagatcgacagcctctttgagggaattgatttttataccagcatcaccagagccaggtttgaagagctgtgctcagatctttttcgaagcactctcgagcctgtggagaaggcccttagggatgctaagttagacaaggcacagatccatgacctggtgctggtgggtggtagtacacgcatccccaaagtgcaaaagttattgcaggatttctttaatggaagggatctgaacaaatctataaatcccgacgaggctgtggcatacggcgctgcagtccaggctgccatcctcatgggagacaaaagtgaaaatgttcaggatctgcttctcttggatgttgcaccgctctcactagggctcgaaactgctggaggggtcatgactgccctgattaaacgaaatagtactatccccacaaaacagacgcagatttttacaacctattccgacaaccaacctggcgtacttattcaagtctacgaaggtgagagagccatgacaaaggataataatctgcttggacgtttcgagctatccggtattcctccagctcctcgcggagtaccacagattgaagtcaccttcgacatcgacgccaacggcatcctgaatgtgaccgcaacagataaatccactgggaaggctaacaaaattactattactaacgacaaaggaaggctgtcaaaagaggagatcgaaagaatggtgcaggaggccgagaagtacaaagccgaggatgaggtacagcgagaacgggtttctgccaaaaatgcactggagtcatatgcatttaacatgaaatcagctgtggaggacgagggtctcaaaggtaagatctcagaagccgacaaaaagaaggttctggataaatgtcaagaagtaatcagctggctcgacgctaacacactagccgaaaaggatgagtttgagcacaagcggaaagaattggagcaggtatgtaacccaataatttcaggtctgtatcagggcgcaggaggcccagggcctgggggatttggagctcagggccctaaagggggaagcggctccgggcctacaatcgaggaagtggactag

SEQ ID NO: 225758 - DNA, 1875 bp, Artificial Sequence
  Description of Artificial Sequence: Synthetic coding sequence
atggctaaggccgctgcaatcgggatcgatctcggcaccacctacagttgtgtgggtgtgtttcagcacggtaaggtggaaattatcgctaatgatcagggtaacagaactaccccttcctacgtggctttcaccgatacggagaggctcatcggggacgcggcaaaaaaccaagtcgcacttaacccccctgtggtgcagtctgacatgaagcattggccgtttcaggtaataaacgacggggataaacccaaagtccaggtgtcctacaagggagaaactaaagcgttttatccggaagaaatttcttcaatggtcctgaccaagatgaaagaaattgccgaagcttacctcggctatccggtgactaatgctgtaattactgtgccagcttatttcaacgactctcagcggcaggccactaaggacgctggcgtcattgccggactaaacgtcctgcgtatcatcaacgaaccaacggctgctgcaatagcctacggacttgatagaactgggaagggggagcgaaacgtgctgatattcgaccttgggggagggactttcgatgtgagcatcctgaccatcgatgatgggatcttcgaggtaaaggccactgccggtgacacccacctggggggtgaggattttgacaaccggctcgttaatcattttgtggaagaattcaaacggaaacacaagaaggatatctcacaaaataaacgagccgtgcggagactgagaaccgcctgcgagcgcgcaaaacgaacactgagctcttctacccaagccagtctggagatcgatagtctgtttgaagggatcgacttctacacatcaatcaccagggctaggtttgaggaattgtgctccgatctattcaggtcaaccctagagcccgttgaaaaagctctgagggacgccaaattggacaaggcacagattcacgacctcgtgctggtggggggatcaacacggattcctaaggtccaaaagctcctgcaagatttcttcaatgggcgagatctgaacaaatcgatcaaccccgatgaggctgtcgcctacggagctgccgtacaagcagctatacttatgggcgacaaaagcgaaaacgtgcaggatttgctgctgctggatgttgccccattgtcgcttgggctggagacggctggtggcgtcatgacagctctgataaaaagaaatagcacaattccaactaagcaaactcaaattttcactacctatagtgacaaccagcctggcgtgctcattcaggtgtacgagggggaaagagcgatgaccaaagataacaacctgctaggcaggtttgagctttctggaattcctcctgcgccacggggtgtcccacagatcgaggtgacttttgatatcgacgccaacggaatcctcaacgtgaccgctacagacaagtcgacaggcaaagctaataaaatcacaattaccaatgacaagggtcggctgagtaaagaagaaattgagcggatggtgcaggaggcagaaaagtataaggcagaggacgaggtccagcgtgaacgtgtctctgcgaagaacgcccttgagagttatgcttttaacatgaagagcgcagttgaggatgaaggcctgaagggcaagatttccgaggctgacaagaaaaaagtgctcgataaatgccaggaggtgatctcctggctcgatgctaacacactggcagagaaggatgaatttgaacataagcgcaaagagttggagcaggtctgcaatcccatcatttccgggctctaccaaggcgctggagggccaggccctggaggcttcggagcacaggggcctaaaggcggatccgggtcaggccctaccatcgaggaagttgattag

SEQ ID NO: 225759 - DNA, 1857 bp, Artificial Sequence
  Description of Artificial Sequence: Synthetic coding sequence
atggcaaaggcagccgcaatcggaatcgatctgggtaccacttattcgtgtgtgggtgtgttccagcacggaaaggtggagattattgccaacgaccagggcaaccgaacaactccctcttacgtagcgttcaccgataccgagagactcataggcgacgcagccaaaaatcaggtcgtgcagagtgacatgaagcactggccttttcaggtgattaacgatggggataaaccaaaagtgcaggtctcatacaaaggggaaaccaaggcattttacccagaggagattagcagtatggtgctcaccaaaatgaaggagatcgccgaagcttatctgggctatcccgtgacaaacgcagtaattaccgtgcccgcttactttaacgattctcagcgtcaggccactaaggatgctggcgtcatcgccggactgaacgtgctccgcataatcaacgaacctactgccgcagcaatagcatatggcctggaccgaaccggtaaaggggagagaaacgtcctgattttcgatctcggcggtgggacattcgacgtctcaatacttaccatcgatgacggtatcttcgaagtgaaggctaccgcgggtgatacccacttgggcggagaggacttcgacaatagattggtgaaccattttgtagaggaatttaagcggaaacacaaaaaagatatctcccagaacaaacgtgccgtgaggagacttcgtactgcctgtgagagggcgaaaagaaccctgtccagctccacgcaggcctcactcgaaattgatagtttattcgaaggcatcgacttctatacatctatcacccgcgctaggttcgaagagctctgcagtgatctgttccggtctaccctcgaacctgtggaaaaggctctgcgagacgccaagttagataaagcacagatccatgatctggtgctggtgggcggaagtactcggatccctaaggtgcaaaagttactgcaagacttttttaacggcagggatttgaacaagagcataaatcctgatgaggctgtcgcctatggcgctgccgtgcaggcggctattctcatgggagataagagtgagaacgtccaggatctgttacttctggacgtcgctccattatcgctgggactcgaaaccgctggaggggtgatgacggcactgattaaacggaacagcacaatcccaactaaacagactcagatttttaccacctactcagataaccagccgggtgtgctaatccaagtgtatgagggtgagagggccatgactaaagacaataacctgcttggacgattcgaactgagtggtattccccctgccccaagaggggtgccccagattgaagtcaccttcgacattgacgccaacggaattctgaacgttacagccacggacaagtcaacaggtaaagctaacaaaatcacgattacgaatgataagggcagactaagcaaagaggagattgaacggatggtccaggaggctgagaaatacaaggcggaagacgaggtccagagagagcgggtcagcgcaaagaacgcactggagtcttatgctttcaacatgaagtcggccgtagaggacgagggtctcaagggcaagatctccgaggccgataagaagaaggttctcgacaagtgtcaggaggtgatttcctggcttgatgccaataccctcgcggagaaggacgagtttgaacataaacgtaaagagcttgagcaggtgtgcaatccgatcatatcgggtctctatcagggggctggaggtcccggaccaggcggttttggtgctcaggggccaaaaggtgggtctggctctggtcccaccattgaggaggtggattag

SEQ ID NO: 225760 - DNA, 1857 bp, Artificial Sequence
  Description of Artificial Sequence: Synthetic coding sequence
atggctaaggcggctgctattggcatcgaccttgggactacttatagctgcgtgggggtgtttcagcatggcaaagtcgaaatcattgccaacgaccaggggaacagaactaccccaagttacgtagcgttcaccgacaccgaacggctgattggagatgctgcaaaaaaccaggtagtgcagagcgacatgaaacactggcccttccaggtcattaatgatggagacaagccgaaagtgcaagtttcttataagggcgaaaccaaggctttttacccagaggaaatttcctccatggtgctcaccaagatgaaggagatcgccgaagcttacctggggtacccagtgaccaatgccgtgatcaccgtgcccgcatactttaatgacagccagagacaagcgaccaaagacgccggagtgattgccggtttgaacgtactgcgcattatcaatgagcccactgctgcagctattgcctacggtttggatagaactggcaagggcgaacgaaacgttctgatctttgatctgggtggcggtacgttcgacgtgtccatccttactattgacgatggcattttcgaggtaaaggctacagccggagatacccacctcggcggagaggattttgataataggcttgttaaccactttgtcgaggaattcaaaaggaaacataagaaagatatctcccaaaataagcgggctgtccggaggttgaggacagcatgtgaaagagcaaagcgaacactgtccagttctacccaagctagcttggaaatcgatagcttattcgagggcatcgacttctatacgtcaatcacgcgcgctcgttttgaagagttgtgctcagatctatttaggtccaccttggagcctgtcgagaaagccctccgcgacgctaagctggacaaggcccagattcatgatttagtgcttgtgggcggaagcacacggatccctaaggtgcaaaaattgctccaggacttcttcaacggcagagacttaaacaaatctatcaacccagatgaggcagtcgcttatggagccgctgtccaggccgcaatccttatgggtgataagagtgaaaatgtccaggacctgcttcttctggatgtcgcccctctttcactgggcttggagaccgccggtggggtgatgacagccttgatcaaacgtaacagcacgatccctaccaagcagacccagatttttaccacttatagcgataaccagccaggcgtcctgattcaggtgtacgaaggagaacgggctatgacaaaggataacaaccttctgggcagattcgaactgagcggtattcctcctgctccccgtggcgtcccgcagattgaagtgaccttcgatatcgacgccaatgggatcctgaacgtgactgctaccgacaaaagtaccggcaaggctaacaaaattacaattacaaacgataaagggaggctgtcgaaggaggagatcgagaggatggtgcaggaagccgaaaagtacaaagctgaggatgaggtgcagagagaaagagtctccgccaagaatgcgctggagtcatacgcattcaacatgaagtcagccgtcgaggacgaaggcctgaaggggaagatctcggaggccgataaaaaaaaagttttggacaagtgtcaagaggtgatctcctggctagacgccaatacattggccgagaaggatgagttcgaacacaagcggaaggaacttgagcaggtctgcaaccccattatcagcggcctgtaccagggagccggagggcctggaccaggaggtttcggcgcacagggtcctaagggtggaagcggtagcggtccaaccattgaggaagtggattag

SEQ ID NO: 225761 - DNA, 1653 bp, Artificial Sequence
  Description of Artificial Sequence: Synthetic coding sequence
atggctaaggcagcagccataggaattgacttaggcacaacttattcttgcgtcggcgtcttccagcacggaaaggtgcagatttcaagtatggtgcttaccaaaatgaaggagattgctgaagcgtatcttggctatcctgtgacaaatgcagtcatcacagttcccgcatactttaacgattcccaaagacaggccactaaagacgcaggtgtgatagctgggctgaatgtgctacgaatcatcaacgaaccaacagccgctgccattgcctacggtctggaccggaccgggaagggagaaaggaacgtactcatatttgatcttggcggagggacgttcgatgtgtcaattctgaccattgacgatggaatatttgaagttaaggccacggccggtgacacccacctcggtggtgaggacttcgacaacagactagtgaatcactttgttgaggagtttaaaaggaagcacaagaaggatatctctcagaataagagagcagtgaggcgtctcaggactgcctgcgaacgagccaagaggacgctgagctcaagtacccaagcaagccttgaaattgatagcctcttcgaagggattgacttttatacttctataacacgcgctcgctttgaggaactttgctcagatctgttcaggagcacccttgaaccagtggaaaaggcactgcgggacgcaaaactggataaagcacaaatccacgacctggtgctcgtaggtggctcaaccagaataccaaaagttcagaaattgctgcaagattttttcaatggcagagacctcaataaaagcattaacccggacgaagctgtcgcttatggggcagcagtccaagctgccattctgatgggggacaagtctgaaaatgtgcaggatctgctgctgctggacgttgcccctctatcacttggtctggagaccgcagggggagtgatgacggccttaataaaacggaacagtaccataccaactaagcagacacagatctttaccacctattccgataatcaaccaggagtgttaatccaggtgtatgagggagagagggcaatgacgaaggacaataatctcctgggtaggtttgagctgagcggtatccccccagctccacgcggagtgccacagattgaggtaaccttcgacatcgacgcgaacggtattttgaatgtaacagcaaccgataagagtaccggaaaagccaacaaaatcacaattaccaatgataagggaaggctctccaaagaagagatcgagagaatggttcaggaggctgaaaagtacaaggccgaggacgaggtgcagcgcgagcgggtgtcagccaagaatgctctagaatcttacgcttttaatatgaaaagcgcagtcgaagacgaaggtctgaagggaaaaataagcgaagctgataaaaaaaaagttctggataaatgccaggaagtcatctcttggcttgacgcaaatacactggccgagaaagacgagttcgagcataaacggaaagaattggagcaggtgtgtaacccgatcatctctggcctctatcagggagcaggagggccaggccctggcggttttggagcgcagggaccaaaaggcggatctggctctggccctactattgaagaggttgattag

SEQ ID NO: 225762 - DNA, 1857 bp, Artificial Sequence
  Description of Artificial Sequence: Synthetic coding sequence
atggcaaaggccgctgctataggtatcgacctgggaacaacctacagctgcgtgggggtgtttcagcatggcaaagtcgaaattatcgcaaacgaccaggggaataggaccacgccttcctatgtggcattcactgatacagagcgcctcataggagatgccgctaaaaaccaggtggttcagagcgacatgaagcactggcccttccaggtaatcaatgacggggacaagcctaaggtccaggtatcgtataagggagagactaaagctttttacccagaggaaattagttccatggtccttaccaaaatgaaggagatagccgaggcctacctggggtaccccgtgaccaacgccgtaattacggtgcctgcctacttcaacgattctcagcgccaggccacaaaggacgctggcgtgatagccggtctgaatgtgcttaggattattaacgagccgactgccgctgcaattgcatacggcctcgatcggaccgggaaaggggagcgcaatgtcttgatctttgatctgggaggcggaacttttgatgtgagtattttgacaatcgacgatggcatcttcgaagtgaaggccacggctggcgacacacatctcggcggagaggatttcgacaacagattggttaatcacttcgtagaggaattcaaacgaaagcataagaaagacataagtcagaacaaacgcgctgttcgccgactgagaacagcctgcgaaagagccaagcggaccctttcctccagcacacaggcctcccttgagattgatagcctgtttgaggggatagatttctatacgtccatcacacgggctagattcgaggaactgtgctccgacctgtttcgtagtacactggaacctgtggaaaaggctttgcgagatgcaaagcttgataaggcccagatccatgatttagttttagtgggcggatccactagaatcccaaaggtgcagaagctgctgcaggattttttcaacggtcgggacttgaacaagagtatcaaccctgacgaagccgtcgcctacggcgctgccgtgcaggctgcaattctgatgggtgacaagtcagagaacgtgcaagacctgctgcttctggacgttgcgcctctgtctctcggacttgaaacagctggcggtgttatgaccgccttaattaagcgaaactctaccatccctactaaacaaacccaaatctttaccacctactctgataaccagcccggagtgctgattcaggtctacgaaggggagcgggcaatgacaaaagataacaacttgctgggtcgctttgaactctctggcattcccccagccccaaggggagtgccccaaattgaggtcacattcgacatcgatgctaatggcatcctgaatgttaccgccacagacaagagtactgggaaggcgaacaaaattaccattacaaatgataaaggccgactgtccaaagaagagatcgagagaatggtccaggaagctgagaagtataaagctgaggatgaggttcagagagagcgggttagcgcaaagaatgcactggaatcctatgcctttaatatgaagtccgcggttgaagatgaaggcttaaaaggtaagatcagcgaggctgataaaaagaaggtcctggataagtgccaggaggtgatttcatggctggatgccaacacgctggccgagaaggatgaatttgaacataagcggaaggaactcgaacaagtctgcaaccccattatttctggattgtaccagggcgctgggggtcctggaccaggcggttttggcgcacagggccctaaagggggttctggctctggaccaacaatcgaagaggttgattag

SEQ ID NO: 225763 - DNA, 1653 bp, Artificial Sequence
  Description of Artificial Sequence: Synthetic coding sequence
atggcaaaagccgctgcaattggaattgatcttggaaccacgtactcgtgtgtcggcgtgtttcagcacggtaaggtccagatctcatcaatggtgctcactaaaatgaaggaaatcgccgaagcctatctgggttatccagtcaccaatgctgttatcacagtgccagcctatttcaatgattctcagagacaggcaacaaaggacgctggagtgatcgccggtctgaacgttctcagaataatcaacgagcccacggctgcagctatcgcatatgggctcgataggacaggcaagggtgaacggaacgtgctgatcttcgatctagggggaggaacgttcgatgtgagcattctgaccatcgatgacggcatttttgaagtaaaggctaccgccggtgatacgcacctaggaggcgaggacttcgataaccgcctcgtgaaccatttcgtggaagagttcaaacggaagcacaagaaggatatcagccagaataaaagagcggtgcggcgattaagaacggcatgtgaacgggctaaaagaacactgtcctccagcacccaggcttctttggagatcgactctctgtttgagggcattgacttttacactagtattactagagctagatttgaagaactctgctccgatttgtttcggagcactctggagcctgtcgagaaggcccttcgagatgcaaagttggacaaggcacagatccatgatctggtgctagtcggtggcagtactcgcatcccaaaggtgcaaaagctgctgcaggattttttcaatggcagagacctgaacaaatcgataaacccagatgaagccgtagcctacggtgccgctgtgcaggcagctatactgatgggagataagagcgagaatgttcaagatctcctgctgttagatgtagcgcctctttcacttggcctggagaccgccggtggcgtgatgactgctctgatcaagaggaatagtaccatcccaactaaacagacgcagatctttaccacatactctgataaccaacccggtgttctaattcaggtctacgagggcgaacgagcgatgacaaaagataataaccttctgggcaggtttgagctcagtgggatccccccagcgcctcggggagtcccccagatcgaagtaacttttgatattgatgccaatggtatcctcaacgtgaccgccaccgataaatcaaccggtaaggccaacaaaatcacgatcacaaatgacaaaggaaggctttcaaaggaggaaatcgaaagaatggtgcaggaggctgagaaatataaagcggaagacgaagtacaacgagagcgcgtgtctgcaaagaatgcgttagaatcatatgcctttaacatgaaaagcgctgtggaagacgaaggcttgaaggggaagatcagcgaagctgataagaagaaggtgctagataagtgtcaggaggttatttcctggcttgatgctaacaccttggccgagaaggacgagttcgagcacaagcgaaaagaacttgaacaagtttgcaatccaattatttctggcctataccagggcgctggaggccctggccctggaggattcggcgcacaggggcctaagggcggttcaggtagcgggcctaccattgaggaagtagattag

SEQ ID NO: 225764 - DNA, 1761 bp, Artificial Sequence
  Description of Artificial Sequence: Synthetic coding sequence
atggccacggctaagggaatcgccatcggaatagatctgggcactacctatagctgcgttggtgtctttcagcacggtaaagtggagatcatagcgaacgatcagggaaaccgcacgacgccctcctatgtggcttttacggatacagagaggctgattggtgacgctgcaaaaaaccaagtagccatgaacccccagaacaccgttttcgacgccaagagactgatcggacggaagttcaacgatcctgtcgtgcaggcggatatgaagctttggccctttcaggttatcaatgattcccagcgccaggcaaccaaggacgctggcgtgattgccggacttaatgttctccggattatcaacgaaccaaccgctgccgcaatcgcctacgggcttgataaaggaggccagggcgagagacacgtgttaatcttcgacttgggaggtgggaccttcgatgtctcaatcctaactatcgatgatggaatctttgaggtgaaagctacggctggcgatactcatctcggcggtgaggactttgacaaccggctcgttagtcacttcgtggaagaatttaagcgcaagcacaagaaagatatctcccagaataaacgagccgtgagacgccttaggacagcctgcgagcgcgctaagaggacactgagcagctccacccaggctaatcttgagattgactccttgtacgagggcatcgacttctacacctccatcacacgcgctagattcgaggaattgtgcgctgacttattccgaggcacgcttgagccagtcgaaaaagccctaagagacgccaagatggacaaggcgaagattcacgacatcgtgctcgtcgggggaagtacaaggatccctaaagtccaacggctactgcaggattacttcaacggacgagatctaaataagtcgatcaatccagacgaagcagtggcctacggagctgccgtacaggcggctattctaatgggagacaaatcagagaaggttcaagatcttctgcttctcgacgtggcacctctcagtcttggtttggaaacagccggaggggtgatgaccgctcttatcaagcgcaactccactatcccaactaagcagacacaaatttttaccacatatagcgacaatcagcctggggtattaattcaggtttatgaaggagaacgggcaatgacaaaggacaacaacctactggggagatttgacttgaccggcattcccccagctccacgcggagttccacagatcgaggtgacgttcgatatcgatgcaaatggtatccttaacgtgacagctaccgacaaaagcacgggcaaggtgaacaaaatcacaattacgaatgataagggcagattatcgaaggaggagattgaaagaatggtcttagatgcggaaaagtacaaggccgaagacgaggtccagcgggagaaaatcgccgctaagaacgctttggaatcttacgcttttaatatgaagtcagtggttagtgacgaggggttgaagggcaaaatttctgaaagtgacaagaacaagatcctggataagtgtaatgaactactgtcctggctggaggtaaaccagctggctgaaaaagatgaattcgatcacaagaggaaagaattagagcagatgtgcaacccgataatcacaaagctgtatcaggggggttgtaccggcccagcgtgtgggaccggctacgtgccgggacgtcctgccacaggcccaaccattgaggaggtggactag

SEQ ID NO: 225765 - DNA, 1926 bp, Artificial Sequence
  Description of Artificial Sequence: Synthetic coding sequence
atggcaacggctaaggggatcgcaattggcatagatctggggaccacctattcctgtgtgggcgtattccagcacggcaaggttgagattattgcgaatgatcaaggcaaccgcaccacgcccagctacgtggcgttcaccgacacggaacgtcttattggagatgctgctaagaatcaggttgctatgaatcctcagaacacggtcttcgatgccaagcggttaatcggccgtaaattcaatgatcccgtggtccaggccgacatgaagctctggcccttccaggtcattaatgagggtgggaagccaaaggtactcgtctcatacaaaggggaaaataaggccttttaccctgaggagatatcctccatggttctgacaaagctgaaggagactgcagaagcttttctgggacatcctgtcacaaacgcagtgataaccgtccctgcgtacttcaacgattcccagcggcaggccaccaaagacgccggagtcatcgcaggcctgaacgtgctgaggatcatcaacgagcctaccgctgcggctatcgcatatgggttggataagggaggccaaggcgagcgccacgtgcttatattcgacttgggaggagggacctttgacgtgagcatcctgaccatcgatgatggcatctttgaagtcaaagctaccgctggggatacacaccttggcggtgaggactttgacaaccgcctggtgtcccatttcgtggaagaattcaaacgcaaacacaagaaagacatttcacagaacaaacgtgcggtccgacgtctgaggacagcgtgtgagcgggctaaaaggacactctctagctccacccaggctaacttggaaatcgactcgctgtacgaagggatagatttctacacttctattaccagagcgaggttcgaggagctctgtgccgacttgttccggggaaccctcgagcctgtagagaaagcactgcgcgacgcgaagatggataaagccaagattcacgatatagtcctggtgggtggctccactcgcattccaaaggtccaaaggctccttcaggactacttcaatggaagagatctcaataagagtatcaaccccgacgaagctgtcgcctacggcgcagccgtgcaagccgctatcctgatgggggataagtccgaaaaagtgcaggacctgttgctcttagatgtggcgccactatccttgggattggaaacggctggcggagtcatgactgccctgatcaaacgcaactcaactatccccactaaacagacacagatcttcaccacctactcggataatcagcccggagtgctcatccaggtctatgagggggaacgcgctatgaccaaagacaataacttgttaggaaggtttgacctgacaggtatcccaccggcacctcgcggtgtgccacagatagaggtgacattcgatatcgatgctaatggaattctaaacgtgacagctacagataagagtactgggaaggtaaacaaaatcaccatcactaatgacaaaggcaggcttagtaaggaggaaattgaacgcatggtcctcgacgctgagaagtataaggcagaggacgaagtgcaaagggagaagattgccgcaaagaatgctcttgaaagttacgccttcaacatgaagagcgtggttagtgacgaggggttaaaaggcaaaatcagtgagagcgataagaataagatcttggataagtgtaatgaacttctaagctggctggaagtaaatcagcttgccgaaaaagatgagttcgatcacaaaaggaaagaactggagcagatgtgcaatccgataatcacgaaactctatcaagggggatgtaccggccctgcttgcgggacgggttacgttcccggtcgcccagccaccgggccaacgatcgaagaggtagactag

SEQ ID NO: 225766 - DNA, 1926 bp, Artificial Sequence
  Description of Artificial Sequence: Synthetic coding sequence
atggcaaccgctaaagggatcgcaattggcatcgacttggggaccacttacagctgtgtgggagtgttccagcacggtaaagtggagattatcgccaacgatcagggtaatagaactacccctagctatgtggcatttaccgacaccgagcgcctcatcggagatgccgcaaaaaaccaggtggccatgaatccccagaacaccgtcttcgacgcaaagcggctcattggacggaagttcaacgatcccgtcgtccaggctgatatgaagctgtggccattccaggtcataaatgagggcggaaagcctaaagtactagtgagctacaaaggcgaaaataaggcattctaccccgaagagattagttcgatggtcctgactaaactcaaagagaccgcagaggcctttctcggtcatcccgttacgaacgccgtcataacagtccctgcctatttcaatgattcacagagacaggccactaaggacgcaggggtgatagctgggttgaacgtcttgcgaattataaatgaacccaccgcagccgctatagcatatgggctggacaaagggggacagggagaaagacatgtcctgatttttgatcttggcggaggaacctttgacgtgtccatcctgaccatcgatgacggaatctttgaagtcaaagctacagccggtgatactcacctggggggtgaagatttcgacaatagactcgtttcccattttgtggaggagttcaaaagaaaacacaagaaggacatctcccaaaacaagagggccgtccgacgtttaaggacggcttgtgagcgcgctaaaagaacactgtcttctagtacccaggcgaacctcgagattgatagtctttacgagggcatagatttctacacatccattacccgcgcacgttttgaggaactatgtgctgatctgttccggggtaccctagaacctgtggaaaaggcactgagagatgccaagatggacaaagcaaaaatccatgatatcgtgctagtgggaggctccacccgcatcccaaaagtgcagcgtttgcttcaggattacttcaacgggagggaccttaacaaatctatcaacccagatgaggcagtggcgtacggtgctgccgtacaggccgctatcttaatgggcgataagtccgaaaaagtgcaggacctcctcctccttgatgttgcacccctctctcttggactggaaaccgccggaggggttatgacagctcttatcaagaggaactcaactattcctacaaagcagacccagatctttactacatattccgacaaccagccaggcgttctgatccaggtctatgagggagagagagcaatgaccaaggacaataacctcctgggccgatttgacctaactggcattcctcctgctcctaggggcgtgccacagattgaagttacattcgacatagacgccaatggaattctgaacgtgactgctatggataagagtaccgggaaagtgaacaaaattactattacaaacgataagggcagactgtcaaaggaggagatcgagcgaatggttctggacgcagagaaatacaaagctgaggacgaggtccagcgagaaaaaatcgcagctaagaatgcactcgagagttatgcttttaatatgaagtccgtcgtatcagacgagggcctcaagggcaaaattagcgagagcgataagaataaaatcctcgataagtgcaacgagttgctgtcgtggttggaagtgaaccagcttgcagaaaaggacgagtttgatcacaagaggaaggagttggagcagatgtgcaatccaatcattacgaagctctatcagggcggatgcacgggtcccgcttgcggaactggctacgttcctggtcggcctgccacggggcctaccatagaggaggtggactag

SEQ ID NO: 225767 - DNA, 1926 bp, Artificial Sequence
  Description of Artificial Sequence: Synthetic coding sequence
atggctactgctaaaggcatcgccatcggaatcgacttaggtaccacgtattcatgtgtgggcgtgttccagcacggtaaggtagagataattgccaacgatcaggggaacagaactactccaagttacgtggcctttacggatactgagcgcctgatcggggatgctgctaaaaatcaggtcgccatgaacccacagaacacagtttttgatgccaaacgtttgattggcagaaagtttaacgacccggttgtgcaggccgacatgaaactctggccttttcaagtaattaatgagggcggaaaaccaaaggtgctcgtctcatacaagggagaaaataaagcgttctaccccgaggaaatctccagcatggtgctcacaaaattgaaagaaacggccgaagcttttcttgggcaccccgtcacgaatgccgttattacagttccggcttatttcaacgattcccagagacaagctaccaaagatgccggagtaattgccggtctcaatgtcttgagaatcattaatgagcccacagccgctgcaatagcctacggcctggacaaagggggtcagggcgagaggcatgttctcatcttcgacctgggaggcggtacgttcgacgtgagcatcctcactattgacgacggtatctttgaggtcaaggccaccgctggagatacacatcttggaggagaggactttgacaatcgtctggtgtctcacttcgtagaagaatttaaacgcaagcacaaaaaggacatatctcagaataaacgcgcagttcgcagacttaggacagcgtgtgagcgggcaaagcgcacgctcagcagtagtacacaggcaaatttagagattgactcactctatgaaggaatcgacttctatacatcaattacacgggcacggtttgaggagctctgcgctgatctctttcgagggacactggaaccagtcgagaaggcactgcgtgatgcgaagatggacaaggctaagatccatgatatcgttcttgtgggcggatctacacggatcccgaaagtccagagacttcttcaagattatttcaacggtcgagacctgaataagtcgatcaatcccgacgaagccgttgcctatggagccgctgtgcaagctgctatcctgatgggtgataagtcagaaaaagttcaggatttgctattgctcgacgtggctcccctgtctcttgggctggagacggcgggaggggtgatgaccgcgctcattaaacgcaactccactattccaactaagcaaactcagatctttaccacttattcagacaaccagccaggcgtactgatccaggtttacgaaggcgagcgagccatgaccaaagataacaaccttctagggcgattcgatcttaccgggatcccacccgctcccagaggcgtcccgcagattgaagtgacctttgatattgacgccaatggaattctaaatgtgacagcaactgacaagagtaccgggaaagtcaataagataactatcacaaacgacaagggaaggctgtcaaaggaggaaatcgaacgaatggtgttggatgccgagaaatataaggctgaggacgaggtgcagcgcgagaaaatcgcagctaaaaatgccctcgagtcttatgcgtttaacatgaaaagtgtagtgtccgatgagggcctaaagggaaaaattagtgagagcgacaaaaataaaattctggataaatgtaatgagctcctatcttggctcgaagtcaatcagttggcagagaaagacgaatttgaccacaagcggaaggagctcgaacagatgtgtaaccctatcattacaaaattgtaccagggcggatgcaccggtccagcctgtggcaccgggtatgtgcccggaaggcccgcaaccgggcctactatcgaggaagtggattag

SEQ ID NO: 225768 - DNA, 1926 bp, Artificial Sequence
  Description of Artificial Sequence: Synthetic coding sequence
atggctacagccaagggcatagctattggaattgacctgggaactacttattcatgcgtgggggtctttcaacatggcaaggtggagatcatcgccaatgaccagggcaatagaacaaccccttcctatgttgcttttacagatacagaaaggctgatcggcgatgctgctaagaaccaagttgccatgaatccacagaacaccgtgttcgacgccaagcgcctaatcggacgcaagttcaacgaccccgtcgtgcaggcagatatgaaactctggccatttcaggtcatcaacgaggggggaaagccaaaggtgctagtttcatacaaaggagaaaataaagctttttatcctgaggaaattagcagtatggttctcacaaagctgaaagagaccgctgaagcgtttctggggcacccagtgacaaatgcagttatcaccgtcccagcatactttaacgatagccagaggcaggctacaaaagacgctggagtgattgcagggctgaacgtactgagaataatcaacgaaccgaccgccgctgccattgcctatgggctcgataaggggggtcaaggggagagacacgtgctgatatttgatttaggtggcggaacgtttgatgtgtctatcctgaccatagatgacgggatattcgaagttaaggcgacggctggcgatacgcatcttgggggagaggactttgacaataggctcgtatcccattttgtcgaggagttcaaacggaagcacaagaaagacataagccagaacaagcgggctgtgcgaaggctaagaaccgcatgcgaacgcgcaaaaagaactctctcgtcaagcacgcaagccaatctggaaatcgactcactttacgagggaattgacttctataccagcattactcgcgcaaggttcgaggagctatgtgccgacctgtttcgcggtacgctggaaccagtggaaaaggccctgcgagacgcgaaaatggacaaagccaagattcacgatatcgtgctggtgggcggaagcacccgaattcctaaagtccagagactgctccaggattatttcaatggaagagatctgaacaaatccatcaatcccgatgaagccgttgcatacggggctgctgtccaggctgccatactgatgggagataagagcgaaaaagtccaagatttgctcttgctggatgtggcacccctttccctgggccttgaaacagctggtggtgtcatgacagcacttatcaagcgcaacagcacgatcccaaccaaacagactcagattttcaccacctattccgacaatcagccgggtgtcctgattcaggtgtacgagggcgagagagctatgactaaagataataaccttctgggccgattcgatctcacaggcatccccccagccccaaggggcgtgccccaaatcgaggtgacctttgacattgatgccaacggcatcctcaatgttaccgccacagataaaagcaccgggaaagtgaataaaattaccatcaccaatgacaaaggcaggctatccaaggaagaaatcgaacgtatggtactggatgcagagaaatataaagccgaggatgaagtccaacgagagaagattgctgctaaaaacgctctagaaagctacgcgttcaatatgaagtctgtcgtttccgacgaaggtctgaaaggtaaaatatccgaatcagacaagaataaaatcctcgacaaatgtaatgaactgctgtcctggctggaggttaatcagctcgctgaaaaggatgagttcgatcacaaacgaaaagagctcgagcagatgtgtaaccccattatcacaaaactgtaccagggcggatgtaccgggcctgcctgcgggaccggatacgtaccagggagacccgcaacaggccctaccatcgaagaggttgattag

SEQ ID NO: 225769 - DNA, 699 bp, Artificial Sequence
  Description of Artificial Sequence: Synthetic coding sequence
gccaaaggcattgcgattgggatcgatttgggaacaacatactcatgcgttggtgtttttcagcacggaaaggtcgagatcattgctaacgatcaaggcaatcgcactacgcccagttacgtggcattcaccgacaccgagaggctcattggcgacgctggggtgatcgccggactgaacgtgctcaggattatcaacgaacctactgctgccgctattgcctatggcttggacaaaggcggacagggcgagagacacgtgctcatcttcgacctcggagggggtacatttgatgtgtccatcttgactatagacgacggaatctttgaggttaaagccactgccggtgatactcatttgggcggtgaggacttcgataatagactggtatcccacttcgtggaagagttcaagcggaaacacaagaaggacatatctcagaacaagcgcgctgtcaggcggttgcggactgcctgcgagcgagccaaaagaaccctgagctcctcaacccaagccaacctggagattgactctctctacgaaggcattgatttctatacgagtatcacaagagctcgattcgaagagctctgtgccgatctgttccgtggcaccctggaaccggtcgagaagggagcccctcctgcaagtcctaggtgcagtggctgcttcagaaccacttcaatggacgtgatctag

SEQ ID NO: 225770 - DNA, 1926 bp, Artificial Sequence
  Description of Artificial Sequence: Synthetic coding sequence
atggccacagcgaagggtatcgcaatagggattgatcttggcaccacctactcttgcgtgggcgtctttcaacacggcaaggtggagatcatcgcaaacgaccagggcaacaggaccaccccgtcctatgtagctttcactgacactgagcgactcatcggcgacgccgctaaaaatcaggtagctatgaaccctcaaaatactgtgttcgacgcaaagcggctaataggacgaaaatttaatgaccccgtcgttcaagcagatatgaaattatggcccttccaggtgattaacgagggaggtaaacccaaggtcttggtgtcatataagggagagaataaagcattctatcctgaggaaataagcagtatggttctgaccaagcttaaggaaacagccgaagcttttcttggtcatcccgtcactaatgccgtgatcacagtgccagcatactttaacgactctcagcgacaggccacaaaagatgcaggagttattgcagggcttaacgtgctcagaattattaatgagccaactgcagcagcaatcgcctacgggctagacaagggcggacagggagaacgtcacgtgctcattttcgatcttggcggtggtacttttgacgtttcaattctgaccattgatgacggtatctttgaggtgaaggccacagccggagatactcatttgggaggcgaggattttgataatcgcctggttagtcacttcgtggaggagtttaagcgaaagcataagaaggacatcagtcagaacaagcgtgcagtacgacgcctgcgcaccgcatgcgaacgagctaaacgcaccctgagctcttccacacaggctaatttagagatcgacagcctctacgaaggcatcgacttctacacgagcatcacgagagcacgcttcgaagagctgtgtgccgacctgtttcggggaactcttgaaccagtggagaaggctttaagagacgctaagatggataaggcaaaaatccatgacattgtgttggtgggagggtcaacccgaatacctaaagtgcagcgtctgctgcaggattattttaatggtcgggatctcaataaatccattaacccggatgaggccgtggcgtacggagctgcagtgcaggcagctatcctcatgggcgataagtctgaaaaggtccaggatctgttgctgctggatgtagccccattgtctctcggccttgaaaccgccggtggcgttatgacagccttgattaagcggaattcgactattcccactaaacagactcagatcttcaccacgtacagtgataaccagccaggcgtgctgatccaggtttatgagggtgagagggccatgacaaaagataataacctgctaggtcggttcgatctgacggggataccaccagccccaaggggcgtgcctcagatagaagtcacctttgacattgacgcgaatggcatcctcaacgtgaccgcgatggacaagtccacgggcaaggtgaataagatcactataaccaatgataaaggcagattgagcaaagaagagatcgagcgcatggttttagatgcggaaaaatacaaagcggaagatgaagttcagagagaaaagatcgccgctaagaatgctcttgagagttacgctttcaacatgaaatccgtggtctcggacgaagggctgaagggcaaaatctcagaatctgataagaacaagatacttgacaagtgcaatgaactcttgtcctggcttgaggtgaaccagctagcagagaaggacgagttcgaccacaagcgcaaggaactggaacagatgtgtaaccccatcattacaaaattgtaccaaggtggctgcacaggcccagcgtgcggcaccggatatgtcccgggtcgaccagcgactggccctaccattgaggaggtcgactag

SEQ ID NO: 225771 - DNA, 1599 bp, Artificial Sequence
  Description of Artificial Sequence: Synthetic coding sequence
atggccaccgccaagggtatcgctatcggcatcgatctaggtaccacatatagctgtgtaggagtgttccagcacgggaaggtggagattatcgcaaatgaccaaggcaaccgcactaccccatcatacgtcgctttcaccgatactgaacggctcatcggtgacgccgcaaagaatcaagtcgcaatgaatccccagaacactgtgttcgacgctaagcgcctgatcggtcgaaaattcaacgatcctgtggtgcaggctgacatgaagctttggcctttccaggtaatcaatgagggcggaaagcccaaggtgctcgtgagttacaaaggcgaaaataaggccttctatccagaagagatcagctctatggttttaactaaactaaaagaaacggctgaagcatttctgggccaccccgtgacaaatgctgttatcactgttcctgcttacttcaatgactcccagcgccaagcgacaaaggatgccggtgttattgccggtctgaatgtgctcagaatcatcaacgagcctacggccgcagctatcgcatacggcttggacaagggcggacagggcgagaggcacgtgttgatatttgatttgggaggtgggacgtttgatgtatctattctgacaatagacgacggcatctttgaggtgaaggcaactgcaggcgatacacacctaggtggtgaagatttcgacaatcggctggtatctcactttgtcgaagagtttaagaggaaacacaaaaaagacatctctcaaaataagagagcagtacgcagacttcgcaccgcttgcgagcgagctaaaagaactctgagcagtagtacccaggccaacttggaaatcgattcactctatgaagggatcgatttttacacatctattactagagccagatttgaagagctgtgtgcagatttgttcagaggaaccctggaacctgtggaaaaagccctacgagatgcaaaaatggacaaggccaaaattcatgacatagtacttgtgggcggatccactcggatcccaaaggtccagcggctgttacaggactacttcaacggtcgagacctgaacaaaagcatcaatcccgacgaagcggttgcctacggcgcagcagtgcaagctgctatcctcatgggggacaagtcggaaaaggtgcaggatctgctccttcttgatgtcgcgccactgagtctgggactggaaacagctggaggcgttatgaccgctctgatcaagaggaacagtacaattcccactaaacagacccaaatcttcaccacgtacagtgacaaccagccaggcgtgcttatccaggtgtacgaaggcgagcgcgcaatgaccaaggataataatctgctgggtcgtttcgacctgactggcatccctccggctccccgaggagtgcctcagattgaagttacttttgatatcgacgcaaatggcatccttaacgtgactgccatggataagagtacaggcaaggtgaataagatcactataacgaatgataagggacgtctctccaaggaagagattgagcggatggtgctcgatgccgaaaaatataaggctgaagatgtctag

SEQ ID NO: 225772 - DNA, 699 bp, Artificial Sequence
  Description of Artificial Sequence: Synthetic coding sequence
gcaaagggtatcgccattggaatcgatcttggaactacatattcctgcgtgggcgtgtttcagcacggcaaggtggaaatcattgccaatgatcaaggtaaccggacaacaccctcttacgtggcctttactgatacagagagacttatcggcgatgctggcgtcatagccggtctgaatgtgttaagaatcataaacgaacctacagctgcagcgattgcatacggcctggacaagggcggtcagggagaaaggcatgtgctcatatttgatttggggggtggcacctttgatgtttccatcctcacgatcgacgatgggattttcgaagtgaaagctacggcaggggatacacacctcggcggagaggacttcgacaatcggctcgtgagtcactttgtcgaagagtttaaacgaaagcacaagaaagacatatcgcagaataaaagggcggtgagacggcttcgtactgcctgcgagcgagccaagcggacactcagctcctcaacccaggcaaacttggaaattgattccctctatgagggaattgacttttatacttccatcactagagctaggttcgaggaactgtgtgcagacctgttccgaggcacattggaaccagttgaaaaaggtgctcctcctgctagcccccgttgtagcggctgcttccggaccacatctatggacgtcatctag

SEQ ID NO: 225773 - DNA, 1926 bp, Artificial Sequence
  Description of Artificial Sequence: Synthetic coding sequence
atggccacagctaaagggatcgcaatagggattgacctcgggacaacctattcttgcgtcggcgtttttcaacacggaaaggttgaaataattgctaatgatcaaggcaaccggactactcccagctatgtggctttcacagacaccgaacggctgattggggacgcagcaaaaaaccaagttgcaatgaatccccagaacactgtcttcgacgccaagcgattgatagggaggaagtttaacgatcctgtggtgcaggccgacatgaagctgtggcccttccaggtgattaatgagggtgggaagccaaaggtgctagtatcctacaaaggggaaaataaggccttctatcctgaggagatctcgtcaatggtgctgacgaaacttaaagagacggctgaggcctttctcggccacccggtcacaaacgcagtcatcacagtgccggcttattttaacgacagtcagaggcaagcaactaaagatgcaggagtcatcgctggcctcaatgtcctacgaatcattaacgaaccgactgccgctgcaatagcttatgggctggacaaaggaggtcagggcgagcgccacgtgctgattttcgaccttgggggtggcaccttcgatgtgtctatcctcacgatcgatgacggcatattcgaggtgaaggccacagccggagatacacacctcggaggggaagacttcgataatcggcttgtgagccatttcgtcgaggaattcaagagaaaacacaaaaaagatatctctcagaacaaacgggcagtgcgaaggttgaggactgcttgcgaaagagcaaaaagaactttatcttcatccacccaagctaacttggagattgattcactatacgagggcatcgatttctacacaagtatcacacgcgcacgcttcgaagagctttgcgcagacctcttccggggaaccctggaaccagtggagaaagcccttagggatgccaagatggacaaagctaaaatacatgatatcgtgcttgttggcggaagtactaggattcccaaagtacagaggcttctgcaggactactttaacggacgcgatctgaacaaaagcatcaaccctgatgaggcagttgcatacggtgccgcagttcaagctgcaatcctcatgggcgataagtctgagaaggtacaggatcttcttttactcgacgttgccccacttagcttggggttagaaacggcagggggagtcatgactgccctgattaaacggaacagtacgattcctaccaaacagacacagattttcacgacttatagcgacaaccagcccggagtgctcattcaagtgtacgaaggcgagagggcgatgacaaaggataataacctgttgggcaggtttgacctcacaggcatcccccctgccccaaggggggtcccacagatcgaggtcacatttgacatcgatgcgaatggaattctgaacgtcactgctaccgacaaatccacaggcaaggtaaacaagatcaccatcaccaatgacaagggtcggctatcaaaggaagagatagagcgaatggtgcttgatgccgaaaagtataaggccgaagatgaggtacagcgcgagaaaatcgccgcaaagaatgccctggagagctacgcctttaatatgaaaagtgtggtgtccgacgagggcctgaagggcaagatcagtgagagcgataaaaataagattttggacaagtgtaatgagttgctcagttggcttgaagtaaaccaacttgcagagaaggacgaattcgaccacaagcgcaaggagctggagcagatgtgtaatcctataattactaagctctaccagggtggctgcaccggccctgcctgtggcacaggctacgtccccggaagacccgctaccggaccgaccattgaggaggtggattag

SEQ ID NO: 225774 - DNA, 1599 bp, Artificial Sequence
  Description of Artificial Sequence: Synthetic coding sequence
atggcgaccgcgaagggtattgcgattggcatagacctcgggactacatacagctgtgtgggcgtgtttcagcatggtaaggtcgaaattatagccaatgaccaggggaatcgcaccacgcccagctacgtggcatttacagatacagaacgattgatcggtgacgctgcgaaaaaccaggttgccatgaatccgcagaataccgtctttgacgccaaaaggcttattgggaggaagtttaacgaccccgtggtgcaggctgacatgaagttgtggcctttccaggtgatcaacgagggcggtaagcccaaagttcttgtcagttacaaaggagaaaataaggccttttatccggaggaaatctccagcatggtgctgaccaagctcaaagaaaccgctgaagcctttctcggtcatcccgtgactaatgcagtgatcaccgtgcctgcctattttaacgactcccagaggcaagccactaaagacgccggtgtaattgcgggactaaacgtacttcggatcatcaacgaacctacagcagctgcaattgcctatggactggacaagggaggccagggcgaacggcacgtgctgatctttgaccttggtggcggaacttttgatgtttccattctgacgattgacgacggaatcttcgaggtcaaagctaccgccggtgatactcacctcggtggtgaagatttcgataatagactggtgtcccatttcgtcgaggagtttaagaggaagcacaaaaaggacatctcacagaataaacgggctgtgaggaggctgcgaactgcttgcgaaagggccaagaggaccctgtcatcctccacccaagcaaacctggaaatcgactcactgtacgagggaatcgatttctatactagtattacgagagccagattcgaagaactctgcgcagatctgttccgaggaaccctcgagcccgtcgagaaggccttgcgcgacgccaagatggataaagctaagatccacgacattgtcctggtgggaggcagcaccaggattcctaaagttcagcgcttactgcaagactactttaatgggagagacttaaacaagagcatcaatccagacgaggcagtggcctacggggcagctgttcaggcagctatactcatgggcgacaagtccgagaaagtccaggacctattgttactcgacgtcgctccgctgagcctggggcttgaaaccgcaggtggtgtgatgactgctctgataaaacgaaactccactatacctaccaaacaaacccagatttttacaacatactcagataatcagcctggggtgttgatacaggtgtacgaaggagaaagggctatgaccaaagacaacaacctactgggtaggttcgacttgaccggcattcctccagcccctagaggtgtccctcaaattgaggtgaccttcgatattgatgccaatgggatcctcaatgttacagccatggataagagcaccggtaaagtgaacaaaataacaataactaatgacaaggggcgtctcagcaaggaggagatcgagaggatggttcttgacgctgagaagtacaaggctgaggacgtgtag

SEQ ID NO: 225775 - DNA, 1599 bp, Artificial Sequence
  Description of Artificial Sequence: Synthetic coding sequence
atggctacggccaagggcatagccatcggcatcgatctgggaacgacatacagctgcgtgggggtgtttcagcatggtaaggtggaaattatagcaaatgatcaggggaatcggacaaccccctcttacgtggctttcaccgacaccgaacgactgatcggagacgccgctaaaaaccaggtcgccatgaatcctcaaaacactgtgttcgacgccaagcggctaattggtcgcaaattcaacgaccctgttgtgcaggcagacatgaagctgtggccctttcaggttattaacgagggcggaaaaccaaaagtgctggtatcatataagggcgaaaataaggcattctaccctgaggagatttcgagcatggtgctgaccaaattgaaggagacagcagaagccttccttggccaccccgtcacaaatgccgtcattactgtcccagcatacttcaatgattcgcagcggcaggcaacaaaagacgccggtgtgatcgctggtctaaacgtcctgcgcattattaacgagcctacagcagctgccattgcctatgggctcgacaagggagggcagggcgagcggcacgtactgatctttgacttgggtgggggaactttcgatgtgagtatccttacaatcgacgacgggatctttgaagtgaaggctaccgcaggagacacacacctcggcggagaagacttcgataacagacttgttagtcactttgtagaagaatttaagcgcaagcataagaaagatattagccagaataaacgcgcagtgagacggctgcgaaccgcctgtgaacgagccaagcgtaccctgtcaagctcaacacaggccaacttggaaattgattcgctatatgaaggcattgacttctatacctccatcacccgggctcgatttgaggagctctgcgcagatctctttagagggacactggaacccgtggaaaaagcactgcgtgacgcaaaaatggacaaggcgaagatacacgacattgtcctggtggggggtagcactaggattcctaaggttcagagactattacaggactatttcaatggcagagacctcaacaagtcaatcaaccccgacgaggcagtggcctatggcgcagccgtacaagccgctatactgatgggggataaatcagagaaggttcaggatctcctgctgttggacgtggcaccactgagtctgggacttgagaccgctgggggagttatgactgcccttataaagaggaactcgaccatccctactaagcagacacagatttttacaacctacagcgacaaccagccaggcgtccttattcaggtctatgagggtgaacgcgcaatgacaaaagacaataacttgctgggtcggttcgacttaaccgggatccctccggctcccaggggcgtgccacagatagaggtcactttcgatattgacgccaacgggattctgaacgtcaccgcaactgacaagagcaccggcaaggttaataaaatcacgatcacaaatgacaaaggcagactctctaaggaggaaatagagcggatggtgttggacgcagagaaatacaaggctgaagacgtgtag

SEQ ID NO: 225776 - DNA, 1926 bp, Artificial Sequence
  Description of Artificial Sequence: Synthetic coding sequence
atggcgacggcgaagggcatcgccattggcattgatcttggcaccacctactcctgcgtcggagtctttcaacacggaaaggtggaaatcattgctaacgatcagggcaacaggactacccctagttatgtcgcatttactgataccgagcgactgatcggagacgcagctaaaaaccaggtggctatgaacccccagaatacggtgtttgacgccaaaaggctgatcggacgcaagttcaatgatcccgtggtccaggcagatatgaaattgtggccatttcaggtaattaatgaggggggaaagcctaaagtcctggtttcatataagggcgaaaataaggcattttatccagaggagatcagttccatggtccttacgaagctgaaggagaccgccgaagcgttcctgggtcatcccgtgaccaatgctgtaattaccgtaccagcctattttaatgatagtcaaaggcaggcaacaaaagatgctggagtgatcgctggccttaacgtgttacggataatcaatgagcctacagcggctgcaattgcttatggcttggacaaaggcggtcagggggaaaggcatgttttaatattcgatctcggcggtggcaccttcgacgtgtccattctgactattgacgatggcatctttgaagtgaaggcgaccgctggcgacacgcacttgggcggagaagactttgataaccgcttggtgtcacacttcgtggaggaatttaaacgcaagcacaagaaggatatcagtcagaacaagcgggcagtacgcaggctgcgcaccgcctgtgagagggctaaacggacattatcgagcagcacccaggcgaatctcgagatcgacagtctgtatgaagggattgacttctacacctccataacacgagcgaggtttgaggagctctgtgcagacttgttccgcggaacgctcgagcctgtggagaaggcccttagggatgccaagatggacaaagccaagatccacgacatcgtgctagtgggcggaagtacccgaatccccaaagttcaacgcctgctgcaagactactttaacgggcgtgatctgaataagagtattaacccggacgaggccgtcgcttacggcgcagccgtccaggccgctatactgatgggcgacaagtcagaaaaggtccaggatctactcctgctggacgtcgcccctttaagtttagggctcgagaccgccggaggggtgatgacagccctgatcaagaggaacagtacaatcccaacaaaacaaacccagatcttcactacctattctgacaatcagcctggagtccttattcaggtctacgaaggagaaagggcgatgactaaggataacaacctgctgggaaggttcgacctgacaggaatacctccagctcctcgcggtgtgccccagattgaggttacctttgatattgatgctaatggtattcttaacgttacggccatggataagagtacagggaaggtgaacaaaataactataaccaacgataagggtcgcctgtctaaggaggaaatcgagcgcatggtccttgatgccgaaaaatataaagcggaggacgaggtgcagagggaaaaaattgcggcaaaaaatgctctggaatcctacgcgtttaacatgaaatcagtcgtatcagacgaaggtctgaaaggaaaaatctccgaatccgataaaaacaagattctagacaagtgcaatgagctgctctcttggttagaagtaaatcagctcgccgaaaaagatgagttcgaccacaagaggaaggagttggaacaaatgtgcaacccaatcattaccaaactctatcaaggaggatgtaccggcccagcttgcggaactggttacgtacccggtcggccagctacagggcctaccatcgaggaggtcgactag

SEQ ID NO: 225777 - DNA, 699 bp, Artificial Sequence
  Description of Artificial Sequence: Synthetic coding sequence
gctaaaggaatcgccattggtatcgatctcggcaccacctactcctgcgtcggcgtgtttcaacatggtaaagtcgagattattgctaacgaccagggcaatcgcacgacaccgtcttacgtggcctttaccgacaccgaacgcctcattggagatgccggagtaatcgccggtctgaacgtgctgagaatcatcaacgaaccgactgcagccgcaatcgcctatgggttggacaagggagggcagggcgagcgccatgttctgatcttcgatttaggaggaggcacctttgacgtttccattttaactatcgatgacgggattttcgaagtgaaggcaaccgccggtgacacccacctcggcggagaggatttcgataatagactagtgtctcacttcgtggaggagtttaaacgaaaacataagaaagatatttcacagaataaacgagccgtccgcaggctgcgcacagcctgcgaacgggctaaaagaaccctcagctcctctacacaggccaacctcgagattgacagtctgtacgaggggatcgacttctacacctccattacacgagcacgcttcgaggagctttgtgccgatctctttagaggaactttggagcccgtggaaaagggagctcctcccgcatcccccagatgctccggatgttttaggaccacgtctatggacgttatttag

SEQ ID NO: 225778 - DNA, 699 bp, Artificial Sequence
  Description of Artificial Sequence: Synthetic coding sequence
gccaaagggatcgctatcggtatcgacctcggaaccacatatagctgtgttggtgttttccagcatggcaaggtggagatcattgctaacgaccaaggtaataggacaacaccctcttatgtggctttcactgatacagagcgtctcataggggacgcgggtgtcatagcagggctgaacgtcctcagaattatcaatgagcccacggcagcggctatagcttatggtcttgataaaggcggacagggcgagaggcacgtgctgatttttgacctggggggaggaacattcgacgtcagtattttgactattgatgatgggattttcgaagtcaaggcgactgcgggagacacccacctgggaggggaagactttgacaatcgcctcgttagtcacttcgtagaggagtttaagcgaaagcacaaaaaagatattagtcagaacaaaagagctgtaaggagactgagaactgcatgtgagcgagctaaaaggactttgtcttcgtcgacacaggcaaatctagagatcgacagcctctacgaagggattgacttctacaccagcatcacaagggcccgttttgaagagctctgcgccgatctgttcagagggacactcgaacctgtggagaaaggggctcctcccgcttctccccgttgctcaggatgtttccgcacaacatccatggacgtgatttag

SEQ ID NO: 225779 - DNA, 1926 bp, Artificial Sequence
  Description of Artificial Sequence: Synthetic coding sequence
atggccacagccaagggtatcgccattgggattgatcttgggaccacctacagctgtgtgggagtgtttcaacatggcaaggtagagatcatcgcaaacgaccaaggaaatcgcacaactccttcttacgtggcttttactgatacagagagactcatcggcgacgcagctaagaaccaggtagcgatgaacccgcaaaatacagtgttcgacgctaaaagattgattggccgtaagttcaacgatcccgtcgtgcaagcagatatgaaactctggcctttccaagttattaacgagggcggaaagccaaaagtgctggttagttacaagggcgagaacaaggctttctaccctgaggagatttcttcgatggttttaactaaactgaaggaaaccgcggaagcctttctcggtcaccccgtaaccaacgccgtgattactgtgccagcctacttcaatgactcccaacggcaggctactaaagacgccggtgtgattgccggattgaacgtgctgagaattataaacgagcctactgccgcagccatagcgtatggtctcgataagggaggccagggagagcgacacgttctgattttcgatctgggcggaggtacattcgatgtgtccattttaaccatcgatgacggtatctttgaagtcaaggccacagctggagatacgcatttggggggtgaggatttcgataaccgtctcgtgagccattttgtcgaagagttcaagcggaagcataagaaggacatcagccagaacaagcgcgcagttcgccgtttacgcaccgcttgcgaaagagccaagaggacgctgtcttccagtacacaggcaaacttggagattgactcactctacgaaggcatcgacttctacacaagcataacaagggcccgttttgaagaactttgtgcggatctttttaggggcacactggaacccgttgaaaaagctctgcgggatgccaagatggataaggccaaaattcacgacatcgtgctggttgggggatcaacaagaatacccaaagttcagcgattgcttcaggactactttaacggaagggatctgaataagtccataaatcctgatgaggccgtggcctacggcgcagcagtgcaggccgctatcctgatgggcgacaaatccgagaaggttcaggacctgctactgctcgatgttgctccgctcagtttgggactcgagacagcgggaggcgttatgacagctctgatcaagcgaaattccaccattccaactaaacagactcagatcttcacaacatactccgataaccagccaggcgtgctcatccaggtttacgagggcgaaagagctatgactaaggacaataatttgctcggcagattcgatctcaccggcatcccaccagctccgcgaggggtaccccagatcgaagttacatttgacatcgacgctaacggcatcctgaacgtgaccgctatggacaaatctacagggaaagtgaacaaaataacaatcacaaacgataaaggtagattgtctaaagaagaaatcgagcggatggtgctcgacgcagagaagtacaaagcagaggacgaagttcagagagagaagattgcagcaaagaatgcgctggagagttacgcattcaatatgaagtcagttgtgagtgatgaaggcctcaaggggaagatcagtgagtctgataagaataagatactggacaagtgcaacgagctgctgagctggctggaagtcaaccagctggccgagaaagatgaattcgaccataagagaaaggagctggaacagatgtgcaaccctatcatcacaaagctctatcagggagggtgtactgggccagcatgtgggacaggatacgtccctggcaggcctgccaccggaccaacaattgaggaggtggactag

SEQ ID NO: 225780 - DNA, 1920 bp, Artificial Sequence
  Description of Artificial Sequence: Synthetic coding sequence
atgtctgcacgaggcccagcaatcggaattgacttgggtacgacatactcctgcgtaggggtcttccagcatggaaaggtggagattatcgccaatgatcagggcaatagaactaccccctcttacgtcgctttcacagatactgaacgcttgataggagacgccgctaaaaatcaagttgccatgaatcccacaaacaccatatttgatgctaagcgtctgattggccgtaagtttgaagacgccacagttcagagcgacatgaaacattggcctttccgtgtcgtatccgaaggcggaaagcctaaagtgcaggtggaatataagggcgagacaaaaaccttttttcctgaagagatttcgtccatggtccttaccaagatgaaagaaattgccgaggcgtacctgggaggaaaagtacacagcgctgtaattactgttcccgcatactttaacgattcacagagacaagcaactaaggatgcagggactattaccgggctgaatgtgcttcggattatcaatgagcctactgctgcggcaattgcatatggtttggacaagaaaggctgcgcagggggtgagaagaacgttctaatttttgatctggggggtgggacattcgacgtaagcatcttaactatagaagatggtatcttcgaggtgaaatcgacagctggagacacccatttgggaggagaggactttgacaaccgaatggtgagccatctggccgaagagttcaagcgaaaacataagaaggacatcggacctaataagagagccgtgcgtaggctgcggacagcgtgtgagagggcaaaacgcaccctgtccagttcgacacaggctagcatcgagatcgattcactctacgagggcgtggatttttataccagcataactcgagccaggtttgaagagttgaatgccgacctttttcggggaacactcgagcccgtggaaaaagctttacgggatgctaagctggataaaggccagatccaggaaattgtgcttgtgggaggaagcacccggatcccaaagatacagaaactcctccaagactttttcaacggaaaggaacttaataagtccataaatccggacgaagccgttgcctatggcgcagccgtccaggccgctatccttattggcgataaaagtgagaacgtccaggacctattgctcctagacgtgacacctctgagcctcgggattgaaaccgcagggggtgtgatgacccctttgattaagagaaacacgactataccaactaaacaaacacaaactttcaccacgtattccgacaaccagagctctgttttggttcaggtctacgagggcgagcgggctatgaccaaggataacaatctgttaggaaaattcgaccttacagggatacccccagcccctaggggggtgccacagatagaggtaactttcgacatcgatgccaatgggatcctgaatgtgacagccgcagacaagtcaacagggaaggagaataaaattacaattaccaatgacaaagggaggctttcaaaagacgacatcgaccgtatggtacaggaggcagagcgatataagtctgaagacgaggccaatcgagatagggtcgccgctaaaaacgccctggaaagctacacgtataatattaaacaaacagtagaggatgaaaagctgcggggtaaaatatcagagcaagacaagaataagattctggacaagtgccaagaggtgatcaactggctagataggaatcagatggcagagaaggacgagtacgagcacaaacaaaaagagctggagcgagtatgtaacccaatcatctccaaactctatcagggcggacccggtggcggttctgggggtgggggtagtggcgcatccggcggaccgaccattgaagaggtcgactag

SEQ ID NO: 225781 - DNA, 1920 bp, Artificial Sequence
  Description of Artificial Sequence: Synthetic coding sequence
atgtctgcaagaggtcccgctatcggtatcgacttgggtacgacatactcgtgcgtgggagtctttcaacatggaaaagtggagatcatcgcaaacgatcagggcaacagaaccaccccatcctacgtcgcatttaccgacaccgaaaggctgatcggagacgccgctaagaatcaggtcgccatgaatcctactaataccattttcgatgctaaaagactaattggtaggaagtttgaggatgccaccgtccagagcgatatgaaacactggcctttccgcgtagtgagtgaagggggaaagcccaaagtgcaagttgagtacaaaggcgaaacaaaaactttttttccagaggaaattagctctatggtcctgacaaagatgaaagaaatcgctgaagcttacctggggggaaaggttcacagtgccgttatcaccgtcccagcttattttaacgatagccagcgacaagctacaaaggacgccggtaccatcacagggcttaacgtactcaggatcataaatgagcccactgccgctgccattgcctacggattggataaaaaaggctgcgccggtggcgaaaaaaacgtgctcatattcgacctcgggggaggcacttttgatgtgtccatcctgaccattgaagatggcatttttgaggtgaaatccactgccggagatacacacctgggcggtgaggatttcgataataggatggtctctcatctggcggaggagtttaagaggaagcataagaaggatataggtcccaacaagcgcgcagtgagacgactgaggactgcctgtgagcgagcaaaacgtactttatcaagttccacccaagcctctattgagatagatagcctgtatgagggcgtggatttctacacttccatcacgagggctaggtttgaagagctgaatgctgatttattcaggggaacactcgagcccgtcgaaaaggctcttagagacgctaaactcgataaaggccagatacaagaaatcgtcctggtgggcggaagcacgaggatccccaaaatacagaaactgctccaagatttctttaatggtaaggagctgaacaagtccatcaaccccgatgaggctgtcgcctacggagccgctgtgcaggcggctatacttattggagataagagcgaaaacgttcaagacctgctgctgctcgacgttactcctcttagcttgggcatcgaaactgctggcggagtgatgacccccctcataaagcgcaacaccactatcccaaccaaacagacacagacctttacaacttatagcgacaaccagtctagcgtactcgtgcaggtatatgaaggagaaagggctatgaccaaggataacaacctgctcggcaaattcgatctcactggtatccctcccgcaccccgtggcgtgccacaaatcgaggtcaccttcgatatcgacgctaacgggatcctcaatgtgacagctgccgacaagtctaccggcaaggagaacaaaatcaccataacgaatgacaaagggcgtctgagcaaggatgacatcgacaggatggtgcaagaagcagagaggtacaaatccgaggatgaggctaatagagaccgtgtcgccgcaaagaatgctttggaatcgtatacatataatattaaacagacggtcgaagacgaaaagttgcgcggaaagatttcagagcaggataaaaataaaatcctagataaatgtcaggaagtgattaattggctcgacagaaaccagatggctgagaaagatgagtatgagcataaacagaaggaactggaacgcgtgtgtaacccgattatatctaagttgtatcaggggggaccgggaggaggatctggtggaggtggaagcggcgcaagtggcggacccacgatcgaggaggtggattag

SEQ ID NO: 225782 - DNA, 1242 bp, Artificial Sequence
  Description of Artificial Sequence: Synthetic coding sequence
atgtctgccaggggtcctgctattggaatcgatctgggcaccacttattcctgtgtgggcgtgttccaacacggcaaggtggaaatcattgcaaacgaccagggcaatcgaacaaccccatcttacgtcgccttcactgacactgagagacttatcggagacgctgctaaaaatcaggtggctatgaaccccaccaacacaattttcgacgcaaagaggttgatcggcaggaagttcgaagagctgaacgcagatctgttcaggggaactctggagcccgtggagaaggctctgcgggatgccaagttggacaagggccagatccaggaaattgttctcgtaggcggaagtactagaatccctaaaatccagaaactcctgcaggatttcttcaacggcaaggaactaaacaagtcaatcaatccggatgaagcagtggcatatggggctgcagtccaggccgctattctaatcggagacaagagcgaaaatgtgcaggacctgctgctcctggatgtcacacctttgagcctagggattgaaactgctggcggtgtgatgacgcccctgatcaagagaaacaccaccattccgacaaagcagacccaaactttcactacttattctgataatcagtccagcgtgttggtgcaggtatacgagggcgaacgggctatgacaaaggacaataacctgctcggaaagttcgatttgacagggattcctcctgccccaagaggagtgccacaaattgaagtaaccttcgatatcgatgctaacggcatcttgaacgtaactgcagcagataagtcaacgggcaaggagaacaagattaccataaccaacgataagggcagactttctaaagacgatatcgatcggatggtgcaggaggcagaaagatacaagtcagaagatgaagccaaccgggaccgtgttgcggctaagaatgccttggagtcctatacttataacatcaaacagactgtggaggacgagaagctgagagggaaaatttcggaacaggataagaacaaaattctggacaagtgccaggaggttatcaattggcttgaccggaatcagatggctgagaaagacgaatacgagcacaagcagaaggaacttgagagggtgtgtaatcctataatcagcaagctgtatcagggtgggcctggtggaggatcaggagggggaggatccggcgctagtggcggaccaactatcgaggaagttgattag

SEQ ID NO: 225783 - DNA, 2523 bp, Artificial Sequence
  Description of Artificial Sequence: Synthetic coding sequence
atgtctgtggttggcatcgatcttggcttccagagctgctacgtggctgttgccagagccggtggcattgagaccatcgccaatgagtactctgatcggtgcacccccgcatgtatcagtttcggccctaagaatcgaagcatcggtgcggcagccaagagccaagtcatctccaatgccaagaatactgtgcaggggttcaaacggttccacgggagggccttcagtgatccattcgtagaagctgagaagtctaatctggcctacgatatcgtgcagctgcctactggactgacaggcataaaggtcacctacatggaggaagagaggaatttcaccacagagcaagttaccgccatgctcctcagcaaactgaaagagacagcggagagtgtgttgaaaaaacctgtcgtggattgtgtggtcagtgtgccctgtttttacaccgatgcagagcgacgctccgtgatggacgcgactcagatcgctgggctgaattgcctgcgtttgatgaatgagacaacagcagttgccctggcatacggcatctacaagcaagacctccctgcactcgaggaaaaacctcgaaacgtggtttttgtggatatgggtcacagtgcctaccaggtcagcgtttgcgccttcaatcgcggaaaattgaaagtgctagctactgccttcgatactactttggggggtagaaaattcgatgaagtcttggtgaatcatttctgtgaggaatttggaaaaaagtacaagctcgacattaagagcaagataagagcacttttgagactgagtcaagagtgtgaaaagttgaagaaattgatgagcgccaatgcttctgacctgccgctgagcatagagtgttttatgaatgatgtggatgtgagtggtactatgaaccggggtaaatttctcgaaatgtgcaacgatctcctggccagggttgagccacctctccggagtgtgctcgagcaaactaagctcaaaaaggaggacatctacgctgtcgagatcgtgggcggtgcgaccagaatacccgctgtgaaggagaagatcagtaaattcttcgggaaagaattgagtactaccctcaatgctgacgaagccgtgacaagagggtgtgcactgcaatgcgcaatcctcagtcctgccttcaaagtcagggagttctccatcactgatgtggtgccttatcctatctcccttaggtggaactctcccgcagaggaaggatcttctgactgtgaagtattctctaagaaccatgctgccccattctctaaagtgctgaccttttaccgcaaggaacctttcactttggaggcttactatagcagtccccaagatctcccctatcctgaccccgctattgctcagttttctgtgcagaaagtcactccgcagtctgacggctccagtagcaaggtgaaagtgaaggtccgtgtcaatgtacacgggattttctctgtatcctctgcctctctggttgaagtacacaagagtgaagagaacgaagagcctatggagaccgatcaaaacgccaaggaggaagaaaagatgcaggtcgaccaagaagagccccacgtcgaggaacaacagcagcaaactcctgccgaaaataaggccgagagtgaagaaatggaaacaagccaagctgggtccaaggataaaaagatggaccaaccccctcaggccaagaaagccaaggtgaaaacgtcaacggtggacctgccaattgaaaatcaacttctgtggcagatcgacagggaaatgttgaacctgtatatagagaacgagggcaagatgattatgcaggacaaacttgagaaagagagaaatgatgcaaagaacgcagtggaggaatatgtatacgaaatgcgggataagcttagcggggaatatgagaaattcgtgtcagaagacgaccggaattctttcaccctgaaactcgaagacaccgagaattggctgtacgaggatggagaggaccagccaaagcaggtttatgtggacaagctcgcagaattgaaaaacctggggcaaccaatcaaaattagattccaggaatcagaagagcgaccaaagctgtttgaagagctggggaagcagatccagcaatacatgaagattatctcgtctttcaagaacaaagaggatcagtacgatcacctggatgccgctgacatgaccaaggtggagaaatctaccaacgaggccatggaatggatgaacaacaagctcaatctccagaataaacagtccctcaccatggaccctgtcgttaaaagtaaggagatagaagcaaaaattaaggaactgacgtcgacctgcagccccattatttccaaacctaagcctaaggtcgagcccccaaaggaagagcagaagaatgcagagcagaacggtcccgtcgacggccaaggagataacccgggaccccaggctgccgagcaaggaacagatactgctgtccctagtgatagtgataagaaactcccagaaatggatatagattag

SEQ ID NO: 225784 - DNA, 447 bp, Artificial Sequence
  Description of Artificial Sequence: Synthetic coding sequence
atgtcagtagtgggtatagacctcggatttcagtcatgttacgtggctgtcgcaagggccggaggtatagagaccatcgcgaacgagtactccgatcgatgcacacccgcttgcatctcctttggtccgaagaatcggtccattggtgccgcagccaagtctcaggtcatttctaatgccaagaatactgtgcagggattcaaacgtttccacggcagagccttctcggacccttttgtagaggcagagaaatcaaacctagcttatgatatagtccagttgcctacaggcctcaccggcatcaaggttacttacatggaagaagagcagaacggcccagttgatggccagggtgataatccagggcctcaggccgcagaacagggcacagatacggccgtccccagcgattctgataagaaattacctgaaatggacattgattag

SEQ ID NO: 225785 - DNA, 1422 bp, Artificial Sequence
  Description of Artificial Sequence: Synthetic coding sequence
atgtcagtggtagggatagacctgggctttcaaagttgctacgtagcagttgcgagggccggaggtatcgagactattgctaatgaatactctgatcgttgcacacctgcctgtatttcattcgggccaaaaaatcgaagcatcggcgcagctgcgaagtcacaagtgatctccaacgctaaaaacaccgtgcagggttttaaacgattccatggtcgggcattttccgatccatttgtggaggcagagaaatccaatttggcttacgacattgtgcagttacctacaggtctgacgggcatcaaggtcacatatatggaggaggaacgcaacttcacaaccgagcaggtcacagctatgttgctatcgaagcttaaagaaaccgccgaatccgttctgaagaaaccagtcgtcgactgcgtcgtctcagtcccttgcttctacactgacgccgaaaggcggtctgtgatggatgccactcaaattgccggattgaattgtttgcggcttatgaatgagaccacggcagtcgctctggcttatggcatctacaagcaagacctccccgctttggaggagaaaccaagaaacgtagtctttgtcgacatgggccacagcgcctaccaggtctctgtgtgtgcattcaatagaggaaaactaaaggtgctggctacggccttcgacactacattaggtggacgcaaatttgacgaagtgctagttaaccatttctgcgaagagttcgggaagaagtacaaactcgatataaagtccaagatacgtgcattgctgagactctctcaggaatgcgaaaagctcaaaaaattaatgagcgccaacgccagcgaccttcctctgtctatagagtgtttcatgaacgacgtcgacgtgagtgggacaatgaacaggggtaagtttctggagatgtgcaatgatctgctagcgagagtcgaaccacctctgcggagcgttttagaacagaccaaactcaagaaggaagatatctacgcagtggaaatcgtcggcggtgccacgagaatcccggcagtgaaggaaaagatatccaagttctttggcaaggagctttccaccaccctgaacgccgatgaggctgtcacgcggggatgtgctctgcagtgcgccattctatccccggctttcaaagttagagaattttccattaccgatgtcgtgccctaccccataagtctacgttggaatagtcctgccgaagagggatcatccgactgtgaagtcttctcaaaaaatcatgccgctcctttttcaaaagtgctgaccttttatcggaaggagccgttcactctcgaagcctactacagctctcccggatttgccctctctaggagctgctattccatcataaagtcacttctgtctctgatggccccagtgcaaaagtag

SEQ ID NO: 225786 - DNA, 1965 bp, Artificial Sequence
  Description of Artificial Sequence: Synthetic coding sequence
atgaagctgtccctggtggcagccatgttgctgctgctgtctgccgcaagggccgaagaggaagacaagaaggaggacgtcggcacggtcgttggtatcgatctcgggaccacttatagttgtgtgggggtattcaaaaatggtagagtggagattattgctaatgatcagggaaatcggatcaccccctcttatgtagccttcacaccagagggagagcggctgatcggagatgcggctaagaatcagctgacctccaaccccgaaaatacagtgttcgacgctaagcgcctcatcggcagaacatggaacgatccaagcgtgcagcaggatataaagtttctgcccttcaaggtggtagaaaagaagaccaagccctacatccaagtggacatcgggggtggacaaacaaaaactttcgccccagaggagatatccgctatggtgcttaccaagatgaaggagacagcagaggcctacctgggtaagaaagtcacccatgctgtggtcactgtgcccgcttacttcaatgacgctcagcgacaggctactaaggatgccggaactatcgctgggctgaatgttatgagaattattaatgaacctaccgccgcagctattgcctatggcctggataagcgtgagggtgagaagaacatcctagtgttcgatctcggtgggggtacattcgacgtcagtttgctcacgatagataatggcgtcttcgaggtcgtagccactaacggagatacacatctgggaggcgaggactttgaccaacgcgtcatggaacattttattaagctgtataagaagaagactgggaaagacgtgagaaaggataaccgtgcggtgcagaaactccgtagggaagttgaaaaggcaaagagagccctgagctctcagcaccaggctcgcatcgaaatcgagtctttttatgaaggggaagacttttcagaaacccttactagagcgaagttcgaggagctgaacatggacctttttaggtccaccatgaagccggtacagaaggtcctcgaagattctgatcttaaaaagtcagacattgacgaaattgtgctagtggggggatcaacaaggatcccaaagatacagcagctggtcaaggagtttttcaacggtaaggagccctcccgagggatcaaccccgatgaagccgtggcctacggagccgcagtgcaagctggggtgctgagcggcgaccaggatacgggggacctggtgcttctggacgtgtgcccccttacgctgggcatagagactgtcggcggagtaatgaccaagctcattccaaggaacacagtggtccctactaagaagagccagatctttagtacagcaagtgacaaccagccaaccgtaacaattaaggtgtacgaaggtgaacgcccattgactaaagataaccacttgctcggtacgtttgacctgacagggattccacccgctccaaggggagtgccacagatagaggtgacctttgagatagatgtgaatggcatcctcagggtgaccgccgaggacaagggaaccggaaataagaataagattactatcactaacgatcagaaccgcctcacgccagaagagatcgaaagaatggtcaatgatgccgaaaagttcgcagaggaagataaaaagctgaaggagaggatagatacgcggaacgagcttgagtcctatgcttatagcctcaaaaatcagatcggggacaaggaaaaactcggcggaaaactctccagcgaggataaagagacgatggagaaggcagtagaggaaaaaatagagtggctggagagccaccaggatgccgacatagaggatttcaaggcgaagaagaaagagttggaagagatcgtgcagcctataatatcaaagttatacggcagtgcagggcctcctcctactggggaggaggacactgctgagaaggacgaactgtag

SEQ ID NO: 225787 - DNA, 837 bp, Artificial Sequence
  Description of Artificial Sequence: Synthetic coding sequence
atgaaactgagcctggtagctgcaatgctgctgttgctctctgcagctagagcggaagaagaggacaagaaagaggatgtgggcacagtggtaggaatcgatctcggtacaacttattcttgtgtgggcgtgttcaagaacggtagggtggagattatcgccaatgaccaggggaacaggattactccgagttacgtggcattcaccccagagggggaacgcctcatcggggatgctgctaagaatcagctgacgtccaaccctgaaaacactgtgttcgatgcaaagaggctgatcggacgtacttggaatgacccgagcgtgcagcaggacataaaattcctgccgtttaaggtcgtggagaagaaaacaaaaccttacatccaagtggatataggcggaggccagacaaagaccttcgcgccagaagaaatcagcgcaatggtgttgaccaagatgaaagagaccgctgaagcatatctgggaaagaaggtgacgcatgctgtggttaccgtacccgcatattttaatgatgcccagcggcaggcaaccaaggacgccggaactattgcgggactgaatgttatgcggattatcaacgagccaaccgctgcagccatcgcatacggactcgacaagcgcgagggcgaaaagaatattctggtgtttgatctaggcggagggaccttcgatgtgtctctcctcacaatcgataatggggtgtttgaagtagtggctacgaatggtgacacccacctcggaggcgaggacttcgatcagagagtcatggaacacttcatcaagctatacaagaagaagactttccttagaccatag

SEQ ID NO: 225788 - DNA, 1932 bp, Artificial Sequence
  Description of Artificial Sequence: Synthetic coding sequence
atgcaggcccctcgtgaactcgccgtgggaatagacttgggcaccacctactcctgcgtcggcgtgtttcagcagggacgtgttgaaattctggctaacgatcaagggaacaggacgaccccatcttatgtggcctttacagacacagagcggcttgttggggatgctgccaaaagtcaggcggcactcaatccacataacacagtcttcgatgctaaacgcctgatcgggagaaaattcgctgatacgacggtgcagtccgacatgaagcactggcctttcagagtagtgagtgagggtgggaagcccaaggtccgagtttgctatcgaggagaagacaagacattttatcccgaagaaattagctccatggtgctgagcaaaatgaaggagactgcagaagcttaccttggtcaaccagtgaaacatgctgtgatcaccgtccccgcatatttcaacgacagccagcggcaagctacaaaggacgcaggtgctatagctggtctgaacgtgcttaggatcataaatgaacccactgccgcagcaatcgcatacgggctcgaccgtcgtggggctggcgagaggaacgtgttgatctttgatctcggcggaggcacctttgacgtcagcgtgctctccatcgacgctggggtatttgaggtcaaggctactgctggggatacacacctcggaggagaggactttgataaccggctggtaaatcactttatggaagaatttaggaggaagcatggaaaggacctctccggcaataagcgtgctcttcgacgtctacgcaccgcgtgcgaacgagccaagcgtaccctctcatctagcacacaggccactctcgagatagacagtcttttcgagggagttgatttctatacgagcatcaccagggcccgattcgaggaactgtgctcggacctctttcggtccacactcgaaccagtggaaaaggcattgcgggatgccaaattggacaaggcacagattcatgacgttgtcctggtgggcggatcaacacggatacctaaggtccagaagcttctgcaagacttcttcaatggcaaagagctaaacaagtccattaaccccgacgaagcagtcgcctacggagccgcagttcaggccgcagtgctgatgggggacaagtgcgagaaggtgcaggaccttctgcttctcgacgtggcccctctgtcccttggtctggagaccgcagggggagtgatgaccacccttatacaaagaaatgccactatcccaacgaaacagacccagacttttaccacttattcagataaccagcccggtgtattcattcaggtttacgagggagagagagccatgaccaaggacaataacctcctgggcaggttcgagctgtccggcataccgccagcaccaaggggagtgccgcagatcgaggtgacattcgacattgacgccaacgggatcctgtccgttacggcaacagacagatccactggcaaagcaaacaagattaccataacaaacgacaaagggcgacttagtaaggaagaggttgagagaatggtgcacgaggccgagcagtacaaagcagaggacgaagcccagcgcgatagagtagccgcaaaaaattccctggaggcacacgtctttcatgtgaaggggtccctgcaagaagagtcactccgggacaagatcccagaggaagatcgaagaaaaatgcaagacaagtgtcgagaggttttggcttggctggaacataatcaattggcagagaaggaagagtacgaacaccagaaaagagagctcgaacagatatgtcgccctatctttagccgtctgtacgggggtccaggcgtgcccggtggctcatcctgtggcacacaggctagacagggcgacccaagcacaggtccgattatagaagaagttgattag

SEQ ID NO: 225789 - DNA, 1860 bp, Artificial Sequence
  Description of Artificial Sequence: Synthetic coding sequence
atgcaggctcccagagagttagcagttgggatcgatctcgggacaacatattcatgcgtggcattcaccgatacagaacggctcgtgggagacgctgccaagagccaggctgcgttaaatccgcataacacagtgttcgatgctaaacgcctaatagggcgtaagttcgctgatacgaccgtgcagtccgatatgaagcattggcctttcagggtagtaagtgaggggggaaagcctaaagtcagggtatgttatcgcggagaggataagaccttttatcccgaggaaatatccagcatggttctctcgaagatgaaagaaaccgctgaagcttacctggggcaacctgttaagcacgcagtgataacagtccccgcttacttcaatgattcacaaagacaggctacaaaagatgccggagcaatcgctggcctcaatgttttacgtatcatcaacgaacccacagccgctgccattgcctacggcttagacaggaggggagctggagagcgaaatgtcctgattttcgacctggggggtggaacgtttgatgtctccgttctgagtattgatgccggagtcttcgaagtaaaggccacagcaggcgatactcacctcggaggggaagatttcgacaataggttggtgaatcactttatggaagagttccgacgcaaacatggcaaggatctgtcaggaaataagcgggcactcagaaggctcaggaccgcttgcgagagggccaaaagaactctgtcgagcagtacacaagccaccctggagatcgacagcctgtttgaaggtgtagatttttacacttccattactagagcgaggtttgaggagctatgcagcgatctgtttaggagcaccctcgaaccagtagagaaagctctccgcgacgccaagctggacaaagcccagatccacgatgtggtcctggtgggcggttcaacccggatccccaaggtccagaaactgctgcaggacttttttaacgggaaggaactcaataagagcattaacccggatgaagccgtggcgtacggggcagcggtgcaggccgcagtgctcatgggtgataagtgtgagaaagttcaagatctacttctgctggacgtggctccactgtccctgggtctagagaccgccggaggcgtcatgaccacactcattcagaggaacgctacgatcccaaccaaacaaacccagactttcaccacctattccgacaatcagcccggtgtgtttatacaggtgtatgaaggagagcgcgctatgaccaaagataataacctgctgggaagattcgaactcagcggcattccgcctgccccacggggtgtcccccagatcgaggtgacgtttgacatagacgcaaatgggattctgagcgtgaccgcaactgacagatccacaggcaaagcgaacaagatcactataacaaacgacaaaggaagattgtccaaggaggaagttgagcgcatggttcacgaagctgagcaatacaaggcggaggacgaggcccaacgtgaccgcgtggctgctaaaaattcactcgaggcacatgttttccacgtgaaaggaagcttgcaggaagagagcttgcgggacaaaatacctgaggaggatcgacggaagatgcaagataagtgcagagaagtgttggcatggctggaacataatcagctggccgaaaaggaagaatacgagcatcagaagagggagctggagcaaatttgtagacccatattttcacgcctatacggtggaccaggcgttcccggagggtcatcctgtggcacccaggctcgtcaaggcgacccttccaccgggccaatcatcgaggaagttgactag

SEQ ID NO: 225790 - DNA, 2337 bp, Artificial Sequence
  Description of Artificial Sequence: Synthetic coding sequence
atgagcaagcgcaagctgattccaaaactctccatccaatcccccgtcctgcatacaaacctgaatgtccagtcaacgcatcccccactaaaaaaagaggatcttcatcggatttccaaggacagtctggagtccgattctgagagcttgactcaggagattatgtgccactccgagtttgacgataggatccgcggaaacggaatggagcccgattctttagatgaagaggagagtccccgttggggctctctccacgaaatggaagaggaggcctccgggaaagccgctcagatggcccgtgagcaaaatcatcatacttgggatcaaggagccaataatcgccagcaacccattgaagacaaatactcagatctgagatatgaccccaactggaaaagcaagaaggaggagggtcagctactgagcgtcgaggcacttcccgaatcaaccgactcctctctcgaaaatctgccgctcgcccctctgtaccccagccaggagaccagcatggaactgagtgggggtaaaggtgagcaaaaggaatccccccagtccgctgccagtctgttgggatccgagttcctttccccgaactacgaacacggggctcgcagaagcaagccgtttagtgaactgtccgattctgaccttgaagagaagagctcttccctgagcccttatgtgaagtcctcttcatcacataacgaggtcttcctgcccggaagtcgcggtccccgaaggcgcaagagcaaacagcacttcgtggaaaaaaacaagctgacgctgggacttccgacccccaaaacagacagctacctgcaactccataataaaaaaaggggggagtctcatccagaacaaatctcctaccccgtacgtgtgacggataaaacttcaatccagaatgccaaggaaatggagaacgctgcaatcgaccccgaagataagtggcatcagcgggcacagcaactcaagaattaccaggagcattggtcgcaatacgagtcaacgaaatcaagcaatgtgccacggggtcagcccagtgacatggtgaacgatcaccagccatctcgacgcccagccaagctcaaaatccgaaaacagtgtaagcaccaaaatggactgaagtcgtccacgactgaggaagttacggcctcccaaggaaatcagaataatcctcccagacagcagcaaaaccaaaataagccactggatacctctaccaagccagagtcaatcgtcatcatgcatgcttccaataacgacgtgcaggccagtagagcgctgcggtcacataacctcaaagagaccagtaacacttttgccccaccaaagcaagccttcgacaaggtactgagcaaaaattccactgggtgtgactccggactgaacgtgaacaaggaaagagggcacaaggaccaagaagagaaacgttttagttaccagcagttgcatacgctgtcagatatggatctgaacaacctcaatgagctgtcaaaacgccatgtgctgctaagccagaaaggttctcagttcgtgtaccatattaacactcacggatctaccaaaaacaaaaaacagctgaaacaaccctacacagaaaccaagtatcgcaatctagaaatgctgtggaagtttcactcttcatctgactcgcaaacagtccgggcttcccctgacagctggctgactcagattatggagcagcaccagcaagctctcgtgcagctgactgacgtgcagccctcagagggagctctgagcagtgttaccttgccacccatcttatcgcgggtggaaagcgagagccagcttagttcagagcgctctcaacggaaccaggtgaaaattagccgaagtaactcggaggggtatctatttcagcttgagaaagggaagaaacataaaaaacgatcttcctccaaaaacacaaaactgaagggataccaaaagagagacgtaaaacttggcggacttggaccagatttcgagtctatcagggataaaacccaaaagcttattcaacagaaggagtacgctaagcaggttaaggagtacaatatgaaaaccttgagcatcctctctaagccgcagactgagaaaacacagaaaaaatcggctatcccccgacagaaggctctggaatacgcaaagactataccaaagccaaagccatccaacctaacccaccaggcaagcaaagagcagaagaaccccacctacgccggaaaggaggagtcactccccgagatctctctgttagagatcctccagaatagacatgagagagaaaaacaggccgtggctgctttcaaggtcctgcacatcgtgtag

SEQ ID NO: 225791 - DNA, 1482 bp, Artificial Sequence
  Description of Artificial Sequence: Synthetic coding sequence
atgtcaaaaggaccagctgttggcattgacctgggcactacatatagctgtgttggggtgtttcagcacgggaaggtggaaatcatcgcaaacgatcagggcaatcggacgacaccctcatacgttgccttcacagatacagagcgtctgatcggagatgccgcaaaaaaccaagtggctatgaaccctaccaatactgtgttcgatgctaaacgtctcataggaagaagatttgatgacgctgtcgtccagtcagacatgaagcactggcccttcatggtggtcaatgacgccggacggcctaaggttcaggtagagtataagggcgaaacaaagagcttttaccccgaagaagtatccagtatggttctgacaaagatgaaggagattgctgaggcatatctgggcaagacagtgacaaatgcagttgttacagtgccggcttatttcaacgattcccagaggcaggctacaaaggatgcaggaaccatcgcgggactgaacgtgttgcggattatcaacgaacctaccgccgctgccatagcttacgggctagacaagaaagtgggcgcagagcgcaatgtgctaatctttgacctgggtggaggtacatttgacgtgtccatcctaactattgaggacggcattttcgaggtcaagtcaaccgccggagatacccaccttggaggggaagatttcgataaccggatggtgaaccacttcatcgcggagtttaagcgtaaacataaaaaggacatttccgagaataaacgtgcggtgcggagactgagaactgcctgcgagcgcgctaagcgaacgctgagctccagtacccaagcaagtatcgaaatcgactccctgtatgaggggatcgatttctacacatcaatcactagggctcggttcgaagagctgaatgctgacctgtttagggggacacttgatccagtggaaaaagcgttgagggacgccaagctggacaagagtcagatccacgatattgtgcttgtcggaggaagcactcggatcccaaagatacagaaactactacaagactttttcaacggtaaggagctgaacaagagcattaacccagatgaggccgttgcctacggtgcagccgtgcaagctgccattctgtccggcgacaagtctgagaatgtccaagatctcttgctcctcgatgttacaccactgtccctcggcatcgaaacagctggcggagtcatgaccgtgcttattaagcgcaatactacgattccaactaagcagacccagacctttaccacatacagtgacaatcagcccggagtgctcattcaggtatacgagggtgagcgggcaatgaccaaagataacaatctcctaggcaagtttgagctcaccggcatgccaggtggcatgcccggaggcttccccggtgggggagctccaccttcaggcggtgcatcatccggacccactatagaggaggtcgactag

SEQ ID NO: 225792 - DNA, 1884 bp, Artificial Sequence
  Description of Artificial Sequence: Synthetic coding sequence
atgtcaaaggggcctgcggttgggattgacctcggaactacatattcgtgcgttggagtattccaacatggcaaagtggaaatcatagccaatgaccagggcaatcgcacaaccccaagctacgtcgcatttacagacacggagaggctgatcggagatgccgctaaaaatcaggtggccatgaaccctactaatactgtgttcgacgcaaaaagactcattggcagacgattcgacgacgccgtggtgcaaagcgatatgaaacactggccattcatggtggtgaacgacgcaggacgcccaaaagtccaagtcgaatacaagggtgagactaagtcgttttatccagaagaagtaagtagtatggtgctgacaaaaatgaaggagattgccgaggcttacctcggtaaagccacaaaggacgccggaacaattgccggtctcaacgtgctcagaatcattaatgagccaactgctgccgctatcgcctatggcctggataaaaaggttggggcagaacggaatgtgctcatcttcgatctggggggaggcacgtttgacgtctccatcctgaccattgaagatggaatcttcgaagtaaagtctaccgcaggagacacccacctgggcggagaggactttgataataggatggtgaatcactttatagcagagttcaaacggaaacacaaaaaggatattagcgagaataagagagctgtgcggagattgcggaccgcctgtgaacgggcaaagagaacgttgtcatcttctactcaggcgtcaattgaaatcgacagtctctacgaaggcattgatttctacacatctattactagagcgagatttgaggagcttaatgccgacctattcaggggcaccctcgatcccgtggagaaggcactaagagacgccaaattggacaaaagccaaatccacgatatcgttctggtgggcggaagtactcggatacccaaaatccagaagctgttgcaggacttcttcaatggcaaggagctcaacaagagcattaacccggatgaagctgtcgcttacggtgctgctgtgcaggccgctatcctctcaggagacaaatccgaaaatgtgcaggatctgctcctcctggacgtgacccctctgagcttagggatcgagaccgcagggggagtgatgaccgttttgatcaagcgtaacacaaccatcccaactaaacaaactcagacttttaccacttacagcgataaccaacccggagttttaatccaggtatatgagggtgagagggccatgactaaagacaacaacctgctgggcaaatttgagctaacggggatcccaccggctccccgtggcgtccctcagatcgaagtgacatttgacatagatgccaatggaatcctgaacgtctcagcagtggacaagtcgactggcaaagaaaataagataacaatcaccaacgataaaggtcgcctgagcaaggaggatatagaacgcatggtccaggaggccgagaagtacaaggccgaggatgaaaaacaacgcgataaagttagctcaaagaattcactcgagagctacgcctttaacatgaaggccactgttgaagacgaaaagctccaaggaaagataaacgatgaggacaagcagaaaattctagataaatgtaatgagataatcaactggctggataagaatcagacagcggagaaagaggaatttgagcaccagcaaaaggagttagaaaaagtgtgcaatcctattattactaagctatatcaatcggcaggtggcatgcctggcggaatgccaggaggattcccaggtggcggagcccctcccagcggaggggcatcgtctggcccaaccatcgaagaagtcgattag

SEQ ID NO: 225793 - DNA, 1941 bp, Artificial Sequence
  Description of Artificial Sequence: Synthetic coding sequence
atgtcgaagggaccagctgttgggatcgatctgggcacaacatactcatgcgtcggagtgttccagcatggcaaagtggagattattgctaacgaccaaggtaatcgcaccactccaagctacgttgcctttaccgatactgagcggctaattggcgacgccgctaaaaatcaagtcgcaatgaaccccacaaatacagttttcgacgctaagaggcttataggcaggcgatttgatgacgccgtggtccagagtgatatgaaacactggccgtttatggtcgtcaacgatgcaggccgacccaaggtacaggtcgagtataagggtgagactaaatcattttaccccgaagaggtgagcagcatggtgctgaccaaaatgaaagagatcgccgaggcctatctaggaaaaactgttacaaacgctgtagtgacagtgcccgcttacttcaacgatagccagaggcaagcaacaaaggatgccggaactattgcagggcttaatgttctgcggataattaacgagcctacagccgctgcaattgcctatggcctcgataagaaggtgggcgctgaaaggaacgtactgatcttcgatctgggcggaggaactttcgacgttagcattttaaccatcgaagatggtatcttcgaagtgaagtccacagctggagatactcaccttggtggagaggactttgacaacaggatggtgaatcactttattgccgaattcaagagaaagcataagaaggatatcagcgaaaataagcgcgcagtgaggcggctccgcaccgcttgtgaaagagcgaagaggaccctgtcctccagcacacaggcgagtatcgaaatcgatagcctgtatgagggcattgacttttacacatccataacacgtgctcggtttgaggaacttaacgccgacctgtttagaggcacgctagatcccgtggaaaaggccctcagagacgccaagcttgacaaatcacagatacatgacatagtcctcgttgggggaagcacacggatccctaaaattcaaaagctgttgcaggacttttttaacgggaaggagctgaataaatccattaaccctgatgaggctgttgcatatggcgcagccgttcaggctgcaatcctgagcggcgacaagtcagagaatgtccaggatctgctgctgttagacgtcaccccgctgagtcttggaatagaaacagccggaggtgtgatgaccgtgctgatcaagcggaacactaccatccccaccaagcagacacaaacattcactacatatagcgacaaccagcccggagtgctgattcaggtgtatgagggtgagagagcgatgacaaaggataacaatctactcgggaagtttgaattgactgggataccccctgcccctcggggagtacctcagatcgaggtcacctttgatattgatgctaatggcatcctgaacgtgtctgcagtggacaagtccaccggcaaggagaataaaatcaccattacgaacgataaaggccgtctgtctaaggaagatatcgagcgaatggtccaggaagccgaaaaatacaaagccgaggacgagaagcaaagggataaagtgtccagtaagaactccctggaaagctacgctttcaatatgaaggcaacagtggaagacgagaaactccaggggaagattaacgatgaggataaacagaagatactggataaatgcaatgaaattatcaactggcttgacaagaatcaaaccgccgaaaaagaggagttcgagcaccagcagaaggagttagagaaagtctgtaatcctatcattaccaaactataccagtcggccggaggaatgccaggaggcatgcctggaggatttcctggcggaggagccccaccgagcggaggcgcttctagtgggccaaccatcgaggaggtggattag

SEQ ID NO: 225794 - DNA, 1503 bp, Artificial Sequence
  Description of Artificial Sequence: Synthetic coding sequence
atgtccaaggggccagctgtgggcatcgacttgggaaccacatacagttgcgtaggcgttttccaacacggcaaggtcgagatcattgccaatgatcagggcaaccgaacaacaccatcctacgtggctttcaccgacacagaaaggctgatcggggacgcagctaaaaaccaggtcgctatgaaccccaccaataccgtttttgacgccaagcgattgataggcagacggttcgacgacgcagtggtgcagtctgacatgaagcactggcctttcatggtcgtgaacgacgctggaagacctaagcataaaaaagatatttctgaaaataagcgggctgtgagacgtctgcgcactgcgtgtgagagggccaaaaggacactcagctcctctactcaagctagtattgagatcgatagcctgtacgaaggtattgatttttatacatccataacccgcgctagattcgaggagcttaacgctgatctgttccggggaacactcgatcctgttgagaaggccctccgagatgctaagctggataagagccagatacatgacatcgtccttgtggggggtagcacgcggatccccaaaatccagaaactcctacaagacttctttaatggcaaggaactcaacaagtctatcaatcctgacgaagctgtggcctacggagctgccgtgcaggccgctatcttaagtggcgacaaatccgagaacgtgcaggacctgcttctcctggacgtgacccctctgagtctcggaatcgaaaccgccggtggagtgatgaccgtgctgatcaagagaaataccaccattccaaccaagcaaacacagacctttacgacgtattccgacaatcagccgggagtactcatacaggtctatgagggggagcgggcaatgaccaaagacaacaacctgttggggaaattcgaactcacaggtatccctccagctcctcgcggagtgccccaaattgaggtcacatttgatatagatgcaaatggtattcttaacgtgagtgccgtcgacaagagtaccggcaaggagaataagataaccattactaacgataaaggtagattatctaaggaagatatcgaaagaatggtgcaggaagccgagaagtacaaggcagaggatgagaaacagcgagataaggtgtcctccaagaatagtctggaaagctacgcctttaatatgaaggccacggtggaggacgaaaagctgcagggcaagattaacgatgaagacaaacagaagattctggacaagtgcaatgagattatcaattggttagacaagaaccagaccgctgaaaaggaggaatttgagcaccagcagaaagagctcgagaaagtatgtaacccaatcataaccaagctgtatcaaagtgccggaggaatgcccggtggcatgccaggagggttcccaggaggaggagcgccaccatcagggggtgccagcagtggacccaccattgaagaggtggactag

SEQ ID NO: 225795 - DNA, 1233 bp, Artificial Sequence
  Description of Artificial Sequence: Synthetic coding sequence
atggttaatcacttcattgcagaatttaaaaggaagcataagaaagacataagcgaaaacaaacgggcagtgagacggttgaggaccgcatgtgagcgtgctaaacgcactctgtcttcttccacacaggcgtccatcgagatcgacagcttgtatgaaggtattgatttctatacctccatcacgagagcaaggtttgaggagctgaatgccgacttgtttagaggcactctcgatccggttgaaaaggctctgcgagacgccaagttggacaaaagccaaatacacgacatcgtgctcgtagggggatctactcgcattccaaaaattcagaaacttcttcaggacttcttcaatgggaaagagctaaacaaatctatcaatccagatgaggcagtcgcgtacggggctgctgtgcaggctgctatcctgagtggagataaatccgagaacgtgcaggacttgctgcttctggacgtgaccccgctgtctttagggattgaaactgccggtggtgtgatgacagtgctgatcaagagaaataccaccatacctacaaaacagacacagactttcacaacctacagcgataatcagcctggcgtattgattcaggtttatgagggggagcgcgcaatgactaaagacaataatttactggggaaattcgagttgactggcattccccctgcacctagaggggtgccccagattgaagtgacatttgatatcgacgccaacggtattctgaacgtgtccgctgtagataagtctaccggaaaggagaataagatcactattaccaacgacaaagggaggctgtctaaagaggacatagagaggatggtgcaggaagccgaaaaatataaagccgaagatgaaaagcaacgcgataaagtctcctcaaagaattctctggagagctatgcttttaacatgaaggccactgttgaggatgaaaaactccagggaaaaattaacgacgaggacaaacaaaagattctagataagtgtaacgaaatcatcaactggctggacaagaaccagacagccgaaaaagaagaatttgagcatcaacagaaagaattagagaaggtgtgcaaccctatcatcaccaaactctatcagagcgccggaggtatgcccggaggcatgccgggtgggtttcccggagggggagctcctccttcaggcggagcttcaagtggcccaactatagaggaggtggactag

SEQ ID NO: 225796 - DNA, 1941 bp, Artificial Sequence
  Description of Artificial Sequence: Synthetic coding sequence
atgtctaaaggccctgccgtcggcatcgacctggggactacatacagttgtgtgggggtgttccagcacgggaaggtcgagattatcgctaatgaccaaggcaatcggactaccccatcttatgtcgctttcactgacaccgagcgtctcattggggacgccgcaaagaatcaggttgctatgaatcctactaatacggtgtttgacgcaaagcggctgatcggcagaaggtttgatgacgccgtggtccaatccgatatgaaacattggccattcatggtagtgaacgatgcgggtcgtcctaaggttcaagtcgagtataaaggtgagactaaaagcttctatcctgaggaggtgtccagcatggtcctgacgaaaatgaaggaaatagcggaagcgtacctcggcaaaactgtcaccaatgcagtcgtgaccgtgcctgcctacttcaacgattctcagagacaggccacaaaggacgccggaactattgcaggcctgaacgtcctgaggatcatcaacgagccaacggccgcagcgattgcctatggtttggacaagaaggtcggcgcagagaggaacgtcctgatatttgatctcgggggtggtacgtttgatgtgtccatcttgacgatcgaggacggcatattcgaagtgaagagcacagccggagacactcacctgggaggcgaagacttcgacaatagaatggtgaaccacttcattgcagaatttaagaggaagcacaagaaggatatttctgagaacaaaagagcggtgcgccgacttcgaaccgcctgtgagagggcaaaacgcaccttatcctcatcaactcaggctagcatcgagattgacagtctgtacgaaggaatcgatttttacaccagtatcacccgggctaggtttgaggagttaaatgcggatctgtttagggggaccttagatcctgtggagaaagctctgagggacgccaagctcgataaatcacaaatccacgacatcgtcctggttggaggctcaactcgcatccccaagatccaaaaattactccaggacttctttaatggtaaggagctgaacaaaagcatcaatccagacgaggccgtcgcctatggggctgccgtgcaggccgctatcctgagtggcgacaaatcggaaaatgttcaggacctgctgcttctggatgtgacacctctaagcctcggcattgaaaccgccggaggcgtgatgacggttcttataaagagaaacaccaccatccccacaaaacaaactcagactttcaccacatacagcgataaccagcccggtgtgctcatccaggtgtacgaaggggagcgtgccatgacaaaggacaacaatttgctaggcaagttcgaactcactggcatcccgccagctccaagaggggttcctcagatagaggtgactttcgatatcgatgccaatgggattctcaatgtatcggccgtcgacaaatccaccgggaaagagaataagatcactataactaatgataagggaaggctgtctaaggaagatattgaacgtatggtgcaggaggctgagaaatacaaagctgaggacgaaaagcagcgggacaaagtttcaagcaaaaacagtcttgaatcatacgcctttaacatgaaagcgactgttgaagacgagaaactccaggggaaaataaacgatgaggataaacaaaagatcctggataaatgcaacgagattattaactggctggataagaatcagaccgccgaaaaagaagagtttgaacaccaacagaaggagttggagaaagtgtgcaaccctataatcactaaactgtaccagtccgccggaggaatgcccggtggaatgcccggaggattccctggtggaggtgctccaccatccggcggagcgagttcggggccaaccatcgaagaggtggattag

SEQ ID NO: 225797 - DNA, 2040 bp, Artificial Sequence
  Description of Artificial Sequence: Synthetic coding sequence
atgatttctgcaagtcgggcagctgctgcaaggctcgtgggagccgctgcctctcggggacccaccgctgccagacatcaagatagctggaacggcctcagccacgaagcattccgcttggtttctaggcgtgactacgccagcgaagccataaaaggagcggtagtgggtatagaccttggaaccaccaactcgtgtgtggccgtgatggagggcaagcaggccaaggtgcttgaaaatgcagaaggagctcggactactccatccgtggttgcgttcaccgcagacggcgagaggctggtcgggatgcccgctaaacggcaggccgttactaacccaaacaacaccttctacgcgaccaagcgacttattggcagaagatacgacgatcccgaggtccaaaaggacatcaagaacgttcctttcaaaatcgtgcgcgcatctaacggagacgcgtgggtggaagcacacgggaaactgtattccccatcacaaatcggcgcattcgtgctgatgaaaatgaaagaaactgccgagaattatctcggccacactgctaaaaatgccgtgatcaccgttcccgcatatttcaacgattcgcagcggcaggcaacaaaggacgccggacaaatctccggattgaacgtacttcgcgtaatcaacgagcctacagccgcagcactggcttatggattggataagagcgaagacaaagtgattgcagtgtatgatctggggggaggaacctttgatatatctattttggaaattcaaaagggagtgttcgaagtcaagtccactaatggtgatactttcctgggcggtgaagatttcgatcaggccctgcttcgccatatagtcaaggagtttaaaagagaaacgggcgtggatctaaccaaggacaacatggcattacagcgagttagagaggccgcagaaaaagcaaagtgcgaactcagctctagtgtgcagaccgatatcaacctgccatatttaactatggattcatctgggcctaagcacctgaatatgaagctgacacgcgctcaattcgaagggatcgtgacagatcttattcgacggaccatcgcgccatgccagaaagcaatgcaggacgccgaagtgagcaaatcagacattggggaggttatccttgtgggaggcatgacaaggatgcccaaggttcagcagactgttcaggacctgttcggtagagctccctccaaggccgtgaacccagacgaagcggtcgctattggggctgccattcagggaggtgtgctcgccggagatgttaccgacgtgcttctgctagatgtaacccccctaagtctgggtatcgagactttggggggagtctttacaaaattgattaaccgcaacaccacaatacctacgaagaagtcgcaagttttcagtacagccgcagatggacaaactcaagtggagatcaaggtgtgccagggagagagggagatggcaggcgacaataaactgttagggcagttcacgctaattggcattcccccagctcctaggggcgtgccacaaatcgaggtcacttttgacattgacgctaacggaatagtccatgtgtcagctaaagataaaggcaccggtcgcgagcagcagatagtgattcagtccagcggcggtctctccaaagatgatatcgaaaatatggttaagaatgcggaaaagtacgctgaagaagaccgaaggaagaaagaacgtgtggaagccgtaaacatggctgagggaattatccacgataccgagacgaaaatggaggagttcaaagatcagcttccggctgatgaatgcaacaaacttaaagaggagatctcgaagatgcgtgagctgcttgcaagaaaggacagcgagaccggggaaaacattcggcaggctgcctcgtccctgcagcaggcttccctgaaactcttcgaaatggcctataagaagatggcatcagaaagagagggctcagggtccagcggcactggggagcagaaagaagaccagaaggaagagaagcagtag

SEQ ID NO: 225798 - DNA, 1998 bp, Artificial Sequence
  Description of Artificial Sequence: Synthetic coding sequence
atgatctccgctagtcgcgcagcagcagctagacaccaggactcgtggaatggtctgtcccacgaagcattccggcttgtgagccggagagactacgccagcgaagcaattaaaggagccgtggtgggaatcgatttgggcaccaccaatagctgtgttgctgtgatggagggtaaacaggccaaggttttagaaaacgcagagggggcacgtaccaccccaagtgtggtggccttcaccgcagacggagagcgcttggttggaatgcctgctaagaggcaggcagtaacaaaccctaacaacactttctacgctaccaaacgtcttataggccgacgttatgacgatccggaagttcagaaggatataaagaacgttcccttcaaaatagttcgcgcttcaaacggggacgcatgggtggaagcgcacgggaaattatactccccatcacagataggggcattcgttctcatgaagatgaaagagacggccgagaactatttaggccatactgccaaaaatgctgtaatcaccgtgcctgcgtacttcaacgacagccagcgtcaggcgaccaaggatgctgggcagatctctggtctgaacgtgctgagagtgattaatgaacccacggctgccgctctggcctacggtcttgacaagtcagaggacaaagtaatagcagtatacgatctcggcggaggcacatttgacatcagcattctggagatacagaaaggcgtttttgaggtgaagagtacgaatggcgacaccttcctggggggagaagacttcgatcaagcacttctgcggcatatcgtaaaagaatttaagcgggagacgggcgtcgacctgaccaaggataatatggcactacaaagggtccgagaagcagcagaaaaggccaagtgcgagctcagtagctccgtgcagacggacatcaacctgccatatctcaccatggactcaagcggcccaaagcacctaaatatgaagttgacgcgggctcagtttgaggggattgtgactgatctgattaggcggactattgcaccatgtcagaaggcaatgcaggacgcagaagtgtccaagagcgacattggagaggtcattctggttggcggaatgacccgcatgcctaaagtgcaacagaccgtgcaggacctgttcggacgcgctcctagtaaggcagtgaaccccgacgaggctgttgccattggggcagccatccaaggcggagtgctcgccggagacgtaaccgacgtgttgctgcttgacgtgacccccctctccctgggaatcgagacactcggcggagtattcaccaagcttatcaaccgcaacactaccatccctacaaaaaagagtcaggtcttttctactgctgccgacgggcagacacaggtggagattaaggtgtgtcagggcgaaagagagatggccggagataacaagctgctgggccagttcactctcattggaatccccccagctccccgtggggtcccacagattgaggtcacctttgacatcgacgctaacgggattgttcacgtatccgccaaggacaagggcacagggagggagcagcagatcgtgatccagtcttcgggcggtctcagcaaagacgacattgagaacatggtgaaaaatgccgagaaatacgccgaggaggatcgccgtaaaaaagagcgcgtcgaggctgttaacatggctgaaggtatcatccacgatacagaaaccaaaatggaggagtttaaggaccagttgcccgctgacgagtgtaacaaactgaaggaggagatctctaagatgagggagctgctggcccgtaaagattcagagacaggagagaatatcaggcaggctgctagcagccttcagcaagcttcactgaaactgttcgagatggcctataagaagatggccagcgaacgggaaggatccggcagcagcggcaccggagaacaaaaggaggaccaaaaggaagaaaaacagtag

SEQ ID NO: 225799 - DNA, 1899 bp, Artificial Sequence
  Description of Artificial Sequence: Synthetic coding sequence
atggcattggttatgaggcttctggacttgttccaggggggtataatgcaccagaagcagagtagagaacaactgcttgtgttgatctgggtgctgccaacccctgcctggcagctttggaaggtgaacaaacagcgttgctggagaatgcctaaagtacccgagcccccactccagctttggccactgcaacagatggtgtcagatctgttggaatgcaggcctagcgaccggctgtccccgacccaaacgattcacttcatgctgccctctgttagcctggctggggatatgatgattttgaagtataggaagaccctcaagatgtttcccctgaaactatcagtcccaccaatggtaatgccagtccttatgaagatgaaagaaaccgcagagaactacctggggcacaccgctaagaatgccgttatcacagtccctgcctattttaatgattcccaacgccaggcgacgaaagatgcaggacagatatctggcttgaacgtgttacgggtaataaacgagcctactgctgccgcactggcatacggattagataagtctgaagacaaggtcatcgccgtgtacgatctgggaggcggtacattcgacatttccatcctggaaatacagaaaggtgtgtttgaggtcaagtctaccaacggggataccttcctggggggtgaggattttgatcaggcgctccttcgtcatatcgtgaaggaattcaagcgcgagaccggggtggatctgaccaaagacaacatggctctgcagagagttagggaggccgctgagaaggcaaaatgtgagctaagctccagcgtgcaaaccgatatcaatttgccttaccttactatggatagttccggacccaagcacctgaacatgaaattgacacgagcccagtttgaagggatcgtcacggacctaattcggaggactatcgctccctgccagaaagctatgcaggacgcggaagtgagcaaaagcgacatcggggaagtgatcctggtgggcggaatgacaagaatgcctaaagttcagcaaaccgtgcaagatctctttggtcgcgcaccgtccaaagccgtaaacccagatgaggcagtggctattggagccgctattcagggaggcgtgctggccggtgacgtgactgacgtgctgctactagacgtcacaccactcagcctggggattgaaacacttggtggggtctttactaagctcattaatcgaaatacgacgatcccgaccaaaaaatcccaggtattctccacagcagctgacggccagacccaagttgagatcaaggtgtgccagggagaaagggagatggcgggtgataataaactcttggggcagtttactctcatcgggatccccccagcaccaaggggcgttccgcagattgaggtaaccttcgacatcgacgccaatgggattgttcacgtgagcgccaaagataaggggactggccgtgaacaacagatagtgatccagagctcgggaggattgtccaaggatgatatcgagaatatggtaaaaaacgccgagaaatacgctgaagaggatagacggaagaaggaacgagtggaggcagtaaatatggcagaaggtatcatccacgacactgagaccaagatggaggaattcaaagatcagttgccagctgacgaatgcaataaactcaaggaagaaatttctaagatgagggagctcctggcgaggaaagactcagaaaccggcgaaaacatacggcaggccgcaagctcactgcagcaagctagcctgaagctcttcgaaatggcatataagaagatggcgagcgaaagagagggttctggcagctccggcacaggagagcagaaagaggaccagaaagaggaaaagcaatag

SEQ ID NO: 225800 - DNA, 2175 bp, Artificial Sequence
  Description of Artificial Sequence: Synthetic coding sequence
atgccagaggaggttcaccatggcgaagaggaggtagaaacgtttgccttccaggccgaaattgcccaactcatgtctctgattattaacacattttactcaaataaagagatctttctcagagagttgatttccaacgcgtcagacgccctggataaaatccgctacgaatctctgaccgacccttcaaaactggacagcggtaaagagctgaaaatagacataattccgaatccacaggaaagaacgctgacactggtggatacagggatcggcatgactaaggctgatctgataaacaatctcggcaccatcgctaaatctggtaccaaggccttcatggaagcactccaggccggagcggacatcagcatgatcggccaatttggcgttgggttctactctgcatacctggtggccgaaaaggtagtggtaattaccaagcacaatgatgatgaacagtacgcctgggagagctccgcgggaggcagtttcaccgttcgagcggaccacggggagccaattggacgtggtaccaaggtgatcctgcacctaaaggaggaccagacggagtacttagaggagagacgagttaaggaggttgtcaaaaagcattctcaattcattgggtatccaattacactctacctggaaaaagaaagagagaaggagataagcgacgacgaggccgaagaggagaagggggaaaaggaagaggaggataaagacgatgaggagaagccgaagattgaagatgtcgggtcggacgaggaggacgactccgggaaggataaaaagaaaaagaccaagaaaatcaaggaaaaatatattgaccaggaagaactcaacaagaccaagccgatttggacccggaatcccgatgatataacgcaagaggagtacggtgagttctataaatcgctgactaacgactgggaggaccaccttgccgtcaagcacttctccgttgagggccaacttgaatttagagccctgctgttcataccgaggagggcaccattcgacctattcgagaacaaaaaaaaaaaaaataacattaagttatatgtgaggcgagttttcatcatggattcatgtgacgaactcatacctgagtacctgaacttcatccgcggagttgtcgatagcgaggacttgcccctaaacatctctcgcgaaatgctgcagcagtctaagatccttaaggtgatccgaaagaatatcgttaagaagtgtcttgagctgttttctgaactggccgaagataaggagaattataaaaagttctatgaagcgttctctaagaatcttaagctgggcatccacgaggactccacgaacaggcgcaggttgtctgagcttctgcgctaccacacctctcagtccggagacgagatgacatccctgagtgaatacgtgtcacgcatgaaagagacccaaaagtcaatttactacattacaggagagtccaaggaacaggtcgcaaattcagccttcgtggagcgggtcaggaagaggggcttcgaagttgtttacatgaccgagccaatagacgagtattgtgttcaacagcttaaagagtttgacgggaaatcccttgtgagcgtcactaaggagggcctggagctacccgaggacgaggaggagaaaaagaaaatggaggagtcaaaggccaagttcgagaacctgtgtaagctgatgaaagagatactggataagaaagtggaaaaggtgacaatcagtaataggctggtcagctccccgtgctgcattgtaaccagcacatacgggtggaccgcaaatatggagcgtattatgaaagctcaagccctcagagacaattcaactatggggtacatgatggcaaagaaacatctggaaattaaccccgaccatcctatcgtcgaaaccctccgacaaaaggcagaggccgacaagaatgataaggccgtaaaagacctcgtggttctgctctttgaaactgcgctgctgtcttcgggatttagtctcgaagatcctcagacgcatagcaatcgcatctaccgcatgattaaactcgggttggggattgacgaagacgaagtcgccgcagaggaaccgaatgccgctgtgcctgacgagattcctcccctggaaggagacgaagatgcgagcaggatggaggaagtggactag

SEQ ID NO: 225801 - DNA, 2175 bp, Artificial Sequence
  Description of Artificial Sequence: Synthetic coding sequence
atgcctgaagaagtacatcacggggaggaggaagtggaaacattcgcctttcaggctgaaattgctcagcttatgtctctgatcatcaatactttctacagtaataaggaaatcttcctacgcgagctcatttctaatgcgagcgacgcgctcgataaaattagatatgagagtttgacagaccctagcaagttggatagtggcaaagagctgaaaattgatatcattccgaatcctcaggaaaggactcttactctcgtcgacacaggtatcggcatgaccaaggccgatctcattaacaacctcgggaccatcgcaaagagtggaactaaggccttcatggaagctttgcaggccggtgccgatatttccatgatcgggcagtttggagttggcttctattctgcttatctggtcgccgaaaaggtggtggttatcaccaagcataatgatgacgaacagtatgcctgggaatcttcagccggagggagcttcaccgttagagcagaccacggggaacccataggcagggggacgaaggtgatacttcatctgaaggaagatcaaactgagtacctggaagagagacgtgtcaaagaggttgtgaaaaagcatagccagtttattggataccctatcaccctgtacctggaaaaggagcgggagaaggagatcagcgatgatgaggctgaagaagagaaaggggaaaaggaggaggaggataaagatgatgaggagaagccgaagatcgaagacgtgggcagtgatgaggaggatgacagcgggaaagacaagaaaaagaaaaccaagaagataaaggaaaagtacatcgaccaagaggagctgaataagacgaagcccatttggacgcgtaatcccgacgatatcacacaagaagagtacggggaattttacaaaagtcttactaacgattgggaagatcatctggcagtcaaacacttctccgtggagggccagcttgagttccgggctttgctgttcatacccagacgagccccatttgatttgttcgagaataagaaaaagaaaaataatatcaagctgtacgtgaggagggtgttcattatggatagctgcgatgagctgattcctgagtacctgaatttcatcaggggcgtcgtggattccgaggacttgccgcttaatattagcagagaaatgctccagcagtctaaaatactcaaggttatcagaaaaaacatcgttaaaaaatgcctagaactgttttctgaattggcggaggacaaagaaaactacaaaaagttctatgaggccttctctaaaaaccttaaactgggaattcatgaagactccacaaacagacgcagactgtcggagttgctccgttaccacaccagccagtccggcgacgagatgactagcctttcggagtatgtgtctagaatgaaggagacccaaaaaagcatttactatataactggagaaagtaaagagcaggtggccaattctgccttcgtcgaaagagtgaggaaacgcggattcgaggtggtatacatgactgagccgattgacgagtactgcgtacagcaactgaaagagttcgacgggaagtccctggtttcagtgactaaggaaggactggaacttcccgaggatgaagaggaaaagaagaaaatggaggagagtaaggctaaatttgaaaatctctgtaagctgatgaaggagatactcgataagaaagtggagaaagtgacaatttcaaaccgtctagttagctctccctgctgcatagtgactagcacatacgggtggacagctaacatggaacgcataatgaaggctcaggcgctgcgcgacaatagcaccatgggctatatgatggccaaaaaacatctggagataaatcctgaccatcccattgtggagacgctgaggcagaaagcagaggctgataaaaatgacaaggcagtaaaggacctggtggtactgctattcgagacagcattactgagcagcggtttctcactggaggatccacaaacccactctaaccggatatatcgcatgattaagctggggctgggcatcgacgaagatgaagtggccgctgaggaaccaaatgctgcggtccccgatgaaatcccaccccttgagggagacgaggacgcatcgcgcatggaggaggtggactag

SEQ ID NO: 225802 - DNA, 465 bp, Artificial Sequence
  Description of Artificial Sequence: Synthetic coding sequence
atggacagctgcgatgagctgatacccgaatatctgaactttatccgcggtgtggtggatagcgaggacctgccgctgaacatcagccgtgagatgctgcagcagtctaagattttgaaagtcatcaggaagaacattgtgaagaagtgccttgaactcttctccgagctcgcggaagacaaagagaattacaagaagttttatgaagccttctcaaagaacctgaagctgggaatccacgaagacagtaccaaccgaagaagactgagcgagctcctgagataccacacatctcaatccggagacgagatgactagtctcagtgagtacgtgagtagaatgaaggagacccagaagagtatttattatattactggcgaaagcaaggaacaggtgtgcccatgtcctacttggctccctctcctcgtgtcttccgtgttcttccccctgcttagcctgtgctag

SEQ ID NO: 225803 - DNA, 489 bp, Artificial Sequence
  Description of Artificial Sequence: Synthetic coding sequence
atggatagttgtgacgagctgatcccagaatacctgaatttcattagaggagtggtagactcggaggatctgccactgaatatatctcgggagatgctgcagcagtccaaaatcttgaaggtgatccgcaagaacatcgtgaagaagtgtctggaactgttcagcgagctagcagaggacaaggagaattacaaaaaattctacgaggcattcagtaagaatctgaagctcggaattcacgaggactcgaccaatcggcgtcgtttgtcagagctgcttaggtatcatacctctcagtcaggggacgagatgacgtccttgtccgaatatgtttctcgtatgaaagaaacgcagaagagcatctattacatcacaggtgagtccaaagagcaagtcgccaactccgcttttgtggagcgatgcccctgccccacatggctgcctctgctggtgtcctcagtctttttccctcttttatctctctgctag

SEQ ID NO: 225804 - DNA, 552 bp, Artificial Sequence
  Description of Artificial Sequence: Synthetic coding sequence
atggacagctgcgacgagctcattcccgaatacctcaattttatcaggggcgtggtagattcagaggatctgccacttaacatcagccgagagatgctgcagcaatccaagatcctgaaagtgatcaggaagaatattgtgaagaaatgtctggaactcttctcagaactggcagaggataaggagaactataagaaattttatgaagcatttagtaaaaatctgaaattgggaattcacgaagacagtacaaacagacgcaggctgtccgagctgcttagatatcacacttctcagagcggcgacgagatgacatcgctgtctgaatacgtctctagaatgaaggagacccagaagtcaatatactatatcacggggagcccatgctggtgtctcgtgtttttctccttgtcatgcccttgcgtagaggggtccaagttacgagtcagcagccctatccccagcctgctgttgaccgccggattggacgtcgtctactgcgggcttttctacttcttgcattttgtgctgaaattgaagtatgcgaagtag

SEQ ID NO: 225805 - DNA, 2175 bp, Artificial Sequence
  Description of Artificial Sequence: Synthetic coding sequence
atgcctgaagaggtccatcatggtgaagaagaagtcgagacattcgcgttccaggctgagatcgcccagctcatgtccctgataatcaataccttctactccaataaagaaattttcctgagggagctcattagtaatgcatcagacgcccttgataagattaggtacgaaagtctaactgatccgtctaaactggatagtggaaaggagttgaagattgacattatcccaaacccacaggaacgaacacttacacttgtggataccggcattggcatgacgaaggctgatctgattaataacctcggtactattgctaagtccggtacaaaagcgttcatggaggcccttcaggctggagctgacatctctatgattgggcagtttggagtggggttttactcggcttacctcgtcgctgaaaaggtggtggtcattaccaaacacaacgacgacgagcagtatgcatgggaaagctcagccggaggcagctttactgtcagagccgatcatggtgaaccgattggtcgaggaacgaaagttatactgcatctcaaggaggaccagacggagtacctagaagagagacgtgttaaggaggtggtgaaaaagcattcccagtttattggctaccctattaccctctacctcgaaaaagagagagaaaaagagatctctgacgacgaggcggaagaagagaagggcgagaaagaagaggaagataaagacgatgaggaaaagcctaagatcgaagatgtgggctcggacgaagaggacgactctgggaaggataaaaaaaagaaaaccaagaaaataaaagaaaaatacattgatcaggaagagctgaacaaaaccaaacctatctggaccagaaatcccgatgacatcacccaggaagagtatggcgaattttacaaatctctcaccaacgactgggaggatcacttggctgtcaagcacttctctgtcgagggccagttggagtttcgcgcactgttgttcatccctcggcgagcacccttcgacctgttcgagaataagaagaagaagaacaacattaaactgtatgtacgtcgggtcttcattatggattcttgtgacgagctgataccagagtacttaaacttcattaggggtgtcgtggatagcgaggatcttccccttaacatatctcgggagatgctgcagcaaagcaagattctgaaagtgattagaaaaaacatcgtcaagaaatgcctggaattgttcagcgaactggccgaagataaagagaactataagaaattctatgaagccttcagcaagaacttgaagctggggatccacgaagactcaacaaaccgtcgacgcctgagcgaactgcttagatatcatacgtcccagtctggtgatgagatgacatctcttagtgagtacgtgtcacgtatgaaggagactcagaagtcaatttactacatcacaggggaatcaaaggagcaggtcgctaacagcgcgtttgtggagcgagtgaggaaacgaggtttcgaagttgtatatatgaccgagcctattgatgagtactgtgttcagcagctaaaggaatttgacggtaagagtctggtctctgtgacaaaagaggggctggagctcccagaggatgaggaggagaaaaaaaaaatggaagagtctaaagccaaattcgaaaacctatgcaagctaatgaaggaaatcctggacaagaaggtggagaaggtcactatttcaaaccgcctggtctcctcaccctgttgtatcgttaccagtacctacgggtggactgctaacatggaaaggatcatgaaagctcaggctctgcgtgataattctacaatgggttatatgatggcgaaaaagcacctggaaataaacccagaccaccctattgtggagaccctccgccagaaggctgaagcagacaagaatgacaaagcagtgaaggatcttgtcgttcttctgtttgagacggcactccttagcagcggattctctctggaagacccacagacacacagtaatcgcatctatcgcatgattaaacttgggctgggtattgacgaggacgaggttgccgcagaggaacccaacgcggctgtgcccgatgagatccccccactggagggggacgaagacgcaagcaggatggaagaagtggattag

SEQ ID NO: 225806 - DNA, 429 bp, Artificial Sequence
  Description of Artificial Sequence: Synthetic coding sequence
taatttattaggggcgtggtggattccgaggatctgccacttaatatctctcgtgaaatgctccagcagtcaaagattctgaaagttatacgcaaaaatattgtgaaaaaatgcctcgagttgttctctgagttggccgaggacaaagagaactacaaaaagttctacgaggcattctctaaaaacctgaaactgggcatccacgaagacagtaccaataggcgccgactgtctgagctgctgcgatatcacacaagccagagcggcgatgaaatgacctccctttctgagtacgtttcccggatgaaagagacccaaaagagcatttactatataaccggagagtccaaggagcaggtatgcccctgccctacttggctgccccttctcgtgagctccgttttctttccgctcttgtcactctgttag

SEQ ID NO: 225807 - DNA, 453 bp, Artificial Sequence
  Description of Artificial Sequence: Synthetic coding sequence
tgattcatcagaggagtggtggacagtgaagatctgcctttaaacatttcccgcgaaatgctgcaacagtctaagattttgaaagtgatcaggaagaatattgttaaaaagtgcctggaactgtttagcgagctagccgaagacaaagaaaactataaaaaattctatgaagcctttagcaagaatctgaaactaggcatacacgaggactccaccaataggagacgccttagcgagctgttgcgctaccacacgagtcagtcaggagatgagatgacatcactcagtgagtatgttagtcgtatgaaggaaacccaaaagtctatctattacattactggggagagtaaggaacaagtcgccaacagcgccttcgtcgaacggtgtccatgccctacatggctgcccctgctagtgtcttcagtctttttccccctcctttctttgtgttag

SEQ ID NO: 225808 - DNA, 516 bp, Artificial Sequence
  Description of Artificial Sequence: Synthetic coding sequence
taatttattagaggtgttgtcgacagtgaggatctcccgctgaatattagtcgagagatgcttcaacagtccaagattctcaaggtgattcggaagaatatcgtgaagaagtgtcttgaactcttttcagaactggctgaggataaggaaaattataagaagttctacgaagcgttcagcaaaaaccttaagttaggtatccacgaggacagcacgaacagaaggagactgtccgaattgctccgttatcatacctcccagtcaggtgatgaaatgacctctctgagcgagtatgtgtctcgtatgaaggaaacccaaaaaagtatctattatatcaccggctctccctgctggtgccttgtgtttttttctttaagctgtccttgcgtggagggaagcaagttgagggtgagctcccccatcccttcacttctgttgacagccggtctggatgtggtctattgcggtttgttttatttcctccactttgtgctgaaactcaagtatgcaaagtag

SEQ ID NO: 225809 - DNA, 507 bp, Artificial Sequence
  Description of Artificial Sequence: Synthetic coding sequence
atgcctgaggaagtgcaccatggcgaagaagaagtggagacttttgcattccaggccgagattgcccagttaatgagcctcatcatcaacactttctactcaaacaaagagatttttctgcgggaattgattagcaacgcatcagacgccctggacaaaattagatatgagtcattgacagacccatctaaactggattccggcaaggaattgaaaatcgatatctctatgatcggccagtttggtgtaggcttctacagcgcatacttagtggcagaaaaagtcgtggtgattactaagcacaacgatgatgagcagtacgcctgggaaagttctgccggaggatcgttcacagtccgggctgatcacggtgagccaatcgggcgagggacgaaggtgattctgcacctgaaggaggatcagactgaatatttagaagagagaagagtgaaggaggtggtgaagaagcactctcagttcattggataccccattactctgtattag

SEQ ID NO: 225810 - DNA, 483 bp, Artificial Sequence
  Description of Artificial Sequence: Synthetic coding sequence
atggaaatcccggttccagtgcaaccttcatggttacggcgagcctcggctcccctgccaggactgagcgccccaggaagattgtttgatcagagattcggagagggcttactggaggcggagctcgcagctttgtgtccaacgacgttggccccatattatctccgcgctccttccgtcgctctgcccgtcgcccaggttcccacagacccaggacacttcagcgttcttctggacgtgaaacacttcagtccggaggagattgcagtcaaagtggtcggcgagcacgtggaggtgcacgccagacatgaggaaagacccgacgagcatggcttcgttgccagggagttccaccgccgttacagactcccaccgggtgtggaccccgctgctgtgactagtgcactctctcccgaaggggtgttgagtattcaggccgcacccgcaagcgcacaagcccctccaccagccgctgccaaatag

SEQ ID NO: 225811 - DNA, 483 bp, Artificial Sequence
  Description of Artificial Sequence: Synthetic coding sequence
atggaaatccctgtccccgtccagccctcttggcttcgccgtgcgtcagctcccctaccaggcctgtccgcacccggacgcctctttgaccagcgcttcggcgagggactgctggaagcagagctggcagccctttgccccacaacactcgcgccatattatctgcgggctccctcagtcgctttgccagtcgcccaggtccctacggatccaggccatttctccgttctgctggatgttaaacacttttccccggaggaaattgccgttaaggtggtcggagaacacgtcgaagtccacgcaagacatgaggaacggcctgacgaacacgggttcgttgctagggaatttcataggcggtatagattaccccctggggtcgacccagctgcggtcacaagcgctttatcaccggagggtgtgctaagtatacaggctgcaccagcgtccgcacaggcaccccctccggctgctgccaagtag

SEQ ID NO: 225812 - DNA, 591 bp, Artificial Sequence
  Description of Artificial Sequence: Synthetic coding sequence
atggaaatccccgtcccagttcagcctagctggctgaggagggcttctgctccattgcccggactgagcgcccctggcaggctctttgaccagcgctttggcgaaggactccttgaggcggaactcgccgcattatgcccgacaacgctggcaccatattatttgagggcccctagcgttgctctgcctgtagcccaagtccctactgatccaggacatttttcagtactcctggacgtcaagcatttcagtcccgaggagatcgccgtaaaggtggtgggggaacacgtggaggtgcatgccaggcacgaggaacggccagacgaacacggatttgttgccagggaattccaccgtcgataccggcttcctccaggagtggatcctgctgccgttacgagtgccctgtcacctgagggtgtactgtccatccaggccgcaccagctccacgggaaccacctcaggccccttctatcaaagccgatcttaccccaccaagccagatgtcccgcgttcgacaaggtctctcatcacatcccctgctggactccgccctgacgagcatcctggacacagccctcatcacctag

SEQ ID NO: 225813 - DNA, 1590 bp, Artificial Sequence
  Description of Artificial Sequence: Synthetic coding sequence
atggacttgccggtgggacccggagcagctgggccaagcaacgtaccagctttcctgacaaagctatggaccttggtttctgaccccgacactgatgcactgatctgttggagccctagcggcaatagttttcatgttttcgatcagggccaattcgccaaagaggtcctgcccaaatacttcaagcataataatatggcctccttcgtgaggcagctcaatatgtacggatttcgcaaggtggtccacatcgagcaaggtggactcgtcaagccggagcgagacgacacagagtttcagcacccatgcttcctcagaggacaagagcagctgctggagaacataaagcgcaaggtaacctccgtgagcaccttgaagtccgaggacataaaaatccggcaggattctgtcaccaaactactcactgacgtgcagttaatgaaagggaaacaggagtgcatggattctaagttattagccatgaagcacgaaaacgaggccctgtggagagaagttgcatcgctccgacagaagcatgcccaacagcagaaagtcgtaaacaaacttattcaattcctgatttccctagtgcaatccaatagaatcctgggtgtgaagcgcaaaatccctctgatgctaaatgactcaggaagcgcacacagtatgcccaagtactcgcgtcagttttccctggaacatgttcatggttccggcccatattccgccccatcgccagcttacagctcttcttctctttacgcacccgatgcggtggccagcagcggcccaattatctctgatatcacggagctagcccctgcctcgcccatggccagcccgggaggtagcatcgacgaacggccactatcctcctctccattggtacgggtaaaagaggaaccacctagccctccccaaagccctagggtggaggaggcaagtcccggacggccatcttcagtcgatactttgctctcccctactgccttgattgactccatcctccgagagtcagagcccgctcccgcttcagtgacggcccttaccgatgccagaggacacaccgacactgagggcaggcccccatctccgccaccaacctcaacccccgaaaaatgcctttccgtggcctgtctggacaagaacgaactcagcgaccatttggacgctatggactccaacctagacaacttgcagactatgctctcttcgcatggcttcagcgtggacacgtccgcccttctggacttattttcacccagtgtgacagtccccgatatgtctctgcctgatctcgatagtagcttggcttccatccaggagctgctgagccctcaagagcccccacggccacctgaggccgagaatagcagtcctgatagtggtaaacagctagttcattacacagctcagcccctattcctgctcgaccctggcagcgtggatacgggtagcaatgacctccctgtcctattcgaattaggtgagggtagttatttctccgaaggtgatggatttgctgaggacccaaccattagcctccttaccgggtccgagcccccaaaggccaaggacccaaccgtatcctag

SEQ ID NO: 225814 - DNA, 1611 bp, Artificial Sequence
  Description of Artificial Sequence: Synthetic coding sequence
atgaaacaaagcagcaatgtgcctgctttcctttctaaactttggactttggtggaggagacgcacacgaatgagtttatcacctggtctcagaatggacaaagcttcctcgtgctggatgagcaaaggttcgcaaaggaaatcctgcccaagtattttaaacataataatatggctagcttcgtgagacaactgaatatgtatggattccgcaaagtggtccacattgactcaggtatagtcaagcaggagagagacggccctgtggagttccagcacccctacttcaaacaaggacaggacgacctgctggaaaacatcaaacgaaaggtgagttcctcaaaacccgaagagaacaaaattcgacaggaagatctgactaagattatttcgtctgcccagaaggtacagatcaaacaagagaccatcgagagcaggttatctgagttgaaaagtgaaaatgaatctctgtggaaagaggtgagtgagctgcgtgcaaaacacgctcagcagcagcaggtgatcagaaaaatagtgcaattcatcgtcacactcgtacagaataaccagttggtgtctctgaaacggaagcgccctcttctactcaatacgaacggcgctcagaaaaaaaatcttttccaacacatcgtaaaagagcccactgataatcatcaccataaagtcccccacagccgcaccgaaggcctcaagccacgggaaaggatcagcgacgacatcattatttatgacgtaaccgacgacaacgccgacgaggagaatattcccgttattccagagaccaatgaggacgtgatatccgatcccagtaactgctctcagtatcctgacatcgttatagtggaagatgataatgaggatgagtatgccccagtcatacagtccggagaacagaacgagcccgctagggaatccctttcctccggaagtgacggtagctcgcccctaatgtctagcgctgtccagctaaatggctcatcaagtctcacctctgaggaccctgtgacaatgatggactccatcctgaatgacaatatcaatctcctcggcaaggttgaactgctggactaccttgatagcatagactgcagtctggaggactttcaagcgatgctgagcggccgacagttctctatcgacccggatctgctcgtcgacttgtttacaagcagcgtccaaatgaaccctaccgattacataaataatacgaaatccgagaacaaaggactggagacaacgaaaaacaacgtggtacagcctgtcagtgaagaagggcgtaagtcaaaatccaaacctgataagcagctgatccagtacactgcatttcctcttctggcctttctcgacgggaatcctgccagtagtgtggaacaggcatctaccactgcatcgagcgaggtcctgtccagtgtggataagcccattgaagttgatgagttgctcgatagttcccttgatcctgaaccaacacaaagtaagctggtacgcttggaaccactcaccgaagctgaagcaagtgaagccacgctgttctatctttgcgagctggcacccgcacccctggattccgacatgcctcttcttgacagctag

SEQ ID NO: 225815 - DNA, 1557 bp, Artificial Sequence
  Description of Artificial Sequence: Synthetic coding sequence
atgaaacaaagttcgaacgtgcccgcattccttagcaaactctggactctggttgaagagactcatactaatgagtttattacatggtctcaaaatggacaatcctttcttgtgctggacgaacagcggtttgcaaaggagattctccctaagtactttaaacataacaacatggcaagcttcgttcgacagctcaacatgtatggcttccgtaaggttgttcatatcgactccggaattgttaagcaggaaagggatggccctgtagaatttcagcacccctattttaagcagggccaggacgacttactcgaaaacatcaagagaaaagtgtcctcctcaaagcctgaggagaataaaattagacaagaggatctcactaagatcatttcttccgcccagaaagtccagattaagcaggagactattgaatcccggttgagtgaactgaagtcagagaacgaaagtttgtggaaggaggtgagtgaactgcgcgctaaacatgcccagcagcagcaagttatcagaaagatagtccagttcatcgtgacactagtgcagaacaaccagcttgtcagcctgaagcggaaaagaccccttctcctaaatacaaatggtgcccagaagaagaacctgtttcagcacattgtgaaagagcctaccgacaatcaccaccacaaggtgccccactcccggacagaaggactgaaaccacgggagcgtattagtgacgacataatcatctatgacgtgactgatgataatgccgatgaggagaacattcctgtgataccggagaccaacgaggacgtgattagcgacccgagtaattgcagtcagtatccggatatagtgattgttgaggatgacaatgaagacgagtacgcccctgtcatccaatctggggagcagaacgagcctgcccgagagtctcttagcagcgggtcagacggatcttcacccctgatgtcatctgcagtacagttgaatgggagcagcagcctgacaagcgaagatccagtcacgatgatggacagtattttaaacgacaatatcaaccttctgggcaaggtggaactgctcgactatttagatagcattgactgctctctagaggacttccaagctatgctctccggcagacagttttcaatagatcctgatctgttggtggactcagagaataaggggcttgagaccactaagaacaatgttgtgcaacccgtgtcggaggaggggagaaaaagtaagtccaagccagacaaacaactcattcagtataccgcttttcctctcctggctttccttgacggcaatccagccagttccgtggaacaggcttctacgactgcgagcagcgaagttctgagcagtgtcgataagccaatagaggtcgacgagcttctggattctagcctggaccccgaacccacccagtcgaaactggttcggctcgagcctctcacagaggcggaggccagcgaagcaactctgttttacctgtgcgaactcgccccagcacctctagactctgacatgcccctactggactcctag

SEQ ID NO: 225816 - DNA, 1005 bp, Artificial Sequence
  Description of Artificial Sequence: Synthetic coding sequence
atgggggaggccggtgcagcagaggaggcctgtagacacatggggacgaaggaggagtttgtgaaagtgcggaagaaagacttggaaaggctgacaactgaggtcatgcaaatccgcgattttttgcccagaattctcaacggcgaagtgctcgagtcattccagaagctgaagatcgtggagaaaaaccttgagaggaaggaacaggagttagaacaactaaaaatggactgcgagcattttaaagctcgcctcgaaacggttcaagccgataatattcgagaaaaaaaggaaaagttggctctcagacagcagctcaatgaagcaaagcagcagttgctgcagcaggctgaatactgcacagaaatgggggcagctgcctgcaccctgctctggggggtctctagcagtgaggaagtggtcaaagccatccttggaggcgataaagcactgaaattttttagcattaccgggcaaacaatggagagtttcgtgaagagcctcgacggcgacgtgcaggagctggatagcgatgagagtcagtttgtctttgccttggctggcatcgtcacaaatgtggcggctatcgcctgcggcagggaattcctggtcaattcatcccgagttctattggacacaattctgcagctcctgggggatttgaagcccggacagtgtacgaagctgaaggtgctaatgcttatgtctctgtacaatgtcagtatcaatcttaagggcctcaagtacatctcagagtcgccagggttcattcctctgctgtggtggctactgagtgacccagacgcagaagtctgcttgcacgtattgaggctggtccagtccgtggtgctggagcccgaagttttcagcaaatccgcaagtgagtttcgaagtagtctgcctctgcagcggattttggctatgagcaaatcccgtaacccgcgtcttcagacagcagcgcaggaactgctggaggatctgcgcacccttgagcataacgtgtag

SEQ ID NO: 225817 - DNA, 780 bp, Artificial Sequence
  Description of Artificial Sequence: Synthetic coding sequence
atggactgcgaacactttaaggctcggcttgaaactgtgcaagccgataatatcagagaaaagaaagagaaacttgcgctgcgacaacaacttaacgaggcaaaacaacagttgctgcaacaggctgaatattgcaccgaaatgggggctgctgcatgtacactgctctggggggtgagctcttcggaagaagtcgtgaaggccatactcgggggagataaggctctgaagtttttcagcataaccggacagaccatggaatcttttgtcaaatcgctggatggcgacgtacaggagctggacagcgacgagtctcagtttgtctttgccctggcaggtatcgtgactaatgtagccgctattgcctgcggccgagaatttttggtgaattcatcccgcgtcctgctagataccattctgcagcttttaggggacctaaagcccggacaatgcacaaaattgaaggtcctaatgttaatgtccttgtacaacgtgtcgattaatttgaagggcctcaagtatatcagcgagtctcccggtttcattcccctgctgtggtggttgctgtccgacccggacgccgaggtttgcctgcatgttctcagactagtgcagagtgtggtgctggaacccgaagtcttcagcaagtccgccagcgagttccgcagctcccttcctctccagcgcatcttggccatgtccaaatctagaaatcccaggctgcagacagccgcacaggaacttttggaggacctaagaacactcgagcataatgtttag

SEQ ID NO: 225818 - DNA, 1479 bp, Artificial Sequence
  Description of Artificial Sequence: Synthetic coding sequence
atgcaggaggcaccagctgccctgcctaccgaacccggacctagccccgtacccgcattcctggggaaactgtgggccctggtgggtgatcccggaacagaccacctaatccggtggtccccatccgggacatcctttttagtctcagaccagtctcgcttcgcaaaagaagttctcccccagtacttcaagcactccaatatggctagcttcgtgagacaactgaacatgtacggctttcgaaaggtcgtctccatcgaacagggaggcctgcttagaccggaacgcgaccatgtcgagtttcaacacccatcttttgtccggggtcgggagcagttactcgaacgggtacgcagaaaagttccagctctgcgcggagacgatgggaggtggcgtccagaggacctaggccgtctcctgggggaagtccaggctctccggggagtgcaggagtccactgaagcgaggctccgggagctcaggcagcaaaatgagattctgtggcgggaagtggtgacccttcgacagagccacggccaacagcacagggtgattgggaagctgatccagtgcctctttggaccactccaggcaggaccttctaacgctggcggaaaacgaaagttaagtcttatgctcgacgaagggagttcctgtcccacccccgctaagttcaacacatgccctctgccgggtgcccttctgcaggatccttactttattcaatcccctctgcctgaaacgaatctcggcctgagcccccatagagcaagggggccaatcattagtgacatccccgaagacagcccgagcccggaagggacgcggctctccccatccagcgacgggcgtcgggagaagggccttgccctgctgaaggaggaacccgcatcccccggtggagacggggaagcaggtctcgctctggccccaaacgaatgtgatttctgtgtgactgcccctcctccgctcccagtggcagtcgtccaggccattctggaaggaaagggatcgtttagtcctgaaggaccgcgaaacgcccagcagccagaacccggagatccccgagagatccctgaccgaggacccttgggcctcgaatctggcgatagatctccagagtccttactgcccccaatgctgctccagcccccacaggagtccgtagagcccgctggacctctggatgttctgggccctagtcttcagggcagggagtggaccctcatggacctggatatggaactgtctctgatgcagccactagtgcctgagcgtggagaacctgagctggcagttaaaggccttaatagtcccagtcctggcaaagatccaacactgggtgctccgttgttattggacgtgcaggctgctctgggagggccagccctgggcttgccaggggcactgaccatatattctactcctgaatcccgcaccgcttcctacctgggcccagaggcctctcccagtccgtag

SEQ ID NO: 225819 - DNA, 1389 bp, Artificial Sequence
  Description of Artificial Sequence: Synthetic coding sequence
atgcaggaggcccctgcagctctcccgaccgaacccggaccatcccctgtgcctgctttcctcggcaaactatgggccctggtgggagacccagggaccgaccacctcatccggtggagcccctctggtaccagctttctggtgtctgaccaatctaggttcgcaaaggaagtacttccccagtacttcaaacactccaacatggccagcttcgtgagacagttgaacatgtacggattcaggaaagtggtttcaatagagcagggaggccttctgcgccctgaaagagatcatgtagaatttcaacatccgtcgtttgtacgcggacgcgaacagctgctggagagagttagacggaaggtccctgctctgagaggtgatgacggacgctggcgccctgaggatctcggacgcctcctgggagaggttcaggcgttgcggggagtccaggaaagtaccgaagccaggctgagagaactgcgtcaacagaatgaaatcctgtggagagaggttgttacattgcgtcaatcccacggtcaacagcaccgagttatcggcaagttaattcaatgtctctttggaccccttcaggccggtccctccaatgcaggcggaaagagaaagctatctcttatgctagacgagggttcgagttgccccaccccagctaaatttaacacgtgtccgctgcctggggctctgttgcaagatccttattttattcagtcaccttctacctattctctgtcccagaggcaaatttgggctttagcccttacgggccctggggcacccagtagtctcacaagccagaaaaccctccaccccttacggggacccggatttctgccacctgtaatggctggggctcccccaccgttgcctgtcgctgttgttcaggcgatcctggaggggaagggcagcttctcccctgaaggcccaagaaacgcgcagcagccagaacctggcgatcccagagagatcccagataggggcccattaggcctggagagtggggacagatctccagagagcctgctgccacctatgttactgcagccaccgcaggagtcagtggaacccgctggtccgctcgacgtcctgggaccttcattacagggccgtgaatggactctaatggatctggacatggagcttagtctgatgcagcccctggtacctgaacggggagagccggaactggctgttaagggcctgaattcaccctcaccaggtaaagatccaacccttggggcacctctgcttcttgacgttcaagctgctctgggcggaccagcactcggcctgcccggtgcgctgactatctattctaccccagaaagcagaacagccagctacctgggacccgaggccagtcctagcccttag

SEQ ID NO: 225820 - DNA, 1251 bp, Artificial Sequence
  Description of Artificial Sequence: Synthetic coding sequence
atgcaggaggctcctgctgctttaccaacggagcccggaccaagtcccgtgcccgcttttctcggcaagttatgggctctggtgggcgacccaggtaccgaccacctaatccggtggagcccatccgggacatcctttctggtttccgaccaatcgcggttcgctaaggaggtgctgccccagtatttcaagcattcaaatatggcgtcctttgtccgccagctgaatatgtatggatttagaaaagtagtgtccatcgagcagggcggactgttaagaccagagcgcgaccacgtggaattccagcacccttcctttgtccgaggacgggagcagctcctggaacgtgtgcgaagaaaggtgcctgccctccgcggagacgacggcagatggagacccgaagacctcggacgcctgctgggtgaggtgcaagcgctgcgcggtgtccaggagtctacggaggcaagactgagggaattgcggcagcagaatgagatcctctggcgcgaagtggtcactctgaggcagtcccatggccagcagcatagggtgataggcaagctcattcaatgtctcttcggacccttacaggcaggacctagtaacgcaggcggaaaaaggaagctgtctctaatgctggatgaaggatcttcctgtcctacccctgctaagtttaacacctgtccacttccaggtgcccttctccaggatccatattttattcagtccccactgcccgagaccaatctaggccttagtccacacagggcccgaggaccaatcattagcgatattcctgaggatagtcccagtcctgagggcactcgcctgagcccgtcatccgacgggaggcggggacccctcgggctggagagcggggacagaagcccggaatccctgctcccccctatgctgctgcaacccccacaggaatcagttgaacccgctggccctttggacgtcctgggacccagccttcaaggtcgggaatggacattgatggaccttgacatggaactttccctgatgcagccgctcgtcccagaacggggagagcccgaactggccgtgaaggggctcaacagcccttctcccggtaaagatccaactttaggtgctcctctgctgttagacgttcaagctgctcttggagggcctgctctgggcctgcctggggcactgaccatatattccaccccagagtctaggaccgcgagctatctgggacccgaagctagtcctagtccttag

SEQ ID NO: 225821 - DNA, 1479 bp, Artificial Sequence
  Description of Artificial Sequence: Synthetic coding sequence
atgcaggaagctcccgcagctctccccaccgagcctggacctagtccggtgccagctttcctgggaaaactgtgggccttggtcggcgatcccggaactgatcatctgatcagatggagtccgtcaggcacctcctttttggtttcagaccagtccagatttgccaaggaggtcctgccacagtattttaagcatagtaatatggcatcattcgttagacaactgaacatgtatggtttccgcaaggtcgtcagcattgaacagggaggtttactgcggccagagcgcgaccacgttgagtttcagcacccctctttcgttagaggacgtgagcagctgttagagcgagtccgcaggaaggtgccggcactgcgcggagatgatggaagatggcgacccgaggatttgggtcggctgctgggtgaggtccaagccctacgcggagtccaggaaagcacagaagcacgactgcgggagctgcgacagcagaacgaaatcctgtggagggaagtcgtgaccctgcgccagtcacacggacaacagcaccgcgtgataggcaagctgattcagtgtcttttcggcccattgcaggccggaccctccaatgctggcggtaagaggaaactgagccttatgctcgatgaaggaagtagctgtcctactcctgctaaatttaatacatgtccattaccaggagcgctgctgcaggacccttactttatacagtcaccacttccagagaccaatttgggactgagtcctcaccgggctagaggcccaataatcagtgatatccccgaggattctccaagccccgaaggaactcgcctttctcccagcagtgacgggcgaagagagaagggcctggccctgctgaaggaggagcccgctagtccaggtggcgacggtgaagccggactggccttggccccaaacgagtgtgacttctgcgtgaccgccccaccacctctgccagtcgccgtggttcaagcaatcctggaaggaaaagggagcttttcacctgaaggacctaggaatgctcagcagccagagccaggagaccccagagaaattccagacaggggacctctgggcctcgaatccggagaccgttcacccgagtctctgctgcccccaatgcttttacagccacctcaagaaagcgtggagccagctggtccgttagacgtgctggggccttcactgcagggacgggagtggaccctaatggaccttgatatggaactctctttgatgcagcctctggtcccagagaggggagagcctgaactcgccgtaaaaggtttgaatagtcctagccccggaaaagaccccacactgggggcacccctgcttctcgacgtacaggctgccttgggtggacccgctctaggattgccaggagcactgactatatattctactccagagagtcgcaccgcctcataccttggaccagaagcttccccaagcccttag

SEQ ID NO: 225822 - DNA, 9 bp, Artificial Sequence
  Description of Artificial Sequence: Synthetic coding sequence
atgcagtag

SEQ ID NO: 225823 - DNA, 414 bp, Artificial Sequence
  Description of Artificial Sequence: Synthetic coding sequence
atgtcctcactcattaggagggtgatctcaactgcgaaggctcctggggcaataggtccatactcccaggctgtccttgtcgatcgaacaatttacatctccggccagatcgggatggatccctcgagcggccagcttgtgagtggcggagtcgcagaagaggctaagcaagcactgaaaaacatgggggaaattttgaaagccgctggatgtgactttactaatgtggtgaagacaacagtcctgctggcagacatcaacgattttaatacggttaatgaaatctacaaacagtatttcaagtcgaacttcccggctcgcgcagcttaccaggttgccgcattgccaaagggaagcaggattgagattgaggcggtagcgatccaggggcctctgaccacggcctctctttag

SEQ ID NO: 225824 - DNA, 14505 bp, Artificial Sequence
  Description of Artificial Sequence: Synthetic coding sequence
atgccatctgaaagcttctgtctggccgcacaagcaaggttagactctaaatggcttaaaacagatatccagctggcttttaccagagacggcctttgcggcctttggaatgaaatggttaaggacggcgagatagtgtatactgggacagagtccacccagaacggcgaactccccccacgcaaggatgattccgtagagccttccggcacaaagaaagaagacttgaatgacaaggaaaaaaaagacgaagaggagactccagctccaatttatagagccaagagtattctggatagctgggtgtggggtaagcagcccgacgttaacgaacttaaggaatgtttgtcagtgctggttaaagagcagcaggctctggccgtgcagagcgccacgacaacactgagtgctctccgacttaaacagcgcctggttatcttggaacggtatttcatcgcgcttaaccggacggtcttccaggaaaatgtgaaggtcaagtggaagtcctccggtatctccttaccacctgtggacaagaagtcatccaggcctgccggtaagggggtggaggggctggcaagagttggctcccgagcggcattatcgttcgctttcgcatttttaaggagagcctggcgctcaggcgaggacgccgacctgtgtagtgaacttctccaggagtctctggatgcattgcgggctctgccagaggcgagcctgtttgatgaatctacagtctcatctgtgtggttggaagtggtcgagcgggctacacgttttctgcgcagtgttgtgacgggggacgtgcacggcacacccgctactaagggaccgggaagcatccctttacaggatcagcacctcgccctagctatcctgcttgagctcgcagttcaacgcggtaccctgtcccaaatgttatcagccatcctgctgcttctgcagttatgggactccggtgcccaagaaactgacaacgagcggtctgcccagggcacgagtgccccattgcttccactactccagcgcttccagagcatcatctgccgtaaggatgctccacactcagaaggggatatgcacctcctgagcggacccctaagtcccaatgaatccttcctccgatatctgactctgccgcaggacaatgaattggccatcgaccttaggcaaacagcagtcgttgtaatggctcatctcgatcgcttggctacaccttgtatgccccctctctgctcgagtccaacatcccataaaggaagtttgcaagaggtgatcggctggggcctcatcggatggaagtactacgctaacgtgatcggcccaatacagtgcgagggcctcgcaaatttaggcgttacgcagatagcctgtgccgaaaagagattcctgatcctgagtcgcaatggacgagtctacacgcaggcctataactcggatactttggctccccagttagtccagggtctggcaagccgcaacatcgtcaaaattgcggctcattccgacggacaccactacctggccctggcggctacaggcgaagtgtactcctggggctgtggggacggaggcagactgggacacggtgacactgtccccttagaggagccgaaagtgatttctgctttctcaggaaaacaggccggtaaacatgtagtgcacattgcatgtggcagtacatactcagcagcaattaccgctgagggagagctgtatacatggggccgtggcaattacggcaggctggggcatgggtccagtgaagacgaggctatcccaatgttggtcgccggactaaaagggctaaaggttatagacgtagcgtgcgggagcggagatgcccagacactggcggtcaccgaaaacggacaagtgtggtcttggggcgacggggattatggcaaactgggccgtggcggatccgatgggtgcaagacccccaagctcatagaaaagctccaggatttggatgtcgtgaaagttagatgcggttctcagttctccatcgctctgactaaagacggccaggtttatagttggggcaaaggagacaaccagcgccttggccatggcacagaggaacacgtccgttatcctaagctgctcgagggactgcagggaaaaaaagtgatcgatgtggcagccggttccactcattgtctggccctgacagaggattcagaggttcattcctggggctctaatgatcaatgtcagcatttcgacacccttagggtgaccaagcccgaacccgcagctctccctggattagatactaagcatattgttggtatcgcgtgtgggcctgctcagagttttgcatggtcgtcttgcagcgagtggagcatcggcctgcgtgtgcccttcgtcgttgacatctgctccatgacatttgagcagctggacctcctgctgcggcaggtgtcagaagggatggacggtagcgcggactggcctcccccacaagaaaaggagtgcgttgcagtggccactctgaatctgctgaggctgcaacttcatgcggctatcagccatcaggtcgacccggagtttttgggtctgggactaggtagtatcctgctgaattcgctgaagcagacagtggtgaccctcgcctccagcgccggtgtgctcagcactgtccagagcgccgctcaggccgttttgcagagcgggtggtccgtgttgctgcctaccgccgaggagagggcgagagccctgtccgcactactcccctgtgcagtgagcggtaatgaggtaaatatctcaccaggacggaggtttatgatcgatctgctggtcggatctttgatggcagacgggggactggagagcgctctgcacgccgctatcaccgctgaaattcaagacatcgaagctaaaaaggaagcccaaaaagaaaaggagatcgatgagcaagaggcaaacgcaagtacctttcacagatcaagaactccactggacaaagatttgattaacactggaatctgcgagtcctcaggcaagcagtgtctgcctctcgtgcaactaatccaacagctattacggaacatcgcttcgcagacagtggcacggcttaaggacgtggcgagaagaatttcttcatgcctggactttgagcaacactctcgggaacggtctgcctctctggacctcttgttgaggttccagagactgctaatcagcaagctgtaccctggggaaagcataggccagaccagtgacatatcttctccggagctgatgggggtgggctccttgctgaagaagtataccgctctcctatgtacgcacattggggacatactgcctgtggccgcttctattgcctcaactagttggaggcattttgccgaggtagcctatatagtggaaggtgactttaccggggttctgctgccagaactggtggtttccatcgtgctactgttatctaaaaacgcaggattgatgcaggaagcaggggcagtgccattactgggagggctgctggagcacttggatagatttaatcatctggcccctggcaaagaacgagacgatcacgaggaacttgcatggccaggaataatggagagcttctttacgggccagaattgccgaaataatgaagaagttacactgattaggaaggccgatttagagaatcacaataaggatgggggattttggacggtcattgacggtaaggtttacgatatcaaggactttcagacacagtccctcaccggcaatagcatacttgcccaattcgccggtgaagatcccgtcgttgcacttgaggctgcactccaattcgaagacacaagggaatccatgcacgcattctgtgtggggcagtatctggaacccgatcaggaaattgtgaccatccccgatctaggttctctaagcagcccgttgattgacactgagcgcaatctggggttgctgctgggtctacatgccagttacctggctatgtcaacgccactgtcacccgtagagattgagtgcgctaaatggctgcagtccagtatattttctggcggactgcaaacctcacaaattcactattcatacaacgaggagaaagacgaagatcactgttcctcaccaggtggcacacccgcatcgaagagccgcctctgttcccatagacgcgcactcggagaccatagtcaggcgtttctgcaggcaatcgctgataataacatccaggaccacaacgtgaaagattttctctgtcaaatagagcgttactgccgccagtgccacttgacaaccccaattatgtttcctcctgaacacccagtggaagaagtgggacgcctgcttctttgctgtctcctgaaacacgaggacctgggtcacgtggctctgtccctcgtgcatgcaggtgccttgggcatagaacaagtaaagcacaggaccttgccaaagtccgtcgtcgatgtctgcagggtcgtataccaagcaaagtgtagcttgatcaaaactcatcaggagcagggtcgatcctacaaggaggtatgtgcaccggttattgaaagactccggttcctcttcaacgagctgagaccggctgtctgtaatgacctatccatcatgtccaaattcaaactgttgtcttcactaccccgttggaggcgcatcgcccagaaaatcatcagggagcgacgcaaaaaaagggtacctaagaaacctgaatccacagatgacgaagaaaaaattggaaatgaagaaagcgacctcgaggaggcttgcatactcccccatagccctatcaacgtggacaagaggcccatcgcgattaagtctcctaaggacaaatggcaacctctcctgagtacagtgaccggcgtacataagtataaatggttgaagcagaatgtgcagggactgtacccccagtcgccccttttgtccactatcgcagaatttgccctcaaagaagaacctgttgatgtggagaagatgaggaaatgcctactgaagcaattggaacgagccgaggtgcggctggagggaattgatacgatcctgaagcttgcaagcaaaaatttccttctgcctagtgttcagtacgccatgttttgtggatggcagcggctcataccagagggtatcgacattggtgagccacttacagattgcctcaaggacgtcgacctgattccacccttcaaccggatgctacttgaagtgacatttggtaagctgtacgcatgggccgttcagaacatcaggaacgtcctcatggatgcttctgccaagtttaaggagcttggcatccagccagtgccactgcagaccatcaccaacgagaatccctccggccctagcctcggcacaattccccaggcgcgatttctcctagttatgctctcaatgctgaccttgcaacatggcgcaaataaccttgatctccttttgaattcaggcatgctggcactgacccagaccgctctgcgtttgatagggccttcttgcgacaacgtggaagaggatatgaatgcctccgcccagggggcatcagccaccgtgttagaggagactagaaaggagacagcaccagtccagttacccgtgtcgggcccagagctcgcagccatgatgaagattggcacacgtgtgatgagaggggtcgactggaagtggggggatcaggacggcccaccaccaggacttggtagggttatcggggaactgggagaagatggctggataagagtgcagtgggacaccggtagcaccaattcttataggatgggaaaagaaggcaagtacgaccttaaactggccgagctaccagcggctgcacagcccagtgcagaggacagcgatactgaggatgactcagaggccgagcagaccgagcggaatatccatcctactgcaatgatgtttacttctaccatcaatctgctccagacactgtgcctgagtgctggcgttcacgctgagatcatgcagtccgaagccacaaagacgctttgcggtctactgcgaatgctggttgaaagcggcactactgacaaaaccagctctcccaaccggcttgtttaccgggagcagcacagaagctggtgtactctgggttttgtgcggagcatcgcactgaccccacaggtatgtggcgctctatcaagtccccagtggattacgctcctgatgaaggttgttgagggacacgcgccatttacggcaaccagtttgcagcgccagattctagctgtgcatctgctacaagccgttctgccgagctgggacaaaaccgagcgtgccagggacatgaaatgcctggtggaaaagctcttcgacttccttggtagcctcctgaccacatgctccagtgatgtgccgctgctgagagaaagcaccctaagacgtaggagagtcaggccccaggctagcctgacagcgacccactccagtacgctagctgaagaggttgtggcattgcttcgaaccctccattctcttacccagtggaatggtcttatcaataagtacattaattcacagctgcgcagcatcacacactcgtttgtcggaagaccctccgagggggcacagctggaggactatttcccagactccgaaaatccagaagtaggaggcctcatggccgtactggctgtgattggaggtatcgatgggagattaaggcttggaggacaggtgatgcacgatgaattcggcgagggcaccgttacgcgcattacaccgaaaggaaagataaccgtgcaattttccgatatgcgcacatgcagagtgtgtccgctgaaccagctgaaacccctgccagccgtggcttttaacgtgaacaacctgccattcacagagcccatgttgagtgtgtgggctcagctggtcaatctggcgggatccaagctggaaaagcataaaatcaaaaagagcaccaaacaagccttcgccggacaggtggaccttgatctgctcaggtgtcagcaacttaaactgtatatcctgaaggcagggagggcactgctcagccatcaggataagctgcggcaaatcctcagccagcctgctgtgcaagaaacaggaaccgtccatacggacgacggcgcagtggttagtcccgatctcggcgacatgagcccagagggccctcagcctcccatgattctgttgcaacagcttctggcctcagccacccagcctagtcctgtcaaagctatcttcgataagcaagagctcgaagccgcagccctggctgtatgtcagtgtcttgctgtggagtcaacccacccaagtagtcccggatttgaagactgctccagctccgaagctacaactccagtcgctgtccagcacattcgtccagccagagtgaagagacgaaagcagtcccccgtgcctgcactgccgatcgtggtacagctgatggagatggggttcagtcggagaaacattgaattcgccctgaagagcctcaccggtgcttccggcaatgccagcagcttgccaggggtcgaggccctcgttggttggttgttggatcactccgatatacaagtgacagagctgtcagacgccgacacagtgagcgatgagtattcagatgaggaagtcgtggaagatgtggacgacgccgcatactccatgtcaacgggtgccgtggtcaccgaatctcagacttataagaagcgcgctgatttcctgtcaaatgacgactacgccgtgtatgtgagagagaacattcaggtcggaatgatggtccgctgctgcagggcgtatgaggaagtctgcgagggagacgtgggtaaggtgattaagctggatagagacggcttgcatgacttgaatgtgcagtgcgactggcagcagaagggaggaacctactgggtcagatacattcacgtcgaactgatcgggtatcccccaccgtctagcagcagtcatatcaagattggtgataaagtgagagtaaaagcctctgtgacaacacctaaatataaatggggaagtgtgacgcaccagtcagttggcgtcgtgaaagccttcagcgcaaatggtaaggacattatcgtcgatttccctcagcagagtcattggaccggtctcctgtctgaaatggagctggtgccttccatccacccaggggtcacctgcgatggttgccagatgtttcctattaatgggtccagatttaagtgcaggaattgtgatgactttgacttctgtgagacctgtttcaaaaccaagaaacacaatacccggcatacattcgggaggatcaacgagcctggacagagcgccgtattttgtggtcggtctggaaaacagctcaagcggtgccactctagccagccgggtatgcttctcgatagctggtctcggatggtgaagtcactgaacgtgtcctcttcggttaatcaggcctcccggctgatcgatggctccgagccatgttggcagtctagcggctcccaaggcaagcactggatacgcctcgagatttttccagatgtcctcgtccaccgtctgaagatgatcgtggatcctgccgactcttcttatatgccgtctctggtggtcgtctccggaggcaacagtcttaataacctcatcgagttgaagactatcaatatcaaccccagcgacacaacggtccccctgctgaatgattgcaccgagtatcacagatatattgagatcgctataaagcagtgtcgttcatctggaattgattgtaagatccacggccttatcttattggggagaatcagagccgaagaagaagatctggcggctgttcccttcttagcctcagataatgaggaggaggaagatgagaaaggtaactctggctccttgatcaggaaaaaggcagcaggtctcgagtccgccgctactatcagaaccaaggtgttcgtatggggtctgaatgacaaagatcaactgggaggcttgaaaggaagcaagataaaagttccaagtttttcagagaccctgagcgctttaaacgtcgttcaggtggctggaggtagtaaatcactcttcgctgtcaccgttgaggggaaggtatatgcctgcggtgaagccactaacgggagattgggcttaggcattagcagcggaacagtgcctataccccgacagatcacggctctaagcagttatgtggtaaagaaagtcgcagtacattctgggggaagacatgctaccgctctgacagtcgatggcaaagttttctcctggggggagggcgatgatggcaagctgggccacttctcccgcatgaattgcgacaagccacgcctgatcgaagcactgaagactaaacgcattagagatatcgcatgtggctcttcccacagtgccgctctcacgtccagcggggagctgtacacatggggtctgggcgaatacggcaggctcggtcacggcgacaatactacacagctaaaaccgaagatggttaaagtactgctcggccacagagtcatccaagtggcctgtggatctcgggacgcgcaaaccttagctcttacggacgagggcctagtcttcagctggggtgacggcgactttgggaagttaggtcgaggagggagcgaaggttgcaacattcctcagaacattgagcgtctgaatggccagggcgtttgccagatcgaatgtggggctcaatttagcctcgccttaacgaagagtggggttgtgtggacctggggaaagggggactactttagactgggacatggatcggacgttcatgtgcgcaagccacaggtggtggagggcctgcgaggaaaaaaaatcgtgcacgtggctgtgggagcactgcactgcctggcagtgaccgattctggacaggtctacgcatggggtgacaatgatcatggccagcagggcaatgggacaaccactgtaaatcgtaagcccacattggtacaggggctggagggccagaaaatcaccagggtcgcgtgtggttcgtcccattctgtcgcttggacgacagtagatgtggccaccccttctgtccacgagcctgttctgtttcagactgctcgagacccgctgggcgctagctatctgggggtaccctctgacgccgatagcagcgcagcttcaaacaagattagcggggcaagcaacagtaagccaaataggccctctttggccaaaattctgctcagtttggatggaaacctggccaagcagcaggcgctctctcacattctgactgcactacagattatgtatgcgagagacgctgtggtgggcgcactcatgcctgccgctatgatagctccagtggaatgcccctctttctcatctgccgcaccttccgacgcgtccgccatggcatccccaatgaatggggaggagtgtatgctcgccgtcgacatcgaggaccgcctctctccgaatccttggcaggagaaaagggaaatagtgtcatccgaagatgccgttaccccttccgcggtgaccccatctgcaccttccgcttccgccagacctttcatacctgtcacagacgacctgggtgctgcttccattatagcggaaacgatgacaaagactaaggaggacgtggagtcacagaataaagccgcaggacccgagccgcaggcgctggatgagttcacctccctcttgattgccgacgatacccgggtggtcgtcgaccttctgaagctgtccgtgtgttcacgggctggagaccgcggacgagacgtcctgagtgctgtcctgtctggaatgggcaccgcttatccacaggtagccgacatgctgctggagctctgcgtgaccgaactggaagacgtcgcaactgattcccaaagcggccgtctttcctcccagcccgtcgttgtagaatccagtcatccctacacagacgatacatccacaagcggcacggtcaagatccccggagccgaaggcctccgcgtggagttcgatcggcaatgctccaccgagcgccgtcacgatcctctgacggttatggacggtgtcaaccggatcgtttctgttaggagcggcagggagtggagtgattggtcttccgagctcagaattccaggcgatgagcttaaatggaaattcatctcagatggctctgttaacggctggggatggaggttcacagtctacccgataatgcctgcagcaggacccaaagaactgctgtcagatcgctgcgtcttgtcctgtcccagcatggatttggtgacatgcctcctagattttagactgaacctggcctctaaccggtcaattgtccctagattggctgcttccctggctgcctgcgcgcagctctctgctcttgccgcatctcatcggatgtgggcactccagagattgcgcaaactgctcactactgagttcgggcagagcataaacattaacaggcttctgggcgagaatgacggcgagactagagctctctcctttaccgggtccgcactcgccgcattggtgaaaggactgcccgaagccctgcaacgtcaattcgaatacgaggatccaatcgtgagggggggaaagcagctgctacactccccatttttcaaggtgctggtcgcactagcgtgcgacctggagctggatacactgccctgttgcgcagaaacgcacaaatgggcttggttccggcgatactgcatggcgagtagagttgctgtggctttagataagcggacacctctgccgaggctgttcttagatgaagtagcaaaaaaaattagggagcttatggctgattccgagaatatggacgtcctacacgagtcccacgatatttttaagcgcgagcaggatgagcagctggtgcagtggatgaatcgccgtcccgatgattggactctctcagccggagggtcaggcacgatctacggatgggggcacaatcatcgaggccaacttggcggtatcgagggcgcaaaggtgaaggtgcccactccctgcgaggcgctggcaaccctccgtcctgtccagctcatcgggggagaacagactcttttcgccgtcaccgcagacgggaaattgtacgctaccgggtatggagcagggggtcgtctagggatcggtggcaccgagagcgtctccaccccaactctacttgagtccatacagcacgtgttcatcaaaaaggttgccgtaaatagtggtggcaaacactgtctggcactgtccagcgagggcgaagtttactcatggggcgaagcagaagacggaaaattggggcacgggaatcggagtccttgtgatcgacctcgagttatcgaaagcctgagaggcatagaggtcgttgacgtcgccgctgggggagctcatagcgcatgtgtgacagccgctggcgatttatacacctggggtaagggcaggtacggtagactcggccacagcgatagcgaggaccagctgaagcccaaactcgtggaggcccttcagggacaccgagtggttgacatcgcctgcggatctggcgatgcccagacactgtgccttacagacgacgatacagtgtggagctggggagatggagattacgggaagctcggccgtggtggaagtgacggctgtaaggtccccatgaaaatcgacagcctgaccggcctcggggttgtgaaggttgagtgcggctctcagttctcagttgctctcacaaaaagtggcgcagtatatacttggggcaagggcgactaccatcggcttgggcatgggagcgacgaccatgtgagacggccaagacaggtgcagggactgcagggcaagaaagtcatcgctattgcaacaggcagtctgcattgcgtgtgctgcaccgaggacggagaggtttatacttggggcgataatgacgaaggccagttaggtgatgggacaacgaacgctatccagaggcctcggcttgttgctgccctgcagggtaaaaaggtgaacagagtcgcatgtggcagcgcccacacactcgcctggtcaacctcgaagcctgcgtcggccggaaagctaccagcgcaagtgcctatggaatataaccatttacaggagatccccatcattgccctgcgcaatcgcctcctgcttctacaccatctctccgaactattttgtccatgcatccccatgttcgatctggaagggtccctcgacgaaaccgggctagggccaagtgtggggttcgacacacttcgcggtatcctgatcagccagggaaaggaggcggcattcaggaaagtggtgcaggccaccatggtcagggaccgccagcatggaccagtggtagagttgaaccgcatacaggtgaagcgctcacgttcaaagggaggcctggctggaccggatggaaccaagtcggtctttggccagatgtgcgcaaaaatgtcttcattcggtcccgactccctactgctccctcacagggtctggaaagtcaagtttgtgggtgagtctgtagacgactgtgggggagggtactccgagtctatcgctgagatatgtgaagagctgcagaatggtctgactccactgctgatcgtgacgccaaacggacgcgatgaaagtggtgccaatcgggattgctatttgttgagtcccgctgccagagctcccgttcattccagcatgttccgcttcctgggtgtgcttttgggcatcgccatccgcacagggtctcctctgtctctaaatctggcagagcctgtgtggaaacaactagcaggtatgagcctcacaatcgctgacctgtctgaggtggataaggactttattccgggacttatgtacattagagacaacgaggcaacttcagaggagtttgaggctatgtctctcccattcacggtgccatcagcgagcggtcaggacatccagctatctagcaagcacacccacataacactggacaatcgggctgagtacgttcggttggccataaactaccggctgcatgaattcgacgagcaggtcgcagcagtgcgcgaaggcatggctagagtcgtacctgtgcccctactgagcctctttactggatatgaattggaaactatggtgtgcggatctcccgatattcccctccacctactcaagtccgttgcaacctacaaggggatcgagccatctgcttctctcatacagtggttctgggaggtcatggagtcctttagcaacaccgagaggtccctcttcctccgcttcgtctggggcagaacacgtctgcccaggacgatcgccgactttcgaggacgggattttgtcattcaggtattggacaagtacaatcctccagaccactttctgccagagtcctacacctgcttttttctgctgaagttgcccagatatagctgtaagcaagtgctggaagagaagctgaagtacgcaattcacttctgcaagagcattgatacagacgactatgcacggatcgctctgacaggagagcccgctgccgatgatagttctgatgactccgacaacgaggacgttgactcattcgcatcagattcaacccaggattacctcaccggccattat

SEQ ID NO: 225825 - DNA, 3075 bp, Artificial Sequence
  Description of Artificial Sequence: Synthetic coding sequence
atggagaggcgctctaggcgtaagtccagaaggaacggaagatccaccgcaggcaaggctgctgccactcagcccgcaaaatctcccggagctcagctgtggctttttccgagtgctgccggactgcatcgtgccctgctgcgccgagtggaagtgaccagacagctgtgttgctccccaggtcgactggccgttctggagcggggtggggcaggcgtccaggtacatcagctcttggcaggaagcggcggagcgcgtacgcccaaatgtattaaattgggcaagaatatgaagatccactccgtggaccagggcgctgagcacatgctgatcttgtctagtgacggcaaaccatttgagtatgacaactattcaatgaagcatctgcgcttcgagtctattctgcaggagaagaaaatcatccaaataacgtgcggcgattatcatagcctggcgctgtccaaaggcggagaactattcgcttgggggcagaaccttcacggtcagctaggtgtgggcaggaaatttccgagcaccaccacacctcaaattgtggagcatcttgccggtgtccccctggcacagatcagtgcaggcgaagcccactctatggccctgtcgatgtccgggaatatttattcatggggtaaaaacgaatgcggtcagctgggcctgggtcacacagagtctaaagatgatccttctctgattgaaggactcgataatcagaaagtggagttcgtggcatgcgggggatctcacagcgctctcttgactcaggacgggctgctgtttacttttggcgcaggaaagcatggacagttgggccacaacagtacccagaacgagctccgtccgtgcctagtggccgagttagttggatatcgtgtgacccagatcgcttgcgggagatggcacacacttgcctacgtttccgatctgggaaaagtgtttagtttcggcagcgggaaagatgggcagctgggaaatgggggaacaagagaccagcttatgcccttgcccgtaaaagtgtccagtagtgaagaactgaagcttgagtcccacacaagcgagaaagagctgatcatgatcgccggtggtaatcagagcatcctcctgtggattaagaaagaaaactcatatgtgaacctcaagcgtactattcctactttgaacgagggtaccgtgaagagatggatcgcagacgtcgagaccaagagatggcaatcaacaaagcgggagatccaggagatcttctcttctccagcttgcctaacaggttcattcctgaggaaacgccgtacaacagagatgatgcctgtctatctggatctaaataaggccaggaacattttcaaagaattgacacagaaggattggatcaccaacatgattactacttgtttaaaggataacctgctgaaacgtctgccgttccactctcctccccaggaggcacttgaaatattttttctgctgccggaatgtccaatgatgcacatcagtaataattgggaatctctggtcgtgccattcgcaaaggtggtatgcaaaatgagtgatcagtcctccctcgtcctggaggaatactgggccactctgcaggagtctacgttcagtaaacttgtacaaatgttcaagactgcggttatctgccagttggattactgggacgagtccgctgaggagaatggcaacgtgcaggcgcttctcgaaatgctgaagaaactccacagggtcaatcaggttaaatgccagttgcccgaatcaatctttcaggtggatgagctgctgcaccggctcaatttctttgtagaagtatgtcgacgatacctttggaagatgaccgtggatgcctctgagaatgttcaatgctgcgtaatattttctcacttccctttcatcttcaacaatctcagcaaaataaagctgcttcatactgacacactgttgaaaatcgaatctaaaaagcacaaagcttacctaagatcagccgcaatcgaagaagagagggaatctgaattcgccttgagaccgaccttcgatctgaccgtgagacgaaatcatcttatcgaagacgtgctgaatcagctctcccaatttgagaatgaagatctgcgcaaagagctctgggttagcttctctggggagatcggctatgatttagggggtgtgaaaaaggaattcttttattgtctgtttgcagaaatgatccagcccgagtacggaatgttcatgtatccggagggcgcttcctgtatgtggtttcctgtgaagcccaagttcgaaaagaaaaggtattttttctttggcgtcctgtgtgggctgtccctgtttaactgcaacgtagctaacctccctttcccactcgctttgttcaaaaagctgctggatcaaatgccatcactcgaagatttaaaggagttgagcccggacctcggcaagaacttgcagacccttttagacgacgagggcgataattttgaggaggtgttctacattcacttcaacgtgcactgggatagaaatgataccaatctcatccctaatggcagcagtattacagtaaaccagaccaacaaacgggactacgtatcaaagtacatcaactatattttcaacgactctgttaaagcggtgtacgaggagttccgcaggggattctacaagatgtgtgacgaggacatcatcaaactgtttcatcccgaggagctgaaagatgtgattgtcgggaatacagactatgattggaaaacgtttgagaagaacgctcggtacgagccgggatataatagctcacatcctactatcgtgatgttctggaaggctttccataagctgacgctcgaagaaaaaaagaagttcttggttttcctaactggcacagatagattgcagatgaaggatctgaataatatgaaaatcactttctgttgtccggaaagttggaatgaacgggaccccattcgggctctcacctgcttttctgtgctgttcctcccgaagtacagcaccatggaaaccgtcgaagaagcactacaggaagcaataaacaacaacagggggttcggatag

SEQ ID NO: 225826 - DNA, 1854 bp, Artificial Sequence
  Description of Artificial Sequence: Synthetic coding sequence
atgggacctacactggctgttccgacaccctacgggtgcattggctgcaagctgcctcagccagagtacccacccgctttgatcatcttcatgttctgcgccatggtgattacaatcgtggtcgatctcattggcaactcaatggtgatccttgccgttacgaaaaacaagaaattaaggaacagcggtaacatctttgtcgtgtctctcagcgtggccgatatgctggttgcaatttacccctaccctctgatgctgcatgcaatgtccattggcggatgggacctcagtcagctgcagtgtcaaatggttggattcatcactgggctttccgtcgtgggaagcattttcaatattgtagctatcgcaatcaacaggtactgctatatctgccacagtctacagtacgaaaggatcttttctgtgaggaacacctgcatctacttagtgataacatggatcatgacagtcctcgccgtgttacctaacatgtatataggaacaatcgaatatgatccgaggacctatacctgcatcttcaactaccttaataatcctgtcttcacagttactatcgtttgtattcatttcgtcttacccttgctgattgtcggcttctgttacgtgcgcatctggaccaaagtactggccgctcgtgatcctgcaggacaaaaccctgacaaccagttagccgaggttcggaacttcttaactatgtttgtgatttttctgctattcgcggtgtgctggtgtcccatcaatgtcctgaccgtcctcgttgccgtgtctcctaaggaaatggccggaaaaatccctaactggttatacttagccgcttacttcatcgcctacttcaacagttgtttgaatgccgtcatctacggtctccttaatgaaaactttcgacgcgagtactggactattttccacgctatgcggcaccccattatcttttttagtgggcttatctccgatattcgcgagatgcaggaggccagaacacttgctagggctagggctcacgcacgcgatcaggccagggaacaggacagggcacatgcctgtcccgcagttgaggaaacaccaatgaacgttaggaatgtccccctcccaggcgacgccgctgcaggccacccagaccgcgcatccggacatcccaaaccacatagtaggagcagctcagcatataggaagtccgcctcgacacaccacaaaagtgtgttctcccactcaaaggctgcctcggggcatctaaaaccagtgtccggacatagtaaacctgcaagtggccaccctaagtctgccaccgtgtaccctaaaccagcctctgtccattttaaggcggactccgttcattttaagggggactccgtgcattttaaacctgattcggtccattttaagccggctagttcaaaccccaagccaatcacagggcaccacgtatctgccggatctcatagtaagagcgcattttccgctgccaccagccacccaaagcccactaccggccacatcaagcccgcaactagtcacgctgagccaacaaccgcagattatccgaaacctgctaccaccagccacccaaaaccaactgcggctgacaacccagagctcagtgcttcccactgccccgaaattccagccatcgcccaccccgtttcagacgactccgacctccccgagtccgcgtcatcacctgcagctggacccacaaaacccgcagccagccaactggagagcgatactatcgcagacctgcccgatccaacagttgtgaccacatcaactaatgactaccacgacgtagtggttattgatgtagaggacgatcctgacgagatggctgtgtag

SEQ ID NO: 225827 - DNA, 13125 bp, Artificial Sequence
  Description of Artificial Sequence: Synthetic coding sequence
atgaaggtagacagaaccaaacttaagaagactccaactgaggcacccgcagattgcagggcgctgatagataaattaaaagtgtgtaacgatgaacagctactcctagagctccagcagattaagacttggaacatcggaaaatgcgaactctatcactgggtggatctcctcgacagatttgatgggattctggcagatgcagggcagactgtggagaatatgtcttggatgttagtatgtgatcggcctgagagggaacagctgaagatgcttcttttggcggtgctgaatttcacggcccttcttatcgagtacagctttagtagacatctttactcatctatcgaacacctgaccacgctcctggccagcagcgacatgcaagtagtgctggccgtattgaacctgctttatgtgtttagtaagcgatctaactatattacacgcttggggtccgataagcgcaccccactgctgacacggctgcagcacctggcggagagctggggcggaaaggagaacggatttgggttggccgaatgttgcagggatttgcacatgatgaaatatccaccatccgctaccacactccattttgaattctatgcagaccccggagctgaggtcaaaatcgaaaagaggactacaagcaatactctgcattatatacatattgagcagttggataaaattagcgagagcccgagtgagattatggagtccctgactaagatgtacagcattcctaaggacaaacaaatgctactctttacacacatccgcctggcccacgggttttcaaatcacaggaagcgtctccaggcagtacaggccagattacacgccattagtatactcgtgtatagtaatgccctgcaagaatccgcaaattcaatcctgtacaatggcttgatcgaggagctagtcgacgttttgcagattacagacaaacagctgatggaaatcaaggccgctagtctccggacactcaccagcattgtccaccttgagcggacacctaagctgagtagcatcattgactgtacagggactgcttcctatcacggattcctgccagtattggtgcgcaattgtatccaggccatgattgatccaagcatggacccgtatccacaccagttcgcaaccgctctgtttagctttctataccacctcgcttcctatgacgctgggggagaagcccttgtaagttgcggaatgatggaggctcttctgaaggtgataaagttcttgggggacgaacaggatcagataacttttgtgacgcgcgcagtgcgtgtagttgacctgatcaccaatctggatatggcagcctttcagagccattccggactgtcaatatttatctatcggctagagcatgaagtggatttatgcagaaaagaatgtccatttgtgattaagcctaagatacaaaggccgaacactacgcaagagggggaggagatggagaccgatatggacggagtccagtgcattcctcagagggcagccctgctaaaatctatgctcaactttctcaagaaagcaatacaggatcccgctttcagtgatgggattcgccacgttatggatggctccttaccaacctcattgaaacatataatatcaaatgccgaatattatggaccctccctattcttgctggccactgaggtcgtgaccgtattcgtatttcaagaaccctcactgctttcctccctgcaggacaacggccttactgatgttatgcttcacgcgctgctgatcaaggacgtgccagccacaagagaggtacttggatcactgcctaatgtgtttagtgcactctgtctgaacgcaaggggtctgcagtccttcgtgcagtgtcagccattcgagagactctttaaagtgctgctgtcacccgattaccttcctgctatgcggagaagacgctctagcgaccccctgggggacaccgcaagcaacctgggatcagccgtcgacgagttgatgcggcaccagcctacactgaaaaccgatgcgacaaccgctattattaagctgttggaggaaatttgtaacctcgggagggatccaaaatacatttgtcagaaacctagcatccagaaggccgatggcaccgcgacagcacctccccctcggagtaaccacgccgctgaagaagctagtagcgaggacgaggaagaggaagaggtgcaggcaatgcagtcttttaatagtacccagcagaacgagaccgaaccgaatcagcaggttgtcggcaccgaggaaagaattcccattcccttgatggattatatccttaatgtcatgaaattcgtagagtctattttaagtaataatactacagacgaccattgccaggagttcgtcaaccagaagggtctcctccctctcgtgacaatcctcggcttaccgaacctgcccatagacttccccactagtgccgcatgccaagccgtggccggtgtgtgcaagtcgatcctgaccctctcccacgagccaaaggtactacaggagggactgttgcaattggactccattctaagctctctggagcccctccatcgacctatcgagtcccccggaggtagtgtactgctccgagaactcgcctgcgctgggaatgttgccgacgctaccctttccgcccaggctacgccactgcttcacgccctgacggccgcacatgcctacatcatgatgttcgtgcatacatgccgcgtcgggcaatccgaaattcgttctatatctgtgaatcagtggggctcccaattgggcctttcagtcctgagcaagctctcccagctgtactgcagcctggtctgggagagcacagtgttgctctcgctgtgcacacccaatagtcttccttcaggctgcgaattcggacaagccgacatgcagaaactggtccctaaggatgagaaggccggaacaactcaggggggaaagaggtcagacggcgaacaggacggcgcagcagggtcaatggatgcaagtacccagggcctgctggaaggcattggactggatggggacaccctggccccaatggaaaccgacgaaccaacagctagtgattctaaaggtaaaagtaagatcacaccagccatggcggcaagaattaagcagatcaagcctctgctgtccgcctcctccagactgggacgggcactcgccgaactcttcggtttattagtgaagctgtgtgttggcagtccagtccggcagcgtaggagccatcacgcagctagcactactacagcacctactcccgctgccagaagtaccgcttctgccctgaccaagcttcttaccaaaggattgagttggcaacctccgccttacactccaacaccccgttttcggctcacattctttatctgttcagtgggatttacgagccctatgcttttcgatgagcggaaatacccctaccatctgatgctgcaaaagtttctgtgtagcggcggacacaacgctttgttcgagactttcaactgggcactttccatgggcggaaaggtgcctgtgtctgagggcctggaacattccgatttgccagacggtacaggcgagttcctggatgcctggctgatgctggttgaaaagatggttaaccctaccacagttctggagtctccacacagtctgccagctaagctgccgggaggcgtccagaattttcctcagttttccgcgcttcgattcctggtggtcacacagaaggctgcctttacatgtatcaagaacctttggaacagaaagcccctgaaggtctatggaggtcgcatggccgagtctatgctcgcgatcctatgccatatactgaggggcgagcctgttattcgggagcgactgagtaaagaaaaagaaggttcaagaggtgaagaagacaccgggcaggaagaaggaggcagcaggcgcgagcctcaggtgaaccagcaacagttgcaacaactcatggacatggggtttactcgggagcatgctatggaagctctgctcaataccagtactatggaacaggcgacagaatatttgctcacacatcctcctcctataatgggaggtgttgtgcgtgacctctcaatgtccgaggaggatcagatgatgcgggcaatagccatgagcctagggcaggatattccaatggaccaaagggccgagtcacctgaagaagtggcctgccggaaggaagaggaggaaagaaaagccagggagaagcaggaagaagaagaggctaagtgtcttgagaagttccaagacgctgatccgctggagcaggatgagctgcacactttcacagacactatgcttcccggatgcttccacttgctggatgagcttcccgacactgtgtatcgggtctgcgacctaattatgaccgccattaaacgcaacggcgctgactacagagacatgatcctaaaacaggtcgtcaatcaggtgtgggaagctgccgacgttctgataaaagctgctctgccactgactacctctgacaccaaaacggttagtgagtggattagtcagatggctactttaccccaggcctccaacctggctacacggatactgttgctcacactccttttcgaagagctgaaactgccatgtgcatgggtagtggagtccagcgggatcctcaatgtcctgatcaagttactggaagtcgttcagccctgcttgcaggctgctaaagaacagaaggaggttcaaaccccaaaatggatcactcccgtcctgttgttaatcgatttctacgagaagaccgccatttcttccaagaggcgtgcccagatgaccaagtatctgcagtccaattctaacaactggaggtggtttgacgacaggtccggccgttggtgcagctactctgcctcaaacaacagcactatcgactcagcttggaagtctggcgagaccagcgtacgatttactgccggtaggaggcggtatacagtgcagtttaccacaatggtgcaagtgaatgaggaaaccggcaatagacggcctgttatgttgactctgttgcgagtgcctcgcctgaacaagaattcaaaaaattccaatggccaagaactcgagaaaacactcgaggagtccaaggagatggatataaaacgaaaggaaaataaagggaatgatacacctctcgcgctggaaagtacgaataccgaaaaagaaacgagcttagaggaaactaagataggcgagatcctaatacagggactgacagaggatatggtcaccgtgctaatcagagcttgcgtgagtatgttaggggttcccgtggacccagatactttgcacgccaccctcaggctgtgtcttagactgactagggaccataaatatgccatgatgtttgcagaacttaaatcaacccggatgatactgaacctcacccagtcatctgggttcaatgggttcacccctctggtcactctgttactacgccacattattgaggatccttgtacactcaggcacacaatggaaaaggttgtgcgctctgccgcaacaagcggggctgggtccaccacaagtggagtggtttcagggagcttgggctcaagggaaatcaactacatcctccgtgtgcttgggccagccgcatgtcggaaccccgatatcttcacagaagttgccaattgttgtattcgtattgctcttcctgcccctcggggatccgggaccgcgtccgatgatgaatttgaaaacttgaggatcaaaggccctaacgccgtgcaactagtgaagacgaccccactcaagccgtctccattgcccgtgattcccgacaccatcaaagaagtcatttatgatatgctgaatgctctggcagcttaccacgccccagaggaggcagacaaatcagaccccaaaccaggagtaatgacccaggaggtgggacaactactgcaagatatgggagacgatgtgtatcagcagtatcggtccctgacccgccagtcaagtgatttcgacactcaatctggattctctatcaattcacaggtgttcgcagccgacggggctagcaccgaaaccagcgcttcaggaaccagtcagggagaagcttcgactcctgaggaatcccgggacgggaagaaagacaaggagggggacagagcctcggaagagggaaaacagaaaggcaaaggtagtaagccgctgatgcctacgagcactatcctgcgactgctggctgagttagtgcgctcctacgtcggcattgctaccttgatcgctaattatagttacactgttggacaatctgagctcataaaggaggactgctcagtgttggccttcgtgctcgaccacctgttgccgcacacccagaatgctgaagataaggatacaccagccctcgctaggctgtttttggcctctctcgccgctgccggatcaggtactgacgcccaggttgcactggtgaatgaagttaaggcagcgctagggagagcactcgcgatggccgagtcgactgagaaacacgcccgactgcaggccgttatgtgcattatttcaacaatcatggaatcttgcccatccacttcatcgttttactcgagcgccacagccaagacccagcataacggaatgaataacatcatccgcctcttcctaaaaaaaggattagtcaatgacctggccagagttccgcactctttagacctgtcttcccccaatatggccaacaccgtgaacgccgctctgaagcctctggaaacactctcccggatcgtaaaccaaccaagctccctgttcggcagcaagtccgcctccagcaagaataagtccgagcaggacgcccaaggggcatcccaggattcttctagcaaccaacaggacccaggagagcccggagaggctgaagtgcaggaagaagaccatgatgtcacacagactgaggtggccgacggcgacatcatggatggcgaagccgaaactgactcagtggtcatcgccggtcagcccgaggtcttgagttctcaggagatgcaggtagaaaatgagctggaagaccttatagatgagctactggaacgcgatgggggttccggcaacagcaccattatcgtaagccgctcaggcgaagacgaaagccaggaggatgtactgatggatgaagccccatccaatctttctcaggcatctaccctccaggctaatagggaggactcgatgaatatcctcgacccagaagacgaagaggaacacactcaggaggaggattctagtgggagcaatgaagacgaagatgactcccaggatgaggaggaggaggaggaagaggacgaggaggatgaccaggaggatgatgaaggcgaagaaggtgacgaggacgacgacgacgacgggtccgagatggagctcgacgaggactatcccgacatgaacgcaagccctttggtcagattcgaacgcttcgatcgggaggacgatctcattatagagttcgacaacatgttctcaagtgcgactgatatccccccatctcccggaaatattcctacaactcacccacttatggtccggcatgcagatcactcttccctcacgctaggaagcggctcaagcacgactagactcacgcaaggaatcgggagaagccagaggacactccggcagctcaccgcaaatactggtcatactatccatgttcattatccaggcaacaggcagcccaacccgccactgatccttcaaagattattaggcccttctgccgcagctgacatactccagctgagtagtagtttacccttgcagtctcggggacgggcacggctgctggtagggaacgatgatgtccatatcattgcacgttccgatgacgagctgctggacgactttttccatgatcagagcactgccacctctcaagcagggaccttatccagtattccaacggctttgacgcgctggacggaggaatgcaaagtgctagacgcggagagcatgcacgattgcgtgagcgtcgtcaaggttagcatcgtgaaccatcttgagttccttagagacgaggaattagaggagagacgcgagaagagaagaaagcagctcgcggaagaggaaaccaagatcacggataaggggaaggaggataaagagaaccgtgaccagagcgcccagtgcacagcatcaaaatcaaatgactccactgagcagaatcttagtgacggaaccccgatgcctgattcctaccccacaactccatcttcgacggatgccgcaacctctgagagtaaagagactctgggaacccttcagagctcacaacagcagcccaccctccccactccacccgctttgggagaagtgccacaagagctgcaaagcccggctggtgaagggggttcttctacccaacttctcatgcccgtggagccagaggagttaggacccacccggccatctggcgaggcggaaaccacccaaatggagttgtctcctgcccctaccatcaccagcctcagcccagaacgggctgaagactccgacgccctgaccgctgtaagcagccagctggagggaagtcctatggataccagtagtcttgccagctgcacccttgaggaggcagtcggcgacacatctgcagcagggagctcagagcagcccagagcagggtcatcgacaccaggcgacgcgcctcccgctgtggctgaggtgcagggaagatctgacggctccggggagagcgcgcaacctcctgaagatagtagtccccctgcttcctctgagtcaagttcaacccgcgattcagctgtagccatcagcggagccgacagcagagggatattggaggaaccccttccttcaaccagcagtgaggaagaagaccccctagccggtattagtctccccgaaggagtggaccccagcttcctggcggcactccctgacgacattcggagagaagttctccagaatcaattgggaattaggccacccacacggaccgccccttctaccaattcgagcgccccagccgtggtcgggaatcccggagtcacggaggtgtcacccgagtttctggccgctcttcctccggctatccaggaggaagttttggcccagcagagagctgaacagcagcgacgcgagctggcccagaacgcttcctccgacacccctatggaccctgtgactttcatacagacgttaccgtcagacttacgcaggtccgtcctagaggacatggaagattctgtactagcggtcatgcctcctgacatagcggcagaggctcaggctctacgcagagagcaagaagctagacagcgccaactcatgcacgaaagactctttgggcattcctccacaagtgcgctgtccgctatactgcggtcaccagcattcacaagcagacttagtggaaatcggggtgtgcagtatacaaggttggcggttcagcgtggtgggacatttcaaatggggggatccagctcccacaacaggccgagcggatctaatgtggacacactcttacgactgcggggaaggctcctgctggaccatgaagctttatcctgtttgcttgtgctgctgtttgttgacgaaccgaaactgaatacgagtaggctgcatagggtgttgagaaacttgtgctaccacgctcaaacccggcattgggtaattcgttccctgctctcgatcctgcagaggtccagtgagtcggagctgtgcatcgaaacaccaaagctcacaactagcgaagaaaagggtaagaagtcctctaaatcctgtggaagcagtagccacgagaacaggcccttggatctccttcacaaaatggaatccaagtcgagcaatcagcttagttggctgtccgtgtccatggacgcggctctcggatgtcgaacaaacatctttcagattcaacggtccgggggaagaaagcacacagagaagcacgcttccgggggtagcaccgtgcatattcacccccaggctgccccagtggtgtgtaggcatgtgctcgacaccctgatacagctggcaaaagtcttcccctcccacttcacacagcagagaaccaaggaaaccaactgcgagagcgatagagagagggggaacaaggcatgcagtccttgttcttctcagagcagcagctctggcatctgcacagatttttgggatctactagtaaaactcgacaacatgaatgtgagtaggaaaggaaagaatagcgtgaagagcgtgccggtctctgccggtggagaaggcgagacttccccgtactctctggaggcttctccactgggccaactgatgaatatgttgtcacacccagtgatccgcaggtcctccttgctcaccgagaaattgcttagactcctgtctctcatttcgatagctttaccagaaaataaagtttccgaggcacaggcaaattcaggatccggagcatctagcacaacaacagcaacttctaccacctccacaactacgaccaccgccgcatccacaactccaacgcccccaacggcgccaacccccgtgacctccgctcccgcactggtggcagctaccgcaatatcgaccattgtggtggcagcgtccaccactgtgacaacacctaccaccgctacgacgactgtcagcataagcccaaccactaagggttcgaagagtcccgctaaagtgagcgatggcggttccagttctactgatttcaaaatggtgagcagcggtctgaccgaaaatcaactgcagctcagcgtcgaagtgctgaccagccacagctgcagtgaagaaggccttgaagacgctgcaaatgtactcctgcaactttcacgtggcgattccggtacgcgcgataccgtgcttaagctcctcctgaatggcgctaggcatcttggctatacactgtgtaaacaaattggaacactcctagcagagttacgggaatacaacctggagcagcagaggagagcacaatgcgaaacactgtctccagacggactgcccgaagaacaacctcagaccaccaagctcaaaggaaagatgcagtccagattcgacatggcagaaaatgtggtaattgtggctagccagaagcggccactggggggtagagaattgcagctcccatccatgtccatgttaacctccaagacttccacacaaaaattctttctcagagtgctgcaagtgatcattcagttgcgcgatgatactcgacgcgcaaacaaaaaagcaaaacagaccgggcgattaggcagctctggactgggttcagcctcttccatccaggccgcagttaggcagttggaagcagaggcagatgctattatccagatggtccgggaaggccagcgcgctaggaggcaacaacaagctgccacctccgagagttcccagtcagaagccagtgtaagaagagaggaaagccctatggatgtcgatcagccctcaccttcggctcaggacacacagtcaattgcgagcgatggcacccctcaaggagagaaagaaaaggaagaacggccacctgagttacccctgctcagtgaacagctttcattggatgaattatgggatatgctgggcgaatgtttgaaggagctggaggagtcccatgatcagcatgccgtgctggtactgcagccagcagtggaggccttctttttagtgcatgccaccgagagagagagcaagccacccgttcgagatacacgggaatcacagctagcccatatcaaagacgaacccccacctctgtcgcccgcacctctgacccctgcaacacctagcagcctggacccgttcttcagtagggaaccctcctcaatgcatatctcctctagcctgcccccagatacgcagaagtttctaagatttgctgagacacacagaaccgttctgaaccagatccttaggcagagtaccacacacctcgccgatggacccttcgccgtgctggtggattacatacgcgtccttgatttcgacgttaaacgaaagtatttccgtcaggagctggagagactcgacgagggcctgcgaaaagaagatatggccgtgcacgtgcgcagggatcacgtgtttgaagattcttaccgggaacttcatcgaaaaagtcccgaagagatgaagaaccgcttgtatatcgtgtttgaaggggaggagggacaagatgcgggaggattactgagggagtggtatatgatcattagccgggagatgtttaaccccatgtacgctctcttcaggacctcgcctggcgatcgggtgacttacacaataaacccaagtagccattgcaatccgaatcacttgtcttacttcaagttcgtcggcaggatagtggctaaggcggtctatgacaatagactgctcgagtgttattttacaagaagcttttacaagcatatcctgggcaagagcgtaaggtatacagacatggaatccgaagactatcatttctatcaggggctggtgtatctgctcgagaacgatgtgtctacacttggctacgacctaacttttagcacggaggtgcaggaatttggggtttgcgaggtgagagatctgaaaccaaacggcgctaatatactggttactgaggagaataagaaggaatacgtccatctggtctgtcaaatgcggatgacaggagcaatccgcaaacagctagccgcttttctggagggcttctacgagattatcccaaagcggctgatttcaatttttacggagcaggaattggagcttctcattagcggccttccgacgattgatattgatgacttgaaaagcaacaccgagtatcacaaatatcagagtaactccatacagatccagtggttttggagggcactccgttcatttgaccaagccgaccgagctaagtttctgcagtttgtgacgggaaccagcaaggttccgttgcaagggttcgcagccctcgaggggatgaatggcatacagaagttccagatccatcgggacgaccgaagcacggaccggctcccatccgcccacacatgttttaatcaactcgatttacctgcctatgaaagctttgagaagcttcgccatatgctgctccttgctatccaggaatgctcagaaggcttcgggctggcctag

SEQ ID NO: 225828 - DNA, 13125 bp, Artificial Sequence
  Description of Artificial Sequence: Synthetic coding sequence
atgaaagtcgataggactaagctcaagaaaacaccgacggaggcacccgctgactgcagagctttgatagataaattgaaggtgtgtaacgacgaacagctgctcctggagttacagcagatcaaaacctggaacattgggaagtgtgaactttaccattgggtggatttgcttgaccgatttgacgggatcctggcggatgctggacagactgtcgagaatatgagctggatgcttgtctgcgatcgccctgagcgagagcaactcaagatgcttctcctggctgttctgaacttcactgcactcctcatcgagtatagctttagcagacacctgtatagcagcatagagcacctgacaacgttgctcgcgagcagtgatatgcaggtggtactggccgtattgaacttgctgtacgtattcagcaaacgcagtaattacattaccagactcggctccgataagagaacgccgcttctgactagactccaacaccttgcagaatcatggggaggcaaggagaacggtttcgggcttgctgagtgctgtagggatctacatatgatgaagtatccccctagcgccacaaccctgcacttcgaattctatgccgatcccggagcagaagtgaaaatcgagaaacgcacgacttctaacactctccattacatccacatcgagcagctcgacaagatttccgaatctccctctgaaattatggagtcgctcacgaagatgtattccatcccaaaggataagcaaatgctcctttttacgcacatcagactcgcccatggattcagcaaccaccggaaacgcctgcaagctgtccaagctcggttgcatgccattagtattcttgtttactcaaacgcactccaggaatccgctaacagcatcttgtataatggcctgattgaggagttggtggacgtcctgcagattaccgataagcagctgatggaaatcaaggccgctagtttgcgaacccttacaagtatagtgcacctcgagcgcaccccaaagctgagctccatcatcgattgcacaggaactgcatcatatcatggattccttccagttcttgtccgaaattgcatacaagccatgattgacccaagtatggacccatatcctcaccaattcgcgaccgctttgttctcattcttgtaccacctggcctcttacgacgccggtggcgaagccctggtctcatgcggtatgatggaggccctgttaaaagtgataaaattcctgggagatgagcaggaccagatcacattcgtgaccagagctgtgagagtagtcgacctcattaccaacttggatatggcagctttccagtcgcatagcgggctgtctattttcatttatcgactggagcacgaggtcgacctgtgccggaaggagtgcccctttgtcattaaacctaagatccagaggcccaataccactcaggagggagaggaaatggaaacagatatggacggggtgcagtgcataccgcagcgggctgccctgctgaagtccatgctcaattttctaaaaaaagcaatccaggatcctgcatttagcgatgggattcgacatgttatggatgggtccctgcctaccagtttgaagcatatcatctcaaacgccgagtactatggaccaagtctgttcttgctggccaccgaagtcgtcaccgtgtttgtgttccaggagccctcccttctgtcaagcctacaggataatggactgacagatgttatgctgcatgcactgctcatcaaggatgtgcccgcaacccgggaggtgctgggcagtctgcccaatgttttcagtgccctctgtcttaatgccaggggcctgcaaagctttgttcaatgtcagccattcgagagactctttaaagtgttgctgtcaccggactacctgccagcaatgcgccgtagaagatcttccgaccccctgggtgatacagccagtaacctcggatcagcggtagacgagttaatgcgccatcaacctactttaaaaactgacgctaccaccgccatcattaagttgttggaagaaatatgcaatctcggcagagacccaaagtatatctgccagaagccaagtattcagaaagctgatggcactgccacagcccctccgccaagatctaatcacgctgccgaagaggcaagtagcgaggacgaggaggaggaagaagtgcaggcaatgcagtcctttaattctacacagcagaacgaaacagaacccaaccagcaggtagtaggcacagaggaacgaatacccatacctctgatggattatatacttaatgtcatgaaattcgtggaatccattctaagcaacaacactacagacgatcactgccaggagtttgtgaatcaaaaaggcttgttacccttagtgacgatattgggattacctaacctcccaatcgatttccctacttccgccgcatgccaggccgtggctggggtttgtaagagcattcttaccctttcccatgaacccaaggtgttacaggagggccttctgcaacttgacagcattctgagctccctcgaaccgctccatcggccaatagaatcacctggaggatcagtgttgctgagggagctggcctgcgcaggcaatgtcgccgacgcgacactgtccgcgcaagcaactccactgctgcacgcacttaccgctgctcacgcctacataatgatgtttgttcacacgtgtagggtggggcagtcggagatacgaagtataagcgtcaaccagtggggcagtcaactcggcctctccgtgctttcaaaactctcacaactttattgttcattggtttgggaaagcactgtgctgctaagtctgtgtacgccaaattctctgccctccggctgcgagttcgggcaggcagatatgcaaaagcttgtcccaaaggacgagaaagcaggtacgacacaagggggaaaacggtccgatggggaacaggatggagctgctggatctatggatgcatccacacagggacttctggaggggatcgggctcgacggcgacaccctcgcacccatggagactgatgagccaaccgcttccgacagcaagggtaagtctaagatcacgcctgctatggccgctagaataaaacagattaagcctcttctctcagcatcctccagacttggaagggcactcgcagagctctttggactgctggtcaaactgtgtgtcggcagtccggtgaggcagaggcgttctcatcacgccgcttctacaacaaccgccccaactccggcagctagatccaccgctagtgctcttactaaattgcttaccaaagggctcagctggcaacccccaccctatactcctacgccacgttttaggctgaccttttttatttgttcagtcgggtttacctcgcctatgcttttcgacgaaagaaagtacccttatcacctgatgttacaaaagttcctgtgctccggcggacacaacgccctcttcgagaccttcaattgggccttgtcgatggggggtaaggttcctgtatctgagggcctcgagcatagtgatttaccagatggcaccggtgaattcctcgatgcttggctgatgttagtggagaagatggtcaaccccaccacggtgctggaatcaccacactctctccccgcaaagcttcctgggggagtccagaatttccctcagttctccgctctaagatttctagttgttacacaaaaagcagcattcacgtgcattaaaaatctttggaatcgcaagccactgaaggtttatggaggccgaatggcggaatctatgctggctatcctgtgccatattttgcgcggtgagccggtgattcgcgaacggctgtccaaggagaaagagggttcacgcggagaggaggacaccggtcaggaggagggcggaagcaggcgagaaccccaagtgaatcagcagcagctgcagcaactaatggacatggggttcacacgcgagcatgccatggaagctctgttaaatacgtccactatggagcaagccaccgagtatctgctcacccacccaccccctatcatggggggagtcgtgcgcgatctgagcatgagcgaggaagatcagatgatgagagctattgctatgtctctggggcaagacatcccaatggatcaacgtgccgagtcccccgaggaagtcgcatgtcggaaagaggaggaggagaggaaggctagggagaaacaggaggaggaggaggccaaatgtctcgaaaaattccaggatgctgatcctctagaacaggacgagctgcacacctttaccgacaccatgctgccagggtgtttccacctattagatgaattgcccgatactgtttacagagtgtgtgacctgatcatgacagccattaagcgaaatggcgctgactacagggatatgatcctgaagcaggtcgttaaccaggtgtgggaagccgcagacgtgcttatcaaagctgctctgcccttaacaacctcagacacaaagacggtctcggaatggatctcacagatggctactctcccccaggcttctaatctggccaccaggattctgttgctgacgctactcttcgaggaactgaaactgccttgcgcttgggttgtggagtccagtggcatccttaacgtcttaataaagctcttggaagtggtccagccctgcttacaggctgctaaggaacaaaaggaagtgcaaacccccaaatggatcacgcccgttctgctgcttatagatttttacgagaagactgctattagctctaagcgcagagcccagatgactaaatacctgcagtctaactcaaataactggcgttggttcgatgatagatcagggagatggtgctcttattccgcttccaataatagcaccatcgactcagcttggaaatccggcgagacttcggttcgattcacggctgggcgtcgtcggtacacggtgcaattcactacgatggtgcaggtcaatgaggaaactggcaatcgccgtcctgtgatgctgaccctgcttagagtcccacggctcaacaaaaattccaaaaatagcaatggccaggagctcgaaaagacccttgaggaaagtaaggagatggacataaagaggaaggagaataagggaaacgatactcccctggccctcgagagtaccaacacagagaaggagacctcgctagaggagaccaaaattggggaaattctgatacaggggttaacggaagacatggtgactgtcctcattcgtgcatgcgttagcatgctcggtgtccccgtagaccccgataccctacacgctacattgagactgtgcctccggctcaccagggatcataaatacgcaatgatgttcgcggaattgaaatctacgcgcatgatcctaaatcttacacaatccagtggatttaatggatttacacccctcgttacgttgctgctccggcacataattgaagacccatgcacattgcggcacaccatggagaaggtggtgcggagtgcggcaaccagcggcgctggcagcactacaagcggtgtggtttcaggatctctcggctcccgggagatcaactacatattgcgcgtcttgggacccgctgcttgcagaaacccagacatctttacagaggtggcaaactgctgcataagaattgcccttccagccccaagaggttcaggtacggctagcgatgacgagtttgagaatttgcgcattaaaggaccaaatgctgtgcagctcgtgaagaccacgccacttaagcctagtccactccccgtgatccctgacactatcaaggaagtgatttatgatatgttaaatgcattggcggcttatcatgcaccagaggaggctgataagtctgatcccaaacctggcgtgatgacccaagaagtaggccagctgttgcaggacatgggcgatgacgtctaccaacagtatcgctctctgacgaggcagtccagtgattttgacacacagtctgggttctccatcaatagccaggtgttcgctgcggacggcgcttccacggagacctcagcatccgggacctcacagggggaggccagtacaccagaagagagtcgggatgggaaaaaagataaagagggtgaccgggctagcgaggagggcaagcagaaaggcaaggggagtaaacccctcatgcctacttctactatccttcggttactcgcagaactggtccgctcctatgtaggaatcgccactctgatcgctaattacagttacaccgtcggtcagagcgaactcataaaggaggactgctccgtgctggcttttgtgctggatcatctccttccccatacccagaacgcagaggacaaggacactccggcattagctcggctgtttctcgcaagcctcgctgccgctgggtcggggactgacgctcaagtggctctggtgaatgaggtcaaggccgctctcggcagagccctggccatggctgagagtacggagaaacatgctaggctacaggccgtcatgtgcataattagtacgattatggagtcctgtccatcaacttcatccttctacagttccgccaccgcgaagacgcaacacaacggaatgaacaatattattcggctgttcctgaagaaggggctggtcaacgacctcgcccgagtgcctcactcactggacttgtcttctcctaacatggcgaataccgtaaacgcagccctaaagcctttggaaacactcagccggattgtaaatcagccgtccagcttattcggcagtaagagcgctagctccaagaataagagcgaacaggatgctcaaggggcaagccaggatagctctagtaaccagcaggacccaggtgagcccggtgaggccgaggtgcaggaagaggatcatgatgtgacacaaaccgaggtcgccgacggcgatatcatggatggagaagctgagaccgattccgtggttatcgcgggtcagcccgaggtgctctcttcacaggaaatgcaggtagaaaatgaactggaggacctcatcgatgagctgctcgaacgggacggtggctctggaaatagcacgattatcgtgtctcgatccggggaagacgagagccaggaagatgtgctcatggacgaagcaccctccaatctatcacaagcctccactctacaggctaatcgcgaggacagtatgaatatcttagaccccgaggatgaggaggaacacacccaggaggaagactctagtggttccaatgaagacgaggacgactcacaagacgaggaggaggaggaagaagaggacgaagaagacgatcaggaggacgacgagggggaagagggagatgaggatgatgacgacgacggcagcgaaatggaactggatgaggattacccagacatgaatgctagtcccttagtccgctttgaaagatttgatcgagaggacgatcttataattgaatttgacaacatgttcagtagcgccacagacatcccccctagtcctgggaacatcccaacaactcaccctctgatggtgcgacatgccgatcatagcagcctcaccctgggaagcggtagctctacaactaggctgacgcaggggattggtcggagtcaaaggaccctccgacagttgacggccaacactggccataccattcacgttcattatcccggtaataggcagcccaacccacctttgattcttcagcgcctattaggaccatctgccgctgctgacattctccaactgagtagctccctgccactacagtcccgagggagagccaggctgctggtgggcaacgatgatgtgcacatcattgcgaggagtgacgacgagctgttagatgactttttccatgaccaatcaacagctacgtctcaagcagggacactaagctccattccgaccgcacttacaaggtggaccgaagaatgtaaggtgctggacgcagagagtatgcacgattgcgttagcgttgtgaaagtttccattgtgaatcatctggagttcttaagagatgaagaactggaggagaggcgagagaagcgaagaaaacagctagcggaggaagagaccaagatcacagataaaggcaaagaagacaaagagaatagagatcagtccgcccagtgcacagcttcgaaatcaaatgatagcaccgagcagaatctgtccgacggtacccctatgcccgacagttaccccactacaccgtctagtaccgatgccgctacctctgagtcaaaggagaccctaggaaccctccagtcctcacagcaacagccaaccctaccaacaccccctgccctaggcgaagtgcctcaagaactgcagagtccagcaggggaaggtggtagcagcacccagctactgatgcctgtcgaaccggaggagctcggcccaacaaggccctctggcgaagcggagaccactcagatggagctgagtccggctcccacgatcacaagtctctctccagaaagggccgaggactcggacgctcttactgccgtcagcagccagctggagggctcacctatggatacctcaagtctagcctcgtgcacgctggaagaagctgtgggggacacgtcagccgctggatcaagcgagcagcctagagcgggtagctctacccctggggacgcaccccctgccgtggcagaagtccaagggagatctgacggatcaggagagtctgctcagccccctgaagactccagccctccagcatctagcgaaagctcctccactcgtgacagcgcagtggccatttccggcgcagatagtcgagggattctggaggagccgctgcctagcacttccagcgaagaagaggaccctctcgccggaatcagtctgcccgagggtgtcgacccaagctttcttgcagcactgcccgatgatatccggagggaggtcttgcaaaatcagctggggataaggccccctacccggaccgcgccatccacaaactcatctgccccagctgtcgtgggaaatcctggggtaacagaagtgtctcccgagttcctggccgctctgcccccagcaattcaagaggaggtgctggcccagcagcgtgctgaacagcagcggagagaactggcgcaaaatgccagttctgacacaccaatggaccctgtgacatttatacagactctgcccagcgatttaagaaggtccgtgttagaggatatggaagattccgtattagccgtcatgccccctgatatcgccgcagaggctcaggcgcttcgacgggagcaggaagcccgacagcggcagcttatgcatgagcgtctgttcggccactctagcactagcgcactgagcgccattctacgctctccagccttcacaagtcgtttgagcggcaataggggggtgcaatatacacgccttgcagttcagagaggtggcacattccagatgggaggctcttcctctcataaccgacctagcgggagcaacgtcgacacactgctcaggctcagaggaagactcctgttagatcatgaggcactctcgtgcctgctggtgttgctcttcgtggatgagccgaagctgaacacctcaaggcttcatagggtccttcggaacctctgttaccacgcccaaacgcggcattgggtcatccgttctttgttgtctatcttgcagcgctctagtgaaagcgaactttgtatagagaccccaaagttaacaaccagcgaagagaaaggaaagaaatcgtcaaagagctgcggaagctcaagccatgaaaatagaccccttgatctacttcataagatggaaagcaaaagtagcaatcaactcagttggctatctgtttctatggatgctgcgcttggctgccgaactaatatcttccaaatacaacggtctggcggacggaagcacactgaaaagcacgcctcaggaggtagtacagtgcacattcacccacaggccgcacccgtcgtgtgtaggcacgtgttggatacactgattcagctggcaaaagtatttccatcccattttacacaacagaggacaaaagaaactaactgcgagtccgaccgagagcgaggcaataaagcctgcagcccttgcagctctcaatctagttcctccggcatttgcactgatttctgggatctactcgtgaagctcgataacatgaacgtttcccggaaggggaagaatagcgtgaaatccgtgcccgtgtcagctggcggagagggagaaacttccccctacagtttggaagctagcccccttgggcagctgatgaatatgctgtcgcacccagtgataaggcgttcctctttactgacagagaaactgctacgtcttctgagtctcatttccatcgcattgcccgaaaacaaggtgagtgaagctcaagccaattctggctctggggcatcctccacgactactgccactagcacgacatctaccaccactacaactgccgcttcgaccacaccaactcctcccaccgcccctacccccgtcaccagcgcccctgcactcgtagccgctactgccatcagcaccattgtagtagcagcgtctacaaccgtgacaacccccactacagctaccaccacagtgtccattagtcccactacgaaaggaagtaagtctcccgcaaaagtttccgacggtgggtcgagctccacagacttcaaaatggtgtcatccgggctaaccgagaatcaattgcagctttctgtggaggtcctaacatcgcactcatgctcggaggagggtctggaggacgcagcaaacgtcttattgcagctgtcccggggagactctgggacacgcgataccgtgctcaagctgttattgaacggtgctcggcaccttgggtatactctgtgcaagcaaataggcaccttgctagctgagctgagggagtataatttggaacaacagagaagagcccaatgtgaaacgctgtcgccagacggcctgcctgaggagcagcctcagacaaccaagttaaagggaaagatgcaatcccgattcgacatggccgagaatgtagttatcgtcgcgagccagaagcgccctttgggaggaagggaactgcagctgcccagtatgagtatgcttacaagcaagactagtacccaaaagttttttctacgcgtcctccaggtgataatccagctccgtgatgacacgcggagagcgaataagaaagccaaacagactgggcgtctcgggagcagcgggttgggctcggcatcctccatacaagccgcagtgcggcagctagaggcagaggccgacgcaattattcagatggtcagggaggggcagagggcccgacggcagcagcaggctgccacatctgagtccagtcaaagcgaagctagcgtgcggagagaggagtcacccatggacgtagatcagccatctccctctgcgcaggacacgcagtccatcgctagcgatgggaccccccagggcgagaaggaaaaagaagagcggcctccagagctccccctccttagtgagcagttgagcttggacgagctgtgggacatgctgggagagtgccttaaggagctggaggaatcccacgaccaacacgcagtgctggtcctccagcctgctgttgaagctttttttctggtgcatgctaccgagcgggagagcaaacctcccgtgcgcgacacccgcgaatctcagctggctcacatcaaagacgagccccctccgctctccccagcaccacttacacctgctacgccttcaagcctggatcccttctttagtcgtgagcccagtagcatgcacatctcttctagtttgcctccggacactcagaaatttctccgatttgctgagacccaccgcacagtcttaaaccagatcctgagacaatcgaccacgcacctagccgacggtccgttcgcagttctggtagattatataagggttctggacttcgacgtgaagcgcaaatactttcgccaagaattggaacggcttgacgaaggactgcgaaaggaagatatggccgtgcacgtgagacgcgaccacgtgtttgaggactcctaccgcgaactacataggaagagtcccgaagagatgaaaaaccgactttatatcgtttttgagggagaagagggccaagatgctggcggactcctccgcgagtggtacatgatcatttctcgcgaaatgttcaaccctatgtacgctctattcagaaccagccctggggacagggttacgtacaccattaacccaagcagtcactgcaacccaaaccatctgtcctactttaagttcgtcggcagaatcgtcgctaaggccgtctatgataatcggcttctggagtgctactttacaaggtccttctacaaacacattcttgggaaaagtgtgagatacaccgacatggagtctgaggactatcacttctatcaggggcttgtgtaccttcttgagaacgacgtatcaaccttaggttacgacctgacttttagcactgaagtgcaagaattcggcgtgtgtgaggtgcgcgatctgaagccaaatggggctaatatcttggttactgaggaaaataaaaaagaatacgtgcacctggtgtgtcagatgcgcatgacaggtgccattcgtaaacagctggctgcctttctggaggggttctatgaaatcatccccaagaggctgatcagcatcttcactgaacaggaactggaactcctaatcagcggtctgcctactatcgatatcgacgacctgaaatccaataccgaatatcataaatatcagagtaactccatccagatacagtggttctggagagcactgcggtcatttgatcaagctgacagagcgaaattcctacagtttgtcacgggcacctccaaagtgccactccagggatttgccgctttggaggggatgaacggtatacagaagtttcagatccaccgggatgataggtccacggaccgattaccgagtgcacatacttgcttcaaccagcttgacctgcctgcctacgagagtttcgagaaactacgccacatgctactcttggccattcaggaatgttcagagggctttggcctcgcatat

SEQ ID NO: 225829 - DNA, 771 bp, Artificial Sequence
  Description of Artificial Sequence: Synthetic coding sequence
atggatccttaccctcaccagttcgctacagctctcttttcttttctatatcacctggccagttacgatgcaggtggcgaggcacttgtctcatgcggcatgatggaagccctactcaaggttatcaagtttctgggggacgagcaggaccagatcaccttcgttactcgcgctgtacgggtggtcgacttgatcactaacttggatatggccgcttttcaatcccactctggcctgagcatatttatctaccgcctagagcacgaggtcgacctttgcaggaaagagtgtcctttcgtgataaagcctaaaatccagcgaccgaatacaacacaggagggcgaggagatggagacggacatggacgtggcagacgtcgccatggaatcgtcacccggatctagcatctccatggaacaccggttagatgtggaactaagagccagcggatcttcgtcatcaaccaacatcagttctggcccttcgcccggaccatcacctggtaccggccctggtccaggccctggacctgggcctggacccggacccggacctggccctggtccaggacccggtcctggtccaggccctggtcccggtccaagaccgggagtgcagtgtatccctcagcgggcagcactcctgaagtcaatgctgaacttcctcaaaaaggcaatacaggatccagcctttagtgacgggataagacatgtgatggacggtagcttaccaacatctctgaaacacatcatctcaaacgctgagtactag

SEQ ID NO: 225830 - DNA, 687 bp, Artificial Sequence
  Description of Artificial Sequence: Synthetic coding sequence
tgagttagttgcgggatgatggaggccctactgaaagttattaagttcctgggggatgagcaagatcagatcacctttgtgactagggccgtcagagttgtagatctcatcacaaatctcgatatggccgctttccagtcacactctggcctttcaatttttatctacagactcgagcacgaagtcgacctctgtcggaaggaatgcccctttgttatcaaaccaaaaattcagcgccctaatactacacaggagggagaggagatggagactgacatggacgtggcagacgtggctatggaaagcagtcctggcagctcaatctccatggaacaccgccttgatgttgagctgagggcatcagggagttctagctcaaccaatatcagctccggcccatccccaggaccctctcctggcacgggacccggtccgggaccaggaccgggtcccggtccgggacctggccctggtccaggccctgggccaggtccaggcccaggcccagggcctggaccccgtcctggagtgcaatgtattcctcagcgggctgccctccttaaaagcatgcttaacttccttaagaaggccatccaggatcccgctttttccgacggcatcagacatgtcatggacggcagtctccccacttctctgaaacatatcattagtaacgccgagtattag

SEQ ID NO: 225831 - DNA, 3594 bp, Artificial Sequence
  Description of Artificial Sequence: Synthetic coding sequence
taacctagcggatcgaatgttgacacactcttaaggctgcgcggacgtctgttgctggaccatgaggcactctcttgccttctggtgttattatttgttgacgaaccgaagctgaacacttctcgactgcacagggtccttcggaatttgtgctatcacgcgcaaacccggcactgggtgatccgtagtttgctgtctatactgcagaggtcctctgaaagcgagctgtgtattgagactccaaaactgacaacctccgaggagaaaggcaagaagagctctaagtcttgcgggtcgtcttcccacgagaacagaccgttggatctcttacacaagatggagtccaagtcatctaaccagctgtcgtggctgtcagtgagcatggacgctgcgctgggatgccgcaccaacatttttcagattcagcgatccggcggaagaaaacataccgaaaagcacgcctcaggcggaagcaccgtccatattcacccccaggcggctcccgtggtgtgcagacacgtgcttgataccctgatccagctggcaaaggtgttcccctcacactttacacaacagagaacaaaagagaccaattgtgaatccgatagggaaagaggaaacaaggcctgttccccatgttcttcacaaagttcctccagcgggatttgtactgacttttgggaccttctggtaaagcttgacaatatgaacgtgtctaggaagggcaaaaactccgtgaagtccgtccccgtatcggcaggcggagaaggggagacatccccttactcactcgaagcatctccacttggccagcttatgaatatgttatcccatcctgtgatcagacggagttctttgctgaccgaaaagttattacgccttttaagcctgatctcgatcgctctgccagaaaataaggtttcagaggcccaggccaattccggcagtggggctagcagtacaacaacagccacgtccaccaccagtacaactaccaccacagctgcctcaacgacaccaacaccgcctacggccccaactcctgtgacctcagcacccgctctggtggccgcaacagctataagtaccatagtagttgctgcttctactacagttaccacccctactaccgcaacgaccaccgtgagcatctcccctaccaccaaaggcagtaaatcccccgctaaggtgtctgatggaggctctagcagcaccgacttcaaaatggtgtcttctgggctgactgagaaccagctgcaactgtccgtggaggtgctgacgagccactcctgttccgaggaagggctggaggacgctgccaacgtcctgttacagttgagccgcggtgactccggaacccgcgataccgtgctgaagttactgctcaacggagctcgccacctcgggtataccctttgcaaacagattggcacactactcgcagaactcagggaatacaatctggagcagcagcgacgagcccagtgtgaaaccttgtctcctgacgggctccccgaggaacagcctcagaccaccaagttgaaagggaagatgcagtctagatttgacatggccgagaatgtagttatagttgcttcccagaaacgtccattaggaggcagggagttgcagttaccgtcaatgtcaatgttgacttctaaaacaagcactcagaagttctttctccgtgtattgcaagtaattatccagctgagggatgatacccggagagcaaataaaaaggctaagcagacgggccgtctcggaagttctggcctagggtctgcctcgagcattcaggccgctgttcggcagctggaagctgaagctgatgcaatcatacagatgagcgagtccagccagagcgaggcctccgtgaggagagaggagtcccctatggatgttgatcagcctagcccgtcagcccaggacacacagagtatcgcatcagatggcacgccccagggagagaaggagaaagaggaacgtccaccggaactgcccctgctgtctgagcagctctccttggatgagctgtgggatatgctgggggaatgtctgaaagagctagaagaatcccacgaccaacacgccgttctcgttcttcaacccgcagtcgaggctttttttttggtccacgccactgaaagggagtcaaagcctccagttcgagacacacgcgagtctcagcttgcacacataaaggatgaaccccctcccctttcaccagcccctctcacacccgctacaccctccagcctggacccatttttcagtagggagccatcttccatgcacatttcctcttcactgcccccagatacacagaaattcctccggttcgccgagacccatcggactgtgctgaaccagatattacgccagagtacaactcaccttgcagacggacccttcgccgttcttgtcgactacattcgagtcttggacttcgatgtgaaacgcaaatattttcgccaggagctggagaggctggacgaaggcttgcgcaaggaagatatggccgtacacgtaagaagggatcacgtgtttgaagactcttatcgagaactccatcgcaagtctccggaagaaatgaaaaatcggctgtatattgtcttcgaaggcgaagaaggacaagacgcgggaggactgctgagagagtggtatatgatcattagcagagagatgtttaatcctatgtacgcactgttcaggacttcccctggagacagagtcacctacactatcaacccttcatcacactgcaaccctaaccatctgagctacttcaagttcgtcggtagaatcgtggccaaagctgtctacgacaatcgcttacttgaatgttactttacccgtagtttttacaagcacattctgggaaagtccgtgcgttataccgatatggagagcgaagactatcacttctatcaggggctcgtatatctcctggagaatgatgtcagcaccttaggctatgacctgactttctccaccgaggtgcaggagttcggagtctgtgaagtcagggacttaaaacccaatggcgctaacatcctcgttactgaagagaacaaaaaagaatacgtgcatctggtatgccaaatgaggatgaccggcgctatccgaaagcagctggctgcctttctcgagggcttttacgagatcattcccaaacggttgatctcgatctttacagagcaagaactggagctgctcatctcgggcttacccaccatcgatattgacgaccttaagagcaataccgagtaccacaaataccagtccaacagtatacaaatccagtggttttggagagccttgagatcttttgaccaggccgatcgcgctaagttcctgcaatttgttactggaaccagtaaggtccctttgcaagggttcgctgcgctcgaagggatgaacggtatccagaagttccagatccatagagatgatagatcaactgaccgcctgcctagcgcccacacatgcttcaaccagttggacttgcccgcttacgaatcttttgaaaaactgagacacatgctgctgttggccatccaggaatgtagcgagggtttcgggctcgcttag

SEQ ID NO: 225832 - DNA, 10226 bp, Artificial Sequence
  Description of Artificial Sequence: Synthetic coding sequence
taatcccttccgtccggatgtgagttcggacaggctgatatgcagaaattggtaccgaaagacgaaaaagcagacggtgaacaagacggggctgccggttcaatggacgcatctacacaaggcttgctcgaggggatcggcctcgatggagacacactggccccaatggaaacggacgagccaacagcctccgactcgaaggggaaatccaaaatcactcccgcaatggccgctaggatcaagcagatcaaacccctcctaagcgccagttctagactgggtcgagcactcgccgaactttttggcctgctggttaagctgtgtgtcggatcacccgtgcgccaacggcgttctcaccatgctgcttcgacgaccactgcccctacgcccgctgcccgaagtacagctagcgctctcacaaaactgctgaccaaggggctgtcttggcagcctcccccttacaccccgactccccgtttcagattaaccttcttcatctgtagcgtaggctttaccagtccaatgctcttcgatgaacggaagtacccgtatcacctgatgctgcagaagttcctgtgcagcggtggccataatgcacttttcgaaacttttaattgggccttgagcatgggcggaaaagtcccagtgtcagaggggctcgagcactctgatttacccgacggcaccggcgaattcttagatgcttggctcatgctggtcgaaaaaatggttaacccaacaactgtactggaaagccctcactcactgcccgctaaactccctggcggtgtccaaaatttccctcagttttcagcactgagattcctggtggtaacacagaaagcagccttcacttgcataaagaatctctggaacaggaagccactcaaggtgtacggagggcgaatggcagaatccatgctcgctatcctttgccatattttaagaggggagcctgtaatccgagagaggctgtctaaagaaaaagaaggatccaggggggaagaagacacaggtcaggaagaaggaggttcgcggagagagccccaggttaatcagcagcagctccagcagttaatggacatggggtttacacgtgagcatgctatggaggctcttctcaacacatctactatggagcaggcgacagaatacctgctgacgcaccctccgccaatcatgggcggagttgttagggatctaagtatgagtgaggaagaccagatgatgcgggctattgctatgtccttgggtcaggatatccctatggatcagagagccgaatcacctgaggaagtagcatgccgaaaggaggaagaggaaagaaaggctcgcgagaagcaggaagaggaggaggctaaatgcctggaaaagtttcaggatgccgatcccttggaacaggacgagctgcatacttttaccgacaccatgctccctggatgtttccatctgcttgacgaactcccagacaccgtgtatcgtgtttgcgaccttatcatgaccgctatcaagcgaaacggcgctgattatagagatatgatcctgaaacaagttgttaaccaagtgtgggaagctgctgatgttttgatcaaagccgctctgccactgactacttccgataccaagacggtgagtgagtggattagtcagatggccaccttgcctcaggcctccaatctggcaactagaatcctcctacttaccctcttattcgaggagttgaagttaccctgcgcttgggtggtcgagtcttcagggattttgaatgtcctgataaaactcctggaagtggtgcaaccctgcctgcaggctgccaaggaacagaaagaggtgcaaacaccaaagtggatcacacctgtgctgctactgattgatttctacgaaaaaactgccatctcgtctaagcggagggcccagatgacaaagtacctgcagtccaacagcaacaactggcggtggttcgacgacaggagtggtcggtggtgttcttattcggcttcaaacaactccacaattgacagcgcctggaagtctggagaaacgtccgtcaggttcacagccggtcgcagacgatataccgtacagtttacgacaatggttcaggtaaatgaagagaccggcaacagaaggcccgtgatgctcaccctgttgagagtgcctcgactgaacaaaaattcaaaaaactctaacggacaggagctggaaaaaaccctcgaggagtccaaggaaatggacatcaagaggaaagagaataagggtaatgatactcccctggcgctggaatccaccaacaccgaaaaagaaacaagcttagaagaaactaaaatcggggagatcttgatacaggggttaaccgaggacatggttactgtcctgattcgggcttgcgtcagtatgttaggcgttcctgtggatcctgatactctgcatgcaaccctccggctctgcctgcgactgacgagagaccacaaatacgctatgatgtttgccgagctcaaatctacccggatgatcctgaacttaacacagtcttccggattcaatgggtttacccctctagtgactctgctgcttaggcacataatagaggacccatgtaccctgagacatacaatggagaaagtcgtccgttccgccgctacatccggcgcaggcagtacgacgagcggcgtggtgtctggcagtctcggatcccgagagatcaactatatcctgcgcgtgctgggtcctgctgcttgtagaaaccccgatatttttacagaagtggccaactgctgtatacggattgcattaccagcccctagagggtctggtaccgcgtcagacgacgaattcgaaaacttgaggatcaaggggccaaatgccgtgcaattagttaaaactacaccccttaaaccctcaccattgccggtaatccctgatactattaaggaggtgatctatgatatgctgaatgccctggctgcctaccacgccccagaggaggcagacaagagcgatcccaagcccggagtgatgacgcaggaagtcggccagctgctccaggacatgggcgatgatgtctaccagcaatatcggtctctgactcgccagagtagcgactttgacacacaaagtgggttctcaatcaattcccaggtgttcgctgctgatggcgcaagtaccgagacctcggcctcgggaactagtcagggcgaggctagcacaccagaagaatccagggacgggaagaaggacaaggagggtgatagggcctccgaagaggggaagcaaaaaggcaaagggtctaagcccttgatgcctaccagtacgatcctgaggttactggcagagctggtgagatcatatgtgggcatcgctacgctgatagccaattacagctacacggtcgggcagtccgaactgattaaagaggactgctctgtactcgcatttgtcttagatcacctcctgcctcacacccaaaatgccgaggacaaggacacgcctgccctggctcggttgttccttgcttcactggcagcggctggctccggcaccgacgcacaagttgccctggtcaacgaagtaaaggccgcattaggtcgggcactggcaatggctgagtctaccgaaaaacatgcacgtctccaggccgtgatgtgcattattagcacgattatggagagttgcccgagcacctcatccttttattcctccgcaaccgcgaagacccagcacaacggcatgaacaatatcatcaggctgtttctgaagaaggggttggtcaatgatttagcgagagtcccccattcgctggacctgtcctcccccaacatggccaacaccgtcaatgccgcactaaagccactggaaaccctgtcaaggattgttaatcagccttccagcctcttcggctcaaagtccgcctccagcaagaacaaaagtgaacaggatgcccagggagcaagtcaggacagcagttctaatcagcaagatccaggagaaccaggagaagccgaggtacaggaggaggaccacgatgtcactcagacagaagtagccgacggcgacattatggatggagaggctgaaaccgatagcgtggtgatcgccggacagccggaggtcttgagttcccaggaaatgcaagtagaaaacgagctggaggatctgattgacgaactcctggagcgcgacggcggatctggaaactccactatcattgtgagcaggagtggagaagacgagtctcaggaggatgtgctgatggatgaggctccatcaaatctcagccaggcctctaccctgcaggccaatagagaagattctatgaatattctcgatcctgaggacgaggaagaacacactcaagaggaggattcctctggctcgaacgaggacgaggacgattcacaagatgaagaagaggaggaggaagaagacgaggaggacgatcaagaggacgacgagggggaagaaggcgacgaggacgatgacgatgatggatctgagatggaattagacgaggactatcccgacatgaatgccagcccgctggtgcgttttgaacgctttgaccgcgaggatgacctaattattgagtttgacaatatgttttcatccgcgacagacatacctccaagcccagggaatattcctacaacacacccgctaatggtgaggcacgctgaccattcatccctgacgctgggctccgggtcgtccacaacacgcctcacccaaggcatcggcaggtctcagcggacactgagacagcttactgctaatacaggtcataccatacacgtgcattatccaggaaaccgtcaacctaatcctcccctgattcttcagaggctcctcggaccatcagccgctgcagacatcttgcagcttagcagttctctaccgctccagtccaggggcagagccaggctcctggtcgggaatgacgacgttcacataatagcgagaagtgacgatgagctactggacgacttcttccatgaccaaagcacagctactagccaggctggtaccctcagcagcattccaacagccctgacacggtggacggaggaatgtaaagtgcttgacgcagaatctatgcacgactgcgtgtcagtcgtcaaagtttccatcgtgaatcacttggagttccttcgggatgaagaactcgaggagagacgagagaagaggaggaaacagctcgcggaagaagagacaaaaatcacagataaagggaaggaagataaagagaaccgagaccagagcgcccagtgtacagcctcaaaatcaaacgacagcaccgagcagaacctcagtgacgggacccctatgccggattcatatcctacgacacctagttctaccgacgccgctacatcagagtcaaaggaaacgcttgggaccctccagtccagtcagcagcagcctacgctgccaacccccccagcgctgggggaagtgcctcaggagctgcagtcccctgccggagaagggggatcgagtacccagctgctaatgcctgtggagccagaggagttgggtcctacccggccttcaggcgaggccgagaccactcaaatggaactttccccagcaccgactataacctctctgtcccctgagagggcggaggattctgacgccttgactgcggtgtcctcccagctggaggggtcaccaatggacacctcttcactcgcctcttgcactctcgaggaggctgtgggggatacctctgctgccggaagcagcgaacaaccccgtgcaggatcctctacgcccggagacgccccacccgcagtggccgaagtacagggtcggtcggatggaagtggagaaagtgcgcagcctccagaagactcaagcccacccgctagctccgaaagttcttctacgagggattcagccgtcgccatttccggggcagacagccgcggtatccttgaggaacccttgccgtcaacatcctcagaggaggaggacccgctggctggaatctccctaccagagggagtggatccttcctttctcgcagccctccctgatgatatcagacgcgaagtcctgcagaaccagctcggtatcaggcctccaacaaggaccgccccttccacaaactcttccgccccagcagtcgtaggaaacccaggcgtcacagaggtctcccccgagtttcttgcagccttgcccccagctatccaggaggaggtcctggcccagcagcgtgcagagcagcaaagacgcgagctggctcagaacgcctctagtgatacccccatggatcccgtgacattcatacaaaccttgccctcagacctgcgcaggtcagtgctggaggatatggaggattctgttttggctgtgatgcccccagacatcgcagcagaggctcaggccctgcggagagagcaggaggctcgccagcgccagttaatgcatgagcgtttgtttggtcactcatctaccagcgcactgagcgccatactccgaagcccagctttcacgagtcggctgtctggaaacaggggggtccagtacactcgactagcggtgcagcgagggggaacttttcagatgggaggtagttccagccacaatcgcccaagcggtagcaatgttgacacactactgcggcttagaggacggcttttactggatcacgaggccctttcatgtctactggttttgctgttcgtggatgaaccgaaacttaacacgagccggctgcaccgcgtgcttcgaaacctgtgctaccatgctcagactaggcattgggtcatccggtcattgctcagtattctgcagagatcttctgaatccgagctctgcatcgagacacccaagttgaccacatccgaggaaaaaggcaaaaaatcgagcaagagctgcggcagcagtagccacgaaaataggccactggacctcctgcataagatggagtcaaaatcgagtaaccagctgtcctggctgtccgtctctatggatgctgccctaggctgcagaacaaacatattccagattcagaggagcggtggacgcaaacacactgaaaagcatgcttccgggggaagcacggttcacatccatccgcaggctgcaccagtggtctgcagacatgtgttggataccctcatccagttggccaaggtgttcccctctcattttacccagcaaagaacaaaagagacaaattgcgaatctgatcgcgaacgcggtaataaagcctgttcaccctgctccagtcaatcaagctcaagcggaatctgtacagacttctgggatttgctcgtgaagctcgataacatgaatgtcagtcgaaagggaaaaaattcggtgaaaagcgtgccggtgtcggcgggaggcgagggagagactagtccatacagcttagaagcgagcccgctggggcagctgatgaatatgttgagccacccagttattcgtcgcagctccctgttaactgaaaagctgctgagactgctttctctgatttcgatcgcactgcctgagaataaggtttcagaggcgcaggctaacagtggatccggtgcctcctctactacaaccgccaccagcacaacctcaactaccacgacgactgccgcatcaactacgcccacccctcctacagcccctacccctgtcacgtcagcccctgccctggtagcggcaaccgctatatctacaattgtcgttgcggcatctaccactgtgacgactcccactaccgctacaaccaccgtttccatttccccgactacaaagggctccaagagcccagccaaggtatctgacgggggtagtagctctacggacttcaaaatggtgagtagcggattgactgaaaatcagctgcagctgagcgtggaagttctgaccagtcacagctgttctgaagaggggctggaggacgccgctaacgtgctactgcagctgagtcgcggagactccggaacacgcgatacagtattgaaattgctcctgaacggagcacggcatctgggctataccctctgcaaacagattgggacactgctggccgagctgcgggagtacaacctggaacagcaaagacgggctcagtgcgagaccttaagtcctgatggcttaccagaagaacagccacaaacaaccaaactgaagggaaagatgcagagccgctttgatatggcggagaatgtggtgatagtagctagtcaaaagcgtcctctgggcggtcgtgagctccagctgccctccatgagcatgctgacaagcaagacatccactcagaaattctttctcagggtactccaggttataatccagctgcgtgatgacacccgccgagcaaacaaaaaggcgaagcagactgggcgattaggctcttcgggcctgggctccgcaagctccatccaggccgctgtgcggcaactagaagctgaggccgacgcaatcattcagatggttagagagggacagcgcgcaaggcgccagcagcaggcggctacctccgagtcctcacagagcgaggcctcagtgagacgcgaggagtctcctatggatgtcgatcagcccagcccaagtgcccaggatactcagtccatcgcctctgacggcacaccacagggtgaaaaagagaaagaggagcggcctcccgaactgcctctcctctcagaacagctcagcctggacgaactgtgggacatgcttggagagtgcctgaaagagctcgaagaaagtcacgaccagcacgccgtgttggtattgcagcctgctgtcgaagcttttttcctcgtgcacgctaccgagagggagagtaaacctccggtgcgtgacactagggagtctcagctggctcatatcaaagatgagccgccacctctgagccctgccccactcacaccagccacccccagtagcctggatccctttttctcacgggagccttcctctatgcacatcagctcgagccttcctcctgatactcagaaatttctgaggttcgctgagacccatcggaccgtgctaaatcagatactgcgccagagcaccacccacctcgccgatggcccatttgccgtgctcgtagattatatcagggtgctggattttgacgtcaagaggaagtatttccggcaagagctcgagcggctcgatgaagggctccggaaggaagatatggctgtacatgtacgtcgagaccacgtcttcgaagacagctatagagagctacaccgtaagagccctgaagaaatgaaaaatcgactgtatatagtgtttgagggagaggagggacaggatgcaggcggtctccttcgggaatggtacatgattatatctcgcgagatgtttaaccctatgtacgctctctttcggacttcaccaggggatagggttacctatactatcaacccaagcagccattgcaacccaaatcacctcagctacttcaaattcgttgggcgtattgtcgccaaagccgtgtacgataatagactgctggaatgctacttcacaagatctttctataagcacattttgggaaaatctgtgcgatatactgacatggagtctgaagattaccatttttatcagggcttggtatatctcctggagaatgatgtcagcactctggggtacgacctgaccttctccactgaggtgcaggagtttggagtctgcgaagttagagacctgaaacccaacggagccaacatcctggtcactgaagagaataagaaggaatacgtgcacttggtttgtcagatgagaatgactggcgctatccggaaacaactggccgcatttctcgagggtttctatgaaattattcctaagcgcctgatttccattttcacagagcaggagctggaactactgatcagcggtctgcccactatcgatatagacgatctcaaatcaaacacagagtaccacaaataccaaagtaactctattcagatccagtggttctggcgcgctctgcgctcatttgaccaagcagatcgggcaaagttcctgcagtttgtcacaggcacaagtaaggtgcctctccaggggttcgccgctctagaggggatgaatggcatccagaagttccagatacacagagatgacaggtcaactgaccgattgccaagcgcacatacctgcttcaatcaactggacctgccagcatacgagagcttcgagaaactgaggcacatgctgctgttggctattcaggagtgctccgaaggctttggactggccta

SEQ ID NO: 225833 - DNA, 651 bp, Artificial Sequence
  Description of Artificial Sequence: Synthetic coding sequence
atgaaagtggatcgcacgaagctgaaaaagactccaaccgaggcaccagccgattgccgggcactcatagataaactaaaggtgtgcaacgacgagcagctgctgcttgagctgcagcaaatcaaaacatggaacataggaaagtgtgaactctaccactgggtcgacctgctggataggtttgatggcatcctcgcggatgcagggcaaactgtggagaacatgtcctggatgctggtctgcgacaggccagagcgggaacagctgaagatgttactgctggccgtgttgaacttcaccgccctacttattgaatactctttctccagacacctgtactctagcatcgagcacttgaccacgctgttagcgagtagcgatatgcaggtagtgcttgccgtgcttaacctactgtacgtcttttctaaacgatccaactacataacacggctcggcagtgacaaaaggacacccctgctgaccaggctgcagcatctcgccgagtcctgggggggaaaagaaaacggctttggcctcgctgaatgctgccgcgatctccacatgatgaaatacccaccttcagctacaaccttgcatttcgagttctacgccgatcctggcgcagaagttaaaatcgagaaacgcaaatag

SEQ ID NO: 225834 - DNA, 282 bp, Artificial Sequence
  Description of Artificial Sequence: Synthetic coding sequence
atgaaagtcgaccgcaccaagctcaaaaaaacaccaaccgaagccccagccgactgccgggctttgatcgataaactgaaggtctgcaatgacgaacagttgcttctcgaactgcagcagattaagacctggaacatcggaaagtgcgaactgtatcattgggtagatttacttgatcggtttgacggaatcctggccgatgctggccagaccgtcgagaatatgagctggatgctggtttgcgatcggccagaaagagagcagctgaagatgttgttatag

SEQ ID NO: 225835 - DNA, 1482 bp, Artificial Sequence
  Description of Artificial Sequence: Synthetic coding sequence
atgctgccgagatgggaattagctctgtatcttttagcatctctaggattccacttctactctttctatgaagtctacaaggtgtcacgagaacatgaggaggaactcgatcaggagttcgaactggaaaccgacaccttatttggaggattaaaaaaagatgccactgattttgaatggagcttctggatggagtggggaaaacaatggctggtttggctactgctcggtcatatggtcgtgagccagatggccacgcttttggctagaaaacatcggccatggatccttatgctgtatgggatgtgggcctgctggtgcgtgttaggcactccgggagtcgccatggtcctgctgcataccacgattagtttctgcgtcgcccagtttcgctcccaactgcttacttggctttgcagcctgctgctactgagtaccctccggctccagggagtcgaggaggtaaaacggaggtggtacaagacagagaacgaatactatctgttgcaattcaccctcacagtgcggtgtctgtactatacctctttttcgcttgaactctgttggcagcaattaccagcggcatcgaccagttattcttttccttggatgttagcgtatgtgttctactatcccgtcctccacaacggacccatcctgtctttctcagagttcatcaagcagatgcaacagcaggaacacgattccctgaaggccagtctgtgtgtcttagcactgggccttggacggctgctctgttggtggtggctggcagagctgatggctcacttaatgtacatgcatgctatttactcttctattcctctgcttgaaaccgtgtcctgttggacattaggtggactggctctggcacaggtgctatttttctatgtgaagtaccttgtcctatttggggtacccgctttgctcatgaggcttgatggcctgacaccgccagccctgcctcgttgcgtatctactatgttttcattcactggcatgtggcgatacttcgacgtgggattgcataactttttgatccgctatgtctatattccggttggtgggtcccagcatggtcttctcgggacacttttcagtactgccatgaccttcgcattcgtgtcttattggcatggtggatatgattacctgtggtgctgggctgcgctgaactggctgggcgtcaccgtggagaacggcgtgagacgtctggtagaaacaccatgcattcaggacagccttgccaggtatttcagtccccaagcaagacggaggttccacgcagcattggcttcctgttctacatcaatgctcatcctatctaacctcgtctttttgggtggcaatgaggttggaaagacctattggaatcgtatttttatccagggatggccatgggtcaccctgtctgtgttgggatttctctattgctacagccatgtcggcatcgcatgggcccagacatatgccaccgattag

SEQ ID NO: 225836 - DNA, 1347 bp, Artificial Sequence
  Description of Artificial Sequence: Synthetic coding sequence
atgaagtttacaaaatcacccgaggatgccactgacttcgaatggagcttttggatggagtggggtaagcagtggttggtgtggctgctcttgggtcacatggttgtctcccaaatggccacactgctggctagaaagcaccgcccttggattctgatgctgtacggtatgtgggcgtgttggtgcgtgctcgggacgccaggtgtcgcaatggtgctgttgcatactacaatttccttctgtgtggctcagttccgttcccagctgctgacttggttgtgttccctcctgttgctttccacgcttagactgcaaggcgtggaggaggtcaagaggcgatggtacaagacggaaaacgaatactatctccttcagttcactctgaccgttcggtgcctttattatacttcgttttccctagaactgtgctggcagcagcttcccgctgcatctacctcttatagttttccatggatgctagcctatgtattctactatccagtactgcacaacggcccaatactgtctttctctgagttcataaagcagatgcagcagcaggaacacgactctctcaaagcaagcctctgtgtgttggcattagggttggggcgactgctgtgctggtggtggctggccgaattgatggcacacctcatgtacatgcacgctatatactccagtataccactgctggaaactgtatcatgctggaccctgggcggtctggcgctggcccaagtcttatttttttatgtcaagtacttggttctcttcggagttccagctcttctgatgaggctggatgggctcacacccccagcgctgccgaggtgcgtatcaacaatgttctctttcacagggatgtggcgctatttcgacgtgggtctgcacaactttctgattcggtatgtgtacattcccgtaggaggcagccagcatggactgctgggcacgctgttctctacagccatgactttcgcctttgtgtcctactggcatggcggatatgactatctctggtgttgggcagccctgaactggcttggggtcacggttgaaaacggggtccggcgactggtcgagaccccgtgcatacaagattcactcgcacggtatttttcaccgcaagctcgaaggagatttcatgccgcattggcgagctgcagcactagtatgctgattttaagcaatctcgtcttcttgggagggaatgaggttggtaaaacatattggaacaggatctttatacagggttggccctgggttactctctctgtgctggggttcctgtactgctactctcatgtggggatcgcttgggcacagacctacgcgactgactag

SEQ ID NO: 225837 - DNA, 552 bp, Artificial Sequence
  Description of Artificial Sequence: Synthetic coding sequence
atgaggctcgacggattaaccccaccagcactcccacggtgcgtgtcaaccatgttttctttcaccggcatgtggaggtacttcgacgtaggacttcataactttctgatcaggtacgtctatattcccgtcggagggtcccaacacggcctccttggaaccctgttctcgactgctatgacatttgccttcgttagctattggcacggcggatacgattatctgtggtgctgggctgccctgaactggctgggggtgacagtcgaaaacggcgtgcggaggctggtagaaacaccttgcatccaggactctctagccaggtacttttcaccccaggctagaaggagattccacgctgctttggccagctgttcaacatcaatgcttatcctgagcaacctcgtattcctcgggggaaacgaagtggggaagacctactggaataggatctttattcagggctggccttgggtaactctctctgtgctcggtttcctctactgttatagccatgtaggcattgcttgggctcagacttacgctacagactag

SEQ ID NO: 225838 - DNA, 1482 bp, Artificial Sequence
  Description of Artificial Sequence: Synthetic coding sequence
atgctgcctcgttgggagttagcactctacctgctggcatccttggggttccacttttacagtttctatgaagtttacaaggtgtctagggagcatgaggaggaattggatcaggaatttgaattggagactgatactctgttcggcggattgaaaaaggatgctacagatttcgagtggtccttttggatggagtgggggaagcaatggctggtttggctgctgttgggccacatggtggtgtcccagatggccacacttctggccagaaagcaccgcccatggatcctgatgctttacggaatgtgggcgtgctggtgcgttcttggcacccctggggttgctatggttttactgcacactacgatcagtttctgtgttgcccagtttcgcagtcagcttttaacatggctgtgctcgttgcttctcctgtctaccttgcggctgcagggagtcgaggaggtgaaacggcgatggtataaaactgagaacgaatactatcttctgcagtttactctgactgtgcgctgtctgtactacacgtccttttccttggagctctgctggcaacaactgcctgctgcctccacaagctacagcttcccatggatgctagcttacgtgttctactacccggttctacataatggcccaatcctcagcttttccgagttcatcaagcagatgcagcagcaggaacatgattccttaaaggcttcactctgtgtcctggcattgggccttggcagactgttgtgctggtggtggctggcagaactgatggcacatctcatgtacatgcatgccatctactcttcgatccctctgctggaaaccgtgagctgctggacgctggggggactcgcccttgctcaagtactttttttctatgttaaataccttgtcctgttcggagtccctgccctgctcatgcgccttgacggacttacaccccctgctcttcccagatgcgtctccaccatgttttccttcacagggatgtggcgatactttgacgttggactgcacaattttttgatccgttacgtctacatacccgtcggcggttcccagcacggtttgttgggaacattgttctccacagccatgacatttgccttcgtttcctattggcacgggggatatgactacctgtggtgttgggcagctctgaattggctgggagttacagtagaaaacggcgtacgtcggctggtggagacgccttgtatacaggattctctggcccgttacttttctccccaggcccgaagacggttccacgctgcactggcttcctgttccacttcaatgctgatactgtcgaacctggtcttcttaggtggcaacgaggtcggcaagacttactggaatagaatctttatccagggatggccttgggtgacactcagcgtattgggatttctttactgctacagtcatgtaggaattgcatgggcacagacctacgccaccgattag

SEQ ID NO: 225839 - DNA, 1557 bp, Artificial Sequence
  Description of Artificial Sequence: Synthetic coding sequence
atgcttccacgttgggaattagcactttacctgctcgcgtcgctgggctttcatttctattcattctacgaagtgtacaaggtgtccagagagcatgaagaagaactggatcaggagttcgagctggagacagatactctgttcggcggattaaagaaggatgctactgattttgaatggtctttttggatggagtggggcaaacagtggctcgtctggctgctgttgggtcacatggtcgtgtcccaaatggccacccttctggctcggaaacacagaccgtggattctgatgctgtatgggatgtgggcctgctggtgcgttttaggcacccccggtgtcgccatggttctccttcacactacgatatcattctgcgtagcacaattccgcagtcagcttctcacatggctctgttccctgctgctcctctctactctgcgactgcaaggtgtggaagaggtgaagaggcgctggtacaaaacagaaaacgagtactatttgttgcagtttacactgacggtgaggtgtctctactacacctccttctcacttgaactctgctggcagcagctcccagccgcttctacaagctactcattcccctggatgctggcctatgtgttttactatccggttctgcataacgggccaatcctgagttttagtgagttcatcaagcagatgcagcaacaagagcacgattctctgaaagcctctctgtgtgttctggcgctcggactgggccgtctgctctgttggtggtggctggcagaacttatggcccacttgatgtatatgcacgcaatttacagcagcatcccactgctggagaccgtttcctgttggactctcggagggctggccctggcccaggttttgttcttttacgtaaagtacctggtgctctttggcgtgccagcactcctaatgaggctggatgggctgacccctcctgccctcccccgttgtgtatcaactatgtttagcttcaccggcatgtggcggtattttgatgtaggactccacaacttcctcatccggtacgtttacatccctgtggggggatcccagcatggcctgctgggaaccctcttcagtacggcgatgacattcgcattcgttagctattggcatgggggttatgactacctatggtgctgggccgctctgaattggctgggagtgaccgtggagaacggggtccggagactcgtcgaaaccccctgtattcaggactccctggcccgttacttctccccccaggcaaggcgtcgatttcacgccgctctcgcttcctgcagcaccagcatgctgatcttgtccaacctcgtcttcctgggcggaaatgaggtggggaagacctattggaaccgaatctttatccagggtggcttatttctgtttttccttctcaacccatgctgggaaacagcatttcaaggattcccagtgtttcttcatttcctccagaccgaggtgctcgcaacatttgtcccaaactacttctcctggaacatctgcatagagaacacaagcgagctaagctcatactag

SEQ ID NO: 225840 - DNA, 1482 bp, Artificial Sequence
  Description of Artificial Sequence: Synthetic coding sequence
atgttgccaaggtgggagctggctctgtatctcctggcgtctctcggatttcatttttatagcttttacgaggtctataaagtcagcagggaacatgaggaggagctggatcaagagttcgaactagagactgacacattatttggcggtctgaaaaaagacgccaccgatttcgaatggagcttttggatggaatggggaaagcagtggctcgtctggctgctcctcggtcatatggttgtgagccagatggcaacattgcttgcaaggaagcacagaccatggatcttgatgctctacggcatgtgggcttgctggtgcgtattggggacaccaggagtggctatggtacttctgcacacaactattagcttctgcgtggcccaatttcgttctcagttgctgacatggctctgtagtctgcttctgctcagtacacttcgcctgcagggcgtagaggaagttaagcgaagatggtacaagacagaaaatgagtattatctcctacagtttaccctcactgtacggtgcctctactacacttccttcagcctggagctgtgttggcagcaactgcctgctgctagcaccagttattcttttccttggatgctagcctacgtattttactatccagtcctccacaatggtcccatactctcgttctccgagtttattaagcagatgcagcagcaggaacacgattccctgaaggcctccttgtgcgtcctcgccctcggcctcgggaggctcctgtgttggtggtggctggccgagctgatggcacacctcatgtatatgcacgctatctattctagcatccccctacttgaaactgtgtcttgctggaccctcggcggactagcgctcgcccaagtcttgttcttttacgttaagtacctagtactgtttggagtgccagcccttctgatgaggctggacggactcaccccgccagctctgcccagatgtgtgtccaccatgttcagttttacagggatgtggaggtactttgatgtaggtctgcataacttcctgattaggtacgtgtacatacctgtggggggtagccaacatggcttgcttgggaccctgttttctactgcgatgacttttgcattcgtgtcttactggcacgggggatatgattatttgtggtgttgggcggctttaaattggcttggtgtgaccgtcgaaaacggagtgcgtagactggtggaaacaccctgcatccaggactctctggcacgatacttcagcccccaggccagaagaaggtttcatgcagcactggcctcgtgcagcaccagtatgctgatcctgtcaaaccttgtgtttctgggtggaaacgaagtgggcaagacttactggaacagaatcttcatacagggttggccatgggtcactctgtccgttctcgggttcttatattgttattcccacgtcggaattgcatgggctcaaacctacgcaacggactag

SEQ ID NO: 225841 - DNA, 624 bp, Artificial Sequence
  Description of Artificial Sequence: Synthetic coding sequence
atggaatggggtaagcagtggcttgtatggctgctattagggcacatggtggtgtcacaaatggccactctgctcgccagaaaacgcaggtggtacaaaacagagaatgagtattatctgcttcagtttacactgaccgtgcgatgtctgtactacactagcttctccctggagctatgctggcagcagctgcccgctgcgtccacaagctactcctttccctggatgttggcatatgttttctattacccagttcttcacaacggccctatcctgtcatttagtgaatttattaagcaaatgcaacagcaagagcacgattcactcaaagcctccctgtgcgtgctggctctgggcctcggtcgactgctctgttggtggtggctggctgagctgatggcacacctcatgtacatgcatgctatttattcatctatccctttgcttgagactgtgtcatgctggactctcggaggcctggctttggctcaggtgctgttcttttatgtgaaatatttagtgctatttggagtgcctgcattacttatgcgcctggacgggctgaccccgcctgccttgcccaggtgcgtgtcaaccatgttcagcttcactggcatgtggtag

SEQ ID NO: 225842 - DNA, 1287 bp, Artificial Sequence
  Description of Artificial Sequence: Synthetic coding sequence
atgttgcctcgctgggaacttgccctctatttgttggccagtttgggatttcatttctacagtttctacgaagtgtacaaagtttcgcgagaacacgaagaggaactggaccaggagttcgaacttgagaccgatacgcttttcgggggactgaagaaggatgcgaccgacttcgagtggtctttttggatggaatgggggaaacagtggttggtctggctgcttctcggccacatggtcgtgagtcagatggctacacttctcgccagaaaacggagatggtacaaaaccgagaatgaatactaccttttacagttcaccctgacggttcgctgcctgtattatacatcattcagccttgagttgtgctggcagcagcttccagcggcatctacttcttactcattcccgtggatgcttgcctatgtgttctactacccagtcctgcataatggtcctattctctcattctccgaatttatcaagcagatgcagcagcaggagcacgactcattgaaagcctcactatgcgtcctggccctgggcttgggtagactgctgtgctggtggtggcttgctgaactcatggctcacttaatgtacatgcatgctatctactcttcaattcctctgttagagacggtatcttgctggactctcgggggtctggctctcgcacaggtcttatttttctatgtgaaatatctagttctctttggcgtcccagcgctactgatgagattagacgggctgacccctcccgctcttcccaggtgcgtatcaaccatgttcagctttacgggaatgtggaggtactttgacgttggcctgcataactttctgattcgatacgtctatattcctgtcggcggatcgcagcatggccttctcgggaccctgttcagcactgcaatgacatttgccttcgtgtcctactggcatggtggctacgactacctttggtgctgggcagccctgaactggttaggcgtgacagttgaaaacggagtgaggagactcgtggaaaccccgtgcatccaggactctttggcccgttattttagcccccaggccaggcgtaggttccatgccgctctagccagctgctcaacttccatgttgatactgtctaaccttgtcttcctggggggaaatgaggtgggaaaaacatattggaaccgtatcttcatccagggttggccttgggtcacattgagcgtgcttggattcctttactgctactcccacgtgggtattgcttgggcccagacatatgctacggactag

SEQ ID NO: 225843 - DNA, 1071 bp, Artificial Sequence
  Description of Artificial Sequence: Synthetic coding sequence
atgctaccaagatgggaactggccctgtatctgctggcttcactgggcttccatttttattctttttacgaggtatacaaagtgagtagagaacatgaggaggaattggaccaggagtttgagctcgagaccgacacactgttcggcggactcaaaaaagatgccactgacttcgagtggtccttctggatggaatggggaaaacaatggttggtatggctgctcctcggtcacatggtcgtgagtcagatggctacactgctggcccgaaagatgcagcagcaggagcacgattcactgaaagcttccctgtgtgtgttggcccttgggcttggcaggcttctgtgctggtggtggctggcagaactgatggcccacctcatgtatatgcatgccatctacagcagcatccctttgctggagactgtatcctgctggaccctgggaggactggccctggcgcaggtcttgttcttctacgtgaaatatttggtactgtttggcgttcccgctctgcttatgcgcctagacggtttaaccccccctgccttacccaggtgcgtcagcaccatgttctcttttactgggatgtggcgatattttgacgtcggcctccacaattttctaatacgctatgtctacatcccggtggggggttctcaacacggacttctcggaacactgttcagtacggctatgaccttcgcctttgtttcctactggcatggaggctacgactacctgtggtgctgggctgccctgaactggctgggagtaaccgtggaaaatggagtaagaaggttagttgaaacgccttgcatccaggactcactcgctcgctacttcagccctcaggcacgtcgcagatttcatgctgcactggcgtcttgttcaacatctatgctcatattgagtaacctagtctttctgggcggaaacgaagtagggaagacatattggaatcgaatcttcatacaggggtggccttgggttaccttatcggtactgggctttctttattgctactcccacgtcggaatcgcatgggcccagacctacgcaacggattag

SEQ ID NO: 225844 - DNA, 1485 bp, Artificial Sequence
  Description of Artificial Sequence: Synthetic coding sequence
atgagcctgggcctgggatcagctgagcggggagtactgggaactaggggcgctcgcgaaaggtgtcggcgtcgcagacccggacagccgggagaacacgaggaagaactggatcaggagtttgagttagaaactgatacattgtttgggggtttgaaaaaagacgcgaccgactttgagtggagtttttggatggaatgggggaagcagtggctggtgtggttattacttggacacatggtagtcagccagatggccactctcctagctagaaaacacagaccatggatcctgatgctctacggcatgtgggcctgctggtgcgtcctcggtaccccaggagtggcgatggtgttactccacacgactattagcttttgcgtggcccagtttcggtctcaactgctgacatggctgtgctcactgttactgctctcaaccctcaggctgcaaggtgtcgaagaagttaaaaggaggtggtataaaactgaaaacgagtattatctgctacaattcactctgaccgttaggtgtctttattacacgtctttttcactggaattatgttggcagcagctacctgccgcatccaccagctattcattcccatggatgcttgcctacgttttctattatcctgtcttgcataacgggcctattctgagtttctcagaattcatcaaacagatgcagcagcaggaacacgattccttgaaagcaagcctatgcgtgttggcgctcgggttaggcaggctgctatgttggtggtggctggctgagttgatggctcacctgatgtatatgcacgctatctattcttccatcccactgctggagaccgtgtcttgttggacactgggaggattggcactggctcaggtgctcttcttttacgtcaaatacctcgttctgttcggggtgcccgcacttctcatgagattggacggactgaccccgcctgctcttccccgttgtgtgtccaccatgttctcatttactggcatgtggagatactttgacgttggccttcataactttttgattcggtatgtgtatatcccagtcgggggatcccagcatggtctgctcgggacactattctctactgcaatgactttcgccttcgtttcttattggcacggagggtacgattatctatggtgctgggccgcactgaactggctgggcgttaccgtggaaaatggggtgcgtaggctagtggaaactccctgtatccaggattctttggctagatacttctcgccacaggcacgtcgccgattccatgctgctctcgcttcctgttccacatctatgctgatattgtcaaatctagtgtttctgggaggcaatgaagtaggcaagacgtactggaacagaatttttatccaggggtggccctgggtgactttatctgttttagggttcctgtattgttactcacatgtgggaatcgcttgggcacaaacatatgcaacggattag

SEQ ID NO: 225845 - DNA, 1293 bp, Artificial Sequence
  Description of Artificial Sequence: Synthetic coding sequence
atggaatggggcaaacagtggctcgtgtggctgttattaggccacatggttgtgagtcagatggccacgcttctggctcgcaaacatcgtccctggattctgatgctgtacggcatgtgggcctgttggtgcgtgctggggactcccggagtggccatggtactgttgcatacaaccattagcttctgtgtagctcagttcaggtcccagctgctaacctggctctgctccttacttctgctgagtacccttcgcctacagggcgttgaagaagtgaagcgccgatggtataagaccgaaaacgagtattatctgcttcagtttacgctgactgtaaggtgtctatactacactagctttagcttagagctgtgctggcaacagttacccgcagcttctacttcatacagcttcccttggatgctggcttacgttttctattatccagttctgcacaacggacctatcctgtctttctccgaattcattaaacaaatgcagcagcaggagcacgattcgctcaaggcttccctttgcgtgctggctttggggctcggcagactcctgtgttggtggtggttagcggagttaatggcgcaccttatgtacatgcacgccatttactctagtataccactgctggagaccgtgtcatgctggaccttaggaggcctggctctggcccaggtgctcttcttttacgtcaagtacctggttctgttcggtgtgcccgcattactgatgagactggacggacttaccccccctgccctccctcggtgtgttagtaccatgttttcattcacagggatgtggaggtattttgatgttggcttgcacaatttcctaattagatatgtttacattccagtagggggatcacagcacggtttgttgggaacccttttctccaccgcaatgaccttcgcctttgtgagctactggcacggcggatacgattacctgtggtgttgggctgctctaaactggctgggcgttacagttgaaaacggcgtgcggaggctggtcgagaccccatgcatccaggattcactggccaggtacttttctccgcaggctcgaaggaggttccacgccgcactagcttcatgctcaacttctatgctgatcctgagcaacctcgtttttctgggaggtaatgaggtggggaaaacttattggaaccgcatctttatccagggctggccatgggtgacactttctgttctcggcttcctctactgctactcacacgtgggaatcgcatgggcccagacgtacgcaacagattag

SEQ ID NO: 225846 - DNA, 2103 bp, Artificial Sequence
  Description of Artificial Sequence: Synthetic coding sequence
atgctcaagatgcttagctttaaacttctcctcctggccgtggccctgggttttttcgagggtgatgccaaattcggagaacggaacgagggatcaggagcccgtaggcggagatgcctcaatggcaacccgccaaagaggctgaagaggcgcgataggaggatgatgtcccagttagaactgttgtccgggggagagatgctgtgcgggggtttctaccctcgactgtcctgttgcctccggtccgattccccaggactgggacgtctggagaacaagatcttcagcgtgaccaataacacagaatgtggcaaactcctggaggaaatcaaatgtgctttgtgtagcccccatagccagtcgctgttccattccccagagcgagaagttctggaaagagaccttgtactgccccttctttgcaaagactattgtaaagagtttttctacacttgtcgcggacacattcccggatttctccaaactactgctgatgaattttgcttctactacgctcgcaaggacggcggactctgtttcccagattttcctagaaaacaggtgcggggtccagcgtccaactacctcgaccagatggaggaatacgacaaagtcgaagagatctcccggaaacacaagcacaattgcttttgcattcaggaagttgtgtcgggactgcgacaacccgtcggcgctctgcactcaggagacggctctcagcgcctattcattctggagaaggaaggttacgtgaagattctcacccccgaaggtgagatttttaaagaaccctaccttgacattcataagcttgtgcagtccggcatcaaaggcggtgacgagaggggcttattgagcctcgcctttcaccctaactataaaaagaatggaaagttgtacgtatcatatacaacaaaccaagagcggtgggctattggtccacatgatcatatacttcgggtggtggagtacactgtcagtcggaaaaatccacaccaggtggatctgaggactgccagagtctttctcgaggtagcagagctgcatagaaagcacttgggaggacagctcctgtttggccctgacggattcctgtacattatacttggtgatggcatgatcacactggatgatatggaggagatggacggcctgagcgattttacagggtcagtgctacggctggacgttgacaccgacatgtgtaacgtgccctacagcattcctcggtctaacccccactttaatagcaccaatcagcccccagaagtcttcgcccacggcttgcatgaccctggtaggtgtgccgttgaccggcaccctaccgatattaacatcaatcttactatcctgtgcagcgacagtaacggcaagaaccggtcaagtgcccgaatcttgcagataataaagggtaaagactatgagagcgaaccaagtctcctggagttcaaacccttctcaaacggaccattggtcggaggatttgtgtaccgtgggtgccagagcgagaggctctacggatcttacgttttcggcgaccgcaatggaaatttcctgaccctgcaacagtcccctgtgaccaagcagtggcaagagaagccactgtgcttgggaacatcaggatcatgtagaggatatttttccggccatattttgggcttcggtgaagacgagttaggggaagtgtacattctgtccagctccaaatcaatgacccagacacataatggcaagctgtacaagatcgtggaccctaagcggccactgatgccagaagagtgtagggcaactgtacagccggcacagactcttacatctgagtgttcccggttgtgccggaacgggtattgtactcccactggcaagtgttgctgtagcccaggctgggagggggatttctgtcgcacagccaagtgtgaacccgcttgtcggcatgggggagtctgcgttcgccctaataaatgcctgtgcaagaagggctacttgggaccccagtgcgaacaggtagaccggaatatccgcagggttacacgggctggcatcttagaccagatcatagacatgacatcttaccttctggacttgacaagctacattgtgtag

SEQ ID NO: 225847 - DNA, 963 bp, Artificial Sequence
  Description of Artificial Sequence: Synthetic coding sequence
atgctgaagatgctcagcttcaaactgttgctcttggctgtggcactgggattcttcgaaggggatgcaaaattcggcgaaaggaatgagggttcgggagcaagaagaagaagatgcttaaacggaaatccacccaaaaggctcaagcgccgtgacagaaggatgatgagtcagctggagctgctgtccggtggtgaaatgctgtgcggcggattctaccctaggttatcttgctgtcttaggtccgacagtcccggacttggcaggctggagaataaaattttctcggtgaccaataatacagagtgtggcaagttacttgaagaaatcaaatgtgccctgtgcagcccccactcgcagtcccttttccacagcccagaacgtgaagttctggaaagagatctagtcttgccattgttatgtaaagactattgtaaggagtttttctacacatgtcgcggacacatccccggtttcctgcaaaccacggcagatgagttctgcttctattacgcacgtaaggatggaggactgtgttttccagactttccaagaaagcaggtgcgcggacctgcaagtaactaccttgaccaaatggaggaatatgacaaggttgaggagatcagcagaaaacataagcataattgtttttgtattcaagaagtggtctcgggcctccgtcagcctgtcggtgcactgcactccggggatgggtctcagaggctgttcatcctcgagaaagaaggttatgttaaaattctgacaccagaaggtgaaatttttaaggagccgtacctggatatacacaaactggtgcagtctgggatcaaagtaggctttctgaactttatctatttctgcgcgggatacgtgaacttcattttagtcctccctagttccctgaaagtgttcctatgcaacaaaaggaaaaatctggcaggcgaaaataagggcgcaacttag

SEQ ID NO: 225848 - DNA, 4146 bp, Artificial Sequence
  Description of Artificial Sequence: Synthetic coding sequence
atggcttctccccgtgcttcacgctggcctcccccactgctcctactgttgctgcctcttctgcttctcccgcctgctgcaccgggtacccgcgacccccctccttctcctgccaggcgcgctttatccctggccccactcgccggtgcaggtctcgagctccagctggagcgtcgccctgaaagagagccacctcctacccccccaagagagaggcgcggtcccgctaccccaggcccttcgtaccgagcccctgaacccggtgcggcaacccagcggggacccagcggtagggccccacgcggtggaagcgcggacgccgcatggaagcactggcctgagagtaacacagaggcacatgtagagaacatcacattctatcagaaccaggaggacttcagtaccgtctcgtctaaagagggggtaatggtgcagacgagtgggaaaagccatgcggcatccgatgcgcctgagaatttaacactcctggccgagaccgccgatgccaggggaagatcgggaagctcatctcggactaattttacaattctgccagtaggttactctctagaaatcgccactgctttgacatcccagtctggcaatcttgccagcgagagccttcacctgccgtcatcaagctcagagttcgacgaaaggattgcagcttttcagaccaagtctggcaccgcctcggagatgggcaccgagagggcgatgggactaagtgaagagtggaccgtgcacagccaagaagccacaacttccgcttggtccccctcttttttacccgcactagagatgggggaacttaccacaccatccaggaaacgcaattcgtccggtcccgatctgagctggctgcacttctatcggaccgctgcgtctagccctcttctggacctctccagcagcagcgagtctacggagaagctcaacaattcaaccggactccagtctagtagcgtttcacagacaaagaccatgcacgtggctaccgtctttaccgacgggggacctcgaactttgcggtcattgactgtctccctcggacctgtgtccaaaacagagggattccccaaagactccaggattgcaacaaccagctcttccgtgctccttagccccagcgccgtggaaagccgcaggaacagtcgagttaccgggaaccctggcgacgaagagtttatagagccaagcacagaaaacgaatttggactcacatcgctccggtggcagaacgactctcccacttttggagaacaccaactggcgtcatcctctgaggtccagaacggcagccccatgtcacagactgaaaccgtcagtaggagcgtggctcccatgcgtggtggcgaaatcacggcccattggctgctgacaaatagcacaacatcagctgatgtgaccggaagttcagcctcctaccccgagggggtgaatgcgagcgtcctcacccaattttcagactcaacagtgcagtcaggtgggtctcacacagcactgggcgatcgatcatacagtgaatctagctccacctcctcctcggaaagtctcaacagttccgccccacggggagagagaagcatcgccggaatcagttacggccaggtgcggggtactgcaatagagcagcggaccagctctgaccacaccgaccacacatacttgtcctcgaccttcaccaagggagagagggctctcctctcaattacggacaattcatcgtctagtgacatagtagagtcctcgacttcttatattaagatttccaattccagccactccgagtattcttcgtttttccatgcgcagactgaacgatcaaacattagctcttatgatggggagtacgctcaacccagcaccgagtcacctgtgctccatactagcaacctcccatcatatactccaaccataaacatgccaaatacatcagtggttttggacacagatgctgagttcgtgtctgactcctcatcctcttcgtcaagttcgtcctccagttcaagcagcggaccccctctccccctgcccagtgtgtcccagtctcaccacctgttctctagtattcttccttccactcgggcttcggttcacctgttgaagagcacctcagacgcttctaccccctggtcaagtagtccatccccgctgccagtgagcttgactactagtacatctgcgccactctccgtatcccaaacaaccctgccacaaagttcatccactccagttctgcctcgggctagggagaccccagtgacttctttccagaccagtacgatgacctcctttatgaccatgctgcacagcagccaaactgccgacctgaagagccagagcaccccccaccaggaaaaagttattacggaatccaagagtcccagcttagtttcactgcccacggaatccacaaaagcagtcactaccaacagtcccctacctccctcgctgaccgagagctccaccgaacagactttgcccgctacttctaccaacctggcccagatgtcaccgacttttactacaaccattctgaagacctctcagccactgatgaccacgcccggaactctctcttcaaccgccagtttggtgactggcccaatcgctgtgcagacaacagcaggtaagcagctctccctcacccacccggagatcctcgtcccacaaatctctacagagggcggtatcagtacagaaagaaacagagtgatagttgatgcaactacgggattgattcccttgacttccgtgcccacatcagctaaggagatgacaaccaaacttggcgtcacagccgagtacagccctgcaagccggtcactaggcacatccccgagcccacaaacaactgtggtgtccaccgccgaggacctggctcctaagtctgccacatttgccgtccagagttctacccaaagtcctacaactgtctccagctctgcttcagttaattcctgcgctgtcaacccttgtctccataacggtgagtgcgtggctgataatacctctagagggtatcactgcaggtgtccgcctagctggcaaggggacgactgcagtgtggatgtgaacgagtgtctgtctaacccttgtccgagcaccgccatgtgcaacaacacccagggctccttcatttgcaagtgtcccgtgggctaccagctcgaaaaaggcatttgcaatctcgtgcgcacctttgtcaccgagttcaaactgaagcggacttttctgaacacaaccgtggagaagcattctgatctacaagaggtggagaatgaaatcactaagacattgaatatgtgcttctccgcgcttcctagttacattcggtctaccgtgcatgcctcgcgggaatccaacgccgtggtgatctcactgcagacaacattctcactcgcatctaatgtgaccctgttcgacttggcggacagaatgcagaaatgtgttaacagctgcaagagcagtgctgaggtgtgccagctattgggatctcagaggaggattttcagggcaggaagtctgtgcaaaagaaaaagcccagaatgtgacaaggatacatccatttgcacggatttagacggcgtcgcactttgccagtgcaaatcaggatatttccagttcaataaaatggaccacagttgtcgcgcttgcgaagacgggtacagactagagaacgaaacttgcatgtcctgcccgtttggcttagggggactgaactgtgggaatccctatcagctaattacagtcgttattgctgcggctggcggaggcctgctcttaatcctcggcatcgctctaattgtgacatgctgtaggaaaaacaagaatgacatttccaagctgattttcaagagtggagacttccagatgtctccctacgctgaatatcctaaaaaccctcgcagccaggaatgggggcgagaggccattgaaatgcacgagaacggcagcaccaaaaatctgcttcagatgaccgacgtgtactattcacctactagcgttcgcaatccggagcttgagaggaacgggctgtacccggcttataccggtttgcctggatcaaggcactcttgcatctttccaggtcaatacaatccgagcttcatttccgatgagtccaggagacgggactatttctag

SEQ ID NO: 225849 - DNA, 5828 bp, Artificial Sequence
  Description of Artificial Sequence: Synthetic coding sequence
atggaagaccggagggcagaaaagagctgtgagcaagcgtgcgaaagcttgaaaagacaggactacgagatggctctgaagcattgcaccgaggccctgctgtctctcggccagtattccatggctgacttcactggaccctgccctctggagattgagagaatcaaaattgaatctttgttgtatcggatcgcttcatttcttcaactgaaaaactatgttcaagcagacgaggactgccgacatgttctcggggaagggctagccaagggagaagacgctttccgcgctgtgctttgctgtatgcagctgaaagggaagctgcaaccggtgagcacaattctcgctaagagtctgaccggggagtcactcaacgggatggtcacaaaggacttgacgaggctaaagacattgctgagcgaaactgagacagccactagcaacgcactcagcggttaccacgtggaggacctcgatgagggttcatgtaacggatggcactttagacccccaccgaggggcatcacaagctccgaagaatacaccctgtgcaagcgcttcctggagcaggggatttgtcggtatggagcacagtgcacctctgctcactcccaggaggaactggccgaatggcaaaagcgatacgcaagccgcctaattaagctgaagcaacagaatgaaaacaaacagctgagtgggtcttacatggaaaccctgattgaaaagtggatgaacagtttatccccggagaaagtgttaagcgaatgtatcgaaggagtcaaggtcgaacataatcccgacctgagcgtgaccgtaagtactaaaaagtcccaccagacctggaccttcgcactgacttgtaaacctgccaggatgctgtaccgtgttgctcttttgtatgacgcgcatcggcctcacttctccataatagcgatctccgctggagattccaccacccaagttagtcaagaggtgccagagaattgccaggaatggatcggcggaaagatggctcagaatggtctggaccattatgtgtataaagtgggcattgctttcaacaccgagatttttggaacattccgccagactatcgtgtttgatttcggtctggagcctgtcctcatgcagagagtgatgatcgatgcagccagtacagaggacctggagtacttgatgcatgccaagcagcagttagtgacaaccgcgaagaggtgggatagctcttccaagactatcatcgacttcgagcctaatgaaacaactgatctcgagaagagtctgctaatccgttaccagattccactttccgctgaccagctcttcacgcagtcagtgcttgacaagagtttgactaagtctaactatcaaagcaggctccacgatttattatacatcgaggaaattgcacagtataaggaaatttctaagttcaatctgaaagtgcagctccagatactcgcctcattcatgcttacaggcgtgtctggaggagccaaatatgctcagaacggacaattgttcgggaggtttaagctgacagaaaccttatccgaggacaccctggctgggagactcgtgatgactaaggtcaatgctgtttatttgctccctgtgccaaaacagaagctcgtgcaaacccaggggacaaaagagaaggtgtacgaggccacaatcgaagaaaaaacgaaagagtacatattcctgcgattgagcagggagtgctgtgaagagctgaaccttcgacctgactgcgacacccaagtagaattgcaatttcagctgaacaggttgcccctgtgcgagatgcactacgcgctggacagaattaaggataacggcgttctatttcccgacataagcatgacaccaaccatcccctggagccctaaccggcagtgggatgaacagcttgacccccgactgaatgctaaacaaaaggaagctgttcttgccattaccacgccgctcgccattcagttgcctcccgtgctgatcatcgggccttacggcacaggcaagacctttacgcttgcacaagccgtgaagcacatcctccagcagcaggagacaaggatactaatctgcactcactcaaattctgccgctgacctgtatataaaggattacctgcacccctatgtcgaggccggaaacccacaggccagaccactgagagtgtattttagaaatcgttgggttaagaccgtgcaccccgtggtccatcaatactgtttgatttctagcgctcatagcacgtttcagatgccgcagaaagaggatattctgaagcatcgggtggttgttgtcactctgaacacaagtcaatatctgtgtcaactggatcttgaacctgggtttttcacacatatcctgctggatgaggccgctcaggctatggaatgcgaaaccattatgcctctggcattggcaacacagaacactaggatcgtgcttgctggtgatcatatgcagttaagcccattcgtgtactccgaatttgccagggagcgcaacctgcatgtatctctgcttgaccgtttatacgagcattaccctgctgagtttccttgtcgcattctgttatgcgagaactatcggtcccacgaggcaattatcaattacacaagcgagctcttctacgagggtaaacttatggcttctggcaagcagcctgcacacaaggacttctaccccctgacattctttaccgcccgtggggaagatgttcaggagaaaaacagcaccgctttctacaataatgcagaagtctttgaagtggttgaaagagtcgaggaattgcggcgaaagtggcctgtggcttggggaaagctggacgatggcagcattggggtcgtgacaccatacgccgaccaggtatttcgcattagagccgagctgcgtaagaagaggctctccgacgtgaacgttgagcgggtgctgaatgtgcagggtaagcagttcagagtgctgtttctttccacagtccgtacgcgccatacgtgtaagcacaagcaaaccccaatcaaaaagaaagagcagttgctggaggacagcaccgaggatctggactatggcttcctaagcaactacaaacttctgaacactgccatcactagagcccaaagtctcgtagcagttgttggcgatcctatcgccctgtgcagtatcgggcgatgcagaaagttctgggaaagattcattgcactgtgccatgaaaatagtagtctgcacggtatcacatttgagcagattaaggcccagttggaggccctggaacttaagaaaacctacgtcctcaatcctctggccccagaattcatccccagggcgctgcgactgcagcactctggctccaccaacaagcagcagcagtcacccccaaagggcaaatcactgcaccacacccagaatgatcacttccagaacgacggcattgtccagccaaatcctagtgtcttaatcggcaatcccatccgggcttacacacctccaccacctctgggaccccatcctaacctcggcaaatccccatcacccgtgcaaaggatagatccccatacaggaactagcatcctgtacgtgcctgccgtatacggaggcaatgttgtgatgtctgtgcccctccctgtaccctggacggggtatcagggcagattcgcagttgacccaagaatcatcacccatcaagccgcaatggcatacaatatgaacttgctgcagacgcacggacgcggatcccccatcccctatggcctgggacatcacccacctgtgacgattggccagccacagaatcagcatcaagaaaaggatcagcacgaacagaacagaaatggaaagtcagatacaaataactctggtcccgagattaataaaatacggacaccagagaagaaacctacagaacccaagcaggtggacctggagagtaatcctcagaatcgcagccctgagtccagaccaagcgtggtgtaccccagcacgaagttccctcgcaaagacaatctgaatcccagacacatcaacctacctctccccgcaccacatgcccaatacgcaatccccaatcgacacttccatcctctgccccagcttccgagaccacccttcccaattccacagcagcataccctcctgaaccagcaacagaacaatctaccagaacaacctaaccagatccctccacagcctaatcaagtggtccagcagcagtctcaattaaatcagcaacctcaacagccgcctccccagctgtcccccgcatatcaggcaggacccaacaacgccttctttaactccgcggtcgcccacaggccccagagcccaccggcagaggcagtcattcctgaacagcagccaccaccaatgctacaggaaggacacagcccgctcagggccatagcgcaacctggcccaatcttacctagccatcttaatagctttatcgatgaaaatccctctggtctacccataggggaggctctagaccggattcacggcagcgtagctcttgagaccctcagacagcagcaggcacggtttcaacagtggtcagagcatcacgcctttctatcccaaggctcggccccatatccccaccaccatcatcctcacctgcagcatcttcctcagcctccactcggtttgcatcagccccctgtccgcgctgactggaagcttacttcgagcgcggaggatgaagttgaaaccacttactctcgtttccaggacctgattcgtgagctcagtcaccgcgaccagtcggaaacaagagaactcgccgaaatgccccctcctcagagtcgtcttctccaataccggcaggttcaatcaaggagtcctcccgcagttccctcaccccctagttcaacagatcatagttcccacttttcaaacttcaacgataacagcagggatatcgaggtggcctctaaccctgcttttccccagaggctccctccacagatatttaacagtccattctccctgccctccgaacatctcgcccctcctcccctgaaatatctcgcacccgacggggcttggacctttgccaacctgcaacagaaccacttaatgggacccggatttccttacggacttccaccccttccccatcggcctccacagaacccctttgtgcagattcagaaccatcagcatgccatcgggcaggagccctttcacccgctgtcctcccggaccgtcagttcctcctccttacccagtctggaagagtacgagccacgcggtcccggacggccactgtaccagcgccgaatttccagctcatcagtgcagccttgttccgaggaggtttcaactcctcaggattctctggcgcaatgcaaagaactgcaggaccatagcaatcaaagttcgttcaacttctctagtcctgagtcttgggttaatactaccagctctacgccctaccagaatattccctgcaacgggtcatctagaacagcacagcctcgggagctcatcgcgccacccaagaccgtgaaacctcccgaggaccaactcaaatcagagaacctggaggtgtccagcagcttcaattactctgtgctgcaacacctcggccaatttccacccctcatgccaaacaagcagattgccgagtcggcgaactcatcatctccccagagcagcgcaggaggaaagcccgcaatgtcttatgcctccgcgctcagagcgccacccaagcctcgacctcccccagaacaagcgaagaagtccagcgacccactgagccttttccaagagttgtctctgggctcgtcttctggctcgaacggcttctactcttacttcaagta

SEQ ID NO: 225850 - DNA, 1365 bp, Artificial Sequence
  Description of Artificial Sequence: Synthetic coding sequence
atggaggacaggcgggctgagaaaagttgtgagcaggcctgcgaaagccttaaacgccaggattacgagatggctcttaagcattgcaccgaagccctgctgagcctcggtcaatatagtatggccgatttcacaggcccttgccccctggagatcgagagaataaaaatcgagtccctcctgtatcgtatcgcgagcttcctgcagctgaaaaattatgtgcaggccgacgaggactgtcgccatgtactgggggagggattggccaaaggggaggatgcgtttagagcggtgctttgctgcatgcagctaaaggggaagttgcagcccgtgtctacgatcctggcaaaatcgcttacgggcgagagcctgaatggcatggtcaccaaggacttgacacggctgaagactttgctgtctgagacggaaactgcaacatcaaatgctctgagcggataccacgtggaagatctggacgagggaagttgcaatggttggcacttcaggccccctcctaggggaatcacctctagcgaggagtacaccctctgcaagcgcttcttggagcaggggatttgtcgctatggggctcaatgcactagcgcgcattctcaggaagagctggccgagtggcagaaaagatatgcatctcggttgatcaagctgaagcagcagaacgaaaacaaacaactcagcggcagctatatggagacgctcattgagaagtggatgaattctctgtcaccagaaaaagttctgtctgagtgcattgaaggcgtgaaagttgaacacaatccggatctttccgtcaccgtctctacaaagaagagtcaccagacatggaccttcgccctgacatgtaagcccgctcggatgttgtatagagttgcgctgttgtacgatgctcacagacctcatttctccatcatagctatctcagcgggtgactccaccacgcaggtctctcaggaagtgcctgaaaattgccaggagtggattggcggtaagatggcccaaaacggtttggaccactatgtctacaaagtaggcatagcattcaacaccgagatcttcggcacctttcggcagactatcgttttcgatttcggcctggagcccgtgctgatgcaacgagtgatgatagacgcggctagtacagaagacctcgaatacctaatgcacgccaagcagcagcttgtgaccactgcgaagagatgggattcaagcagtaagactattatcgatttcgagccaaatgagacaaccgatctagagaagtctctcctcatccggtatcagatcccactctcggaaaagaagaaaaagaagaagaagaaaaagaagaagaagaaaaagaaaaagtag

SEQ ID NO: 225851 - DNA, 294 bp, Artificial Sequence
  Description of Artificial Sequence: Synthetic coding sequence
atgccagcagaaagaccagctggcagtggcggatcagaagccccagcaatggtggaacagttggacaccgccgtcatcaccccggcaatgctagaggaagaagaacagctcgaagcagctggtctggagcgtgagagaaaaatgctcgaaaaggccagaatgtcatgggatagagaaagtaccgagattaggtacaggagattacagcatcttctggaaaagtcgaacatttactccaagttccttctgacaaaaatggaacagcagcagcttgaaacagtaatgaaaatttag

SEQ ID NO: 225852 - DNA, 2517 bp, Artificial Sequence
  Description of Artificial Sequence: Synthetic coding sequence
atgcctgccgagcgtccagctgggtctggcggaagcgaggcccctgcgatggtcgagcagctggataccgccgtcatcacacctgctatgttggaagaagaggaacaattggaggcagctgggctcgagagagaacgcaaaatgctggagaaggcacgcatgagctgggatagagagagcacagagattagatacagacggctccagcatcttctggaaaaatccaatatttactccaagtttttattgaccaagatggagcagcagcagctggaggagcagaagaagaaggaaaagctcgagcgaaagaaagagagcctgaaggtgaagaagggaaagaacagtattgatgctagcgaagaaaaacctgtcatgcgcaaaaaacggggacgagaggacgagtcttacaacatcagcgaagtgatgagcaaggaagagatcctgagcgtcgccaagaaaaataaaaaggagaacgaggacgagaattcgtctagtaccaatttgtgcgttgaggaccttcagaaaaataaggactccaattccatcattaaggacagactatccgagaccgtgagacagaataccaagttttttttcgacccggtgcgcaagtgtaacgggcagcccgtccctttccagcagcccaagcatttcacaggaggggtgatgcgctggtatcaagtggagggaatggaatggctgaggatgctctgggagaacggcattaacggtatcctcgccgacgagatgggattggggaagacggtgcagtgtattgccactattgctctcatgattcagagaggagtaccagggcctttcctggtgtgtggacccctgagtacgctgcctaactggatggccgagttcaagcggttcacacctgacatccctactatgctgtaccacggaacacaggaagaaaggcagaaattggtgcgaaacatttacaaacgcaaggggacgttgcagatccatcctgtggtcattacgagcttcgaaatcgcgatgagggatcggaacgctctgcagcactgttactggaagtatctaatcgtcgacgaaggacatagaatcaaaaacatgaagtgcagactgattagagagttgaaaagatttaatgccgataacaagctcctgctgacaggaaccccgttgcaaaacaatttgtccgaattgtggtcccttctcaatttcctgttacctgacgtttttgatgatctcaaaagcttcgaatcttggttcgatatcacatccctgagcgaaactgctgaagatattatcgcgaaggagcgtgagcaaaacgtgctgcacatgctccatcagattttgacaccctttttactaaggcgtctcaaatcagacgttgcattggaagttcccccaaaacgcgaagtggtggtctacgcacccctcagcaagaaacaggagattttttacaccgccatcgtcaataggactattgccaatatgtttgggtctagtgaaaaagaaactatcgagctgtcaccaactggacgcccaaagagacgaacgcggaaaagtatcaattactcaaaaattgacgacttccctaatgaactggagaaactcatcagccagattcagccagaagtggatcgcgagagagcagttgtagaggtcaacatccctgtggaaagcgaagttaatctgaaattgcagaacattatgatgttgctccgcaaatgctgtaaccacccatacctgatcgaatatcccatagatcctgtcacacaggaattcaagattgacgaggagctcgtgacgaacagcggaaagtttctgattcttgacagaatgctgccagagctcaagaaacgcggacacaaagttctcctcttctcacaaatgactagtatgttagacatattaatggactactgccatctccgcgattttaattttagtcgtctagatggcagcatgagctattcagaaagagaaaagaatatgcactccttcaacaccgaccccgaggtgttcatattcttggttagcacccgcgcaggtggattaggcatcaatctcacggccgctgatacggtcatcatctacgactcagactggaatcctcagtccgatctccaggctcaggatcggtgccataggatcggtcagaccaagcccgtcgtcgtgtaccggttagtgaccgctaacactattgaccaaaagattgtggagcgcgctgccgcaaaacgtaagctcgagaagctaatcatccacaaaaaccactttaagggaggacaatctggcctgaacttgtcgaagaattttctggatccaaaggaacttatggagctactgaagtcccgagactatgaacgcgagataaaaggaagcagagaaaaggtgatctccgacaaagacctcgagctcctcttagaccggtccgaccttattgaccaaatgaatgcttccggaccaatcaaggaaaagatggggattttcaagattctagagaactccgaggactcctctcctgaatgccttttttag

SEQ ID NO: 225853 - DNA, 2655 bp, Artificial Sequence
  Description of Artificial Sequence: Synthetic coding sequence
atgccggctgaaaggccagccggatccggcggtagcgaggctccagccatggtggagcaattagatactgctgttatcacacctgcaatgcttgaagaggaagaacagctcgaggccgctggtttggagcgcgagcggaaaatgttggaaaaggctcggatgagttgggacagggagtctaccgaaatccgatacaggcggctgcagcacctgttggaaaaatcaaatatttacagtaagttcctactgaccaagatggagcagcagcagctggaggaacagaaaaaaaaggagaaacttgagcgcaagaaggaaagcctgaaggtcaagaaagggaagaattccatcgatgcctcggaagagaagcctgtaatgcgcaagaagcggggacgggaggacgagagttacaacatcagtgaagtgatgtctaaggaggagatcctctcagtcgctaagaaaaataaaaaagagaacgaggatgagaactccagctctaccaatctgtgtgtcgaggatctccaaaaaaacaaagatagtaatagcattattaaagaccgcctgtccgaaacggtaaggcagaacactaagtttttcttcgaccctgtgcgaaagtgtaacggtcagcctgtgccgttccagcagccaaaacactttaccggaggggtgatgaggtggtaccaagtcgagggaatggagtggctgagaatgctgtgggagaacgggataaatggaatcctggctgacgagatgggactcggaaagaccgtgcagtgcatcgctacgatcgcacttatgatacaacggggtgtgccagggccttttctcgtttgtggaccactgagcaccttaccaaattggatggccgagtttaagaggttcacacctgacataccgaccatgctgtatcatggcacacaagaggagcgacagaagctcgtcagaaacatttacaagagaaaaggcaccctgcaaatacatcctgtagtcattacgagctttgagatagcaatgagagacaggaacgcattgcagcattgttactggaaataccttattgtggacgaaggacaccgcattaaaaacatgaaatgtaggctcattagggagctgaaacgttttaatgcggataacaagctcctcctgacagggaccccactccagaacaatttgtctgagctgtggagcctgctcaatttcctgctgcctgatgtctttgatgatctgaagtcctttgagtcctggttcgacatcacatctctgagcgaaactgccgaagacattattgccaaggaaagagaacagaatgtgctgcatatgctccatcaggagcgaatccctcggatgtacgtgtccgagttcactgatgaaggattctttgaggggaagttaccatcccggaaagatctgtatgatattcgtccttatgaaaatacatatctcctgaagctccacaccaacttcgagatcctcactccctttctgctgaggcgactgaaaagcgacgtcgctctagaggtcccccctaaacgagaggtcgtcgtttatgccccactctccaagaagcaggagattttttatactgctatcgtgaacagaaccatcgccaatatgttcggaagttcagaaaaggagaccattgagctgtcaccaactggccgacctaagcgtcgcacgagaaagtccattaactacagcaagattgatgattttcccaatgagctggagaagctgatatcgcagatccagcccgaggtggaccgagagagggccgtggtggaagtaaacatacccgtggagtctgaggttaatctgaagctgcagaatattatgatgctcctgagaaagtgctgtaatcacccgtatctaatcgagtatcccatcgaccccgtcacccaggaattcaagatcgatgaggagctcgtgacaaactctggtaagttcctcatcctggatcgaatgctccctgaactgaagaagcggggacacaaggtcttgctcttctcacagatgacatcaatgctggatatactgatggactactgccatctgcgcgattttaacttttcaaggctggacggctcgatgtcctactccgagagagagaagaacatgcacagctttaacacagatcctgaagtgttcatctttctggtgtcgacacgagccggagggctgggcatcaacctcaccgcagccgacacagttattatttacgattctgattggaacccacaaagcgacttacaggctcaagaccgctgtcacagaataggccagacgaagcccgtggttgtttatcgcctcgtgactgcaaatacaatagatcagaaaatagttgagcgcgctgctgctaaaaggaaactcgaaaagctgataattcataaaaatcactttaaaggtgggcagtccggcctcaacctgagcaagaattttctggaccctaaggaacttatggaactgttgaagtctcgagattacgagcgtgagatcaagggctcgcgggaaaaagtcataagtgacaaggatctcgagctgctgctggaccgaagtgacctgattgaccagatgaatgccagcggccctattaaggaaaaaatgggcatttttaaaatcctagagaactcagaggattctagccctgaatgcctcttctag

SEQ ID NO: 225854 - DNA, 390 bp, Artificial Sequence
  Description of Artificial Sequence: Synthetic coding sequence
atgcccgctgagagaccagccggaagcgggggtagcgaggcgccagctatggtggaacagctggataccgcagtgatcacccccgctatgctcgaagaggaggagcagttagaagccgcaggcctcgagagggaacgcaaaatgttggaaaaggcccgtatgtcctgggatcgggaatccacggaaatcagataccgcaggcttcagcacttgctggagaagtccaatatttatagcaagtttctgctgactaagatggagcagcaacagctcgaagagcagaagaaaaaggaaaaactcgaacggaagaaagaaagcctaaaagtaaagaagggtaagaactctatcgacgcttcagaagagaaacctggaaatttcgtctgtggatag

SEQ ID NO: 225855 - DNA, 948 bp, Artificial Sequence
  Description of Artificial Sequence: Synthetic coding sequence
atgcccgctgagcgccctgctggcagcggtgggagtgaggcccctgctatggtggagcaactagacactgccgtcattacaccagcaatgctggaggaggaggaacagctggaagcagcaggcttagagagggagcgtaaaatgctggaaaaagccaggatgagttgggacagggaatccacagagatccgatataggcggctgcagcatctgctcgagaagagcaatatttacagtaaattcctcctgacaaaaatggagcaacaacagctcgaggaacagaaaaagaaggaaaagctagagcgtaagaaagaatccctgaaagtgaagaagggcaagaacagcatagatgcaagcgaagaaaaacccgtgatgaggaagaagcggggtcgcgaggacgagagttataacatctcggaggtcatgtcaaaggaagagatcttgagtgtggccaaaaaaaataagaaagaaaacgaagatgaaaacagctcgtcaactaacctctgtgtggaagacctccagaagaacaaggactcgaacagcattatcaaagataggctgtcagaaacagtgagacagaacaccaagttcttctttgatcctgtgaggaagtgtaacggtcagcctgtgccattccagcaacctaagcacttcacagggggagtcatgcgatggtatcaggtagaaggtatggagtggctgcgaatgctgtgggaaaatgggatcaacgggatcctggcagacgagatgggcctgggtaagacagtgcagtgtatcgcgactattgccctaatgatacaacgaggggttccagggccattcttagtgtgcggcccattgtcaacactccctaattggatggcagagttcaaacgattcacaccggacattccaacaatgctgtaccacggcacacaggaggagcgccaaaagctcatctacctgtag

SEQ ID NO: 225856 - DNA, 2223 bp, Artificial Sequence
  Description of Artificial Sequence: Synthetic coding sequence
atgccagccgagaggccagccggttccggcggatcagaggcccctgccatggtggaacagctagataccgctgtcataacacccgctatgctggaggaggaggagcagcttgaagcagcaggcctcgaaagagagcgcaaaatgctagagaaggccagaatgtcgtgggaccgagagtccacggagatccgatacaggcgtcttcaacatctgctggagaaatccaacatatattccaaatttctgctgacgaagatggagcagcagcaactggaggagcagaaaaaaaaggaaaaattggagaggaaaaaggagtctctaaaagtcaaaaaaggcaagaattctattgacgcttccgaggaaaagcccgtcatgcggaagaaaaggggaagagaagacgagtcatataacatctccgaggtgatgtcgaaagaagagatcttatcagtcgcaaaaaaaaataagaaggaaaacgaggacgagaacagcagtagtactaacttgtgcgtggaggatctccagaagaataaggacagcaatagcataattaaggaccgcctctcagagaccgtacggcagaatacaaagtttttctttgatcctgtccgcaagtgcaatgggcaacctgtgcctttccagcagccaaagcattttacgggcggagtgatgcgatggtatcaagtggaaggaatggaatggctgcgcatgctgtgggagaacggaattaacggcatcctcgccgatgaaatgggcttagggaagacagtacagtgtattgccacaatcgctctgatgattcagagaggagtaccaggccctttcctggtatgtgggccactgagtacactcccaaattggatggccgaatttaaacggttcacccccgacatcccaactatgctgtatcacggaacccaggaggagcgtcagaaactcgtgaggaacatttacaaacggaaaggcaccctgcagatccaccctgtggtcataacttctttcgaaatcgcaatgcgggatcgtaacgcacttcagattctgacaccatttctgctaaggcgactgaagtcagatgtggcacttgaagttccacctaagcgggaagtcgtggtctacgctcctcttagtaagaagcaggagatcttctacactgcaatagtgaacaggaccattgctaatatgttcggaagcagcgaaaaggaaacaattgagctatccccaactgggaggcctaagcgcaggaccaggaagtcgatcaattatagcaaaatagatgattttcctaacgaattggagaaattgatctcccagatccagccagaggtggacagggaaagggctgtggtggaggtgaatattccggtggagtccgaggtcaacctgaagctacagaatattatgatgctattgcgtaaatgctgtaatcatccgtatctgatcgagtacccaatcgacccagtgacccaggaatttaagattgatgaggaactcgtcaccaatagtggtaagtttctaatccttgaccgaatgttgccagagcttaagaagaggggccataaggtccttctgttcagtcagatgactagcatgcttgacattctaatggattactgccatctgcgcgatttcaatttctcgagactcgatggaagcatgtcctacagtgagagagaaaaaaatatgcatagctttaacactgaccctgaggttttcatattcctcgtgtccacccgcgcaggtggtctcggtatcaacctgacagccgcagacacagtgatcatctatgactccgattggaatccgcagtccgatctacaggcccaggacaggtgtcaccgcatcggccagactaagccagttgtcgtttaccggctggttacagcgaacaccattgatcagaagattgtagaacgagctgccgcaaaaagaaagctggagaagctcatcatccacaaaaatcacttcaagggcggacaaagtggactgaatctctctaagaatttcctcgacccaaaggagctgatggaactgctaaaatcccgagattatgagcgagaaatcaaaggcagcagggaaaaagtgatttcggataaagacctggaattgcttttagatcgcagcgacctaatcgatcagatgaacgccagcggccctattaaggagaaaatgggaatatttaagatcctggaaaatagtgaggattcctcacctgagtgtttattttag

SEQ ID NO: 225857 - DNA, 579 bp, Artificial Sequence
  Description of Artificial Sequence: Synthetic coding sequence
atggtggaacaactagatacggccgtcatcacacctgccatgttagaggaggaggagcaattagaggcagcgggtttggagagggaacgaaaaatgctggagaaggcaaggatgagctgggatcgagaatctacagagatccgttaccgcagacttcagcacctattagagaagagtaacatttactccaagtttctgttaactaagatggagcagcagcagctagaggaacagaaaaagaaggagaagctggaacggaaaaaggagtctctgaaggtcaaaaagggtaaaaatagtatcgacgcgagcgaggagaaacccgtgatgcgaaaaaaaagaggtagagaagacgaaagttacaatatttccgaggtgatgtccaaagaagagattctctctgtagccaagaagaacaaaaaggaaaacgaggatgaaaactcatcctccacaaacctatgcgttgaagatttacaaaagaacaaggattcgaactcgatcattaaagatcgcttatcggaaactgtcagacagaacacaaagtttttcttcgaccctgtacggaagtgcaatggccaatag

SEQ ID NO: 225858 - DNA, 1461 bp, Artificial Sequence
  Description of Artificial Sequence: Synthetic coding sequence
atgtggaaatctgtcgttgggcatgacgtgtcagtctctgttgaaactcagggtgacgactgggacacagatccggacttcgttaacgatatttcagaaaaggagcaaaggtggggggctaagaccatcgaagggagtgggcgaaccgagcacattaacatccaccagttgaggaacaaggtgtccgaagagcatgacgtgctgcggaagaaggaaatggagagcgggcctaaggcttcgcatggatatggaggtaggttcggcgtggaaagagataggatggacaagtccgctgtgggccacgagtatgttgccgaggtcgagaagcatagcagtcagacagatgcagcaaaaggctttgggggtaagtacggcgttgagagagatcgcgctgacaaatctgcagtaggattcgattataaaggagaggtggaaaagcacacaagccagaaagactacagtagaggattcgggggaagatacggagtcgagaaagacaagtgggataaagcggcacttggttatgattataaaggcgagacggaaaaacacgaatctcagagagactacgccaaagggttcggcggacagtacggcattcagaaagaccgagtggataaatccgcggttgggtttaatgaaatggaggctccaactaccgcatacaagaagacgactcccatagaagcagcttcctctggaacaagaggtctgaaagccaagtttgaaagtatggcagaggagaagaggaaacgggaggaggaggagaaggcacaacaggtggccaggcggcagcaggaacgtaaagcagttaccaagcgtagtccagaagctcctcagcccgtgatcgcaatggaggagccagccgtgccggctccactgcctaagaagattagctctgaagcctggccccctgtcggcaccccccctagctccgagtccgagccagtgcgcacatcgcgggaacaccccgtgccactgctgcctatacggcaaaccctgcctgaagataacgaggaacctcctgccctgcctccgagaacgctcgagggtttacaggtggaggaggaacctgtatacgaagctgaacctgaacccgagccagagccggagcctgaacctgagaacgactatgaggacgtggaagagatggataggcacgaacaggaggacgaacctgaaggcgattacgaagaggttctggaaccggaagactcctcattctcctcagcattggctggatccagtggctgtcccgctggagccggtgccggtgccgttgctctggggataagcgctgtggccgtgtacgattatcagggagagggatccgatgagctgtcttttgacccagacgacgtgattactgacattgagatggtggatgagggatggtggagaggaaggtgccatggacattttggcctgttcccagccaactatgtgaagctgctagagtag

SEQ ID NO: 225859 - DNA, 600 bp, Artificial Sequence
  Description of Artificial Sequence: Synthetic coding sequence
atgcctaactataagctgacctactttaacatgagaggaagagccgagatcatccggtacatttttgcctatcttgacatccaatacgaagatcaccgcattgaacaggccgattggcctgaaataaagtccactctgcctttcgggaagattcccattttagaggtggacggactgacactgcaccagtctttggccatagcacgctaccttactaaaaacactgacttggctgggaacactgaaatggagcaatgccatgtcgatgccattgtggacaccctcgatgattttatgagctgcttcccttgggctgagaaaaagcaggatgtgaaagagcaaatgttcaatgaactcctcacttacaatgcccctcaccttatgcaggatctggatacataccttgggggtagagagtggcttattgggaattcagttacatgggcagacttttactgggagatctgtagcacaaccctgctcgtattcaaaccagacttgctggataatcatccgaggttagtcactcttaggaagaaggtccaagctattcctgctgtggcgaactggatcaagcgacgtccccaaacaaaactctag

SEQ ID NO: 225860 - DNA, 813 bp, Artificial Sequence
  Description of Artificial Sequence: Synthetic coding sequence
atgcagtacccccacccagggccagcagctggagcagtgggggttcccctctacgcaccaacccctcttctgcaaccagcccaccccacgcccttttacatagaagacatcctgggaaggggtcccgctgctcccacacccgctccaactctcccatcccccaatagctcattcacttctcttgtttcaccatacaggacccccgtgtatgagcctacccctattcaccccgctttcagccatcacagtgcggctgcattagccgctgcctatggtcctggcggatttgggggtcccctttacccttttcctcggacagtgaatgactacacgcacgccctgctgagacatgatcccctcggaaagccattgctgtggtctccatttctccagaggcctcttcataagcggaagggcggtcaggttagattctccaatgatcagacaattgagctagagaaaaaatttgagactcagaaatacctgtcccccccagagagaaagcgactggctaaaatgctccaactatcagagcgacaggtgaagacttggtttcagaatcgacgcgctaagtggcgccgactcaagcaggagaacccccagtccaataaaaaggaggaattagagagcctggattcttcttgtgaccaacgacaagatctgcctagcgaacagaacaagggcgcttccctggactccagccaatgcagtccaagccctgcaagccaggaggatctggagtccgaaatcagcgaagatagtgatcaggaggtggacatcgaaggggacaagtcgtactttaacgctgggtag

SEQ ID NO: 225861 - DNA, 570 bp, Artificial Sequence
  Description of Artificial Sequence: Synthetic coding sequence
atgctggggatgatcaagaacagtctcttcggatccgtggagacgtggccatggcaggtcctgtctaagggcgataaagaggaggttgcctatgaagaacgagcatgcgagggcggaaagttcgcaacagtggaagtcacagataaaccggtggacgaagctcttcgggaggcaatgccgaaagtggccaagtacgctggcggtactaatgataaaggaattgggatgggaatgaccgtaccaatatctttcgccgtgtttcctaatgaggacggtagtttgcagaaaaaacttaaggtctggtttagaatacctaaccagtttcaatccgatccgccagccccatcggataagtccgttaaaatcgaggagcgggaaggcattaccgtgtacagcatgcagtttgggggatacgcaaaagaagcagactatgtcgcacaagctacacgtctcagagcggcactcgaagggacagccacctaccgcggagatatctacttttgtacaggctacgatccgcctatgaagccttacggccgaaggaatgagatctggctgctgaaaacatag

SEQ ID NO: 225862 - DNA, 4059 bp, Artificial Sequence
  Description of Artificial Sequence: Synthetic coding sequence
atgagcaaagtgactgccccaggaagtggtcctccagcggcagcatctggtaaggagaagagaagcttcagtaaaaggttattccggagcgggagagcagggggtggaggcgcaggcggacctggcgctagcggacctgctgccccatcttccccgtcttcgccgagttcggctagatccgtggggtctttcatgtccagggtgcttaagaccttgagcactctatctcacctgagtagtgaaggagccgctcctgatcgagggggattgaggagttgtttcccacccggtccggcagccgctcccactccacctccatgtccgccaccaccagcatccccagcccctcccgcatgtgcagctgaacccgtgcctggagtagctggtttacggaaccacggcaacacgtgtttcatgaatgcaacactgcagtgtctgtcaaacaccgaactgttcgctgagtacctcgccctaggtcaataccgtgcgggtcgaccggagccaagtcctgaccccgagcagcccgctggcaggggagcacaaggacagggcgaagtgacagagcagctagcccaccttgttcgtgccctgtggacccttgagtacacaccgcagcacagtcgcgattttaagactatcgtttctaagaatgccctgcagtaccgcggtaattcacaacacgatgcacaggagttcctgctctggttgttggatcgcgtgcacgaggacctgaaccattccgtcaaacagtccgggcaaccacccctgaaacctccctcagaaacagatatgatgcccgaaggaccgagcttccctgtctgtagcactttcgttcaggagcttttccaagcacaataccgatctagcctgacttgtccccactgtcaaaaacagtccaatacctttgacccttttctatgtataagtttacctatcccgctgccacacacaagacccctgtatgtgactgttgtgtaccaggggaagtgtagccattgtatgcgaataggagtagccgtccccctatccgggaccgtggccaggctgagagaagctgtatctatggaaacaaagatcccgaccgaccaaatcgtcctgaccgagatgtactatgacggattccatcggagcttctgtgatacggatgatctggaaaccgtccacgagtctgactgtatctttgctttcgagacacccgagatctttcgtccagaggggatcctgagccagcgcggaatccatctgaacaacaaccttaaccatcttaagttcggattggattatcatcgcttgtccagcccaacccagacagccgcaaaacaaggcaaaatggattcgcccacttctagggctggctccgacaagatagtcctgctggtttgcaatcgggcatgcaccggccagcagggcaaaagatttgggctaccgtttgtgctgcatctggagaaaaccatcgcctgggatttattgcagaaggagattctggagaagatgaagtactttctccgccctacagtgtgcatccaagtgtgtcctttctccctgcgggtggtgtcagtggtgggcattacctacttacttccccaggaggagcaacccttatgtcaccctatcgtggaaagagcactgaaatcttgcggacctggtggcaccgcccacgtgaaattagtggtcgagtgggataaggaaacccgggattttctctttgtaaacaccgaggatgagtacattcccgatgccgagtccgtgcgacttcagagggagcgccatcatcaaccacagacatgtaccttgagtcaatgctttcagctttacactaaagaagagcggctggcacctgatgatgcttggagatgtccgcactgtaagcaattgcagcagggatctattactctctccctgtggacgctacctgacgttttgatcatccatctaaagaggtttaggcaagagggagaccggcgaatgaaactgcagaacatggtcaagtttccactcacaggcctggatatgacaccccatgtagtaaaaaggtcccagagtagctggagtcttccttcgcattggtcaccctggaggcgaccatacgggttgggacgggaccccgaggattatatctacgacctgtatgcagtgtgtaaccatcacggtactatgcagggcggacactacactgcttattgcaaaaactccgttgatgggttgtggtattgctttgatgacagcgatgtgcagcagctgagtgaagacgaggtgtgcacacaaaccgcgtacattctattttaccagaggagaacagccatcccaagttggtccgcaaactcttcagtggccggaagtacatcgtcttcactgtgtgagcattgggtcagccggttgcctggcagcaagccggctagcgttacctccgccgcttctagccggaggacgtcactcgcttcactcagtgaaagcgtagaaatgacaggggaaagaagtgaggatgatgggggattctccacacgcccttttgtgcggagtgtgcagcgtcaaagtctcagcagccgcagctccgtgacgtcgcccttggccgtcaatgagaactgcatgcggcctagctggtcacttagtgccaagttacagatgcgtagcaactcgccatctcgcttctccggcgattctcctatacactccagtgctagcacactggagaagataggcgaggctgccgacgataaagtgtctatctcttgcttcggttctcttcggaacctgagctcgagttaccaggaacctagcgatagccactctcgccgagagcataaggccgtaggcagggccccactggcggtcatggagggcgtttttaaagatgagagtgacacccgtcgcctcaattccagcgtagtggacacccagagtaagcacagtgctcagggcgatagactacccccacttagtgggccttttgataacaataaccagattgcttacgtcgatcagagcgattctgtggatagcagtcccgttaaggaggtaaaggccccatctcatcccggaagcctggctaaaaaacctgagagtaccaccaaaaggtcaccttcaagcaagggcacaagtgagccagagaagtctctgaggaagggcaggccggcattggcgagtcaagaatcgtccctctcctccacgagcccctcatccccgctgccggtgaaggtgagcttgaagccaagtcggtcccgcagcaaagcagactcttcgtccaggggttcagggagacactcaagtccagcacccgctcagcccaaaaaagaaagctcacccaagagccaggattccgtgagtagcccctcccctcaaaagcagaaatcagcctccgcgctcacatacactgccagctcaacctccgccaaaaaagctagtggtccagcaaccagaagtcctttccctcccggtaagtccaggactagtgatcactcactgtcgcgcgaaggcagtcgccagagcctgggaagtgaccgagccagtgctacctctacttctaagccgaactcacccagggtcagtcaggccagagcgggagaaggacggggtgccggtaagcacgtgcgcagcagctctatggctagtctgcgatccccctccacctcgattaagtctggactaaagcgcgattcaaagtcagaagataaagggctcagcttcttcaagagcgctctgagacagaaggaaaccagaaggagcacagaccttggcaaaacagccttgttaagtaagaaggctggcggatctagcgtgaaatcagtgtgtaaaaatacaggagacgacgaagctgagagaggacaccaacctccagcctctcagcagcccaacgccaacaccactggcaaagaacagctggtcactaaagatcccgcaagcgcgaagcatagcctccttagcgcaagaaagtcaaagagcagccaactggactccggagtcccatcaagtccagggggacgccagtcggctgagaaatcctctaaaaaattgtctagctcaatgcaaacttcagccaggccaagtcagaaaccacagtag

SEQ ID NO: 225863 - DNA, 951 bp, Artificial Sequence
  Description of Artificial Sequence: Synthetic coding sequence
atgagtgccgaggtggaaacttcggagggcgtggatgaatccgaaaagaagaactccggcgcactggagaaagagaaccagatgaggatggcagacctgtccgagttgttaaaggaaggcacaaaggaggcccatgaccgcgctgaaaacacccagttcgttaaggacttcctaaaggggaacatcaaaaaggaactttttaagttggccacaactgctttgtactttacatactctgcactggaggaggaaatggagaggaacaaggaccatcctgcatttgcccctctgtacttcccaatggaactccacagaaaggaagctcttactaaagatatggagtatttcttcggagaaaactgggaggaacaggtccaatgtccaaaagcagcccagaagtatgttgaaagaatacattacattgggcaaaatgaaccagagctacttgtagcgcatgcttacacacgttacatgggggatctttctgggggtcaggtcctgaaaaaggtcgcccagcgggctctaaaactgccgagtacaggagaggggacccagttttatctgttcgagaacgtggataacgctcaacagtttaagcagttatacagggccaggatgaacgccctcgatctaaacatgaaaaccaaggaacgaatcgtcgaggaagctaataaggccttcgaatacaatatgcagattttcaatgaattagaccaggcaggcagtacccttgcgagagagactctcgaggacggctttccagtccacgatgggaaaggtgacatgcgaaaatgcccattctacgcagctgaacaggacaagggggctctcgaaggatcctcttgcccttttcgtacagctatggcagtgctacgcaagccttccttacagttcattctggctgccggagtagctcttgcagctgggcttttagcttggtactacatgtag

SEQ ID NO: 225864 - DNA, 951 bp, Artificial Sequence
  Description of Artificial Sequence: Synthetic coding sequence
atgtcggccgaagtggaaacatccgagggcgttgacgaaagtgagaagaagaacagcggagccctggagaaagagaatcagatgcggatggcagacctgagcgagttactgaaagaaggcacaaaggaggcccatgatcgagccgaaaacactcagttcgttaaagattttctcaagggtaatatcaagaaggagctttttaagctggcgacaacggccctgtatttcacctactcggcgctggaagaagagatggaaagaaataaagaccaccccgcttttgccccattgtactttcctatggaacttcacagaaaagaagcactcactaaggatatggagtactttttcggcgagaattgggaggaacaggtccaatgccccaaggccgctcagaagtacgttgagcgtattcactacattggtcagaatgaaccagagctgctagtggcacacgcgtataccagatacatgggtgatctgtcaggaggacaggtgttgaaaaaagtggcacaaagagccttgaaactgccttccacaggggaaggcacacagttctacttatttgagaacgtggataacgctcaacagtttaagcaactgtacagggctaggatgaacgccctggaccttaatatgaaaaccaaggagaggattgttgaggaggccaataaagcctttgagtataatatgcaaattttcaatgaactggatcaggcaggaagcacactagccagagaaaccttggaagatgggtttccagtccatgatggcaagggcgatatgcgtaaatgccctttctatgccgcagagcaagataagggagcattggagggttccagctgcccgttcagaaccgctatggctgtacttcgcaagccaagcctgcaattcattttagccgcaggagtagccttggccgctggcttactggcctggtattatatgtag

SEQ ID NO: 225865 - DNA, 951 bp, Artificial Sequence
  Description of Artificial Sequence: Synthetic coding sequence
atgtccgcagaggtagaaaccagcgaaggagtggatgaaagtgaaaagaaaaactctggtgcccttgagaaggagaatcaaatgagaatggcggacttgagcgaactacttaaagagggaactaaggaggcccacgaccgggcagagaacacacagttcgtgaaagatttcctgaaaggaaacatcaaaaaagagttatttaagttggccacaactgcactgtattttacttactcggccctagaggaggagatggagcgcaacaaagatcatcccgcattcgcaccgctctatttcccaatggagctgcacagaaaagaggccttgaccaaagacatggaatacttttttggagaaaactgggaggaacaggtgcagtgccctaaggcagcccagaaatacgtggagcggattcactatattggacagaatgagccggagttgttggtagcccacgcctatactcggtacatgggtgacctgtccggcggtcaggtgctgaaaaaagttgcgcagcgggctctgaaactgccatcaacaggtgagggcactcaattctatttattcgaaaatgtggataacgcccagcagttcaagcagctataccgcgctcgcatgaacgctctggatctaaatatgaaaacaaaagaacgtatagtcgaggaggcaaacaaggccttcgaatacaacatgcagatctttaacgagcttgatcaggcaggctccactttggcaagagaaacgctcgaagatggctttcctgtgcacgacgggaaaggtgacatgcggaaatgccctttttatgctgctgaacaggataagggcgcactggaagggagcagctgtccctttagaactgccatggccgtcctccgcaagcctagtctgcagtttattctcgcggcaggcgtcgcgttggcagctgggctgcttgcatggtactatatgtag

SEQ ID NO: 225866 - DNA, 951 bp, Artificial Sequence
  Description of Artificial Sequence: Synthetic coding sequence
atgagcgccgaggtcgaaacctcagagggtgtggatgaatccgagaaaaaaaacagcggcgcactagagaaggagaaccagatgagaatggccgacctgagcgagctgctgaaggagggaaccaaggaggcacacgaccgagccgagaacacacagtttgtgaaagactttctaaaaggcaacattaagaaggagttgttcaaactggcgactacagcactgtacttcacttactctgcattggaggaagagatggagagaaataaagatcacccggcttttgccccactgtacttccctatggagcttcataggaaagaagccttaaccaaggacatggagtacttttttggtgagaattgggaggagcaggtgcagtgtccaaaggctgcccagaagtacgtagagcgaatacactatatcggccaaaatgagcccgaattgctggtggcgcatgcatatacccgatatatgggggacctgagcggcggtcaggtcttaaagaaagtggcccaaagagcgctaaagctcccatcaacaggcgaaggcactcagttttacttgtttgagaatgttgataatgctcaacagttcaaacagttgtatagagcccgtatgaacgcccttgatttaaacatgaagacaaaggagcgcatcgtggaagaggccaataaggctttcgagtacaacatgcaaatcttcaatgaactcgaccaggccggttccactctcgccagggagaccctcgaggacgggttccctgtccacgatgggaagggcgatatgaggaagtgccctttttatgctgccgagcaagataaaggtgcacttgagggcagctcctgtcccttcaggaccgcgatggccgtgctgagaaagccttctctacagtttattctggccgctggagtcgctcttgcggcaggactgttagcttggtactatatgtag

SEQ ID NO: 225867 - DNA, 951 bp, Artificial Sequence
  Description of Artificial Sequence: Synthetic coding sequence
atgtccgcagaagtggaaacctctgagggcgtagacgagtctgaaaagaagaactcaggcgctctcgagaaagagaaccagatgcggatggccgacctgagcgagctactgaaggagggaaccaaggaagcccatgacagggcggagaacacacagtttgtgaaagactttctgaaaggtaacatcaagaaagagctattcaagctggcaaccacggccttatacttcacatacagcgctttggaggaggaaatggaaagaaacaaagaccacccagccttcgctcccctctatttcccaatggagttacatcgcaaggaagctctgactaaagatatggagtactttttcggcgaaaactgggaagagcaggtgcagtgtcctaaagcagcccaaaaatatgtagaaagaattcattacattggccaaaacgagccggagttacttgtggctcacgcctatacccgctacatgggcgacctgtccggaggacaggtcctgaagaaggttgctcagcgagcactcaagctccccagtaccggtgaggggacacaattctatttatttgagaatgtggacaacgctcagcagtttaagcagctgtacagagctcggatgaatgctttggaccttaatatgaagacaaaggagcgcatcgtcgaagaagccaacaaggctttcgaatataatatgcagatattcaacgagctggatcaagctggcagcacgctcgctcgagagactctggaggacgggtttccggtgcatgatggaaagggcgacatgaggaaatgtcccttttacgccgcagaacaggataagggcgctcttgagggtagctcgtgtcctttccgcaccgccatggccgtgctccgcaaacccagtctccagtttattttggccgcaggggtggcgctagccgctggcttgctcgcttggtactacatgtag

SEQ ID NO: 225868 - DNA, 16907 bp, Artificial Sequence
  Description of Artificial Sequence: Synthetic coding sequence
atgatcagttgggaggtagtgcacaccgtgtttctgtttgccctcctgtactcttccttggcccaagatgcttcaccacaatcagaaatccgtgccgaagaaatccctgaaggagcctccacgttagcttttgtgtttgatgttacggggtccatgtatgatgaccttgtgcaagtcatcgaaggagcctcaaagattcttgaaacctctctgaagagacccaagagaccacttttcaactttgccctcgtgccttttcacgacccggaaattgggccagtgactataaccaccgatccaaaaaagttccagtatgagctccgggaactttacgttcagggcggtggagattgtcctgaaatgagcatcggcgctatcaagatcgccctcgagataagccttcccggtagtttcatttacgttttcactgatgcaagatcaaaagattacaggcttacacatgaggtccttcagctgatacagcagaagcagagtcaagtggtctttgtgctaacaggcgactgtgatgatagaacacacatcggctacaaagtctacgaggaaatcgcatccacaagtagtggccaggtgttccacttagacaaaaagcaggttaacgaagtattgaagtgggttgaggaggccgtacaagccagcaaagttcacctcctcagtacggaccacctggagcaagccgtgaacacttggcggattccatttgaccccagcctgaaggaagtcacagttagcctttcagggccttctccaatgatcgagatccgtaaccctctgggaaagctcattaaaaaaggttttgggcttcacgagctcctgaacatccataacagtgccaaggtggtcaacgtgaaggagcctgaggcgggaatgtggaccgtgaaaaccagctcatctggccgtcacagcgtgagaatcactggtctgtctaccattgatttccgcgcaggtttcagtcggaaacccacattggacttcaaaaagacggtatcaaggccggtacaaggcattccaacatacgtactgctgaacacaagcgggatttctacacccgctcggatcgaccttctggagctgctaagcatctcagggtctagcttaaagacaatccctgtgaaatactatccacatagaaaaccatacggaatctggaacataagtgacttcgtgcccccaaacgaagcgttttttctcaaggtcacgggttatgacaaggatgattatctgttccagagggtaagtagcgtatccttttccagtatcgtcccagacgctccaaaggttacaatgcctgagaagactccaggatattaccttcagcccggacagattccttgctccgtggactccctccttcctttcacattatccttcgtacggaacggcgtcacgctcggcgttgaccagtatctcaaagagtccgccagcgtgaatctcgacatcgcaaaggtgactctgtcggacgagggcttctacgagtgcatcgccgtatcctcagccggtacgggtagggctcagacattttttgacgttagcgagccccctcccgtaattcaagtccctaacaatgtgacggtaaccccaggggagagagccgtgctcacttgtcttatcatctcagctgtggactataatctcacttggcagcgtaatgaccgagatgttaggcttgccgagcctgccaggattcggaccctggccaacctgagcctggagctcaaaagcgtgaagttcaatgatgccggtgaataccactgtatggtttccagtgaaggcggttccagcgcagctagcgtgtttttgacggttcaagaaccgcctaaagtaaccgtgatgcccaaaaatcaatcctttacaggaggttccgaggtctccatcatgtgctctgcaaccgggtaccccaaacctaagattgcgtggaccgtaaatgacatgttcatcgtgggctctcatcgatacagaatgacgtcagacggtacgctgtttattaagaacgccgctccaaaggatgcagggatctacggctgtctcgcttcaaactcggccggaacagacaaacagaacagcacactacgatacatagaagctcccaagctcatggtggtccagtcagagctgctcgttgccctgggagacataactgtgatggaatgcaaaacttctggcatccccccaccacaagtaaaatggtttaagggcgacctggagttgagaccaagcacctttttgatcatcgaccctcttcttgggctgttaaagatccaggaaactcaggatctggatgcaggtgactacacgtgtgttgccataaatgaggccggtagggccacaggaaaaataacgcttgatgtgggctcacctcccgtctttattcaggaacccgcagatgtatcaatggaaattgggtctaacgtcacactgccctgctacgtgcaggggtaccccgaacccaccatcaaatggcgtagactcgataacatgcctatatttagtaggccattctccgtgtctagcatctctcagttaagaactggagcactgtttatcttgaatctatgggcttctgacaagggaacctatatttgcgaagctgagaatcagttcggaaaaatccagtctgaaaccactgtcacggtgacgggactggtcgctccacttatcggtatcagcccttccgtagcgaatgtgattgagggtcagcagctcacccttccatgcactctactcgctggaaacccaattcctgagcgacgatggattaagaatagtgccatgctgctgcagaatccctacatcacagtcagatcggacggaagtctgcatattgaacgggtgcaactgcaagatggaggcgaatatacctgtgtggcatctaacgtggctggaacaaataataaaactacctccgtggtggtgcatgtgctgcccacaatccagcacggacagcaaatcttgagcactatcgaggggatacccgtgacattgccctgcaaagcgtccgggaatccaaaaccaagtgtcatctggagcaagaaaggagagctcatttccacatcctctgcaaagttctcagctggtgcagatggctccctttacgttgtgtcgcctggcggagaagaatcaggggagtatgtctgtacagctaccaacacagcgggatacgctaagcgaaaagtccagttaaccgtttacgtgcggcctagggtgttcggcgatcagagaggtctgtcacaggacaagccggtagagatctccgtgctggccggtgaggaggtgactttgccttgcgaggtcaagagcctccctccacctatcattacttgggctaaagagacacagcttatctcccccttttccccccgtcatacattcctgccttccggctccatgaaaatcaccgaaacgaggacatctgactcagggatgtatctttgtgtcgcaaccaacatcgccggaaatgtcacccaggcagtgaagcttaacgtccacgttcctccaaagatacagcgtggcccaaaacacttgaaggtccaggtggggcaaagggtggacataccctgcaacgctcagggaactcctctccctgtcatcacgtggtcaaagggtggctcaacgatgctagtagacggtgaacatcatgtatctaatccagacggcaccctgtccatagaccaggctacgccgtctgatgctggcatttacacatgtgtggctactaatatcgcgggaactgacgagactgaaattacccttcatgtgcaggagcccccaaccgtagaggacctggaacctccgtataatacaacctttcaagaaagagtggcaaaccagcgcattgaattcccctgtcccgctaaaggtacccctaaacccaccataaaatggctgcacaatggcagggagctgaccggacgagagcctggaatctccattctcgaagatggtacactccttgtgatcgcctctgttacaccgtatgacaacggcgaatacatctgtgtcgccgtcaacgaggctgggacgacagaacggaagtataacctgaaggtgcacgtgccccctgtgattaaggacaaagagcaggtgaccaatgtcagtgtcctgctaaatcaactgacaaacctgttctgtgaagtagaaggaaccccttccccgatcatcatgtggtataaggacaatgtgcaggttactgaaagctcaactatccagacagttaacaatggaaaaattctgaaactatttcgcgcaacgccagaggacgcgggtagatactcctgtaaggccattaacatagccggtacatcacagaagtattttaacattgatgtactcgtcccgccaactataatcgggaccaactttcctaacgaggttagcgtggtccttaaccgggacgtggcgctggaatgtcaggtgaagggcacaccatttccagacatacattggttcaaagatggtaaacccctttttctgggagatccgaacgttgaattgttggaccgtggacaggtgctgcacctgaagaacgctaggcggaacgataagggcaggtatcagtgcactgtgtccaacgccgctgggaaacaggctaaggacattaagctgaccatctacattccccctagcatcaagggaggaaacgtaaccacagacatctcagtccttatcaattctcttattaagctcgagtgtgaaacgagggggctgcccatgcccgctataacttggtacaaggatggacagcctataatgagcagtagccaagccctttatatcgacaagggccagtatctgcatatccccagggcccaagtctcggattcagccacatacacctgtcacgtggccaatgttgcagggacagcagaaaagagttttcatgtcgacgtatatgtgcctcctatgattgaggggaatctggctactcccctgaataaacaggtggtgatagcacactccctaacactcgaatgtaaggccgctggcaacccttctccaatcctcacctggcttaaagacggcgtccccgtgaaggcaaatgacaacatcaggatcgaagcagggggtaagaagctggagatcatgtctgcccaagagattgaccgtggccagtacatatgcgttgctacaagtgtggctggcgaaaaagaaatcaagtatgaagtggacgtgttggtgccacccgctatcgaggggggtgatgagacttcctatttcatagttatggttaataatctcttggagctcgactgtcatgtgacaggcagccctcctcctacaataatgtggcttaaagacggccagctgatagacgagcgtgacggattcaaaatactacttaatgggcgtaagcttgtcatagcacaagctcaagtgtccaacacagggctgtacaggtgcatggccgctaataccgccggtgatcacaaaaaagaatttgaggttactgttcacgtgccccctacaatcaaaagctctggtctatccgagagagttgtcgtgaaatacaaacctgtggcgctgcagtgcattgctaatgggatccccaatccaagcattacatggctgaaagacgaccaacccgtgaacactgctcagggaaacctcaaaattcagtcgagcggacgagtccttcagattgccaaaactctgctggaggacgcaggtaggtacacttgcgtggctactaatgccgcaggtgaaacccagcaacacatccagctacatgtgcatgaacctccaagcctcgaggacgcaggtaagatgctaaatgaaactgtgcttgtgagcaaccccgtccagctggagtgtaaagcagcagggaatcccgtgccggttatcacgtggtataaggataatcgactccttagcggctctacctcgatgactttcctgaatcgcggtcagattattgatatcgaaagtgctcagattagtgatgccggtatttacaagtgcgttgccatcaattccgcaggggcaaccgagctgttctactccttgcaggtccacgtcgctcctagcatttcagggtccaacaacatggtggccgtggtcgtaaacaaccctgtacgattggaatgtgaagcacgcggtatccccgctccctcacttacctggcttaaggacgggtcaccagtgagttccttttccaacggtctccaagtgttatccggcggacgaatactggctctgaccagcgcacagatttcagatacaggccgatatacatgcgtggccgtgaatgcagcaggcgagaaacaacgcgacatagacttgagggtttacgtgccaccaaacattatgggcgaggaacaaaacgttagcgtgctgatcagtcaggccgttgaactgctttgtcagtcagacgcgattcctccccctacacttacttggttgaaagatgggcacccactgctgaaaaagccaggtttaagcattagcgaaaacaggtcggtcctcaaaatcgaagatgcgcaggtgcaggataccggtagatacacgtgtgaagctaccaatgtagcgggaaagactgaaaagaactataatgtgaatatctgggttccaccaaatatcggtggaagcgatgagctgacacagctcacagtgatagaaggaaaccttatttctctgctttgtgagtcatccggaataccccctccaaatttgatttggaaaaaaaagggaagtcccgtgttgactgatagcatgggcagggttagaatcctgtcgggcggaagacagttgcagatcagcatcgctgagaagtctgacgcggctctgtattcctgtgtggcctccaacgtggcagggactgcaaagaaagagtacaacctccaggtatatatccggccaaccatcaccaactcaggatcgcaccccaccgagataattgtgacccggggtaagtcaattagcctggagtgcgaggtgcaggggatcccgcctccaaccgtgacgtggatgaaagacgggcatcctctaattaaagctaaaggcgtggagattctggatgaaggccacatccttcagctgaaaaacatccatgtaagtgacacaggtcggtatgtttgtgttgcggttaacgtcgcgggaatgacagataagaagtatgacttgtctgtccacgctccacctagtatcattgggaaccacagaagtcccgaaaatatctcggtggtggaaaagaactctgtctccctgacctgtgaggccagcgggattccgctgccctctattacttggtttaaagacggatggcctgtttccttgagcaattcagtgcgaattctgtccggcggaaggatgcttcgtcttatgcagaccacaatggaggacgcaggtcagtatacatgtgtcgtgaggaatgcggcaggcgaggagcgcaagatttttggcttgtcggtactcgtgcccccacatatcgtcggagaaaatacattagaggatgtcaaagtgaaggagaaacagtcggtcacactaacttgcgaagtgacaggaaacccagtgcccgagatcacgtggcacaaagacgggcaacctctgcaggaggacgaagcccatcacattataagcggaggacggtttctgcagataacaaatgtacaagtgccacacactggacggtacacatgcctcgcttccagcccggcagggcataaatcgcgcagcttcagtcttaacgtgtttgtgagccccaccatcgccggagttggatcagatggcaaccctgaggatgtgacagtcattcttaactcaccgaccagcctagtatgtgaggcatactcctaccctccggcaaccatcacatggtttaaggatggaacaccattggagagtaaccggaacattaggatactgcctggcggtaggactctgcagatcctgaatgctcaggaggacaatgcgggaaggtactcatgtgtggctactaacgaggcgggagagatgattaagcattacgaggtcaaagtgtacattccacccattataaataagggcgacctatgggggcctggcttatctcccaaggaggttaagataaaggttaataatactctaacccttgagtgcgaggcttacgccataccgagcgctagcctgtcctggtacaaggatggccagcctctcaagtctgatgaccatgtaaatatcgctgccaatggacatactctccaaatcaaggaggctcagattagcgacaccggacgctatacctgtgtagcttcaaacattgccggtgaggacgagcttgatttcgatgtgaacattcaggtgccaccgtcatttcagaaattatgggagattggcaacatgcttgacaccgggcgtaacggcgaggctaaagatgtgataatcaataatccaatttcgctgtattgcgagactaacgccgctccccctcccacgttgacatggtataaggacggccaccctttgactagttcagacaaggtgttgattctgcccggtggccgtgtgttacagatccccagggctaaggtggaagacgcaggcaggtacacgtgcgtggcagtcaatgaggccggtgaagacagcttgcaatatgatgttcgagtgctcgtccctccgattattaagggcgctaacagcgatctgccggaggaagtcaccgtcctagtcaacaagtctgcgctcattgagtgtctttcctcaggatctcctgccccaagaaactcctggcaaaaggacggccagcctctactggaagacgaccaccataagttcctcagcaatgggcgtatcctacagattctgaacacacaaattaccgatattggcagatatgtgtgtgtggccgaaaacacggcaggtagtgccaagaaatatttcaacctgaatgtccacgtgcccccttccgtgatcggacctaagagcgaaaacctgacggtggtcgtaaataactttatatcccttacgtgtgaggtctcggggtttccacccccagacctgtcttggctcaagaatgaacaacccatcaaactgaacaccaataccttgatcgtcccgggaggtaggactctccaaatcatacgtgccaaggtgtctgatggtggtgagtatacatgcatagctataaatcaggccggagagagcaaaaaaaaattttccctgacggtctacgtgccaccgtccataaaggaccacgacagcgaatcactaagcgtggtcaatgtcagggaagggacatctgtgtcattggaatgcgaatctaacgctgttccgcctccagtgatcacatggtataagaatgggcgtatgataacggagagcacccatgtggaaatcctggccgacggccagatgctacacatcaagaaagctgaggtgagcgatacaggtcagtacgtttgccgggctatcaatgttgccggacgggacgataaaaacttccacctcaacgtgtacgtgccacctagtatcgaagggcctgaaagagaggttatagtcgagactattagtaacccagttacactcacatgtgatgctacaggaattcctccacccaccatcgcctggcttaagaaccataaacgtatcgaaaactccgactcactcgaagtgcgcatcctcagtggtgggtctaaactgcagatagccaggtcccaacacagcgatagcggcaactacacatgtatagccagcaatatggagggtaaggcccagaagtactattttctgtcaatacaggtgcccccttctgttgccggagctgagatcccctcagacgtgagcgtcttactgggcgagaacgtggagttagtgtgtaacgctaatgggatacccaccccactcatccagtggcttaaagacggtaaaccgattgcatcaggggaaacagagaggattcgtgtctctgcgaatgggagtacactgaatatttatggcgctctaacatcggacacaggaaagtacacctgtgttgctacgaacccggctggcgaagaagaccgaatcttcaatctaaatgtttacgtaactccgactatcagaggcaacaaagacgaagcagagaagctcatgacactggtggacactagcatcaatatcgaatgcagagcgaccggaacacctcctccacagattaactggctgaaaaacggactgccgttacccctcagttcccacattaggctgctggccgcaggtcaggtgatccggattgtgcgggctcaagtgagcgacgtggccgtgtatacctgcgtggcctccaacagagctggagttgacaataaacattacaatcttcaggtctttgctccccctaatatggacaatagtatgggcacagaggagattaccgtgctgaaggggtcctctacctccatggcatgcatcactgacggcacccctgcgcctagtatggcatggcttcgagatgggcagcccctcgggctggatgcccacctgacagtgagcacgcacgggatggtcctgcagctcttaaaggccgagacagaggatagcggcaagtatacatgtatagcaagtaatgaagcaggagaggtgtccaaacatttcattctgaaagtgctggagcccccacatatcaatggctccgaagaacacgaagaaataagcgtgattgtcaacaatcccttggaactgacctgcatcgcttccggaatccccgcacctaagatgacatggatgaaggacggcagacctctgccccaaaccgaccaggtgcaaaccttggggggtggagaggtgttgcgaatttccactgctcaggtggaggacacaggaaggtacacctgcctagcctcctcgcccgctggagacgacgataaagagtacctggtgcgggtccacgtacccccaaatatcgccggaaccgatgaaccccgagacatcacagtactgcggaatagacaagtgaccctggaatgcaagtccgacgccgtgcctccccctgtgatcacatggctgcgaaacggggagagactgcaggccacaccccgagtgaggatcctgagcggcggaaggtacttgcagatcaataatgccgacctgggagatactgccaactacacctgtgtagcgtctaacatagcgggtaagacgacacgcgagttcattctgaccgtgaacgtgccaccaaatattaaaggaggacctcagtcgctagtcatacttctgaacaaatccaccgtccttgaatgcatcgctgaaggagttccaacgcccaggattacatggcggaaagacggcgcagtgttagccggtaatcacgctagatacagcatcttggagaatgggttcttgcacatacaaagcgcacacgtgacagatacagggaggtacctatgtatggcaacgaacgcagcgggaaccgatcgcagacggattgacttgcaggtgcatgtgcccccatcaattgctccgggaccaaccaacatgaccgtgattgttaatgtgcaaaccaccctcgcatgcgaagcaacaggcattccaaagcccagcattaactggaggaaaaacggccacttgctcaacgtggaccaaaatcaaaattcctaccgtctcctctccagtgggagcctggtgatcatttcaccatccgtagatgacaccgccacttacgagtgcacagtaaccaacggagccggtgacgacaagcgcaccgttgatctcacagtccaggtacctccgtccattgcagatgaacccacagatttcctggtcactaaacatgcacccgcagttattacctgtacggcttctggcgttccttttccgtctatccactggacaaagaacggtatcagactgctgccgagaggggacggttaccggattctttcatctggagctatcgagatcttagcaacccagctcaatcacgcgggtagatatacttgtgttgctaggaacgccgcaggtagcgcgcaccgccatgtgactctccacgttcacgagccccctgtgatccaaccgcaaccaagcgagctgcacgtcatcctgaataatccaattctgctgccttgtgaagccacaggcacaccaagtccattcatcacttggcagaaagagggcattaacgtaaacacatctggacggaatcatgcagtactgccatccggtgggctccagattagcagagctgtgagagaggatgccggaacatacatgtgtgtcgcccagaaccccgcaggcacggctttagggaagatcaaattaaacgtccaggtaccacccgtgatctcgccccacctgaaggagtatgtgatcgcagtggataagcccattacactgtcctgtgaggcagatggcctgccaccacccgatattacttggcacaaggacgggcgtgcgattgtcgaaagcataaggcagcgggtgttgagtagcggcagtttgcagatagcatttgttcagcctggggacgctggacactatacatgcatggccgctaacgtggcaggctcctctagtactagcaccaaacttacggtgcacgtccctccacgcatccggtccactgaaggccattacacagtgaatgagaacagccaggcaatacttccttgtgtagctgacggcatccccacacctgcaatcaactggaaaaaggacaacgtgttgttggccaatctgctggggaagtacacagctgagccatacggagaactcatactggagaacgtggtgctggaggacagcgggttttatacttgcgtggcgaataatgccgcaggcgaggacacgcataccgtgagccttactgtacacgtgctgccgactttcaccgagcttccaggtgatgtgtcactgaacaaaggcgagcagcttcggctatcatgcaaagccacaggcattcctctcccaaaacttacctggacgtttaataacaacattatccctgcccactttgattccgtgaacggccacagcgagctggtgatcgagagggtgtctaaggaggattccggcacatacgtttgcacggctgagaactctgtgggcttcgtgaaggccattggttttgtgtacgtgaaggaaccacccgtgttcaagggagactacccctctaactggatcgagccacttggcggaaacgccatcttgaattgcgaggtgaagggcgacccgacacccaccatccagtggaaccgcaaaggtgtggacatcgagatctctcaccgtatacgccagctagggaacggctcacttgccatctatgggacagtgaacgaggacgccggtgattacacgtgcgtggctactaacgaggcaggcgtggtagagcgctctatgtccttaaccctgcagagcccaccaattattactctggaaccagtggagacggtaataaatgctggcggaaaaattatcctaaattgccaggctacgggggaaccccagccaactatcacctggtcacggcaaggacactctatttcttgggatgaccgagtgaacgtcctgtccaataatagcctttacattgccgacgcccagaaggaagatacaagcgaattcgagtgcgtggcaaggaatctgatgggaagcgtgctggtaagggtgcctgtcatcgtacaagtgcacgggggattttcgcagtggtccgcctggcgggcatgttcggtgacttgcggcaagggcatccaaaagcggagcaggctatgcaatcagccccttccagcaaatggagggaaaccatgtcaaggctcagatttggaaatgcgaaattgtcaaaacaaaccttgtccagtggacggatcgtggtcagaatggagcctgtgggaggagtgcacaaggtcatgcgggaggggaaatcaaacaagaacacgcacttgtaacaatccatccgtgcagcatggaggtagaccctgtgagggtaacgctgttgaaattattatgtgcaacataagaccatgccctgtccatggggcttggtcagcttggcaaccgtggggaacatgtagcgagagctgtggcaagggcacacaaactcgggctagactctgtaacaaccctccaccagcctttggtggttcgtattgcgacggggctgagacacagatgcaagtgtgcaacgagagaaactgtccaatacatggtaaatgggctacatgggcatcatggagtgcctgcagtgtcagttgcggcggtggcgctcgccaacgaacaaggggctgctccgatccagtaccccagtacggtggcaggaaatgtgaaggctccgatgtccagtcagatttttgcaatagcgatccatgccctacgcacggaaattggagcccatggtctgggtggggaacgtgctcacgcacctgcaacggagggcagatgcgcagatacagaacgtgtgataacccgcctcccagtaacgggggaagggcttgcggaggccctgactcacaaattcagaggtgtaatacagacatgtgccccgtggacggttcttggggctcttggcattcctggagccagtgttccgccagctgcgggggaggcgagaaaacccgcaaacggctatgcgaccaccccgttccggtcaaaggaggacgcccatgtcctggtgacaccacacaggttactcgttgcaacgtccaggcctgtcctggcggaccccagcgggcacggggttccgtcattggcaatatcaatgatgttgagtttggcattgcctttctgaatgcgactataactgactctccaaactccgatacccgcataattcgagcaaagatcaccaacgtcccccgatcgctaggatccgctatgaggaagattgtgtctattctgaacccgatctattggacaactgccaaggaaattggggaggcagtaaatggtttcactctgactaatgcagtcttcaagcgcgaaacccaagtggagttcgccacaggggaaatccttcagatgagccacatcgcgagaggcctggacagtgacggaagtctcctgttggacatcgtggtatcaggctatgtgctgcagctacagtcgcctgcagaggttaccgtgaaagactatactgaggactatattcaaactggccctgggcagctgtacgcctactctacgcgtctgttcaccatcgatgggatttctattccctacacctggaatcataccgtgttctatgatcaagctcagggcaggatgccttttcttgtcgagaccctgcacgcctccagcgtggagtcagattacaaccaaatcgaagagaccctcggctttaagattcacgccagcatctctaaaggtgaccgctcgaatcagtgtccttcaggctttaccctggactcagtggggccattctgtgctgacgaagacgaatgcgccgcaggaaatccttgttcacactcttgccacaacgctatgggcacatactattgttcctgtccgaagggcctgactatcgcagcggatgggcgtacctgtcaagacattgatgagtgcgcgcttggacgccacacatgtcacgctggacaggactgcgacaatacaatcggatcctacaggtgtgtggtgcgttgtggttccggttttcgcaggacaagcgacggactatcctgtcaggacattaatgagtgccaagaaagttcaccctgccatcaacgttgttttaatgccattggcagttttcactgtgggtgcgagccaggataccaactgaaagggagaaaatgcatggacgtcaatgagtgcagacagaatgtttgccgcccagatcagcactgcaagaacacacgaggcggttacaagtgcatcgatctttgtcccaacggtatgaccaaggccgagaatggtacttgcattgatatcgacgagtgtaaagacgggacacaccaatgtagatacaatcagatttgtgaaaatactcgcggttcatatcgctgtgtctgtccaaggggctacagatctcaaggagtagggcgaccttgcatggatattaacgaatgcgaacaggttcctaaaccatgtgcacatcagtgttccaacaccccaggcagtttcaagtgtatctgtcccccagggcagcacctgttaggagacggcaaaagctgtgctggcttggaaagattgccgaactacgggacgcagtatagctcgtataacctggccaggtttagccctgtgcggaataactatcagcctcagcagcactatcgtcaatatagccacctgtacagtagttattccgagtacaggaactctcggaccagtctgagtaggactagacgcacaatccggaaaacttgccctgagggaagcgaggccagtcatgatacgtgcgtggatattgacgaatgtgagaacacagacgcgtgtcagcacgagtgtaagaatacttttggttcttatcagtgcatctgcccacccggatatcaactgactcataacggaaagacctgtcaggacattgacgagtgtctggagcagaatgttcattgtggacccaacagaatgtgctttaatatgcggggttcatatcagtgtatcgatacaccttgccctcctaattatcagagagatccagtttccggcttctgcctcaaaaattgtccacccaatgacttggagtgcgcgctatctccctacgccctcgagtacaagctggtttcgctaccatttgggatcgccacaaaccaagatctgatccggcttgtggcatacacccaagatggggtcatgcaccccagaactactttcctcatggttgatgaggagcagactgtgccattcgcactaagagatgagaatctgaaaggcgtggtgtacacaaccagacccttgagagaggctgagacatatagaatgagagtccgggctagcagctattccgctaacggcaccatcgagtaccagactacgttcatcgtatacattgccgtcagtgcttacccatacta

SEQ ID NO: 225869 - DNA, 16556 bp, Artificial Sequence
  Description of Artificial Sequence: Synthetic coding sequence
atgatttcctgggaagtcgtgcacaccgtttttctgttcgccctcctgtactcctctctggcccaggacgccagtccccaatccgagatcagggcagaagagataccagagggtgctagcacccttgcctttgttttcgacgtcacggggtccatgtacgatgatctggtccaagtaatagaaggtgcctccaagattcttgagacctcgctgaaacgccctaagcgtccactcttcaattttgccctagtacccttccacgatcctgagattggccctgtgactatcaccacagaccccaaaaagtttcaatacgagctgcgggagctctacgtacagggcggaggagattgtccagagatgtctatcggggctatcaaaattgcattggaaatctctctgcccggaagttttatttacgtattcacggacgcccgaagcaaagattacagactcactcatgaggtactacaactgatccaacagaaacagagccaggtggtgtttgtcctaaccggggattgcgacgaccggacgcatatcggatataaagtatatgaagaaatcgcgagcacttccagtggccaagtcttccacctggataagaagcaagttaatgaagtcctgaaatgggtggaggaggccgttcaagctagcaaggtgcatctcctttccacggaccatcttgagcaggccgtaaatacttggcggatcccatttgatccaagccttaaagaggtcacggtctctttatccggccctagcccaatgatcgaaataagaaatccgcttggcaagctaatcaaaaagggctttggactgcatgaactgcttaacatccacaattccgctaaggttgtgaacgttaaggaaccagaagcagggatgtggaccgtcaagactagctcttccgggaggcacagcgttcggatcactggtttatcaaccatcgatttccgggctggcttcagccgaaaacctactttagatttcaagaagacggtgtcacgcccagtgcaaggaattcccacatacgtgttactgaatacttctggcattagcacccctgccaggatagacttactggagctgctgagcatctcaggatcatctctgaaaactattcccgttaagtattatcctcatcggaagccctatggcatatggaacatcagcgacttcgttcctcctaacgaggccttcttcttgaaagtaaccggatatgataaggacgactacctgttccaaagggtctccagcgtaagttttagttccatcgtaccagacgcccctaaggtgacgatgccagaaaagactcctggctattatctgcagccagggcagatcccttgctccgtcgattctctccttccgttcacgctatctttcgtgcgaaatggcgtgaccctgggtgttgaccagtacctgaaagaaagcgccagtgtgaatctcgacatagcaaaggtcaccttgagcgacgagggattttatgagtgcatcgccgtctcctccgccggaaccggcagggcccagacgttctttgatgtgtccgagccccctccagtcatacaggtgcctaacaatgtgactgtgacaccaggcgagagggcagtcctgacatgtctcatcatttcagccgtggactacaacctcacgtggcagagaaacgatcgtgatgttaggctcgcggagccagcgagaatcagaaccctggctaacttgtctctggaactgaagtcagtgaagtttaatgatgcaggcgagtaccactgcatggtctcttccgaaggcggatcttctgctgcttccgtgtttctaacagtgcaggaaccgccaaaggttaccgtaatgcccaaaaatcagagtttcactggcggatctgaggtgagtatcatgtgtagtgcaaccggataccccaagcccaagattgcgtggaccgtgaatgacatgtttatcgtgggttctcaccggtacaggatgacttcagacggcaccctattcatcaagaatgccgctcctaaagatgcaggcatttatgggtgccttgcctcaaattcagcaggtaccgataaacagaattctacacttcgatatatagaagctccaaaactcatggtggtgcagagtgaacttctggtggcactgggagatattactgtgatggagtgcaagacatctggcatccctccgccacaggtcaagtggtttaagggcgatctggagctgcgacccagtacgttcttaatcatcgatcccttacttggtctcctgaaaatacaggagacacaggacctcgatgcgggtgattacacctgcgtggctatcaatgaagccggtagggcaactggaaaaataacattggatgtggggtcgccccctgtctttatacaggaaccagctgatgtgagtatggagataggaagcaatgttaccctcccctgttacgtgcaaggctaccccgaacctaccattaagtggcgcagactcgacaatatgcctatcttcagcaggccattttcagtcagttctatatcgcagctgcgaaccggggcactctttatattgaatctatgggcctcagataaaggcacttatatctgtgaggcagaaaaccagtttggaaagatccaatcagagacgacagtgaccgtcacgggcctggtggccccactgattgggatttcaccttctgtggccaacgtcatagagggccagcaactgactctgccctgtaccttgctggccggaaaccccatcccagagcgaaggtggatcaaaaatagtgcaatgttattacagaatccttacatcacagtgaggagcgatggatctttgcacatcgagcgggtgcagctgcaggatggcggagagtatacttgcgtcgcctccaatgttgccggaaccaataataagaccacctcggtggtggttcatgtcctcccaactatccagcacggccagcaaatcctgtctaccatcgaagggattccggtcacgctcccatgtaaggcctccggaaaccccaagccatcggttatctggagcaagaaaggcgagctgatcagcacatccagcgccaagttctcagcgggtgcagatgggagtttgtacgtggtgagtccaggaggtgaagagtcaggggaatacgtgtgcacagctaccaacacagcaggctatgctaaaaggaaagtacagctgactgtatacgttaggccccgtgtgtttggtgaccagaggggcttgtctcaagataaaccagtggaaatctccgtgctagccggagaagaagtcactctaccctgcgaagtgaagtcactgcccccacctataattacctgggccaaggaaacccagctcatttcacctttttccccgaggcatacctttctaccaagcggaagcatgaagataacagaaactcgtaccagtgatagcggaatgtatttatgcgtagctacgaacattgccggaaacgtaacccaggccgtcaaactgaatgtgcatgtgcccccaaagatccagcgaggacctaaacatctgaaagtgcaggtcggacagcgggtggacatcccatgcaatgcacagggcacacctctgccggttatcacctggtcaaagggagggtccacgatgctcgtcgacggggaacatcacgtgagtaaccccgacggaacactgagtattgaccaggctaccccctcagatgctggaatctatacttgcgtggccactaatattgccggtaccgacgaaacagagattaccctgcatgttcaggagcctccgaccgtggaggacctagagccaccctataacacaacattccaggagcgggtcgccaatcaaagaatcgaatttccgtgtcccgcaaaggggacgcccaaacctaccattaaatggttacataacggacgtgagctcacaggacgcgaaccgggaatatctattcttgaggatgggactctccttgtgatcgcctcggtgaccccttatgataatggagaatacatctgcgtggccgttaatgaagccggtacaaccgagagaaaatataatctcaaagtccatgtacctccggtgataaaggataaggaacaggtcactaacgtaagcgttcttcttaaccagctgaccaacctcttctgtgaagtcgagggaaccccatcaccaattataatgtggtacaaagataacgtacaggtgacagaatcgagcaccatccagaccgtcaataacggaaaaattctgaagctgtttagggctaccccagaggatgcaggtaggtatagttgcaaagcgataaacattgccggaacttcccagaaatacttcaatattgacgttctggtcccacccaccatcatcggtacaaatttcccgaacgaggtgtccgtagtgctgaaccgcgacgtggctctggagtgccaggtgaaagggaccccttttcctgacatccattggtttaaagatgggaagccactgtttctgggggatccaaatgtggaactgttagataggggtcaagtgctgcacttaaagaacgctaggaggaacgataaaggtagataccagtgcaccgtctccaacgcagcgggaaagcaagcgaaggatataaagctgactatctacattccacctagtattaagggagggaacgtgaccactgacatctccgtcctgataaactcccttatcaagttagagtgcgagacacggggattgcctatgccagccattacatggtacaaggacggacagcccatcatgagttcaagccaggcattatacattgataagggccagtatttacatatcccacgcgcacaggtgtcagacagcgcaacatacacttgccacgtcgctaacgttgcgggaacagccgagaaaagttttcacgtggatgtgtacgtgccccctatgatagagggaaatctagcaacccccttgaacaagcaggtcgtaatcgcacattctctgacattggagtgcaaggccgctggtaatccgtcaccaattttaacttggctgaaggacggagtgccagtgaaggctaatgacaacatacgcatcgaggccggtgggaaaaaactggagatcatgagtgcacaggaaatcgatcgcggacagtacatttgcgtggcaacctctgtcgcaggtgagaaagagatcaagtacgaagtggatgtgctagtgccacccgctattgaaggaggtgatgagaccagctactttattgtgatggtcaataaccttcttgagttggattgccacgttacaggcagccctccccctaccattatgtggctaaaagatgggcaacttattgatgagagggatgggtttaaaatcctgttaaatggcagaaagcttgtgatagcacaagcccaggtgtccaataccggtctctaccggtgcatggcggctaatactgccggagaccacaaaaaagaattcgaggtgacagtacatgtgcctcccacaattaaaagctcgggtctgagcgagagagtcgtcgttaagtacaagcctgtggctctgcagtgcattgccaatggcatccctaaccctagcataacctggttaaaagatgaccagcctgttaatacagcccagggcaatctcaagatccaatcatcaggcagagtgctccagatcgccaaaacactccttgaagatgcgggtcgatacacctgcgtggctaccaacgctgctggggagacgcagcagcatatccaactgcacgtgcacgagcctcctagtctggaagacgcaggcaagatgcttaatgaaacggtgctggtgtctaatccagtccagcttgaatgtaaggccgctgggaaccctgtgcccgtaattacatggtacaaggataaccgtctcttgtctgggtccacctccatgacatttctgaaccgcggacaaatcatcgatatcgaatctgcacagatttcagatgctggtatctacaagtgtgtggccataaattcggcaggagccaccgagctgttctacagcttgcaagtgcacgttgctccaagcatcagcggtagtaacaatatggtagcggtggtggtcaacaatcctgtccgccttgagtgcgaggcccgagggatccctgccccatccttgacttggctcaaagacggctctccggtcagcagtttctccaatggtttgcaagtcctgagcggaggaaggattcttgcgcttacaagtgctcagatatctgatacaggaaggtatacctgtgtagccgttaacgcggctggtgagaaacagcgcgatatcgatctccgcgtgtacgtgcctcccaacataatgggagaagagcagaacgtctctgtgctcatttcacaggcagtggaattgctttgccagtccgacgccattccgcctccgactctcacgtggctcaaagatggccaccctctcctcaaaaagccgggtctcagcatctctgaaaatcgcagcgtcctgaagattgaggacgcccaagtccaggacacagggagatacacatgtgaggcgaccaatgtggcgggaaagacggagaagaactacaatgtcaacatatgggttccccctaacataggtgggagtgacgaactcacccagctgacggttatcgagggcaatctcattagcttgttgtgcgaaagtagcggcatcccccctccgaaccttatctggaagaaaaaagggtcccccgtccttacggacagtatgggtcgggtgagaatcttgtccgggggaaggcagcttcaaatctccatcgccgaaaagtcagatgctgcgctgtacagctgtgtggcttcaaatgttgccggaacagccaagaaagaatacaacctccaagtgtacattagaccaaccatcacgaactccgggagtcacccaaccgagatcatcgtgaccaggggcaagtccatctcgttagagtgtgaggtgcagggcattccccctccaactgttacctggatgaaggacggacacccccttattaaagccaaaggggtggaaattctggacgagggccacattctgcagctcaagaacatccacgtttccgacactggcagatatgtctgcgtcgcagtcaacgtggccggtatgacagataagaagtacgacctcagtgtccatgccccaccatccataatcggtaaccacaggtctcctgagaatattagtgtggttgaaaaaaactctgtgtctctgacatgcgaggcgtcaggaatcccactgccctccatcacttggttcaaggacggctggcctgtgtccctgagtaacagcgtgcgcattctgagtggtggaagaatgcttcgcttaatgcagacgactatggaagacgccggacagtatacttgcgtcgtcagaaacgcagcgggagaggagaggaagatcttcggcctcagcgtcctggtacctccacacatcgttggggaaaacactctcgaagatgtgaaagtgaaggagaaacaaagcgtaactttgacttgtgaggttacaggaaaccctgtgccagaaatcacttggcacaaggacgggcaacccctccaggaggatgaggcacatcacatcattagtggcggaagatttcttcagatcacaaacgtgcaggtcccacacacaggacgctacacctgccttgctagctcacctgcaggacataaatccagatcattttctttaaacgtgttcgtgagccctacgattgctggagtgggcagcgatggcaacccagaggacgtgactgtgatcttaaactctcccacttcattggtgtgtgaagcttatagctaccctcccgcaacaataacttggttcaaggacggaacacctcttgagagcaatcggaacattcgaatcctgcccggaggacgcaccctacagattctcaatgcacaggaagataacgctggaagatattcatgtgttgctactaatgaagctggcgagatgatcaagcactacgaagtcaaagtttatatcccacccatcattaacaagggcgatttatggggccctgggctgagcccaaaagaagttaagatcaaagtgaataatactctgaccctcgagtgtgaagcatacgctattccttctgcctcactctcctggtacaaggatggccagcccctcaagtcagacgatcatgtgaacatcgccgctaacggccatacacttcagatcaaagaagcacaaatttccgatactggcaggtacacatgtgtggcctccaacatcgcgggtgaagacgagcttgattttgacgtaaatatacaggtgcctccgtcattccaaaaactgtgggagattggcaacatgttagacactgggcgtaacggcgaagcaaaggacgtcatcatcaataacccaatttctttatactgtgaaactaacgcggctcctccaccgactctgacatggtacaaagacggccatcctttaacctcctcagataaagtcctaatactgccgggaggcagggtcctgcagatcccacgagcgaaagttgaggatgccggacgctacacctgcgtggcagtaaatgaggctggtgaagactccctgcaatatgatgtcagggttcttgtcccacctataatcaagggcgctaactctgacctgccagaggaggtgaccgtcttggtgaataagtccgctttgattgaatgtttgtcgtctgggagcccagcaccccgaaatagctggcagaaagacgggcagcccctgctggaagacgaccaccacaagttcttaagcaatggtaggatactgcaaattctgaacacccagatcacagatattggcaggtatgtgtgcgttgccgagaatacggctggtagtgccaagaagtactttaatcttaatgttcacgttcccccttccgttatcgggcctaagagcgagaatctcacagtggtcgtgaacaacttcatttccttgacctgcgaagtgagcggattcccgccacccgacctttcttggctgaagaacgaacagcccataaaattgaatacgaacacccttatcgtcccaggaggacggactctccaaataatccgcgctaaggtgtcggacggaggggagtacacttgtatcgccattaaccaggcaggcgagagtaaaaagaaatttagtttaacagtgtacgttccgccatctattaaggaccacgattctgagagcctgtctgtcgtcaatgtgcgcgagggtacaagtgtctctctggagtgtgagtcgaacgcagtccctcctcctgtaataacatggtataagaatgggcgtatgattaccgagtctacacacgtcgaaattctagcagatggacagatgctgcacatcaaaaaagcggaggttagcgacacaggccagtacgtttgtcgggctattaatgtggctggacgggatgacaaaaattttcacctgaacgtctacgttccaccctcgatcgagggccctgaacgcgaggtgatcgtagagacgatttccaacccagtaaccctaacgtgcgacgcaacaggtatcccacctcctacaatagcatggctgaaaaatcacaagcgaattgaaaattctgacagtctcgaggtgcgaatcctgtccggcggttccaaactgcagatcgctcgctctcagcacagtgattcgggcaattacacctgcattgcctcaaacatggagggaaaggcccaaaaatactacttcctgtccattcaggtacccccatcagtcgccggagctgagatcccctcggacgtttctgtgctccttggagagaacgtggagctggtctgtaacgctaatgggatccccacccctcttatccaatggctaaaagatgggaaacctatcgcctcaggagaaactgaacggattcgtgtcagcgcgaacggctccaccctgaatatttatggagctctgactagtgacacgggtaagtacacctgcgtggctactaatcccgctggtgaagaggataggatctttaacttgaatgtgtacgttaccccaaccatccgtgggaacaaggacgaggccgagaaactcatgacgctggtggacaccagtatcaatattgagtgccgagcaacaggtacaccacccccacagattaactggttgaagaatggactgcccctgcctctgagttcacacatcaggctcctagctgcaggacaggtgatacgcatcgttagggcccaggtgtccgacgtcgcagtctacacctgcgtcgcctctaacagagccggtgttgacaacaagcactataatctccaagtgttcgccccacctaacatggataactccatgggaactgaagaaataactgtgcttaagggatcttcaacgtcgatggcctgcatcacggacgggacgccagccccatcgatggcctggctgcgggatggacaacccctcgggctggacgcccatctgacagtctccactcacgggatggtgcttcaactgctgaaagccgagacagaagactcgggtaagtacacgtgtatcgcctccaacgaggcaggcgaagtttctaagcatttcattctgaaggtcctggagccgcctcacataaacggctctgaggagcacgaagagatttctgttatcgttaataacccactcgaacttacctgtatcgcctcaggcatccctgcccctaaaatgacttggatgaaggatggtcgacctcttccccagaccgaccaagtgcagaccctcggcggaggggaggtcctgaggatatccaccgcccaggtggaagataccggacggtatacctgcttggcctctagcccagctggcgatgatgacaaggaatacttagtgagggttcacgtcccaccaaacatagccggtaccgacgagccaagagacattactgttctgagaaacagacaggtgaccttagaatgcaagagcgatgccgtgccgccacccgtcattacttggttacggaatggagagcgcctgcaagcgacacctcgagtgcggatcctgagcggaggtcgctatctgcagatcaataatgccgatctgggcgataccgcaaactacacatgcgtagcctccaatattgcaggaaagacaacacgagaatttatcctgacagttaacgttccacccaatattaagggtggtccacagtccctcgtgatattgcttaacaaatcgactgtgctggaatgcatcgccgagggggttccaacaccgaggattacctggcggaaggacggtgccgtgcttgccggtaaccacgcacgctactccatcctggaaaacgggtttttacatatccagtctgcacacgttaccgacacaggcagatatctgtgcatggccacaaatgcagccggaacagacaggaggagaatcgacctgcaggtacacgtgcctcctagcattgcaccaggcccaacaaacatgaccgtgatagtgaacgttcagaccaccctagcatgcgaggccactggaataccaaagccaagcattaactggaggaagaatggccaccttctcaatgtagaccaaaatcaaaatagttatagactgctgtccagtgggagcctggtcatcatcagccctagcgtggacgatacggcgacctacgagtgcactgtgaccaacggtgcgggtgatgacaagcgcacggtggatctaactgtgcaggtacccccatccatcgctgacgaacccacagactttctcgtgaccaaacatgctccagccgtgatcacctgtaccgcttccggagttcctttcccaagtattcactggacaaagaacggcatacggttactacccaggggggatggatacagaatcttgtcctccggagctatagaaattctggcaacccagctcaatcatgctggaagatatacctgcgtagctcgcaatgcagccggaagtgctcacaggcacgtgactctacacgtgcatgaaccccctgtgattcagcctcaaccgagcgagctgcacgtgattctgaataatccaattcttctgccatgcgaagctaccggaactccaagtccgtttatcacctggcagaaagaggggatcaatgtgaacaccagtggccgaaatcacgctgtgttaccctctggcggactgcagatcagcagggcagtccgtgaagatgctggaacatacatgtgcgttgcgcaaaatccagccggtactgcgcttggcaaaattaaattaaacgttcaagttcccccagtgatcagcccccatctaaaggaatacgtgattgcggttgacaaaccgatcaccctgtcctgtgaagcagacggcctgccaccacctgacattacttggcacaaagatggcagagctattgtggaatcgatcaggcagcgggtgctatcttccgggtctctccaaattgcatttgtccagcccggtgatgccggacattatacctgcatggcagccaatgtagccggatcatcgtcaacaagcacaaagctcactgtgcatgtgcctccccgtatacgctctactgagggccattataccgtgaatgagaatagccaagcaatcctcccgtgcgttgctgatggaatccccacccctgctatcaactggaagaaagacaacgtcctgttggctaacctcctgggaaagtacacggcagagccttacggcgagctgatccttgagaacgtggttctggaggattctggcttctacacctgtgtagccaacaacgccgcaggcgaggatactcacaccgttagcctgacggtccacgtcctgcccactttcactgagttgcccggagacgtatcattgaacaagggtgaacaactgcgtctttcctgcaaggccaccggcatccctctgcccaaacttacttggacttttaataataacatcattcccgcacacttcgactcagtcaacgggcactctgagctggttatagagagagtcagcaaagaggactccgggacgtatgtttgtacagccgaaaactctgtgggatttgtgaaggcaatcggtttcgtatatgtgaaagaaccccctgtgtttaagggagactatccctcaaattggattgagccacttggtgggaacgccatactcaattgtgaggttaagggggaccccacccccactattcagtggaacaggaagggtgttgacatagagattagccatagaatcaggcagctgggtaatggcagcctggcaatttatggtaccgtcaacgaggacgctggcgattatacttgcgtggcgacgaatgaggcaggcgtggtggaaaggagtatgagcttgaccctgcagtccccccctattataacacttgagcctgtggagaccgtgatcaatgccggaggtaaaatcatcctcaactgccaagcgacaggtgaacctcagcctactatcacttggtccaggcaggggcacagcatatcttgggacgacagagtgaacgtcttgtcaaacaatagcctgtacatagctgatgctcaaaaagaggacacatccgagtttgaatgcgtagctcgtaacctaatggggtccgtattagtgcgtgtacccgtcattgtacaagttcacggtggattcagccagtggtcagcctggcgagcgtgctccgtgacctgtgggaaaggcattcaaaagagatcacggctgtgcaatcagcctttgcccgctaatgggggaaagccctgtcaagggagcgaccttgagatgcggaactgccagaacaaaccttgccccgtggatggctcttggagcgagtggtccttatgggaagagtgcacccggagctgcggcagggggaaccagacacgcacccgtacatgtaacaaccccagcgttcagcacggtggccgaccctgcgaaggcaatgcggtggagattattatgtgtaacataaggccctgccctgtgcacggcgcatggagtgcttggcagccctgggggacttgctcagagtcatgcggaaagggtacgcaaaccagggctagactctgcaataatcctcccccagccttcggtggcagctactgtgacggtgctgagacccagatgcaggtgtgtaatgagcgcaactgcccaattcatgggaaatgggccacttgggcaagctggagcgcctgctctgtgtcatgcggcggtggcgctcggcagcgcacaaggggctgcagtgatcctgtcccccagtatggcggacgcaaatgcgaggggtctgatgtgcagagtgatttttgcaacagcgatccgtgtcccacacatgggaattggtcaccttggtctgggtgggggacttgcagccgtacgtgcaatgggggacagatgagaaggtaccgcacttgtgataaccctccacctagcaacggcggacgcgcatgtggcggaccagacagccagattcagagatgtaacactgacatgtgccccgtagacggctcatggggaagttggcactcctggtcccagtgttcagcttcatgcgggggtggggagaagaccaggaagaggctgtgtgatcaccctgtaccagttaaaggtgggcgaccatgtccaggagatactactcaggtgacaagatgcaacgtgcaggcctgtcccggtgggcctcagcgggctaggggaagtgtaattggaaatattaatgatgtggaatttggcatcgcttttttgaacgcaacaattactgacagtcctaatagcgacacaaggatcataagggctaagattacaaatgttccacggtcgctgggtagcgcaatgcgtaaaattgtctctattctcaaccctatctattggactacagcaaaggagatcggcgaagcggtgaatggtttcaccctgactaacgcagtgttcaagcgtgagacgcaagtggagttcgctactggcgaaatactgcaaatgtcccacattgctcggggactcgactccgacgggagtctgctgttggacattgtggtgtctggttacgtgcttcagttacagtcaccggctgaggttacagtaaaagactacactgaagattacatccagaccgggcctggccagctgtatgcctactccacccgccttttcaccatcgatggcatcagtataccatacacatggaaccacaccgtcttctatgatcaggcccagggaagaatgccatttttggttgagaccctgcacgctagctcagtggaatccgattacaaccagattgaagagactctggggttcaagatccatgccagcatcagtaaaggcgacagaagcaaccagtgcccttccggcttcactctggactctgtgggtcctttctgcgctgatgaggacgaatgcgccgcaggaaatccctgctcgcatagctgccataatgcaatgggaacctattactgctcctgtcccaaggggctgaccatcgctgcagatgggaggacctgtcaggacatagacgagtgtgccttgggcaggcatacatgccatgcagggcaggactgcgataataccataggatcgtatcgatgcgttgtgcgttgcggttcaggttttcgcaggacgtcggatggactttcttgccaggacatcaatgaatgccaggaatctagcccctgccatcagcggtgtttcaatgccatcggctcgtttcactgtggatgcgagccaggataccaattgaaaggacgaaaatgcatggacgtgaacgagtgtcgtcagaacgtctgtcgcccagatcagcactgtaagaatactagaggcggttacaaatgtatcgacctttgccccaacggcatgaccaaggctgaaaatgggacgtgtattgacatagatgagtgcaaagacggcacccatcagtgtaggtacaatcagatctgtgagaacacccgcggaagctaccggtgtgtgtgtccccgaggttatcggtcacagggagtgggcagaccctgtatggacatcgatgaatgcgagaacaccgacgcctgtcagcacgagtgtaaaaataccttcggcagctatcagtgtatatgtcctcctggctatcagttgacacacaacggaaagacctgtcaagatatcgatgagtgcttggaacagaatgttcattgcggcccaaaccggatgtgttttaacatgcgcggatcataccagtgcattgacaccccctgtccaccaaactaccagcgggatcctgtgagtggtttttgtctgaaaaattgtccgcctaatgacttggaatgcgcactgagtccttatgccctcgagtataagttagtttctctgccattcggcatagcaaccaaccaggacttgattagattagtcgcatatacacaggacggcgttatgcaccctcgcacaacttttctgatggtagatgaggaacaaactgttccattcgctcttcgcgatgagaacttaaagggcgttgtatacaccacccgacccctgagagaggccgagacatatagaatgcgcgtgcgagcctccagctactccgcgaatggtaccatcgagtatcaaacaactttcatcgtgtatatcgctgtatctgcctacccttacta

SEQ ID NO: 225870 - DNA, 723 bp, Artificial Sequence
  Description of Artificial Sequence: Synthetic coding sequence
gcaattggaagtttccattgtggatgtgagccaggatatcagctgaaaggtagaaagtgcatggacgtgaatgaatgtaggcaaaacgtttgccggccagaccagcactgcaagaacacacggggtggatacaagtgcattgatttgtgccctaacggcatgactaaggcagagaacggtacatgcattgatatcgacgagtgtaaagacggaacacaccagtgtcgatataaccagatctgcgaaaataccagggggtcctatcgttgtgtgtgtcccagaggttaccgctcacagggagtcggcagaccttgcatggacatcgatgagtgtgagaacacagacgcctgtcagcatgagtgcaagaacacattcggatcctatcagtgcatctgccccccagggtatcagttgacacacaatggtaagacatgccaggatatagatgagtgtctggagcagaacgtgcattgtggccctaatcggatgtgtttcaacatgcgcggaagctaccagtgtattgacactccctgcccccctaactaccagcgcgaccctgtctccgggttctgtctcaaaaattgtccacccaacgacttagagtgtgccctgtcgccatatgcactggaatataagcttgtcagccttccattcggcatagccacgaatcaggatctcattagactggtagcctacactcaggatggcgtcatgcacccttag

SEQ ID NO: 225871 - DNA, 1455 bp, Artificial Sequence
  Description of Artificial Sequence: Synthetic coding sequence
atggatcttgggaaagaccagtctcatttgaagcatcaccagacccccgatccacaccaggaggagaatcacagtccagaagtcattgggacctggagcctgagaaacagggaactgctgcgcaagaggaaggctgaagtgcatgagaaagagactagccagtggctcttcggagagcagaaaaaacggaagcagcagcgcaccgggaaaggcaaccgaagaggccgtaagaggcaacagaatactgagctgaaagtggagcctcagcctcaaattgagaaagagatcgtcgagaaggctctggcccctatagagaaaaagactgagcctcctggttctataacgaaggtctttccttcggtggcaagcccacaaaaagtagttcccgaagagcacttttctgagatctgccaggagagtaacatttaccaggaaaacttttctgagtaccaggagatcgcagttcagaaccatagctctgagacatgtcagcacgtcagcgagcccgaggatttgagccccaagatgtaccaagaaatctccgttctgcaagacaattcaagcaagatttgtcaggacatgaaagagcccgaggacaacagccccaatacatgccaggtgatctcagtcattcaggatcacccttttaagatgtaccaggacatggcaaagcgcgaagacttggcacccaagatgtgccaggaagcagcagtgcccaagattctaccatgtcctacgagtgaggacacagcagacttggccggttgttcgctccaggcctatcccaagcctgacgttcctaagggctatatccttgatactgatcaaaaccccgcagaacctgaggaatataacgaaactgaccagggtatcgcagaaaccgagggcctctttccaaaaatccaggagatcgcagagccaaaggacctctctacgaagacccatcaggagagtgccgaacccaagtatcttccacataaaacctgtaacgaaatcatagttcctaaggcaccttcccataaaaccatccaggagacaccccactctgaggattatagcatcgaaatcaaccaagagactcctggctccgaaaagtactcgcctgagacctatcaggagatccccggactggaggagtactcgcccgaaatttaccaggagactagccaacttgaggaatacagtccagaaatttaccaagaaaccccaggccctgaggatctctcaaccgagacttataaaaacaaggatgtgcctaaggagtgcttccctgagccccaccaggaaaccggcggtcctcagggacaagacccaaaagcacatcaggaggatgccaaagacgcttataccttcccccaggaaatgaaggaaaagcccaaggaggagccaggcattccagccattcttaacgaaagccaccctgagaacgatgtgtattcctacgtgctcttttag

SEQ ID NO: 225872 - DNA, 1455 bp, Artificial Sequence
  Description of Artificial Sequence: Synthetic coding sequence
atggacctggggaaagatcagtcccacctaaagcaccaccaaacacccgacccccaccaagaggagaaccacagtccggaggtgattggaacttggagtctgcggaatagggagctcctccggaaacgaaaagccgaggtgcacgagaaagaaacctcccagtggctatttggcgagcagaagaagaggaaacagcagaggactggcaaaggcaaccggaggggcagaaaacgccagcagaacaccgagctgaaagtggagccacaaccgcagatcgaaaaggagattgtggagaaggctctggccccaattgaaaagaagaccgaaccgccagggtccatcaccaaggtgttcccttcagtggcttcacctcaaaaggtggtccccgaggaacatttctccgagatatgtcaggaatccaatatttaccaggaaaacttctctgaatatcaggaaatcgcagtccaaaatcattcatcagagacatgccagcacgtgtctgagccggaggacttaagtccgaaaatgtatcaggagatttcagtactacaggataactccagcaagatttgtcaagacatgaaagagcccgaggacaactcgcccaatacctgtcaggttattagcgtgattcaggaccatcccttcaagatgtaccaggacatggctaagagagaggatctcgcccctaagatgtgccaagaagccgctgtgccaaagatcctgccttgccctacctctgaggataccgcggacctggcgggatgtagtctgcaggcctaccctaagccagatgtccctaaagggtacatcctcgacacagatcagaatcctgctgaacccgaagaatataatgagaccgatcaaggcattgccgaaaccgagggcctgttccccaagatccaggagattgctgagcctaaggatctgtccaccaagacacaccaagaaagtgccgagcccaaatatcttcctcacaagacatgtaacgagatcatagtgcccaaggccccatcccacaagacaatccaggagacaccccactcagaggactatagtattgagataaatcaggagacacccggatccgagaagtattcacccgagacataccaggagattcccggactggaggagtattcaccagagatttaccaagaaacgtctcagctagaggaatattcacccgagatttaccaagagacccccggacccgaggacctctccaccgagacctataagaataaggatgtgcctaaggaatgcttccccgagccccatcaagagaccggaggaccccaagggcaagatcccaaagcccatcaggaggacgctaaagacgcttatacctttccacaagagatgaaggaaaaacctaaggaagagccgggaatccccgcaatcctgaacgaatcccatccagaaaacgacgtgtactcttatgtgctgttctag

SEQ ID NO: 225873 - DNA, 429 bp, Artificial Sequence
  Description of Artificial Sequence: Synthetic coding sequence
atggtcttatcgcctgccgataaaaccaacgtgaaggctgcttgggggaaagtcggagcacatgctggtgaatacggcgctgaagctctggaacggatgttcctcagttttccgacgacaaagacgtacttccctcacttcgaccttagccacggttcggcccaagtcaaaggccatggaaagaaagtggcagacgcactaactaatgccgtagctcatgtggacgatatgccaaatgccctatcagccctgagtgacctccatgcccataaactccgggttgatccagttaactttaaactgctgtcgcattgtctgcttgtgacactcgcagctcatctcccggctgagtttacccccgctgtacacgcatctctggacaagtttctggctagtgtgtcgacggtcctgacttcaaaatatcgttag

SEQ ID NO: 225874 - DNA, 429 bp, Artificial Sequence
  Description of Artificial Sequence: Synthetic coding sequence
atggttctatctccagctgacaagacaaacgtcaaagccgcatgggggaaagttggtgctcacgcgggagaatacggcgctgaggcattagaacgcatgtttctttctttcccgacgacaaaaacctatttcccgcatttcgacctgtcgcatggatcagcccaggtgaaaggccatgggaaaaaggtggctgatgcactgacgaatgctgtcgcccacgtggacgatatgccaaacgctttgtcagcactatcagacttacacgcccacaagttgcgggtcgatccagttaacttcaaacttctgagccattgccttctggtaaccctcgcagcacatctgcccgctgaatttacccccgcagtacatgcctctttggacaagttcctcgcctccgtcagtacagttttgacaagcaagtatcgctag

SEQ ID NO: 225875 - DNA, 333 bp, Artificial Sequence
  Description of Artificial Sequence: Synthetic coding sequence
atgtttttgagttttccgactacgaagacgtacttccctcactttgatctgtcacatgggtccgcccaggtgaaaggacatggcaaaaaagtggctgacgccctgacgaatgctgtcgctcatgtcgacgacatgcctaacgccctctcggccctttcggacctgcacgctcacaaactcagagtcgaccccgtgaacttcaaacttttgagtcactgcctgctggtaaccctagctgcgcacctgccagctgagtttacaccagcagtccatgcatcattggataagtttttggcctcggtgtctactgttttgacctccaagtatcggtag

SEQ ID NO: 225876 - DNA, 444 bp, Artificial Sequence
  Description of Artificial Sequence: Synthetic coding sequence
atggtgcacctgactcccgaagaaaagtccgcagttaccgcactgtgggggaaggtcaatgtcgacgaagtaggcggagaggccctcggcagactcctggtggtctatccatggacacagcggttcttcgagtctttcggtgatcttagcacccctgacgccgttatgggtaatcctaaggtgaaagcacatgggaagaaggtgcttggggcattttccgatggccttgcccacttggataatttaaaagggactttcgctacgctgagtgagctgcactgtgacaaattgcacgttgatcctgaaaattttaggctcctaggcaatgtgctggtttgtgtcctggcccaccacttcgggaaagagttcaccccaccggtgcaggctgcttatcagaaagtagttgccggagttgccaacgcactagcccacaagtatcactag

SEQ ID NO: 225877 - DNA, 273 bp, Artificial Sequence
  Description of Artificial Sequence: Synthetic coding sequence
atggtgcacctgaccccagaggaaaaaagcgcggttactgcactgtggggcaaggtgaatgtcgatgaagtggggggagaagctctcggcaggttactggtggtgtatccctggactcagagatttttcgagtctttcggcgacttgtccacccccgacgcagtcatgggcaatccaaaagttaaggcacatgggaaaaaagtgctgggagccttctctgacggcctagcacacctggacaatctcaagggcactttcgctacactctcatag

SEQ ID NO: 225878 - DNA, 426 bp, Artificial Sequence
  Description of Artificial Sequence: Synthetic coding sequence
atggtacacctaacgccagaggaaaagactgcagtgaacgccctgtgggggaaggtaaacgtggatgcggtcgggggagaagcattaggcagactgttggttgtctacccctggacacagcggtttttcgaatcctttggagacttgtcgagccccgatgccgtgatgggtaatcccaaggtgaaggcacatggcaagaaagtcctgggcgcatttagtgacgggctagcgcacttagataaccttaaagggacattttcgcagctgtccgaactgcattgtgacaagctccacgtggatccagaaaatttccgcgtgtgcaagaaggtacccgaagcgcttcaaattggttccacgtgtctgttctataaggaatacatgggaaaggagaagtccaaaggcactgtccaaggtatcaacggctag

SEQ ID NO: 225879 - DNA, 444 bp, Artificial Sequence
  Description of Artificial Sequence: Synthetic coding sequence
atggtgcacctgacccctgaagagaagacagcggtcaatgccttgtggggcaaagtgaatgtagatgcggtcggcggagaagcactcggtcgactgttagtagtgtacccatggacgcaaaggttcttcgagagcttcggcgacctgtcaagccccgatgccgtgatggggaaccctaaagtcaaggcacatggaaaaaaggtgctcggtgcgttctccgatggcctggcccatctagataatttgaaagggacatttagtcagctgagcgagttacattgcgacaaactgcatgtggatcccgagaatttcagactcctgggcaatgtcctggtgtgcgtcctggccagaaactttggaaaagaattcacgcctcagatgcaggctgcctaccaaaaagttgtggccggagtggccaatgctctcgcccacaagtatcactag

SEQ ID NO: 225880 - DNA, 315 bp, Artificial Sequence
  Description of Artificial Sequence: Synthetic coding sequence
atggtccatctcactcccgaggagaaaacggctgttaatgccttatggggcaaggtgaacgtggacgccgtgggaggagaggcgttaggacgcctgttggtcgtgtatccctggacacaacgcttcttcgagtccttcggggacctaagtagtcccgatgccgtgatgggaaatcccaaagtgaaagcccacgggaaaaaggtgctaggggcattctccgacggtctcgcacaccttgacaatttgaaggggaccttcagtcaactgtcggagctccattgcgacaaattgcatgtcgaccctgaaaacttctag

SEQ ID NO: 225881 - DNA, 444 bp, Artificial Sequence
  Description of Artificial Sequence: Synthetic coding sequence
atggttcacttcactgccgaggaaaaagcagccgtgacttctctgtggtccaagatgaatgttgaggaggccggaggagaagcactcggcaggttgctagtggtctacccctggacgcagcgcttttttgactcgtttgggaacttgagctccccttccgccatacttggtaaccctaaagtcaaggcccacgggaagaaagtactgacctcgtttggtgacgccattaagaacatggacaatctgaaaccagcctttgcgaaactttccgaactgcattgcgataagttgcatgtggatcctgagaactttaagcttctggggaatgtcatggtgatcatcctggctactcactttgggaaagaattcaccccagaggtgcaggccgcttggcagaagcttgtctccgctgtagcgatcgccctcgcccataagtaccactag

SEQ ID NO: 225882 - DNA, 444 bp, Artificial Sequence
  Description of Artificial Sequence: Synthetic coding sequence
atggtgcacttcacagctgaggagaaggcagccgtcacatctttatggagtaagatgaatgtggaagaggccggaggcgaggcgctggggagattgctggttgtgtacccctggacgcagaggttcttcgattctttcggcaatctgtcctctccatcggctattctaggaaatcctaaggtgaaggcccacggtaaaaaagttctgacttcctttggcgacgctattaaaaacatggacaatctgaagcccgcttttgctaagctgagtgagctgcattgtgacaagctgcatgtggatccagagaattttaagctcctcggaaatgtaatggttataatcctggcaacacactttgggaaggaattcactcccgaggttcaggccgcttggcagaagctggtgagcgctgtcgccattgccttggcacacaagtatcactag

SEQ ID NO: 225883 - DNA, 264 bp, Artificial Sequence
  Description of Artificial Sequence: Synthetic coding sequence
atggttcattttacagcagaggaaaaggccgctgtgacaagcttgtggagtaaaatgaatgttgaggaagcgggtggagaggctcttgggcgtctgctggtggtgtacccttggacccagagattctttgacagcttcggcaatctgtcttcgccaagcgcgattctgggtaaccccaaggtgaaggcccacgggaagaaagtcctgactagtttcggggacgctattaagaatatggataacttgaagccagctttcgcatag

SEQ ID NO: 225884 - DNA, 444 bp, Artificial Sequence
  Description of Artificial Sequence: Synthetic coding sequence
atgggtcacttcactgaagaggacaaggcaacaatcacttccctgtggggaaaggtaaatgttgaggatgctggcggagagactctgggaagacttctcgtggtttacccatggacccagaggttctttgacagtttcggcaacctgagttctgcctctgcaattatggggaaccccaaggtgaaggcgcacggcaaaaaagttctgacctcgttgggcgacgcaacaaagcatctggatgatctgaaagggactttcgcccagctcagcgaactgcattgcgataagctccatgttgatcccgaaaacttcaagctcctgggcaatgttctcgtaactgtgctcgcgatccacttcggaaaagaattcacccccgaagtgcaagccagttggcagaagatggtgaccgcagttgcaagcgccctgagttctcgctaccattag

SEQ ID NO: 225885 - DNA, 444 bp, Artificial Sequence
  Description of Artificial Sequence: Synthetic coding sequence
atgggccatttcaccgaagaagacaaggccaccattacaagtctgtggggcaaggtgaacgtggaagacgcgggaggagagaccctaggcaggttgcttgtggtctacccatggactcagaggttcttcgattcatttgggaatctgtcatctgctagcgcaatcatgggcaaccctaaggttaaggcccatggcaagaaggtcctgaccagcctgggggacgctatcaagcaccttgatgaccttaagggcactttcgctcaattaagcgaactccattgtgacaaactgcacgtggaccccgagaacttcaagctcctgggcaacgtgctggtaacagtgctggccatacacttcggaaaggagtttacaccagaagttcaggcgagctggcagaaaatggtaacaggggttgcatctgcactgagcagccgataccattag

SEQ ID NO: 225886 - DNA, 477 bp, Artificial Sequence
  Description of Artificial Sequence: Synthetic coding sequence
atgggccacttcactgaggaggataaagcaaccattacatcgctgtggggcaaggttaacgtggaagacgcaggcggtgagacattaggacgcctcctggtagtgtacccatggacacagaggttctttgacagcttcggcaatctttccagcgctagtgccataatgggcaatcccaaggttaaagcccacgggaagaaagtgttgacttctctgggcgacgccatcaagcaccttgacgatctgaagggcacatttgctcagctcagcgaattacactgtgataagctgcatgttgaccccgagaattttaagcttctggggaatgttctcgttacagtgctggctatccactttgggaaagaattcacccccgaggtacaggcctcatggcagaagatggactggtcaggccaatgtccagtgctgcaaattcccctatcctcgttgcctatgatgcagagcttccaagggtag

SEQ ID NO: 225887 - DNA, 414 bp, Artificial Sequence
  Description of Artificial Sequence: Synthetic coding sequence
atggtggtgctgggcgaaatgaagagaaaggtcttacctctacatttcctccccttcatgcgcctcctggtcgtatacccatggacacagcgttttttcgactctttcgggaatctgtcatccgccagcgctatcatggggaatcctaaggtcaaggcgcacgggaaaaaggtcctcacctctctgggtgacgccattaagcacctggacgatcttaagggaacgtttgctcagctgtcagagctgcattgtgacaagctgcacgtggatcctgagaatttcaagctgctgggcaatgtgctggtcaccgtgctggcgattcatttcggaaaagagttcacacccgaggtccaggccagctggcagaaaatggttactggtgtagcatcagcactgagttcaaggtaccactag

SEQ ID NO: 225888 - DNA, 444 bp, Artificial Sequence
  Description of Artificial Sequence: Synthetic coding sequence
atgggtcattttacagaggaagacaaagccaccattactagtctgtggggcaaggtgaatgtggaggatgcaggcggagagaccttggggagattgctggtagtgtacccttggactcagcggttctttgatagctttggaaatctgagctccgcctccgcaataatgggcaatcccaaagttaaagctcatggaaagaaggtgcttacctctttgggtgacgctataaagcatctggacgacctgaaaggaaccttcgctcagctttctgagctgcattgtgataagctgcatgtggaccctgaaaatttcaaactcttgggcaacgtgctcgttaccgttctggccatccatttcgggaaggaatttactcctgaagtgcaggcgagctggcaaaaaatggtgaccggcgtagcctcagccctatcatctcgatatcactag

SEQ ID NO: 225889 - DNA, 426 bp, Artificial Sequence
  Description of Artificial Sequence: Synthetic coding sequence
atgttgtcagctcaggagcgcgctcagatagcccaggtctgggatctgatagcgggacacgaagcacagtttggcgcagaactgctcctgagattattcaccgtctatccttcaaccaaagtttacttccctcatctgtctgcttgtcaggatgcaacccagttgctgtcgcatgggcagcgtatgctggctgccgtgggggcagcggtgcagcacgtggacaacttgcgagctgccttgtcaccactggccgatttacacgcactggtcctacgcgtggaccccgctaacttccccttactgattcagtgcttccacgtggtgctggctagccatttgcaggatgaattcactgtgcagatgcaagccgcttgggacaagtttctgacgggggtcgccgtggtgctgaccgaaaaataccggtag

SEQ ID NO: 225890 - DNA, 429 bp, Artificial Sequence
  Description of Artificial Sequence: Synthetic coding sequence
atggcactgtctgccgaggatcgcgctcttgtgagagctctgtggaaaaaactcggctccaatgtcggagtctacaccacggaggccctggagcgaacctttctggcctttccggcaaccaagacttatttctcacacctcgatttgtccccaggaagttcgcaggtgcgagcacacgggcaaaaggttgctgatgctctgtcactggccgtggagcgcctggacgacctacctcatgctctaagcgccctgtctcatctgcatgcgtgtcagttgagagtagaccctgcctcattccaactcctgggccattgcctactggtcaccctggctcgacattatcccggtgattttagccctgcccttcaggcatctctcgacaagtttctgtcccacgtaatttcagcccttgtgtccgaatacagatag

SEQ ID NO: 225891 - DNA, 429 bp, Artificial Sequence
  Description of Artificial Sequence: Synthetic coding sequence
atgagcctgactaaaacggaacggacaattattgtctccatgtgggctaagatcagcactcaggcagacaccatcggtaccgagacactggagcgcctatttctgagtcacccccagacaaaaacctacttcccgcacttcgacttacacccaggatctgcccaactgcgtgcgcacgggtccaaagtggtagccgctgtcggggatgctgttaagtcgattgatgatattggcggtgcactgtccaagttgagcgagctacacgcttacattctgcgcgtggaccccgtcaactttaaactgctgagccattgtctactggtaacgctggccgctcgtttccctgccgactttacggcagaagcccatgcggcatgggacaagtttttatccgtcgtttccagcgtcctcaccgaaaaatacaggtag

SEQ ID NO: 225892 - DNA, 1389 bp, Artificial Sequence
  Description of Artificial Sequence: Synthetic coding sequence
atggcccgagttctgggcgcaccagtggcgttgggcctatggtccctgtgttggagtctggccatagccactcctctgccccctacatcagcccacgggaacgtagcggagggcgagactaagcctgatcctgacgtgacagagcgttgcagcgacggttggagcttcgatgcgacaaccctcgatgataacgggaccatgcttttttttaagggagaattcgtgtggaaaagccacaagtgggatcgggagctgatttccgagaggtggaagaacttcccttcaccagtcgacgccgcatttaggcaggggcacaattctgtcttcctcatcaaaggagacaaggtttgggtctatcctcccgaaaagaaggaaaaaggctatcccaaattattacaggatgagtttcctggcatccctagtcctcttgatgccgcagtggagtgccacaggggcgaatgccaggcagaaggagtgctgttttttcaaggcgatcgcgaatggttctgggatcttgctacaggtacaatgaaggagcgatcttggccggcagtcgggaactgtagtagtgcgctcagatggctcggcagatactattgcttccaggggaaccagtttcttcggttcgaccccgtgagaggcgaggtacctcccagataccccagagacgttcgcgactacttcatgccctgccccggacgcggacatggccaccgaaacggtaccggacatggaaactcgacacaccatggacccgagtacatgaggtgttccccacatctggtcctgagcgctttgacttccgataatcacggtgctacatacgccttctccggtacccactactggagactggatacgtccagggacgggtggcactcctggcctattgcgcaccaatggccgcagggaccctccgccgttgacgcagctttttcctgggaagagaagctttatctcgttcagggcacccaagtgtatgtttttctgacaaaaggcggatataccctggtgtctggttatcctaagcgactggagaaggaggtgggcacaccacatggcattatcctggattctgtggatgccgcttttatctgtccaggatcctcccgcctccacatcatggcgggacgacgactatggtggctggacctcaagagcggggcacaggctacttggactgagcttccatggccccacgaaaaagtggacggtgccctgtgtatggaaaaaagtctaggaccaaactcctgcagcgcgaacggccctggcctttatctgatacatgggccaaacctctattgctattcagatgttgagaaactgaatgcagcgaaagccttgcctcaacctcagaacgtcacatctctcttgggctgtactcactag

SEQ ID NO: 225893 - DNA, 765 bp, Artificial Sequence
  Description of Artificial Sequence: Synthetic coding sequence
atggctcgcgtgctaggcgcaccagttgctctcggcctctggtctttgtgctggtcgctggccatcgctacgccacttccgccaactagtgcccacgggaatgtagccgaaggagaaacgaaaccagaccccgacgtgaccgagagatgcagcgatggctggtcttttgacgccacaacactggatgataacgggactatgctgtttttcaaaggagaattcgtgtggaaatcccacaagtgggatagagaattaatctcggaaaggtggaaaaacttccccagcccagtggatgcagccttcaggcaggggcataactcagtttttttaattaagggtgacaaggtttgggtttatccccctgagaagaaggagaaaggctaccccaaacttctccaggatgaattcccaggcataccctcaccactggacgccgctgtggaatgccacagaggtgagtgtcaggccgaaggggtgctgttttttcaaggagaccgtgagtggttttgggacctggccacaggaacaatgaaagagaggtcctggcccgcagtgggcaactgtagttccgcactacgttggcttggaagatattattgtttccagggcaatcagtttctacggttcgacccagttcgcggtgaggttcctcctaggtaccctcgagacgttcgggactatttcatgccctgccccggacgtgggcacggacataggaacggcacaggacacggaaactcaatatgcgctgtggcccacatctag

SEQ ID NO: 225894 - DNA, 1353 bp, Artificial Sequence
  Description of Artificial Sequence: Synthetic coding sequence
atgtggctaaaggtgtttaccacttttttgtctttcgccacaggcgcttgttctgggctcaaggtaaccgtcccatcccatacagttcatggggtgagaggccaggccttgtaccttcccgttcattatggcttccataccccagcaagcgacatccaaattatctggctcttcgagcgcccacataccatgcctaaatacttgttaggctccgtgaacaagtctgtcgtgccggatctggagtaccagcacaagttcactatgatgccgccaaacgcctcactgttaatcaaccccctacaattcccagatgaggggaattacatcgtcaaagtaaacatccagggcaacgggacccttagcgcttcccagaagatccaggtgaccgttgacgatccagtgaccaaacccgttgtgcaaattcaccctccctccggggctgtggaatacgtggggaatatgaccctgacctgtcacgtggagggcggaactcggttggcatatcagtggctgaaaaatggccgacctgtgcacacctcgagtacctattcgttttcaccccagaacaacactctgcacattgcacctgtaaccaaggaagacatcggcaattatagttgccttgtgcggaatcctgtgtccgaaatggaatccgacattattatgccgatcatttactacggcccttacggactccaggtgaatagtgacaaggggctcaaggtaggtgaagtgtttaccgtcgatctgggtgaagcaatactgtttgactgcagtgccgatagccatccccctaacacatattcgtggatccgaaggactgataatacgacctacattatcaagcacggaccacgcctggaggtcgcttctgaaaaagtagcccaaaagactatggactacgtgtgttgcgcatacaacaacattaccggtaggcaggacgagacccattttaccgttattattactagcgtgggtctggagaagctggcacagaaagggaagtcactttcccccctagcctctatcaccggtatctctttgttcttgatcatcagcatgtgtttgctgttcctgtggaagaaatatcagccttataaggtaatcaagcagaagcttgaaggtcggcctgaaactgagtatcgcaaggcccagaccttcagcggacatgaagacgctttggatgatttcgggatctacgagttcgtggcctttcccgacgtctccggcgtctctaggattccttcaagatctgtgccagcgtctgattgtgtctcaggccaagatctgcattccaccgtctatgaagtaattcagcatattccagctcaacagcaggaccaccccgagtag

SEQ ID NO: 225895 - DNA, 1389 bp, Artificial Sequence
  Description of Artificial Sequence: Synthetic coding sequence
atggggcaagatgcttttatggagccatttggggataccctcggggttttccagtgcaagatttacctgctgctgttcggggcttgctctggactcaaggtgactgtgcccagtcacactgtgcatggcgtccgaggccaggccctctatctccctgtgcattacgggtttcatacacctgcaagcgatatccagatcatatggcttttcgaacgccctcataccatgccgaagtacttgctcggatcagtgaataaaagtgtcgtgccggatttggagtatcagcacaagttcacgatgatgccccctaacgctagcctgctcattaaccccctgcagtttcctgacgaaggaaactacattgtcaaggtaaatattcagggaaacggtactctgtctgccagtcagaaaatccaggttacagttgacgaccccgtgacaaaacccgttgtccagatacatcccccaagcggggcagtggagtacgtaggaaacatgacgttgacatgtcatgtcgagggaggaaccaggttggcatatcaatggctgaagaacggacgccctgtgcacaccagctctacttattccttttccccacagaataacactctgcatatagcgccagtgaccaaagaggatattggcaattattcctgcctcgtgaggaaccctgtatcagaaatggagtccgatataattatgccaataatttactacggtccgtatggactgcaggtgaatagcgataaaggtttaaaggtgggagaagttttcactgttgacttaggtgaggcaatcctctttgattgtagtgcagactctcaccccccaaacacatactcttggattaggaggaccgacaataccacctacatcattaaacacgggcctcgactagaggtggccagcgaaaaggtcgcacagaagacaatggattatgtctgctgtgcctacaacaatatcacagggagacaggatgagactcacttcaccgtgatcattaccagtgtcggtctggagaagttagctcagaagggcaaatctctctcaccactggcttcaattacaggcatttccctgtttctcattatcagtatgtgtctcctttttttgtggaagaaatatcagccttacaaggttatcaaacagaaacttgaggggagacccgagaccgagtaccggaaggcccaaacattttctggccatgaagatgccttggatgatttcgggatttatgagttcgtggcttttccagacgtctcgggggtgtcacgaatcccttcaaggtcggtcccagcatctgattgcgtgagtggtcaagacctacatagcaccgtgtatgaggtgatacagcatattccagcgcaacagcaggaccatcctgagtag

SEQ ID NO: 225896 - DNA, 1104 bp, Artificial Sequence
  Description of Artificial Sequence: Synthetic coding sequence
atggcctatagggtgctgggcagagccggtcctcctcagcctaggagggcacgacgtctgctttttgcgttcaccctttctctgagttgcacctatttgtgttactcattcctctgctgttgtgacgatctgggacgaagtcgcttgttaggcgcacccagatgtctgcggggtccaagcgcgggaggacagaagctcctacagaagtcccgaccgtgcgacccatccggcccaacaccctctgagccatccgccccaagtgcgcctgccgcagctgtgcccgcacccagattgagcggctccaaccattctggcagccccaaactgggaactaaacggctgccacaggccctgatcgtgggcgtgaagaagggcggaactagggccgtccttgagttcatcagagtgcaccccgatgttcgggcactggggactgagcctcacttttttgatagaaattatggtcgcggattagactggtacagatcactaatgcctaggaccctggagtcccagataactttggaaaaaacgccaagttacttcgtgactcaggaagcgcctcgaagaatcttcaatatgagccgagatacgaagttgatcgtagtcgtgagaaatcctgtgacacgggctattagtgattatacccagaccttatccaagaagcccgatatacccacgttcgagggtcttagttttcggaataggaccctgggcctggtggacgtaagttggaatgcaatacgcatcggaatgtacgtgttacatctagagagctggttgcaatactttcccctggcacagattcacttcgtttcgggcgagagactgattacggaccctgcgggagaaatgggaagagttcaggactttctgggaattaaacggttcattacggataagcatttctattttaacaaaactaaggggtttccttgcctgaaaaaaactgagagctccttgctgccccgttgcctgggtaagagcaaggggagaacacatgtgcagattgaccctgaagtgatcgatcagctaagggaattttaccggccttataacattaagttctacgagactgtggggcaggatttccggtgggaatag

SEQ ID NO: 225897 - DNA, 1035 bp, Artificial Sequence
  Description of Artificial Sequence: Synthetic coding sequence
ccaccggctcgcgcacacggggcaatggcatacagagtgctgggtagggccggtcctcctcagcccagaagagccaggcggctgctttttgcctttacactatcattgtcttgcacctacctctgttactcttttctgtgttgctgtgatgatctggggagatcgagactacttggcgctcctagatgcctgaggggcccatctgcagggggtcagaaactcttacagaaatcccgcccttgtgatccctccggcccaaccccgtcggagccttctgcaccatcagcccctgctgccgcagtgcccgctccacggttgtccggctccaaccattcaggatcgcccaagctgggaaccaagagactacctcaagccctgattgtcggagtgaaaaaggggggaacccgggcagtgctggaattcatccgggtacacccagatgtacgggcactaggcactgagccacatttcttcgacagaaattatggtcggggtctggattggtaccgttcattgatgccacggacactggagagtcagatcaccctcgagaaaacacccagttacttcgtgacgcaggaagcccctcgacggatcttcaacatgagccgcgatacaaaattaatcgttgtcgttaggaaccctgtgaccagggccatatccgactatacacaaacgctgtctaaaaagccagacattcctacattcgaggggttatcgtttagaaatagaacactgggcctggtcgacgtgtcgtggaacgctatacgcattggcatgtacgtactacatcttgaatcttggttgcagtacttccccctcgcgcagatccacttcgtgagtggcgagcgactgataaccgacccagcaggagagatgggcagagtccaggattttcttgggataaagcggtttatcaccgacaagcatttctactttaacaagactaaaggattcccatgcctaaagaaccgcatagaaccccctgccagcatgctgggccagatcaaaagggaaaattcctgcaccgattag

SEQ ID NO: 225898 - DNA, 1221 bp, Artificial Sequence
  Description of Artificial Sequence: Synthetic coding sequence
atggcacctcctggcccagcctcagctttaagtacttcagcggagcccctgagccggagtatttttcggaaattcctgctgatgctctgctccctcttgacctctctttatgtcttttactgtcttgcagagcgatgtcagacactctcaggacctgtggtggggctctctggtgggggtgaggaggccggagcccctgggggaggagtcctcgccggaggcccacgggaactggcggtatggcctgctgcggcacagcggaaacgattgttgcagcttccgcagtggcgcagaagacggcctcccgcaccgagagatgacggggaggaggccgcatgggaggaagagtctcccggtctcagcgggggacctggcggaagcggcgctgggagtacagtcgccgaagctcctccaggcacccttgcgctcctgttagacgagggatccaaacagctcccacaggccattataataggggtgaaaaagggcggaacacgcgctctattggagtttctcagggtgcaccctgacgtacgcgctgtaggggctgaaccacacttcttcgatagatcttatgataagggcttagcatggtaccgggatctgatgccaaggacattagacgggcagattactatggaaaaaactccttcttactttgttaccagagaggcaccggctagaatctcagccatgagcaaggacacaaaacttatcgtggttgttcgtgatccagtaactagggcgatctccgactacacgcagaccctgagcaagcggcctgacattcctaccttcgagagcttgacattcaagaataggactgctggccttatcgacacctcttggtccgctattcagatcggcatttatgccaaacacctcgagcactggcttaggcatttccccattaggcaaatgctcttcgtgtcgggggaacgacttatatccgatcccgctggcgagcttggaagggtgcaggatttcctcggactgaaaagaatcatcactgataagcatttttatttcaacaaaaccaaaggcttcccctgtttgaagaaagccgaaggctctagtaggccacactgtttggggaagaccaaggggcgaacccaccccgagatcgatcgggaggtggtgcggagactgcgagagttctatagaccattcaacctgaaattctatcagatgacaggccatgatttcgggtgggacgggtag

SEQ ID NO: 225899 - DNA, 1173 bp, Artificial Sequence
  Description of Artificial Sequence: Synthetic coding sequence
atgggacagagactgtcaggcggaaggtcttgtctggatgtccctggacggcttttgccccagccccctcctccgcctcctcccgtgagacgaaagctcgctctgcttttcgctatgctatgtgtgtggctttacatgtttctatacagctgtgctggctcctgcgctgctgccccaggactactgctgttggggtcaggaagtcgagcggcacacgacccccctgcactcgccactgcccctgatggaactcccccacgactcccatttcgtgcaccacctgcgacccccttagcctccggaaaagagatggccgagggcgctgcttcccccgaggagcagagtccagaggtgcctgacagcccctcgcctatttctagctttttttctgggtccggttccaagcaattgcctcaggctattatcatcggcgttaagaaggggggaacccgggctctcctggagttcttgcgtgtccacccggacgttagggcggtcggcgctgaacctcacttttttgaccgctcttacgataagggccttgcgtggtaccgagacctgatgcctaggaccctcgacggacagataacaatggaaaagacaccgtcttatttcgtgactagggaggccccagcacggatctctgcaatgtctaaagataccaaacttatagtagtggtcagggatcccgtcacaagggccatcagtgactacactcagacattgagtaagcgtcccgatattccaaccttcgagagccttacgttcaagaaccgcactgcaggactcatcgatacctcatggtccgctattcaaattggcatttacgcaaagcacctggaacattggctccgtcattttccaatccgccagatgctcttcgtctctggagagcgcttgatctcggatccggcaggagaactcggcagagtgcaagacttcctaggcctgaagagaattataaccgacaagcacttttatttcaataagacaaaaggttttccatgtctgaaaaaagccgaaggatcaagcagacctcattgtcttgggaaaaccaaggggagaacgcaccctgaaatcgaccgagaggtggtgcgcaggctgcgcgagttttatcgaccattcaacctgaagttttatcagatgacagggcacgattttgggtgggactag

SEQ ID NO: 225900 - DNA, 1173 bp, Artificial Sequence
  Description of Artificial Sequence: Synthetic coding sequence
atgggccaacggctcagcgggggtaggtcatgtctggacgttcccggtaggctccttcctcagcccccaccacctcctccgccagtgaggcgcaaattggcacttctgttcgccatgctgtgcgtgtggttgtatatgtttctctactcttgtgccggttcctgtgctgccgctcctgggcttctactactgggttccggtagccgcgctgcacatgacccacccgctctggcaaccgccccagacggcactcctccaaggctcccgtttagagctccccctgccacccctctagccagcgggaaggagatggccgagggcgctgcatccccagaagagcaaagccctgaggttcccgattcccccagccctatttcttcattcttttccggaagtgggtccaagcaacttccccaggccatcattatcggagtaaagaagggcggtacccgcgcacttcttgaatttttaagggtgcatcctgacgtacgggctgttggagccgaaccacattttttcgaccgatcctatgacaaaggactcgcatggtaccgggatctaatgcccaggactttggatggccaaatcacaatggagaagacgcctagttactttgtcacccgtgaggcccctgcaagaatctccgctatgtctaaagatacaaagctgatcgtggtcgtgagggatcccgttactcgggctataagtgactacactcagaccctgtcaaaacggccagatatccccacattcgagtccctcaccttcaagaatcggacagcgggactgattgacacatcctggtctgctattcaaatcgggatctacgcgaaacaccttgagcactggctgagacatttccccattaggcagatgctattcgtctcgggggagagactcatttccgatcccgcaggggagctggggcgtgtccaagattttcttgggttgaaaagaatcattacagacaagcatttctacttcaacaagacaaaagggttcccttgccttaagaaagccgagggcagtagcaggccacattgcctcggcaaaacaaagggacgaacacatcctgaaatagatagagaagtcgtcagaaggcttcgggagttctatcggccattcaacctgaaattttaccagatgaccgggcatgatttcggttgggattag

SEQ ID NO: 225901 - DNA, 1371 bp, Artificial Sequence
  Description of Artificial Sequence: Synthetic coding sequence
atggctcggtggcccgcacctccccctccgccacctccgcctcctccactggcggctccccctccacccggagcttctgccaagggccctcccgctcggaagctgctgttcatgtgcacgctcagtctgagcgtgacgtacctgtgctacagccttttggggggatccgggagtctccagttccccctggcattgcaggagtctcccggagcggcagcagagcctcctccttctccacccccaccctcactcctgcctaccccagtgaggctaggagccccttcccagcctcccgctcccccacctttggataacgcctctcacggcgagccaccagagccacctgaacagccggctgcaccgggaacagacggatggggccttccttcaggcggtggcggagcccaggacgcttggctcagaaccccactcgctccttcggaaatgatcaccgcacagagcgctctccctgagcgggaggcacaagagagtagcactaccgatgaggacctggcgggacgaagagcagccaatggatctagcgagcgcggaggcgctgttagcactcccgattacggggagaagaagttaccacaggctctgattatcggtgtcaagaaaggtggtacacgggctttactggaagctatccgggttcaccctgatgtacgcgctgtcggagttgagcctcacttctttgaccgaaactacgagaaggggttggaatggtaccgcaatgtgatgcctaagacgctggacggtcagattaccatggaaaagacgcctagctattttgtaacaaacgaggcccctaaaagaatccatagtatggctaaggacattaaactcatcgtcgttgtgagaaacccggtcaccagggccatcagcgactatacacagacactctccaagaagcccgagattccgaccttcgaggtgttggcttttaaaaaccggacattgggcctcattgatgcctcatggtccgcaatacgaatcgggatctacgcacttcatctcgagaactggctccaatactttcccctttcgcaaatattgtttgtgagcggggaaaggttaatcgttgatccagctggggaaatggctaaagtgcaggattttcttggactgaagcgggtggtaacggagaagcatttctattttaataagacaaagggatttccctgtctaaagaagcctgaagacagctccgcacctcggtgcctgggcaagtctaagggaagaactcacccacggatagatccagatgtgatccaccggctaaggaagttttacaaacctttcaatctgatgttttaccaaatgaccggccaggactttcagtgggagcaggaagagggagataaatag

SEQ ID NO: 225902 - DNA, 1041 bp, Artificial Sequence
  Description of Artificial Sequence: Synthetic coding sequence
atgcttttcaaacagcaagcttggctgaggcaaaagctccttgtgttgggaagtcttgcagtggggagtctcctatatctcgtggccagggtgggaagcctcgataggcttcaacccatttgcccgatcgaaggcaggctgggcggagctaggacccaggccgagttcccccttcgggctctgcagttcaaaagaggtcttcttcacgaatttcgaaaaggcaatgcatctaaagaacaggtccgcctccacgatctggtgcagcagctcccaaaggccattataatcggcgtgaggaaaggaggaacacgggcactattggaaatgctgaatcttcacccagctgtcgtcaaagcttctcaagaaatccacttcttcgataacgacgaaaactatggaaagggtatcgagtggtatcgtaagaaaatgccatttagctacccccagcagatcacaatagagaagagcccagcctacttcatcactgaagaagtgcctgagcgtatctacaagatgaacagtagtataaaacttctgattatagtgagagaacctaccacgcgggcaatcagcgactatactcaggtgttagagggaaaagagcgtaaaaacaagacctattataaattcgagaaactggcaatcgacccaaatacctgtgaagtgaacaccaaatacaaagctgtccgcacttccatttataccaaacacctggagaggtggctaaaatacttccccatcgaacagtttcatgtagttgatggggaccgtctgattaccgagccgttgcctgaacttcaattggtcgaaaaatttctcaatcttccccctcgcattagtcaatataatctttattttaacgccacccgcggtttttattgtctccgctttaacatcatcttcaataagtgcctcgccggaagcaagggaaggatccacccagaggtcgacccaagtgtcataaccaaactccggaagttttttcatcctttcaaccaaaaattctaccagataacaggtcgcacactgaattggccttag

SEQ ID NO: 225903 - DNA, 1041 bp, Artificial Sequence
  Description of Artificial Sequence: Synthetic coding sequence
atgcttttcaagcagcaggcgtggctgcgacagaagttgctcgtgcttggaagcctggctgtggggtctttgctttacctggttgccagggttggctccctcgatagactgcagccaatctgccccattgagggccgactgggaggagccaggacccaggccgaatttcctctgagagcccttcagtttaagcggggactgctccacgaatttcgcaagggaaacgccagcaaggagcaggtacgcctgcacgatctggtccaacaactcccaaaggcaattataataggagtccgaaaaggcggtactcgagctcttctggaaatgttaaatctgcatccggcagtggtaaaagccagtcaggaaatccacttcttcgataacgatgagaactatgggaagggaatcgaatggtatcggaagaaaatgcccttctcttaccctcagcaaataacgatcgaaaaatctcctgcttactttattaccgaagaggtgccggaacgcatctacaaaatgaatagttcaatcaaactccttataattgtacgtgagcccactacaagggccatctccgattacacacaggttctcgagggcaaggagagaaaaaataagacttactataagttcgaaaagctggctatcgatccgaatacatgcgaggtgaacactaaatacaaggccgtgcgcactagtatttacaccaagcacctagagcgctggctgaaatactttcctattgaacagttccacgttgttgacggagacaggctgatcaccgaacctctgcctgagctgcaactcgtagagaagttcttaaacttgcctccgcgtatctcccagtacaatctttactttaacgccactcgtggattttactgtctccggttcaacatcatttttaacaagtgcctggctggatccaagggcagaatccatcctgaggtggatccatccgtgatcacaaagttaagaaagttttttcatccttttaaccagaagttttatcagatcactggcagaaccctcaattggccttag

SEQ ID NO: 225904 - DNA, 969 bp, Artificial Sequence
  Description of Artificial Sequence: Synthetic coding sequence
atgctcttcatcaagtttattcatctggaggtgtttagcatgcccgagagggccattgctagacatgaagtccgggaaattgaacaaaggcataccatggatggtcccagacaagatgccacactggacgaagaggaagatatggtgatcatctataatcgggtcccaaaaacagcttccacatccttcaccaacatcgcttatgacttgtgtgccaaaaataagtaccatgtgctgcatataaatactactaagaacaaccctgtgatgagcctccaggatcaggtgagattcgtgaagaacattacatcttggaaagagatgaagcccggattttatcacggacacgtgagttacttggacttcgccaaattcggtgtgaagaagaagcccatctacattaatgtcattcgggacccaatagagaggctggtgtcctattactactttctgagatttggagatgattatcgcccaggcctgaggcgtaggaagcaaggtgataagaaaacgttcgatgaatgcgtggcggaagggggtagcgattgcgcccctgagaagctgtggcttcagatcccgttcttctgtggtcatagttctgagtgctggaatgtgggttcgcgctgggccatggatcaggccaagtataatcttatcaacgaatacttcctggtcggagttacagaggagctggaagattttatcatgttgttagaagcggctctgcccagattctttcggggagcgacagaattatatcgcaccgcacccgataccgctaccccttcccaccgacacggcccaatttgtggcagcaagtctatttcttcactgctcgtcaaggtatctcccgtgtgcaaggattcacactgccactgcaggcggggaactgggactcccaaaggcgagacattagccaccctggctccttgttcccagagctggtcttctgtaacccatagatggtag

SEQ ID NO: 225905 - DNA, 912 bp, Artificial Sequence
  Description of Artificial Sequence: Synthetic coding sequence
atgctgttcatcaagttcatccacctagaggttttctctatgcccgagcgcgctattgcacgccacgaggtgcgtgagatcgagcagaggcataccatggacgggcctaggcaggatgcaacactggacgaagaagaggacatggttatcatttacaatcgtgtccccaaaacagcctctacttcctttactaacatcgcatacgacctgtgcgctaaaaataagtatcatgtcttgcacattaacacaacgaagaacaatccagtgatgtcattacaggaccaggttcggtttgtcaagaacatcacctcctggaaggaaatgaagcctgggttctatcacgggcatgtttcttacctcgacttcgccaaatttggggtcaagaaaaaacctatatacattaacgttatccgcgaccccatcgagcgtttagtatcatattattacttcttacgtttcggagacgactacagacctggtcttaggaggcgaaaacagggggacaagaagacatttgacgagtgtgtcgcagaggggggatctgactgtgcccctgaaaaactctggctgcagatcccgttcttttgcggtcactcctccgagtgttggaatgttggaagcagatgggctatggaccaggctaagtacaatctgatcaatgaatactttctggtcggggtgacagaggagctggaggatttcatcatgctactggaagcggctctgccccgtttctttcgtggtgctaccgaattgtataggaccgcgccagacaccgctactccatcccatcggcatgggccaatctgtggatctaaatcaatatctagccttttggttaaagtttcccccgtttgcaaagattcccattgtttgggtaagtgcagtcgcaacggcctgagtgctgtgtag

SEQ ID NO: 225906 - DNA, 1071 bp, Artificial Sequence
  Description of Artificial Sequence: Synthetic coding sequence
atgggcttgctgaggatcatgatgcctccgaagctgcaactgcttgccgtggtggcattcgcggtcgcaatgctgttcctggaaaaccagatacagaagttggaggaatccaggtcgaagcttgagcgagctattgcacggcacgaagtgagagagattgagcagaggcacactatggacgggccacgtcaagatgcaactttagatgaggaagaggatatggttattatatataaccgagtgcctaagacagcgtcgacttcgtttaccaatattgcttacgacctgtgcgccaaaaataaatatcacgtgctccacatcaatactacaaagaataacccagtaatgtcccttcaagaccaggtgcgctttgtaaagaacattacttcctggaaagaaatgaagcctggcttctatcacgggcatgtgtcatacctcgactttgccaaattcggcgtcaaaaagaagcctatatatatcaatgtgattagagacccaatcgagcgactggtgtcatactactatttcttgaggttcggggacgattaccgacccggactaagacgccgaaagcaaggcgacaagaaaactttcgacgaatgtgtggctgaaggaggttctgactgtgcccctgaaaaactctggcttcaaatccctttcttctgtggacactcctctgagtgctggaatgtgggttccagatgggccatggaccaggccaagtacaatcttatcaacgaatattttctggtcggcgtaacagaggagctagaagactttattatgctactcgaggcggcactgcctaggttttttcgtggtgccactgagctgtaccgaacgggcaaaaaatcccacctccggaagaccacagagaaaaaacttccaacaaaacagactatcgccaagctgcagcaaagcgatatctggaaaatggaaaacgagttctatgagtttgccttggagcaatttcaattcattcgcgctcacgctgttagggaaaaggatggcgacctgtatattcttgcacagaattttttctatgagaaaatctaccccaagagcaactag

SEQ ID NO: 225907 - DNA, 690 bp, Artificial Sequence
  Description of Artificial Sequence: Synthetic coding sequence
atggggctcctgcggatcatgatgccaccaaagttacaactactggcagtggttgccttcgccgtggcgatgctgttcctggaaaatcagattcagaaactagaggagagtcggtccaaactcgagagagctatcgctcggcacgaggtgagagagatcgagcagaggcacaccatggacgggccaagacaggacgcaacacttgacgaagaggaagacatggtgattatctataatcgggttccgaaaactgccagcacttcattcaccaatatcgcgtacgacttatgcgcaaaaaataagtatcacgtattgcacatcaacaccaccaaaaataatcccgtgatgagcttgcaagaccaggtcagatttgtaaagaatattacctcctggaaagaaatgaagcccggtttttatcacggacatgtcagttatctcgatttcgccaaattcggtgtcaaaaagaagcccatctacattaacgttatcagagaccctattgagaggcttgtcagctactactacttcctccgcttcggggacgattaccggccaggattacgcaggcgcaagcaaggagacaagaagaccttcgatgagtgcgttgctgagggcggatccgactgtgcgccagaaaaactgtggctgcagataccgtttttctgcgggcattcttccgagtgttggtag

SEQ ID NO: 225908 - DNA, 1236 bp, Artificial Sequence
  Description of Artificial Sequence: Synthetic coding sequence
atgcgcagacgccgtgcagggggtagaacgatggtcgaacgcgcttccaagttcgttctagtcgtggccggttccgtatgcttcatgctgatcctctaccagtacgctgggcctggacttagcctcggggctcccggaggtcgcgcaccccctgatgatcttgacctgttcccaacaccagaccctcattacgaaaaaaagtactattttcccgtgagagaactggaacgctcactacggttcgacatgaagggtgacgacgttattgttttcctccacatccagaagacagggggaaccacttttggaagacatctggtgcagaacgttagactcgaggtgccatgtgactgtaggcctggacagaaaaaatgcacctgctaccggccaaatcgtcgcgaaacttggttattctcccgttttagcacaggatggagttgtggcctccatgccgattggactgagctgacgaactgtgtgccgggagttctcgatagaagagacagcgctgccctacgaactccacgaaaattttactacattacattgctgcgcgaccctgtgagtaggtacctcagtgaatggaggcacgtccagagaggcgcaacttggaagacttccctgcatatgtgtgacggaaggactcccactcccgaggaactcccaccgtgttacgagggcactgactggtctgggtgcacgttacaggaatttatggactgcccatacaatctggccaacaatagacaggtccgcatgcttgctgacctctccctagtgggctgctataacctctcatttattcctgaagggaagcgggcacagttgctgttagagtcggctaagaagaatctgagaggcatggcgtttttcgggctgacagaatttcagcgcaagacacagtacctgtttgagcgcacattcaatctgaagttcataagacccttcatgcaatataattccacacgcgctggcggagtggaggtggatgaagatacaatacgcagaatcgaagaactgaacgacctagacatgcaactctacgactacgcaaaggatttatttcaacaacgataccaatacaaacggcagctcgaacgacgcgagcaacgcttgcggtcccgagaggaaagactgctgcacagggccaaagaggccctgcctagggaggatgccgacgagccaggccgagtgcctaccgaggattatatgagtcacatcatcgagaaatggtag

SEQ ID NO: 225909 - DNA, 831 bp, Artificial Sequence
  Description of Artificial Sequence: Synthetic coding sequence
atgcttttcttgtttgccgtaattgttttgcagtatgtctgtcctggtacggaatgccaactcctgcgcctacaagctttcagttcgcccgtgcctgacccctaccggagcgaggatgagtctagcgcaagatttgtcccacgatacaactttacccggggagacctcctccgaaaggttgacttcgatatcaagggagacgatttgattgtgttcttgcacattcagaagaccggcggtacaacttttggaagacacctcgtcagaaacattcagctggagcagccctgcgagtgccgagtgggacagaagaagtgcacctgccatagacccggaaagcgggagacgtggctgtttagtcgtttctcgacgggctggagctgtggtctgcatgcagattggacggaactcacatcttgtgtcccaagcgtagtagacggcaaacgagatgctcggctccgaccttccagatggcggatctttcagattctcgacgctgcttccaaagacaagcgtgggagcccgaatacgaacgcgggagccaactctcccagctccacaaagacacggaacaccagcaaatctggtaagaacttccactatattacgatcctgagagacccagtgtcccggtacctgtccgagtggaggcatgtccagagaggagccacgtggaaggcctcccttcacgtgtgcgatgggaggccccctacctcagaggaattgcctagttgctatacaggcgatgactggtctgggtgccctctcaaggaatttatggattgcccctataatcttgccaacaacaggtgcgcctgcagcccaacctag

SEQ ID NO: 225910 - DNA, 1389 bp, Artificial Sequence
  Description of Artificial Sequence: Synthetic coding sequence
atggacgagaagagtaataaattgctgttggctttggtgatgctatttctgttcgccgtcattgttctccaatatgtgtgccctgggaccgagtgccaattgctccgtttacaggccttttcctcacctgttcctgatccataccgatcagaggacgaaagctccgctagatttgtgccgagatataactttaccaggggagatctactgaggaaggtagattttgacatcaaaggcgatgatttgattgtctttctgcatattcaaaagactggagggactaccttcggacgccacttggtacgtaacatacagctcgagcagccctgcgaatgtcgggtagggcagaagaaatgcacatgtcaccggccagggaaacgcgaaacttggttgttctctagattttcaacaggctggtcttgtgggttacacgccgactggacagagttgacatcctgcgtgcccagtgtggtagatgggaagagagatgctcgacttcggccatcccgctggaggattttccagattctcgatgccgcaagcaaagacaagcgagggtcacccaacactaatgccggagccaatagtccctcctctaccaagacccggaacacatcaaagagcgggaaaaactttcactacatcaccatactaagggatccagttagccggtacctgtctgaatggagacacgtgcaaaggggggcaacctggaaggcaagcctacatgtttgcgacggcagaccaccaacttccgaggaactgccatcctgctataccggcgacgactggtctgggtgtccccttaaggaatttatggactgcccttataatctggccaataacaggcaggttaggatgctctccgatctgactcttgtgggatgctacaacttgtcagttatgccagaaaagcagcgtaataaagtcctgcttgagagtgccaaatctaatctgaaacatatggctttctttggcctgacagagtttcagcgcaagacccagtacctgtttgaaaagacctttaatatgaactttatttccccattcacccagtataataccactcgagcaagctctgtggagattaatgaagagattcagaagcgcatcgaagggctgaactttctggacatggaactgtacagttatgcgaaagatctgttcctgcagcgttatcaatttatgcgccagaaagagcatcaagaggcgcgtcgtaaacggcaagaacagcggaaatttctgaaagggaggctgctccaaacccactttcaatcacagggtcaaggtcagtcacagaaccccaaccaaaatcagagcaaagaacagaatgacaatactagtaacgggacgaacgactacatcgggagcgtagagaaatggaggtag

SEQ ID NO: 225911 - DNA, 1818 bp, Artificial Sequence
  Description of Artificial Sequence: Synthetic coding sequence
atggccctgcccgcttgtgctgtcagagaatttgaaccacctagacagccagaaaggggcgctcccgtgagaaccacatgtccccgaaggcattctagagtcgaagctgagttggctgcaagtagaccaggttctgtggccgcatctgtgagggccggtccacccaggggagtgagccacgggtttcacacacgcccactgctggataaacccagaaaggcatcttccagtctggccggagcagcttgcgctccactgtttgccctgctatctaggggcaggcgaagacgaatgcacgtactgcggaggcggtgggatttaggatcactgtgccgagccttgctaactaggggtctggctgctctgggccatagcctcaagcacgtgctgggggctatcttctctaagatcttcgggccaatggcttctgtgggaaatatggacgaaaagagcaataagctcctgctcgccctagtgatgctgttcctgtttgcagtaatcgtccttcaatacgtgtgccctggcaccgaatgtcagctgctgaggctgcaggcattctcctcacccgtgcccgacccttataggtccgaagatgagtctagcgcccgttttgtgccacgctacaactttactaggggcgacctgctgcgcaaggtggactttgacatcaagggcgatgatcttattgtgttcctccacatacagaagacgggtggcacaacctttggtcggcatcttgttaggaatattcagctcgaacagccttgcgagtgtagggtaggacagaagaaatgcacttgccatagacctggaaagagagaaacctggctttttagccgattcagcaccggctggtcttgtggtttacacgctgactggaccgaattgacatcctgcgtcccctccgtggtcgatggcaaacgcgatgctaggcttagaccctccaggaactttcactatatcaccattcttcgagaccccgtctcccgatatttgtcggagtggcgacatgtccagcggggagctacctggaaggcctctcttcacgtttgtgacggacggcctcccacatcagaggagctaccctcttgttatactggcgatgattggagcggctgccccttgaaagagttcatggactgcccctataatctggccaacaatcggcaagtcagaatgttgtccgacttgacattggtaggatgctacaacctgtcagtgatgccagagaagcaaagaaataaagtgctactcgaatctgctaaatcaaacctgaaacacatggctttctttggcctgaccgagttccaaaggaaaacacaatacttgttcgagaagactttcaacatgaactttatctccccttttacccagtacaatactacaagagcctcctccgtggaaataaatgaggagatccaaaaacgcatcgagggactgaattttctagacatggaactgtacagctacgctaaggatctatttctgcaacgttaccagtttatgaggcaaaaagagcatcaagaagctcggaggaagagacaagagcagcgcaaatttttgaagggtcggttgttacaaacccacttccagtcccaagggcagggtcagtcacagaatcctaaccagaatcagtcacaaaaccccaacccgaacgctaatcaaaaccttactcagaacctgatgcagaacctgacccagtctttgagtcagaaggaaaaccgcgaatctccaaaacagaactcagggaaggagcaaaatgataacactagtaatggcacgaatgactacattggcagtgtggagaagtggcgatag

SEQ ID NO: 225912 - DNA, 1380 bp, Artificial Sequence
  Description of Artificial Sequence: Synthetic coding sequence
atggatgaaaaatcaaataaattactgttggccctcgtcatgcttttcttgtttgcggtgatcgtcttgcaatacgtctgccctggtacagagtgccagctgctgcggttgcaggctttctcatctcccgtgcccgacccttatcgctccgaagatgagtcatctgctcgttttgtgcctaggtataatttcacaaggggtgatctactgaggaaggttgatttcgatattaagggcgacgatctcatcgtgtttctccacattcagaagaccggaggtacgacctttggaaggcaccttgtgaggaatatccaactagaacagccctgcgagtgtcgggtgggccaaaaaaaatgtacctgtcatagaccgggaaaaagggaaacatggctcttctcgcgcttttccaccggatggagctgcggactgcatgcagattggaccgagctgaccagttgcgtccctagcgttgttgacggcaagagagatgccagattgcgcccttcacgaaactttcactacatcaccatccttagagaccctgttagccgctacctgtccgaatggcgccatgtgcagaggggggctacctggaaagccagccttcacgtgtgtgatggacgccctcccacttcagaggaacttccttcttgctacactggggacgactggtccggctgtcctctgaaggaattcatggattgtccatacaatctcgccaacaacagacaggtccgaatgctgagcgatcttacactggttggctgctataatctaagtgtcatgcctgagaagcagcgcaacaaagtgcttctggagtccgctaagtccaatctgaaacatatggccttcttcggactgactgaattccagcgtaagacacagtacttgtttgaaaaaaccttcaatatgaattttatttcaccatttacgcaatacaatacaaccagagcgagcagtgttgaaatcaatgaggaaattcagaaacgaattgaagggctcaacttcctcgacatggagttgtacagctatgctaaggacttattcttgcagaggtaccaattcatgcgtcagaaagagcaccaggaagcacgccgaaagcgtcaggagcagaggaagtttctgaaaggtcgtctgcttcaaacccactttcagtcacagggtcagggacagtctcagaaccccaaccagaaccagtcacaaaaccccaaccctaatgcgaaccagaaccttacccagaatctcatgcagaacctgacgcagtccttgtctcagaaggagaatagggagtcccctaagcaaaattcaggcaaggaacagaatgataacaccagcaacggaactaatgactatatcggctctgttgagaagtggcgttag

SEQ ID NO: 225913 - DNA, 996 bp, Artificial Sequence
  Description of Artificial Sequence: Synthetic coding sequence
atgctcctgaaacacaatggtaagttgctcttattttaccttctgtcttaccaggcgctggccagcgactggttttactgttctttcaatcgctggcggatcttccaaatcctagatgcagcaagaaatttccactatattaccatccttcgcgacccggtgagccgatacctgagcgagtggcgccacgtgcagagaggggctacatggaaggcaagcctccacgtttgtgatggacgtcccccaacctccgaagagctccctagctgctacactggcgacgactggtccggatgtcctctcaaggagtttatggactgtccgtacaatctggcaaacaacagacaagtcaggatgcttagcgatttgacgctagtggggtgctataacctgagcgtcatgccagagaagcagcgtaataaagttctactggagtcggcaaaatcaaacctgaaacatatggccttcttcggccttacagaatttcagcgtaagactcagtacctgtttgaaaagacttttaacatgaattttatcagtccatttactcagtataacaccacacgtgcgtcctcagtggaaattaatgaggaaatccaaaaacgcatagaaggcctgaactttttagacatggaactctattcctacgccaaggatctctttctgcagaggtaccagttcatgcgccagaaagagcatcaggaggcccgtagaaaaagacaagagcagcgaaaatttctcaaagggagacttctgcagacacactttcagtctcagggtcaggggcagagccagaatccaaaccagaaccagagtcagaaccccaatccgaacgccaatcagaacttgacccagaacctcatgcaaaatcttactcagtcactctctcaaaaagagaaccgcgaatcacctaagcagaattctggaaaagagcaaaacgataacaccagcaatggcacgaatgactacatcgggtccgttgagaaatggcgatag

SEQ ID NO: 225914 - DNA, 1938 bp, Artificial Sequence
  Description of Artificial Sequence: Synthetic coding sequence
atggcgttgcccgcttgcgccgtgagagaatttgagcctccacgccagcctgagcgcggtgccccagtccgcacaacttgtcccagacgacactcacgagtggaggcagagctcgccgcttcacgccctgggagtgtggctgcctctgtgagagccggtcccccaaggggcgtctcccacggttttcatacacggccactcctggacaagcccaggaaagcctcttcctccttggccggagccgcatgtgcccctctgtttgccctcctcagtaggggcagacgccgacgaatgcacgttttgcgacggaggtgggaccttggctctctttgccgggcactcctcacccggggtctggcggctctcggtcattctctgaagcacgtgcttggggcaatcttcagtaaaatctttggcccaatggcctccgttggaaatatggacgagaagagcaataagctgttgctggcccttgtcatgctgtttttattcgccgtcatcgttctacagtacgtgtgtccaggtaccgagtgccaattgttgcggctgcaggccttcagctccccagttcctgatccatacagaagcgaggacgaaagctcagctcgattcgtgcctcggtacaacttcaccagaggggacctactgcgcaaggtcgactttgacatcaagggcgatgacctcatcgtctttctgcacattcaaaagacagggggaaccacctttggccgacacctggtgaggaatattcaactggagcagccttgcgagtgccgagttggccagaagaagtgcacctgccaccgccctggaaaacgcgagacgtggctgttctctcggttctcaaccggctggtcctgtgggttgcacgctgactggactgaactcacttcctgcgtaccctcggtggtcgacggtaagcgcgatgctcggctacggccttcgagatggcgcatattccaaatactggatgccgctagcaaggataagagaggttcccccaacacaaatgctggcgcaaactccccttcttccacaaaaacacgcaacacctctaaaagcggaaaaaacttccactacatcactatcctgagggacccagtgtctagatatctgagcgagtggcgtcatgtgcagagaggggctacatggaaggcttccttgcatgtgtgtgacgggcgtcccccaacctctgaggagcttccctcgtgctacaccggggacgattggtccgggtgccccttaaaagaattcatggactgcccttacaacctggccaataataggcaagttcgcatgctttctgaccttacacttgttggctgctacaatctgagcgtgatgcctgaaaaacaacgcaacaaagtcctgttggaaagcgcaaaatcaaacctgaagcatatggcttttttcggtctgacagaattccagcgaaagacacaatatttgtttgaaaagacatttaacatgaatttcatttcccctttcacacaatataataccacgcgagctagctcagtcgagatcaacgaagagatccagaaaaggatagaaggcctgaattttctggacatggagctgtattcatacgcaaaagacctgtttctgcagagatatcagtttatgagacagaaagagcaccaggaagcccgacgcaaacggcaggagcagcggaagttcctgaaagggagactgttgcagacacactttcagtctcagggccaaggccaaagccagaatcctaaccagaaccagagtcaaaacccaaatcccaacgcaaaccagaacctcacgcaaaaccttatgcagaatctgacgcagagtttgagtcagaaggagaatcgggagtcccctaaacaaaattctgggaaggagcaaaatgataacacgtccaatggcacgaatgactacattggttccgtggagaagtggagatag

SEQ ID NO: 225915 - DNA, 1416 bp, Artificial Sequence
  Description of Artificial Sequence: Synthetic coding sequence
atggatgagagatttaataagtggctgttgactccggtcctgaccctcctgttcgtggtgatcatgtaccagtatgtttcaccatcttgtacatccagctgtactaactttggggagcagccaagggccggagaagctggaccacctgcagtgcccggacccgcaaggcgggctcaggccccacccgaggagtgggagcgacggcctcaactaccacccccacccagggggcctcctgaaggacctcgcggtgctgcggcaccagaggaagaggacgaggagcccggagaccctcgagagggcgaggaagaagaagaagaggacgagcctgacccagaggcaccggaaaacggtagcttaccaagattcgtccccaggttcaactttagccttaaagatctcactagattcgttgacttcaatataaaggggagggacgtgatcgtgtttctccacattcaaaagaccgggggaacgacctttgggcgtcacctcgtgaaaaacataaggctggagcagccatgttcctgcaaagctggtcagaagaagtgtacttgccacaggccgggaaaaaaagagacatggttgttcagccggttctcaaccggttggtcatgtggcctccacgccgattggactgagcttaccaattgcgtcccagccatcatggaaaagaaggactgtccccgaaaccattcccatacccggaacttttactatatcacaatgctgagggatcccgttagtagatatctgtcagagtggaaacacgtacagagaggggcaacttggaagacatcactgcacatgtgtgatgggcgttcacctacccccgatgaacttcccacttgttacccaggggacgattggagtggcgtgagtttgagggagttcatggactgcacctataacctggcaaataatagacaggtgcgaatgctcgctgacctgagcctcgtaggctgctacaacctgaccttcatgaatgagtcagagaggaatacaattctactgcagtctgcaaagaacaaccttaagaatatggcattttttggtctgaccgaattccagaggaaaacgcagttcctgttcgagcggacatttaatctgaaattcatatcccctttcacacaatttaacattacacgggcaagcaacgtggaaattaacgaaggggcacgacagagaattgaggacttaaacttcctggatatgcagctttatgagtacgccaaagatctgttccagcagcgctaccaccacacgaagcaattggaacaccagcgggacagacagaaacgcagggaggagcgcaggctccaacgagagcaccgcgaccatcaatggccaaaggaggatggagccgctgaggggaccgtcaccgaggactataacagccaggtcgtaaggtggtag

SEQ ID NO: 225916 - DNA, 543 bp, Artificial Sequence
  Description of Artificial Sequence: Synthetic coding sequence
tgagcacagaccccacctcctcccccagccgcagtggctgtcgcagtcacccccgtgcctcagttccccagagcatgtaccgaagctgagttcgcttgtcactcctacaacgagtgtgtggcacttgaatacaggtgcgaccgcagacccgactgcagagacatgtctgacgagttaaattgcgaggagcctgttctgggcatatcgccaaccttctcactgttggtagagaccacgtccctgcccccaagacccgaaacaactatcatgaggcaaccccctgtcacccatgcaccccaacctttactgccaggatccgtcaggcctcttccttgcggaccccaggaggcagcttgccgtaacggccactgcataccacgtgactacctgtgcgatggccaagaagattgtgaggacggctccgacgagctggattgtgggccaccccctccatgtgagccaaacgagtttccttgcggcaacggtcattgtgccctgaaactctggcggtgtgacggtgactttgattgcgaggatcgctag

SEQ ID NO: 225917 - DNA, 285 bp, Artificial Sequence
  Description of Artificial Sequence: Synthetic coding sequence
taaggacacccccattctccaagctcaggcgctgcatgggcggcagcctttctgggaggaagacccccaggaacatcttgctgtacactaagcgttcagccactgaggacccaagccgctacagcagcaggtagtcctacccgttgggcacagcctcggccactccccagctgcagttcgaaaaaccccgagttggggccagagctgcctcgagatgtatatatgcctggtccatggacactcggggagggcccagggcagtgcccagctggataccctcgttag

SEQ ID NO: 225918 - DNA, 13176 bp, Artificial Sequence
  Description of Artificial Sequence: Synthetic coding sequence
atggggtggcgcgctgccggagcactcctcctggccctactcctccacggcagacttctggccgtgacacacggcctgagggcatacgacggcctgtccctgcccgaagacatcgagaccgtgaccgcatcccagatgagatggacacactcctatctgagcgacgatgaagacatgcttgctgactcgattagcggggatgacttggggagtggtgacctgggatcaggagatttccaaatggtgtactttcgggcactggtgaatttcacccggagcatagagtatagcccccaattggaggacgccggaagccgcgagttccgcgaggtgtcagaagcggtggtcgacacattagagtcagagtacttgaagatcccaggcgatcaagtggttagtgtggtttttattaaggaactggacggttgggtatttgtcgagctcgatgtcggatcggaaggcaacgctgatggagcccaaatccaagagatgctcctgcgcgtgatatccagcggttcagtcgcttcctatgtgaccagcccccaggggttccagttcagaaggctgggtacagtccctcagtttccacgggcttgtacggaggcagagttcgcatgtcattcctataatgagtgtgtggccctcgaatatcggtgcgaccggaggcctgattgtcgcgatatgtcagatgagcttaattgtgaagagccggtccttggtatttcaccaaccttcagtctgttagttgagaccacctcgctacctccgaggcccgaaacgacgattatgaggcagccccctgtaacacacgcgcctcagcccctgctccctgggtcagtcagaccactgccatgcggtccccaggaggccgcatgcagaaatggccactgcattcccagggattatctttgtgatggccaggaggactgtgaggacggcagtgatgaactggactgcgggcctcccccaccatgcgagccaaatgagtttccgtgcggcaatgggcattgtgctctcaagctctggaggtgcgacggagattttgactgcgaagacagaactgacgaggcaaactgcccgacaaaaaggcctgaggaggtctgcgggccaacgcagttccgctgcgtgtctacgaatatgtgtatcccggcatcttttcactgtgatgaagaatcagattgcccggatagatccgacgagttcgggtgcatgcccccacaagttgtcaccccacccagagaaagcatccaggcgtcaagaggacaaacagtgacttttacttgtgtggcaattggcgtgcctactccaatcattaactggcggctcaattgggggcacatcccatcacatccaagggtaaccgtgacttccgagggcggtaggggaactcttatcataagagatgtaaaagagtcagaccagggagcttacacctgcgaggccatgaatgctcgcggaatggtgtttgggataccagacggagttttggaattagtgccccagagaggcccttgccccgacggccatttctacctggagcacagtgccgcttgtctgccatgcttctgcttcggaattacctctgtttgtcagagtactcgcaggtttcgggatcaaatccgactgcgattcgatcagccagatgatttcaaaggggtcaacgtgactatgcccgctcagccagggaccccccctctctcttctacacagttgcagatcgaccccagtctgcatgagttccagctggtggacctgagccggaggtttctcgtgcatgattctttttgggcccttccagaacagtttctgggcaataaagtggactcttacgggggtagccttcggtacaacgtacgatatgaactcgcccgtgggatgctggaacctgtacagagacccgacgttgtgctgatgggcgctggctaccgactattatcccgaggtcatacaccaactcagccaggggcacttaaccagcgtcaggtgcaattctcggaggaacactgggtgcacgagtctgggagaccagtccagcgggcagaactcctacaagtgctccagtcactggaggctgtactcatacaaactgtatacaatacaaagatggccagcgtaggcttatctgacatagctatggataccaccgtaacacatgctacgtctcatggtagggcccatagcgtcgaagagtgccgatgtcctatcggatactcaggcctcagttgcgagtcctgtgacgcccactttacaagagtcccaggaggtccctacctgggaacttgcagcggctgcaattgcaatggacatgcttcaagttgtgacccagtgtatggacactgtttgaattgccagcataatactgaaggccctcagtgtaataagtgtaaggccggatttttcggcgacgccatgaaagcaacagccaccagttgcagaccttgcccttgcccctacatcgacgcctcgcggcgtttttccgatacttgttttctggataccgatggtcaggccacttgtgacgcctgcgcgcctggctacactggccgaagatgtgaaagctgtgcccctggctatgaaggtaaccccatacagccaggaggaaagtgcaggcccgtaaaccaggagattgtgcggtgtgatgagcgaggctcgatgggaactagtggagaagcctgtagatgtaaaaataatgtggtggggagactgtgtaacgaatgtgccgatggtagctttcatttgagcacgaggaaccccgatgggtgcctgaagtgtttctgtatgggggtcagccgccactgcacttcaagtagttggtcacgagcacagttacacggcgcaagcgaggaacccggtcactttagcttgacgaatgctgcaagcacacacacgaccaacgagggcatttttagtccgacaccaggcgagctaggcttttcctcattccaccgccttctgagcggaccgtatttttggagcttgccgtcccgcttcctgggggacaaggtgacctcttacggaggagaattgagatttaccgtgacacagcggtcccagcctggatccacgcctctgcacggccagccactcgtggtacttcagggcaacaacattatactcgaacaccatgtagcccaagagccctcaccagggcaaccctctacatttattgtcccttttagagaacaggcgtggcagagacctgatggacaacccgcaacacgggagcatctgctaatggcactggccggaattgataccttactcattcgcgctagctatgctcagcagcccgctgagtctcgggtcagtgggataagcatggacgtggcagttccagaggagactgggcaggaccccgcattggaggtggagcagtgctcctgtcctccagggtatcgtggcccatcttgccaggattgcgacaccggatacactcgcaccccaagtggactctatttgggcacctgcgagaggtgcagctgccacggccatagcgaggcctgcgagccggagactggcgcatgccagggatgtcagcaccataccgagggccctcgctgtgagcagtgccagccaggttactacggggacgcacaacgcggtaccccccaggactgccagctttgcccttgttacggcgaccctgctgccggtcaggccgcacatacatgttttctcgacaccgatggccatcccacttgcgacgcttgttcgcccggacacagtggaagacactgtgaacgttgtgcgcctggatattatggcaacccatcccagggccagccttgtcagcgcgactctcaggttccgggtcctatcggatgcaactgcgatccacagggctcagtctccagtcaatgcgatgccgcaggacaatgtcagtgtaaggctcaggtggaaggtctgacctgctcacattgtaggcctcaccatttccatttgtcagcttctaatccagacggatgcctgccatgcttctgtatgggtattacacagcagtgcgcctcttcagcgtacactcggcatctcatttcgacacacttcgcaccgggtgacttccagggattcgctttagtcaatccgcagaggaacagccggctaaccggcgaattcactgtagagcctgtaccggaaggcgcacaactgagctttggaaatttcgcacagctcggacatgagtctttctactggcagctgccagagacctaccaaggagacaaagttgccgcatacgggggaaagctcagatataccctgagttacaccgccggtccccagggcagcccactgagtgaccccgacgttcagattacgggaaacaacatcatgctcgtcgcctcccagcccgcactgcaaggccctgaacggcgaagctatgaaatcatgttcagagaggaattctggcgacgcccagatggacagccagccacgcgcgaacatctgctgatggccctcgctgacctagacgagctccttattcgcgcaaccttttccagtgtacccttggccgcatcaatctcggctgtgtcacttgaggtggcacagccgggacctagtaaccgacccagggccctcgaagtcgaggaatgccgatgcccacctggatatatcggactatcatgccaggattgcgccccagggtataccagaacagggagcggcttgtatctgggccactgtgaactctgcgaatgtaatggtcactccgatttgtgccacccggagaccggcgcatgttcgcaatgccagcataacgccgcaggtgaattctgcgagctatgtgcgccaggctattatggcgacgccactgccggtacgcctgaggattgccagccttgtgcctgtcccttaactaatccggagaatatgttcagcagaacatgcgaatcattaggggcaggcggatatcggtgtacagcctgcgaaccagggtacactggccaatattgcgaacagtgcggcccaggatacgtcggcaaccctagcgtgcaggggggtcagtgcctgccggagaccaatcaagcgccactggtggtggaggtgcaccctgccaggtccatagtaccccaggggggttcccactccctgaggtgccaggtgtctggcagtcccccacattacttctactggagtcgcgaggacggccgacccgtgcccagcggcacgcaacagagacaccagggatccgagttacactttccatcagtgcagccatcagacgcgggtgtttatatctgtacatgtagaaacctccatcagagcaatacctctcgggcagagctcttagtgaccgaggcgcctagtaaaccaatcacagtgaccgtcgaggagcagcgctctcagagtgtaaggccaggtgcagatgtgactttcatctgtactgccaagtcaaagagtcccgcttataccctcgtctggacaaggttacacaatggaaaactccccacccgagccatggactttaacggaatactgacaattcggaatgttcaactttcagacgccggaacttatgtgtgcactggtagcaatatgttcgccatggaccagggaaccgccaccttacacgttcaggcttcagggaccctcagcgcaccggttgtctccatccatccaccgcagctgacagttcaaccaggccagctcgccgaatttagatgttccgcaaccggctcacctacgcccacactggagtggaccggtgggccaggaggacaactccccgctaaagcgcaaatccatgggggaatactgagattgcccgctgtggaaccgaccgatcaagcccaatacctctgtagagcacatagtagtgcgggacagcaggtagctagagccgtcctgcacgtacatggaggcggaggtccacgcgtgcaggtctcgccagagagaacccaggttcacgccggaagaactgtccgcctgtattgccgcgcagctggggtcccctccgccactattacatggcgtaaagaaggtggatccttgcccccacaagcacgcagtgagagaaccgatatcgctaccctactgatcccagccataactactgctgatgccggtttttatctgtgcgtagccacgtcaccagccggaaccgctcaagccaggatccaggtggtggtcctgagtgcctccgacgcatccccaccaccggttaagatcgaaagctctagtccctcagtcacagaggggcaaacactcgatctaaattgcgttgtggcgggaagcgcccacgcccaggtgacctggtaccggagagggggttccttgcctccacatacccaggtacatggtagccgcctcagactgccgcaggtgtcccctgcagacagcggcgagtatgtgtgccgagtggaaaacggatccgggccaaaggaggcatccataaccgtgtctgtgttacacggcacgcacagcgggcctagctacacacccgtgcctggttcaactagaccaatccgtatcgagccaagtagttctcacgttgcggagggacagactttagatctgaattgtgtggtaccgggtcaggctcatgcacaggtaacctggcataaaagaggtggatctctgccagcaagacaccagactcatggcagtttattgcggctgcaccaggtcacccccgcagacagtggcgagtatgtgtgccatgtggtggggaccagtggcccattagaagcatctgttctggtgacaatcgaggcctccgtgatccccggtccaatccctcccgtcagaatcgagtccagtagcagtaccgtcgccgagggccaaacactagacctcagttgcgttgtagcaggccaggcccacgcccaggtgacatggtataagcggggaggaagcctacctgctaggcaccaggtcagggggtcaaggctgtatatcttccaggcgtcccctgccgacgcaggccagtatgtatgccgcgcatcaaacggcatggaagcctcaataactgtgactgtgacaggcacccagggcgcaaatctcgcctatccggctggatcaacccagcctatacgaatcgaacccagcagctctcaagttgcagaggggcagaccctagatcttaactgcgtggtgccaggccaaagccacgcacaggttacctggcataagcggggaggttccttgccagtacgtcaccaaactcatggatctctacttcgattatatcaagcctctccagctgattcgggagaatatgtgtgcagagttctgggttcaagtgttcctctggaggcttctgtgttggttaccatcgaaccggctggcagtgtgccagccttaggcgttacccccacagtcaggatcgaaagttcttcctctcaagtcgccgagggtcaaaccttagatctcaactgcctcgtagcaggtcaagcccatgcccaggtgacttggcataaacgagggggatctctgccagcccgacaccaggtgcatggatctcgactgagactgcttcaggtgactcccgctgactccggcgagtacgtctgcagagtggtggggtcctcgggcactcaggaggcgagcgtcttagttactattcaacagaggctgagcggatcacactcccagggcgtggcctatcctgtgcgtattgagagtagcagcgccagtctggccaacgggcataccttggatctgaactgcttggtagcatctcaggcacctcacactatcacttggtacaaacggggagggtctctacccagtagacaccagattgtgggatccagactccggatcccgcaggtaactcccgctgatagcggggagtatgtttgtcacgtgagcaacggagcgggtagccgtgagacttcgctgatcgtaactattcaggggtccgggtccagtcacgtgcccagtgtgtcccctccgatccgcatcgagagttcctctccaaccgtagttgaaggacagacactggatctcaattgcgtggtggcacgacaaccccaggcaataattacttggtacaagcgaggaggatcacttccgtcccgccaccagactcacggttcgcacctcagactgcaccaaatgagtgtcgcagactccggagagtacgtgtgtcgggcaaataacaacattgacgccctggaagcctcaatcgttatatcggtatcacccagcgctggctctccatccgccccaggcagctccatgcctattcgcatcgaatcctcaagcagccatgtggctgaaggtgagactctggatctcaactgtgtggttcccggacaggctcacgctcaagtgacatggcacaagagagggggatcccttccttcacatcatcagacgagaggttccaggctacgcctgcaccacgtgagccccgcagattccggggaatacgtatgcagggttatgggctcctctggaccccttgaagcttctgtgctggtcactatcgaggcctcggggtccagcgctgtgcacgttcccgcacccggtggcgcacctcctattcgtatcgagccttcgtccagccgagtggcggagggccagacgcttgacctaaaatgtgttgtacccggtcaggcacatgcccaggttacttggcacaaacgaggaggcaatctcccagctaggcaccaagtgcatggccctctgctgcgtctgaatcaggtgtccccggcagattcaggggagtactcatgccaagtgaccggtagttctgggacattggaagcatccgtattagtcacaatcgagcccagctcaccagggccaatccccgcaccagggctcgcgcagccgatttatattgaagcaagcagcagtcacgtgacagaaggacagaccctggatctcaactgcgtggtgccaggccaggcccatgcccaggtgacatggtacaagcgcggtggctccctgcccgctagacatcagacacatggctctcagcttagactccaccttgtgagtccggcagactctggagaatacgtttgcagagcggcatctggacctggtcctgaacaggaagctagcttcaccgtcacagtgccaccatcagagggttcttcctaccggctgcggtccccagtcattagcatcgaccccccatcatctacagtgcagcaggggcaggatgcttcttttaagtgtctgattcacgacggcgctgctcctataagcctggagtggaaaacacgcaatcaggaactggaggacaatgtccatatttcacctaacggcagcatcattaccatcgtggggacacggccaagcaatcacggcacctacaggtgcgtagcttctaatgcctacggagtggctcagtcagttgtgaatctgtcagtgcacggacccccaacagtgagcgtcttgccagaaggcccagtgtgggtcaaggtcggcaaggcggttactctggagtgtgtgagtgctggcgagccacgctcgtctgccagatggacacggatcagctcaacccccgcaaaactggaacaaagaacatatggacttatggattcccatgccgtgctacagatcagctccgcgaaacctagtgatgcgggtacgtatgtgtgccttgcccagaatgcattagggaccgcccagaaacaggtagaagtgatagtggatactggggctatggccccaggagccccacaggtgcaggcagaggaagccgagctcaccgtggaagcgggtcacacggctaccctgcggtgttccgctaccggaagccccgcacctacgatacactggagtaagcttcgttctcccctgccctggcaacaccgcctggaaggtgacactctaatcatccccagagtggctcagcaggactccggtcagtacatttgtaatgccacatcccccgcagggcatgccgaagccactatcatactccacgtggaatcaccgccttatgccaccaccgtgccagaacacgcctccgtccaagcaggcgagactgttcagctgcagtgcctggctcacgggacccctcctctcacattccagtggtcacgggttggttcgagtttacctggcagagctacagccaggaatgaactgttgcacttcgagcgcgctgccccagaggattctgggagatatcgctgtcgcgtaaccaataaggtaggcagtgctgaagcctttgctcagctccttgttcagggtccaccgggatctctccccgctacatccattcccgcaggttcaactcccaccgtgcaggtgaccccacagttggaaacaaaaagcatcggcgcatctgtggagttccactgcgcggtcccctctgaccgcggtacgcagttaagatggtttaaggaggggggacagctgcccccaggacacagcgtgcaggatggcgtgctgcgaattcagaatctggaccagtcctgccagggcacctatatttgccaggcccacggcccttggggtaaggcccaagcatccgctcagctggtcatacaggcccttccatcagtgcttataaatatccggaccagtgtgcagaccgtcgtcgtgggacacgccgtggagtttgagtgcctggccctaggtgacccaaagccccaggtgacgtggtcaaaggtgggcggtcatctgcggccagggatcgttcagtccggcggagtggtgaggattgcacacgtggaactggccgacgccggacagtacaggtgcaccgcgaccaacgctgccggaaccacccagtcacacgtactgcttctagtacaggcacttccacagatttctatgcctcaagaggtgcgggtgccagccggtagcgctgctgtctttccatgcattgcttctgggtaccccaccccagatatatcctggtccaagctggacggaagcttgccacctgactctcgcctggagaataatatgcttatgctaccaagtgtccggcctcaggatgctggcacctatgtctgcaccgccacaaataggcagggcaaagttaaggcctttgctcacctacaggtgcctgaaagggtagtgccctacttcacacagacaccttatagctttctccctctgcccactatcaaagacgcctatcgcaagtttgagatcaagataactttccgcccagactccgccgacgggatgttgctgtataacggccaaaagcgtgtgccaggatcccccaccaaccttgccaacagacaacctgatttcatttcgtttggactggttggcggacgtcccgaattccgattcgacgcaggaagtggcatggcgaccatccggcacccgactcccctggccctcggccattttcacactgttacactccttagatccctgacccaaggatctctaatagtaggcgacctggcgcctgtgaatggaacgtcccaaggtaaatttcagggactcgatttgaatgaggagctgtacttgggtggatatccagattacggcgcaattcccaaggccggtcttagcagtggattcattgggtgcgtgcgcgaactgaggattcagggtgaggagattgtcttccacgacttaaacctgaccgctcatggcataagtcactgtcccacgtgcagagaccgaccttgccagaacggcggacagtgccacgatagtgaatcttcttcgtacgtttgtgtatgccctgcaggattcactgggagccgttgcgagcactcccaggctctgcactgccatccagaggcgtgcgggccagatgctacctgtgtgaacagacctgatggtcggggttacacctgccgatgtcatctcgggaggtccggcctgcgttgtgaagaaggtgtgaccgtaactacaccaagtttgtctggtgcagggtcttaccttgcactcccagccttgacaaacacccatcacgaactcaggttggatgtggagtttaagccattagccccagatggcgtgctcttgttcagtggaggcaaaagcggacctgtggaagacttcgtctccttggcaatggtggggggtcacctcgagtttaggtacgagctggggagcggacttgcagtgttacggtcggcagagccactggcacttggtaggtggcatagagtgtcggccgagcggctgaacaaggatggcagcctgagggtcaacggcggaaggcccgtgttgcgatccagtcctggcaagagccagggcctgaatttgcatactctcctgtatctgggtggggtggaaccttcagtgccgctgagccctgccaccaacatgagcgcgcattttcggggatgcgtcggagaagtgtctgttaatgggaaacgcttggacctcacctactcttttctagggagccaggggatcggtcagtgctatgacagcagcccttgcgagagacagccttgccaacacggtgcaacctgcatgccagccggagagtacgagtttcaatgcctgtgcagggacggattcaagggggacctgtgtgaacacgaggaaaatccatgtcagctgcgggaaccgtgccttcatggaggaacgtgtcaaggaacgcgctgtctctgcctgcccggtttctcaggaccacgctgccagcaaggctcaggacacggcatcgccgagtcagattggcacctcgagggctcgggcggaaatgacgcccctgggcagtacggagcctatttccacgatgatggttttctcgcattcccaggccatgttttcagtcgctcactaccagaagtgcccgagacaatcgagctcgaggtgcgcactagcaccgccagcggcctgctgctgtggcagggagtcgaggttggagaagctggccagggcaaagacttcatctccctgggattacaggatgggcacctggtgtttagatatcagctgggatccggagaagctagactggtgtcagaggaccccataaacgacggcgaatggcacagagtgacggccctgagggaaggacggcgagggtccattcaggtggacggggaggaattggttagtgggcgatcccccggacccaacgtggccgtgaacgcgaagggaagtgtctatataggcggagcccctgatgtggccaccctgactggtggacgcttctcatctggcataacgggctgcgtcaagaacttggttcttcacagcgctcggcctggagctcctcctccccagcctttggacctgcagcatcgagcgcaggcaggagctaacactcgcccttgtcctagttaa

SEQ ID NO: 225919 - DNA, 720 bp, Artificial Sequence
  Description of Artificial Sequence: Synthetic coding sequence
gtaacacacggcctccgagcgtatgacggactgtcactgcccgaggatatcgaaaccgttactgcgagtcagatgagatggacccattcatacctctcagacgacgaagatatgctcgctgactcgatatccggtgatgatctgggcagcggggatctcggctcaggcgacttccagatgggatcctggatggctggattcttgtggtcctggatgtgggctaggaaaggcatgagaatgggcctgagattccgcaggtgttgttccgggtcatcccccgctgccctctggccgcctaccagcccactgccgcgagacagttcatcggatgcttgggcccagtgcccttcatcccaggagccagcaaggaggccctcattgccggctacggccacgatgagtgtgtggccctggagcatagctgtcactggtggcccaaccgcaggtacgtgtctgatgtcttcaattgttcgttcccagtcctgggtatcagccccacacagcttatcactctggcgcaggcatctgtaccgtccaggacaacggcagccaagctgtgattcacatcagtcccccacgctgttatctccttgtttcccggtaccgtctgggccttgccctgtcggccctaggcggccacacgctgctatggggacggcatctccagagaccacttccgcgaccgaccgtcggaccgcacgaaccgccgcaatgtcctag

SEQ ID NO: 225920 - DNA, 567 bp, Artificial Sequence
  Description of Artificial Sequence: Synthetic coding sequence
atgaacgcaggcgcatctgtactcactttcccgtgggcagtttacgggctacctagagcacggccagcagtgacagatctgacggggcctctaccaccaagcagccctgctctgccatctgtccttattaatatccggacgtccgtgcagactgtcgtggttgggcacgccgttgagttcgagtgcctcgccttgggggatccaaagccccaggttacctggtcaaaggtgggaggccacctcagaccaggcatcgttcaaagcggcggtgtcgtaagaattgcgcacgtcgagttagcagatgctggacagtacaggtgcaccgctaccaacgccgctgggacgacccagtctcatgtgctactgctggtgcaagccctgccccaaatctccatgccccaggaggtacgcgtgccagcgggtagtgccgctgtgtttccatgcattgccagcggttaccctactcccgacatcagctggtcaaagctggatgggtctttgcctcctgactcccggttggaaaataatatgctgatgttgcctagtgtcaggccgcaggatgcttag

SEQ ID NO: 225921 - DNA, 594 bp, Artificial Sequence
  Description of Artificial Sequence: Synthetic coding sequence
tgaactcccagtggtctgtacctgggaacatgtgaacgatgcagctgtcacggacactccgaggcttgtgagcccgagactggggcttgccaggggtgccagcaccacactgaggggcctcggtgcgagcagtgtcaaccaggatattacggggatgcacagcggggtactccacaagattgtcagttgtgtccctgctacggggacccggctgctggtcaggcggcacacacatgctttttagataccgacggccatccgacgtgcgacgcatgctccccagggcacagtggccgacactgtgaaaggtgtgcaccgggatactacggtaacccgtcgcagggacagccctgtcaacgggattcacaggtgcctgggccaatcggatgcaactgcgacccacaggggtccgtgagttcccaatgcgatgcagcaggacaatgccagtgtaaggtctcccccaacccatgcccatgcggcgcttgctctgccccactgcctcgcccttgtggagagatcagacagcatctcgtcgaggccgaaacctgggcttggggtgccggacacggtggtcaagggcgaggttgtccttag

SEQ ID NO: 225922 - DNA, 492 bp, Artificial Sequence
  Description of Artificial Sequence: Synthetic coding sequence
cctcctgtgaagattgagtcttcatccccctcagtgacagagggacagacccttgatttgaattgtgtggtggcgggttctgcccacgcccaggtcacatggtaccggcgtggcggatcattgcctccccacacccaagtacacggaagccggttgcgcctgccccaggtcagtccagcagattctggcgagtatgtatgtcgggtcgagaacgggagcggaccaaaggaggcgtccattactgtatcttattgcccacccgcatggtcctggtgtgtgccaggttcaacacggccaatccgtatcgagccttcgtccagccacgtggctgaagggcaaactcttgacctaaactgcgttgtcccaggccaggcacacgcacaggtcacatggcacaagagggggggtagtctgcccgcacggcaccagacccatgggagccttctcaggttgcatcaggtaacacctgccgacagtggagagtatgtgtag

SEQ ID NO: 225923 - DNA, 573 bp, Artificial Sequence
  Description of Artificial Sequence: Synthetic coding sequence
cctgaggacattgagactgtgaccgcatctcaaatgaggtggacccactcttatctgtcggatgacgaagacatgctggctgattccatctcgggggacgatcttggtagtggcgacctgggcagcggagatttccagatggtttacttccgcgctttggtcaatttcactcggagtatcgagtatagcccccagctagaggatgccggatcacgagagttccgcgaggtgagcgaggccgtcgtagacacactggagtctgaatacctcaagatccctggagatcaggtggtttccgttgtgtttattaaggagcttgatggatgggtcttcgtcgagctagacgtcggtagtgagggaaatgctgatggggcacagatccaagagatgttactgcgcgtgatctcatccgggagcgtggcgagttacgtcactagcccccagggctttcagtttagacgactcggaacaggggagcccatcctcgtcagtggcatagcttctagtcgcctggtcggctcgcccttttctgtttccgccatcggcagccagctgggtcttgcacaccactag

SEQ ID NO: 225924 - DNA, 624 bp, Artificial Sequence
  Description of Artificial Sequence: Synthetic coding sequence
ggagagtcccgtgaagggaggggatatcggcaggtagctcagagagtggcggagcgatctcccgtgccgtcattgctgagtcactctggatgcgttgtccacactagactgtcacccgtcccatctgtcagcccccctattcggattgagagctcctcccctacagtcgtggaaggtcagacgcttgatttaaattgtgttgttgccagacagcctcaggcaataattacctggtacaagagaggcggaagcctgccaagtaggcaccagacccatggttcacatcttcgcctacatcaaatgtcagttgctgattctggtgagtatgtctgccgcgctaacaataatattgacgctcttgaggcctctatcgtcatttctgtcagcccttctgctggaagtccaagtgcccctggctccagcatgccgattcggatcgaatcaagctcatcgcacgtcgcagagggagaaaccttagatttaaactgcgttgtgccgggacaagcacatgcgcaggttacttggcacaaacggggaggctcactgcccagccaccaccaaacgcgcggatcccgcctgaggcttcatcacgtgagcccggcagactctggagagtacgtatag

SEQ ID NO: 225925 - DNA, 1104 bp, Artificial Sequence
  Description of Artificial Sequence: Synthetic coding sequence
atggggtggcggcgtggcagaggcgcaccacgttttcctgatgggatggctgccggtcagaggcgaagttctctatcaaggctggggtctcaggccgaaggtttattgacaagtcagaccatggggggacaggccgaaacactgctcacttcccagactggttggctcctcggccgtggatgtaacctgggatctcctggcggtcaggtatcttgggataaggtcaggatacctggcgtcctccagaggttgggggtaacttactttgtggtggccgtattagagttactctttgcgaaacccgtccccgagcattgtgcttccgagagaagctgcctgagtcttagggacattacaagctcttggcctcagtggctgctgatcttggtcctagagggcctctggctgggcctgacttttctgctgccagtgccaggttgtcccacaggttacctcggccctgggggaataggagacttcggaaagtatccaaactgtactggcggtgcagctgggtacattgatcgtttattgcttggagacgaccatctgtatcagcacccatctagcgcagtcctctaccacacagaagtggcgtacgaccccgaaggcatacttggaacaatcaattctattgtgatggcctttctgggtgtccaggcagggaagatcctcctgtactacaaagctcggacaaaagacatactgattcggtttactgcttggtgctgtatcctcggcctgattagcgtcgcgctgacgaaagtgtccgagaatgaagggtttatccccgtgaataaaaatctctggtccctgagttatgtgactactctttccagcttcgctttcttcattctcctcgtgctctacccagtggtggatgtcaaaggtttatggacgggaactccctttttctatcctggtatgaactccattctcgtgtatgtcggacatgaggttttcgagaattattttccctttcaatggaagctgaaggataaccagtcacataaggagcacttgacgcaaaacatcgtggccacagccctgtgggttcttatcgcgtacatcctgtacagaaagaagatcttttggaagatttag

SEQ ID NO: 225926 - DNA, 669 bp, Artificial Sequence
  Description of Artificial Sequence: Synthetic coding sequence
atgtccggcgctggccgagccctggcagcacttttgctggctgctagtgtcctgtccgcggctttattggcccctggtggctcctctgggcgagatgcccaggctgctccacccagagatcttgacaagaaaaggcatgccgagcttaaaatggatcaggccctgctgctcattcataacgagctgctgtggactaacttaactgtgtactggaagtcggagtgttgctaccattgtctgttccaggtactggtgaatgtgccccagagtcccaaggcaggaaagccttccgcggcagcagcgtcagtcagcacccagcacggttcaattctacagctcaacgacaccctggaggaaaaggaggtgtgcaggctggaatacaggtttggcgagttcggcaattatagtcttctggtcaagaacattcacaatggggtgagcgaaatcgcatgtgatttggcggtgaatgaagatccagttgattccaatctgcccgttagcatcgcttttctcattgggctggcggtcattatagtgatttccttcctgcgattactgttaagggtgctcctttgccacccaggatggtcagcggtcgccccatcccgtttgactccttcctctgcgtcgcgtgtgcacaccattctgctgccacagcccccagagtag

SEQ ID NO: 225927 - DNA, 1908 bp, Artificial Sequence
  Description of Artificial Sequence: Synthetic coding sequence
atgagtggagccggtagggccttggctgccctcctgctagcagcatcggtgctgagcgctgccctgctcgcaccgggaggctcaagcggaagggacgctcaagctgccccaccgagagacctcgacaaaaaaaggcacgccgaactgaaaatggatcaagctctgttactgatccacaacgagctgctttggacaaatctcaccgtgtactggaagagcgagtgttgctaccattgcctcttccaggtactggtcaatgtgccccagtctcctaaggctgggaagcccagcgcagccgcagctagcgtgtctacgcaacatgggtctatcctgcagctgaacgatactcttgaggagaaagaagtctgcagactggaatacagatttggtgagtttggcaattattccctcctggtgaaaaacatccacaatggcgtttcagaaatagcgtgtgatctcgccgtcaatgaagacccggtggactcgaatcttccagtctcaattgctttcctaataggcctggccgtgatcatcgtaatctctttcttacggctgctgttgtcccttgatgatttcaataattggatcagcaaggccattagtagccgagagaccgatagactgatcaattccgagctgggctctcccagccgcaccgacccactggatggggacgtccaaccagctacttggcggctgtctgcgctgcctccgcgactccgctccgtggatacatttagaggcatcgcactgatcttgatggtctttgtgaattatggaggagggaaatactggtatttcaagcacgcatcctggaatgggctcacagtggccgatctcgtgtttccttggttcgtatttataatgggcagcagtattttcctctccatgacaagcattctgcagagagggtgctctaaatttaggcttttgggcaaaatcgcatggaggtccttcctcctgatctgcattggcatcataattgtgaatcctaattactgtctaggccctttaagttgggataaagtcaggattcctggagtcctgcagagactgggtgtgacctatttcgtcgttgccgttctggaactgcttttcgccaagccagtgcccgagcactgtgcttcagagaggtcatgtcttagccttagggatatcactagttcttggccacagtggttgcttatcctcgtgctggaggggctgtggctgggtctgacattcctcctgccggtgcctgggtgccccacaggttacctgggccctgggggtataggagacttcggcaagtacccgaactgtacaggtggggctgcgggatatatcgaccgtctcctgttaggggacgatcacctgtaccagcatccttcctccgccgtactgtaccacacagaggttgcttacgaccccgagggtatccttgggaccattaattctatcgtcatggccttcctgggtgtgcaggccggaaagatcctgctttattataaagctcggaccaaggacattctgatcagatttaccgcatggtgttgcattttagggctgatttcagtggccctgacgaaagtttcagagaacgaaggctttatccccgtcaataagaacctgtggagcctgagttacgtaaccaccctgtctagctttgccttcttcatcttattagttttataccccgtggtggacgtgaaagggttgtggacagggacacctttcttctaccccggaatgaatagcattttagtgtacgtgggtcacgaggtgttcgagaactattttccgtttcagtggaagcttaaggacaaccagtcccacaaggaacacttgactcagaacattgtggctacggccttgtgggtgctgattgcatatatactgtaccgcaaaaagatcttctggaagatatag

SEQ ID NO: 225928 - DNA, 1992 bp, Artificial Sequence
  Description of Artificial Sequence: Synthetic coding sequence
atgaccggcgcacgagctagcgcggcagagcagcgcagagcaggccgttctggacaggccagagccgctgagagggcagccggtatgtcaggtgccggtcgggctttagccgcactgctgctcgccgcttcggtgctgagcgccgctctattggctccgggaggctcatccgggagggatgcccaggctgctccacctagagaccttgataaaaagaggcacgctgagctcaaaatggaccaggccctgttactcatccacaatgagttactttggaccaacctgaccgtttattggaagagtgaatgctgttaccattgcctcttccaggtcttggtaaatgttcctcagagccctaaagctggcaagcccagcgcagcggctgccagcgtctctacgcagcatggttccattctgcagctcaatgacactctggaggagaaagaagtctgtcgactcgagtatcgctttggagagtttggcaactactcgttattggtgaagaatatccacaatggtgtgtctgagattgcatgcgacctggcggtaaatgaggatcccgtcgattcgaatctacctgtgtcaatcgcttttctcatcggattggcagttataattgtcattagtttcttgaggctcctcctgtccctcgatgattttaacaattggatttctaaggccatctcctccagagaaacagacagattaatcaacagcgagctgggctcaccttcaaggactgacccattagatggagatgttcagccagccacctggagacttagtgcgctgccgccaaggctgaggtctgtggatacctttagaggcatcgctttaattctgatggtgttcgtgaactacgggggaggtaaatactggtatttcaaacacgcttcttggaacggactgaccgtggccgacttagtcttcccatggttcgtctttatcatgggctcttctattttcctttctatgacctcaatcttgcaacgagggtgctccaaattccgcctgctcggaaagattgcatggagatctttccttttgatctgtatcggcataatcattgtgaatccgaactactgcctcggaccactgtcctgggacaaagtacgcataccgggtgtactgcagcgtctcggcgttacatacttcgtagtggcagtcctggagctcctctttgcaaaacctgtgccggagcactgcgcctccgaacggtcttgcttgagcttaagggatataaccagctcatggcctcagtggctgctgatcctcgtgctcgaggggctctggcttggactgacctttctcttgcccgtcccaggctgtccaactggttacttaggccctggtggcataggagacttcgggaagtaccccaattgtacaggcggagcagcgggatacatcgacagactcttgctgggcgacgaccatctgtaccagcacccatccagtgccgtcctgtatcacaccgaagtggcttatgacccggaggggattctcgggacaatcaattcgattgtaatggcctttcttggcgtccaggccggaaaaattctgctgtattacaaggcgcgaacaaaggatatactgattaggttcaccgcctggtgctgtattctcggtctcatctctgttgcactcactaaggtctctgaaaatgaaggatttatccctgtgaataagaacctctggagtctgtcttacgttacgaccctaagctccttcgcttttttcatccttctggttctgtacccagtcgtagatgtgaaagggctctggaccggaaccccattcttttacccgggaatgaactctatcttagtctatgtcgggcacgaagtattcgaaaattactttcccttccagtggaagcttaaggacaatcagtcacacaaggagcacctcactcaaaacatagtcgctaccgctctgtgggtgctgatcgcctacattctgtatcggaagaaaattttctggaagatctag

SEQ ID NO: 225929 - DNA, 1647 bp, Artificial Sequence
  Description of Artificial Sequence: Synthetic coding sequence
atgcgcgtgttgtgcgcgtttcctgaagcgatgccgtccagtaattcgcggccacccgcttgcctggcccctggggctctctatctagcactactgctgcacctctcactctcctcccaggcgggtgaccggaggcccttacctgtggacagggcagccggattaaaggagaagaccctcatcctacttgatgtgtccacaaagaacccagtgaggactgtcaacgagaatttcctttccctgcagttagaccccagcataatccatgacggctggttagacttcctgtctagcaagagattagttacgctcgcccgaggtctgtctccagcatttctaagattcggtggcaaacgcaccgattttctgcagttccagaatcttcgtaaccccgcaaagtcccgcggagggccaggaccagattactatttaaagaattacgaggacgacattgtccggagtgatgtggcccttgataaacagaagggctgcaaaatcgctcagcaccccgacgtgatgttagaactgcaacgggagaaggccgcacagatgcacttggttctactgaaagagcagttcagcaatacctatagcaacctcattctgactgcacgttctctagataaactgtacaattttgccgactgttccggtttacatctaatatttgctctaaacgctctaaggcggaatccaaataactcttggaatagttccagcgcactctctctgttgaaatacagcgcctctaagaaatataacatctcttgggagctgggcaacgaaccaaacaactatcgaaccatgcacggacgagcagtgaacggaagccagctcggaaaggattacattcagctgaagagtctgctgcagccaatccggatttacagtcgcgcaagtctgtatggtcccaatataggccgacctagaaagaatgtgatcgccttgttagatggtttcatgaaagtggccggatcaactgttgacgcggtgacatggcaacattgctatattgatggcagggtagtcaaggtgatggactttctcaaaaccaggctgctcgacaccctctcagatcagatccgcaagatccagaaggtcgttaacacttacactcccggaaagaagatctggctggagggtgtggtgactacaagcgctgggggtaccaacaacctgtccgactcttatgccgcaggctttctgtggctcaatacacttggcatgttagccaatcaagggattgacgtggtgatacgccatagtttctttgaccacggctataatcatctggtggaccagaattttaaccccctgccagactactggttgtcgctcctttacaagaggcttatcggaccgaaggtactggcagttcatgtggctggactgcaacgaaaaccaaggccagggcgtgtgatccgggataagttgcggatctacgctcactgcacaaatcatcataatcacaattacgttagaggtagtataacgctgtttatcattaacctccacagaagcagaaaaaaaataaaactggcgggtacgttgcgcgacaaattagtgcaccagtacctgctgcagccatacggacaagaagggcttaaaagcaaaacccagaggtgccagtattgtgggattatttag

SEQ ID NO: 225930 - DNA, 1605 bp, Artificial Sequence
  Description of Artificial Sequence: Synthetic coding sequence
atgcgagtcctgtgcgccttcccagaggccatgccatcctctaatagccgtccgccagcctgccttgccccaggagccctgtacctcgccctgcttttgcacctgtccctcagctctcaggctggggacagaaggcctttgcctgtggacagggcagccggtctgaaggaaaagaccctgatcctgcttgacgtctcaactaagaaccccgtgaggaccgtgaacgagaacttcctgtcattacaacttgacccttctattatccatgacggctggttggacttcctctcttctaagagactcgtgacccttgcccgagggttgagcccggcttttctgaggttcggcggaaaaaggacagacttcctgcagtttcagaaccttcggaaccccgcaaagagccgaggcggacctggcccagactattatcttaaaaactacgaagacgatattgttaggtctgacgtcgctttagacaagcagaagggttgcaaaatcgcccaacatcccgacgtcatgctggagttacagcgtgaaaaggctgcacagatgcacttggttttgctgaaggagcaattcagcaacacctactctaacctgatacttacagagccaaacaattatcgtactatgcatgggagagctgttaatggctctcagctgggcaaggattatattcagctcaaatcccttctgcagccgattagaatatacagccgcgcatccctatatgggccaaatattgggagaccacgaaagaacgttatcgcactgctcgacgggtttatgaaagtggctggctcaaccgtagacgcagtcacctggcaacattgttacatcgacgggcgtgtcgtcaaagtcatggatttcttgaaaaccagactactcgacacactgagcgaccaaatacgcaagatccagaaagttgttaatacctacacccctggaaagaagatctggctggaaggagtggttaccactagtgccggagggaccaataacctgagtgatagctatgccgctggatttctatggctcaacaccctgggcatgctagctaaccagggaattgacgtagtgattcggcacagtttttttgatcacggctataaccaccttgtagatcagaatttcaatccacttcccgattactggttgtcattgctctataagaggctgattggtcctaaagtgttagcagtccacgtcgctgggctgcaaaggaaacctagacctggtcgcgtcatcagagacaaactcagaatttacgcacattgtactaaccatcacaatcataattacgttcgcggaagcatcaccttattcatcatcaatctccatagatctagaaagaagatcaagttagccggtaccttgcgcgataaactggttcatcagtacttgttgcagccttacgggcaggagggcctaaagagcaaaagcgttcagctgaatggccagcctctcgtaatggtggacgatgggacactcccagagctgaaacccagaccactgagggccggtcggaccctcgtgattcctccagtaactatgggtttctatgtggtgaagaacgtgaatgctcttgcatgccggtacagatag

SEQ ID NO: 225931 - DNA, 1779 bp, Artificial Sequence
  Description of Artificial Sequence: Synthetic coding sequence
atgagggtgttgtgcgcttttcccgaagctatgccctcctcaaactccagaccacctgcctgtctcgcaccgggagcactttatttggcacttctcctgcacttgagtttgtcatcccaagcaggtgacaggcggccactgccagttgatcgagcggctggtctcaaggagaaaactcttattctgctggacgtctcaactaaaaaccccgtgcgcacggtcaacgaaaacttcctctcactgcaactagatccttctatcattcacgatgggtggttggacttcctctcaagcaagcggctcgtaaccctcgcccgtggattgagcccagctttcctgagatttggcggaaaaaggaccgattttctgcagttccagaatttgaggaaccccgcaaagtcaagggggggtcccggacctgactattacttgaaaaattacgaggatgatatcgtacgaagtgatgtggccttggacaagcaaaaaggatgcaagatcgcccagcatcccgacgtgatgctcgagctgcagcgcgaaaaagccgcacaaatgcacttggttcttctgaaagagcagttcagcaatacctactcaaaccttattctgaccgcacggtctctggataaactgtacaatttcgcagactgcagtggcttacatcttatctttgcccttaatgcacttcggagaaatccaaataacagctggaactcctcctctgcactatcattgctgaaatactctgcctcaaaaaagtacaacatttcctgggagctcggcaatgagccaaataactataggacaatgcacggcagggcagtaaatggctcacagctgggcaaggactacattcagctgaagtcattgctgcagcccatcagaatatactcgagagcttctctctatggcccaaacatcggaagaccacggaaaaatgtgattgccctgctggacggcttcatgaaagtggccggttctacagtcgacgcggtcacctggcaacattgttatatagacggtcgcgttgtgaaggtgatggatttcttgaaaaccagactgctggacacactctcagaccagatccggaagattcagaaagttgtgaatacttatacaccgggaaaaaaaatttggttggagggggttgtgaccaccagcgccggaggaacgaataacctgtcggactcttacgccgctgggttcttgtggctcaacacattgggtatgttggcaaaccagggaatcgacgttgtcatccggcactccttctttgatcatgggtacaatcacttggttgatcagaattttaacccattgccggactattggctttcactcctgtacaaaaggcttatcgggccaaaggttctggccgtgcacgtcgctgggttgcagaggaaaccacgacctggtagggttatacgagacaagctgagaatttacgcgcactgtacgaaccatcataatcataattacgtgcggggatctatcacactcttcattatcaaccttcacaggagtcgcaagaaaatcaaactcgcaggaactctgcgcgacaaactggtgcaccaatacctcctacagccctatggccaggagggcctgaagtcaaaaagtgtgcagctcaacgggcaaccattggtcatggtagacgacgggaccctgcctgaactaaagccccgtcccctgagagcagggagaaccttggtgattcccccagtgactatgggcttttacgtggttaagaatgtgaacgcactcgcctgtaggtatcgatag

SEQ ID NO: 225932 - DNA, 1443 bp, Artificial Sequence
  Description of Artificial Sequence: Synthetic coding sequence
atgcgcgtgctttgtgccttccctgaggctatgcctagttccaatagcagacccccagcctgtctcgcacccggtgccctctacttggccctgctgctccatcttagcctgagctctcaggctggcgatcggaggcccttgcctgtcgatagggcagctggactgaaagaaaagaccctcatcctactggacgtctctacaaaaaatcctgtccggacagttaatgagaattttctgtccctgcagctggatccaagcattattcatgacggatggctcgacttccttagcagtaaacggcttgtcacccttgccagaggtctcagccccgcttttctgaggtttggcggaaagaggacagattttctccaatttcagaacctgcggaatcctgcgaagtcccggggaggtcccggacccgattattacttaaagaactatgaagacgaacccaacaattatcgcactatgcacggccgagccgtgaacggcagtcaactaggaaaggattacatacagctgaagagcctgctccaaccgatccgaatttattctcgagccagtctgtacggcccaaacatcggcaggccgaggaaaaatgtgatcgcgttgctcgatggctttatgaaggttgccggatctaccgtcgatgcggtgacgtggcaacactgttatattgatggcagggtagtgaaagtgatggacttccttaagactcgtctgctggacacccttagcgatcaaattcgtaagatccagaaggtggtcaatacatacactcctggtaagaagatatggctagagggtgtggtgactactagcgccggaggaacgaacaatctctccgactcgtatgcagccggattcttgtggctcaatacactgggaatgctggctaatcagggtattgacgtggtcatccggcattccttcttcgaccacggatacaatcaccttgtggaccaaaacttcaatccattgccagactactggctgtccctgttgtacaagcgcctcatcggtcccaaagtgttagcagttcacgttgcgggattgcaacggaaacccaggcccggtcgtgtgattcgagataagctccgaatctacgctcactgtaccaatcatcacaaccacaactatgtcagggggagcattaccttgtttattatcaacctccataggtcacgcaagaagatcaaactcgccggaactctccgggataaattggtacaccagtacctgcttcaaccgtacggacaggaagggttgaagagcaaaagtgtgcaacttaatggacagcctttagtgatggtagatgacggcacattgcccgagctgaagccaaggcccctcagagcagggagaacactggtgataccccctgtgactatgggtttctatgtagtgaagaatgtgaatgctctggcgtgtaggtacagatag

SEQ ID NO: 225933 - DNA, 1251 bp, Artificial Sequence
  Description of Artificial Sequence: Synthetic coding sequence
atgaaaagagagcgtggtgccctgtcacgagcatctcgagctttgagactcgcaccctttgtgtacctgctcctcattcagactgaccccctggagggtgtgaacattacaagccctgtcaggttaatacacggaactgttggcaagtcagcactgttatcagtgcagtactcttccacctcttctgatcgccctgtcgtgaaatggcagctgaagcgggataagccggtgaccgtcgtgcaaagcatcgggactgaagtgatcgggactctgcggccagattatcgagatcggattcgtctgtttgaaaatgggtccctcctcctttctgacctgcagctggctgacgaaggtacttacgaagtggaaatttccatcaccgacgacaccttcacgggggagaaaaccattaatctgactgttgacgttcccatctctagaccccaggtactggttgcaagtaccacagtgttagaactgtcggaggcatttaccctcaactgcagccacgagaacgggactaagccctcatacacatggctcaaagacggtaaacctctcctgaacgactcccggatgctgttgtcgccggaccagaaggtgctgaccattacgcgcgtgctcatggaagacgacgacctgtattcctgcatggtcgagaaccctatctctcagggcaggtccctgcctgtgaaaataacagtgtacaggaggtccagtctctatattatcctcagcaccggcggtatattcttactggtaactttggtgactgtgtgcgcctgttggaagccaagtaagagaaagcaaaaaaaactggaaaaacaaaactcccttgagtatatggaccagaacgacgatcgactgaaacctgaggcagacactctgcccagatctggcgaacaggagcgcaaaaaccccatggctttgtacattttgaaagataaggattccccagaaacggaggagaatcctgcaccagagccgcgatcagccaccgaacctggcccacctggctacagtgtatcaccagcagtcccgggaagaagccctggactccctatccgttccgccaggcgttatcccaggtctcctgccagatccccagctactgggcgtacccattcctctcccccacgtgcacccagctctcctggcaggagcaggtcagccagccgaacacttcgcacggccggagtccatatcatcagggaacaggatgaagccggacctgtagagattagtgcctag

SEQ ID NO: 225934 - DNA, 1104 bp, Artificial Sequence
  Description of Artificial Sequence: Synthetic coding sequence
atgaagcgtgagaggggcgctttgtctcgagccagcagggctctgaggctggccccatttgtgtacctcctgctgatccagacagatccacttgaaggcgtaaatattaccagcccagtccgtctgatacacgggaccgtggggaagtctgctcttctgtccgtacaatactcctctaccagctctgaccgaccggttgttaagtggcagttgaaaagggacaagcccgttaccgtggtgcaaagcatcggaaccgaggtgattggcaccctgcgacccgattaccgagaccgcattaggttattcgagaacggtagtctgctgctgtcagaccttcagctggcagacgaggggacgtatgaggtggagatctccattacagacgataccttcaccggcgagaagacaatcaatctaaccgtggatgtaccgatctctcgcccacaggttctggtggcgtctactaccgtactcgagctgtccgaagcctttacgctgaattgctcccatgagaacggaactaagccttcctacacttggctgaaagatggaaaaccgctgctcaatgacagcagaatgctgctatctcccgatcagaaggtcctgaccataacacgcgtcctgatggaggacgatgacctgtactcttgtatggtcgaaaacccaatttcccagggtcggtcactgcccgtgaaaatcacagtgtacagacgttcctctctttacattattctctcaaccggtggtatttttctgcttgtgaccctcgtaactgtatgcgcttgctggaagccatccaagaggaaacagaagaagctggagaaacagaattcattagagtatatggatcaaaacgatgaccggctcaaacctgaaggtgaactgccggctactcagtcaccaattccttcaacaatcagatcagtaggatgctgggagaaggctgagctgggcgacaaagaaaactcttccgccggaaccctgccgtctgatcttggcgctagcaaaggcaaagagcccgaacctgcttcgctagcctctagccacagcctcccaagacggcacgccatgccgagcaccctttccgtgtccgttcacgagtag

SEQ ID NO: 225935 - DNA, 669 bp, Artificial Sequence
  Description of Artificial Sequence: Synthetic coding sequence
atgtcccaaaccaaaatgcttaaagtcagggtgactctgttctgcatcctggccggaatcgttctggccatgactgccgtagtaactgatcattgggctgttctgagtccccacatggaacaccataacaccacgtgcgaggccgctcactttggcctctggagaatttgcacaaaaagaattcctatggacgatagcaagacatgtggaccgatcacgctgccgggtgagaagaattgcagctactttagacacttcaatccaggagagagttccgagatctttgaattcacaacccagaaggagtactcgatctcagctgcagcgatcgcaatcttctccctcggattcataatccttggatcactgtgtgtattgcttagccttgggaaaaagcgggactacctgctgcggccagcgagcatgttttacgcctttgctggcctgtgcatcttagtgagcgttgaagttatgaggcagtctgtgaagagaatgatagactccgaggatacggtttggatagaatactactactcctggtccttcgcatgcgcttgtgcagcatttatccttctctttttggggggtctggccttgctgctgttcagcctgccacggatgcctaggaacccctgggagtcttgtatggatgcagaacctgaacactag

SEQ ID NO: 225936 - DNA, 633 bp, Artificial Sequence
  Description of Artificial Sequence: Synthetic coding sequence
atggacttggaagagtttctgtccgagaatggcatcccccctagcccatcccagcacgatcacagcccccatccccctggacttcagccagcctccagtgcagccccttctgtgatggacctgtccagtcgggcttccgcccctctgcacccaggcatccctagcccaaactgcatgcagagccctatacggcctggccaactactcccagctaacaggaatacaccgagtcccattgatcccgacaccattcaagtccccgtaggttacgaacccgatcccgcagacttagccttgagcagcatccctggccaggagatgttcgacccaaggaagagaaaattttccgaggaagagcttaagccccagcccatgatcaaaaaagccaggaaggtttttatccctgatgatttaaaagatgacaagtactgggcccgtagacgtaaaaacaacatggcagctaagaggtctagagatgccagaaggttgaaagaaaatcagatcgccatacgagcgagtttcttagaaaaagaaaatagcgccctcaggcaagaagtggcagacctcaggaaagagttgggaaaatgcaaaaacatactcgcaaaatatgaggccaggcatggaccactgtag

SEQ ID NO: 225937 - DNA, 1095 bp, Artificial Sequence
  Description of Artificial Sequence: Synthetic coding sequence
atgcaccctcaggttgtgattctttccctgatcctacatctagccgattccgttgccggtagcgtcaaggtgggaggcgaagctgggccttccgtgaccctcccctgtcattatagcggagccgtcacaagcatgtgctggaatcggggatcatgctcactgtttacttgtcagaacggcatcgtttggaccaacgggactcacgtgacataccgcaaagatacacgctataaactgctcggagacttgagtcgcagggatgtgagcctcacaatcgaaaacacagcagtgagcgattccggcgtgtattgctgccgcgtggaacatcgtggttggtttaatgatatgaaaatcaccgtcagtcttgagatagtgcctcccaaggtgaccactacccctattgtgaccacagtgcccactgtgacgactgtacgtacgtccaccactgttcctactaccaccaccgttcccatgacaacggtccctaccacgactgttcccaccacaatgtctataccaacaaccacaaccgttttgacaactatgaccgttagcacgacgactagtgttcctactaccactagcatccccaccactacaagcgtaccggtcacaacgaccgtatcaacctttgtgcctccgatgcctctgcctcgacagaaccacgagccagttgcaacctccccttcatcccctcaacccgcagaaactcatcctacaaccctgcagggggctatacgtcgtgagcccacctcaagtcctttgtactcttacacaaccgacggcaacgacaccgttactgagtccagcgatgggctctggaacaacaatcaaactcagctttttctcgaacattcgctgctgacagctaacacgaccaaagggatctatgcaggagtgtgcatttccgtcttggtgctgttagccctgcttggtgtgataatcgcaaagaaatactttttcaaaaaggaagtgcaacagcttagcgtgagcttttccagtctccagatcaaagccttacagaatgcagtggaaaaggaagtgcaggctgaggacaatatttacatcgagaactctctatacgcgaccgactag

SEQ ID NO: 225938 - DNA, 1206 bp, Artificial Sequence
  Description of Artificial Sequence: Synthetic coding sequence
atgcacccgcaggtagttatactcagccttatcttgcaccttgccgatagtgtagctggctccgtaaaagtaggtggagaggctggtccctcggtcactctgccatgtcactattccggtgcggtaacaagtatgtgttggaatcgtggctcttgctcactcttcacatgccaaaacggaatcgtctggactaatgggacacatgtcacataccgtaaagatacacgctataagctgctaggtgacctctctaggagggacgttagtttgacaatcgaaaacacggccgttagtgacagcggagtttattgttgccgggtcgaacatcgcggttggttcaacgatatgaagatcacagtctccctggagatcgttccccctaaggtgaccacaacccccatcgtcacgacagtgcctaccgttaccacagtgaggacaagcactacagtgcccacaaccactaccgtgcctatgactaccgttcccaccaccacagtccctacaaccatgtcaatacctaccaccaccaccgtgcttacgacaatgacagtatccaccacaacgagtgtccccacgacaacgtctatccccaccaccacatcagtgccggtcaccaccacagtgtccacctttgtgcccccaatgccgctgccgaggcagaatcatgaaccagtggcaacaagtccaagttcaccacagccagctgagacacatcccacaacactccagggagccatcagaagggagcctactagctctcctctgtactcatatactacagacggcaatgatactgttactgaatcctccgacggattgtggaataataatcagacccaactgttcctcgagcacagcctcttaacagctaataccacaaagggaatttacgccggagtctgcattagcgtgttggttttactcgcattgctgggggtcattattgctaagatgtttcatctcgccgcattcaagttgaaactgtgtaaaatgcaactaaagcgtaaaagcaagcagaagaccatttcaactcttagaatcgtctttatgccacgaactaaaacccagtggtgctcactgagagtctacgcacacgagtgccgtagactcaacagacaccagcacatccggaggctattagaccccaagacaatctttctgtttcaatttcatcttgcattccaacacgtctcagacaccggctag

SEQ ID NO: 225939 - DNA, 672 bp, Artificial Sequence
  Description of Artificial Sequence: Synthetic coding sequence
atgcatccccaggtagtgatccttagtctgattttacaccttgccgatagtgtcgccggttctgtcaaggtggggggtgaggccggaccttctgtgactcttccctgtcactactcaggcgcagtgaccagtatgtgctggaacaggggttcctgttccctctttacctgccagaacggtatagtgtggaccaatggtactcatgtcacctatcggaaggacactagatacaagcttctgggagatctgtcccgcagggacgtgtcgctcactattgagaataccgctgtgtctgatagcggggtctattgctgcagagttgaacacagaggatggtttaatgatatgaaaatcacagtgtctctggaaatcgtgccacctaaggtaactaccaccccaatcgtaacaaccgtccccaccgtgaccactgtgcggacatccactaccgtccctaccacaaccacagttcctatgacgaccgtgccgaccacgactgtgcccacgacaatgtcaattcccacaactacaacggtgttgaccactatgacagtgtcgacgacaacatctgtccctactaccacaagcatccccactactacaagtgttccagttactaccacagtcagtactttcgttcctccaatgccactgcctagacaaaatcatgagtag

SEQ ID NO: 225940 - DNA, 1095 bp, Artificial Sequence
  Description of Artificial Sequence: Synthetic coding sequence
atgcacccgcaggtggtaattctgagtctcattttgcacctcgcggattccgttgcaggctctgtgaaggtgggcggagaagctggtccaagcgtcacactgccttgccattatagtggagcggtaacaagtatgtgctggaatagaggaagttgcagtctgtttacctgccagaatggtatagtttggaccaatggaacccacgtgacttacaggaaggacactcgctacaaactattaggcgacttgagcagacgggacgtgtcactgacaattgagaatactgcagtcagtgactcaggggtgtactgttgcagggtcgagcaccgcggttggttcaacgatatgaagataactgtaagcctggagatcgtccccccaaaagtgaccaccactcctatcgtgactacagtccctaccgtcaccacggtgagaaccagcaccactgtgcccactacgaccactgtgcccatgacaacagtcccgacaacaacagttccaacgacaatgtcaatccccactaccactactgttctgaccacgatgactgttagcaccacaacatccgtccccactactacctccatccctacaacgacgtcggtgcccgtgactacgaccgtgagcacatttgttcctccaatgcccctccctcggcagaaccacgagcccgtggccacaagtccgtcctctccacaacctgcagaaacacaccccactactctacaaggcgcaatcagacgggaaccaacttcttccccattgtattcttacacgaccgatggaaacgacacagtgacagagtcttccgacggactctggaataataatcaaacacagctatttcttgaacattctttgctcacagccaataccaccaaggggatttatgctggcgtgtgtatcagcgttctcgtgttgttggctctgctcggcgtcattatcgcgaagaaatacttcttcaagaaggaggtgcaacagttaagcgttagtttttcatccctgcaaataaaagcgttgcagaacgccgtggagaaagaggttcaggccgaagataacatttacattgaaaatagcctgtatgctactgactag

SEQ ID NO: 225941 - DNA, 1095 bp, Artificial Sequence
  Description of Artificial Sequence: Synthetic coding sequence
atgcatccacaagtcgtgattctgagcttgatactccatctcgcagacagcgttgctggctcagtgaaggtggggggtgaggccggaccctcagtcacgttgccctgtcactattcaggggctgtaacttctatgtgctggaaccgcggatcctgcagcctctttacttgtcagaatggcatagtatggactaacggcacccacgttacatataggaaagacactcggtataagctactgggagacctctccaggagagacgttagcttaaccatcgaaaatactgctgtaagtgactccggagtttattgctgccgggtggaacacagggggtggttcaatgacatgaagattaccgtgtcccttgaaattgtgcctcccaaagtgactacaactccaattgttaccaccgttcctaccgtgacaacagtgaggacctcgactacagtgcccacgactacgactgttcccatgaccaccgtcccaactaccactgtcccaactactatgtcaattccaaccacaacaactgtgcttaccaccatgaccgtgtctactaccacatcagtgccgaccaccaccagcatccccacaaccacctccgtgccagtaacaaccacagtatccacgttcgtccccccaatgcccttgccacgacagaaccatgaacccgtcgctactagcccctcctccccacagccggcagaaactcatcctaccactctccagggggctattcggagagagcccacaagctcacccctgtactcctacacgactgacggcaacgacaccgtgactgagagttcggacggactgtggaacaacaaccagacacagttgttcctagagcatagtctgcttactgcaaacactacaaagggcatctatgcaggagtgtgcatctcagtgctcgtgctcctggctttgcttggcgtgataatagccaagaagtatttttttaagaaagaggtgcagcagctgagcgtatccttttcctccttacaaatcaaggccctccagaacgcagtagaaaaggaagtccaggccgaggataacatttacattgagaattcattgtacgcaaccgactag

SEQ ID NO: 225942 - DNA, 522 bp, Artificial Sequence
  Description of Artificial Sequence: Synthetic coding sequence
atggagcccggtgccggtcatctcgacggccaccgcgctggatctccctcactgcgtcaagctctgtgcgacggttcagcggttatgttcagtagtaaagaaagaggtagatgcacagtcattaactttgtccccctcgaagcgccactccgcagcactccacgcagcaggcaggtgactgaggcgtgcggaggcgaagggcgagccgtgcccttgggcagtgaacctgagtggtccgtgggagggatggaagccaccctcgagcagcatctcgaagacaccatgaagaatcctagcattgtgggggtgctctgcacagactcacaggggttgaatctgggctgtcgtggaacgttaagcgatgagcatgcgggtgtaatcagcgtgctggcacagcaggcagcgaaattaacctctgacccaacagatattcccgtcgtgtgcctcgaatctgataacggtaacattatgatacaaaagcacgacggcataaccgtggccgtgcataagatggcgtcctag

SEQ ID NO: 225943 - DNA, 267 bp, Artificial Sequence
  Description of Artificial Sequence: Synthetic coding sequence
atgggaaactggggtctgggcatcgctccatgggtcgatggtgagagcgagctggaattcagacgtctgggaatgcagggcccattggaagcacttaggagaagagagtggaatacgcagagggcctcattttcattctcgtttttaatcgcactctctccccatactgtggattattgccactcctatgagttgttcaatcggaggtggcacggacatgtgctggcaacccagagaccttctctttttatactgatgctggtgtag

SEQ ID NO: 225944 - DNA, 2334 bp, Artificial Sequence
  Description of Artificial Sequence: Synthetic coding sequence
atgggtaggggatcagggaccttcgagagactgctggacaaggccacgtcccagctgttgctggagacggactgggagtctatcctgcagatctgcgacctgattagacaaggcgatacacaagccaagtatgccgttaattccatcaagaaaaaggtcaatgataagaacccacatgtagcattgtacgcgctggaggtcatggagagcgtggtgaagaattgcggccagacagtccacgacgaggtggcaaacaaacagactatggaggagcttaaggatctattgaaaagacaggtggaggtaaatgtgcgcaataagatcctgtacctcatccaggcttgggcacatgctttcaggaacgagcccaagtataaagtggttcaggacacgtaccagattatgaaggttgaggggcatgtgttcccagagttcaaagaatccgacgccatgtttgccgcagaacgagcccctgactgggtcgatgccgaggaatgtcaccggtgtagagttcagttcggggtaatgaccaggaagcaccattgccgcgcttgcggtcagatcttctgtggaaaatgctcttctaaatatagtacgataccaaagtttggaattgagaaagaagtaagagtgtgcgagccctgctatgagcagctcaacaggaaagcagagggaaaggccacaagtactacagagttgccgccagagtatctgactagccctctctcgcagcagtcacaacttcctcctaaacgcgatgaaacggctctgcaagaagaagaagagcttcagctggcacttgctctgtctcagtctgaggctgaggaaaaggagagacttcgtcagaaaagtacctatacctcctatcccaaggctgaacctatgccatcagccagctcagccccaccggcaagctctctctactccagccccgtcaattcatctgcccctctcgcagaagacatcgatccggagctagctagatatctcaataggaattattgggagaagaagcaggaggaggcccgtaaatctcctactcctagcgcccctgtccccctgacagaacctgccgctcagcctggagaaggccatgccgctcccaccaatgtggttgaaaaccccctgcctgagacagacagccaacctatcccgccttccggcggtccgtttagcgagccacagttccacaatggagagtcggaagagtcgcatgagcagtttctcaaggccctccaaaacgccgtgacgacgtttgtgaatcggatgaagagcaatcatatgagaggtaggtctattacgaacgattctgccgtactgagcctctttcagtcaattaatggaatgcacccccagctgctggagctgttgaatcaactggacgagcgcaggctctattacgaagggcttcaggacaagctggctcaaatccgcgacgccagaggggcattgtccgcgttgcgagaggagcatcgtgagaagctgagacgagcagccgaagaagcggagaggcagcgccaaattcaactggcacagaaactggagattatgaggcagaagaaacaagaatacctggaggtgcaacgacagcttgcgatccagcggctgcaagagcaagaaaaagagcgccagatgcgtctcgaacaacaaaagcagactgtccagatgagagcccagatgcctgccttcccccttccttatgcccagcttcaagccatgcccgcagctggaggcgtactctaccagccttccggaccggctagtttcccttcaactttctcacctgcaggttcagtggagggatcaccaatgcacggcgtgtacatgagtcagcctgcgcctgcggcagggccatacccatcgatgccatctactgctgccgaccctagtatggtctcagcctacatgtatccagctggggcaactggggctcaggcagcccctcaggctcaggctgggcctaccgcaagtcccgcttatagttcttatcagcccacccccacagcgggttaccagaatgtggctagtcaggcccctcagtcattaccagcaatctcacagccaccccagtcctccaccatgggctacatgggcagccaaagcgtcagcatggggtaccagccctacaacatgcagaaccttatgaccactctaccctctcaagacgctagcctaccgccacaacaaccttacatcgcgggtcagcagcccatgtaccagcaaatggccccatctggaggacctccccagcagcagccaccggtggcccagcagccacaagcgcaaggcccaccagcccaaggcagcgaggcccagctgatttctttcgattag

SEQ ID NO: 225945 - DNA, 2076 bp, Artificial Sequence
  Description of Artificial Sequence: Synthetic coding sequence
atgggacggggaagcgggacgtttgaacgtctgttagataaggctacttctcaactgctcctggaaactgactgggaatccatactacagatatgtgacctgattcggcagggagatacacaggccaaatacgccgtcaattcgatcaaaaaaaaggtgaatgacaagaacccccacgtcgccctatacgcattagaggtgatggagtctgtggtcaaaaattgcggtcagactgtgcatgatgaggtggccaataagcagactatggaagagttgaaggatctgctgaagcgccaggtggaagttaatgtgcgcaataagatactgtacctaattcaggcctgggctcacgcttttcgtaatgagcccaagtataaggtggtgcaagatacttaccaaataatgaaggtggagggtcatgtgtttccagaatttaaggaatccgacgcaatgtttgcagctgaacgggctccagattgggtcgacgctgaggaatgccaccgctgcagggtccaatttggcgtgatgacccgaaaacaccattgtcgggcttgcgggcagattttttgcggcaagtgtagttccaaatacagtaccatacctaaattcggcatagagaaagaagtgcgtgtttgtgagccgtgttatgagcagttgaaccgcaaagcagaaggtaaggccactagcactacagagctgccccctgagtatctgacctcccccctgagccagcagagccaactgccgcctaagagggacgaaactgcactgcaagaggaagaggaactgcaactggcactagccttgtcacagagcgaagcagaggaaaaagagcgacttagacaaaagagcacctatacctcatatcctaaggccgaaccaatgccctctgcgtctagcgcacctcccgcatcatcattgtatagcagcccggttaactcaagcgcacccctcgctgaagacatcgatcccgaattggccaggtatctaaatagaaactattgggaaaagaaacaggaggaagctcggaagtcccctactcccagtgcaccggttcctctaactgagccagctgcccagcccggagaaggacatgcggctcctacaaatgtcgtcgagaatcctctgcctgagacggattcccagcctatccccccttctggcggaccctttagtgaacctcagttccacaatggtgagagcgaggaatcccatgaacagttccttaaagccctgcagaatgcagttaccaccttcgttaacagaatgaaatcaaatcacatgagaggcaggagtataaccaacgactctgccgtcctctcgttgtttcaaagcataaacggcatgcatccgcaactcctggagctgcttaaccaacttgacgagagaaggctatactacgaaggtctgcaggacaagctggcgcagattagagatgctcgcggtgcattgtcagccctgagagaggagcatagggaaaaactgcgccgtgctgccgaggaagctgagcgacagagacagattcagctcgcccaaaaacttgaaatcatgatgcacggggtttacatgtctcagcccgctcccgctgcgggaccctacccgagcatgcctagtactgcggcagatccatctatggtgtccgcctatatgtatcctgcaggagctactggggcacaggctgcgcctcaggcccaagcagggcctacagcaagtcctgcctatagttcttaccaacccacgcctacagccggatatcagaatgtggcttcacaggcccctcaatcgctgccagctatcagccagccgcctcaatctagcacaatgggatacatggggtcacaatccgtgtctatggggtaccaaccttacaatatgcagaaccttatgaccacactcccctcgcaggacgcctcactccctcctcagcaaccctatatcgcaggccagcaaccaatgtaccaacaaatggctccctcaggcggacctccccagcagcagcctcctgttgcccagcagccacaggcccaaggccctcccgcacagggttctgaggcccaactaatcagcttcgattag

SEQ ID NO: 225946 - DNA, 324 bp, Artificial Sequence
  Description of Artificial Sequence: Synthetic coding sequence
atgaggctctcaaagacccttgtcgacatggacatggcagactactcggcagcccttgaccccgcatataccactctcgaatttgaaaatgttcaggtactcacaatgggtaacgattttgttgccgctgcctccaggcagatagaggcaagtcctcccacatctttggagcatatttggagaggaggtcagttctcaacagggaggcatgtgcccatccgaaggcatcagccacaacgggcacaacagccaggctgtcaacgtccggtttgccacttgcgcggtcccggacacggccagaccctcaggtgtctggaactgtag

SEQ ID NO: 225947 - DNA, 1425 bp, Artificial Sequence
  Description of Artificial Sequence: Synthetic coding sequence
atgcgcttaagtaaaaccttagttgatatggacatggccgactattctgctgctctggatcccgcatacacaaccctggaatttgaaaatgttcaagtgctcactatggggaacgataccagtcctagcgaagggaccaacttaaacgccccaaacagtctaggtgtgtccgccttatgcgcaatctgcggcgatagagctactggcaagcattacggagcatcttcctgcgatggctgtaaaggttttttcaggagatctgttcgaaaaaaccacatgtactcatgtcggttttcacgccagtgcgtggtggacaaagataaaagaaaccagtgcaggtactgtagactgaagaaatgtttccgggcaggcatgaaaaaggaggccgtgcagaatgagagagatcgtatcagtacacgccgatcatcatacgaagattcaagcctaccgagcataaacgccctgctgcaagctgaagtgctgtctaggcagatcaccagccctgtgagtggcattaatggcgatatccgcgctaaaaagattgcctcaattgccgacgtttgcgaaagtatgaaggagcagctgcttgtactggtggaatgggcaaaatacatccccgcattttgcgaactcccactcgatgatcaggtggccttgctgagggctcacgcgggagagcacctcttactgggagccacgaagagatccatggtgttcaaggacgtgctgctgctgggaaacgactatatcgtccccagacactgtcctgagctagctgagatgtcccgagtgagtatacgcatactggacgagcttgtacttccttttcaagagctgcaaattgacgacaatgagtatgcgtacttgaaggctatcattttcttcgaccccgacgctaagggcctatcagaccccggtaagattaagaggctccggtctcaggtgcaagtgtcactggaagactacattaacgacaggcagtacgactctcgtggaagattcggtgaactgttgctgttgctgccaacactgcagagcatcacttggcagatgattgagcagattcagttcattaagctgtttggaatggcaaaaattgacaacttactccaggaaatgctgctgggtggttctccctctgacgcgccacacgctcatcatcctctgcacccacacttgatgcaggagcacatggggaccaacgtaatcgttgctaacactatgcctacacatctaagcaacgggcagatgtgcgaatggccacgcccacgcggtcaggcggctacccccgagaccccacagccatcccctcccggagggtctggttccgaaccttacaaactgctgcccggtgcggttgccacgatcgtaaagccactttccgcaataccccagcctaccatcacgaagcaggaagttatctag

SEQ ID NO: 225948 - DNA, 1359 bp, Artificial Sequence
  Description of Artificial Sequence: Synthetic coding sequence
atggtatccgtgaatgcgccacttggcgcacctgtagaaagtagctatgatacatccccttctgaaggaactaacttgaatgccccaaatagtttgggggtgagcgccctgtgtgccatttgtggggacagggcaaccgggaaacattatggtgcaagttcttgtgacggatgcaaaggatttttcaggcgctctgttaggaaaaaccatatgtacagttgcagatttagtaggcagtgcgtggttgataaagacaagaggaatcaatgcagatattgtcggctgaagaaatgtttccgcgcaggcatgaagaaggaggcggtccaaaatgaacgggataggatctctacaaggagaagctcctacgaggactcaagtctgccctcaatcaacgcactcctgcaggcggaggtgttgagccgacagatcacatctcctgtaagtgggataaatggcgacatcagggctaaaaaaatcgcctccattgccgatgtgtgcgaatctatgaaggagcagttactagtgctagtggaatgggccaagtatattcccgctttttgcgagttacctctcgatgaccaagttgccctcctcagagcacacgcgggagagcatttactgctgggggctactaaacgatccatggtgttcaaggatgtcctgctgctggggaatgactacattgtgcctcggcactgtcctgagcttgccgaaatgagcagggtttctattaggatcctagacgaactggtgcttccctttcaagaattacagatagatgacaacgaatacgcgtatctgaaggccattatctttttcgatcccgatgcgaaagggttatccgaccccggtaaaatcaaaaggcttaggtctcaggtgcaagtgtcattagaggactacattaacgataggcagtacgattcccgtgggaggtttggtgaactgctcttactcttgcccactttgcagagtatcacttggcagatgattgaacaaatccaattcatcaagctattcggaatggccaagatcgacaatttgctgcaggagatgttgctgggaggctctccttcagacgctccacatgcgcaccatccgctgcacccacatctcatgcaggaacatatgggcaccaatgttatcgtggctaatacgatgccgacccatctctctaacgggcaaatgtgtgaatggcctcgcccacgcggacaggccgcaacgcctgagacgcctcagccaagtccacccggtggaagcgggagcgaaccgtataagcttttgcctggcgctgtcgcaaccattgttaagccactgagcgccattccccaacccaccattaccaagcaagaggtcatctag

SEQ ID NO: 225949 - DNA, 1515 bp, Artificial Sequence
  Description of Artificial Sequence: Synthetic coding sequence
atgagactatcaaagaccctcgtggacatggacatggccgactactctgcagccctggacccagcttatacaacactagagttcgaaaatgtgcaggtgctcacgatgggaaatgttttgttaccgctgcggctagccagactgaggcaccccctaagacatcactggagtatttccgggggagtggacagcagcccacagggcgacaccagcccatccgaagggactaatctgaatgctccgaactcactcggtgtatcagccctgtgcgcgatctgcggcgaccgggcaacaggcaaacattacggcgctagctcttgcgatggctgcaaagggttctttaggagatcagtcagaaagaatcacatgtattcttgtcggttcagccgtcaatgcgttgttgataaagataagcggaaccagtgtcgctattgtcggcttaagaagtgctttagagctgggatgaagaaggaggctgtacagaacgaacgggaccggattagtactagacgcagtagctacgaggatagcagtctaccaagtataaacgccctgttgcaggccgaagtattgtctagacagataacttctcctgtctctggaatcaatggggacatacgagcaaaaaaaatagcgtcaatagccgacgtgtgtgaatccatgaaagagcagctgttggttctggttgaatgggctaagtacatccctgcattttgtgaattgccactggatgaccaggtagccctattgcgagctcacgccggagaacacctgctgctcggggcaacgaagaggtccatggtttttaaggatgttctcttgctcggcaacgactatatagtgcctcgccattgccccgaactggcagagatgagccgcgtgtctatcagaattctcgacgagctcgttttgcccttccaggaactgcagatcgatgacaatgagtacgcctacctaaaggctatcatattttttgaccccgatgcaaagggcctcagtgacccaggcaagattaaacgcctgaggtctcaggtgcaggtctcgttagaagattacatcaacgaccgacagtacgactcccggggaaggttcggagagctcttgctgttgctgcctaccctgcagagtattacgtggcaaatgatagagcagattcagttcattaaactctttgggatggcaaagattgacaacctgttgcaggagatgttgcttgggggatccccttctgacgctccacatgcccatcaccctcttcaccctcacctaatgcaggaacacatgggcaccaacgtgatagttgccaacacaatgcccacacacctgagcaacgggcaaatgtgtgagtggcccaggccgaggggccaagccgctacacctgagaccccccagccgtcacccccagggggaagcggtagtgaaccatataaactgcttccaggagcggttgcgacaatcgtcaagcccctgagcgccattccccagcccactatcactaaacaggaagtgatttag

SEQ ID NO: 225950 - DNA, 1395 bp, Artificial Sequence
  Description of Artificial Sequence: Synthetic coding sequence
atgagactctccaaaaccctcgtggatatggacatggctgactactccgccgctctggatcctgcttacactaccttggaattcgagaatgtgcaggtgctaactatggggaatgacactagtccctcagagggtacaaacctgaatgcaccgaatagcctcggtgtctccgcgctgtgcgcgatttgcggcgatagggctaccggcaagcactacggcgcatccagctgcgatggttgcaaaggatttttccggaggagcgtgcggaaaaatcatatgtacagttgcaggttttctcgacagtgtgtggttgataaagataagagaaatcagtgccgctactgccgtctaaaaaagtgctttcgggctggaatgaaaaaggaggcagtgcagaatgagcgtgacaggatttcgacaaggagaagctcctacgaggactcctctttaccatcaatcaatgccctgcttcaagctgaagtactcagtagacagattaccagccccgtttcaggtattaacggtgatataagggccaagaaaatagcaagcattgccgacgtctgcgaatctatgaaggagcagttgcttgtgttggtggaatgggctaagtatataccagccttctgcgaactgcccctggatgaccaggtggccctgctgagagcccacgcaggagagcacttgctcttgggagctactaagaggtctatggttttcaaagacgtcctgctgctgggaaatgactatatagtcccacgccactgccccgaactggctgagatgagtcgggtctcaatccgcatccttgacgaactcgtactgcccttccaggaattacagatcgacgacaacgagtatgcgtaccttaaggccatcattttcttcgacccagacgccaagggcctgtcagatccagggaaaattaagcgcctcaggtcacaggtgcaagtgtccctcgaggactacatcaatgaccgccaatatgactctcgcggtagattcggagaactgttgctactccttccaaccttacagtctataacctggcagatgattgagcagattcaattcatcaaactgttcggaatggccaaaatagataacctcctgcaagagatgctcctggggggaagtccttcggacgccccacatgcccaccaccccctgcaccctcacctgatgcaggagcatatgggcactaacgtgatcgtggcgaacactatgcccacacatctttcaaatggccagatgagtacgccagaaacaccccagccgtcccctcctgggggatcaggctctgaaccatacaagcttctccctggcgctgtggccaccatagtcaaacctctgagcgctataccacagcctaccatcaccaagcaggaagtaatatag

SEQ ID NO: 225951 - DNA, 1254 bp, Artificial Sequence
  Description of Artificial Sequence: Synthetic coding sequence
atgcgcctgagtaaaacccttgttgatatggacatggccgactattcagctgctttagatcccgcatatacaacactcgagtttgagaacgtgcaggttctcacaatgggtaatgacacatcacccagcgagggaactaacttaaacgcgcctaacagcctgggagtgtctgccctctgcgccatatgcggggatcgggctactggcaaacattatggcgctagctcctgcgacggctgtaagggcttttttaggcgcagtgtcagaaaaaaccacatgtactcctgccggtttagccggcaatgcgtggtggataaggacaaaaggaatcaatgtagatactgccggctcaaaaagtgcttcagagccggaatgaagaaggaagcagtgcagaatgaaagagaccgaatttcaactaggagatcatcatacgaggattcctcgctgccatctatcaacgccctgctgcaagccgaagtcctttcccggcagattactagtcccgtgtcgggcataaatggagatatacgagccaagaagattgccagcatcgccgatgtgtgtgagtcaatgaaggagcagctgttggtgctcgtggagtgggcaaagtatattcccgctttttgtgagctccctctagacgaccaggtcgccctgctgagagcccatgctggtgaacacctgctgttgggcgctacaaagcggtccatggtcttcaaggacgtcctcctgctgggtaacgactatattgtcccgaggcactgtcctgaactggctgaaatgtcccgggtctccatcagaattcttgacgagttggtgctgcccttccaggagctccaaatcgacgataatgaatacgcctacctgaaagctataatattcttcgatcccgacgccaaaggattatctgaccccggaaaaataaagagactacggtcccaagtccaagtgagtctggaggattatattaatgaccgacagtacgattcccggggaagattcggggagctgctgctgcttctgcccactttgcagtccattacgtggcagatgatagagcagatccagttcattaaattattcggtatggccaagatcgataatctcttgcaggagatgcttttgggtggtccgtgccaagcacaagaaggccgagggtggtctggggacagccctggcgatagaccccatacagtatctagccccctatcgtcactggccagtcccttgtgccgtttcgggcaggtggcctag

SEQ ID NO: 225952 - DNA, 1329 bp, Artificial Sequence
  Description of Artificial Sequence: Synthetic coding sequence
atggttagcgtaaacgcacctctcggcgcacccgttgagtcttcctacgatacttcccccagcgagggtaccaatctgaatgccccaaattcgttgggggtcagtgccctgtgcgcgatatgtggggatcgcgcaacagggaagcactacggggcatcttcttgtgatggatgtaaagggttttttagaagatcagtgagaaagaaccatatgtatagttgccgcttctctcggcagtgcgtggtggacaaagataaacggaatcaatgcagatattgccggctgaaaaagtgctttcgagccggaatgaaaaaagaagctgtgcagaatgaaagagatcgtattagcacacgtagaagttcttatgaggattcctcactgccatcaattaatgcactgttacaggcagaggtcctctcaagacagattacaagtccagtgtctggcatcaatggtgacattcgagcgaaaaagatcgcctcaatcgccgatgtttgcgaaagcatgaaggaacagcttctggtgttagtggagtgggccaaatacatcccagcgttctgtgagttgccacttgacgaccaggtggcactcttgagggctcatgcgggtgaacatctcttgttgggcgctacgaaaaggtctatggtctttaaggacgtcctactcctggggaatgactacattgtaccacgccattgcccagagctggcagaaatgagccgcgtgtccatccggattctcgacgaactggtgcttccattccaggagctgcagatcgacgacaatgagtacgcgtatttaaaggccattatctttttcgaccccgacgcgaagggcctctccgatcctgggaaaattaagcgtctaaggagccaggtccaggtatcccttgaagactatatcaacgatcggcagtacgattcgcggggacgcttcggagagctgctgttattgctgccgacattgcagagcatcacctggcaaatgatagagcaaatccagtttattaagctgtttggaatggccaaaatcgacaatctgctgcaagagatgctgctggggggatcacccagcgatgcaccgcatgcccaccacccactgcatccccatctgatgcaggagcatatggggaccaatgtgatcgtagctaacaccatgccaacccatctgagtaacggtcagatgagcactccagagaccccacagcctagccctcctggaggctctggatcagaaccctacaaacttctccccggtgccgtcgcaacaattgtcaagccgctctccgccataccacagcctactattacgaagcaagaagtcatttag

SEQ ID NO: 225953 - DNA, 1227 bp, Artificial Sequence
  Description of Artificial Sequence: Synthetic coding sequence
atgaataccaccgacaatggagttaactgtttatgcgccatatgtggagatagggccacaggaaagcattatggagccagcagttgcgacggttgtaaaggattttttaggcgaagcatcaggaagtctcacgtatatagctgtagattttccagacaatgtgtagtcgacaaggataaacggaatcagtgcagatactgccgcctacgcaagtgttttcgagctggcatgaagaaagaggccgtccagaatgagcgcgacagaattagtacaagacgttctactttcgatggttctaacattccctcaataaacaccctcgctcaggctgaggtgaggtcaagacaaatttcagtttcctctcccggtagctctaccgatattaatgtgaagaagattgcaagcattggcgacgtgtgtgagtctatgaagcagcagttgctggtactggtggaatgggctaaatacattccagccttctgcgagctcccattggatgatcaggtagcgttgctaagggcccatgccggtgagcacctgctgctcggtgctaccaagcgttccatgatgtataaggacatcttgctattaggaaacaactatgtgattcatagaaactcatgtgaggtagagatcagtagagtggcgaacagagtcctggacgagttggtcaggcctttccaagaaatccagatcgatgacaacgagtacgcatgcctgaaagcaattgtcttcttcgatccggatgccaaggggcttagcgacccagtcaagatcaagaacatgcgcttccaagtacagatcggactggaggattatattaatgacaggcagtacgactctcgaggcaggttcggggagctacttctgttgttaccgactctgcagagtatcacatggcagatgatcgagcagatccaatttgttaaattattcggtatggtgaagattgataatctgttacaggagatgttgctaggcggtgccagcaatgacggtagccacctgcatcatcccatgcatccccacctgtctcaggacccgttaaccggacaaaccattctgttaggccctatgtctaccctggtccacgcagatcagatctccacacctgagacccccctgccctcgccgcctcagggcagcggtcaggagcagtataagatcgctgctaatcaagcgagtgtcatctcccaccaacacctctcaaaacaaaaacaactctag

SEQ ID NO: 225954 - DNA, 1338 bp, Artificial Sequence
  Description of Artificial Sequence: Synthetic coding sequence
atggacatggcaaattattccgaagtcttagatccgacctatacgaccctggagttcgagactatgcaaatcctgtacaactctagcgactccagtgcccctgaaaccagtatgaacactaccgataatggagtgaactgtctgtgcgccatctgcggcgaccgtgcaaccggcaagcactacggcgcttccagttgcgatgggtgcaaggggttctttcggagatccatcagaaagagccatgtgtacagctgcaggtttagcagacaatgcgtggttgataaagacaagaggaaccagtgtcggtactgtaggcttcggaaatgttttagggctggcatgaagaaggaggcagttcagaatgaacgcgaccggatttctacccggagaagcaccttcgatggatccaacatcccctctatcaacacactcgctcaggctgaggtacgtagtaggcagatctctgtcagctccccagggtcatcgactgatattaatgtgaagaagatcgcttctataggtgatgtttgtgagtcgatgaaacagcagttgcttgtgctggtggagtgggctaaatatatccctgccttctgcgaattgcctctagatgaccaggttgcactcctgagagctcacgctggcgaacacctgttgttgggcgcaacgaagaggagtatgatgtacaaagacattcttctgttggggaataactatgtgatccatcgcaattcctgtgaggttgagattagcagagtggcaaaccgggtcctggacgaacttgtgaggcccttccaggagatccagatcgatgataacgagtatgcatgcttgaaagccatcgtgttcttcgaccccgatgcaaaagggctcagtgaccccgtgaagatcaaaaacatgaggtttcaagtgcagatcgggttggaagattatatcaacgatcggcagtacgatagccgaggtaggtttggtgaactgttgctgctcttacccaccctgcaatctattacgtggcaaatgatcgagcaaatacagtttgtgaagctgtttgggatggtcaaaatagacaatctgctgcaggaaatgctgctcggcggagcctcgaatgatggctcccatctccatcaccccatgcatcctcatcttagccaggatccgttaactggacaaaccattcttctcggcccaatgagtacactggtgcatgcagaccaaatctccactcccgagacgcccctgccatcgcctcctcaggggagtgggcaggaacagtacaaaatcgctgctaaccaggccagtgtgatttcccaccagcatttaagtaagcagaagcagctgtag

SEQ ID NO: 225955 - DNA, 723 bp, Artificial Sequence
  Description of Artificial Sequence: Synthetic coding sequence
atgagccgatccaatcgtcaaaaagagtacaagtgtggtgacctggtattcgcgaagatgaagggctacccccattggccagccagaatcgatgaaatgccagaagcagctgtaaagtctaccgctaataaatatcaggtcttctttttcggcactcatgaaacagcttttctgggtcctaaagacttgtttccctatgaagagagcaaagagaaattcggcaagcccaataagaggaagggcttttcggagggactgtgggagatcgaaaataatcccacagttaaggcctcgggatatcagtcaagccaaaagaaaagttgcgtggaggagccggagcctgagcccgaagcagccgaaggcgacggtgacaagaagggaaatgccgagggttcaagcgatgaagagggtaagctggtgatcgatgaacccgcaaaggaaaagaacgaaaagggggcattaaagaggagggcaggcgatctgcttgaagactctcccaagaggccaaaggaagcagagaaccccgagggtgaagagaaggaagcagctacgctggaagttgaaagaccgctccctatggaggttgaaaaaaattccaccccttctgagcccggttccggtcgcggtccccctcaggaggaggaggaggaggaagatgaggaggaggaggccactaaggaggacgcagaagccccagggataagagaccacgaatctctttag

SEQ ID NO: 225956 - DNA, 771 bp, Artificial Sequence
  Description of Artificial Sequence: Synthetic coding sequence
atgcaccccgaggggggacagttcgtgccacaactcctaggacacctactagccaccaagctcaaacgattcctcttatcaaaggggggtcgcagagcccaaatcccagatgtgtcgagagccacacctcacaccatagacgaaatgcctgaggcagcggttaaatcgaccgcaaataagtaccaggtgttcttcttcggtactcacgagaccgctttcttagggccaaaagacctcttcccctatgaggaatccaaggagaagtttggtaagcctaacaaacgcaaggggtttagtgaggggctgtgggaaattgaaaataatccaaccgtaaaggccagtgggtaccagagtagtcagaagaagagctgcgtggaagagcctgagcctgagcccgaagccgcagagggagatggagacaagaaggggaacgccgaggggtcctccgacgaggagggtaagcttgtgatcgacgagccggctaaagaaaaaaacgagaagggtgcgctgaagcggcgtgccggtgaccttcttgaagatagtcctaagaggcctaaggaagcagagaacccagagggcgaggaaaaagaagccgctacgctcgaagtggagcgccctcttcccatggaggtggaaaaaaactcaactccatcagagcccggatctggcagaggacccccacaagaagaggaggaagaggaagacgaagaggaggaggctaccaaagaggacgccgaagcacccggaattagagaccatgaaagcctgtag

SEQ ID NO: 225957 - DNA, 702 bp, Artificial Sequence
  Description of Artificial Sequence: Synthetic coding sequence
atggagcagcgcgcaggtggaaacagggttcagacttccacactgaattgcgcaggagcagccgtgatcgatgagatgcctgaagcagccgtcaagtcaactgctaacaagtatcaggtctttttttttggcacacatgagacggccttcttgggacccaaggacctgtttccgtatgaggagagcaaggaaaaatttgggaagccaaataagaggaagggattctctgaagggctgtgggaaatcgaaaataatccaaccgttaaagcctcaggttatcagagctcacagaagaaatcttgtgtcgaggaacctgaacctgagcccgaggccgcagaaggcgatggggacaaaaagggtaacgctgagggaagttccgacgaggagggcaagttagttattgacgaaccagcgaaagagaaaaatgaaaaaggcgctctaaagcgcagggcaggcgacctacttgaagacagtcccaagcggccaaaggaggcggagaacccagaaggagaagagaaagaagctgctacactggaggtggaaaggcccctgcccatggaggtggagaagaattctactccaagtgagccgggtagcggacgtggccctccccaggaggaggaggaggaagaggatgaagaggaggaggcgacaaaggaagacgctgaggctcccggaattcgtgaccacgagtccctttag

SEQ ID NO: 225958 - DNA, 789 bp, Artificial Sequence
  Description of Artificial Sequence: Synthetic coding sequence
atgtctaggtccaaccggcaaaaggagtacaaatgcggagacctggtcttcgctaagatgaaggggtaccctcattggcccgcacgtatcgacgagatgcctgaggctgccgtgaagtcaaccgccaacaagtatcaggtcttcttttcaggacccacacgcagacatagctgggcccctaagacgagcagcttaacccgtaacccaagacgcagcctggctagtcccacaaggggaaaaggctccgcccgaggctgtgggagatcccgcactaccttattgtcacgtctgccagccatctccccccctccatcctgcacagagccctgccttcctggtcaatgggtgtacccaggcgctaaccccaccgagagcagtcagaagaaaagctgtgtggaagagcccgagcctgaaccagaggccgcagagggagatggcgataagaaggggaacgcggagggctcaagcgatgaagaaggaaaactggtgattgacgaacctgccaaggagaagaatgaaaagggggctcttaaacggagggccggagacttactagaggattcaccgaagaggccgaaggaggcggagaatcctgaaggggaggagaaggaagctgctacccttgaggtggaacggcctcttcctatggaagtggagaagaatagcacacccagcgaaccaggctctgggagggggccacctcaggaggaagaggaggaggaagacgaggaagaagaggctaccaaagaagatgcggaggcccctgggatccgcgatcacgaaagatag

SEQ ID NO: 225959 - DNA, 627 bp, Artificial Sequence
  Description of Artificial Sequence: Synthetic coding sequence
atgccagaggccgcagtgaagagcacagccaataaatatcaggtctttttttttggcacgcatgagaccgcctttctgggaccaaaagatttattcccttacgaagagtctaaggaaaagtttggtaaaccaaataagcgcaaaggcttctctgaaggtttatgggagatcgagaacaaccccaccgttaaggcatcagggtatcagtcctctcagaagaaatcctgtgtggaagagccagagccagagcctgaagctgcagaaggagacggcgataaaaaaggcaacgcggaggggtcctccgacgaggaaggcaagttggtaatcgacgagcctgcaaaggaaaagaacgagaagggcgctctgaagcgtcgtgcgggtgatctgctggaggatagtccaaagcggccaaaagaggcagaaaatcccgaaggcgaggagaaggaggcagctacattggaagtggagcggccactgcctatggaagtcgagaaaaatagtactccctccgagcctggtagcgggcgtggcccaccccaagaagaggaggaggaggaagacgaggaagaagaggccacaaaggaggacgccgaagcaccaggtatacgggatcacgaatccctctag

SEQ ID NO: 225960 - DNA, 723 bp, Artificial Sequence
  Description of Artificial Sequence: Synthetic coding sequence
atgtctcgctccaaccgccagaaggaatacaagtgcggtgacctggtctttgctaaaatgaagggttatcctcactggcctgctaggatcgatgagatgccggaagccgcagttaaatccactgccaacaagtatcaggtgttctttttcggtacacatgagacggcatttctcggccctaaagatctctttccatacgaggaaagtaaagagaagttcggaaaacccaataaaagaaagggattcagtgagggactctgggagatcgagaacaaccctactgtcaaagcctctggctatcagagtagccagaagaagtcatgcgtggaggagccagagccagagcctgaagccgctgagggggatggtgacaagaagggtaacgccgaaggctcgtcagacgaggaagggaaattagtaatagacgagcctgctaaagaaaaaaacgagaaaggcgcattgaaacgcagagcaggcgatcttctcgaggattcacctaaacggcctaaggaggccgagaaccccgagggggaggagaaagaggccgctaccctggaggtcgagagaccactccctatggaagtagaaaagaatagcacacccagcgagcctggcagtggaagagggcctcctcaagaagaagaagaggaggaggatgaagaggaagaagcaacaaaggaggacgctgaagccccagggatccgcgatcacgaaagtctgtag

SEQ ID NO: 225961 - DNA, 2676 bp, Artificial Sequence
  Description of Artificial Sequence: Synthetic coding sequence
atgcacgccattaacggttttgtattcggaaatctgcctgagctcaatatgtgtgctcaaaagcgcgttgcatggcatcttttcggcatgggcaacgagatcgatgtccacacagcttttttccatgggcagatgcttacaacccggggacaccatacggatgtcgccaacatctttcccgctacatttgtcacggctgaaatggttccgtgggaaccaggaacctggctgatctcttgccaagtcaattctcacttcagggatggaatgcaggccctgtacaaggtcaagagttgttccatggcccctcccgtggacctgctcactgggaaagtccggcagtacttcatcgaagcccacgaaattcagtgggactacggcccaatggggcacgatggctcgaccgggaagaatctgagggaacccggtagcatatccgacaaattcttccagaaatcctcctctcgaattggcggtacctactggaaagtgcgctacgaagctttccaggacgaaaccttccaagaaaaaatgcatctcgaagaggatagacacctaggcatcctgggccctgtaatcagggctgaggtgggagataccattcaggtggtattctataaccgcgcttctcagcctttttcaatgcagcctcatggtgtgttctacgagaaggattacgaaggcactgtgtataatgacgggagttcctaccccggtctggtcgcaaagccctttgagaaggtgacttaccgttggaccgtccctccacatgctgggcctacggctcaggatcctgcctgtttgacctggatgtactttagcgctgccgaccctatccgtgacaccaactcaggactcgttggccctctgttagtgtgccgcgctggggcactgggcgcagatgggaaacagaaaggggtagataaggagttcttccttctatttaccgttctagacgaaaataagagttggtacagtaacgcaaaccaagctgccgctatgctggactttaggctgctgtctgaggacatcgagggctttcaagactcaaatagaatgcacgcaataaatggcttcctgttctccaatcttcctcggttggacatgtgcaaaggagacactgtggcctggcatctgctcggactgggcacagaaaccgatgtccacggggttatgttccaaggcaatactgtgcagctgcagggaatgagaaagggtgccgcaatgctgtttccacacacttttgtcatggctatcatgcagcctgacaatctaggtacattcgaaatctattgtcaggcgggtagtcatcgcgaagctgggatgcgcgcaatttacaatgtcagtcagtgccctggccaccaggccactcctaggcagaggtatcaggctgcgaggatctattacatcatggccgaggaggtggagtgggactattgccctgacagatcatgggaacgagagtggcataaccagtcagaaaaagactcatatggctacatcttcttatcaaataaggatggcttactggggtccaggtataaaaaggcggtattcagggagtatactgacggaaccttcaggataccgaggccacgcacgggacccgaggaacacctcggcatacttggccctttgattaaaggtgaagtgggagatattcttactgtggtttttaaaaataatgctagcaggccatattccgtgcatgcccacggagtgttggaaagtacaaccgtgtggcccttggcggctgaacctggcgaagtcgtcacttatcaatggaatattccagagaggagcggccctggaccgaacgatagcgcgtgtgtgagttggatctactattccgccgttgaccctatcaaggatatgtactcagggctcgtgggtccactggccatttgtcagaaaggcatcctggagcctcacggaggaagaagcgatatggaccgagagttcgccctgcttttccttatattcgacgagaacaagtcctggtacctggaggaaaacgtggctacgcatggatcccaggacccgggtagtatcaacctgcaggacgaaaccttcctggaatccaacaaaatgcacgctattaacggcaaattgtacgccaacctgagaggcctgactatgtaccagggcgagagggtagcttggtatatgctcgcaatgggccaggatgttgacctacacactatccatttccacgccgagagctttctatacagaaatggtgaaaattacagggccgacgtagtggacctgttccctgggaccttcgaggtcgtagagatggttgccagtaatcccggtacttggctaatgcactgccatgtgacagaccatgttcacgcgggaatggagaccctgtttactgtgtttagccgcaccgaacacctgtctcccttaacagtcatcaccaaggaaaccgagaaggcagtgccaccaagagacattgaggagggcaatgtgaaaatgctcggcatgcagattcctataaagaatgttgaaatgctggccagcgtgctcgtggctatcagcgtgaccctccttctggtggtgttggctctggggggagtggtgtggtaccagcatcgccagcgcaagctgcgaagaaaccgtcggagtattcttgatgacagctttaagctcctaagcttcaaacagtag

SEQ ID NO: 225962 - DNA, 3477 bp, Artificial Sequence
  Description of Artificial Sequence: Synthetic coding sequence
atggagtctggacacctcctgtgggcattgttattcatgcaatccctttggcctcagttgacagatggcgcaacgcgagtttactatttgggcatcagggatgtgcagtggaactacgcacctaaaggcaggaatgttatcaccaaccagccattggacagcgatattgtcgcatcaagcttcttgaaaagcgacaaaaaccgaatcggcggtacctacaaaaagacaatatacaaagagtataaggacgactcctataccgacgaggtcgcccaacctgcctggctggggttcttgggtcctgtattacaggccgaggtgggggacgtgattctgatacacctgaaaaactttgcgacccgtccctacacgattcatccgcacggagtgttttatgagaaagattccgagggatcactgtatcctgatggctccagtgggcctttaaaagctgacgacagcgtaccgccaggcggatcgcatatctataactggaccatccccgagggacacgcccctactgacgcagatccagcttgcctcacttggatctatcactcccatgtagacgcgccaagggatattgctactggtctgattggcccactgattacgtgcaagcgcggagctctcgatgggaattcacctcctcagcggcaggatgttgaccacgacttcttcctgctcttttctgtggtcgatgaaaaccttagctggcacctgaatgaaaatatagccacctactgctccgaccccgctagtgtggataaggaggacgaaacttttcaggagtctaataggatgcacgccataaatggattcgtgttcgggaacttgccagaactcaatatgtgcgctcagaaacgcgtcgcatggcacctgttcggaatgggtaacgaaattgacgtgcacacggccttcttccatggccagatgctgaccacgcggggtcatcatacggatgtagcgaacatctttccggctaccttcgtgactgccgaaatggtcccctgggagccaggaacttggctgatctcatgtcaggttaactcccatttccgcgatgggatgcaggccctgtataaggtaaagtcatgctccatggcgcctcccgtagacctgttgaccggaaaagtcagacagtactttattgaagcacatgaaatccaatgggattacggtccaatgggccatgacgggtcaaccggtaagaacctaagagaacctgggtccatttccgataagttcttccagaagagcagcagccggattggaggtacatactggaaggtgcgatacgaggcattccaggatgaaacgtttcaggagaaaatgcatctggaggaagacaggcatctcgggatcctagggccagtgataagagccgaggttggggatactatacaggtagtgttttacaaccgagcttcccagccattttccatgcaaccccacggcgtattctacgagaaggactatgaaggcacggtgtataatgacggttctagttatcctggactggttgctaagccgtttgagaaagtgacataccggtggacggtgccccctcatgcaggcccaaccgcgcaggaccctgcctgcctgacttggatgtacttcagcgcagctgaccccatcagagacactaactccgggttggtgggaccactccttgtgtgccgtgccggagctttgggcgctgacggcaagcagaagggagtggacaaggagttcttcctgttgttcacagtgctcgacgagaacaagtcatggtatagcaatgcaaaccaggctgccgcaatgctggacttccgcctgctatccgaagacattgagggctttcaggattccaacagaatgcacgctatcaacgggttcctcttttcaaacctaccccgattagacatgtgcaagggcgatacagtggcttggcacctgctaggtctagggacagagaccgacgtgcacggggtgatgtttcagggaaataccgtgcagcttcaaggcatgaggaaaggagcagccatgctcttcccgcacacatttgtcatggcaattatgcagcctgacaatctcgggacgttcgagatatactgccaagccggatcccaccgcgaggcaggcatgagagcgatctacaacgtgtctcagtgcccaggtcaccaggctacgcctcggcagaggtaccaggccgcacgaatctattacataatggcagaggaagtcgagtgggattattgccccgacaggagctgggagcgggagtggcataaccagagtgaaaaggatagttacgggtacatctttctgtccaataaggacgggttattgggatctcgctacaagaaagctgtgtttagagaatatacggacggaactttccgcatacccagaccccgaaccggacctgaagaacacctgggcattcttggaccattgatcaaaggggaggtgggagatattctgaccgttgtgttcaagaataatgcatcccgaccttattccgtacatgcccatggcgtattagagtctacaactgtatggcctctggccgcagaaccgggagaggtcgtgacttaccaatggaacatacctgagaggtcaggtcctggcccaaacgatagcgcttgcgttagttggatctattatagcgctgtggatccaattaaagatatgtacagcgggctggtgggcccattagctatttgtcagaaggggattttggagccgcatggcggacgatccgacatggaccgcgaattcgcattgctttttttgattttcgacgagaataaatcgtggtacctggaagaaaacgtggcaacacatggctcgcaggatcccggatcaatcaatcttcaagacgaaaccttcctggagagcaataagatgcacgcgattaacgggaaattgtatgctaacctccgcggtctgactatgtaccaaggggaacgggtggcctggtacatgctcgccatggggcaggatgtggatctccacaccatccattttcatgctgagagcttcttatatcgcaacggagagaactacagagccgatgttgtcgacctttttccgggaactttcgaggtggttgagatggttgcgagcaatcccggaacttggttgatgcactgtcatgtgacggatcatgtgcatgcaggaatggagacactgtttaccgtatttagtcgaaccgagcatctctcgccgctaaccgtcataaccaaggagacagagaaagcagtgccaccaagagatatcgaggagggaaacgtgaagatgctgggaatgcagattcccataaaaaatgtggaaatgctggctagtgtactagttgctatctcagtgacgctcctcctggtagtattggcactgggcggagtagtatggtatcagcataggcaaaggaaattacgccgaaacagacgcagtatccttgacgactcttttaaattgctaagtttcaagcaatag

SEQ ID NO: 225963 - DNA, 3486 bp, Artificial Sequence
  Description of Artificial Sequence: Synthetic coding sequence
atgtgggccatggagagcggacacctgctttgggcgctacttttcatgcagtccctctggccccaactgacagacggagcgacaagggtgtattatttgggcatacgggatgtgcagtggaactacgcaccaaagggacgcaacgtgattaccaaccagcctttagatagcgacatagtggcctctagcttcctcaaaagcgataagaataggattgggggtacttacaagaaaactatctacaaagagtacaaggacgacagctatacagatgaagtggctcaaccggcttggttagggttcttggggcctgtgttgcaggccgaggttggggatgtaattcttatacacttaaagaatttcgccacaaggccttacaccatccacccccatggggtgttttacgagaaagactctgaaggtagcctttaccccgacggatcctcaggacctctcaaggcagacgattctgtgccacccggagggtcacacatttacaattggaccatcccagaggggcatgcacccactgatgccgatccggcttgcctgacctggatctaccactctcatgtagatgcaccgagggacattgctacgggcctgatcggaccactgataacttgtaagcgcggtgctctggacgggaacagcccgccacagcgccaggacgtggaccatgatttcttcctgctgttttcagtggtggatgaaaatctttcctggcatctcaacgagaacatcgcaacctactgcagtgaccccgcttcagtggataaagaggacgaaaccttccaggaatccaacaggatgcatgccataaacgggttcgtattcggaaatctgcccgagctgaatatgtgcgcccaaaagcgagttgcttggcatctattcggaatgggcaatgaaatcgacgtacataccgccttctttcatggccagatgctgaccaccagggggcatcacaccgatgtcgccaatatctttccggcaacctttgtaacggccgaaatggttccctgggaacccggaacgtggttgatctcatgccaggtgaattctcacttcagagacggcatgcaggccctttacaaggtcaaatcgtgttctatggccccacctgtggacctgcttaccgggaaagtgcgtcagtactttatagaagctcatgagattcagtgggactacggacctatggggcatgatggatcaacgggaaaaaatctgcgtgagcccggatccattagcgacaagttcttccagaaatccagctcaaggatcggagggacttactggaaagtgcggtacgaggcgttccaagacgaaacattccaggaaaagatgcatctagaggaagatcgacacctagggatcctgggccctgttattcgggcagaagtaggcgatactattcaggtggtgttttataaccgagccagtcagccttttagcatgcagccacatggggtgttttacgagaaagactacgaagggacagtgtataatgatggctcctcctatccaggactggtggctaagccatttgaaaaggtgacctatcggtggacagttcctccccatgccggacccactgcccaggaccccgcttgtctcacctggatgtacttcagtgccgctgacccaattagagacacaaacagtggactcgtaggccctctgctcgtgtgcagggcgggagctctcggcgcagatggcaagcagaagggtgtcgataaggagttttttctacttttcactgtactggacgagaataaatcttggtattccaatgcaaaccaggccgcagcaatgctggacttccggctgctgtctgaggacattgaaggcttccaggactccaatcggatgcacgctattaacggattcttattcagcaacttgcccaggctcgatatgtgcaaaggtgataccgtggcctggcaccttctaggtctgggaacagaaaccgacgtgcatggagtgatgtttcaagggaacacagtccagctccagggaatgaggaagggcgcagctatgctgtttccacacacctttgtgatggcaataatgcaacccgacaacttgggtacattcgagatatactgccaggcaggatcccacagagaagctgggatgagggctatctataatgtgtctcagtgccctgggcaccaggctaccccgagacagaggtatcaggccgctagaatctactacatcatggccgaagaggtggaatgggactattgtccagacaggagctgggagcgtgaatggcacaatcagagtgagaaagattcctacggctacatcttcctatctaataaagatggcttgctgggaagtcgttataaaaaggccgtgttccgcgagtataccgacggcaccttccggatccctcgtcccaggacaggcccagaggagcacctgggaatcctagggcctctcattaaaggagaggtgggcgatatccttactgtcgtgtttaagaacaacgcgtccagaccttattctgtccatgcccacggcgttctggagagtacaacagtgtggccactggcggcagaacccggtgaggtcgttacataccagtggaacatcccagagcgttccggtcctggacccaatgattccgcatgcgtgagttggatatattattcagccgtagaccccataaaggacatgtattccggactagtcggccctctggccatctgtcagaaagggatcctggagcctcacgggggtagatccgatatggatagggaatttgctttgctcttccttatctttgatgagaacaagtcatggtatctggaagaaaatgtggcaacacacgggagtcaggatcctggctccatcaacctgcaggacgagacgtttctggaaagtaataagatgcacgctatcaacggaaagctttatgcgaacctgcgtgggctgaccatgtatcagggtgaaagggtggcgtggtatatgctggcgatgggtcaggatgtcgatttgcacacaattcacttccatgccgagagctttctgtataggaatggagagaattatcgcgcagacgtcgtggacctttttcccggtacctttgaggttgtcgaaatggtggcctcaaaccccggtacatggttgatgcattgccacgtgacagaccacgttcatgccggtatggagaccttgttcacggtgttcagtaggaccgagcatctctccccgctgaccgtgattactaaagagactgagaaggccgtgccacctcgtgatatcgaggaagggaacgtgaagatgttagggatgcagattccgattaagaatgttgaaatgctggcatcagtcctggtagcgatctccgtgacgctgttactggtcgtcctcgccctcggcggtgtggtgtggtatcagcataggcaacgtaagctcagaaggaatcgccgtagcattcttgacgattcttttaaactgctcagtttcaagcagtag

SEQ ID NO: 225964 - DNA, 2910 bp, Artificial Sequence
  Description of Artificial Sequence: Synthetic coding sequence
atgtgggcgatggagagtggacacctactgtgggcactgctgttcatgcagagtttatggccacagctgaccgatggggctacaagagtatattaccttggaattagggatgtacaatggaactacgcccctaaagggaggaacgtcataactaatcaaccactcgactcagacattgttgcatcgagtttcctgaaaagcgacaaaaatcggatcggtggaacatacaaaaaaacaatctacaaagaatataaggatgattcctacaccgatgaagttgcgcagcccgcttggctcggattcctcgggcctgtactgcaggccgaggttggcgacgttatcctgatccatctgaagaattttgctaccaggccgtacactattcatccacatggggtattctatgagaaagacagtgaaggaagcctgtaccccgatggatcttctggacccctcaaggcggatgatagcgtcccaccaggagggtcacacatctacaattggactattcctgagggacatgcccctaccgacgcagatcccgcttgtctcacctggatctaccacagtcacgtcgacgcgcctcgggacattgctacggggctcattggcccactgatcacctgtaaacgaggagcactagatggcaactccccgccacaacggcaagacgtagatcatgactttttcttgctgttctctgtcgtggacgagaacctttcttggcacctgaacgagaacatcgccacctattgcagcgatccagccagtgtagacaaggaagatgagacttttcaggagtccaacagaatgcatgccatcaacggatttgtcttcggtaacttaccggagttgaacatgtgcgcccagaaacgcgtagcatggcacctgtttggtatgggcaatgagattgatgtccatacagccttcttccatgggcagatgctgaccactaggggacatcacaccgacgtcgcaaacatatttcctgctacatttgttacagcagaaatggtcccctgggagcctgggacatggctgattagttgccaggtgaattctcactttagagacggcatgcaggcgttatacaaagtcaaatcatgtagtatggcccctcctgtagacctgttaacaggaaaagtgcgacagtacttcatcgaggcccacgaaattcagtgggactatggaccaatgggacacgacggcagcacaggcaagaatctccgggaaccgggttcgatatccgataagttttttcagaaaagttcttccaggattggcggaacatattggaaggtacgctacgaggcctttcaagatgaaacctttcaggagaagatgcacctcgaagaggataggcacctgggaatccttggcccagttatcagagcagaagtgggggacacaatccaggtagttttttataatcgcgcatctcagccattctctatgcagcctcacggcgtcttctacgaaaaagactatgaaggaactgtatacaatgacggaaccttcgagatttattgccaggctggcagtcaccgggaagccggaatgcgtgctatatataacgtgagtcaatgccccggtcatcaggcaacgccacggcagcgttaccaagcggctcgtatctattacatcatggctgaggaagtggagtgggactactgtcccgaccgaagttgggaacgagagtggcacaaccagtccgaaaaagatagttacgggtacatattcttgtccaacaaggatggcctccttgggtcccgatataagaaggctgtgttcagagagtataccgatggtacgtttaggattccacggcctcgtactggtcccgaggaacacctcgggatcctgggcccattgatcaaaggggaagtcggtgatatcctcacagtggtgttcaagaataatgcgtcccgcccttattcagtgcacgcccatggggtcctcgagtctacaactgtgtggcccctggccgctgaacctggcgaggtggtgacctaccagtggaatatccctgagaggagcggacccggacctaatgattctgcgtgtgtaagctggatttattactcagccgtggatccaattaaagacatgtactccggtctagttgggcctttggctatttgccagaaaggcattctagaaccacatgggggtaggtcagacatggaccgcgagtttgccctgctatttctaatcttcgatgagaataagagttggtacctggaggaaaacgtggccacacatggttctcaagatcccggaagcataaacttacaggatgagacatttctagaatccaacaagatgcacgctataaacggcaaactgtacgccaatcttcggggactcacaatgtatcaaggagagagggtagcttggtatatgcttgcaatgggacaagatgtggatctgcataccatccatttccacgcagagtccttcctctataggaacggcgagaattacagagccgatgtggtggatctgtttcctggcacatttgaagtggtggagatggttgcgtctaaccccggaacctggctcatgcattgccacgtaactgaccacgttcacgccggaatggaaaccctcttcacggtcttcagtagaactgagcacctcagcccccttaccgttataaccaaggaaaccgaaaaagcggtcccacctcgggatatcgaagaaggtaatgtgaaaatgctcgggatgcagattccaatcaaaaatgtcgagatgctggcctccgtgcttgtggctataagtgtgacccttcttctggtcgtgctggcattgggcggagtggtgtggtaccagcacagacagcggaagcttaggcgcaatcgacggagtattctggatgactcttttaagttactgagctttaaacagtag

SEQ ID NO: 225965 - DNA, 2436 bp, Artificial Sequence
  Description of Artificial Sequence: Synthetic coding sequence
atggaaagtgggcacttgctgtgggccctgctctttatgcaatccttatggccccaactcacggacggtgccactcgggtgtattatctgggcatccgggacgtgcaatggaactatgctccgaaaggtcggaatgtgattacaaaccagcccctagatagcgacatcgtggctagtagcttcctgaaatctgataagaaccgtattggcggaacatataagaaaacaatctataaagaatataaagacgactcgtatactgacgaagtcgctcagcctgcctggctagggtttctgggtcccgtgcttcaggccgaggttggggacgtcatcctaatccatttgaaaaacttcgccacccgcccatacacaatccatccacatggagtgttctacgaaaaggattccgagggctccctctaccctgatggcagtagcggaccactgaaggcagatgatagtgtccccccagggggaagccacatttataattggacaattccggaaggccacgctcctacggatgctgaccctgcatgtttgacatggatttaccattcccacgtggacgcaccgagggatattgcaacagggctgattggaccccttattacctgcaaacggggagcgctagacgggaattccccaccgcagagacaggatgtggatcacgactttttcttactgttctcagtcgtggacgaaaatctgtcctggcacctgaatgagaatatagccacctattgtagtgaccccgcttcggtcgacaaggaggatgaaaccttccaggagtccaacagaatgcatgctatcaatggcttcgtttttggaaacctccctgaactcaacatgtgtgcccagaaacgcgtggcatggcacctgtttgggatgggaaacgaaattgatgtgcatactgcctttttccacggacaaatgctgactactcgtggtcaccatacagatgtggccaacatattcccagctaccttcgtgactgccgagatggtgccatgggaacccggaacctggctgatctcctgccaggtgaattcccatttccgggacggcatgcaagccctctataaggtgaagagctgttctatggcccctccagtggacttgctgacaggcaaagtaaggcaatactttattgaggctcacgagattcagtgggactatggacccatgggccacgacggctccactgggaagaaccttagggaacctggctcaatctccgacaagttttttcaaaaatcgtcgtctcggataggcggtacctactggaaggtccggtacgaagccttccaggatgagactttccaggagaaaatgcacctagaggaagaccgacacctgggaatcttagggcctgtcatcagggcagaggtcggtgacacaatccaagttgttttttacaaccgggcaagccagcccttttcaatgcaaccacatggagtattttacgagaaggactatgaagggactgtgtataacgacgacccaatcagagacaccaactccggtcttgtcggacccctgctggtttgccgcgctggagccctgggcgctgacggtaaacagaaaggagttgacaaggagttttttctgctctttactgtgctagatgaaaataaatcgtggtacagcaacgccaaccaggccgctgcgatgctggattttagacttctgtcagaggacatagagggcttccaggatagtaatcgaatgcacgcgattaacggattccttttttctaatttaccccgacttgatatgtgtaagggcgacactgtggcatggcatttgctaggccttggaaccgagacagacgttcacggcgtaatgttccaggggaataccgtgcagctgcaggggatgcgtaaaggcgctgcgatgctcttcccacacaccttcgtgatggctattatgcagcctgataacctgggaacatttgaaatctattgccaggcaggaagccaccgcgaggccggtatgcgagctatctacaacgtgtcccagtgccctggccaccaggccactcctaggcagcggtaccaggctgctcgaatttactatattatggcggaagaggtcgagtgggactactgccctgacaggagctgggagagggaatggcacaatcagtccgagaaggattcctacgggtacatatttttatccaataaagatggattattgggatcacgctacaagaaagccgtgtttcgagaatacaccgacggcactttccgaatcccaagaccccgaactggtcctgaagaacacctggggatccttggccctctgattaagggcgaggtaggcgacatccttactgtcgtgttcaaaaataacgccagccgtccatactctgtgcacgcacacggcgtgctggagagtactaccgtgtggccactggccgctgaaccatag

SEQ ID NO: 225966 - DNA, 3483 bp, Artificial Sequence
  Description of Artificial Sequence: Synthetic coding sequence
atgtgggctatggaaagcggtcacctgctgtgggcactcctgtttatgcaaagtctgtggcctcaactgactgacggggcaaccagagtgtactacttaggtattagggacgtgcagtggaactacgctcctaagggtaggaatgtgatcactaaccagccattggattccgatattgtggcctcctctttcctaaagtctgacaaaaaccgcatcgggggaacctacaagaagactatctataaagaatataaagatgacagctatactgacgaggtggcgcagccagcatggctcgggtttctgggccctgtactgcaggccgaggtcggagatgtgatcttgatccacctgaagaactttgctactaggccttacaccatccaccctcacggagtgttttacgagaaagacagcgagggatctttatatcctgatggaagcagcggcccactgaaggccgacgatagcgtaccacccggaggcagtcacatatacaactggactattcccgaaggccacgcacctactgatgctgatcccgcttgccttacctggatctaccatagtcatgtagatgctcccagggacatcgcaaccggactaattgggccacttattacctgtaaaaggggggctttggatggcaatagccccccacagcgccaggacgtggatcatgattttttccttctctttagtgtggtggacgagaacttaagttggcacctcaacgaaaatattgccacctactgtagcgaccctgcctctgtcgataaagaggacgaaacctttcaggagagcaatagaatgcacgctatcaacggcttcgtctttggcaatttgcctgaacttaacatgtgtgcacagaagcgggtggcctggcatctcttcggaatgggcaacgagattgatgtacataccgccttcttccatggccaaatgcttactacccgagggcatcatactgacgtggccaatatttttccagcgaccttcgtgacggcggagatggtaccctgggagccaggaacctggctgatttcctgccaggtgaatagtcatttccgggacgggatgcaggcactgtataaggtcaagagctgttcgatggcacctcctgttgatctgctcacgggtaaggtcaggcagtatttcatcgaggcccacgagattcagtgggactatgggccaatgggtcacgatggatccactgggaaaaatctgcgggagccaggtagtatctcagacaagttcttccagaaatcatcatcacggatcggagggacatactggaaggtcaggtacgaagcctttcaggacgagacttttcaggagaaaatgcacctcgaagaagaccgccacctcggcatcctggggccagtaatccgggcagaggtcggtgatactatccaggtggtcttttataatagggccagccaaccattttcaatgcagcctcatggagtgttctacgaaaaagactatgaggggacagtatataacgacggatcatcatatcccggtctggtcgccaagcctttcgaaaaggttacatatagatggaccgttccaccccacgccggtcccactgctcaggacccagcgtgtctaacatggatgtatttcagtgctgcggacccaatcagggacacaaacagtgggctcgtagggccactccttgtatgccgcgctggcgcactgggggctgacggcaaacagaaaggtgttgacaaggaattctttctcctgttcacggtgctggacgaaaacaagtcgtggtactctaatgcaaaccaagctgccgcaatgctggacttccggttgctgtctgaagacattgagggattccaggactcgaaccggatgcacgctattaacgggtttctgttcagcaacctgcccagactggatatgtgcaagggcgacactgtggcttggcaccttctcggtttggggactgagactgacgtccacggcgtgatgtttcaggggaatacagtacagctgcaggggatgcgcaagggagccgctatgctgttccctcacacgttcgttatggccatcatgcagcctgacaatcttggtacgtttgagatctattgccaggcaggctcccaccgagaagctggcatgcgtgcaatctacaatgtgtcccagtgccccggtcatcaagcgacccctcgccagaggtatcaggctgcaagaatctattacattatggccgaagaggtcgaatgggattactgccctgatcggtcctgggagagagagtggcacaatcagagcgagaaagacagttacggctatatcttcctgagcaacaaagacggccttttaggaagtagatacaagaaggcggtctttcgcgagtacactgacggaacattccgcattcccagacctaggacgggaccagaggagcatctcggcatactcggcccactgatcaagggcgaggtgggagacatattaactgtcgtatttaagaataatgccagccgcccatacagtgtgcatgcccatggggtcctcgaaagcaccaccgtctggcctttggcggctgagccaggcgaagtggtgacttaccaatggaatatacctgagagaagcggaccgggtccaaatgacagcgcctgtgtctcttggatatattattctgccgtggatccaataaaggacatgtacagtggattggtgggtcctcttgctatttgtcagaaaggcatcctggagccccacgggggacgctctgatatggatcgagaatttgcgttgttattcctcatcttcgatgagaacaagtcctggtatctcgaagaaaacgtggccacacacggcagtcaagacccagggtctataaatctgcaggacgaaacgtttttggagtctaacaagatgcatgctattaacggcaagctatatgccaatctgcggggactgactatgtaccaaggtgaacgagtcgcctggtacatgcttgctatgggacaggacgtggatttacataccattcatttccacgccgaatcgttcctgtaccgtaatggagagaactacagggctgatgttgtcgatctctttccagggactttcgaggtggtggaaatggtggcctctaacccaggcacatggcttatgcactgtcatgttaccgaccatgtgcacgccggtatggaaacgttattcacagtgttctctaggactgaacacctctctcccttgaccgttattacgaaagaaacagagaaagtgcccccacgtgatatagaagaagggaatgtcaagatgctgggcatgcagattcccattaagaacgtggagatgctcgcaagtgttttagtggctatcagcgttacactcttactggtagtacttgccttgggaggagttgtgtggtatcagcatcgccagaggaaactgagacgcaacagacgctctattctagacgactctttcaagctgcttagtttcaaacagtag

SEQ ID NO: 225967 - DNA, 627 bp, Artificial Sequence
  Description of Artificial Sequence: Synthetic coding sequence
atggaatccgggcatctgctttgggccctgctgttcatgcagtcactatggcctcagcttacggatggtgcaaccagagtgtattacctggggatacgcgatgtgcaatggaactacgcacccaaaggcaggaatgtaattacaaatcaacctctggattctgatatagtggcatcttctttcctgaaatcggacaaaaaccgcatcggtggtacgtacaaaaaaaccatttacaaggagtacaaggatgattcttatacagatgaggttgcacagcctgcctggctcggttttctgggacctgtcctgcaggcagaggtgggcgatgtcatcttgattcacttgaagaactttgccactaggccctacaccatccaccctcacggagtattttacgagaaagattctgagggctccctgtatccggatggttccagcggacctctcaaggccgacgactcagtcccacctggtggcagccacatctataactggaccatccctgaaggccatgccccaactgatgcagatcccgcatgcctcacctggatctaccactcacacgtggacgcgccacgagatatagccaccggactaatcgggccactgatcacatgcaagcgctag

SEQ ID NO: 225968 - DNA, 3639 bp, Artificial Sequence
  Description of Artificial Sequence: Synthetic coding sequence
atgactcagaccctgccataccatttgtctttgttaaatgtgctgttccctgggccatgctccaggcacttcaagttcagaagaggtaaatgtgctcagccagcttggcgaaaggtctccgcaccctctcaggacttgttaatcacaaaggtcatgtgggccatggagagcgggcatctgctgtgggcattgctatttatgcagtctctctggccccagctcacagatggtgctactagggtgtactaccttggtatacgcgacgttcagtggaattatgcacccaagggacgaaatgtcatcactaatcaaccactggattctgatatcgtagcttccagcttcctgaagtccgataaaaatcgaattgggggaacttacaagaagacaatctacaaggagtacaaggatgacagttatacagatgaggtggcccaacccgcatggctcggcttcctgggccctgtgctgcaggcagaggtaggtgacgtcatacttatccatctgaagaatttcgctacaagaccgtataccatccacccgcatggggtgttctacgagaaggactcggagggctccctgtatcccgacgggtcctctggacctttaaaggccgacgactcagtacctccgggagggtcccatatatataactggaccataccagagggccatgccccaactgacgcagatcccgcttgtctaacgtggatctaccattcccacgtggacgccccaagagatatcgccacgggccttatcggcccactcattacatgcaagcggggtgctttggatggcaacagccctccacagaggcaggatgtggatcatgacttcttccttcttttttctgttgtggatgagaatctcagctggcacttaaatgaaaacatcgccacgtattgtagcgatccagccagtgtggataaggaggatgagacctttcaggagtctaaccggatgcacgctattaatggctttgtattcggtaacctgcctgagttgaatatgtgcgctcaaaagagggtcgcctggcatctctttggaatgggcaatgagatcgacgttcatacggcattctttcacggccagatgctgacgactaggggccatcataccgatgtggccaatattttccctgctaccttcgtaacagccgagatggttccctgggagcctggtacctggctgatatcctgtcaggttaatagtcactttagggatggaatgcaagcattatacaaagttaagagttgctcgatggccccacccgtagacctgttaactggcaaagtgagacagtactttattgaggcacacgagattcagtgggattacggcccaatgggacatgatggatcgacaggcaagaacctacgcgaaccaggaagcatcagcgataagttctttcaaaaaagctctagtcggattggagggacttactggaaggtgcggtatgaggcttttcaggacgaaacctttcaggaaaaaatgcatctcgaggaggaccgccaccttgggatcctggggcctgttatacgtgccgaagtgggcgatactatccaagtggtcttttacaatcgagcatcgcaaccattcagtatgcagccccacggtgtgttctacgagaaggattatgaaggaactgtgtataacgacggcagcagctaccctggcctcgtggctaaaccatttgaaaaggtcacctacagatggacggttccaccacatgcgggacccaccgcccaggatcccgcttgtttgacctggatgtattttagcgctgcagacccaatccgagatacaaactcgggtctggtgggccctctgcttgtgtgtagagctggtgcactgggcgctgatggcaagcagaaaggcgttgataaggaattcttcctactctttactgttctggatgagaacaagagttggtactctaacgcaaatcaggcagccgcaatgctcgattttagactgctcagcgaagacatcgagggctttcaggattcaaatagaatgcatgcaatcaatggcttcctgttcagcaacctccctaggctagacatgtgcaaaggtgatactgtagcttggcatctgcttgggctgggtactgagactgatgtgcatggggtcatgtttcaggggaacactgtgcagctccaagggatgcgtaaaggagctgcaatgctattcccgcacacttttgttatggccatcatgcagcctgataatctcggaacgtttgaaatctattgtcaggctggctcacatagggaagctggcatgcgagcaatttacaacgtttctcagtgtcccggacatcaggccacaccaagacaacgctaccaggctgccaggatttactacatcatggccgaggaagtcgaatgggactactgccccgaccggtcatgggagcgcgaatggcataatcagtccgaaaaggattcctacggctacatcttcctgtccaataaggacggactcctgggctccaggtacaagaaggctgtcttccgagaatacacagacgggacattccgcatccccagacccaggacaggaccagaggaacacctgggtatcctgggccctctgattaaaggggaggtgggtgatatcctgacagtggtattcaaaaacaatgcatcaagaccctactcagtccacgctcacggagtgttagagtctacaaccgtgtggcctctggcagccgaacccggtgaagttgtgacataccagtggaacatcccggaacggagcggacccggtcccaatgattctgcgtgcgtatcctggatttattacagtgctgtggaccccatcaaagacatgtattccggcttggttggcccactcgccatctgccagaaagggatcctagaacctcacggcggacgctcagatatggatagagaattcgccctgctgtttcttatcttcgacgagaataaatcatggtacctggaggaaaacgtggcgacacacgggtcccaggatcccggatcaataaatcttcaagacgaaaccttccttgagtctaacaaaatgcacgctatcaacggcaagctgtacgcgaatttgcgaggcctgactatgtaccagggcgagagggtggcttggtacatgctggcaatgggtcaggatgtggacctgcatacaattcatttccacgccgaaagtttcctataccgcaacggcgagaactaccgagcagatgtggtggacctttttccgggaacattcgaggtcgtagagatggtggccagtaacccagggacatggttgatgcattgtcacgttaccgatcacgtccacgccggtatggaaaccctatttacggtcttctcacggaccgaacacctctcccccttgaccgttattactaaagagaccgagaaagcagtacctccccgtgacatagaggagggaaatgtgaagatgctgggcatgcagataccaattaagaacgtagagatgcttgctagtgtcctggtcgcaatttctgtgacactcttgctggtggtcctagctctgggtggcgtggtgtggtatcagcatcgacaaagaaagctgcggagaaataggcggtccattctggacgacagctttaaacttttgtctttcaaacagtag

SEQ ID NO: 225969 - DNA, 1254 bp, Artificial Sequence
  Description of Artificial Sequence: Synthetic coding sequence
atggcccagaaagagggcggacggacagttccttgttgtagcagacccaaagtggccgctctcacagctggcacactgctactgctgaccgccataggggctgcctcctgggccattgttgccgtgctgctccgctccgaccaagagcctttgtatcccgtacaggtatctagcgccgatgcacgcctcatggtattcgacaagacggaaggcacatggaggctgttgtgtagcagccggagtaacgccagggtagcaggactgtcttgcgaggagatgggtttccttagggctctgacgcacagcgagctagacgttcgaactgccggagccaacggtaccagcggttttttttgcgtggatgaaggaaggcttccccacacacagaggcttctggaggtgatatccgtttgcgattgccccagagggaggtttctggctgcgatttgtcaggactgtgggagacgaaagctgcctgtggatcgtatagtgggcggtagagataccagcctggggagatggccttggcaggtttccctgagatacgatggcgctcacttatgcgggggaagcctgctcagcggtgactgggtcctgacagccgcacattgtttcccagaacgtaatagagtgctctccagatggcgcgtctttgcaggggctgtggctcaggccagtcctcatggcctgcagctgggagtgcaagcagtcgtgtaccatggcggttacctccccttccgagacccgaacagcgaagagaactcaaacgatatcgctctagtgcacctgtccagccccttgcctttaaccgagtatattcagcctgtttgcttaccagccgcaggacaagcactcgtcgatggaaagatttgtactgttacgggatgggggaatacgcagtactacggccaacaggcaggagtattgcaggaagcccgagtgccaattattagtaacgacgtctgtaacggggctgacttttacggcaatcagattaagcccaagatgttttgcgccggttaccccgaaggcggaatagatgcatgccagggggacagcgggggacccttcgtatgcgaagacagcatcagcagaacccctcggtggaggctgtgtggtatcgtgtcatggggtacaggttgcgcactagcacagaagcccggagtttatactaaagtaagcgattttcgcgaatggatcttccaggctatcaagacccattccgaagccagcggaatggtgactcagctgtag

SEQ ID NO: 225970 - DNA, 1254 bp, Artificial Sequence
  Description of Artificial Sequence: Synthetic coding sequence
atggcccagaaggagggtggcaggaccgtcccctgttgctccaggcccaaagtggccgctctgactgctggtacactgcttctgctcaccgcgataggcgctgcgagttgggccatagtagctgttctgctacgcagcgaccaggagccattgtacccagtgcaagtgtcttctgcagacgccagactgatggtgttcgataagactgaaggcacatggaggctgctgtgctcttctcgatccaacgcaagagttgcgggtttgtcctgtgaggagatgggcttccttcgagcccttacacacagtgagctggacgttcgcaccgccggagcgaacgggacgagtggattcttttgtgtcgacgaaggcagactccctcatactcagaggctgctagaagtcatcagcgtgtgcgactgcccaaggggacggtttcttgctgcaatttgccaagattgtgggaggagaaagttgcctgtcgataggatcgtagggggacgagacacatcccttggtcgatggccgtggcaggtgagcctacgctatgacggcgcacatctgtgcggtggttccctcctaagcggcgactgggtgctcaccgccgctcactgtttcccagagcggaaccgggtcttgtcacgctggcgagtctttgcaggcgcagtagcccaggccagtccacacggcctgcagctgggagtgcaagccgtcgtgtatcacggaggctatcttccgtttagggatcccaactcagaagagaattctaacgacatagctttggtacacctatcctccccgctgccccttacggaatacattcagcccgtgtgcctcccggcagcgggacaggcactggtagacgggaagatttgcacggtaacaggttggggcaacactcaatactatggccagcaggccggagtacttcaggaagctcgagtccccattatttcaaacgacgtgtgcaacggtgctgacttttatggaaatcagatcaagcccaaaatgttttgcgctggttacccagagggaggaattgacgcctgtcagggtgattccgggggacccttcgtgtgtgaggacagtatatccaggacccccagatggagactctgtgggatcgtttcttgggggacggggtgtgcccttgcccagaaacccggagtgtataccaaggtttccgatttcagagagtggatcttccaggctatcaaaacccattccgaggcgtctggaatggtgacccagctttag

SEQ ID NO: 225971 - DNA, 1182 bp, Artificial Sequence
  Description of Artificial Sequence: Synthetic coding sequence
atgtgtaaaatgcgaactagggaggatatgcaactcgggaatgaaggtccaggtaccgcgcttaggctgatacatctgcaagtgagcagtgcagatgcgcgtctaatggtgtttgacaaaacggaagggacatggcgcctcctgtgttcttcccgcagtaacgcacgagtggccggtctatcatgcgaggaaatggggttcctacgcgcactcacgcattcagaactcgatgtccgcacagccggtgctaacggcacgtcggggttcttctgtgttgacgagggtaggttgccccatacgcagcgcctgttagaagtgatatccgtgtgcgactgtccgcgtggccgtttcctggccgctatctgtcaggattgtggtagaagaaaactgcctgtagatcgaattgtcggtgggcgtgataccagtctgggcagatggccatggcaagtgagcctgagatatgacggcgctcatctctgcggtggctcattgctgagcggagactgggtgttaactgctgcccactgtttccctgagcggaatagggtcctcagtagatggagagtattcgctggtgccgtcgcacaggcctcccctcacggcttgcaacttggcgtgcaggcagttgtctatcatgggggatacctcccatttagggaccctaactctgaggagaattccaatgacatagccctcgtgcatttgtccagccctctcccgctgaccgagtacatacagcccgtttgtcttcccgcagccggtcaagcattggtggatggtaagatctgtaccgtgaccggatgggggaacacgcagtactatggacaacaagcaggcgtcctgcaagaggcgagagtacccatcatatcaaacgacgtatgcaatggcgcagacttttacggaaatcagataaaacccaagatgttttgtgccggatatccagaagggggaatcgatgcttgccagggcgattctggagggccattcgtgtgcgaggatagcattagtcgcacacccagatggaggctttgtggtatcgttagctggggcaccggatgtgcccttgcacagaaacccggtgtgtacactaaagtgtcagatttccgggagtggatttttcaggctattaaagttaaggtcgggtctcgatgggaacccggttggggtcggctgggagtttag

SEQ ID NO: 225972 - DNA, 2103 bp, Artificial Sequence
  Description of Artificial Sequence: Synthetic coding sequence
atgaaatgcgtgctcgtagctacagagggagcagaggttctgttctactggaccgatcaggaattcgaagaaagtctccgactgaaatttgggcagagtgagaacgaagaggaagaattacctgccctcgaggaccagctgtccaccctattggcacctgtaatcatttcgtctatgactatgctggagaagctctctgacacctatacatgcttctcaaccgaaaacgggaatttcctatatgtcctgcacctgtttggggagtgcctgttcatagcaatcaacggcgaccatactgaaagcgagggtgatctccgaaggaaactgtacgtcttaaagtatctgtttgaagtgcacttcggtcttgtcacagtggacggccatctgatcagaaaagaactcaggcccccagacctcgcccagagagtgcaactgtgggagcactttcaatcgctgttgtggacatatagccggctccgcgaacaggaacagtgctttgcggtggaggccttggagcggctgatacatcctcagttatgcgaactgtgtatagaagcgttggagaggcatgttattcaggccgtcaatacatcccccgaacgcggtggcgaagaagccttacacgcattccttttggtccattccaaacttctagctttttacagcagtcatagcgcgagcagcctgagacctgccgatctgctcgccctcatccttctggtccaggacctctaccctagcgagtcaactgccgaggacgacattcagccttccccaagacgagccaggtcctctcaaaacattcccgttcaacaggcgtggagccctcatagcaccggtcccacaggagggtcatcagctgagacagagacagacagtttttctctccccgaagaatactttacaccagcaccgtcacccggtgatcaaagctcagggagcaccatttggctcgaggggggaactcctccgatggatgcattgcagatcgccgaagacactctgcagacattggtgccccattgtcctgtgccctccggcccacggaggatctttctggatgccaatgtgaaggagtcctactgtccattagtgccccatacaatgtattgcctgcctctgtggcaaggaattaacctagtgctgctaactcggagccctagcgcgccactggcgctggtgctctcccaattaatggacggcttttccatgctcgaaaagaagcttaaggagggcccagagcccggtgctagcctcagatctcagccattagtgggggaccttaggcaacgtatggacaaattcgtgaagaataggggcgcacaagaaattcagagcacgtggttagagttcaaagccaaagctttctctaaaagcgagcccggatcctcttgggaactgctacaggcatgcgggaaactcaaacggcagctttgcgctatctacagacttaattttctgaccactgccccatcccgcggagggcctcatctcccccaacacctccaggaccaggtgcaaagactgatgcgtgaaaagctcaccgactggaaggactttttgctggttaagagcagaaggaatataacgatggtatcatacttggaagactttcccggacttgtacactttatctacgtggaccgcacaactggtcagatggtcgcaccgagcttgaactgctcacaaaagacatctagcgagctgggaaagggaccactggctgccttcgtcaaaacgaaagtctggtcactcatccagctggccagaaggtacttgcagaaaggctacaccactctgcttttccaagagggggatttctattgttcctactttctgtggtttgagaacgacatgggatacaagttgcagatgatcgaggtgcctgtgctcagcgacgattcggtgcccattggtatgctgggcggtgattactataggaagctgctccgctactactctaagaaccggcctacggaagctgtaagatgttacgagctcctagccctgcacctgtccgtgattcccaccgaccttctggtacaacaggccggtcagctggctagacgcttgtgggaagcctctcgaattcctctactgtag

SEQ ID NO: 225973 - DNA, 975 bp, Artificial Sequence
  Description of Artificial Sequence: Synthetic coding sequence
atgaaatgcgtccttgtggcgacagagggagctgaggtgctgttctattggacagaccaggagtttgaagagtcactgcgactcaagtttgggcagagcgaaaatgaagaagaagagctgccagctcttgaggatcagctgtcgactctcctcgcacccgtgatcatttctagcatgacaatgcttgagaaactatctgatacatacacgtgcttctctacagagaatggtaactttctctatgttctgcatctgttcggggaatgtctgttcatcgctattaatggcgaccacacggagtcagagggggatctccggcgtaagctttacgtgctaaagtacctgtttgaggtgcacttcggcctagtgaccgtggatggccatttgatccggaaggagctcaggcccccagaccttgctcaacgggtccagctgtgggaacattttcagtccttgctgtggacctactcccgactccgggaacaggagcagtgttttgcagtagaagcgctcgaaaggctcatccatccccagctttgcgaactctgtattgaagctctggaacggcacgtcatccaagcagttaatacatcacccgaaagaggaggagaggaagccctacacgcgtttctcttagtccacagcaaattgttggctttctatagctcccattctgcctcttcactgcgaccagctgatctgctagctctgatcttgctggtgcaagatctttaccccagcgagagcacagcggaggacgatatccagccatcacctcgacgggctcgtagtagccagaacattccagtacagcaggcatggtctccccactccacggggcctaccggcggatcctctgcagaaacagagactgacagcttctccctacctgaagaatactttacccccgcaccatctccaggtgaccaatcaagcggagaggatagaaggaaagcaggaggcaataactcttag

SEQ ID NO: 225974 - DNA, 981 bp, Artificial Sequence
  Description of Artificial Sequence: Synthetic coding sequence
agactcattcatccccagttgtgcgaattatgtatcgaggcactggagagacatgtgatacaagcagtgaacacctccccagagcgcggaggggaggaagcactgcacgccttccttttggtccactcaaagctccttgcgttctactccagccatagcgcgtcttcacttcggcctgccgacttgctcgccctgattcttctagtgcaggatctgtatccgtcagaaagtacggcagaggacgatattcaggagacggactcattttctcttcctgaagaatactttacccccgctcccagcccaggagatcaatccagcggcagtaccatatggctggagggagggactccccctatggacgcgctgcagattgcagaagacacgttgcagactttggtgccccactgtcccgtccccagtggtccccgacgaatctttctcgacgccaatgttaaggaatcgtattgcccactcgtgccacatacaatgtattgcctacctctttggcaagggattaatctggtgttgctgacacgttctcccagtgccccactggccctagtattgagtcaattaatggatggattctccatgctcgaaaaaaagctcaaagagggacctgaacctggagcatctctgagatcacagcccctggtcggagatctaagacaacggatggataaatttgtcaagaacagaggcgcacaggagatccaatccacgtggctggaattcaaagcaaaggccttttcaaagtctgagcccggttcctcctgggaactcttgcaggcctgtgggaaactgaagcgccagttgtgcgccatttaccggctcaatttcctgacaaccgctccatcacggggaggtccacatctgcctcagcacctccaagaccaggttcaacggttaatgagagaaaaattaactgattggaaggactttctgctggttaaaagccgccgaaacatcacgatgtag

SEQ ID NO: 225975 - DNA, 2103 bp, Artificial Sequence
  Description of Artificial Sequence: Synthetic coding sequence
atgaagtgtgtgctcgtggcaaccgagggcgcagaggtccttttctactggaccgaccaggagttcgaagagagtctgcgtctcaagtttggacagtctgagaacgaggaagaggaactgcccgctctggaggatcaactctctacactgctggctcctgtgatcatatccagtatgacaatgctggaaaagctatctgacacgtatacctgttttagcactgaaaatggcaatttcttgtatgtgttgcacctgtttggagagtgcctgttcatcgctatcaacggtgatcacactgagtccgaaggggacctgagaaggaaattatacgtccttaaatatctgtttgaggtgcattttggactcgtgactgtagatggccacctgattcgcaaggaactgcgacctcctgacctggcccagcgggtgcagctgtgggaacactttcagtcgttgttgtggacctattccagattgagagagcaggagcagtgctttgcggtggaagcgttagagcgcctcatccacccccagctctgtgaactgtgtatagaagcacttgaaagacacgtaattcaagccgtgaataccagccctgaacgtgggggtgaagaggccctgcacgccttcttgttggtccacagcaaactcttggctttttattctagtcattccgcatcatccctaaggcctgctgacttattggcattaatcctgctggtgcaggatctctatcccagcgagagcacagccgaggacgatattcaacccagccctcgcagggctcgttccagtcagaacattcctgttcaacaagcatggtctccacattcaacgggtcctactggcggatcatcagccgaaaccgaaacagactcgttctctctgcccgaggagtattttacacctgccccatcccccggagatcagtcctccgggagcaccatttggttggaaggcggaactcctccgatggatgctcttcaaatcgcagaggatactcttcaaaccctcgtccctcactgcccagtcccttctggcccacgaagaattttcctcgacgctaatgtcaaagagagttactgccctctagtaccgcacaccatgtactgcctccctctatggcagggcatcaatctcgtcctcctgacacgctcaccctccgctcctctcgccttggtcttgtcgcagctgatggacggcttctccatgctggaaaaaaaacttaaggaggggcctgagccaggggcttctctcagaagtcagccactggtgggagacctccgacagcggatggacaagttcgtaaagaaccgcggagctcaggaaatacagagtacctggcttgaatttaaggcaaaggcgttctccaaatcagagcctgggagcagctgggagttactgcaggcttgcggaaaactcaagcgccaattgtgtgctatatatcgcctgaattttctgactacagcacctagtcgcggagggcctcacctaccacagcacctccaggaccaggtccagcgcctcatgcgagagaagctgaccgactggaaggactttctcctggtgaaatctagacgcaatattactatggtgtcttatctggaggacttccctggcctcgtgcatttcatttacgtcgacaggaccacaggacagatggttgcgcctagtttgaactgcagccagaagacatcaagcgagctgggtaagggcccattggcagcttttgtgaaaacaaaagtgtggagtctgatccagttggcaagacggtatctgcagaaagggtacacaaccctcttgttccaggagggtgacttctattgctcttacttcctgtggtttgagaatgacatggggtataagttgcagatgatagaggtaccagttctgtccgacgattcggtgccaattgggatgctagggggagactattaccggaaactcctgcgctactactccaagaacagacctaccgaggcagtcagatgttatgagctcctggcattgcatcttagcgtgatcccaactgatctgcttgtgcaacaggcaggacagctggctcgtcggctgtgggaggcctcccggataccacttctgtag

SEQ ID NO: 225976 - DNA, 2004 bp, Artificial Sequence
  Description of Artificial Sequence: Synthetic coding sequence
atgaagtgcgtacttgtggctaccgagggggctgaagtgcttttctattggactgaccaggagtttgaagagagccttagactgaagttcggtcaatcagaaaacgaagaagaggaactaccagccctcgaggaccagcttagcacgttgttggcacctgtgataatctcctctatgactatgcttgagaaacttagcgacacctatacttgtttcagtacagagaacggaaatttcctctatgtattgcatttattcggggaatgtctgttcatagccattaatggtgatcacacggagtctgagggggacctaaggcgtaagctttacgtcctcaaataccttttcgaggtccacttcggcctcgttacagtagacggccacctgattagaaaggagctccgcccaccagacttagcccagagagtgcagctgtgggaacattttcagtctctgctatggacgtactccagattgcgtgagcaggagcagtgcttcgccgtcgaggcactcgagcgactaattcatccccaactgtgtgagctttgtatcgaggctctggaaaggcatgtgattcaggccgtcaatactagtcctgaacggggaggcgaggaagccctacacgcctttctgctcgtacattccaagcttctagcgttctattcctctcacagcgcttctagcttgcgtcctgccgaccttttggcattgatcttactggtgcaagacttgtaccccagtgaatctaccgcggaagatgatattcaggaaacagatagtttcagtctgccagaggagtactttacccccgctccttcaccgggagaccagagttctggatcaacaatatggctcgagggcggtactcccccaatggacgccctgcagatagctgaggatactctgcaaaccttggttcctcactgtcccgtcccttccggacctaggaggatctttctcgacgctaacgttaaagagtcttattgtccacttgtacctcacactatgtactgcctgccactctggcaaggaatcaacctggttctgctcacaagaagccctagcgctcccctcgccctcgttttgtcacagctcatggacggcttctccatgctagagaaaaaattgaaagagggcccagaacctggggcatcccttaggtctcagcccctggttggtgatctgaggcaacgtatggacaagttcgtgaagaatcggggtgcccaggaaatccagtccacatggcttgagttcaaagccaaggccttttcgaagtccgagccaggttcgtcctgggaactactgcaagcttgtggtaaactgaagcgacagctgtgcgccatttaccgactgaattttctgaccacggcccctagtagggggggaccccacctgcctcaacacttgcaggaccaggtccaaagactgatgagagagaaattgaccgactggaaggactttctgctggtcaaatctagaaggaacatcacaatggtcagctatcttgaggattttccaggactggtgcattttatttacgtcgaccgcacaaccggccagatggtagcaccatccctcaactgctcccagaaaacctcaagcgaacttggtaaaggcccattggccgctttcgtcaaaacaaaagtctggagccttattcagctggcacgcaggtatttacagaaggggtataccactctcctcttccaggagggggacttttactgctcttatttcctctggttcgagaatgacatgggctacaagctgcaaatgatcgaggtgccagtcttgtctgatgacagtgtcccaattggcatgctcggtggagactactaccgaaagttgttgagatattacagtaagaatcgccctaccgaggcggtgcgctgctatgaacttttggccctccatctgagcgtaattcccaccgatctgttggtgcagcaggctggacagttggctagacggctttgggaggctagcaggataccattgctctag

SEQ ID NO: 225977 - DNA, 480 bp, Artificial Sequence
  Description of Artificial Sequence: Synthetic coding sequence
taactccgccctccggacctcgcccagcgcgtccagctttgggaacactttcaatcgctcctatggacatactcccgactgcgagaacaggaacagtgtttcgctgtcgaggcactcgaacgcctgattcatccacagctgtgtgaactgtgtatagaggccctggagaggcacgttatccaggctgtcaatacatcccctgagaggggtggagaggaggcactccacgccttcttgttagtccattcgaagctgctggccttctattctagccactcagcctctagtctccgcccagcggacctactggcattgatactgctagtacaggacctgtaccccagcgaatccactgctgaagatgacatccaagagaccgattcgttctcacttcctgaggaatacttcactcccgcaccttcccctggcgatcaaagtagtggcgaagaccgtagaaaggccggtggaaataactcttag

SEQ ID NO: 225978 - DNA, 3015 bp, Artificial Sequence
  Description of Artificial Sequence: Synthetic coding sequence
atggtgcagctttataatctgcacccatttggcagccagcaggtggtaccctgtaagctcgagccggatcgattctgtggcggagggagagatgctctgttcgtcgcagcaggttgtaaggtcgaggcctttgcggtagctggacaggagctgtgccaacccaggtgcgcattctctacactgggccgtgtcctgagactggcctactcggaggctggggactacttggtcgcgattgaagaaaagaacaaggcgacatttttgcgcgcttatgttaactggagaaataaacgaacagagaacagccgggtctgcattcgaatgattgggcacaacgttgaagggcctttctcaaaggccttcagagaccagatgtacatcatagagatgccgctatctgaggcaccgctttgcattagctgctgtccagtgaaaggagacctcctggtgggttgcaccaataaactcgtcctctttagcctcaagtaccagatcattaatgaagaatttagcctgctggactttgagagatcactgattatccacatcgacaacattacccccgtggaagtcagtttctgcgtcgggtacgtggctgttatgtctgacctggaggtcctcatcgtcaagctcgaaagcgggcctaagaacggggagcgggtgcaccaccatccgcacaagacgaacaatagaatccgcaggaccgaggagggaattagtaacgagatcagccagctggagagtgatgatttcgtgatctgccagaaacctttagaactactcggcgagaagtctgaacaatccggcctttcagttacactcgagtctacgggtctggccgacgagaagcgaaaatacagccattttcagcacctactctaccgcaggtttgccccagatatctcctcttacgttttgagtgacgacatcaaactacattccctgcagctgctgcccatatatcagacaggaagcttaacatctgatggaaaaaacctgtcacaggagaaagaacttctgagcttgttctgtttcttctccctaccgcatgtaggttatctctacatggtggtaaaatcagttgaactgatgtctgtatatcagtatcccgagaaaagtcaacaggctgttctgactccccagttcctgcatgtgatcacctctaacaatctccagtgttttaccgtgaggtgctccgcagccgcagcccgagaagaagatccatatatggacacaacactcaaggcgtgtccccctgtctcaatggacgtgtgcgccctccggattcagctattcatcggcttgaaggctatttgccactttaagaatcatatcatactgctaacaaaagctgagccagaggccatcccggagagaagacaatctcccaaacgtttgctgtctaggaaagacacttctgttaagattaagatcccccctgttgcagaagcgggatggaatctgtatatcgtcaacaccatctctccggttcagttgtataaggagatggtcgattactccaacacctacaaaacagtgaaaacccagtcctgtatccatttgctgtccgaggcccacctgttagttcgggctgcactcatggatgcaagtcagctggaaccgggtgaaaaagcggagctcctggaagcttttaaggagtcatgcggccaccttggcgactgctattcgaggctcgactctcaacacagccacctgacactcccgtattataagatgagtgggctcagtatggcagaggtgctcgcgcgaacagactggactgtcgaagatggcctgcagaagtacgagcgtggccttatcttctatatcaatcatagtctctacgagaacttagacgaagagctgaatgaggaattagccgctaaagtagttcagatgttctacgtcgctgaacctaagcaggtccctcacatcctatgttccccctctatgaaaaatatcaatccactgaccgccatgtcctatcttcggaagctggatacttcggggttttccagcatactagtcaccctcactaaagccgctgtagcgctgaaaatgggagacttagacatgcacagaaatgagatgaagagccatagtgaaatgaaactggtatgcgggtttattctggagcctagactactgatccagcagcgcaaaggtcagattgtgcccactgagctcgccctgcacttaaaagaaacgcaaccaggcctgttagtggctagcgtgctcggactacagaaaaataacaaaattggcatagaagaggctgattcattctttaaggtattgtgtgccaaagacgaagataccatcccccagctgctcgtcgatttctgggaagcccaactcgtcgcttgtttaccagatgtagtgcttcaggagctcttttttaagcttacttcgcaatacatttggcgactgagtaaaaggcagccccctgacactaccccgctgcggacatccgaggaccttatcaacgcatgcagccattacggcttaatttacccctgggtgcatgtggtaatcagctcggactccttagcagacaagaactatacagaggatctctctaaactgcagtctctaatctgcggccctagctttgatattgcatctattatcccctttcttgagcccctgtcggaggatacaatagcagggctctcagtgcatgtgctctgtaggacccggcttaaggagtacgagcagtgcatcgacatcctcttggagaggtgtcctgaagctgtgatcccttatgccaaccatgagctaaaagaggagaatagaactctctggtggaaaaagctgttgcccgaattgtgccagaggattaaatgtggtggagaaaaataccagctgtacctgtctagtctaaaggagactttaagtatagtggcagtggaacttgaactgaaggatttcatgaacgtcctgccagaagatggaacagccaccttctttctaccataccttctttattgttcccggaagaagcccctgacttag

SEQ ID NO: 225979 - DNA, 1587 bp, Artificial Sequence
  Description of Artificial Sequence: Synthetic coding sequence
atggcaacctcgacgtccactgaggccaaaagtgcatcatggtggaactactttttcctgtacgatggatctaaggtcaaggaggagggtgaccctacgagagccggaatctgctacttctacccttcacagaccctcctggatcaacaggagctgctttgcggccagattgcgggtgtggtcaggtgtgtgtctgacatctcggacagccctcccactttggtgcgccttagaaagttgaagtttgctatcaaagtggacggagattatctttgggttctagggtgtgctgtcgaattgccggatgtgagttgtaagagattcctggaccaactcgtaggttttttcaatttctataacgggcctgtgagcctagcctacgaaaattgctcacaggaggaactatcaaccgagtgggacacattcatcgagcagattcttaaaaacacatcagacctccacaaaatcttcaactcactctggaatttggaccagaccaaggttgagcctctgctccttctgaaggcggctagaatactacagacatgtcagcgctcacctcacattcttgctggctgcatactatacaagggactaatcgtgagcactcagcttccaccctccctcacagccaaggttctattacaccgcaccgcaccccaagagcagcgacttccaaccggcgaggatgcccctcaagagcacgggaaatggatgctgtggtcttttaagaacagagtcacccaccaaaacccgaacggcgctgcgcttcctcctaatgttcagattataccggtctttgtcacaaaggaggaggcaataagcctgcacgagtttcctgtggagcagatgacacgaagcctcgcctctcctgccggattacaggacggctcagcgcaacatcaccctaagggcggaagcactagcgccctgaaggagaatgctacaggccacgttgaatctatggcttggaccaccccagaccctacgagtcccgatgaagcttgccccgatggaaggaaagaaaatggctgtctatctggacacgacctcgagagcatccgccctgctgggttgcataactccgcgaggggtgaggtactgggtctgtcatcctccctaggtaaggagttagtgttcctgcaggaagaactggacttatccgaaatccacattcctgaagcccaagaggtcgagatggctagcggccactttgcttttctccacgtgcccgtgccagacggtcgcgcaccttactgcaaagccagcctgagcgctagctctagcctggagccaacgccaccggaagacacagccatctccagtctgaggccgccaagtgcgcctgagatgctgacacagcacggggctcaggaacagctcgaagaccacccaggccatagctcacaggctccaattccgagagctgaccctctcccaaaaagcaccgtgcttttctctgggggatgcgtgaaaggcagcgatacacagctatgcgtacccggactggtatggtacctggaacctcagttttactacgtgatcgtgcggcattttttcgacagcatgcggcagacagcgggatag

SEQ ID NO: 225980 - DNA, 2127 bp, Artificial Sequence
  Description of Artificial Sequence: Synthetic coding sequence
atggccacttctacctccactgaagccaagtcagccagctggtggaattacttctttctatatgatggatctaaagtcaaagaagagggggaccccacccgcgctggcatttgctacttttatcctagccagaccttgctggaccagcaagagctgctgtgtgggcaaatagctggagtggtcagatgtgtgtcagatatttctgactcccccccaaccctggtgagactgagaaagcttaagttcgcaatcaaggtggatggtgattacctgtgggtccttggctgtgccgttgagctgcccgatgtgtcgtgtaagcgtttcctggatcaattggtcggcttttttaatttctataacgggccagtgagcctggcctatgagaattgttcccaggaggagctcagcaccgaatgggatactttcatcgaacagattttgaaaaacacctccgaccttcacaagatatttaactctctgtggaacttggatcagaccaaggttgagccgcttctgttactcaaagctgccagaatactgcagacctgtcaacgatcccctcacatcttagcaggatgcatcctctataaaggactcatcgtgagtacccaacttccaccttccttgacagcgaaggtcctgctgcatagaaccgctccccaggagcagcggctcccaacaggcgaagatgctccacaggagcacggcgctgctctgccacctaatgtgcagattatcccagtattcgtcacaaaagaggaagctatttctctgcatgaatttcccgtagaacagatgaccagaagcctggcgtctccagcaggactgcaggatgggagcgctcagcaccaccccaaaggtggcagcacaagcgccctaaaggaaaatgccacagggcatgttgaaagcatggcttggactacgccagacccaacgtctcccgacgaggcttgccctgatggcagaaaggaaaatggctgtctctccggtcatgacctggagtctattaggcctgccggtttgcacaattccgcacgtggcgaagtgcttgggctgagtagctcccttggaaaagagctcgtctttttgcaggaggagcttgatctcagtgagatccatatcccagaagcccaagaagttgagatggcctcagggcacttcgcgtttctacacgtacctgttcccgatggccgagcgccatattgcaaagcatctcttagtgcctcctcgtctctcgagccgactccaccagaggacacagcaatcagttctctgaggccccctagcgctcctgaaatgttgacacagcacggcgcacaggagcaattggaggaccacccagggcatagctcacaggccccaataccccgtgccgaccccttgcctcgcaggaccagacggcctcttctgctgccaaggcttgatcccggtcaacggggaaacaaactgccaacaggggaacagggtctcgacgaggacgtggatggtgtgtgtgaatcccacgctgctccaggactcgaatgctcgagcggatcggctaactgccagggtgcaggccctagcgccgatgggattagttctcggctgactcccgcagaaagctgcatgggcctggtgagaatgaatttgtatacacactgcgtaaaggggctagttctgtcccttctggctgaggagcccctccttggcgattccgccgcaatcgaggaggtctatcatagcagcctggcctcccttaacggactcgaggtgcacttgaaggaaacacttcctcgtgatgaagccgcttcaaccagctcaacctacaactttacgcattacgacaggatccagtcactcctcatggcgaatctgccccaggtggccacaccgcaagacaggaggtttcttcaagctgtcagtctgatgcattctgagtttgcccagctgcctgctctctatgagatgaccgtgcgcaatgcctccacagcggtgtacgcgtgctgtaatcccattcaggagacctacttccagcagctggccccagccgcaaggagctccgggttcccaaatccgcaagacggcgcatttagtttgtcaggaaaagctaagcagaagcttctcaaacatggggtcaatttgctttag

SEQ ID NO: 225981 - DNA, 2166 bp, Artificial Sequence
  Description of Artificial Sequence: Synthetic coding sequence
atggcacctctgtgcagcctcgcccgttggaattacttctttctgtatgacggctcaaaggttaaagaggagggggatcccactcgcgctgggatctgttacttctacccctcccagaccctgctcgatcaacaagaattactgtgtggacaaattgctggcgtggtgagatgcgtctcagacatcagcgactcacctccaacactggtccggctgagaaagctgaagtttgccatcaaagtggacggggactatctctgggtcctgggctgcgccgtagaactcccggacgtgagttgtaaacggttcctggaccagctcgtggggttttttaatttctacaatggtccggtgtcccttgcctacgagaattgttcccaggaagaactgtccacagaatgggatacgtttattgaacagatcttgaaaaatacttccgatctgcacaaaatatttaattctctgtggaatcttgaccagactaaagtggaaccactattactattgaaggcagccaggattctacaaacctgccagcgatctccacacatcctggcaggatgtatcctgtataagggcctgatcgtttccactcaactgcctcccagcctgactgcaaaagtcttattacacaggaccgccccacaggaacagcgactccctactggtgaggatgccccacaggaacatgggaaatggatgctgtggtcttttaaaaaccgcgtgacccatcagaaccctaatggggctgcccttccccctaatgttcagatcatccctgttttcgtgacaaaggaagaagctatcagcctccacgagttcccggtggagcagatgactcgatcactcgctagccccgctggcctgcaggatgggagtgcacagcaccaccccaagggagggagtacttcagcattaaaggagaatgccactggacacgtcgaaagcatggcctggaccacacccgatcccactagtcctgacgaggcctgccctgatgggaggaaagagaatggatgtctgtcagggcatgatttggaaagcatcagaccggctggccttcacaatagtgcacggggtgaagtcttaggtctgtcttctagcctggggaaggaacttgttttcttacaagaagaactcgacctaagcgagatccatataccagaggcccaggaggttgagatggcatccggtcattttgcctttttacatgtcccagtccctgatgggagggctccctattgcaaggcctcactgagcgcgtcctcttctttggaacccaccccccctgaagatacggccatcagcagtctgaggccaccatcagctccggaaatgctgactcagcatggggctcaggagcagcttgaggatcacccaggccatagttctcaggctccaatccccagggccgaccctttacccaggaggacaagaagaccccttctgttacctagacttgaccccggacagaggggaaacaagcttcctactggagagcagggtctggacgaggacgtggatggcgtatgtgaatcccacgccgctcctggtttggaatgctcatccgggtcggccaattgccagggggctggtcctagtgcggacggtatttccagtcggctgacacccgctgagtcttgcatgggtctcgtcagaatgaatctgtatacacactgtgtgaaagggctggtcctgagtttactggccgaggagcctttactgggagattctgcagcaatcgaggaagtgtatcacagctccttggcctcacttaatggccttgaagtgcatctgaaggaaacattaccacgggatgaggctgcaagcacatccagcacttataacttcacccactacgatcgaatacagtcactgctgatggcaaacttgcctcaggtggcaacacctcaagatcgccgattcctgcaggctgtttctcttatgcacagcgagtttgcgcagctccccgcactctatgaaatgaccgtccgcaacgcctctactgccgtgtacgcttgttgcaacccaatccaggagacctacttccaacagttggctccagcagccaggtcatctggattccctaacccacaggacggtgcattctcactttccggcaaggccaagcagaagctactgaaacacggcgtgaatcttctctag

SEQ ID NO: 225982 - DNA, 2127 bp, Artificial Sequence
  Description of Artificial Sequence: Synthetic coding sequence
atggcaacatctacctctacagaagcaaaaagtgcgtcttggtggaactactttttcctgtatgatgggtctaaagtgaaggaggaaggagacccgacacgtgccggaatttgttacttttatcctagccaaaccctgttagatcagcaggaattactctgcggccagattgctggcgttgttcgctgcgtttccgatatttcagacagccccccaacacttgttaggctgagaaagctaaaatttgctattaaggtcgatggagattacctatgggtgctgggctgcgccgtggagctacccgatgtctcctgtaaacggttccttgatcaattagtggggttctttaacttctataacggacctgtctctctagcatacgagaattgttcccaagaggaactgtccaccgaatgggatacatttatcgaacagatcctcaagaacactagcgacttgcacaagatttttaactctctttggaacctggaccagaccaaggtagaacctctcctattgctcaaagcggcacggatcttgcagacttgccagagaagcccacatattttggcgggatgtattctctataagggactgatcgtgtcaactcaactgcccccttctctgactgctaaagtgttgctgcatcgcaccgcacctcaggaacagcggctccccaccggagaagatgcaccacaggagcacggagcggctctgcctcccaacgtccaaatcatccccgtgttcgttaccaaagaagaggccatcagtctgcacgagttccctgtggagcaaatgacccgatccctggctagccccgcagggctgcaggatggctccgctcagcaccatccaaaaggaggtagcactagtgccctaaaagagaacgccactggacatgtggaatcgatggcctggacaacgcctgaccctacttctccggatgaagcctgtcccgacggccgtaaggagaacggttgccttagtggccatgatttagagtccatcagacctgcgggacttcacaattctgcaagaggggaggtgttgggcctcagctcatctctcggaaaagaactagtgttcctacaggaggagcttgacctgagcgagatacatatccctgaggcacaggaggtggaaatggcctctggccattttgccttcttgcacgtgccagtgcctgatggcagagctccgtactgtaaggcctccctctcggcctctagcagtctagaacccaccccccctgaggacactgcaataagtagtttacgccctcccagtgctccggaaatgctgacgcagcatggggctcaggagcagctggaagatcatcccggtcattcatcccaggctcctattccccgtgccgaccctctgcccaggcgaactcgtcgacccctcttgctccctagactagacccagggcagcggggaaataagcttccaaccggagaacagggactcgacgaagatgttgatggcgtttgcgagagccatgccgctcctggtcttgagtgcagctccggcagtgctaattgccagggcgcaggaccttccgctgatggaatttcgtcccggttgacaccagccgaatcttgcatgggtttggtccgaatgaacctttacacacactgtgttaaggggctggttctgagtctattagcagaagagcccctgttgggagattccgctgcaattgaggaggtttaccacagttctctggcctccctaaacgggttggaagtgcatcttaaagaaacactgccacgggacgaagctgcgtctacgtcttcaacctacaactttacgcactacgaccgaatccagtctctgctaatggcaaatttacctcaggttgccacaccacaggaccggagattcctgcaggccgtgtctctaatgcacagcgaatttgcacaattgccagccctgtatgagatgaccgtgcggaacgcatccacagctgtgtatgcttgctgtaacccaatccaggaaacctactttcaacagctagctcctgcagccaggagttccggcttccctaatcctcaagatggggctttctctcttagcggtaaagcaaagcagaagttgttaaaacacggagtgaacctgctatag

SEQ ID NO: 225983 - DNA, 2112 bp, Artificial Sequence
  Description of Artificial Sequence: Synthetic coding sequence
atggctcccctctgtagcctggctcggtggaattacttttttctctacgacgggtctaaggtaaaggaggaaggtgatcccacccgggcaggaatttgctacttttacccttcccagactctgctggatcaacaggagcttttgtgtgggcagatagcgggtgtggtgcggtgtgtgtcagacattagcgacagtccccctaccctcgttcgcctcagaaagcttaagtttgctattaaggtggacggcgactacctctgggtgctcgggtgtgctgtagagcttcctgatgtgtcttgcaaacgttttctcgatcagctggtggggttcttcaatttttataacggaccagtgtcgctggcgtatgagaactgttctcaggaggaattgagcacagagtgggacacttttattgagcaaattttgaaaaatacctctgatttacataagatatttaacagcctgtggaacttggatcagactaaggtcgaacctttattgctccttaaggctgcccgaattctgcagacttgtcagagatcaccccatatcctggccggatgtattctttataaggggttaatcgtctcaacgcaactgcccccaagtttgacggccaaagtgctgctgcaccggaccgcaccccaggaacagcggctgccgactggggaggatgcaccgcaggaacatggcgctgccctgcctcctaacgtgcaaattattcctgtcttcgtaactaaggaagaagcgatctcattgcacgaatttccagttgagcaaatgaccagaagtctggcctctcccgcaggactgcaggatggctctgcacagcatcatccaaagggcggatcaacttccgcgctgaaggagaacgccaccgggcacgtagaatctatggcttggaccacccctgatcctacgtcacctgacgaggcctgcccggacggcagaaaagaaaatggctgcctttctggccacgatctagagagcatcagaccagcaggacttcataattccgcgcgtggggaggtgctgggcctcagttcctcactgggcaaggagctcgtgtttctgcaggaggaactcgacctgagcgagatccacatccctgaggctcaggaagttgaaatggccagtggccatttcgcctttctgcacgttcccgtccctgacgggagggcgccatactgcaaagccagtctatctgcatcctcaagccttgagccaactcctcctgaagatactgctatttcttccctcaggccacctagcgctcccgaaatgctcacacaacacggagcccaggagcaactcgaagatcacccgggacatagtagccaagcccctattccgcgtgctgacccactaccaaggaggaccaggaggcctcttctgctgcccaggctggaccctgggcagcgtggcaataagctgcccaccggggaacaggggctcgacgaagacgtagacggagtctgtgagtcccacgccgcacctgggctagaatgttctagtggttctgctaattgtcaaggggcaggaccatctgctgacgggatctcgagcaggttaactccagccgaaagctgcatgggtttggtgaggatgaatttatacacacactgtgtgaagggactggttttatcactcctggccgaggagccacttctgggcgattctgcagccatcgaggaggtgtatcatagttccctggcgagtctgaatggattggaggttcatctgaaagagacactgcctagggacgaagcagctagcacctctagtacatacaatttcacacactatgatagaatccagtcactgcttatggctaacctgccacaggtcgctaccccccaggataggcggtttcttcaggccgtgtcactcatgcattccgagttcgcccaactccccgctttatacgagatgacagtgcgaaacgcatccactgccgtctacgcttgttgtaaccctatccaggaaacttatttccagcagctggcccctgccgctcgctcatcagggttcccaaatcctcaggacggggcttttagcctcagcggcaaggccaagcaaaagctgctgaaacacggcgtgaacttgctatag

SEQ ID NO: 225984 - DNA, 3390 bp, Artificial Sequence
  Description of Artificial Sequence: Synthetic coding sequence
atggcatttgtaccagttattcccgagtcctattctcatgtcctggccgagtttgagtctttggacccactattatccgcccttcgactagatagttcaagattgaaatgtacttctattgccgttagccggaaatggctggccctgggtagctcaggaggtggccttcacctgatccagaaggaaggatggaagcaccggctgttcctgagtcaccgggagggggcaatttcccaggtagcttgttgtcttcatgacgatgactatgtggctgtggccacatcgcaggggctggttgtggtttgggagctcaaccaagagcgacgtggtaaaccggaacagatgtatgtgagcagtgagcataaaggcaggcgcgtcaccgcactctgctgggacacagctatccttagagtgtttgttggggaccacgcaggaaaagtgtccgccattaagctgaacactagcaagcaggcaaaggcggctgcggcttttgtgatgttccctgtacaaaccattacaaccgtagactcctgcgtggtccagctggactatctggatggaaggctccttatttcctcattgactagatcctttttatgcgatactgagagggagaagttctggaagatcggaaacaaggaaagggatggggaatatggtgcttgcttcttccccggtaggtgctcaggaggccagcagcccctcatttattgcgccaggcctggttctcgcatgtgggaagtgaatttcgacggagaagtgataagtacgcatcagtttaaaaagctattgtcactcccccctctgccagtgattacccttcgatcagagccgcagtacgatcacacggccggaagctcccagagcttaagctttcctaagttactgcatctgtcagaacactgcgtactgacctggaccgaaagaggcatctacatcttcattccccagaacgtgcaggtgctcctatggagcgaggtcaaggatatacaagatgtcgccgtttgcaggaatgagctgttctgtctccacctaaacggcaaggtgagtcatctgtcattgatttcggtggagaggtgcgtcgagagactgctcaggcggggtctttggaatcttgctgccaggacctgctgcctgtttcagaactctgtgattgcctcacgcgctcgcaaaacacttacagccgacaaactggaacatctaaagagtcaactggatcacggaacttacaacgatctgataagtcagttggaggagctcattctcaagtttgagccactcgattcagcctgctcctccaggcgctcttcaatcagcagccatgagagtttcagcattcttgactcaggcatttacaggataatctctagcaggcgcggaagccagagcgatgaggactcctgttcattgcactctcagaccctcagcgaggacgagaggtttaaggagttcacaagccagcaggaggaggatctgcccgaccagtgctgtggctctcatggcaacgaggacaacgtctcgcacgcccctgttatgtttgagactgacaagaacgagaccttcctgcctttcggaatacctttgccattccgttctccctcccctctggtttcgctccaagccgtaaaggaatccgtgagttccttcgtcaggaaaacaacagagaaaattggcacactgcacacatcccccgatctcaaggttaggccggaactcaggggggatgagcaatcttgtgaggaagacgtgtcgtccgacacttgtcccaaagaggaggatacggaagaggagaaggaggttacgtctcctccaccggaagaggacaggtttcaagagctgaaagttgccactgccgaggcaatgaccaaattgcaggatcctctggtcctctttgaaagcgaatccctccgtatggtgctacaggagtggctgtctcacctggaaaaaacattcgcaatgaaagacttctcgggggtcagcgatacagacaattcatccatgaagcttaatcaggatgttttgctggtcaacgaatccaagaaaggcatcttggatgaagataatgagaaagaaaaaagagacagcctcgggaatgaggagtccgtcgataagaccgcctgtgagtgtgtgcgatctcctcgtgagtctttagacgatcttttccagatttgttcaccttgtgcaatcgcatccggactgagaaacgatctggccgaactgaccacgttgtgccttgaattaaacgtgctgaattccaagattaagtcaacctccggacacgtcgaccatactcttcagcagtattctcctgaaatccttgcctgccaattcctgaagaaatatttcttcttactgaaccttaagcgcgctaaagaatctatcaaacttagttattctaactctccgtctgtctgggacacatttattgagggactgaaagaaatggctagctccaatcccgtctacatggaaatggagaaaggcgatttacctacaagactgaaactcttagacgatgaggtgcctttcgattctccccttcttgttgtctatgctacaagactgtatgagaagttcggcgagtcagcattgagatcgttgataaagtttttcccgagtatcctgccttcggacatcatccagctctgccatcaccaccccgcagaattcctggcatacctggatagtctagtgaagagccgccctgaggaccagcggagctcgttcctggagagtctgctgcagcctgaatccctacgtctggattggctgttattggccgtcagccttgacgctcctccaagcacttccacaatggacgacgaagggtatcccaggcctcattctcacctgctgagctgggggtactcccagctgatcttgcaccttatcaagttaccagctgatttcatcaccaaggagaaaatgaccgatatatgtagatcctgtggtttctggccgggatatttaatactttgccttgagttagagagacgaagggaagcctttaccaacatcgtatacctcaatgatatgtcactgatggaaggagacaatgggtggattccggagacagtcgaggaatggaaactgctgctgcacttaattcagtccaaaagcactaggccggctccgcaggaatcgctgaacggatctctgagcgatggaccgtcaccgatcaatgtagagaacgttgccctcctgttggctaaagccatggggcctgaccgagcctggtccctcttgcaggagtgcggtctggcgctagagctgtcggagaagttcactagaacatgcgacattttgagaatcgccgaaaaacggcagcgcgctctgatccaatcaatgctggaaaagtgtgacaggtttctgtggtcccaacaagcctag

SEQ ID NO: 225985 - DNA, 3048 bp, Artificial Sequence
  Description of Artificial Sequence: Synthetic coding sequence
atgtatgtttcaagtgagcacaaagggagacgcgttaccgctctgtgttgggacacagcaattttgcgcgtatttgtgggtgaccatgctggcaaggtgagtgcaatcaagctgaacacatccaagcaggcaaaggcagctgcagcctttgtgatgttcccagtccagaccattacaacagtggatagctgtgtcgttcagttggactacctcgacggtaggctgctgatttcctccctcacgagaagttttctgtgcgataccgaaagagagaaattttggaagattggaaacaaggagcgcgacggggagtacggagcttgcttctttcccggtcggtgtagtggcggtcagcagcctctgatttattgtgccaggcccggttctcggatgtgggaggtgaacttcgacggggaggtgatctctacccatcagttcaaaaaacttcttagcttgccacccctacccgttataaccttaaggtcggagccacagtatgaccacaccgccggatcctcccagtctttgtctttcccaaaactgctgcacctgagtgagcactgtgtccttacctggacagaaaggggaatctatatctttatacctcagaatgtgcaggtgctactgtggtcagaagtgaaagacattcaggacgtagccgtgtgtaggaacgaactgttttgtcttcacttgaatggtaaggtgtcgcatctcagtttgatcagtgttgagcgctgcgtcgagaggctactccgcagaggtctgtggaacctggccgctcgtacatgctgtctttttcaaaactcagtgattgcgagccgcgctcggaaaaccttaacggctgataaactggagcatctcaagtcccagcttgaccacgggacatataatgatctaatctctcagttggaggagctgattttgaaattcgagcctctggatagcgcttgttctagcaggcggagttcgattagttcccacgaatcatttagtatcctcgattccggcatctaccgcattattagctcccgacgaggctcccagagtgacgaagacagttgttccctccattcccagactttgtccgaggacgagagattcaaggagttcacctcacagcaggaggaagacctgcctgaccaatgctgcggaagccatggtaatgaagataatgtttctcacgctcccgttatgtttgagacggacaaaaatgaaacattcctcccctttggcatccccctgccctttaggtccccttcaccactggtctctctgcaggctgtgaaggagtcagtctcaagttttgtgcggaaaacaacagaaaagataggcaccctccacaccagcccagacctcaaagtgcggcctgaactaagaggcgacgagcaatcgtgcgaagaggatgtttcttccgatacctgtcctaaggaggaggataccgaagaggagaaagaagtcacatcccctcctccagaagaagacagattccaggagctgaaagtagccaccgcagaggcgatgacaaagttacaagatccactagtgttgttcgagtcagaaagtctcaggatggttcttcaggagtggctctcccatctggagaaaacttttgctatgaaagatttttccggcgtctccgataccgataactcaagtatgaaactcaatcaggatgtactgctggtgaatgagtctaagaaagggattctcgacgaagacaacgaaaaagagaagagagactcactgggcaatgaggaatcagtcgacaagaccgcctgtgagtgcgtgcgctcaccacgcgaatctctggacgatttgttccaaatatgctccccttgcgccatcgcaagtggactccggaacgacctggcagagctcacgaccctgtgtctggagctgaatgtactaaattccaaaatcaaatcaacaagcggtcacgtggaccatactcttcagcaatactccccggagatactggcttgccagtttctgaagaagtacttcttcctgctaaatctcaaaagagcaaaagagtctatcaagctcagctatagcaactcacctagtgtgtgggatacttttatcgagggactgaaagagatggcatctagcaatcccgtgtacatggaaatggagaaaggcgatctgcccacccgattgaagttgctggatgacgaggtcccttttgacagcccattattagtggtttacgccaccaggctctacgaaaaattcggtgaaagcgcgcttaggagccttattaaattttttccctccatcctacccagcgacattatccaactctgccatcatcacccggcagagttcttggcatatttggattctcttgtgaagtcccgtcctgaggaccaaaggagctcatttcttgagtctctgcttcagcctgaaagtctgcgacttgattggctgctgttggccgtcagccttgatgctcccccttcaacctccacaatggatgatgagggatatccgcgaccccacagccatctcctgtcatggggctattctcagcttatcttacacctcataaagctgccagctgactttattactaaggaaaaaatgacggacatctgccgttcgtgcggtttctggcccggttatctgatcctttgtctggagctggagaggagaagagaagccttcacaaacatagtgtacttgaacgatatgagtttaatggagggagacaacggctggatcccagaaactgtagaggagtggaagttgctgctgcacctcattcaatcaaagagcacccgccctgcacctcaggaatcactgaacggctccctgagtgacggacccagccccattaatgtcgaaaatgtggcgctcctccttgcgaaggcaatgggacctgatagagcatggtccctacttcaagaatgcggtttggcactggagttgagcgagaaattcaccaggacttgcgacatattgcgcatcgccgaaaaacgtcagagagctcttatccagtccatgctcgagaagtgcgaccgcttcctctggtcccagcaagcatag

SEQ ID NO: 225986 - DNA, 3048 bp, Artificial Sequence
  Description of Artificial Sequence: Synthetic coding sequence
atgtacgttagcagtgagcacaagggtcgaagagtgacagccttatgctgggatacagccatcctgagggtgttcgtcggagaccatgccggaaaggttagcgccatcaaactcaataccagtaagcaggcaaaggctgctgcagcttttgtgatgttcccagtgcagactatcacaaccgtcgacagctgcgtggtgcagctagactacctggacggtaggcttcttattagcagccttactcgtagtttcctctgcgacaccgagcgggagaagttttggaagataggcaacaaggagcgtgacggggagtacggggcttgtttttttcccggtcggtgttcaggcggacagcagccgttgatttattgtgcaaggcctggatcccgtatgtgggaggtgaatttcgacggggaagttatttccacacaccaatttaagaaactcctgtctctgcctcccctgcctgtgattacactcagaagcgagccccagtacgaccacacagcagggtcctcacagtctctgtcttttcctaaactcttacatcttagcgagcactgtgtactcacgtggacagagaggggcatttatatctttataccacagaacgtgcaagtgttgctctggagcgaggtcaaggacatccaggacgtcgcagtatgtcgaaacgagctcttctgcctccatttaaatggcaaagtgtcacacctcagcttaattagcgtggagaggtgcgtcgaacgcctgttaaggcgaggactgtggaatttggctgccaggacttgttgtttgtttcagaactctgttatagcgtctcgagcccgaaagacactaacagccgacaaactggaacacttaaagtctcaactagaccacgggacttacaacgacctcatctctcaactggaggagttaattcttaaattcgaaccactggacagcgcttgcagcagcaggcgctcatcaatatcatcccatgagagcttctcgattctggacagtgggatttatcgtatcatttcgtctcgcagaggaagccagtctgatgaggattcctgctccctccactctcagaccctgtctgaggatgagcggtttaaagaatttactagccagcaggaagaagatctcccagatcagtgctgcggcagtcatggaaatgaagataatgtctcacacgcccctgttatgtttgaaaccgataaaaatgagacatttcttccatttggcattcccctaccattccgatccccgtcacctctggtctcccttcaggccgtcaaggagtctgtatcatcgtttgttcgtaagactactgaaaagatcggaactctccatacatctcctgatctcaaggtaaggcctgagctgagaggagacgaacagtcctgtgaagaagatgtttcgtctgacacatgccccaaagaagaggatactgaagaagaaaaggaggttacgagccctcctcctgaggaggacaggttccaagaactcaaggttgctaccgctgaggcgatgactaaactacaagatcctctggttcttttcgaatccgaatctctcagaatggtccttcaggaatggctttctcacctggagaagacctttgctatgaaggatttttccggggtaagcgacaccgataatagctccatgaagttaaaccaggacgtgttgcttgtgaacgagagtaagaaagggattttagatgaagacaacgaaaaggagaagcgtgactcactgggcaacgaagagtcagtggacaagaccgcctgcgagtgcgtccggtctcctcgtgaaagcctcgatgaccttttccagatctgttctccatgcgcaatcgcatccgggctgaggaatgacttggctgaacttacaacactgtgcctggagctgaacgtgctgaacagcaaaattaaaagtacctcggggcacgtcgatcacaccttacaacaatactccccggagattctggcctgccagtttctgaaaaagtattttttcctcttaaacctgaaacgggctaaagagtcaattaagctctcctactctaactccccttctgtgtgggatacttttatcgagggcttgaaagagatggccagcagtaatccagtgtatatggaaatggagaagggcgacttgcccactaggcttaaactactggatgacgaagtgccctttgacagccctctgctggttgtgtatgcaacaaggctgtatgaaaaattcggtgagtccgctctccgtagtctgatcaagtttttcccatcaattcttccttccgacataattcaactgtgccatcaccaccctgccgagttcctagcttatcttgatagccttgttaagtcaaggccagaggaccagcgcagttccttcctcgaaagtctgctgcagcctgagtcccttcggttggattggctcttgctggccgttagtcttgatgctcctcccagcaccagcactatggacgacgaaggctaccccagaccccattcccacctcctctcgtggggttacagtcagttgatcttacatctaataaagctccctgccgactttattactaaagaaaaaatgactgacatctgtagatcatgcgggttctggccagggtacctgatcctgtgccttgagctggagagaaggagagaggcgttcaccaacatcgtgtatttaaacgatatgagcctgatggaaggagacaatggctggataccagaaacggtagaggagtggaagctcctccttcacttgattcagtctaaaagcaccagacccgctcctcaggagtcgctgaacgggagcctttcggacggcccaagtcctataaatgttgagaacgtggctctgctcttggcaaaggccatgggacctgatcgggcttggagcctcctccaagagtgtggccttgctttagaactcagcgaaaaattcaccagaacatgcgacattcttagaattgccgagaaacggcagcgagcgctgattcaatctatgctggagaagtgtgacagattcctatggagccagcaggcctag

SEQ ID NO: 225987 - DNA, 2328 bp, Artificial Sequence
  Description of Artificial Sequence: Synthetic coding sequence
atgaaaaggagtggcaccttgagattactgtcggatctgtccgcctttggtggggcagcacgacttcgcgaacttgtggcgggtgattctgccgtccgagtgcggggatcacctgatggtcgacacctcctgctgcttcgccctcccggagctgtggcaccgcagcttctggtggctagtcggggacctggcgctgagttggaacgcgcttggccggcaggccagccgtccccgcttgatgctttttttctcccatggccagcccgtcccgcattggtcctcgtgtgggagtcaggcctagctgaggtgtggggagctggcgtgggcccaggctggcgcccattgcaatcaaccgagctctgtcctggcggtggcgcacgtgttgtcgctgtggccgctctgcgcggacgccttgtctggtgcgaagagagacaagccagagctgaaggccctagcggatcacccgcagcagcattctctcattgtgtgtgcgtacgaacactggaaccctctggcgaagcttccacgagccttgggagaacccacgttcttctgcaccattgtccagctttcggtctcctcgccagctgcagacagctgttcttggttcccactgccactacttggcccggagtagcccatgtccttctgatatggagtccgggtaagggtaaagttatggtggcagctcccagacttggactctcctactcgaagtctctgaaccccggacgaggtgatacctgggattttaggacccttttacgaggacttcctgggctgctgtcccccagagaacctctggccgtgcatacatgggctccgacaccacagggactcctgcttctggacttcggcggaacagtgagtttgctgcaatctcacggtggcaccagggctgttggcactctgcaggaagctcctgtcggcccatggggcagcgccgctctcggtacttttcaaggcacacttgcttgtgtgctaggctccacactggagcttctggatatgggtagtggacagttgttagagcggaaagtgctgtcgaccgacagagtccacctgttggagccaccagcccctggcatggaggatgaggaggagctggagacgcgcggaaacctgcgccttctatctgctctgggcctgttctgtgtggggtgggaagcccctcaaggcgtcgaattgccatccgccaaggacctcgtgtttgaggaagcttgtgggtattatcagaggaggtcattacgaggcgcacagttgaccccagaggaactgcgccactctagtacgtttagagctccccaagctttggcctctatcctgcagggccacctgcccccaagtgccctgttgacaatgctccggaccgaactgcgcgattaccgcggtttggagcagctcaaagctcagctagtagctggcgatgacgaggaagcgggatggacggagctcgcagaacaggaggtcgcacgattgctgcggacggaattgattggcgatcagttggctcaactcaacaccgtgttccaggctctccctaccgccgcatggggcgcaacgctaagagccctccagctccagctcgacggcaatggaaagttaaggagtcaagcaccaccagacgtctggaagaaagtgttgggcggaatcacggccggtaaggagccacctaacggaatcctgcctcccttcgaactattgtgccagtgtctatgtcagctggagccacgctggctaccaccgtttgtagaactggcccaacaacaggggggacccggatggggagcaggaggcccaggattaccattgtataggagagccctagccgtcctcggtgaggaaggcacacggcctgaagccctggagctggaactccttctctcctcaggcagacccaaggcggtccttcaagccgtcggacaactggttcagaaggaacaatgggatcgcgctctagatgccggactggccctaggaccctcctctccactgttacggtctgagattttcaaattgttactcgctgaatttgcacagcaccgaagacttgacgcacatttgcctctcctctgtaggttgtgcccacctgagctggcccctgccgagttgctgctactcctccggacttaccttccggacgaggtgggcccaccaacgccattcccggaacccggagcagagccaccactgacagtgggcctccttaaggcgttgctggagcaaacaggggcacagggctggttaagcggaccagttctctccccgtacgaggatattctgtgggatccgtctaccccccctccaacccccccacgggatctttag

SEQ ID NO: 225988 - DNA, 1596 bp, Artificial Sequence
  Description of Artificial Sequence: Synthetic coding sequence
atgcttggctttctgagcagagggccaagtatgaagctctgtatgggcttggcgtgcgtgctgtccctctggaatactgtatcaggtatcaaaggggaagctaagaaagagaaaggtatgacttttcttccgacaacagtgagtggcctcagggaggaagaaagaaaagagaaaggagtggccttcctggcaaccacagagctgcctgcacgaagcatcgacctttcagctctcaaccttactgaattggtgaatggaatgctctccagagcactgaaagactccaaaaaatttttctcccttttgagtgtcacatcctactcgtcattcgccttccacaaattctctgtggccgtatacaatatctccaacctgaagactgtggaccccgctaaattccccacacgatactgctactgcctgaacaatcggaccaatgacctctcagattttaccgcccttttggttgatattatcggtaattcaacttcgtacttgaccgagatattcaagagcacatctatcctgagcgtgaaccagtccaatgaatccgactgtatatttatttgtgtcatgaccggtaagtctggtagaaacctatctgacttctgggagatcgaggaaaaatatcctattatcaactacactttcacctccggactctccggcgtcctgggtgccgcaacccgcggaactgctaggacctctaagcccaccacaaagtctcagaagaccctgccatccacaagtcccggacattggacacagtcaaccccttgggccagtgccctaagaagctccccctggacggaaaccgcagctccaagtgaaaccgaggagacactgaatacaggtagaccacctgagctgcctgccagagcgactgctacatggtttagcgcctcacacactttgccggctctggccacaaggcgtgtcgctagaactcagtggctgacagccgataggcagacctgggcctccatctcgtctgtaccctgggcacagacaatcagtgagaaaaagcctggcggatcattgtgggagacgcgtagctctccaccgactacggccggaactgaggaggcgatgaacaccacaagcctgctcgccccagctgcagagatcatggcgaccccaggatcaccgtctcaggctagccctacgctgggagctttcacccatggcacgcaaacgccttctcccacaaaggcaacagctcctaggtacccccagacaggcgatttgagtgcagagtggcccttcactgccggagaagagccagtcctcgtgccacggccacaccaggtttcacggtgccctcagccactctttaaggtcggtgcaatggccgcagctcccctgactttagccatccagcgcctaaacccatgcctgatggagttatgtcagttttttcagcagtgcctgtgcatgtcacagagatctcctcggactgaggacatgcgctattgcttggagtattactcttggtttttgaaaaatgcaacctatatttgccagcgggtgaagagagtctcccacagccacaccctcaaacaaaaatgcctagaaaatatctgtaaaagtgtgtag

SEQ ID NO: 225989 - DNA, 558 bp, Artificial Sequence
  Description of Artificial Sequence: Synthetic coding sequence
atgtccccctccctccaggagggagcacaattgggcgagaataaaccttccacatgtagctttagtatcgagagaatcctgggcttggatcagaagaaggactgcgtgccgctgatgaagccacaccggccatgggccgatacctgctcgtcaagcgggaaggacgggaacctgtgtcttcacgtccccaatccaccttccggcatatcatttcccagcgtagtcgaccaccccatgcccgaagagcgcgcaagtaagtacgagaactactttagcgcttcagaaaggctgtcacttaagcgcgaattgtcctggtatagagggcgacgacctcggactgccttcacgcagaaccagatcgaggttctcgaaaatgtgtttagagtcaattgctaccctggtatcgatattagggaggatttggcacagaaactgaaccttgaagaagaccgaattcaaatttggtttcagaacaggcgggcaaagctaaaacgaagtcaccgcgagagccaatttctcatggcgaaaaagaacttcaataccaatttgctggaatag

SEQ ID NO: 225990 - DNA, 324 bp, Artificial Sequence
  Description of Artificial Sequence: Synthetic coding sequence
atgtccccgtccctgcaggaaggggcacagttgggagaaaacaagccaagtacatgctcgttttccatagagagaattcttggcctcgaccagaagaaagactgcgtccctttgatgaaaccccatcggccttgggctgatacctgctcatctagcggtaaggacggaaatttgtgcctccacgtgcccaacccaccctcagggatcagcttcccgagtgttgtggaccatccaatgcctgaagagcgggcatcaaaatacgaaaactacttttcggcctcagagagattaagcctaaaacgcgagctgtcctggtaccgctag

SEQ ID NO: 225991 - DNA, 1263 bp, Artificial Sequence
  Description of Artificial Sequence: Synthetic coding sequence
atggaagttccccctcggctatctcatgtgcccccaccactctttccatcagccccagctaccctggcaagccggagcctctcccattggcgtccacggccaccacggcaattggctccacttctgcccagtctggcccctagcagcgctcgtcagggggctcgaagggcccagcggcatgtaaccgcccagcaaccatcgagactcgccggaggagcagctattaaaggagggcgtaggcgcaggccagacttattcaggaggcactttaagagttcaagcatccaacgttctgccgcagctgcagcagcaacaagaaccgcgaggcagcacccaccagccgactcttccgtgactatggaagatatgaatgaatacagcaatatagaagagtttgctgaggggagtaagataaacgcgagcaagaatcaacaggacgacggaaagatgtttattgggggactgtcttgggacacttcgaagaaagaccttaccgaatatctcagtcgcttcggcgaggtagtggattgtacaattaagaccgacccggtgaccggccgttctcgaggctttggatttgtgctgttcaaagatgccgctagcgttgataaggtccttgagttaaaggaacacaaacttgacgggaagttgattgaccccaagagggccaaggccttaaagggcaaggagccccctaagaaagtgtttgttggagggttgtcaccagatacctctgaagagcagattaaggaatatttcggcgcttttggtgagatcgagaacatagaattaccgatggataccaagaccaatgagagaaggggattctgcttcattacatacactgacgaagagcctgtgaagaaactcttagagtctcggtaccaccagataggatccggcaaatgtgagatcaaagtcgcccagccaaaagaggtctaccgccagcagcagcaacaacaaaagggcggacggggtgcagccgcaggcggaaggggaggcacacgcggacgaggaagaggacaaggccaaaactggaaccagggctttaataactactacgatcaggggtacgggaattacaattcagcttatggaggggaccagaattacagcggatatgggggatacgactacacagggtataattatggaaactacggatacggccagggctacgctgattacagcgggcagcaaagcacgtacggcaaggcctcccgcggaggaggtaaccatcagaacaactaccagccctattag

SEQ ID NO: 225992 - DNA, 735 bp, Artificial Sequence
  Description of Artificial Sequence: Synthetic coding sequence
atggaagatatgaatgaatacagtaacatagaggagttcgccgagggttccaagattaacgcatccaagaaccaacaagatgacggcaaaatgtttatcggcggtctcagttgggatacgtcaaaaaaggatctcacagagtacttatcccgctttggggaggtggtcgactgtaccataaagacagacccggtcacaggcagatcccgcggattcggctttgtcctatttaaggatgctgcctccgtggataaagtcctcgagttgaaggaacataagttggatggcaaactcatagatccaaagcgtgccaaagccctgaaaggcaaagagccccctaaaaaggtcttcgtcgggggacttagtccagacacttctgaagagcagattaaggaatatttcggagcttttggtgagatcgaaaatattgaactcccaatggacactaagaccaacgagaggcggggattctgcttcattacttacaccgatgaagagcccgtcaagaagctcttggagtcgcggtaccaccagataggcagtggaaagtgtgagattaaggtggcccaaccgaaggaagtatatcggcagcagcagcaacagcagaaagggggtcggggagcagccgcaggtggaagaggagggacacgcggtcgcggacgcggacagcagagcacgtatggtaaggcctctagaggcggagggaaccaccagaataattatcagccgtattag

SEQ ID NO: 225993 - DNA, 1263 bp, Artificial Sequence
  Description of Artificial Sequence: Synthetic coding sequence
atggaagttccaccacgcttaagccacgtccctccacctctatttccttccgctcccgctaccctggctagcagatccctgagccactggagacctcgacctcctagacagctcgctccccttcttcccagcctggctccctcttcagctaggcagggcgcacgcagagctcagcgtcatgttacggcccagcagccaagccgcctcgcgggaggagcagccattaagggcggtaggagacggagacccgacctgttcaggaggcacttcaaatcgtccagtattcaacggagcgctgccgctgccgctgcaacccgtacagcaaggcagcacccccctgcagatagcagcgtaacgatggaggatatgaacgaatactccaacatagaggagttcgctgagggctctaaaatcaacgcctccaaaaatcagcaggatgacggaaagatgttcatcggagggttgagctgggacacatcaaagaaagatctaacagagtacctgagccgattcggtgaggtggtggattgtactataaaaactgatcctgtcacaggtcggtcaagaggattcggctttgttctgtttaaggatgctgcgagcgtcgacaaagttctggagctgaaggagcataagttggatggtaaattaatcgaccctaaaagggccaaagccctgaagggaaaggaacctccgaaaaaagtgttcgtggggggtctgtcccccgatacatccgaagagcagattaaagagtattttggtgccttcggcgaaattgaaaacatagaattgccaatggacaccaagacgaatgaaaggagaggattttgtttcataacctacactgacgaagaacctgtgaagaaactgttggagagtaggtatcatcagataggctctggaaagtgcgaaattaaggtggcgcagccaaaggaagtgtatcgtcagcaacagcagcagcaaaagggaggccgaggagccgctgccggagggagaggagggacccgaggcagaggcagaggccaagggcagaactggaatcagggatttaataactactatgatcaagggtacggaaattacaacagtgcgtatggaggagaccaaaattattctggttacgggggttacgactacactgggtacaattatggtaattatgggtacgggcagggttatgccgactattctggtcagcagagcacctatggtaaagcgtcccggggtggcggtaaccaccagaacaactatcagccatactag

SEQ ID NO: 225994 - DNA, 1902 bp, Artificial Sequence
  Description of Artificial Sequence: Synthetic coding sequence
atggctaaccaggtcaatggcaacgcagtccagcttaaggaggaggaagaacccatggacacctcatccgtgactcacaccgagcactacaaaacactcatcgaggctggtctcccccaaaaagtggccgagcgactggacgagattttccagaccgggttagtggcctatgtggaccttgatgagcgcgcaatcgacgctctacgggagtttaacgaggagggcgctctaagtgtgctgcaacaattcaaggagtctgatctgagccacgtgcaaaacaaatctgcttttctctgcggcgtcatgaagacataccgacagcgagaaaagcagggctcaaaagtccaggagagcaccaagggaccagacgaggccaagataaaagcattgttagaacgcacaggatacacgcttgacgttaccaccggtcagaggaaatatggcggtccaccaccagactcagtctattctggcgtacagccgggaattggcacagaagtcttcgtaggcaaaatccccagagatctatacgaggacgaactggtcccactgttcgagaaggctggcccaatttgggacctgaggctcatgatggatcccctatcagggcagaatagagggtacgcgtttataaccttttgcgggaaggaggctgcccaggaagccgtaaagctgtgcgactcttatgagattagaccaggtaaacaccttggagtgtgtatctcagtggccaataatagactgttcgtggggtcaataccaaaaaacaagaccaaagagaatatcctagaagagttctctaaggtaacagaggggctcgtggatgtgattttataccaccagccagacgataagaagaaaaaccgaggcttctgcttcttagaatatgaggaccacaagtcagctgcgcaggctcgacgtagactcatgagcggcaaggtgaaggtctggggcaacgtggttaccgtggagtgggccgacccggtggaagagccagaccctgaggtcatggctaaggtcaaagttttgttcgttagaaatttggcgactacagtgaccgaggagattctagaaaaatcattttccgagtttggtaagctggaacgggtgaaaaaactgaaggactacgctttcgttcatttcgaggaccgaggggcagcggtgaaggcgatggacgagatgaatgggaaagagattgagggggaggagatcgagattgtgctggccaaaccccctgacaagaagcggaaggagcgccaagccgctcggcaggcgagccgaagcaccgcatatgaggactactattaccaccccccacccaggatgcctcctccaattcgtggcagaggcagagggggagggcgaggtggctacggatacccacctgactactacggatatgaggattactatgatgactattatggctacgactatcatgattaccgcggtggctacgaggatccatactatggatacgatgacggatacgccgtacgaggccgtggcggaggacgcggaggcaggggcgctccacctccccctagaggtagaggagcgccaccacccaggggacgtgctgggtattcccagagaggcgcaccacttggaccacccagaggaagtcgcggagggagggggggtcctgcgcagcagcagaggggcagaggatccagaggctcccgcggtaacagaggcggaaatgtaggtggcaaaaggaaagccgatggttataaccagccggatagtaagcgacggcagacaaacaaccaacagaactggggaagccagccgatcgcccagcagccactccagcagggcggagactacagtggtaattacggttataataatgacaaccaggagttctatcaagacacatacggacaacaatggaaatag

SEQ ID NO: 225995 - DNA, 1902 bp, Artificial Sequence
  Description of Artificial Sequence: Synthetic coding sequence
atggcaaaccaagtgaatggcaatgctgtgcagttgaaagaagaggaagaaccaatggacaccagctctgtgacacacacagaacattacaaaacgctgatcgaagctgggctcccccagaaggttgcagagagactcgatgaaatcttccagacagggctcgttgcgtatgtagatctcgacgaacgcgcaatagatgcactgcgcgagtttaacgaggaaggcgcactctccgttctgcaacagtttaaggaatctgacctctctcatgtccaaaacaagagcgcattcctttgtggagtgatgaaaacctacagacagagggaaaaacagggtagtaaagtgcaggagtcaactaaaggtcccgacgaggcgaaaattaaggcactgctggagagaacaggatacacactagatgtaaccacgggacagcggaagtatgggggacccccacctgactctgtatattctggggtccagcctgggatcggaacagaagtgtttgtcggtaaaatcccacgagacctgtacgaagatgaactcgttccccttttcgagaaagccggacccatttgggacctgcggctgatgatggacccactgtcgggccagaaccgcggatacgccttcattacattctgtggaaaggaggctgctcaagaggcagttaagttgtgcgattcatatgaaatccgacctggtaagcacttgggcgtttgcataagcgtcgccaataatcgcctgtttgtaggttcaatccctaaaaataagacaaaagagaacatcttggaggaattctctaaggtcacagaaggactggtggacgtcatcctgtaccatcagcccgatgacaagaaaaagaatcgtggcttctgctttctagagtacgaagatcacaaatcagcagctcaggccaggcgcagactgatgagtggcaaggtgaaagtttggggtaacgtggtgaccgtcgaatgggcagatcctgtagaggagcccgacccagaagttatggccaaggtgaaggtgctgtttgtgcgcaaccttgccaccactgtaaccgaagagattttagagaaaagttttagtgaattcggtaagcttgaaagagtcaagaagttgaaggactacgcctttgtacatttcgaagaccggggagcagccgtgaaggctatggacgagatgaacgggaaggagatcgagggggaggaaatcgaaattgttttggccaagcctcctgataaaaaacgaaaggaacgtcaggctgcaagacaggcctccagaagcacagcttacgaggactactattaccatcctcctcccaggatgcctccaccaatcaggggacgcggaaggggaggcggtagaggtgggtatggatatccccctgattactacggttacgaggattattatgacgactattacgggtatgactatcacgactatcggggtggctacgaggacccctactatgggtacgatgatggctacgccgtcagaggcaggggtggtgggcgaggcggacgaggtgccccacccccaccaaggggtaggggggcacctcctccgaggggcagagccggttatagtcagcggggtgcaccactggggccacctcggggtagcagaggcggtcggggaggacccgcacagcaacagcgcggaaggggctctagaggctccaggggcaaccggggaggcaatgtgggagggaagcggaaagctgacggatataaccagccagactccaagcgcagacagaccaataaccagcagaactgggggagccaacctattgcacaacagcccctgcaacaggggggagattactctggcaattacgggtataacaatgacaaccaggagttctatcaggatacgtacggtcagcaatggaaatag

SEQ ID NO: 225996 - DNA, 1911 bp, Artificial Sequence
  Description of Artificial Sequence: Synthetic coding sequence
atggctaaccaggttaacggaaatgccgtgcagctcaaggaggaggaggaacctatggacacatcttccgtcacacacacggagcactataagacactaattgaagcagggctgcctcagaaagtcgctgagcgactggatgaaatttttcagacaggcttggtcgcatatgtcgacctggatgagcgtgctattgacgccctgagagagtttaacgaggagggagccctctctgttctgcagcaattcaaggagtccgacttgagccatgtacagaacaaatctgccttcctatgtggagtgatgaaaacctatcgacagcgcgagaagcagggttctaaggtacaggaaagcactaaaggaccagacgaagctaagatcaaggcactgctagagcggaccgggtacacccttgacgttacaaccggccagcgtaagtatggcggaccgcctcctgatagtgtttactcaggtgtgcaacctggaatcggcactgaggtcttcgtcgggaaaattcccagggacctatacgaagatgagctggtaccattgttcgagaaggctggaccgatttgggatctgcgtctgatgatggaccccctgtcaggacagaatcgcggttatgcttttataacattttgtggaaaggaggcagcccaggaggccgtgaaattgtgcgactcgtacgaaatcaggccgggaaagcacctaggcgtgtgtataagcgtggcaaataatagactgtttgtgggttctatcccaaaaaacaaaactaaagaaaatattctggaggagttctccaaagtgaccggactcaccgagggtttagtcgacgtgatcttgtaccaccagccggacgacaagaagaagaatagggggttttgtttcctggagtacgaagaccacaagagtgccgcacaggccagaagaagacttatgtctggaaaagtgaaagtgtggggcaacgtggtgacagtggagtgggcagaccccgtggaggagccagatcccgaggtgatggccaaagtcaaagtgttatttgtgcgtaatttggccaccactgtcacggaagagattctcgaaaagtcattctctgagttcgggaaactggaaagagtgaagaaattaaaagactacgcatttgtgcactttgaggaccgcggtgccgcagtgaaggccatggatgaaatgaacggtaaggagatcgagggcgaggagatagagatcgtgttggcaaagccaccggataagaaacgcaaagaacgtcaagccgctcgacaagcctcccgctcgactgcctacgaggactattattatcaccctcccccaagaatgcctccacctatccgcggtagaggcaggggcggaggcaggggaggatatggttatccccctgattactacggctatgaggactactatgatgactactatggttacgactaccacgattacaggggcggttacgaagatccatactacggctacgatgatgggtatgccgtgcgaggtcgtggtgggggtcggggagggagaggagcaccaccacccccaagagggaggggtgccccacctccgagaggacgagctgggtactcacagcgtggagctccattagggccaccgagaggttctaggggtggacgagggggtcccgctcagcagcaaagaggcagagggtcacgcggatcccggggtaatcggggaggaaacgtcgggggtaaaagaaaggctgacggctacaaccagccggactcgaagaggaggcaaacaaacaaccagcaaaattggggctctcaacctatagcccagcaacccctgcagcagggaggggactattccggaaactatggttacaataatgataaccaggagttctatcaggatacctatggacaacaatggaagtag

SEQ ID NO: 225997 - DNA, 1422 bp, Artificial Sequence
  Description of Artificial Sequence: Synthetic coding sequence
atgaagacataccgccagagagaaaagcagggctccaaagtacaggaaagtaccaagggcccagatgaggccaagatcaaggctctcctggaacgcacgggatacactttggatgtgactacaggacagagaaagtacggtggcccacctcctgacagcgtgtattcaggagttcagcctggtataggcaccgagtgcgatagttatgagatacggccaggcaagcatcttggcgtgtgtatttcagtagccaacaaccgcctgtttgtcggcagtatcccaaagaacaagacgaaagagaacattctcgaagagttttccaaagtcacagaaggactggtggacgtgatactatatcatcagccggacgacaagaagaaaaaccgcggattttgttttctggaatacgaggaccacaaatccgccgctcaggctagaaggagacttatgtccggcaaagtgaaagtgtggggcaatgtggtgactgtggagtgggcagatccagtcgaagaacccgacccagaggtgatggctaaggttaaggtattgtttgtccgtaacctcgcgactacggtgaccgaggagattctcgagaaatccttcagtgagtttggtaagctcgaacgggtcaagaagctcaaagattacgcttttgtgcacttcgaagatcgaggagcagccgtgaaagcgatggacgaaatgaatggaaaggaaattgagggcgaggagattgagatagtgctagcaaagcctcccgataaaaagagaaaggagagacaagcagccaggcaggcctctagaagtactgcttacgaagactattactatcaccctccccctaggatgcctccacctattcgcggacgaggaagaggaggtggtaggggcggatacggatatccaccagactactacggctatgaagactactacgacgactactatggctacgattaccacgattaccgaggcggttacgaagacccatattatgggtacgatgatggatacgcagtaaggggaagaggcggtggtagaggtggcaggggggcacccccacctccacgcggtcgcggagcccctcccccacgagggagagctggctacagccaaaggggtgctccgcttgggcctcctcgcggaagcaggggcggtcgcggagggccagcccagcagcagaggggacgaggctcaaggggttctagagggaacagaggtggaaatgtgggaggtaagcgtaaagcagatggctacaatcagcccgactcaaagagacgccaaacaaataaccaacagaactgggggtcacaacctattgcccagcagcccctgcagcaagggggagattactccggaaattacggttacaacaatgacaatcaagagttttaccaggacacctatggccagcagtggaaatag

SEQ ID NO: 225998 - DNA, 1788 bp, Artificial Sequence
  Description of Artificial Sequence: Synthetic coding sequence
atggccaatcaggtgaacgggaacgccgtgcagctgaaagaggaggaggagcctatggatacctcaagtgtgacccacacagaacattacaagactctcattgaagcgggattaccccaaaaagtggccgaaaggctggatgagatattccaaactggtttagtcgcgtatgtggaccttgatgagcgtgcaatagatgccctccgcgagtttaatgaggaaggcgctctcagcgtgcttcaacagtttaaggagagcgacctgtcccacgtgcagaacaaatcagcatttctgtgcggtgtcatgaaaacctatcgccagcgcgagaaacaaggctcgaaagtgcaagagtcaactaaggggcctgatgaagcgaagataaaagtttttgtgggaaaaattcccagggatctgtacgaggatgagctggtccctctgtttgagaaagcagggccaatttgggacctcagacttatgatggatccgctcagtggccagaatagaggatacgcttttatcaccttctgtggaaaagaggccgcacaggaagccgtgaagctgtgcgatagttatgaaatccgcccaggcaagcacctgggggtatgtatttcagtggccaacaataggctttttgtaggctcaattcccaagaacaaaacaaaagagaatattctggaggaattttccaaagtcactgaaggtctggtggatgtaatcctgtaccaccagccggatgacaagaagaagaatagggggttctgttttcttgaatacgaggatcacaagagcgccgctcaggctcgaaggcggctcatgtccggtaaagtcaaggtgtggggaaacgtagttacagtggagtgggccgaccccgttgaggaaccagaccctgaggtcatggctaaagtcaaggtgcttttcgtgagaaatctagcaacaacagtgactgaggagattctggagaaatctttcagcgaatttggaaaactagaacgggtcaaaaagcttaaagattacgcattcgttcatttcgaggaccgaggcgctgcagtcaaggctatggacgaaatgaatgggaaagagattgagggggaagagattgagatcgtcttagctaagccccctgacaaaaagagaaaagagcgacaggcagcaagacaggcttcccgctctactgcctatgaggattattactaccatcctcccccaaggatgccccctccaatccgtggtcgcggaaggggcggaggaaggggcggttacgggtaccctcccgactattatgggtacgaagattactacgacgattattatgggtacgactaccacgactaccgcggaggctacgaagatccttattacggatatgacgatggatacgcagtgaggggcagaggaggcggtcgcggagggagaggcgcaccccctccgcctcgagggcgtggagccccaccccctcggggtagagccggttactctcagaggggggctcctttagggcctccaaggggcagcaggggcggtagaggagggcctgcccagcagcaaagaggtcgtgggagtagagggagtcgcggaaaccggggtgggaacgtgggtggcaaaagaaaggctgatggatacaaccaacccgatagtaagcgaagacaaaccaataaccagcaaaactgggggtcgcaacccatcgcacagcagcccctgcagcaggggggagattatagcggcaattacggctacaacaatgacaatcaggagttttatcaggacacatatggtcaacaatggaaatag

SEQ ID NO: 225999 - DNA, 2304 bp, Artificial Sequence
  Description of Artificial Sequence: Synthetic coding sequence
atgcgctcgtgggcgttcagctacttggatgcaatggacaacataacacgtcagaaccaattctatgacacccaggtgattaagcaggagaacgaaagcggctatgagcgaagacccctcgagatggaacagcagcaggcatacaggccggagatgaaaactgagatgaagcaaggtgctccaacctcatttctcccccctgaagcgtcccaactcaagccagatcgacagcaatttcagtcccgcaaacggccttacgaggaaaaccgcggacgtggctattttgaacaccgagaagatcggaggggccgttccccacagcccccagcagaggaagatgaggacgatttcgacgatactctggttgctattgacacgtataactgtgatctacactttaaggtggctcgcgaccggtcttcaggctatccactgaccatagaaggctttgcttacctgtggagtggtgctcgcgctagttatggagttcgtaggggcagagtgtgcttcgagatgaaaattaacgaggagatctctgtgaagcacctgccctctactgagcctgatccgcacgtagtgcgaatagggtggtctctggattcttgctcgacacagctgggagaagagccattctcatatggttacggcggtacaggtaagaagtcaacaaatagccgctttgagaactatggtgacaagtttgccgagaatgacgtgattgggtgttttgctgatttcgagtgtggtaacgacgtcgaactgagcttcacaaagaacggaaagtggatggggatcgctttcaggattcaaaaggaagctctgggcggtcaggctttgtacccccatgttctggtgaagaactgtgccgtcgagtttaacttcggccagagggcagagccctactgcagtgtacttcccggatttacgtttattcaacacttgccactctccgaacgtatccggggaacagtcggtccaaagtctaaggccgagtgtgaaatattgatgatggtaggccttcccgcagccggaaaaactacctgggctatcaagcacgccgcaagcaatccttcgaagaagtacaacattttaggcaccaatgcaatcatggataagatgcgtgtgatgggactacgtaggcagcgcaactacgctggacgctgggacgtcttgatccagcaggccacccagtgtctgaatcggctaattcagatagccgctaggaaaaagagaaactatatactggaccaaacaaacgtgtacgggtccgcacagcgcaggaagatgcggccttttgagggcttccagcgcaaggccatcgtgatttgcccaaccgatgaggacctgaaggaccggaccatcaaacgaactgatgaagagggcaaggatgtgcctgaccacgcagtcctggaaatgaaggcaaatttcacactgcccgacgtgggcgattttctggatgaagtgttgtttatcgaattgcagagagaggaggccgacaagctggtgcggcagtacaatgaagagggcaggaaggccggtcccccacctgagaagagattcgacaatcggggtggtggaggatttagaggcagggggggtggcggagggttccagaggtacgagaaccggggaccacctggaggcaaccggggtggctttcagaatcgtggaggtggctcaggcggtgggggtaattacagggggggatttaatcgatctggcggaggcggttattcacaaaacaggtggggaaacaacaatcgcgataacaataactccaataaccgaggctcttataaccgcgcaccccagcaacagccaccaccacagcagcccccacctccccagcctccacctcagcagcccccacctccgccatcctattcacccgcacggaatcccccaggggcttccacttataacaaaaatagtaacattcctggtagcagcgccaatactagtacccccacagtgagttcatactctccccctcagccctcctacagccagcccccatacaaccagggcggttattctcaaggatacactgcacctccccctccgccacctcccccacctgcatacaattacgggtcatacggcggatacaatccggctccgtataccccacccccacctcccacggcccagacgtaccctcagcccagctacaaccagtatcagcagtatgcccagcagtggaaccagtattatcagaatcagggccagtggcccccttactacgggaattatgactacgggtcttacagcgggaacacacaggggggtacctctacccaatag

SEQ ID NO: 226000 - DNA, 369 bp, Artificial Sequence
  Description of Artificial Sequence: Synthetic coding sequence
atggacgttcggaggttgaaggtgaatgagctacgcgaagaattacagcggagggggctggacacaagggggctgaaggccgagctcgccgagagactgcaggcagctttggaagccgaagaaccagatgatgagcgggaactagatgccgatgacgagccgggtagaccgggacacatcaacgaagaggcagagttacagcccgcaaccttgcaaccaggccgtctgcaacccggtctacacagccccacagccagcacaagcaccactacttgcctgcagctgtgggaattgaggcggctccaacccggtcctctatatcctacagctacgccgcactgcacagacttgccctctgcacaactgtag

SEQ ID NO: 226001 - DNA, 2271 bp, Artificial Sequence
  Description of Artificial Sequence: Synthetic coding sequence
atggacaacataaccaggcagaatcaattttatgatactcaagttatcaagcaagaaaacgaaagcgggtacgagcgacgaccacttgagatggaacaacaacaggcctataggccagagatgaaaaccgaaatgaaacagggggcacccacaagctttctaccgcctgaggcttctcaactgaaacctgaccgtcaacagttccagagcaggaaacggccttatgaagagaatagagggcgagggtattttgagcatcgcgaagaccggagaggacgatcaccccaaccgccagctgaggaagatgaggatgacttcgacgatacactggtagccatcgatacctacaattgcgacctccacttcaaggttgctcgcgataggtcaagcgggtatccactcaccattgagggtttcgcctatctctggtcaggtgcacgggcttcctacggagttaggagagggagagtgtgcttcgagatgaaaattaatgaagaaatttccgtcaagcatctcccaagtaccgagccagacccccacgtggtgaggattggctggtccttggattcctgtagtacccagctcggagaagagccgttctcatacggctacggaggaacaggcaaaaagtcgaccaactctcgctttgagaactacggggacaagttcgccgagaacgacgtaattggctgctttgcagattttgagtgcgggaacgacgtggaattgagttttacaaagaacggaaagtggatgggaattgcctttcgtattcagaaggaggccttggggggtcaggcgctgtacccccacgtcttagtaaagaattgcgccgtcgaatttaacttcggccagcgggctgagccctactgttccgtgctgcctgggttcacttttatccagcacctcccattatcagaaaggatccggggtacggtgggcccaaagtccaaggccgagtgcgagattctgatgatggttggcctgcctgcagcgggaaagactacgtgggctattaagcatgccgcatcaaatcccagtaagaagtacaatatcctgggcaccaacgctatcatggataagatgcgggtcatggggctgcgacgccaacggaactatgcgggaaggtgggacgtgctaatacagcaggccacccaatgcctgaacaggctgattcagatagcggcaagaaagaaaagaaactatatcctggatcaaacgaatgtgtatggctcggctcaaaggaggaaaatgcgcccatttgagggctttcaaaggaaggcaattgtgatttgtccgacggacgaggatctgaaagataggaccattaagagaactgacgaagaggggaaagatgtgccagatcatgccgtcctcgagatgaaagcgaattttactctgcccgacgtaggtgactttcttgatgaggtgctgttcattgaactgcagagagaggaggccgacaagctggtccggcagtataatgaggagggacgcaaggctggccctccgcctgagaaacgatttgacaaccgtggagggggagggttcaggggacgcggtggagggggaggattccagcgctacgaaaatcgtggacccccaggtggaaacaggggaggctttcagaataggggcggagggtctgggggtggcggaaactaccggggaggcttcaatcgcagcgggggaggcggatacagccaaaataggtggggtaacaataacagggacaacaataacagtaataaccgaggttcctataaccgagcacctcaacaacagccacccccacagcaacctccccctccacaacccccaccacagcaaccacctccacctccaagttactcccccgctcgcaaccctccaggagcatccacttacaataagaattcgaacatcccgggatcctccgcaaacacatcaaccccaaccgtgagttcctattcgccaccacagccttcatactcgcaaccaccatataatcagggaggctactcccaggggtatacagcacctccaccccctccccctccacctccggcatacaattacggtagctacggaggctacaatcctgccccttatacaccgccaccgccacctacagctcagacttatccccagccatcctacaaccaatatcaacagtacgcacagcaatggaaccagtattaccagaaccagggacagtggccaccctactacgggaactatgattatggtagttatagcggaaacacacagggaggaacctccacacaatag

SEQ ID NO: 226002 - DNA, 2259 bp, Artificial Sequence
  Description of Artificial Sequence: Synthetic coding sequence
atggacgtgagacggctgaaggtaaatgagctccgagaggaactgcagaggagaggactggacacccgaggcctcaaagctgagctggcagagcgactgcaaccacccccaccagggcttcagccacacgccgagccaggcggttactccggcccagatggccattacgccatggataacatcactcgccagaaccaattttacgacacacaggtgatcaaacaggagaatgagtccgggtatgaacgtaggcctctcgagatggagcaacaacaggcctataggcctgagatgaaaactgagatgaaacagggcgctcccactagcttcctacctccggaagcaagtcagctgaagccagacagacagcagtttcagtctaggaagaggccctacgaagagaatcggggtcgcggatactttgagcatcgcgaagatagacggggtagatctccacaaccccctgccgaagaagatgaagatgatttcgacgatacattggtggccatcgacacctataactgcgacctgcactttaaggtcgcgagggaccggtcctctggataccccctgactattgagggtttcgcctatctgtggtctggtgccagggcttcctatggggtgagacggggacgagtgtgttttgagatgaaagattttgaatgtggtaacgatgtggagctgagctttacaaagaatggtaagtggatgggcattgcattcagaattcagaaagaagcgctgggagggcaggcactgtaccctcatgtacttgtcaagaactgcgcagtggaatttaactttggtcagcgcgcagagccctactgtagcgtcctgccaggctttactttcattcagcatctcccattgagcgaaaggatacgtggtactgttggccctaagagcaaggccgaatgcgagatccttatgatggtaggtcttcccgcagctggaaagacaacgtgggccataaagcatgctgcatcgaatccaagcaaaaagtacaacatactgggaacaaatgccattatggacaagatgagagttatgggactgcgcaggcagcgtaattatgcgggtcgttgggacgtcctgatccaacaagccacccaatgcctcaacagattgatacagatcgcagcgagaaaaaaacggaactacattctcgatcagacaaatgtctacggcagtgcccagcgaagaaagatgagaccatttgaagggttccaacggaaggctattgtgatatgccccactgatgaggatctcaaggatcgcaccatcaagcgcaccgatgaagaagggaaagatgtacctgatcatgccgttctagaaatgaaggccaactttacactgcccgatgtgggggatttcctcgacgaagttttgttcatagaactgcaaagagaagaagctgacaaattggtccgccaatataacgaagaagggaggaaagcgggacccccacccgaaaaaagattcgacaatcggggagggggagggttcaggggaagggggggaggcggtggctttcaaaggtacgagaacagagggcctcccggaggaaacagagggggatttcaaaacagaggtggaggctcaggcggaggaggcaactaccgcggaggctttaatagaagcggagggggaggatatagccaaaatcgatggggtaataataacagagataataacaatagcaacaatcgtggctcatacaatcgggcaccacagcagcagccaccaccccagcagcccccacctccacagcctccccctcagcagcccccaccacctccatcttacagtccggctagaaatcctcccggtgcctccacatacaataagaactctaacatcccaggaagcagtgccaatacatctactcctactgtgtcgagttatagtccaccccagtcgttcggtttcttccccagcacctttcagccttcttattcgcagcccccatacaaccaaggaggttatagtcagggctatactgcccctccgcctccgcctccacctccccctgcctataattacggatcatacggcggatataatccagctccttatacccctccgcctccaccgacagcacagacctacccacaaccctcatacaaccagtaccagcagtacgcccaacaatggaaccaatactaccagaatcagggacaatggcctccatattatggaaactatgattatggcagctactcgggaaacacccagggcggaacatctacccagtag

SEQ ID NO: 226003 - DNA, 2571 bp, Artificial Sequence
  Description of Artificial Sequence: Synthetic coding sequence
atggatgtgcggaggctcaaggtgaatgaactcagggaagagctgcagagacgagggctggacactcggggtctcaaggctgaactggctgaacgactgcaggccgcactcgaagctgaggagcccgacgacgaacgggagttggacgcggacgacgaacccggtagaccaggccacattaacgaggaagttgagaccgagggaggctcggaactggagggcactgcccagccaccgcctccaggactgcagcctcatgcggaacccggtggctattctggaccagacggccactacgccatggataatatcaccaggcagaatcaattctatgatacacaggtgatcaagcaggagaatgagagtggctatgagcgacgcccactcgaaatggaacagcagcaggcatataggccagagatgaagaccgaaatgaaacagggcgcaccaacatccttcctcccacccgaggcctcacaactgaagcctgaccggcagcagttccagagtcggaaacgtccttacgaggagaaccgaggacggggatatttcgagcaccgggaggaccgcaggggccgttcgcctcagcccccagctgaggaggacgaggacgacttcgacgatacgctcgttgcaattgatacctataattgcgacttgcacttcaaggtcgccagagaccgttcctccgggtatcctttaacaattgaggggttcgcgtatctgtggagcggagctcgcgcaagttacggagtgcgtcggggaagagtctgttttgaaatgaagatcaatgaggaaattagcgtaaaacacttgccttcaaccgagcctgacccgcatgtggtgaggatcggctggtcgcttgatagttgttccacacagctaggcgaggagccctttagttatgggtatggtggcactggcaaaaagtctacaaattctcggtttgagaattacggcgacaaattcgccgagaacgatgtcatcggatgtttcgcagatttcgagtgtggaaacgacgtagagctgagttttacgaagaacgggaagtggatgggcatcgccttccggattcagaaggaagctctggggggtcaggccttatatccccatgtcctcgtcaaaaactgtgccgtggagtttaactttggtcagagagccgaaccgtactgctccgtgctgcctggatttacttttatccagcaccttcccctttccgagaggattcggggaacagtcgggccaaaaagcaaggctgagtgtgaaatcctcatgatggtgggactcccagccgcagggaaaactacttgggccattaagcatgcagccagcaacccaagcaaaaagtacaacatcctgggaaccaatgctatcatggacaagatgagggttatgggcttaaggcggcagcgcaactacgcaggcaggtgggacgttttgatccaacaagcaacccagtgtctgaaccgactcatccagatcgctgcccgtaaaaaacgcaactatatcttggatcagaccaatgtctatggaagtgcacagaggcggaaaatgcgcccttttgaggggtttcaacgaaaggccattgtcatatgcccgacagacgaagatttgaaagatagaacaataaagcgtacagacgaggagggaaaggatgtacccgaccacgccgtcctggagatgaaggctaacttcacacttcccgatgtgggagacttcttggacgaggtccttttcatcgaattacagcgggaagaagctgacaaactggtgcgccaatataacgaagaggggagaaaggcaggccctcctcctgagaagcgcttcgataataggggaggtgggggttttcgcggacgcggaggtggtggcggatttcagcggtacgaaaacaggggtccccctggcggtaacaggggtggctttcagaatcgtggcggtggttctggcggagggggaaattacagagggggatttaaccggtccggaggaggagggtacagccagaaccgctgggggaacaacaatagggacaacaacaactcaaacaacaggggatcctacaatcgtgcacctcagcagcaaccccctcctcagcagcctccacccccacagcctccacctcagcagccaccaccaccccctagttacagcccggctcggaaccccccaggcgcatccacttacaacaaaaattcaaacattccgggatcatccgcaaacacttccaccccaaccgtcagctcatactccccccctcagccaagctatagccagcccccttacaatcagggcggttacagccaaggctataccgctcccccaccaccacctcctcctccgccagcatacaactatggatcttatgggggatacaatcccgcaccatatacacctccgcctcctccgaccgctcagacttacccgcagccttcctacaaccaataccaacagtacgcccagcagtggaaccagtactatcagaaccaagggcagtggcccccttattatgggaactacgattacggttcctattcgggaaacacccagggcggaactagcacccaatag

SEQ ID NO: 226004 - DNA, 2751 bp, Artificial Sequence
  Description of Artificial Sequence: Synthetic coding sequence
atggactgcgaacactccctgtctctgccttgtcgaggagccgaggcgtgggaaataggaatcgacaagtatttatacgctatgcgcctctcagacgagaccctcattgacatcatgacccgtttccgaaaggaaatgaagaatgggctaagtcgggacttcaaccccactgcaacagtgaagatgctgcctaccttcgtccgttcgatacccgatgggtccgaaaagggggattttattgcccttgatctcggcggttcctcattcaggattctgagagtgcaggtaaatcacgagaagaatcaaaatgtgcacatggagagtgaggtttacgatacgcccgagaatattgtgcacggttccgggtcccagctgtttgatcacgtggccgagtgtctcggggatttcatggagaaacgcaagattaaggataaaaagttgcctgtcggctttaccttttcctttccgtgtcagcagagcaaaatagacgaagcgatattgatcacgtggacgaaacggtttaaagcttccggagtggagggcgcagacgtggtgaagttactgaataaagctataaaaaagcggggagattatgacgccaacatagtggctgtagtgaacgacactgttggcacaatgatgacatgcggatacgatgaccagcattgcgaggttgggcttatcattggcacaggcacaaacgcctgctacatggaggagctcagacacatagacttagttgagggagatgaaggtagaatgtgcattaataccgagtggggggcatttggtgatgatgggagcttagaggacataaggactgaattcgatcgtgagatcgaccgaggctctctcaaccctggtaagcagctcttcgagaaaatggtgagcggaatgtacctgggcgaactggtgcgcctcatcctcgtgaaaatggccaaggaaggccttctctttgaagggaggatcacgcccgaattgctgacacgcggtaagttcaacacgtcagacgtgagcgccatcgaaaagaacaaggaaggtctccacaacgctaaagagattttgacccggctgggggtggagccatcagatgacgactgtgtgtctgtccagcatgtgtgtaccattgtttctttccggagtgctaatctggtcgcagcaaccctgggagccatacttaaccgcctgagagacaataaggggactccacgtcttcgcactacagtgggggtggatggatctttatacaaaacacatcctcagtatagccgtcggttccataaaacacttagaaggctggtaccagactccgatgtgcgctttctcctgtcagaatcggggtctggtaagggggctgctatggtgactgccgtcgcctacaggctcgccgaacagcacagacagattgaggagacccttgcgcacttccacctgaccaaggatatgctgcttgaggtcaaaaaacgcatgcgagctgagatggagctcggtctgagaaagcagactcacaacaatgctgtagtcaaaatgttaccctccttcgttaggcgtaccccagatgggaccgagaatggagattttctggctctcgatttgggagggacgaatttcagagtgctccttgtcaaaattaggagtggaaagaaaagaaccgtggaaatgcataacaaaatctatgcaattccaatcgagattatgcagggcaccggcgaagaactcttcgaccacattgtgtcctgcattagtgattttctggactacatgggaataaaggggccacgtatgcccttgggattcaccttcagcttcccctgtcagcagaccagtctggacgccggaatactaatcacctggacaaagggtttcaaagccacagactgcgtgggccatgacgtcgttacattgttgcgcgacgctatcaagaggcgggaagagtttgacctggatgttgttgccgtggtcaatgataccgtcggcaccatgatgacgtgcgcgtatgaggagccgacttgcgaagtaggcttgatcgtgggcacaggctctaatgcctgttatatggaggaaatgaagaatgtagaaatggtcgaaggagaccagggccaaatgtgcattaatatggaatggggggctttcggggataatggttgcctcgatgacatccgcactcactacgaccggcttgtcgacgagtacagtctgaatgcaggcaaacaacggtatgaaaagatgatttccgggatgtacctcggagaaatcgtaagaaatatcttgatagacttcacaaagaaaggctttctgtttcgaggtcaaatttcagagactctcaagactagggggatcttcgaaacaaaatttctgtcacagattgagagcgaccgcctggccctccttcaagtgcgcgctattctccagcagctgggcctcaacagcacatgcgatgactcgatcctcgtgaaaactgtctgtggagttgtcagccgcagagctgcccaactctgcggtgccggaatggccgctgtggttgacaaaatacgagagaatagaggcctcgataggctgaacgtgacggttggagtcgatggtactctctataaactgcaccctcatttcagtagaatcatgcaccagaccgtcaaagagctgtcccccaagtgtaacgtgtcctttctgctctctgaagatggatctggtaagggggcagccctgattaccgccgtgggcgttcggttgcgcacagaagcctcgtcctag

SEQ ID NO: 226005 - DNA, 2754 bp, Artificial Sequence
  Description of Artificial Sequence: Synthetic coding sequence
atgattgccgctcaactgcttgcttactacttcacagagctgaaggatgatcaggtcaaaaagatcgataaatacctctacgccatgcgactgagtgacgagacgttaattgatattatgactcgcttcaggaaggagatgaaaaatggactcagcagagacttcaatccgacagctaccgtgaagatgctacccactttcgtgcggtccatcccagacggctcagagaagggtgacttcatcgctctggacttaggcggtagcagtttccgaatactccgcgtacaggtaaaccacgagaagaatcagaatgtgcacatggagtccgaagtgtacgatactcccgaaaacatagtgcatggttctgggagtcagctctttgatcatgtggcagaatgcctgggtgacttcatggaaaaacgtaagatcaaggacaaaaaacttccagtcggctttaccttctccttcccctgccagcagtccaagatcgatgaggctatcctaatcacatggactaagcgcttcaaagcctccggagtcgagggagcggatgtagtgaagctcctcaataaagctatcaaaaaaaggggagattatgatgctaacattgtggccgtggttaatgacaccgttggcaccatgatgacctgcggctatgacgatcagcattgtgaggtgggtctcatcattgggacaggtactaatgcatgctacatggaagagttacggcatattgaccttgttgagggagacgaaggtcgtatgtgcataaacactgagtggggagcctttggagatgatggatccctggaggatatacgcacagaatttgatagagagattgacagggggtctttaaatcccggaaagcagctgttcgaaaagatggtttccggcatgtatctaggcgaactggtgcgcttaattctggttaagatggcaaaagagggcttgttattcgaaggacgcattacccccgagttattgacgcgcggtaagtttaatacctccgacgtgtcggccatcgagaaaaataaggagggcctgcacaatgccaaagagattctcacacggctgggcgttgaacccagcgacgacgactgtgtcagcgtgcagcacgtttgtactatcgtgtcgttcaggtccgcaaatctggtcgctgctaccctgggagcaatcctcaacagactcagggataacaaaggaacacccaggcttcgcaccaccgttggagtcgacggcagtttgtacaagacacacccacagtatagtaggagatttcacaagacgctacgtcgactggtgcctgattccgacgtgcgcttcttgttaagcgaatctgggtccggcaagggggctgccatggtcacagccgttgcctacagactagcggaacagcatcggcagattgaagaaactctcgctcattttcatctcacgaaagatatgctgcttgaagtgaagaagagaatgcgcgcagagatggaactcggtctgcgtaagcagacacacaacaacgccgtcgtgaaaatgctccccagctttgttcgtcggacacctgacggcacagaaaatggagactttctcgctttagacctcgggggtaccaactttagagtgttattggtgaagattcgaagcggcaaaaaacggaccgtggagatgcacaataagatctatgcgatcccgatcgagattatgcaaggaactggggaggagctgttcgaccacatcgtatcttgcatatcagacttcctggactatatgggcatcaaggggccacgcatgccgctcggctttacattctcctttccttgccagcagacctcgctcgatgccggaatactcatcacctggacaaaaggattcaaagctaccgattgtgtcggccacgacgtggtgacactgctgcgagatgcgattaagaggcgagaagaattcgacctggatgtcgtggcagtggtcaacgacacagtaggcactatgatgacatgcgcctacgaagaaccaacttgtgaagtcggattaatagttgggactgggagcaacgcgtgctatatggaggagatgaagaacgttgagatggtggagggcgatcagggccagatgtgtatcaatatggagtggggcgcatttggggacaacggctgcctggatgatattaggacacactacgatagacttgtggacgaatatagcctgaacgcgggaaagcagcgctatgaaaaaatgatttcagggatgtatttaggagaaatcgttaggaacattctgattgacttcacaaagaaggggttcctgttcagagggcagatctccgaaactctgaagacaagggggatcttcgaaaccaagtttttatcccagatcgagtctgaccgactggctctgctacaagtgcgagccattctgcagcagctaggtctgaacagcacctgtgatgactctatcctcgtgaaaacggtctgcggcgtcgtgtctaggagggcggctcaactgtgcggagcgggaatggctgcagtcgtcgataagattcgcgagaacaggggcctcgaccggctcaacgtgaccgtgggcgttgatggcacattgtacaagctccatcctcatttttcgcgcatcatgcatcaaaccgtcaaagaacttagtccgaaatgcaatgtgtccttcttgctctctgaggacggctcaggtaaaggggctgctcttataacagccgtcggagtccgccttaggactgaagcttcatcctag

SEQ ID NO: 226006 - DNA, 2718 bp, Artificial Sequence
  Description of Artificial Sequence: Synthetic coding sequence
atggcaaagcgcgcacttcacgacttcatcgacaaatatctctatgccatgaggctgtccgacgagacactcattgatatcatgacacgcttcagaaaggagatgaagaacggcctcagccgtgacttcaacccaacagctaccgtgaagatgctgcccacatttgtccgtagtatacctgacgggtctgagaaaggcgatttcatagcccttgatctgggcggttcatcattcaggattctgcgcgttcaagtcaatcatgaaaagaaccagaacgtgcacatggagtcagaggtgtacgatactcccgagaacatcgtgcacgggtcgggatcacagctcttcgaccatgtggcggagtgtcttggggactttatggaaaaaaggaaaataaaagacaaaaagctgcccgtaggcttcacctttagcttcccttgtcagcagtcaaaaattgacgaggcaatcctcatcacttggactaaacgctttaaggcttcaggtgttgaaggagcagacgttgtcaagctgttgaacaaggcaatcaaaaagcggggagattacgatgccaacattgtagctgtggtaaacgacactgtgggcaccatgatgacttgcggctacgacgatcagcactgtgaagtcggcctcatcattggaactgggaccaatgcctgctatatggaggagctcagacacatcgaccttgtggaaggagatgagggaagaatgtgcataaacactgagtggggcgctttcggggacgatggcagcttggaagacatccgaactgaatttgatagggaaattgaccgcggatctctgaatcccggaaaacagctatttgagaaaatggtatctgggatgtacctgggggagctggtgaggttgatcctggtgaaaatggcgaaagagggtctgctgtttgaggggagaataacgccagagctgctgactagaggtaaattcaatacatctgatgtatctgccatcgaaaaaaacaaggaaggcctgcacaacgctaaagagatcctcactaggctcggggtcgaaccctcggatgatgactgcgtcagtgtgcagcacgtttgtacgattgtgtcctttagaagcgcgaacctggtcgccgcaaccctgggtgccatcctaaacagactgagggacaacaaagggacgccgaggctccgcactaccgtcggagtggacggtagcctctacaagacccacccccagtattccagacgtttccataagacccttagacggctggtccccgattccgatgtgaggtttcttctgagtgagagcggtagcggtaaaggagcggctatggtgacagctgtcgcttaccgactggccgagcagcacagacagatagaggaaacactcgcgcactttcacctgacgaaagacatgctcctggaggtgaaaaagagaatgagggcagagatggaactcggtctgaggaagcagactcataacaacgccgtggtgaagatgctgccaagttttgtaaggcgcaccccagacggcacagagaatggcgacttcctcgctctcgatctcggaggaaccaattttcgagtcctgcttgtgaaaattcgtagcggaaaaaagagaacggtggagatgcacaacaagatttacgcgattcctatcgagataatgcagggaaccggcgaggagctctttgaccacatcgtctcctgcattagcgactttctagactacatggggattaagggccctcgcatgcccttaggatttacctttagctttccttgtcaacagacttcactggacgccggtatactcatcacctggacaaagggattcaaagccaccgattgtgtgggccacgatgtcgttactctgctgcgcgatgcgatcaaacgacgagaagaattcgatctcgacgtagtcgcggtggtgaacgatactgttggcaccatgatgacctgtgcctacgaagaaccaacttgtgaagtcggcttgatagtcggcaccggctccaatgcttgttacatggaagaaatgaaaaatgtggagatggtagagggtgatcagggacagatgtgcatcaatatggagtggggggcatttggtgataatgggtgcctcgatgacattcggactcattacgatcgactggtcgatgagtacagcctgaatgctggtaaacagagatatgagaaaatgatcagtggcatgtatctcggcgaaatagtgcgcaatattctgatagacttcacaaagaagggctttttatttcggggtcaaatcagcgaaacactgaaaacccggggtatctttgaaacgaaatttttgtcacaaatcgagtccgatagactcgcccttcttcaggtgcgagcaatcctgcagcagctgggtctgaattcaacgtgcgacgactccatcctggtgaagactgtatgtggagtggtgagtcggagggccgctcagctgtgtggtgcaggtatggccgcagtggttgacaaaattcgcgagaataggggtctcgatcgattaaatgtcaccgtgggggtggacgggactctctacaagctgcatcctcatttctctaggataatgcatcagacagtgaaggaactgtcacctaaatgcaatgtctcattcttgctatccgaagacggatcgggcaaaggagcagctcttataacagcggtgggagtaagattaaggactgaagcaagttcctag

SEQ ID NO: 226007 - DNA, 2766 bp, Artificial Sequence
  Description of Artificial Sequence: Synthetic coding sequence
atgggccaaatctgtcagagagagagtgctacggccgcagaaaagcctaagctccaccttttggctgagagcgagatcgacaaatatctgtacgctatgagactgtccgacgagaccctgatcgacatcatgacccggttcaggaaggagatgaaaaatggtctcagccgagactttaatccaacggctacagttaagatgttaccaacttttgtgcgctcaatccccgacggaagcgagaagggggatttcatcgccctcgatctgggcggttcctcttttcggatcttgcgggttcaagtcaatcacgaaaaaaatcaaaacgtgcatatggagtctgaagtatatgacaccccagagaatatcgtacacggcagcggctctcagcttttcgatcacgtggcggagtgtctcggcgattttatggaaaaacgcaagattaaggataagaagctccctgttgggttcacatttagttttccatgtcagcaatcgaagatcgatgaagccatcctcataacatggactaaaaggtttaaggcatcaggcgtcgaaggtgccgatgtggtgaaactactgaacaaggcgatcaaaaaacgcggtgactatgacgcaaatatcgtcgctgtggtaaatgacacggtggggaccatgatgacctgtggatatgacgaccagcactgcgaggtcggccttattataggaacagggaccaacgcatgctatatggaagagctcaggcatatcgatctagtggagggagacgagggcagaatgtgtattaataccgagtggggagcttttggggacgacgggtccttagaagacattagaacggaatttgatcgcgagatcgaccgtggatccctaaatcctggtaagcagctctttgaaaaaatggtgtctggaatgtatctgggtgagctggttaggctgatactcgtcaagatggccaaggaaggcctgctgttcgagggcagaatcacccccgagctgctgactagggggaagtttaacacgtcggacgtgagcgcaattgagaaaaacaaggagggtctacacaatgcgaaggaaatcctcacccgcctgggagtggaacccagcgacgacgattgtgtgtccgtgcagcatgtctgtacaattgtgtccttcagaagcgctaacctggtggctgcgacactgggggctatccttaatcgccttagagacaacaaaggtacaccacgtttacgtacaacagtgggcgtagatggcagtctgtacaagactcatcctcagtactcaagaagattccacaagactctgcgaagactggtgcccgattcagacgtgcgtttcctgctgagtgaaagcggcagcggtaagggggcagccatggtcacagctgtcgcttaccggctggcagagcagcaccgccagattgaggagaccctggcacactttcacttgaccaaagatatgcttctcgaagtaaagaagcgcatgagggccgaaatggagctcggtcttcggaagcagacccacaataatgccgttgtcaagatgctgccttcttttgttcggagaacacccgatggtacagagaatggagactttctggcactggatctaggcggtaccaatttccgagtgcttctcgtgaagattcgcagcggcaaaaagagaaccgtggagatgcacaataaaatttatgctattccaatcgagattatgcagggaacaggcgaagagctctttgatcatatcgtaagctgtatatctgacttcttagattatatgggtattaagggcccaaggatgcctctggggttcacattctccttcccgtgccagcagactagtctggatgctggcattctcatcacttggactaagggcttcaaagcaacagattgcgtgggccatgacgtggtcactcttctgcgcgacgctatcaagagacgggaggagtttgatctcgatgttgtcgcggtggtcaatgatacagtgggtacaatgatgacgtgcgcgtacgaggagccaacttgcgaagtaggcctgattgtaggtacaggcagcaacgcctgctatatggaagagatgaaaaacgtggaaatggtggaaggcgaccaagggcagatgtgcatcaacatggaatggggcgctttcggggataacgggtgcttggacgatattagaactcactatgatcgcctcgtggatgagtatagcttaaacgccggaaagcaacgttacgagaagatgatatccggcatgtatctgggggagatagttcgcaatattctcatagacttcactaaaaaggggttcctgtttagaggtcaaatatctgaaaccctgaagaccaggggaatcttcgaaaccaaattcctgtcgcagatcgaatcggatcggctggctctgctgcaggtgcgggcaattttgcaacagctcgggctgaattccacctgcgacgattctatcctagttaaaacagtttgcggagtggtgtcaaggcgtgcagcccagctgtgtggggcaggcatggctgcagtggtggataaaattcgggaaaatcggggactagatagactcaatgtgactgtaggagtggacggaactctgtacaagctccacccccatttcagtcggatcatgcatcaaaccgtcaaggagctgtcccctaagtgcaatgtgagcttcctgttgagtgaagacggcagtggcaagggcgctgcacttataaccgccgtcggggtccggctaaggactgaggctagctcctag

SEQ ID NO: 226008 - DNA, 2748 bp, Artificial Sequence
  Description of Artificial Sequence: Synthetic coding sequence
atgatcgcggctcagctcttggcatactatttcaccgaactgaaggatgatcaggtcaagaaaattgataagtacctgtacgccatgcgcctctcagacgagacgctgatcgatattatgacccgctttcggaaagagatgaaaaacggactttcccgcgacttcaatccaacagccacagttaagatgctgcctacttttgtacgcagcatccccgatggctccgagaaaggagacttcattgctttggatctgggtggaagtagttttcgcatactgcgtgtccaagtgaaccacgaaaagaaccaaaacgtccacatggaaagcgaagtgtacgacacaccagagaacatagtgcacggtagtgggagtcagctcttcgatcacgttgccgagtgtttgggcgacttcatggagaagcggaaaatcaaagacaagaagctgcccgtcgggttcaccttttcattcccatgccagcagtccaaaatcgacgaagctattttgattacgtggaccaagagatttaaagcatccggagtggagggcgctgatgtggtgaaactcctgaataaagcaataaagaagagaggagattatgacgctaacatcgtcgcagtagtgaatgatactgttggtaccatgatgacctgcggctacgatgatcagcattgtgaggtcggactgatcattggaacaggcacaaatgcttgttatatggaggagctccggcacattgatctggtggagggggatgagggtaggatgtgcatcaatacagaatggggcgcatttggtgatgacggatcacttgaggatattagaactgagtttgacagggagatcgaccgaggatctctgaaccctggcaaacagctgtttgagaagatggtcagcggaatgtatttaggcgaactcgtgcgcctgatcctggttaagatggccaaggaaggcctcctgtttgaaggacgtatcaccccggagctcctgacccgtggcaagttcaacacaagtgacgtgtctgccatcgagaagaataaagagggacttcacaatgctaaagagatactgacccggctcggggtagaaccttcggatgacgactgtgtctcagtgcaacacgtgtgtaccatcgtgtctttccggtctgcaaaccttgtggcagccaccctgggagctatactgaatcggctgcgcgacaataagggcacgccaaggcttcgaactacagtcggcgtggacggtagcctatataagactcatccacagtattcacggagattccataaaactctgagacggcttgttccagatagcgatgtccgcttcctcctcagcgagagcggatccgggaagggagcagccatggtgactgccgtcgcgtatagactggcggagcagcatagacagatcgaggaaactctagcccacttccacctgaccaaggacatgctgcttgaggtgaaaaagagaatgcgtgccgagatggagctcggattgcgaaagcagacgcacaacaacgctgtagtcaagatgcttccctcattcgtccgcagaactcccgatggcaccgagaatggggatttcctcgccctcgaccttggaggcacaaactttagagtgttgctcgtcaagatacgttccggaaagaagaggacagtcgagatgcacaataagatctacgctattcctattgagataatgcaaggaactggggaagaactattcgaccacatcgtgtcgtgtatctccgactttttggactatatgggcataaaggggcctaggatgccccttggctttacattttctttcccatgccagcaaacctccctggacgccggtattctaataacatggacaaaggggttcaaagccaccgactgcgtgggacacgatgttgtgacacttctgcgtgacgcaataaagagacgggaagaatttgatctggatgtagttgctgtcgtcaacgatactgtcggcaccatgatgacatgcgcttacgaagaacccacttgcgaagtaggcttaatcgttggcacgggaagcaacgcctgctacatggaggagatgaagaacgtggagatggtcgagggcgaccagggccagatgtgcatcaacatggagtggggagcctttggcgataacggttgtcttgatgatatccgcacacattatgaccgactggttgatgagtattcccttaatgccggtaagcaaagatacgaaaaaatgatatctggcatgtatctgggcgagatcgtgcgaaacatcttaatcgactttaccaagaagggattcttgtttagaggacagatctcagaaaccctgaagacaaggggcattttcgaaacaaaatttttaagccagatcgagagcgacaggctggccctgctgcaggtccgggctatcctgcagcagctcgggctcaattctacatgtgatgacagcatattagtaaaaactgtgtgcggcgtagtgtcccggagggctgctcaactatgtggcgcagggatggccgcagttgttgataagataagggaaaacaggggcctggaccggcttaacgtaacagttggtgtggacggcacgctctataagctgcatcctcatttttcacgcattatgcatcagaccgtgaaggaactctcgccaaagtgtaatgtttcttttttgctgtcagaagatggttccggaaaaggagctgccctcatcactgcggtgggcgttagacttagaacagaggcatag

SEQ ID NO: 226009 - DNA, 345 bp, Artificial Sequence
  Description of Artificial Sequence: Synthetic coding sequence
atggctaagagagctctccacgattttatcgacaagtacctgtacgctatgcgtctgtctgacgaaacgctcatcgacatcatgacgcgcttccgaaaggaaatgaaaaacggccttagcagggacttcaatccaaccgcaaccgtgaaaatgctcccgacatttgtgagatcaatccccgacggctcagagaaaggtgacttcatcgccctggatttaggtggaagcagctttagaatcctccgcgttcaggttaatcatgagaagaaccagaacgtgcacatggagtccgaagtctatgatacacccgagaatattgttcatgggtctggatcccagctttag

SEQ ID NO: 226010 - DNA, 876 bp, Artificial Sequence
  Description of Artificial Sequence: Synthetic coding sequence
atggactgtgagcactctctgagcttgccctgtagaggagcagaagcatgggaaatcgggatagataaatacctttacgctatgcggctcagtgatgagacactcatagatattatgacacggtttaggaaagaaatgaagaacggactttctcgcgacttcaacccaaccgctacagtgaagatgctgcccactttcgtgcgcagtatccctgatggatcggagaagggcgactttatagccctggatctgggtgggtcatcttttagaattttgcgggtgcaggttaatcatgaaaaaaaccagaacgtccacatggagtcagaggtgtatgataccccagaaaatatcgtccatgggagtggtagccaactgttcgaccacgtggcagagtgtctgggggacttcatggagaaaaggaaaatcaaggacaagaagctgccagtcggcttcacattcagctttccatgtcagcagagcaagatcgacgaggctatcctaatcacctggaccaaacgtttcaaggcatcaggtgtcgaaggcgctgatgtggtgaagctcctaaataaagcaattaagaagcgtggggattatgacgccaacattgtggccgtggtgaatgacacggtgggcactatgatgacatgcggatacgacgaccagcactgcgaagtgggtctcattatcggaaccggcactaacgcatgctacatggaagaactccgccatattgatctcgtggagggggatgagggacgtatgtgcattaacacagaatggggagcctttggtgacgacggtagcctggaggacattcggacggagttcgatagagagatcgacagggggtccctgaacccaggtaagcagttgtag

SEQ ID NO: 226011 - DNA, 2859 bp, Artificial Sequence
  Description of Artificial Sequence: Synthetic coding sequence
atgggtcagatatgtcaacgagagtcacggcagggcctggctatgttgcctcggctattcctcaacccttggcgccaggtgatcctgctcccacagcctcccaaagtgctagggctgcaggcaacggctgcggagaaacccaagctacacctactggccgagagcgagatcgacaaatacctatatgccatgcggttgtcagacgagactctcatagacatcatgacacgctttcgcaaagaaatgaagaatggcttgtcacgagactttaacccaactgctactgtcaagatgctgccaactttcgttagaagcattcctgatggctcagagaaaggcgactttatagccctcgatctgggaggatcttctttccgaatcctccgagttcaggttaaccatgaaaaaaatcaaaatgtccatatggaatccgaagtttatgatacgccagaaaacatcgtacacggttctggcagccagctgttcgatcatgtagccgaatgtcttggcgattttatggaaaagcgaaagattaaggataaaaagctcccagttggattcactttctcctttccctgccagcagtcaaaaattgacgaggccatcctgatcacatggaccaagaggttcaaagcatcaggtgttgaaggcgctgatgtagtgaagctgctgaacaaagccataaagaagagaggcgattacgacgccaatatagtggcagttgtcaatgacactgttggaacaatgatgacatgcggctatgacgatcaacactgcgaggtcggcttgataatcgggaccggaacaaacgcctgctatatggaagagctaagacacatcgaccttgtagaaggagacgaggggagaatgtgcattaatacagaatggggcgctttcggcgacgacggtagcctggaggacatccgcacggagtttgaccgggaaatcgatagaggatccttaaatcctggcaaacagctctttgaaaaaatggtgtccgggatgtatttgggggagctggttcgcttaatccttgtcaaaatggctaaagaaggcctactgtttgagggacggattactcctgagctcctgaccaggggcaagtttaatacgtccgatgtgtcagccatagagaagaacaaagaagggttacataatgctaaggagatcttaactcgacttggcgtggagccgtcagatgatgattgcgtcagtgtccaacatgtgtgtaccatcgtcagttttcggtctgccaacttagtggcagcaaccctgggcgcaatcttaaaccggttgagggacaacaaggggaccccacggttgaggacaaccgtcggcgtagacggaagcctctataagacgcacccgcagtattctcggcgtttccacaagactctgcggcgactggttcccgactcagacgtacgattcttactctccgaatctgggtcaggaaaaggtgccgctatggttacagcagtggcctatcgcttggcggagcagcatagacaaatagaggaaacgctcgctcatttccaccttaccaaagacatgctgctcgaggtgaagaagcgaatgcgcgcagagatggagttgggactccgaaagcaaacccacaataacgccgttgttaagatgctcccttctttcgtcaggaggaccccagacggtaccgagaatggcgattttctggccctggaccttggaggcacgaactttcgggtcctattagttaaaatccgaagcgggaagaagcgaactgtcgaaatgcacaacaaaatatatgcaatccctatcgagataatgcaggggacaggagaagagctcttcgaccacatagtttcatgtatttcggacttcctggactatatgggcatcaagggccctagaatgcccctgggcttcacgttctccttcccatgccagcaaaccagtctcgatgcaggaatcctgatcacatggacaaaaggatttaaggctacagactgtgtgggacacgacgttgtaaccctgttgcgcgacgccatcaagagacgcgaagagtttgacctggacgtcgttgcagtggtcaacgacaccgtcggcaccatgatgacctgtgcctatgaggaacccacctgcgaggttggactcattgtaggcacaggtagtaacgcttgctatatggaagagatgaaaaatgtagaaatggtagaaggggatcaggggcagatgtgcatcaatatggagtggggggcttttggtgataacgggtgcttggacgacatacgcactcactacgacaggcttgtggatgaatactctctgaatgccggaaagcagcgctacgagaagatgatatccggtatgtatttgggtgagatcgtgaggaatatcctgatagattttacaaagaagggctttcttttccgcggacagatatctgagactcttaagacccggggaatctttgagactaagtttctgagtcagattgaatcagatcgtctggcgctgcttcaggtgagagctatcctgcaacagctaggcctgaattctacctgtgatgactccatcctggtgaagaccgtttgcggggtagtttccaggagggccgcacaactttgcggcgctggcatggccgcagttgttgataaaatccgagaaaacaggggactggaccgtttaaacgtcacagtcggagtggatggtacactgtataagctccaccctcacttcagcagaattatgcaccagaccgtgaaggagttatcgccaaagtgtaacgtgtccttcctcctgagtgaggatgggtccggcaaaggcgcagccctcattaccgctgtcggtgtgagactgagaacggaagcctccagctag

SEQ ID NO: 226012 - DNA, 420 bp, Artificial Sequence
  Description of Artificial Sequence: Synthetic coding sequence
atgggtcaaatctgccagcgcgaatccgctactgccgctgagaaaccaaaactgcaccttctagcagagtccgaaattgacaagtatttgtacgccatgcgtctctctgacgagacccttattgacataatgactcgattccgcaaagaaatgaaaaacggactctccagggacttcaatcccactgcaacagttaaaatgctacccacattcgtacgctcaattccagatggtagcgaaaagggggactttatcgctcttgatctcggcggttcttctttcagaattctgagggtccaggtcaaccatgagaaaaatcagaatgtgcacatggagagcgaggtgtatgacacgcccgagaacattgtgcacggcagtggctcacagctttttgaccatgtggccgagtgtctgggctag

SEQ ID NO: 226013 - DNA, 2754 bp, Artificial Sequence
  Description of Artificial Sequence: Synthetic coding sequence
atgatcgcatcccatctgctggcttatttctttacagaactcaatcacgatcaggtgcagaaagtggaccaatatctctaccacatgcgactgagtgatgaaactttattggaaatctctaagcggttccggaaggagatggaaaagggcctcggagccaccacccacccaaccgccgctgttaagatgctgcctacgttcgtccggtccaccccagatggcacagagcatggcgagtttctagccctcgatttgggcggtactaattttagggtgctgtgggtgaaagtgaccgataacgggctccagaaagtagaaatggaaaatcagatatacgcgatcccagaagacattatgaggggttcgggcacccaactctttgatcatattgcagagtgcctggctaacttcatggacaaactacagattaaggacaagaagttgcccctgggcttcactttttcctttccctgccaccaaacaaagctggacgaatcattcttagtcagctggacaaaaggttttaagtcatctggggttgagggtcgcgatgtggtggcattaattaggaaggctattcagagacggggagattttgacatcgatatagtggcagtggtaaatgacactgtgggcaccatgatgacttgcggatacgacgaccacaattgcgagattgggcttatagtcggcactggctccaacgcctgttatatggaagagatgagacatatcgacatggtcgaaggagacgagggcaggatgtgtattaatatggaatggggcgctttcggagacgatggaagcttgaatgatataaggacagagttcgaccaggaaattgatatggggtcgcttaatccaggcaagcagctgttcgaaaagatgatcagtggtatgtacatgggcgaattagtaagattgatcctggtgaagatggccaaggaagaactcttgttcggtgggaaactgtctcccgaactgcttaacaccggcaggtttgaaacaaaagacatcagcgacatcgaaggagagaaggacggtattaggaaagctagagaggtcctgatgcgactcggtctagaccccactcaggaggattgcgtcgccactcaccgaatctgccagatcgtctccaccagatctgcatccctctgtgccgcaacactggcggctgtacttcagcggattaaggaaaacaaaggagaggagagactgcgctccacgataggtgtggacggctcagtgtacaaaaaacatcctcatttcgccaagcgcctgcataagacagtgaggaggctggttcccggttgcgacgtgcgcttcctccgttccgaagatggctctgggaagggcgcagcaatggttacggctgtcgcttataggctcgcagaccagcatagagcaaggcagaaaactctggagcatttgcagctctcgcacgatcaattactcgaggtgaaaaggagaatgaaggtcgaaatggagaggggcttatcaaaggaaactcacgcctctgcccctgttaagatgttacctacttatgtttgcgccacacccgacgggaccgagaaaggggactttcttgctttggacttaggtggaactaacttcagggtcctgctggtcagggtcagaaacgggaagtgggggggagttgagatgcataataagatatatgctattccccaggaagtgatgcacggaacaggggatgaattatttgaccacatcgtgcagtgtattgcagattttttggagtacatgggtatgaagggagtgtcgctccctcttgggttcaccttctccttcccttgccagcagaactctctggatgagtcaatcctccttaaatggactaagggtttcaaagccagtggatgtgagggcgaagacgtggtaaccctgctgaaagaagccattcacaggcgcgaggaatttgatctggatgttgtcgcggtcgttaatgatacagtcggcactatgatgacatgcgggttcgaggacccccattgtgaggtgggtttaatagtcggtaccggatcaaacgcatgttacatggaggagatgaggaatgtcgaactagtggagggcgaagaggggagaatgtgcgtgaacatggaatggggtgcattcggggataacgggtgcctggatgattttagaaccgaattcgacgtggcggtggacgagctgagcctaaaccctggaaaacaacgctttgaaaaaatgatctcgggaatgtacctcggggaaatagtcaggaatatccttatagattttactaagcggggactgctgtttagaggcaggattagtgaacgcttgaagactagaggtatcttcgaaacgaagttcctgtcgcaaattgagtctgactgcctcgctttgctgcaggttagagctatcctgcaacacctggggttggaatcaacctgtgatgacagtataatcgttaaagaggtgtgtactgtggtagcgagaagagcggctcagttatgtggcgctggtatggctgctgtcgtcgatagaattagagagaatcggggactggatgctctcaaagtgaccgttggcgtggacggtactctatataaacttcacccgcactttgctaaagtgatgcacgagaccgtgaaggacctggcccctaagtgcgatgtgagcttcctccagtcagaagacgggtctggtaaaggagccgctctgattactgctgttgcttgccggatccgtgaagccggacagcgttag

SEQ ID NO: 226014 - DNA, 2670 bp, Artificial Sequence
  Description of Artificial Sequence: Synthetic coding sequence
atgcggctcagcgatgaaacactgctggaaattagcaaaaggttcagaaaggagatggagaagggtctcggcgctaccacacacccaaccgcggctgtgaagatgctcccgacatttgtgagatcaactccagacggaacagaacatggcgagtttctggccctagacctcggaggcactaactttagagtgctgtgggtgaaagtcaccgacaatggattgcagaaagtggagatggaaaatcagatatacgctatccccgaggacatcatgcgaggatccggcacacagctatttgatcacatagctgaatgtctggcgaacttcatggacaagctgcaaatcaaagacaaaaaactgcctctgggcttcaccttctcgttcccctgtcatcagacaaaattggacgagtcctttctggtgtcatggactaaaggctttaaatcatcaggtgtcgaaggacgcgatgtggtcgctctcatacgcaaggcaatccagcgtagaggcgactttgacattgatatcgtggcagtagttaacgataccgttgggacaatgatgacatgtggctacgacgatcataattgcgaaatcgggttaatcgtgggtaccggatccaacgcttgttacatggaggagatgcgtcacattgacatggttgagggcgatgaaggaagaatgtgtatcaatatggagtggggggctttcggagatgacggatctctgaatgatattcgcacagagtttgaccaggaaatcgacatggggtcacttaatccgggtaaacagctgtttgagaagatgatctctggtatgtatatgggagaattggtgagactcatcttagtgaagatggcaaaggaggaactgttgtttggaggtaagttgtccccggaactgcttaacaccggcagatttgagaccaaggacattagcgacatcgaaggagagaaggacggaatccgcaaggctcgcgaggtactgatgaggttgggcttagatccaacacaggaagattgtgtagctacacaccgcatctgtcagatcgtgagcacacggtccgcttctctttgcgctgcgacgcttgcagctgtgctccagcgcattaaagagaacaagggggaggagcgcttacgctccacaattggcgttgacggctccgtgtataagaaacatccccacttcgcaaagcggctgcataaaacagtgagacgccttgtgcccggatgcgacgtgcgattcttacggagcgaagacggaagtggtaaaggcgctgccatggtgactgctgtggcatatcggctggcagatcagcaccgggcaagacagaaaaccctagagcacctacaactctctcacgatcagcttttggaggtaaagcgccgtatgaaggtggagatggaacggggactgtctaaagaaacacacgccagtgcaccagtgaaaatgctgcccacatacgtatgtgccacccctgacggaacagaaaaaggtgattttctcgccctcgatctgggtggcaccaactttcgcgtcctgctggtccgggtacgcaatggtaagtgggggggtgtcgagatgcataataagatctatgccattcctcaggaagtgatgcatggcacaggcgatgagctgtttgaccacatagtccaatgcattgcggactttttggagtacatgggcatgaagggagtcagtctccccctgggctttacctttagttttccctgtcagcagaattcattggacgaatccatactattgaagtggactaagggatttaaggcgagcgggtgcgaaggagaggatgtggtcacactactgaaggaggctatccaccgccgagaggagttcgacctggacgttgtagcggtggtaaatgacactgtaggcaccatgatgacgtgcggctttgaagatcctcactgtgaggtaggactgattgtcgggactgggtcgaacgcttgttacatggaggagatgaggaacgtggagttggtggagggagaagaaggcagaatgtgcgtaaatatggagtggggggcttttggtgataacgggtgtctcgatgattttagaacagagtttgatgtggccgtggatgagctatcgctcaaccccggaaaacagcggtttgagaaaatgattagcggcatgtacttgggggagatagttcgcaacattctgattgatttcaccaagcgaggactcctgttccggggacggatttccgagaggcttaaaacccgaggaattttcgagacaaagtttttgtcccagatcgaaagtgattgcctggctttattgcaggtgcgagctatccttcagcatctagggctggaatctacctgcgatgatagtatcatcgtcaaggaagtctgtaccgttgtggcacggcgtgcagctcagctgtgcggagccggaatggcagccgttgttgatcgtatccgagaaaacagggggctggacgctctgaaggtgactgttggcgtggatgggactctgtataaactgcaccctcattttgctaaggtaatgcacgagactgtaaaagacttggctccaaagtgcgatgtttcattccttcagagtgaagatgggtcaggcaaaggagcggctcttatcaccgccgtcgcctgccggattagggaagcgggtcagcgatag

SEQ ID NO: 226015 - DNA, 2754 bp, Artificial Sequence
  Description of Artificial Sequence: Synthetic coding sequence
atgatagcgtcacacttgctggcttacttcttcacagaacttaatcatgatcaggttcagaaggtggatcagtatctgtatcatatgagactcagcgatgagaccctgctggagatttccaaaagattcagaaaggagatggaaaaaggactcggcgctacgactcaccctacagccgcagttaagatgctccccacttttgttcgatccacaccagatgggacagaacacggcgagtttctcgccctggacctgggaggtaccaactttagagtgctctgggtgaaagttacagacaatggcctgcagaaggtggagatggaaaatcagatttatgcaatcccagaggacatcatgcggggatccggcactcagctgttcgaccatatcgccgagtgcctggctaattttatggataaactccagattaaggataagaaactccctctgggctttacgttttctttcccctgccatcagactaaactggatgaaagcttcctggtgagttggaccaagggattcaagtcttctggcgtggagggtagagacgtcgtcgccctgatccgcaaagccatccagcgtcggggagattttgacatcgatattgtggccgtggtgaatgatacggtcggcacgatgatgacctgcggttatgacgatcacaattgtgaaatcggcctgatagtgggaactgggtccaacgcatgttatatggaggaaatgcggcatatcgacatggtggagggggacgagggcagaatgtgtatcaacatggaatggggtgcattcggagacgatgggtctctgaatgatattagaaccgagtttgatcaggaaatcgatatgggcagcctgaaccccggaaaacaattgttcgaaaagatgatctccggaatgtatatgggagagctcgtgaggcttattctggtgaaaatggccaaagaggaactgcttttcggcggaaaactgtctccggaactgcttaacaccggcaggtttgaaacaaaggatatttctgatattgaaggcgagaaggacggcatccgcaaagctcgggaagttttgatgcgtctgggattagatccaacacaagaggattgtgtagcaacacataggatttgtcagatcgtgtccaccaggtctgcaagcctgtgtgctgcaacccttgcagccgtactgcagcgtatcaaggagaataagggcgaggagcgccttaggtcaacgatcggggtcgacggctccgtgtataagaagcacccacattttgctaagcgactccataagaccgtaagaaggctcgttcccggatgcgatgtgcgtttccttcggtccgaggacggttctggtaagggggcagccatggtcaccgccgtggcatatagactcgccgaccagcaccgtgctcggcaaaagactttagagcatctgcagctgtcccacgatcagctgctggaagtgaaacgcaggatgaaagtggagatggaaaggggtctgagtaaggaaacccatgcatcagctcccgtgaaaatgctccctacatacgtgtgtgccacccctgatggaaccgagaaaggcgatttcttggcactggatttagggggaaccaatttcagggtgctgcttgttagagtaaggaatggaaagtggggaggcgttgagatgcataacaaaatatatgcaattccgcaggaggtgatgcatggaaccggcgatgaactctttgaccatatagtccagtgcattgctgattttcttgagtacatgggaatgaagggcgtcagtcttccattgggtttcacatttagttttccttgccaacagaattcactcgatgagtccattctgctgaaatggaccaaggggttcaaggcttctgggtgcgaaggcgaagacgtggtaaccttgctcaaggaggccattcaccgaagagaggaattcgacctcgatgtggtggcagtggtgaatgacaccgtgggaacgatgatgacctgcggcttcgaggacccgcactgtgaggttgggcttattgtgggcacgggaagcaacgcctgctacatggaagagatgagaaacgtcgaactggtggagggagaggaaggccgaatgtgcgtgaatatggaatggggcgctttcggagataacggttgccttgacgactttaggacagaatttgacgtggccgtagacgagttatcccttaaccctggcaaacagaggttcgaaaagatgatatccggaatgtaccttggtgaaatagtccggaacatactgattgattttacaaagaggggcctgcttttcagagggagaatctccgaacgactaaaaactcgcggaattttcgagacaaagttcttatcgcagattgagagtgactgtctggcattacttcaggtgagggccattctgcagcatctgggtctcgaatccacctgcgatgacagtatcattgtgaaggaggtgtgtaccgtcgtggctcggagggctgcgcagttgtgtggcgctggcatggcagcagtcgtcgataggattagagagaaccgcggtctggacgctctgaaggtgaccgtgggggtcgatggaaccctgtacaagcttcacccccattttgccaaagtcatgcatgagaccgtcaaggacctcgcccctaagtgcgacgtgtcgttcttgcagtcagaggatggcagcggtaagggcgcagccttgattaccgccgttgcttgccgcatccgcgaggccggacagcgatag

SEQ ID NO: 226016 - DNA, 2772 bp, Artificial Sequence
  Description of Artificial Sequence: Synthetic coding sequence
atggactcaataggctcaagcggcctgcgtcagggtgaagaaactctgtcctgctccgaggaggggctgccgggtccgagcgacagcagtgagctggtgcaagaatgcctgcagcagttcaaagttactagggctcagttacaacagatccaggcctcccttcttggctcaatggagcaagctttgcgaggtcaggcaagcccagcacctgccgtgcggatgctcccaacctacgtcggatcgaccccccatggaacagagcagggagacttcgtggttcttgaactgggagctactggagcctcactgcgagtgctttgggtaaccctaaccgggatcgaggggcatcgggtcgagccaaggtcgcaagagtttgtaatcccacaagaagtgatgctgggcgcaggccagcagctcttcgacttcgccgctcattgtctcagcgagttcttggatgcccagccagtcaacaagcagggcctgcagctgggtttcagtttttcattcccctgtcaccaaactgggctggatagaagcacattgatatcttggaccaaaggttttcgatgtagtggagtggaaggccaggatgtggtgcagctgttaagggatgccatcaggcgacagggggcttacaatatcgacgtggtggccgtggtcaatgacacagtaggcacaatgatgggctgtgaacccggtgtgaggccgtgtgaggttggactggtagtggatacaggcaccaatgcgtgttatatggaggaggctcggcatgtcgctgtactggatgaagaccgtgggagggtatgtgtaagtgtggagtggggcagcttctctgacgacggcgcattaggccctgtacttactacctttgatcacactcttgatcatgagagcctcaatcctggagcgcagagatttgaaaaaatgattgggggactgtacctcggggaactggtgagactggtcctggcccatcttgcaagatgtggcgtgcttttcgggggttgtacctcccccgcattgctgtcccagggctccatattgttggaacacgtcgccgagatggaggacccctcaacaggcgcagcacgggtgcacgccatcctgcaggatttagggctgagcccaggcgctagtgatgtcgagctggtgcagcacgtttgtgcggcagtctgcactagggcagcccagttgtgcgccgctgcacttgctgcagtactcagttgcctccagcatagcagagagcaacagacactgcaggtggctgtggctaccggaggcagggtgtgcgagcggcacccacgattttgcagcgtgctccaggggacagtgatgctcttagcaccggagtgtgatgtgtcactgatcccaagcgtggatggagggggaaggggtgtcgccatggtgaccgcagttgcagccagactagccgctcatcggcgactgctcgaggagacactagccccatttcggttgaatcacgaccagctggccgcagtccaggcccaaatgcgaaaagccatggccaagggtctgagaggcgaggcctcgtccctccggatgcttcctacattcgtcagggctacccccgacggctccgaacggggagatttcctggccctggaccttgggggtacgaattttcgcgttctgctggttcgcgtaacaacaggcgtccagataaccagtgagatttattccattcccgagactgtggctcagggatctggacaacagctttttgaccacatagtggactgtatcgtggacttccaacagaaacaggggctgtcaggtcagtcactgcctctgggcttcacgttctccttcccctgtcgccaactaggccttgatcagggaattttactgaattggactaagggcttcaaagcgtcggactgtgaggggcaagatgtagtgtctctgctccgcgaggctataactcgcaggcaggcggtggaattgaacgtagtagcaattgtcaacgatactgttggtaccatgatgagttgcggatatgaagaccctaggtgcgaaattggactgattgttggtaccggtaccaatgcgtgttatatggaggagctccgcaacgtggctggcgttcctggggatagtggaaggatgtgtatcaacatggagtggggggcattcggagatgacggaagcttggcaatgctgtccacccgcttcgatgcctctgtggaccaggcgtccatcaacccaggcaaacagcgatttgaaaagatgatttcggggatgtatctgggtgaaatcgtgagacacatactgctgcatctgacttccctgggggtgctgttcaggggacagcagattcagcgactccagaccagggacatttttaagaccaagtttctaagtgagatcgagtcagattccctggccctccgccaggtaagagcgattttagaagatcttggactgccccttaccagcgatgatgccctgatggtgctggaagtctgtcaggccgtaagtcagagagcagcccagctctgtggcgcaggagtcgccgcagttgttgagaagatcagagagaaccgtggactggaggaactcgcggtgtctgtgggggtggatggcaccctatataagctgcatccgagattttctagcttggttgccgcaaccgtgagagaactggcccctagatgtgtcgtgaccttcttgcagagcgaagacggatctggtaagggagctgcgttggtgacagccgtggcgtgccggctcgcccagctgacccgggtgtag

SEQ ID NO: 226017 - DNA, 1590 bp, Artificial Sequence
  Description of Artificial Sequence: Synthetic coding sequence
atgacatcttcaaggctttggttctctttattgctggccgcagcttttgctggccgagcgaccgcactctggccctggcctcagaatttccagacttcggatcagcgttacgtcctgtaccccaacaattttcaatttcagtacgacgtaagttcagccgcacagccaggatgcagtgtgctggatgaggcgttccagaggtacagggacctgctgtttgggagcggatcctggcccagaccctatctgactggcaaaagacataccctggaaaagaacgtgcttgtcgtttccgtagtgacgccaggttgcaaccagctccccaccctcgaatctgtcgagaactacacactgaccattaacgacgaccagtgtcttcttcttagcgagactgtgtggggcgcactgaggggattggaaacattcagccagttggtctggaaaagcgctgagggcactttctttatcaacaagaccgagattgaggactttccacggttcccacataggggactcttactggatactagtagacattacctgcctctcagttccatattggataccctcgacgtgatggcttacaataagcttaatgtattccactggcacttggtagacgatccctcttttccctatgaatctttcaccttcccggagctcatgaggaaggggagctacaatccagtcacacacatttacacagcccaggatgtgaaagaggttattgaatatgcacgactgcgaggaattcgtgttttggccgagttcgacacccccggacacaccctgagctgggggcctggaattccaggactgctcaccccatgttactctgggtccgaaccaagcgggacctttggaccagtgaatccttctctcaacaatacctatgaatttatgtccacctttttcctggaagtgagcagtgtgttccctgatttctacttgcacctgggcggagacgaggtggattttacttgctggaagagcaaccccgagattcaggacttcatgagaaagaagggcttcggcgaagacttcaagcagctcgagagcttttatatccagactctgctggacatcgtaagcagttacggtaagggctacgtggtgtggcaagaggtctttgacaacaaggtaaaaattcagcccgacacgattatacaggtctggagagaggatatccctgttaattacatgaaagagttggagctcgtgaccaaggcgggatttagagcacttctctccgcaccttggtacctgaaccggattagttatgggcctgactggaaagatttttacattgtggagcccctggccttcgaaggtactcctgagcaaaaagccctagtgattggaggcgaggcatgcatgtggggggagtatgttgataatacaaacctcgttcctaggctctggccacgggctggagcagtcgctgaacgcttgtggtcgaacaagctgacgagtgatctgaccttcgcatacgaaagactgagccattttcgctgtgagctccttcgcaggggtgtccaggcacagcctctgaatgttggattttgtgaacaagagttcgaacagacttag

SEQ ID NO: 226018 - DNA, 906 bp, Artificial Sequence
  Description of Artificial Sequence: Synthetic coding sequence
atgatgactagtgtgtattcaagcctgagactgtcaggcgaactgtccgaagacgtgatggcatataacaaactgaatgtctttcactggcatctcgtcgatgacccgtccttcccatacgaatctttcaccttcccagagctcatgcgcaagggctcatacaaccccgttacgcatatctatacagcgcaagacgtaaaagaggtgatcgagtacgctcgactgagaggcattcgcgtgttggccgaatttgatactcccggtcataccctctcgtggggccctgggatccctggcctgctcactccatgttacagcggatccgaaccgtccggcaccttcgggcctgtgaatcccagcctcaataacacttatgagttcatgagcacgttctttctggaggtctcttctgtttttccagacttttacctccatctcggcggagacgaggttgattttacatgctggaagagcaatcctgaaatacaggacttcatgcgtaaaaaaggctttggtgaggactttaagcagctcgaatcattctatattcagacactgctggatattgtgagttcatacggaaaggggtatgtggtttggcaggaagtgtttgacaataaagtgaaaatccagcccgatactataatccaggtgtggagagaggacatcccagttaactacatgaaagagttagagttggtgacaaaggctggcttcagggctcttctgtcagccccatggtaccttaaccgaatcagctatgggccagactggaaagacttttacatcgtggagcccctggcattcgaggggacaccggagcagaaagccctggtgatcggtggggaggcttgtatgtggggggagtacgtagacaataccaaccttgtccctcggctgtggtag

SEQ ID NO: 226019 - DNA, 507 bp, Artificial Sequence
  Description of Artificial Sequence: Synthetic coding sequence
atggcgtacaacaagctaaatgtattccactggcacctggtcgatgatcctagcttcccttacgaatctttcacctttccagaactgatgagaaagggaagctacaaccccgtcacccacatctatactgcacaggatgtgaaggaggtcatagagtacgctcggttgcggggaatacgagtgctagccgaatttgatactccgggacatacactgtcttggggcccaggaatccctgggctcctgacgccatgttatagtggatccgagcccagcggaacgtttggacctgtcaaccccagtcttaataatacttacgaattcatgtctaccttctttctggaggtgagcagtgttttcccagacttttatctgcatctgggaggcgatgaggtggactttacctgctggaagagcaatccggagatacaggattttatgcgcaagaaaggcttcggcgaggacttcaagcagctagaatctttctacatacaaacttatccttag

SEQ ID NO: 226020 - DNA, 1671 bp, Artificial Sequence
  Description of Artificial Sequence: Synthetic coding sequence
atggagctgtgcggactgggcctgccgagaccacccatgcttttagccctgttactggccaccctgctcgcggctatgctcgccctgcttacgcaggtcgcgcttgtcgtgcaggtggccgaagccgcaagggctcccagcgtgtccgcaaaacctggcccagcgctatggccgctgccacttctagttaagatgactcctaacctgttgcacctcgctcctgagaatttctacatttctcattctcccaactctaccgccggaccatcttgtacactgctagaggaagcctttcgacggtaccacgggtacatattcgggttctacaaatggcaccacgaaccggcagagtttcaggctaagacacaagtccagcaattgctcgtgtccattaccctgcaaagcgagtgcgatgcttttcccaatataagtagtgacgagtcgtataccttgcttgttaaagagcccgttgctgtattgaaagctaatcgcgtatggggagctcttcggggactggagacattcagtcagctggtctaccaggatagctatggaacattcacaatcaacgagtccaccatcattgacagtcctcggttttctcatcgcggaattctgatcgatacgagtagacattacctacccgtcaagatcatcttaaagaccctggacgccatggccttcaataagtttaatgtcctgcactggcacatagtcgatgaccaatcttttccataccagagtataacctttcctgaactgtccaataagggcagttattctctgagccacgtgtacaccccaaacgacgtgaggatggtgatcgagtacgctcggctccgcggaatcagagttctgccagaatttgacactcctggtcacactctctcatgggggaagggccaaaaggatctgctgactccttgttattctcgccagaataaacttgactctttcgggcctatcaaccccacgctgaataccacgtactcttttctgactacctttttcaaggaaatatccgaggtctttcccgaccagttcatccacctgggaggcgacgaggtggagttcaagtgttgggagagcaatcctaagatccaggactttatgcgacaaaaaggattcgggaccgattttaaaaagcttgagtcattctatatccagaaagtgctagacatcatcgcgaccatcaacaaaggcagcatcgtatggcaggaggtgtttgatgataaggctaaactcgcacccggaacaatcgttgaagtgtggaaagactccgcgtaccccgaggaactgtctcgggtgactgcttccggatttcccgtgatcttgtccgctccatggtacctagatttgatcagctatggccaggactggcgaaaatactataaagttgagcctctcgattttggtggcactcagaagcagaagcagctgtttatcggcggtgaggcctgtctttggggcgagtacgttgacgcgacaaacctcacacctagactgtggcccagggcgtccgcagttggagaaaggttgtggtcatctaaagatgttagagacatggacgatgcatatgacagactgactcggcaccgctgtcggatggtcgagagaggaatagccgcacagcctctttacgccggatattgcaatcacgaaaatatgtag

SEQ ID NO: 226021 - DNA, 996 bp, Artificial Sequence
  Description of Artificial Sequence: Synthetic coding sequence
atggccttcaataaatttaatgttcttcactggcacatcgtcgatgaccagagtttcccttaccagtccatcactttccccgaactgtctaacaaaggttcatacagtctgtcccatgtgtataccccaaatgacgtgaggatggttatagaatacgctcgtcttagaggtattagagtgctgccagagttcgacactccgggtcataccctttcatggggtaaggggcagaaagatcttttgaccccctgctatagtaggcagaataagttggattcatttggaccaataaatccaacgctaaacaccacatacagtttcctgaccacttttttcaaagaaatttctgaggtgttcccagaccaattcatccatctgggaggtgatgaggtggaattcaagtgctgggagagtaaccccaagattcaagacttcatgaggcagaaggggttcggaacagatttcaagaagctcgaatccttctatattcaaaaggtactggatattatcgccactattaacaagggctctatcgtctggcaggaagttttcgacgataaggccaagctggctcccggaacgatcgttgaggtttggaaggactctgcgtatcctgaggagctctcacgagttaccgccagtggattcccagtcatcctgagcgctccttggtaccttgacctgattagctatggccaggattggcggaaatattacaaagtggagccactggacttcggcggtacgcagaaacagaagcaattattcattggtggtgaagcctgcctgtggggagagtacgttgatgcaacgaatctaactccacgactatggcctagggcctccgcagtgggagagaggctttggtctagcaaagacgtgagggacatggacgacgcttacgaccgccttaccagacaccgatgcagaatggtggagagagggatagccgctcaacccctgtacgcgggttattgcaatcacgagaacatgtag

SEQ ID NO: 226022 - DNA, 2376 bp, Artificial Sequence
  Description of Artificial Sequence: Synthetic coding sequence
atgtggaatatgctgattgttgccatgtgcttggcgctgctcggctgtctgcaggcccaagaactgcagggacatgtctctatcattctgctgggagccacaggggacctggcaaagaaatacctctggcagggcctctttcagctttacctggatgaggccggaagaggccacagtttctcattccacggggcagctcttacagccccaaagcagggacaagaactgatggcgaaggctctcgagtccctaagctgcccaaaggatatggccccatcccattgtgctgagcacaaagatcagttcctccagctgagccaataccgtcaactcaagactgctgaagactatcaagccctgaataaggatatagaggcccagttacagcatgcgggactccgagaggccggacggattttctacttctctgtcccaccctttgcttacgaagacattgccaggaatattaactcttcctgccgcccaggcccaggcgcttggctgagagttgtgcttgagaagcccttcggtcatgatcactttagcgcgcagcaactggctaccgagctgggaaccttcttccaagaagaggagatgtatagggtggaccattatttgggaaaacaggcggttgctcaaatactgccattccgtgaccagaaccggaaagccttggacggtctttggaatcgccaccatgtagaacgtgtggagattatcatgaaggaaactgtcgatgctgaagggaggaccagcttctatgaagagtacggtgtcattagagacgtccttcagaatcatctcaccgaggttctgaccttagtggctatggaactcccccacaatgtgagtagtgcagaggccgtgctccggcataaattacaagttttccaggctctgcggggactgcagcggggttccgcggttgtcggacaatatcagtcttattccgaacaagttagacgggaactgcagaagcctgactcatttcattccttgaccccgacctttgcggcagtgttggtccatatcgacaacctgagatgggagggggtgcctttcattctgatgagcgggaaggctctggacgaacgggtgggctacgcgaggattctgttcaagaaccaagcatgctgcgtgcagtcagagaaacactgggcagccgctcagtcacagtgcctgcccaggcagctcgtcttccacataggccatggcgatttgggatcaccagcagttctggtgagcaggaatttgttccgtccatctttacccagctcatggaaagaaatggaaggtcccccagggctgaggttgttcgggtcgccactctctgactattacgcatacagccctgtgagggaacgcgacgctcatagtgtgctgctgagccacattttccacggtagaaaaaattttttcatcaccactgagaacctgctagcttcctggaatttttggactccactgttagagagcttagcacacaaagcgccaaggctgtaccccggtggagccgaaaacggcagactgttagatttcgagttctcaagtggtcgactcttcttctcccagcagcaaccagagcaacttgtgccaggccctggtcccgcacctatgccctctgacttccaggtgctaagggccaaataccgcgagtcccccctagtctccgcctggagcgaagaactcatcagcaagctggccaacgatatcgaggcaacggctgtccgggcagtgagaagattcggtcagttccacctggccctctcaggagggtcttcccccgtggcactgttccagcagctggcaactgcccactatgggttcccgtgggcccacacccacctttggttagtggatgagagatgtgttccgctgtccgaccctgaaagtaattttcaggggctccaggcccacctccttcagcacgtacgcattccatactacaacatccacccaatgcctgtccatttacaacagcgcctgtgtgccgaggaggatcaaggagcacagatttatgccagggagatatccgcgctagtggccaattcttccttcgacttagtgctccttggtatgggcgctgatgggcacacggcttcactgttcccacagagcccaaccgggctggacggagaacagctagtggtcctgacaacgtcccctagccagcctcaccgccgaatgtcactgtctctgcctctcatcaaccgtgccaagaaagttgctgtgctggtgatgggtcgcatgaagcgggaaattactacacttgtgtcccgcgttggtcatgagcccaagaagtggcctatctctggagtgctgccccattccggtcagctggtgtggtacatggattacgacgcttttttgggctag

SEQ ID NO: 226023 - DNA, 1968 bp, Artificial Sequence
  Description of Artificial Sequence: Synthetic coding sequence
atggggaggtgggcgtgggttccttcaccgtggccgccaccagggctcggcccattcctgttactgcttctgctgctcctgctcctgcctcgtggatttcaaccgcaaccagggggaaacaggactgagagtcctgagccaaacgcgactgctacccccgctatccctaccatcctcgtgacatcagtgactagtgaaacacctgccacttccgcaccggaggccgagggaccccagtccggtggcctacctcctccaccgcgagccgtcccgtcatcaagttctccccaggcacaggctctaaccgaggacggcagaccatgtcggttcccattccgatacgggggacgcatgcttcacgcatgtacatccgaggggtccgcacatagaaagtggtgtgctacaacacacaactatgatcgcgacagggcctggggctactgcgtggaagccaccccccctcctggcggaccagcagcccttgacccctgtgcctctggaccctgcctgaatggaggctcatgctccaatacccaagatccccagagctatcactgtagctgtcctagagcttttacaggcaaagactgcggaaccgaaaagtgtttcgacgaaacccgctacgaatacctggaagggggagaccggtgggccagggtgcgacaggggcatgtggaacagtgtgaatgcttcggtgggcgaacctggtgtgaaggcaccagacacaccgcatgcctgtcctcaccttgtctgaatggtggcacctgccacctgattgttgctactggcaccactgtctgtgcatgcccccctgggtttgcaggcaggttgtgtaacattgagcccgatgagagatgctttttgggtaacggcacagggtacagaggcgtggccagtacaagcgctagcgggctctcctgcttggcctggaactccgatcttttatatcaagaactgcacgtcgattctgtcggagccgctgcactattaggactcggccctcatgcctattgccgaaaccctgataatgacgaacggccttggtgctacgtggtgaaggactctgcgctgtcgtgggaatactgcaggctcgaggcctgcgaaagcctgacaagagttcaactcagccccgacctccttgcaacgctgcctgagccagcctctcctggacgccaagcctgtgggagaagacacaaaaagagaactttcctgaggcctagaatcattggagggagcagttcactgcccggatcccacccttggctggcagccatttacatcggtgatagcttctgcgcgggtagccttgtgcatacgtgttgggtcgtaagcgcagcacactgtttttcgcacagcccccctcgcgactccgttagcgtggttctaggccaacattttttcaatcgcactacagacgtcacccagacttttggaatcgaaaagtatattccctacactctgtattccgtcttcaatccttcagatcacgatttggtgctgattcgtttgaaaaagaagggggacaggtgcgccacacgcagccagtttgttcagccaatatgccttccagagccgggaagcactttcccagctggccataagtgccagatagccggttggggccatttggacgaaaacgtgagcggttatagctcatctctacgcgaggccctggtccccctggtcgccgatcacaagtgtagttctcccgaagtgtatggtgcggacattagcccaaacatgctctgcgctggttatttcgactgcaaaagcgacgcctgtcagggagattccggtggccctctggcttgcgaaaagaatggtgttgcctacctctacggaattatcagttggggagacggatgcggcagactgcacaagccgggagtatatactagggtggcaaactacgttgactggatcaacgatcgtattcgccctccgaggagattggtggctccctcatag

SEQ ID NO: 226024 - DNA, 3807 bp, Artificial Sequence
  Description of Artificial Sequence: Synthetic coding sequence
atgtcatccgtggccgtccttacgcaagagtccttcgctgaacaccgtagcggcctggttccacagcagattaaggttgccaccttgaattctgaagaagagtctgacccaccgacttataaagatgcatttccaccgcttcccgaaaaggccgcttgcctcgagagcgcgcaggaaccaagtggcgcatggggcaacaagatacgccctataaaggcatctgtgatcacccaggtgtttcatgtcccgcttgaggagcggaagtataaggacatgaaccaattcggcgaaggggagcaggctaaaatatgtctcgagattatgcagcggaccggagcacacttggagctttcactcgctaaagatcagggactgagcatcatggtcagcgggaaacttgacgctgtcatgaaagcgcgaaaagacattgtggctcgtctgcagacccaggcctcggcaacggtggctatcccgaaagaacatcatcggttcgttatcggtaaaaacggggaaaagcttcaagacctggagctgaagacggccaccaaaatccagatccccaggccggatgacccttcaaaccagattaaaattactgggaccaaagaaggcattgaaaaagctcgacacgaagtgctcttgatttcagcagagcaggacaagagagctgtagagcgcctggaagtcgagaaagcgttccacccgtttatcgctggaccttataaccggctggtcggagagattatgcaggagacgggaacacggatcaacataccccctcctagcgttaatcgaacagagattgtcttcaccggcgaaaaagagcagcttgctcaggcagtggcacgcataaagaagatatacgaagagaagaagaagaagacaactaccattgctgtggaagttaagaaaagccaacataaatacgttatagggccaaaaggcaactctctccaggagattcttgagagaaccggggtaagtgtggagatccctcctagcgatagtatatctgagactgtcatactccgcggagagcctgagaaattaggccaggcacttaccgaagtgtacgctaaggcaaatagttttacagtgagtagcgtggccgcaccatcatggcttcataggtttatcattggaaaaaaggggcagaacctagccaagatcacccagcagatgcctaaggtgcacatcgaatttacagaaggcgaagataagattacgctagaagggcctactgaagatgtcaatgtggctcaggaacagatcgagggcatggtgaaggacttgatcaaccggatggactatgtcgaaatcaacattgaccataaatttcataggcacctgattggaaaatcaggcgcaaatataaaccgaattaaggatcagtacaaagttagtgtacgaatcccccctgatagcgagaagagcaatttgatcagaatcgaaggagatccacagggcgtccagcaggctaaaagagagcttttggagctggcctcacgcatggaaaatgagcggacaaaagacttgataatcgagcagcggttccacagaaccatcattggccagaagggagagcggatacgtgagattcgagacaaatttcctgaagtgattattaacttccctgacccggctcaaaagtccgacattgtgcagttgagaggcccaaagaacgaagtggagaaatgcacaaagtatatgcagaaaatggtggctgacctagtagagaactcatattcaatatccgtcccaatttttaagcaattccacaagaacattatcggaaaaggcggtgccaacatcaaaaagattagggaagaatcaaatacaaaaatcgacctgcctgccgaaaactccaacagtgagactataatcatcaccgggaaaagggccaattgcgaggctgccagaagcaggatcctgagcattcagaaagacctagccaatatcgccgaggtcgaggtctccataccagcaaaactccacaacagtctgatagggaccaagggtcgcttgattcgctcaattatggaagagtgcggaggagtacatatacatttccccgtcgaaggatccggctctgataccgtggtcataaggggcccttcgagtgacgtggaaaaggccaaaaaacagctcctacacttagctgaagaaaagcagaccaagtctttcacggtagatattagagccaagcccgaataccataagtttctgataggcaaaggcggaggcaagatcagaaaagttagggacagcaccggagcaagagtcattttcccagccgcagaagacaaagaccaggacctgatcactatcatcggaaaggaggatgctgtccgcgaagcacagaaggaattggaagccctgatacagaatcttgataacgtcgtggaagactctatgctggtggacccaaaacaccatcgacacttcgtgataagaagaggccaggtgctccgcgagatcgcagaggagtatgggggagttatggtgtcattccctcgaagtggtacccagagcgacaaagtaaccctcaagggcgctaaagactgtgtcgaggccgcaaagaagcgtatccaagagatcatcgaggatttagaggcccaggttacactagaatgcgccatcccccaaaagttccatcgtagcgtgatgggcccaaaaggaagccggatccaacagatcactcgcgattttagcgtgcagatcaaatttcctgatcgagaggaaaatgcagtgcacagtaccgagccagtcgtacaggaaaatggggacgaggccggagagggccgtgaagctaaagactgcgaccccggaagtccacggaggtgtgatattatcatcatcagtggacggaaagaaaagtgtgaggcagctaaagaagccttagaagctctggttcccgtcaccatcgaggttgaagtcccatttgacctccaccggtacgtcattgggcagaagggctctggcatcaggaaaatgatggacgaatttgaggtgaatatccatgttccggctcctgaattacaaagcgacataatagccatcactggcctggccgctaatctcgatcgcgcaaaggccggtctgctggaacgtgtgaaggagctgcaggcagaacaggaagatcgggcactccggagctttaagttgagcgtaaccgtggatcctaagtaccatcccaaaatcataggaaggaaaggcgcagttataacccaaatcaggttagaacacgatgtgaacatacagttccccgacaaggatgacggtaatcaaccccaagaccagattaccatcactggttacgaaaaaaatacagaagccgctagggatgccattctgaggattgtgggggagctggagcagatggtgtctgaggacgttcctctcgaccatcgggtgcacgcacgaatcattggcgctcggggaaaggcgattaggaagatcatggacgagttcaaagtagacatccgctttccccaatcaggcgcacctgatcccaactgtgtgacggtgaccggcctgcccgaaaatgttgaggaggcgatcgatcatatcctgaacctcgaggaggagtaccttgccgatgtggtggacagtgaagccctccaggtttacatgaagccaccagctcatgaagaagcgaaagcaccttcaagggggtttgttgtgcgtgacgccccatggaccgcttcgtcgagcgagaaggcccctgatatgtcatcttccgaagaatttccatctttcggggctcaggtagctccaaagactttaccctggggccctaagaggtag

SEQ ID NO: 226025 - DNA, 3807 bp, Artificial Sequence
  Description of Artificial Sequence: Synthetic coding sequence
atgagcagtgtcgccgtcctcacacaggaaagctttgctgagcatcggtcgggcctcgtgccgcagcagattaaagtggcaaccttgaattcagaggaagagtcagatccccctacgtacaaagacgcattccctccactccccgagaaagctgcttgcctggagtctgcacaagaaccaagcggagcatgggggaacaaaatccgacccattaaagcttccgtgatcacccaggtgttccatgtcccactggaggagagaaagtataaggacatgaaccagttcggagagggtgagcaggcgaagatctgtctggagatcatgcaacggacaggcgctcatcttgagctgagtcttgcaaaagatcagggcctcagtatcatggttagcggaaagctggatgcagtgatgaaagcacgaaaggacatcgtggccaggttgcaaacccaagcttctgctacagttgctattccaaaagagcaccaccggttcgtcatcggaaagaatggagagaaactgcaggatctcgagctcaagacagccacaaagattcagataccgcgtcccgatgatccatccaaccagataaagatcacagggactaaagagggcatcgaaaaggctagacacgaggtgctgctgatttcagctgaacaagacaaaagggccgtggagagattggaagttgaaaaggcattccacccgtttatcgcaggtccctacaaccgcctggtgggtgagataatgcaggagactggcacgcggatcaatatcccccctccttccgttaaccggaccgagattgtgtttaccggagaaaaagagcaactggcccaggccgtcgccaggatcaagaaaatttatgaagagaaaaaaaaaaagactaccacaatcgcagtcgaagtcaaaaagtcccagcataaatatgtaatcggaccaaaaggcaattcactccaggaaatactggagagaacaggtgtctccgtggagatccccccaagcgatagcatttccgaaacagtgattctgagaggggagcccgaaaagctcggccaagcccttacagaggtttatgccaaagcgaattctttcaccgtaagcagcgtggccgcaccatcttggcttcataggttcattatcgggaagaagggacagaatctggctaaaatcacgcaacagatgcctaaagtacacattgaatttaccgagggcgaagataagatcactctggagggacccaccgaagatgtgaacgttgcacaggagcagatcgagggcatggtcaaggatctcatcaacagaatggattatgttgagataaatatcgaccataagttccacagacacttgatcggaaaatccggcgctaacattaacaggatcaaagaccagtataaggtgagcgtccggatcccccctgattctgaaaaaagtaatctcattcggatcgaaggggacccccagggcgtacagcaggctaagagggagctgctggagttggcctctcgcatggagaacgagcggactaaagacctgatcattgagcaaagatttcatagaactataatcggacaaaagggagagcgcattcgcgagatcagagacaaatttccggaggtgattattaatttccctgaccctgcccagaaatcagacattgttcagctgcgcggacctaagaatgaggtggaaaagtgcactaagtatatgcagaaaatggtggcggacctcgttgaaaattcctattcgatttcagtgcccatatttaagcagtttcataaaaatataattggcaagggtggcgctaatattaagaagatcagggaggaaagcaataccaagatcgacttacccgctgaaaacagcaactcagagaccattataataactggaaagagagctaattgcgaggccgctcgcagcagaatactgtccatacaaaaggatctagcaaatatcgctgaggtagaagtttccattcccgctaagcttcataacagtttaatcggtaccaagggacggcttatcagaagcattatggaagagtgcggaggggtgcatattcattttcctgttgaagggtccggttctgatacggtcgtgattcgaggcccatccagcgacgtggaaaaagcaaagaaacagctgctgcatttggctgaagagaaacagactaagtcgttcacagtggacataagggccaagccggagtaccataaatttctgataggtaaaggcggtggaaagataaggaaagtcagggactcaactggagctcgtgttattttccccgctgccgaggacaaggaccaagacctcatcacaatcatcgggaaagaggatgcagtgagggaagcgcagaaggagctcgaggccctcatacagaaccttgacaatgtggttgaggatagtatgctggtggaccccaagcaccatcggcacttcgtgatccgcaggggtcaagtcctcagggagattgccgaggagtatggtggagtgatggtgtcattcccacgcagcgggacccagtcagacaaagtgactcttaagggcgcaaaggattgcgtggaggccgctaagaagcgcatccaagagataattgaggatctggaggcccaagtgacattagaatgtgccatcccccagaagttccaccggagtgtaatggggcctaagggatcccgcatccaacagattaccagagatttttccgtgcagatcaagtttcccgaccgggaagagaacgcagtgcattccacagagcccgtcgtgcaggaaaacggggatgaagccggtgagggacgcgaggccaaagactgcgaccctggcagcccacggaggtgcgacattattattatatcgggcagaaaggaaaagtgcgaggcagctaaggaagcacttgaggcgctcgtgccagtgacgattgaagtagaagtgccgttcgacctgcaccgctatgttataggccagaaggggagtggtataaggaaaatgatggacgagtttgaagtcaacatccatgtccctgctccggaactccagtcagacatcatcgctatcactggactggccgctaacctggatcgggcaaaggcgggactcctcgagcgagtaaaagaactacaggccgagcaagaggacagggcccttaggtctttcaaactttctgtcacagttgatccaaaatatcatccgaaaattattgggaggaagggggcagttattacacagattagactagaacatgatgttaatattcaattccctgataaagatgatggcaaccagccccaagatcagataacaatcacgggttatgaaaaaaatacagaggcagcgcgtgatgctatccttagaatcgtgggagagctggagcagatggtttctgaagacgtccctctggatcacagagtccacgccaggataataggggctcgcggaaaagctattagaaagataatggatgaattcaaggtcgacattcgattccctcagtccggagcccctgatcccaactgcgtgaccgttacagggttgcctgagaatgtcgaggaggctatagaccatatactgaatcttgaagaggaatacctggccgacgtggtggacagtgaagccctgcaggtttacatgaaaccacccgctcacgaggaggctaaggccccatccagagggtttgtcgtgagggacgccccatggaccgcaagttcatccgagaaagccccagacatgtccagctcagaagagtttccctcatttggagcccaggtggctcccaagactttgccttggggacctaaacgttag

SEQ ID NO: 226026 - DNA, 3807 bp, Artificial Sequence
  Description of Artificial Sequence: Synthetic coding sequence
atgtctagcgtggcagtgctcacccaggagtctttcgcagaacataggtccggtctggtgccccaacagattaaagtggctacccttaactctgaagaagagtccgacccaccaacctataaggatgcattccctcctttaccagagaaagctgcttgcctcgagtccgcacaggagccttcaggggcatgggggaacaagattcggcctatcaaggcatcagtgattacacaggtctttcacgtccctttggaagaaagaaagtacaaggatatgaatcagttcggtgagggggaacaggcaaaaatctgtttggagattatgcagaggacaggggctcatctcgagctgagcttggccaaggaccagggattgtccattatggtctctgggaaactggatgcagtgatgaaggcacgcaaagacatagttgctcgactgcagactcaagcaagtgcgactgtcgctattcccaaggaacatcatcggtttgttatcggtaagaacggagagaagctccaggacctggaactcaagacagccacaaagatccagatacccaggcctgacgatccaagcaaccagatcaagattaccggaaccaaagagggtatcgagaaagccaggcacgaagtgctcttaatctctgcggaacaggataagcgggctgtggaacgtctcgaggtcgaaaaagcgtttcacccatttatcgctggtccttacaatcggctggtgggtgagatcatgcaggagacggggacccggattaacatccccccaccatccgtgaaccgcaccgaaattgtgttcaccggagagaaggagcagctggctcaagcggtggcccgaattaaaaagatctacgaggagaagaaaaaaaagaccacaaccatagccgtcgaagttaagaagtcccaacacaagtacgtgattggtccaaaaggtaatagcctgcaagagatcctcgagcgcacgggagtctctgttgagatccccccaagtgatagcatttccgagaccgtgatcctccggggtgagcctgaaaaactgggccaggcactgaccgaggtctatgccaaggccaactcattcacagtgtcatcagtagccgcaccatcctggcttcaccgcttcataattggcaagaagggccaaaacctggccaagataacccagcaaatgcctaaggttcacatcgagtttacagagggcgaagacaagataactctggaaggccctacagaagacgtgaatgtggctcaggagcagatagaggggatggtaaaagacctaattaacaggatggactacgtcgagatcaacatcgaccacaaatttcatcgtcatcttattggtaagagcggcgcaaacataaacaggattaaggatcagtataaagtgtcagtccggattcccccagattcagaaaagtccaatctcatacggatcgaaggcgatccacagggggtgcagcaggcgaagcgtgagctgcttgaactcgctagccgcatggagaacgagcgcactaaggacctcatcattgagcagcggtttcacaggacaatcatcggccagaagggcgagcgtatcagggagattcgggacaaattccctgaagttatcataaacttcccagaccctgcccaaaaatccgacattgtccagctccgaggacccaagaacgaggtggagaagtgcacaaaatacatgcaaaaaatggttgcagatctggtcgaaaactcctattccatctcagttcccatcttcaaacagttccataagaacattataggaaaaggtggcgctaatatcaaaaagattcgagaagagtccaacaccaaaattgacttacctgcagaaaacagcaacagcgagactatcatcatcactggcaagcgagcgaattgcgaagcggcacgttctagaatcttaagcatccagaaggatttagccaacatcgctgaagtagaggtatcgataccggctaaattgcacaactccctcattgggacaaaaggtcgacttatccgttctattatggaagaatgtggaggcgtccatatccacttcccagtggaaggtagtggctctgataccgtggtgatcagagggccatcttcagacgtggagaaagctaaaaaacagctgctgcacttagcagaggagaagcagacaaaatccttcaccgttgacattcgcgcaaagccagaatatcataaattccttatcggcaaagggggtggcaagatccgtaaagtaagagacagcacaggagccagggtcatcttcccggcagccgaggataaagatcaggacctgattacaattattggaaaagaagacgccgttcgcgaggcccagaaggaacttgaagcacttatccagaaccttgataacgtggtcgaggacagcatgctcgttgatccgaaacaccacagacatttcgttattaggcggggacaggtcctcagggagatcgccgaggagtacggtggagtgatggtgagcttccctcgatctggtacccagtcagacaaggtgacccttaagggtgccaaggattgtgtcgaagctgcgaaaaaaaggatccaggagatcatcgaggatttagaagctcaggtaacacttgaatgcgctatcccacaaaagtttcaccgctccgtgatggggccaaaaggctcccgtattcagcagatcaccagggactttagcgttcagataaagttcccagacagagaagagaacgccgtgcatagcaccgagccggtcgtacaggaaaatggagacgaggcaggggagggacgagaagcaaaggactgcgaccccggtagtcccagacgctgcgatatcataataatttcgggcaggaaggagaaatgcgaagccgctaaggaggcgctggaggccctagtgccagtgacaatagaggtcgaggtgcctttcgatctccacaggtatgttataggtcagaaaggatcaggtattaggaagatgatggacgaatttgaggtgaatatacacgtacctgcacccgaattacagagtgacatcatcgcaattaccggacttgccgcaaatctcgaccgtgcgaaagccggactattggaaagggtcaaagaactgcaagccgagcaggaagaccgagccctgcggtcatttaaattaagcgtcacggtggatcctaagtaccacccaaagatcataggtcgaaaaggggcagtcatcactcagattcgcctggaacatgacgtgaacatccagtttcccgacaaggacgacggcaaccagccccaggatcagatcactataaccgggtacgaaaaaaatactgaagccgctagagacgcaatcctacgcatcgtgggggagctcgagcagatggtgtcagaggatgtccctttagatcacagagttcatgcgaggatcattggggctagaggcaaggctattagaaaaatcatggacgagtttaaggtcgacatcagatttccccagtccggtgctccagatccaaattgcgtcacagtgactgggctccccgaaaatgttgaggaggccattgatcacatcctgaacttggaggaggagtatttggctgatgtcgtcgattctgaggcgttacaagtttacatgaagcctccagcacacgaggaggcgaaagctccaagtcggggatttgtagtgcgagacgctccatggactgccagcagctctgaaaaagcgcctgatatgagctcctcagaagagttcccttcttttggggcacaggtcgcccctaaaaccctgccatggggaccaaagagatag

SEQ ID NO: 226027 - DNA, 249 bp, Artificial Sequence
  Description of Artificial Sequence: Synthetic coding sequence
atgtctagcgtcgcagttctcactcaggaaagttttgctgagcaccggagcggactagtgccccagcaaattaaagtcgctactctgaactccgaggaagaatcggacccccctacctataaggacgctttccctccactcccagaaaaggccgcatgcctagaatcagcccaagaaccatccggagcgtggggtaacaagattcgccctatcaaggccagcgtgataacacaggtcttccatgtgtag

SEQ ID NO: 226028 - DNA, 45 bp, Artificial Sequence
  Description of Artificial Sequence: Synthetic coding sequence
atgagctccgtagccgtactgactcaagagtcattcgccgagtag

SEQ ID NO: 226029 - DNA, 210 bp, Artificial Sequence
  Description of Artificial Sequence: Synthetic coding sequence
atgagctctgtagccgtactgacccaggagtcttttgcagagcatagatctggcctggtgccccagcagatcaaggttgcaaccctaaattccgaggaggagagcgatccccctacttataaagacgcctttcccccactccctgaaaaagcagcgtgcctagagagcgcccaggagcccagtggtgcctggggaaataagatccgttag

SEQ ID NO: 226030 - DNA, 165 bp, Artificial Sequence
  Description of Artificial Sequence: Synthetic coding sequence
atgtcatccgtcgccgttctcactcaagagtcatttgccgagcatagatcaggcttagtgccccagcaaatcaaagttgcaactcttaatagcgaggaggagagtgacccacccacttacaaggacgcatttcccccactccctgagaaagccgcatgcctgtag

SEQ ID NO: 226031 - DNA, 675 bp, Artificial Sequence
  Description of Artificial Sequence: Synthetic coding sequence
atgtcctccgtggccgttctgacccaagaaagcttcgcagagcaccgatcaggactggtacctcagcagataaaagttgcaacattgaactctgaagaagaatctgacccgcctacgtacaaggatgcatttcccccactcccggaaaaggccgcttgcctggagagtgctcaggagccgtctggtgcgtggggtaataaaattcgacccattaaggcaagtgtcattacccaggtttttcatgtccccctggaggagaggaaatacaaagacatgaatcagtttggcgaaggcgagcaagctaaaatttgcctggagattatgcaacgcaccggcgcacacttggagctctcacttgcaaaggaccaaggcctatccatcatggtctctgggaagctcgacgctgtcatgaaggctcgaaaagacatagtggctaggttacaaacacaagcatcagcaaccgtggccatccctaaagagcaccatcgttttgtaatcggaaaaaacggggagaagttgcaggacttagaacttaagacggcaaccaagattcagatccctaggcccgacgatcctagcaatcagatcaagatcaccggaaccaaggaagggatagaaaaagccagacatgaggtcctactgatctctgccgaacaggataagagggcagtgtag

SEQ ID NO: 226032 - DNA, 246 bp, Artificial Sequence
  Description of Artificial Sequence: Synthetic coding sequence
atgtccagtgtggctgttcttacgcaagagtcctttgccgagcacaggtctggcttagttccccaacagatcaaggtggctacattaaattctgaagaagaaagtgatcccccaacttataaggacgctttcccaccgttacccgaaaaggccgcttgcctggagtccgcccaggaaccatccggtgcatggggaaataaaatccgtccaatcaaggcatctgttatcacccaggtctttcactag

SEQ ID NO: 226033 - DNA, 240 bp, Artificial Sequence
  Description of Artificial Sequence: Synthetic coding sequence
atgtcgtcagttgctgtcttaacccaagaatcattcgccgagcacagatccggtctggtgccccaacagatcaaggtcgccactcttaacagcgaggaagagagcgatcctccaacctataaggacgcgtttccaccgctacccgagaaagccgcatgcttagagagtgcccaggaaccttccggagcctggggtaataaaataaggcccattaaagcatccgtgattacacaggtgtag

SEQ ID NO: 226034 - DNA, 291 bp, Artificial Sequence
  Description of Artificial Sequence: Synthetic coding sequence
atgtccagcgtggcggtcttgactcaggagtcgtttgccgagcaccgatcgggactagtgccccagcaaattaaagtggctacactcaacagtgaggaagaatctgaccctcccacatacaaagacgcttttcctcccctcccagagaaagccgcatgcctggagtccgctcaggaacctagcggagcatggggaaataagataagaccgatcaaggccagcgtgatcacgcaggtttttcatgtccccctcgaagagcgcaagtacaaagatatgaaccagtttggctag

SEQ ID NO: 226035 - DNA, 60 bp, Artificial Sequence
  Description of Artificial Sequence: Synthetic coding sequence
atgagctctgtggccgtgcttacccaggaatcctttgctgaacacagatcagggttgtag

SEQ ID NO: 226036 - DNA, 3708 bp, Artificial Sequence
  Description of Artificial Sequence: Synthetic coding sequence
atgcacttagccgagagagataggtggctgttcgtcgccacggtaatgatgcatttcgtgtccatcaagagtggctttcctgggctctgcgtgggtgtgcgaagtaccatgtcctctgttgcggtcctcacccaggaatcctttgccgagcataggtctggactggtgccccaacagattaaggtcgccactttaaactcggaagaggaatctgatccaccgacctataaagatgcgttcccccctcttcccgagaaggccgcatgcttggagtcggcccaagagccttctggtgcctggggaaacaagattcggcctatcaaggcgagtgtgatcacgcaggtgtttcacgttcccctcgaagagagaaagtacaaagacatgaatcaattcggggagggcgagcaagctaagatttgtctggaaattatgcagaggacaggcgctcacctggagctgagcttagctaaggatcagggattatccatcatggtttctgggaaattggacgccgtcatgaaagctaggaaggacattgttgcccgactccagacccaagccagtgcaacagttgctatccccaaggagcatcacagattcgtcattggtaaaaacggcgaaaagctccaggatctggagcttaaaaccgcgacaaaaatccagatcccaaggcccgatgatccatcaaatcagatcaaaattactgggaccaaagagggtatcgagaaggccagacacgaggtgctgcttatctctgctgagcaggacaagcgcgcagttgaacggctggaagtggagaaggcttttcacccattcattgcgggaccgtacaatcgcctggtcggagagattatgcaggaaacaggcaccagaattaacatacccccaccatcagtgaacaggaccgagatcgtatttaccggggagaaggagcagttggcccaggccgtggcccgtatcaagaagatctacgaagaaaaggcaaattcgttcaccgtatcaagcgtggccgctccttcttggctgcacagattcattattggcaaaaagggccagaatctggcaaagattacccaacagatgccgaaagtgcacatcgaattcacagaaggagaggacaagattactctagaaggccctaccgaagatgtaaacgtggcccaagagcagatcgagggcatggtcaaggacctgatcaaccggatggattacgtggagatcaacattgaccataaattccacaggcatctcatcggcaagagcggcgcaaacatcaacaggataaaggaccagtataaagtctccgttagaattcctccagacagtgagaagagtaacctgattagaattgagggggaccctcagggcgtccagcaagccaaacgcgaacttcttgaattggcctctcgaatggagaacgaacgcaccaaagatctgataattgaacaaagattccacagaacaattattggccaaaagggagagcgtattagagagatccgagacaaatttccggaggtcattatcaacttcccagaccccgcacagaaatcggatatagttcaactccgcggaccgaagaacgaggttgaaaagtgtaccaagtacatgcaaaagatggttgctgacctggtagagaactcttattccatctcagtgccaatcttcaaacagttccacaagaacattatcgggaaaggcggagcaaacatcaagaagatcagagaagagagcaacaccaaaattgacctgccagccgaaaattcaaacagtgaaacgatcattattaccggtaaacgagctaactgcgaggcggcaaggtcccgcatcctgagcatccagaaagacctcgctaacattgcagaggtggaagtgtctattccagcaaaactgcacaattctttaattggaacgaaaggccgactgatccgcagcattatggaggaatgtggaggggttcatatccatttccctgtggagggttcaggctccgatacagtggtgattagagggccatcttctgatgttgaaaaagccaaaaaacagttgttgcatttggccgaggagaaacagaccaagtcatttaccgtggatatccgggcaaaaccagagtaccataaatttctcattggaaaaggaggaggtaaaatccggaaggtccgggattctactggcgcaagagttatttttccggcagccgaagataaagatcaggacctgattactatcatcgggaaggaagacgctgtgcgcgaggcacaaaaagaactggaggcgctcatccagaacctggataatgtggttgaggattccatgttggttgacccaaaacaccaccgacatttcgtaattcgacgcggtcaggttctcagggagatcgccgaagagtacgggggtgtgatggtttcattccccagaagtggtacccagagcgacaaggtgactctgaaaggggctaaggattgtgtggaggccgctaagaaaagaattcaagaaatcatcgaggatttggaggcacaagtgaccctcgaatgcgccatacctcagaaatttcatagatcagtgatgggtcccaagggttctcggatacagcagatcacgagggacttcagtgtacagatcaaatttcccgatagagaggagaatgcagtgcactcaacagagcccgtggtgcaagaaaatggcgatgaagctggtgaaggcagagaagcaaaagattgcgaccctggatcccccagacgttgtgacataatcattataagcggtcgcaaagagaagtgcgaggcagccaaggaagccctcgaagcactcgtaccagtgactatcgaggtggaggtccctttcgacctgcacagatatgtgatcggtcagaagggaagcgggattcgcaaaatgatggatgaatttgaggtgaacattcacgtgccggcacccgaactgcagagcgatataattgcaataaccggtctggcagcgaaccttgacagagcaaaagcaggtctgctcgagcgcgtcaaggagctccaggcggaacaagaagatcgtgcactgcgcagttttaaacttagcgtcacagttgatccgaagtaccatccaaagataataggcaggaagggggctgtgatcacgcagattcgtcttgagcacgacgtgaacatccagttccctgacaaagacgatggaaatcagccgcaggaccagattaccattactggatatgaaaaaaatactgaggccgctagggatgccatcctgcggattgtgggcgagcttgagcaaatggtgagtgaggatgtgcctctcgatcaccgtgtgcacgctcggatcattggggctcggggtaaggctatccgcaaaataatggacgaatttaaagtcgacatcaggttcccacagagcggagcacccgaccctaactgtgttaccgttacaggattgcccgaaaacgtggaagaggcaatcgaccacattcttaaccttgaagaagaatatctagcggacgtggtagacagcgaagctctccaggtctacatgaaacctccggctcacgaagaggccaaggccccaagtagaggctttgtcgtgagagatgcaccctggacagcctcgagttccgagaaggcaccagacatgtctagtagtgaggaattcccatcattcggcgcacaagtggctcctaagaccctgccctggggcccaaagcgttag

SEQ ID NO: 226037 - DNA, 666 bp, Artificial Sequence
  Description of Artificial Sequence: Synthetic coding sequence
atgtccagtgtggccgtgctgactcaagaatccttcgctgaacaccgctccggcctggtgccccagcagattaaggtggcgacactgaacagtgaggaggaatccgatccacccacgtataaggacgccttcccgcctctgccggagaaggccgcttgcttagaatcagctcaggaaccgagcggcgcttgggggaacaagattagacccattaaggcatcagtaatcacgcaggtcttccacgtaccattagaagagagaaagtacaaagacatgaaccagttcggggagggagaacaggctaagatatgtttggagatcatgcaaaggaccggcgctcacctggaattgagcctggcgaaagatcaagggcttagcatcatggtgtcgggaaagctcgatgctgtcatgaaggcaagaaaggacatagtagcacgattgcagacacaggcctctgccacggtcgcgatccctaaagaacatcacagattcgttattgggaagaacggcgaaaaactgcaagatcttgaacttaagactgctacgaagattcaaattcccagaccagatgaccccagtaatcagattaaaatcacaggtacaaaagaagggattgaaaaggcacggcacgaggtgctactgatttccgcagagcaagataagtag

SEQ ID NO: 226038 - DNA, 426 bp, Artificial Sequence
  Description of Artificial Sequence: Synthetic coding sequence
atgtcaagcgtggccgttttgactcaggaatcttttgccgaacatagatccgggttggtaccacaacagatcaaggtggctacactgaactccgaggaggagagcgatccacccacgtacaaagatgcttttcctccattgccagagaaagccgcatgtctcgagtccgctcaggaaccgagcggcgcatgggggaataagatccgcccaataaaggcatcggtcatcacacaggtctttcacgtgcccctggaggagaggaaatacaaggacatgaaccaattcggagaaggagagcaggcaaaaatttgtctggagattatgcagaggacaggagcccatctggaactcagcttggccaaagaccagggtctctcgatcatggtgagtggtaagctggatgctgttatgaaagcaagaaaatag

SEQ ID NO: 226039 - DNA, 381 bp, Artificial Sequence
  Description of Artificial Sequence: Synthetic coding sequence
atgtcctcggtcgctgtgctgacccaggagagctttgcagagcaccgcagcggtctcgtcccccagcaaatcaaggttgctaccctgaatagtgaggaagagtccgaccctcccacttacaaggacgcctttcccccactgcccgaaaaagccgcttgtttggagtccgcccaggaacccagtggagcttgggggaacaaaattcgacccataaaagccagcgtgattacccaagtcttccacgtgcccctggaagagcgcaagtataaagacatgaatcagtttggcgaaggcgagcaggccaaaatatgcctggagataatgcaacgaacgggcgctcatctggagctgtctctggcgaaagatcagggcctgtcttag

SEQ ID NO: 226040 - DNA, 444 bp, Artificial Sequence
  Description of Artificial Sequence: Synthetic coding sequence
atgagcagcgtggctgtgcttactcaggagtcatttgccgagcataggtctggcctcgtcccgcaacagataaaggttgcgactctgaacagcgaagaggagtcggacccgcctacttacaaggacgcctttccacctttgcctgaaaaggcagcatgtttggaatccgctcaggagccaagcggggcatggggcaacaaaatccgccctatcaaggcatccgtcatcacccaggtgttccatgtgcccctggaggaaaggaaatacaaggacatgaaccagttcggcgaaggcgaacaggccaaaatctgtctggagattatgcaaaggacgggagcccacctggagctcagtctggcgaaagatcaggggctgagcatcatggtctcggggaagctggacgccgtcatgaaggcaaggaaagatattgtagcaagactttag

SEQ ID NO: 226041 - DNA, 54 bp, Artificial Sequence
  Description of Artificial Sequence: Synthetic coding sequence
atgtcttctgtagccgtattaactcaggagtcatttgccgagcaccgatcctag

SEQ ID NO: 226042 - DNA, 495 bp, Artificial Sequence
  Description of Artificial Sequence: Synthetic coding sequence
atgtctagcgttgccgtgctcacccaggagtcgtttgcagaacataggagcgggctggtgcctcaacagatcaaggtcgccacactcaacagtgaagaggaatccgatcccccaacatataaagatgcgttccctccactcccggagaaagctgcatgccttgagagcgcccaggagcccagcggagcctgggggaataaaattcgacctattaaggccagtgtgatcacacaggtgttccatgtgcccctggaagaacgcaagtataaagatatgaatcagtttggagaaggagagcaggctaagatctgtctggagatcatgcagagaaccggcgcacatcttgagttaagtctagcaaaggatcaggggttgtccatcatggtttccggcaaactggatgcggtgatgaaagcacgtaaggacatcgtggccagactgcagactcaggcctctgctactgtcgccattccaaaggaacatcacagattttag

SEQ ID NO: 226043 - DNA, 144 bp, Artificial Sequence
  Description of Artificial Sequence: Synthetic coding sequence
atgtcaagtgtggctgtgctgacacaggagagctttgcggagcacagatcagggcttgtgcctcagcagatcaaagtggcaaccctgaatagcgaagaggaaagcgacccacctacatataaggacgcttttcccccactatag

SEQ ID NO: 226044 - DNA, 1044 bp, Artificial Sequence
  Description of Artificial Sequence: Synthetic coding sequence
atggagaacctgatgacctcctcaacgctgccccctctgtttgctgatgaagacggcagcaaagaatcaaacgacctggcaaccaccggactaaaccaccccgaggtcccttactcttcaggcgcaacttctagtaccaataatcccgaattcgtcgaggatctcagtcagggacagctgctgcagtccgagtcctctaacgcagctgagggcaacgagcaacggcacgaagatgaacagcggtccaaacggggaggctggagcaagggtaggaaacgcaagaagcctcttcgtgatagtaacgcccctaagtcgcccctgacaggttatgtgaggttcatgaatgagcgcagggagcagcttcgtgccaagcgccctgaagtccccttccctgagatcacacggatgctgggcaacgaatggtctaagctcccccctgaagaaaagcagcgatacctcgatgaggctgatagggataaggagcggtatatgaaggaactggagcagtatcaaaagacagaggcttataaggtgttctctcgcaaaacacaggataggcagaaggggaaatcacatagacaggatgccgctaggcaggcaacccatgaccacgagaaggagactgaagtgaaggagagatccgtgttcgatattccaatttttaccgaggaatttttgaatcacagcaaagccagggaagctgaactgagacagctccgaaagagtaacatggaatttgaggaaagaaacgcagctcttcagaagcacgtcgaaagcatgcgtaccgctgttgagaaactggaggtggacgttattcaggaacgctccagaaacactgtacttcaacagcaccttgaaacgctgagacaagttctgacttcctccttcgccagcatgcctttacctggctcgggagaaactcctaccgtggacacaatcgattcttacatgaatagacttcactccattatcttagccaatccccaggataacgaaaatttcattgctaccgtgagggaagtcgtcaatagattggaccggtag

SEQ ID NO: 226045 - DNA, 1044 bp, Artificial Sequence
  Description of Artificial Sequence: Synthetic coding sequence
atggagaacctgatgacaagttccacattgcccccactgtttgccgatgaggatgggtccaaagaaagcaatgacctggctactactggtcttaatcaccccgaagtcccctattcatccggggctacgtcttcaaccaataaccccgagtttgtggaggatctttcccagggccagctgctgcagtccgaatcctccaatgctgcagagggcaacgagcagaggcacgaggacgaacagaggagtaaacgcggtggatggtccaaggggagaaaacgcaagaagcctctgcgcgattccaatgcaccaaagtcacccctgaccggttatgtcaggtttatgaatgagcgaagggagcagctacgcgcaaaacgccctgaggtgcccttccccgagattaccagaatgctgggtaacgagtggtccaaactgcccccagaagagaaacaacgatatctggatgaggctgaccgcgacaaagagcggtacatgaaagaactggagcagtaccaaaagaccgaagcctacaaagtgttctcccggaaaacccaggatagacagaaggggaagagtcaccgccaggacgctgctcgccaggctacccacgaccacgagaaggaaacagaagtgaaagagcgctctgtgtttgatatacccattttcactgaggagttcttaaaccactctaaggctcgtgaagccgaacttcgccagttgcggaaatccaacatggaatttgaggagcggaatgctgctctgcagaaacatgtggagagtatgcggacagccgtggagaagctcgaagtggacgtgatccaagaacgaagcagaaacacagtgctccagcagcacctggagaccttgagacaggtgctaactagctcctttgcatctatgccactccccggatccggggaaacgccaaccgtggacaccattgattcttatatgaatcggttgcattccataattttggccaacccacaagacaacgagaactttatcgccacagtgagagaagtggttaacaggctagaccgctag

SEQ ID NO: 226046 - DNA, 471 bp, Artificial Sequence
  Description of Artificial Sequence: Synthetic coding sequence
atggaaaacctgatgactagcagcaccctccctcccctttttgccgacgaagatggatcgaaagaatctaacgatctcgctaccaccggattaaatcacccagaggtgccgtacagctccggtgcgaccagtagcaccaacaacccggaatttgtcgaggacctgtcgcagggacaattgctccagagcgaaagtagcaatgcagctgaaggcaacgaacagaggcatgaggacgagcaaagaagcaagcgcggtggctggtccaagggcaggaaaagaaaaaaacccctcagagactctaatgcacccaaatctcctctgacaggatacgtgaggtttatgaatgagcgtcgggagcagctccgggctaaaagaccagaggtcccgttccctgagattacccgcatgctcggcaatgagtggtcgaagcttcctcccgaggaaaagcaacgctacctcgacgaagcttag

SEQ ID NO: 226047 - DNA, 303 bp, Artificial Sequence
  Description of Artificial Sequence: Synthetic coding sequence
atggagaatttaatgacgtcctctactctccctcccctctttgcggatgaggatggttccaaggagtctaacgatcttgccacaacgggactcaaccatccagaggtcccctactcctccggtgcgaccagctccacaaacaaccccgaattcgtggaagatctatcccaaggacaactgctgcagtctgaatcctcaaacgcagctgaaggaaacgagcaacgacacgaagacgaacagaggagcaagcggggaggatggagcaaaggtagaaagagaaagaagccactgagggacagctag

SEQ ID NO: 226048 - DNA, 489 bp, Artificial Sequence
  Description of Artificial Sequence: Synthetic coding sequence
atggaaaatctgatgacatctagcacccttccccctctgttcgccgacgaggacggctccaaggagtcaaatgacttagcgacgactggtctgaatcatcccgaggtgccatatagcagcggcgcaaccagcagtacaaataatccggaattcgttgaagacctgtcacaaggccagctcctgcagagcgagagctccaacgcagccgaaggcaacgaacaacggcacgaagatgagcagcgcagcaagagaggtggctggtctaagggtagaaagcgtaagaaaccgctacgcgattcgaacgcgcctaagtccccgcttacgggctacgttcgattcatgaacgagaggcgggaacagcttcgcgctaagaggccagaagtacctttccctgagattacccggatgctgggcaatgagtggtctaagctcccacctgaggagaaacagagatacctcgacgaagcagatcgagacaaggagagatag

SEQ ID NO: 226049 - DNA, 954 bp, Artificial Sequence
  Description of Artificial Sequence: Synthetic coding sequence
atgtcacacggtcccaaacagccaggggcagccgcagctccggcaggcggtaaggcacctggccaacacggaggattcgtagtcacagttaagcaagagcgaggcgaagggccacgcgctggagagaaaggctcgcacgaggaagaacctgtgaaaaagaggggctggccaaaaggaaaaaaaaggaaaaaaattttgccgaacggaccaaaagccccagtgactggttacgtgagattcctgaacgaacgacgcgagcagataaggacccggcaccccgatctccccttcccagaaatcaccaagatgcttggcgctgaatggagtaagctgcagccgactgagaaacagaggtacctggatgaggcagaacgggaaaagcagcagtacatgaaggagctgagagcttatcagcagtctgaagcttataaaatgtgcacagagaaaatccaggagaaaaagataaagaaggaggactctagctctggcctgatgaacacactgctgaacggccacaaaggcggtgattgcgacgggttttccacgtttgatgttcctatttttacagaggaattcctggatcagaataaggccagggaggccgagttacggcgattgagaaagatgaatgtggcatttgaagagcagaacgcagtgcttcagaggcacacccaaagcatgtcaagtgctcgagaacgcctagaacaggagctggcccttgaagaaagaaggaccctagcactccaacagcagttgcaggccgtgagacaggcactgacagcgagcttcgcgagtctgcctgtccccggaacaggcgaaactccgactctgggcaccctggatttctatatggctcgccttcacggagccattgaacgagatcctgctcagcacgaaaagctcatagttcggattaaggagatcctggcacaagtcgctagcgaacacctgtag

SEQ ID NO: 226050 - DNA, 807 bp, Artificial Sequence
  Description of Artificial Sequence: Synthetic coding sequence
atggatacccgggttggcacagccatggcatcacccccatctatgttcccttcctcattgaaatctagttggaccaagaccaaaagggtgcgcaggtcattcggtgccgaggatgaatgtggattgcggggtgctgagaggggcacggctgaggcccatgcggaacatgaacagcgcgcaagggctagtggggctggtgctggagcagggggtgcagaggatgccggtgccgctgccgctgctccaggcagggctcccggagcccaccgccaattacgcctgaccgccggagctggccacggccgtaacgctcatgccggacatagcggcctgctgcacggccctgcaagcagatcacaccgggcaaggccacgcccagcaagggaagctcatcggccacatcagggaaatcctggacccggacgccagcgggctcctgtgagatccggacgcgcacatgacgcagaagaaaagctgtgggccaggccctgccatacacccccacggggtagagaggcaggcggacctccgggacccggacctatcctgcacctaggcggatcctccccccctaaaattaagttcctccagcatcccttctctttccaaagcccccagccgcctgagccaggtaaatctacgcgcgacacacctcggaggacgtcacaaccaagagtgcctctgttgggcggacaaacacgctacacagggtctccaggacatccccaggacactggacaaaccaaacccacccctagtacacgccaggacccaccgaactatagtctcaggggggcagtgccatag

SEQ ID NO: 226051 - DNA, 648 bp, Artificial Sequence
  Description of Artificial Sequence: Synthetic coding sequence
atgtcccacgggccaaaacagcccggagccgctgccgctccagcaggcggaaaagcaccaggccagcatggcggttttgtggttaccgtcaagcaggagcgaggcgaaggacctcgagctggcgagaagggctctcacgaagaggagccagttaagaagcgcggatggcctaagggtaaaaaacgtaagaagatcctgcccaatggtcccaaggccccagtgaccggctatgttagatttttgaacgagcgcagagagcaaatccgcactcgtcatcctgacctaccctttccggagataacaaaaatgctcggggcagagtggtctaagctgcagcccactgaaaagcaacgttatctggacgaggcagaacgcgagaagcagcagtatatgaaggagttgagagcctaccaacagagcgaagcctataagatgtgtacagaaaagatccaagaaaagaaaatcaagaaagaggatagttcttcagggctgatgaatacgctcctgaatggccataaaggcggagattgcgacggattcagtactttcgacgtccctatctttactgaagagtttctggatcagaataaagctagagaggcggagctgagaagattgcggaaaatgaacgttgcttttgaggagtag

SEQ ID NO: 226052 - DNA, 429 bp, Artificial Sequence
  Description of Artificial Sequence: Synthetic coding sequence
atgtcacatggtcccaaacagcctggggcagcggctgcccctgcaggcggaaaagcgccagggcaacacggaggctttgttgtaaccgtgaagcaggagagaggtgaaggacccagggccggagagaaaggcagtcacgaagaggagcccgtgaagaagcgtggctggcctaaagggaaaaagaggaagaaaattctccctaatggcccaaaggcccctgtaaccggttacgttcgcttcctcaacgaaaggcgcgaacagatcaggactcgtcatcctgatctcccattcccagagatcaccaagatgctcggggcagagtggtccaaactgcaacctaccgaaaagcagagatacctcgacgaggccgagagagaaaaacaacaatatatgaaggagctccgcgcttaccagcagagtgaggcttag

SEQ ID NO: 226053 - DNA, 324 bp, Artificial Sequence
  Description of Artificial Sequence: Synthetic coding sequence
atgtccgaatctagtagtaaatcttcccagccccttgccagtaagcaggagaaagacggtaccgagaagcggggtcgcggtagacctagaaaacagcctccagtctcgccaggcacagctctggtgggctctcagaaagaaccttcagaagtgccaaccccaaagaggccacgtgggaggcccaaaggaagcaagaacaagggcgctgccaaaacaagaaaaaccacaacaaccccgggacgcaagcctcgaggccgtcccaagaagctggaaaaagaagaggaggaaggtattagccaggaaagcagcgaggaggaacagtag

SEQ ID NO: 226054 - DNA, 291 bp, Artificial Sequence
  Description of Artificial Sequence: Synthetic coding sequence
atgtctgagagcagtagcaagtccagccagcccctagcttcaaagcaagaaaaggacggaacagagaagcgtggcagaggcaggcctcggaaacagcccccaaaggagccgtcagaggtgccaacgcccaagagaccacgcggtagacctaaggggagtaaaaacaagggcgcagcaaagacaaggaaaaccacgacaactcccggacggaaaccccgtggtcgccctaagaaactcgaaaaggaagaggaagagggtatatctcaggagagcagcgaggaagaacagtag

SEQ ID NO: 226055 - DNA, 291 bp, Artificial Sequence
  Description of Artificial Sequence: Synthetic coding sequence
atgtctgagagttcgagcaagtcctctcaaccgctggctagcaaacaggagaaggacggaaccgaaaagagaggtagaggcagacctagaaagcaacctcccaaggagccttccgaagttcctacacccaagcggccaaggggccgtcctaaggggagcaaaaataagggcgctgccaagacccgtaagaccacaactacacccggacgcaagcctcggggaagacccaaaaaattggagaaagaggaggaggagggtatttctcaggagagctcagaagaagagcagtag

SEQ ID NO: 226056 - DNA, 324 bp, Artificial Sequence
  Description of Artificial Sequence: Synthetic coding sequence
atgtcagaaagcagcagcaagtcttctcaaccactggcctcgaagcaagagaaagacggtacagagaagcgtggtcggggtaggcccagaaaacagccgccagtgagtcctggcaccgcattggtgggctcccagaaggaaccatccgaagtgcccacaccaaagcggccaaggggaaggcccaaaggcagtaaaaataaaggcgcagcaaaaacccgaaagacaaccacaacgcctgggaggaagccgagaggacggccaaaaaagttagagaaggaagaggaagaagggatttctcaagagtctagtgaggaagaacagtag

SEQ ID NO: 226057 - DNA, 291 bp, Artificial Sequence
  Description of Artificial Sequence: Synthetic coding sequence
atgtctgaaagtagttcaaagtcttctcaacctctggcctcaaagcaggaaaaggatggcaccgagaaaagggggaggggaagacctcgcaagcagccccctaaggagcctagcgaggtacctacccctaaacggcctcgagggaggcccaagggaagtaagaataaaggagctgctaagacgcggaaaacgaccacgactccaggacggaagcccaggggcaggcctaaaaagctcgaaaaggaggaagaagagggcatcagtcaggagtcgtctgaggaggagcagtag

SEQ ID NO: 226058 - DNA, 987 bp, Artificial Sequence
  Description of Artificial Sequence: Synthetic coding sequence
atgtcggagagcagttcaaaaagttcccaacccctggcatcaaagcaagagaaagacggcactgaaaaacgcggtcgtggccgacccagaaagcagcccccagtgagcccgggaactgcgttagttggaagccagaaagagccctccgaagttcccacacctaaacgccctcgcggacgcccaaaggggagcaaaaacaaaggtgaaggaggtcgagggggtcatctagccggagtattaggaggtggagcggttacacacgcctgccgtctcctcttaacaggcggagccgctagcttctgggactggaccgctctgttgaggtctcaccgccctcatccctttccacggccaacgatcactaccgcctctggccgtcatccccatctaccacccgttccctcccctcctcactatacagcccaccagcctttgcagggtagccatgggttgtcaggcgagcagttttccccaggactgagctcccagcttccacccccaactcacgcttatacccatgcccttctagataaggctaacattcccctctcgagaacgctgcaccttcttcgcccacattccctcgggggaggagatatcgcattgtgggcatttgggttaggtgccccttcactcttgctgcattgcagcttgtggctgccaatcgttggcccaggcagagtgcccctggcccttaaaggtgctcaggccccttctcacccaggaactccctactcgactgcgctggccgctgccggagtggccaatggcggaggatgttggcctcctggcttcccacagcccaattgtctgtgtcaccacgtcggcttaacttttcatcccagcccgacctcccttgtgccagtgctcggctggacagccccttttggctatcgtaaagctggcggagtaagccccctgcttccattgcactgtgggcactccccgttggccctccggctaggctccgagtacattctgtggtag

SEQ ID NO: 226059 - DNA, 291 bp, Artificial Sequence
  Description of Artificial Sequence: Synthetic coding sequence
atgtccgagtcctcctccaaatctagccagcctctggcctccaaacaggagaaagatggaacagagaaaagaggcagaggaaggcctcggaagcagccacctaaggagcctagcgaggtcccgacccctaagagaccccgagggaggccgaaggggtcaaagaacaaaggggctgcaaagacccgtaaaactacgaccacccccggaagaaagcctcgcggtagaccaaagaagttagaaaaggaagaagaggaggggatctcccaggaatcaagcgaggaagaacaatag

SEQ ID NO: 226060 - DNA, 324 bp, Artificial Sequence
  Description of Artificial Sequence: Synthetic coding sequence
atgagtgagtcttcgtctaagagcagccagcctctggcttcaaaacaggagaaagacggcaccgagaagaggggacggggtaggcctcgcaaacagcctccagtgtctcccggtacggcactggtcgggtcccagaaggagccttccgaagtgccaacccccaagcgcccacggggacgacccaaaggatctaagaacaagggcgcagcaaagactcgtaaaacgaccaccacacctgggaggaagccccgaggaaggccgaaaaagctggaaaaggaggaggaagagggcatctcgcaggaatcgtcagaagaggaacagtag

SEQ ID NO: 226061 - DNA, 321 bp, Artificial Sequence
  Description of Artificial Sequence: Synthetic coding sequence
atgtccgcaaggggagagggcgcaggacagccctcaacttctgcccagggccagcccgctgcccctgcgccacagaaaagggggcgtggaaggccacggaagcaacaacaggagccgacaggcgagccctcaccgaagcgccctcggggaagaccaaagggcagcaagaataagtccccttcgaaggccgcacagaagaaggcagaggctacgggcgaaaaacgtccccgtggacggcctcggaagtgggacaacctgctgcctaggaccagcagcaaaaagaaaactagcctgggcaactcgactaaacggagccattag

SEQ ID NO: 226062 - DNA, 357 bp, Artificial Sequence
  Description of Artificial Sequence: Synthetic coding sequence
atgagcgcgagaggggaaggcgctgggcagccttccacatcagctcagggacaacctgccgcacccgcacctcagaagcgcggaagaggcagacctcgcaaacaacagcaggaaccgacaggcgagccgtctccaaagcgcccaagaggacggcctaaagggagtaagaacaagtccccatctaaagctgcgcaaaagaaggcagaagctacaggagagaagcgtccacgaggtcggcctcgaaaatggccccagcaggtggtgcagaagaagccagctcaggtcaacgttgcgctacccggtaaagaccatcctggaaatctgatatatctactgttctccaagaatgcgacttag

SEQ ID NO: 226063 - DNA, 273 bp, Artificial Sequence
  Description of Artificial Sequence: Synthetic coding sequence
atgtcagccagaggagaaggcgctggccagccctccacctctgcgcagggccaacccgcagccccagccccacagaagcgaggcagaggacgtcctagaaagcagcagcaggaacctaccggcgaaccaagccccaaaagacccagaggcaggcctaaggggagcaagaataagtctccttctaaggcagcacaaaagaaagcggaggctacaggggagaaacggcctagaggacgcccacggaaatgggaggagttttatatcgcggcttag

SEQ ID NO: 226064 - DNA, 330 bp, Artificial Sequence
  Description of Artificial Sequence: Synthetic coding sequence
atgagcgcaaggggcgagggtgcaggacaaccctctaccagcgcccaaggccagcctgccgcacctgctcctcagaaacgtggcagaggcaggcccaggaagcagcaacaggagcccaccggtgaacctagccctaagcgcccacgaggcaggcccaaggggagcaaaaacaagagccccagcaaggcagcacagaagaaggccgaagcaaccggagaaaagagaccgagaggcagaccaaggaagtggccccagcaagtggttcagaaaaagcctgcacaggaggagactgaggagacatcctctcaggagtcggccgaagaagactag

SEQ ID NO: 226065 - DNA, 279 bp, Artificial Sequence
  Description of Artificial Sequence: Synthetic coding sequence
atgtctgcgaggggggagggagcagggcaaccaagcactagcgcccagggtcagcccgctgctcccgctccccaaaagcggggtagaggacggccacggaagcagcaacaggagcccaccggagagccctctcctaagcggcctcgagggaggccaaagggatccaagaacaagagtccttctaaggcagcccagaaaaaggcggaagctactggggagaagaggcctcggggacggccacggaaatggtggctgctgatgaagagtccatgttggtag

SEQ ID NO: 226066 - DNA, 312 bp, Artificial Sequence
  Description of Artificial Sequence: Synthetic coding sequence
atgtctgccaggggggagggcgctggacagccctccacttcagctcaggggcaacctgccgctcccgctccccagaaaaggggacgcggacgccctcggaagcagcagcaagagcccacaggagaacccagtcctaaacggccacggggaaggcccaagggcagcaaaaataagtccccttctaaggcagcacaaaaaaaagccgaggctacaggtgagaagaggcctaggggcaggccacgaaagtggcttcgggctcaagcactcgatagtgatggcctcggctctaactccggtcctagtctgagttag

SEQ ID NO: 226067 - DNA, 261 bp, Artificial Sequence
  Description of Artificial Sequence: Synthetic coding sequence
atgagcgctcgcggtgaaggtgcaggccagcccagcacatcagctcagggacagccagctgccccagctccacaaaaaaggggtcgcggaaggccccgtaagcaacagcaggagccaactggcgagcccagccccaagcggccacggggacgcccaaaagggagcaaaaacaagtctcctagcaaagctgcccagaagaaggcagaagcgaccggtgagaagcggcctcgcggacgacccaggaagtggctgcagaattag

SEQ ID NO: 226068 - DNA, 300 bp, Artificial Sequence
  Description of Artificial Sequence: Synthetic coding sequence
atgagcgctagaggggaaggagctgggcagccttctacaagcgcgcagggccagccagctgcacctgcccctcagaaaagaggcagaggtcgtccacgcaaacagcaacaggagcccaccggcgagccgtcccccaaacggccaaggggaaggcccaagggaagtaagaataaatccccttcaaaggccgcacaaaagaaggcagaagccactggggagaaaagacccaggggcaggcctagaaagtggccgcagcaggtcgtgcagaagaagcccgcacaggtgcggcactcacattag

SEQ ID NO: 226069 - DNA, 477 bp, Artificial Sequence
  Description of Artificial Sequence: Synthetic coding sequence
atgggcaagggtgatcctaaaaaacccaggggtaagatgtccagttatgcattttttgtgcagacctgcagggaggagcataaaaagaagcaccctgatgcctcggtgaattttagcgagttctcaaagaagtgctcagaacgatggaaaacaatgagcgcaaaagaaaagggcaaatttgaagacatggccaaggctgacaaggcccgttatgaaagggaaatgaagacctatattccgcctaaaggcgaaacaaagaaaaaattcaaggaccctaatgccccaaagagaccgccttcagcgttttttcttttctgttcagaataccggcctaagattaagggcgagcacccaggcctgagcatcggggacgtggcgaaaaagctcggggagatgtggaacaataccgccgctgacgacaagcagccgtatgaaaaaaaagccgctaagcttaaggaaaagtacgagaagttttag

SEQ ID NO: 226070 - DNA, 648 bp, Artificial Sequence
  Description of Artificial Sequence: Synthetic coding sequence
atgggaaaaggggacccaaaaaaaccccgagggaagatgtcaagttatgcattttttgtacagacgtgtagggaagaacacaaaaagaagcaccccgacgcctcagtgaacttttccgaattttctaagaagtgcagcgaaaggtggaagacaatgtcggctaaagaaaaaggaaagtttgaggatatggccaaggccgacaaagcccgttacgagagggaaatgaaaacgtatatcccccctaagggcgaaactaaaaagaaatttaaagatcccaacgcccctaaaagacctccctcagctttcttcttgttctgttcggaatatcgcccaaaaatcaaaggagagcatcctgggcttagcattggtgatgtggctaagaaactcggggagatgtggaataacaccgctgccgacgacaaacaaccctacgaaaagaaggcggcaaaacttaaggagaaatacgaaaaagatatagccgcttatagggctaagggcaagccagatgccgctaagaagggggttgtgaaggctgagaaaagtaaaaaaaagaaagaagaggaggaggatgaagaagacgaagaagatgaagaagaggaggaagacgaggaagacgaggacgaagaggaagacgatgacgatgagtag

SEQ ID NO: 226071 - DNA, 648 bp, Artificial Sequence
  Description of Artificial Sequence: Synthetic coding sequence
atgggaaagggagaccccaagaaaccgagaggcaagatgtcttcctatgcattcttcgtgcagacctgccgcgaggagcacaagaagaagcaccctgatgcttctgtcaacttttccgagttcagcaaaaaatgttccgagaggtggaagacaatgtcagctaaggagaaaggaaaatttgaggacatggccaaggctgataaggccaggtacgagcgggaaatgaaaacctacattcctcccaaaggtgaaaccaaaaagaaattcaaagatcccaatgcgcctaagagaccaccatccgcctttttcttgttctgttccgaatatcggcctaaaataaagggagagcatcctggccttagtatcggggacgtcgcaaagaagcttggggagatgtggaacaatactgccgcagacgataagcaaccatatgagaaaaaggcggcaaaactcaaggaaaagtatgaaaaagacatcgctgcatacagagccaaggggaaacccgatgccgcaaagaagggtgtggtgaaagccgagaagtcaaaaaagaagaaagaggaggaagaagatgaagaagatgaagaggacgaggaggaggaagaggatgaggaggatgaggacgaggaggaggacgacgacgatgagtag

SEQ ID NO: 226072 - DNA, 294 bp, Artificial Sequence
  Description of Artificial Sequence: Synthetic coding sequence
atgggaaagggcgatcctaaaaagcccagggggaagatgagcagctacgcatttttcgtacagacctgccgtgaggaacataaaaagaagcacccggatgcctccgttaatttctccgaattttcaaaaaaatgtagcgagagatggaaaaccatgtcagcaaaagagaagggtaagtttgaagacatggccaaggccgataaagcaagatatgaacgtgagatgaaaacatacatcccccctaaaggtgagaccaagaaaaagtttaaagatcccaacgccccaaaacgatag

SEQ ID NO: 226073 - DNA, 477 bp, Artificial Sequence
  Description of Artificial Sequence: Synthetic coding sequence
atgggcaagggcgaccctaagaaacccaggggaaagatgagtagctacgctttttttgtgcaaacctgtagggaggagcacaagaagaagcaccctgacgcctcagtcaacttttcagaattcagcaagaaatgctccgaaagatggaaaaccatgagcgcaaaggaaaagggcaagtttgaggacatggccaaggcggataaagccaggtatgaaagggagatgaaaacctatatccctccgaagggggaaactaagaagaaatttaaggatccaaatgccccaaagagaccaccaagcgccttctttcttttttgttcggaataccgcccaaaaatcaaaggagagcacccagggttaagcattggtgatgtcgctaagaaactcggcgaaatgtggaacaacacagctgctgacgacaaacagccctatgaaaagaaagctgccaagctgaaagaaaagtatgaaaagttttag

SEQ ID NO: 226074 - DNA, 648 bp, Artificial Sequence
  Description of Artificial Sequence: Synthetic coding sequence
atgggtaagggggacccaaagaaaccgagaggcaagatgtccagctacgccttcttcgttcagacatgtagggaagaacacaaaaaaaagcaccctgatgccagtgtgaatttcagcgagttctctaagaaatgctctgagagatggaaaactatgtccgccaaggaaaaagggaaatttgaagacatggctaaagcagataaagcacggtatgagcgagagatgaaaacgtatatacctcccaaaggggagacgaagaagaaattcaaggatcccaatgccccaaaacgacccccttccgcctttttcctgttctgttccgaataccggcctaagatcaaaggggaacatcccggactgtctatcggggatgttgccaaaaagctgggggaaatgtggaataatacggccgctgatgataagcagccatacgaaaagaaagctgcaaagctgaaagagaagtacgagaaggatatcgctgcatatcgcgctaaaggcaagccggatgcggctaagaagggggtggtcaaggcggaaaagtccaaaaaaaagaaagaggaggaggaagatgaagaagatgaggaggatgaagaagaggaggaggacgaggaagacgaggatgaggaggaagacgatgatgatgagtag

SEQ ID NO: 226075 - DNA, 648 bp, Artificial Sequence
  Description of Artificial Sequence: Synthetic coding sequence
atgggcaaaggcgatccgaagaaaccccgtgggaaaatgagttcctacgcttttttcgtccagacatgtcgcgaagagcataagaaaaaacacccagatgcctctgtcaatttctccgagttctcaaaaaaatgcagtgagaggtggaagaccatgtctgccaaagagaaggggaaatttgaggatatggccaaagccgacaaggctcggtacgagcgcgagatgaagacctacatcccccctaaaggcgaaacaaagaaaaaattcaaggacccaaatgcacctaaaaggcccccttctgcgttctttctcttctgttctgaatacaggcctaaaatcaaaggcgaacatcccggtctgagcatcggggatgtcgcaaaaaagctaggagaaatgtggaacaacaccgctgctgacgataaacaaccgtatgagaagaaagctgccaagttgaaagaaaagtacgaaaaggatattgcagcataccgcgctaagggcaagcccgacgccgcaaaaaaaggggtcgtgaaggctgagaagtccaagaagaaaaaagaagaggaagaggacgaagaggatgaagaagatgaagaggaagaagaagatgaagaagacgaagacgaagaggaggatgacgatgacgagtag

SEQ ID NO: 226076 - DNA, 489 bp, Artificial Sequence
  Description of Artificial Sequence: Synthetic coding sequence
atgggcaagggcgaccctaaaaaacccagaggaaaaatgagcagctatgcctttttcgtccagacatgtcgtgaggagcataaaaagaaacatcctgatgccagcgtaaatttcagcgaattcagcaaaaagtgttccgaacggtggaaaacgatgagcgctaaggagaagggcaagtttgaagacatggcaaaagctgataaagctcgctatgagcgggagatgaagacttacattccccctaaaggcgaaacaaaaaaaaagtttaaggatccaaatgcaccaaagaggcctccctccgcattttttttgttctgctccgaataccgccctaagataaagggggagcaccccggtttgagcatcggcgatgtcgctaagaagctcggagagatgtggaacaacactgctgcagacgataagcaaccttatgagaaaattctcctccacatagaactgaaggaaagcctgatgcagcagaagcggtag

SEQ ID NO: 226077 - DNA, 630 bp, Artificial Sequence
  Description of Artificial Sequence: Synthetic coding sequence
atggggaagggtgatccgaacaagccacggggaaaaatgtctagttacgcgttctttgtgcagacttgtagagaggagcacaaaaagaaacaccctgattcctcagttaattttgctgagtttagcaaaaagtgcagcgaaaggtggaagaccatgtcagctaaagaaaaatctaagttcgaggatatggccaagagtgataaagctcgctatgatagggaaatgaaaaactacgttcctcctaagggagataagaaaggcaagaaaaaggaccctaacgctcccaaacgccctccttcagcatttttcttattctgctcagagcacagaccaaagattaagagtgagcaccctggcttgtctattggagacacagcaaagaaattaggcgaaatgtggagtgagcagagcgccaaagataaacagccgtatgaacagaaagccgctaagctgaaagagaaatacgaaaaagacatagccgcatacagggcaaagggcaagtctgaagctggaaaaaaaggcccaggaagaccgaccggatctaagaagaaaaatgagcccgaggatgaggaagaggaggaggaagaagaagacgaggacgaggaggaagaagacgaggatgaagagtag

SEQ ID NO: 226078 - DNA, 630 bp, Artificial Sequence
  Description of Artificial Sequence: Synthetic coding sequence
atgggcaagggggatcccaacaagccacggggaaaaatgtcctcatacgctttttttgtgcagacctgcagggaagaacataagaagaaacacccagactcttccgtcaattttgctgagttctcaaagaaatgcagtgagaggtggaagactatgagcgctaaggaaaagtctaagttcgaggacatggctaagtcggataaagcacgttacgaccgggagatgaaaaactatgtgccgccaaagggagataagaagggtaagaaaaaggaccctaacgctcccaaacggcctccttccgctttctttctcttttgcagcgagcaccgccctaaaattaagagcgagcaccctgggctgtctataggggatacagctaaaaagctaggagaaatgtggtccgagcagtccgctaaagataagcagccttatgagcagaaggccgctaaactgaaagaaaagtacgagaaggacattgctgcctacagggccaagggtaagagtgaagcaggaaagaaagggccagggcgtccgaccggcagcaaaaagaagaatgaaccagaagatgaagaagaagaggaggaagaggaagatgaagacgaggaagaggaggacgaggatgaagaatag

SEQ ID NO: 226079 - DNA, 630 bp, Artificial Sequence
  Description of Artificial Sequence: Synthetic coding sequence
atgggtaagggagatcccaacaagccaaggggtaagatgagtagctatgcctttttcgttcaaacctgcagggaggagcacaagaagaaacaccccgatagtagcgtgaactttgcagagttcagtaagaagtgcagcgaacgctggaagacaatgtccgcgaaggagaagagcaaattcgaggacatggcgaagtccgacaaggcgaggtacgatcgagaaatgaagaactatgtgcctcccaaaggcgataaaaagggaaagaagaaagacccaaatgcacccaaacggccaccaagtgccttctttctcttttgctctgaacacaggcccaagattaagagtgagcatccaggtctgagcatcggtgatactgccaagaaactcggggagatgtggtccgagcaaagcgcaaaggacaagcagccttacgagcagaaagcagcgaaactcaaagagaaatacgaaaaagatatcgctgcctatcgcgcaaaaggcaaaagcgaggcgggaaaaaagggcccaggtcgacccactggctccaaaaaaaaaaacgagccggaggacgaggaggaagaagaagaagaggaggatgaagacgaagaggaagaggacgaagacgaggaatag

SEQ ID NO: 226080 - DNA, 405 bp, Artificial Sequence
  Description of Artificial Sequence: Synthetic coding sequence
atgggaaaaggtgacccaaataagccgagagggaaaatgagttcctacgcattttttgtgcagacctgtcgtgaagaacacaaaaaaaagcatcccgattcgagcgtgaactttgctgagttttcaaaaaagtgctctgaaagatggaagactatgtccgcaaaggaaaagtctaagttcgaagatatggccaagtccgataaggctaggtacgacagagaaatgaagaattatgtaccgccaaaaggggataagaaagggaagaaaaaggacccaaatgctcccaaaaggcctcccagcgccttctttctcttctgctccgagcatcgcccaaaaatcaagtccgaacaccccggattgtcaattggagacacagctaaaaaactaggagaaatgtggagttag

SEQ ID NO: 226081 - DNA, 603 bp, Artificial Sequence
  Description of Artificial Sequence: Synthetic coding sequence
atggctaaaggcgatccgaagaaaccaaagggtaaaatgagtgcctatgcattctttgttcagacgtgcagggaagaacacaagaagaaaaaccccgaagtaccggtaaattttgccgagttcagcaagaagtgttccgaaagatggaagactatgagcggcaaggaaaagagtaagtttgatgagatggctaaagcagacaaagtgcgctacgatagggaaatgaaagattatggcccagccaagggtggtaagaaaaaaaaagatccaaatgcaccaaagaggcccccttctggttttttccttttttgctcagaatttaggcctaaaattaaaagtacgaaccccggaatttcaataggcgacgttgcaaaaaagctcggtgaaatgtggaacaatctgaatgattccgaaaagcaaccctacataaccaaagccgcaaaactcaaggaaaagtacgaaaaggatgttgcagactataagtccaagggcaagtttgacggcgctaaaggaccagccaaggtggcccgaaaaaaagtggaagaggaggacgaggaggaagaggaagaggaggaggaggaggaggaggaggaggacgaatag

SEQ ID NO: 226082 - DNA, 567 bp, Artificial Sequence
  Description of Artificial Sequence: Synthetic coding sequence
atggcaaagggtgaccccaaaaagccaaaagggaagatgtcagcctatgccttctttgtgcagacctgcagagaggagcataagaagaaaaacccggaagtccccgtgaacttcgctgaatttagtaagaagtgttcggaacggtggaaaaccatgtcggggaaagaaaagtctaaattcgatgagatggcaaaggccgacaaagttcgttatgatagggagatgaaagattacggcccagctaaaggcggaaaaaagaaaaaggatccgaacgctcctaagcgcccaccttctggtttttttctgttttgcagcgagtttcgaccaaagatcaaatcaaccaacccaggaatctccatcggcgatgtggccaaaaaactcggtgagatgtggaacaatctgaatgattctgagaagcagccttacatcacgaaagccgcaaaactgaaggagaagtacgaaaaagacgttgctgattataaaagtaagggcaagtttgacggggctaaaggaccagccaaggtggcccgaaaaaaagtcgaggaagaggatgaggaggaggaatag

SEQ ID NO: 226083 - DNA, 462 bp, Artificial Sequence
  Description of Artificial Sequence: Synthetic coding sequence
atggcgaagggcgaccctaagaaacccaaaggcaaaatgtctgcgtacgcatttttcgtgcagacctgccgtgaggaacataaaaagaagaaccccgaagtccccgtgaacttcgcagaattttccaaaaagtgttctgaacggtggaagaccatgtccggcaaggaaaagagcaaattcgatgagatggccaaagctgacaaggtgcgctacgatagagaaatgaaggattacggcccagcaaaaggcggaaagaaaaagaaagacccaaatgcccctaaaagaccacccagcgggttctttctcttttgctctgagtttagacccaagataaagagcaccaacccaggcatctccattggcgatgtcgcaaagaaactcggggagatgtggaataaccttaacgattcagagaagcagccatatattacaaaagcagccaagctgaaggagaagtactag

SEQ ID NO: 226084 - DNA, 603 bp, Artificial Sequence
  Description of Artificial Sequence: Synthetic coding sequence
atggcaaaaggtgacccaaagaagcccaaggggaaaatgtccgcatatgcattcttcgttcaaacctgtcgggaggagcacaaaaaaaaaaatcctgaggtgcctgtgaattttgctgaattttcgaaaaaatgcagtgagcgctggaaaaccatgtcaggtaaggaaaagagcaaattcgacgagatggccaaggccgacaaagtgcgctatgacagagagatgaaagactacggccctgccaaggggggtaaaaaaaaaaaggatccaaacgcccctaagcggcctccctctgggttttttctgttttgctctgagttccgacctaagatcaagtccacgaacccaggcatctcaattggcgacgtcgccaaaaaactgggggaaatgtggaataatttgaatgattccgaaaagcagccttacatcacaaaggccgctaaactcaaagagaagtatgagaaggacgtcgctgactataagtctaagggtaagttcgatggggcaaaaggtcccgctaaagtggccagaaaaaaggtcgaggaagaagacgaggaggaggaagaagaggaagaggaggaagaggaagaggaagatgagtag

SEQ ID NO: 226085 - DNA, 582 bp, Artificial Sequence
  Description of Artificial Sequence: Synthetic coding sequence
atggccaagggcgaccccaagaagcccaaaggcaaaatgtctgcgtacgccttttttgtccagacctgccgtgaggagcataagaagaaaaaccccgaggtgccagttaacttcgccgaattttccaagaaatgttccgagcggtggaaaacaatgtcgggcaaagagaagagcaagttcgatgagatggccaaggcggataaggtgcgatacgacagggagatgaaggattacggtcccgcaaagggtggcaagaagaagaaggatcccaatgctccgaaacggcctccctcgggattttttcttttctgctccgagttccgccctaaaatcaagtctaccaaccccggtatatcaatcggcgatgtcgctaaaaagctgggtgagatgtggaataatctgaacgatagtgagaaacaaccttacattactaaggctgcaaagctcaaggagaagtacgagaaggatgtggccgactacaagtcaaaggggaagtttgacggggcaaagggccctgcaaaggtggcaaggaagaaggtggaagaggaggatgaagaagaggaggaagaggaggaggaatag

SEQ ID NO: 226086 - DNA, 273 bp, Artificial Sequence
  Description of Artificial Sequence: Synthetic coding sequence
atgccaaagcgtaaggcggagggcgacgctaaaggagacaaggccaaagtcaaggatgaacctcagaggagaagcgccaggctgtccgctaaacccgctccaccaaagccagaaccgaagcctaaaaaggcgccagccaagaagggcgagaaagtgccaaaggggaaaaagggcaaagcggatgcgggaaaggagggcaacaacccagcagagaatggtgatgccaaaacagatcaggcccagaaggccgaaggcgctggcgatgctaagtag

SEQ ID NO: 226087 - DNA, 234 bp, Artificial Sequence
  Description of Artificial Sequence: Synthetic coding sequence
atgccaaagcggaaatcacctgaaaacacagaaggcaaagatggatctaaggtgacaaagcaggaacccacccggagaagtgctcgcctgtcagcgaagcctgcaccaccaaagcctgaacccaagccacggaagacttcggcaaagaaggaacccggtgctaagattagtagaggcgctaagggaaagaaagaagagaagcaggaagccggtaaagagggtacagagaattag

SEQ ID NO: 226088 - DNA, 300 bp, Artificial Sequence
  Description of Artificial Sequence: Synthetic coding sequence
atgcctaaacgcaaatcccccgagaacacggagggtaaagacggttccaaagtcaccaagcaggaaccgacacgccgttcggcaaggctgtccgcaaaacctgctcccccaaaacctgagcccaagccacgcaagacatccgccaaaaaagaaccaggggctaagatttctcgaggtgcgaagggaaagaaagaagaaaaacaggaagccggaaaggaaggaactgcccctagtgagaatggcgagaccaaggccgaggaggcgcagaaaactgaatcagtggataatgaaggggagtag

SEQ ID NO: 226089 - DNA, 507 bp, Artificial Sequence
  Description of Artificial Sequence: Synthetic coding sequence
atggtcttattcttccgcattaacttacagacaaagaagtgcaaacaaaaaggcaagggcgagcagagagaaaaccgaccaaagtggttaacaaagaaactcaaaaaaacttatctccgaaaaaccggcaagcgaaggctccgtcgggtccagccacttatgaaacaggagcgcaagaaaccatccctgataaacaatcacattccctgcctgattagcggaccgtgcttaccgtcatgtacgatccagagaaacatatttattaattacttcgttaacgcttccttcttagttgcgctggagacatttttgcggaggcgcgaatctcacctgatccctttctttaaatgcaagtgcttttttctgcgaggcgagattatttgctggctgtttatcttctggtacaaccagaaaattgtatgggatatcgagctgtgggaagcactgactgtgtcaggcgtctccctgacattccacaggtggggcgtgtcattttatattctttag

SEQ ID NO: 226090 - DNA, 303 bp, Artificial Sequence
  Description of Artificial Sequence: Synthetic coding sequence
atgcccaagcgcaaggtttcatcagcggagggggctgctaaggaagagcctaagagacggtcggcccgattgagcgctaaacccccagcaaaagtggaagcaaagcctaaaaaggccgctgccaaggacaaatccagcgataaaaaagtgcaaactaaaggcaagaggggggctaaaggtaagcaggccgaggtggccaaccaggagaccaaagaagatctgcccgctgaaaacggggagactaagactgaagagagtccagcctctgatgaagcgggagagaaggaagcaaagtctgactag

SEQ ID NO: 226091 - DNA, 582 bp, Artificial Sequence
  Description of Artificial Sequence: Synthetic coding sequence
atgggaaaacagaactccaagttaaggcccgagatgctccaggatttgcgcgagaacacagaatttagtgagcttgagctccaggaatggtataaagggttccttaaggattgtccaacaggtatcctgaatgtggacgaatttaagaaaatttacgctaacttttttccatatggagatgcatctaaattcgctgaacacgtcttcaggaccttcgacaccaactcggatggcacaatagattttcgcgaattcattatcgctctctcggtgacatcacgtggaagactggagcagaaactgatgtgggctttcagtatgtatgacctcgacggaaatggctatatcagccgtgaagagatgttagagattgtccaggcaatctacaagatggtgtcgtcagttatgaaaatgccggaggacgaaagcacgccggaaaagaggacggagaagatctttaggcagatggatacgaataatgacgggaagcttagcctcgaggagttcattaggggcgcaaaaagcgatccatccatcgtgaggctgctgcaatgcgatcctagtagcgcttcccagttctag

SEQ ID NO: 226092 - DNA, 582 bp, Artificial Sequence
  Description of Artificial Sequence: Synthetic coding sequence
atggggaagcaaaactccaagctgaggccagaggtcttgcaggacctgcgggaaaacactgagttcactgaccatgaactgcaggagtggtacaagggctttctgaaagactgccctaccggccacctcaccgtcgatgagttcaagaagatctacgcaaatttttttccctatggggatgcctctaagttcgcagagcatgtatttaggactttcgatacaaacggagacggcacgattgactttagggaatttattattgcactcagcgtcacttcacggggaaaattagagcaaaaattgaagtgggccttctctatgtatgatctggatggtaatggttatatctcaaggtcagaaatgctggaaatcgtgcaggcaatttacaagatggtatcaagcgtgatgaagatgcccgaagacgaatcaactcctgagaaacgcactgacaaaatcttccgacaaatggatacaaataacgacggcaagctgtcactcgaagagtttatcagaggggctaaaagcgacccatccattgtccgactgctgcaatgcgatccatctagtgcatctcaattctag

SEQ ID NO: 226093 - DNA, 582 bp, Artificial Sequence
  Description of Artificial Sequence: Synthetic coding sequence
atgggcaaacaaaactccaaactgcgccctgaagtcctacaagaccttcgggaaaacactgagttcaccgatcatgagcttcaggagtggtacaaggggttcctcaaggactgcccgaccggtcacttgactgtggacgaattcaaaaagatttatgctaatttcttcccctacggtgatgcgtctaagttcgctgagcatgttttccgaactttcgataccaatggcgacgggactatcgacttccgcgagtttattattgccctatctgtcacttcacggggaaagcttgaacagaagctgaaatgggcattcagtatgtatgatctcgatggtaatggctacatctctcgcagtgagatgctggagattgtgcaggctatctacaaaatggtttcatccgtcatgaagatgcctgaggacgaaagcaccccagagaaaaggacagataagatcttccggcagatggataccaacaacgacggaaagctgtcattggaggaatttattaggggcgctaaaagcgatcccagcattgtgcgactgctccaatgcgatcctagcagcgctagtcaattctag

SEQ ID NO: 226094 - DNA, 93 bp, Artificial Sequence
  Description of Artificial Sequence: Synthetic coding sequence
atgggcaagcaaaactctaagcttaggccagaagtgttacaagatctcagagaaaacactgagttcaccgatcatgagcttcaggagtggtag

SEQ ID NO: 226095 - DNA, 3054 bp, Artificial Sequence
  Description of Artificial Sequence: Synthetic coding sequence
atgaaactgttgaaacctacatgggtgaatcacaatggaaagcccatctttagcgtggatattcaccctgatgggaccaaattcgctactggtggacaaggccaggattccggcaaggtggtgatctggaatatgtcgccggtgttgcaggaggacgacgaaaaagatgaaaatatccccaagatgctgtgtcagatggacaaccatctcgcatgcgtgaactgtgtgcggtggtccaattcaggaatgtacctggccagcggtggtgacgataagctgatcatggtgtggaagagggctacttacattggaccatcaactgtctttggttctagcggcaaactcgctaatgtcgaacaatggcggtgtgtttccatcctacgtaatcatagtggcgatgttatggatgtagcctggtcccctcacgatgcttggctcgctagctgtagcgtggacaacactgttgttatctggaacgccgtgaaatttcccgaaatccttgccaccctccggggtcactcgggccttgtgaagggactgacatgggaccccgtgggcaaatatatcgcctcccaggccgacgatcgaagtctgaaagtttggaggacgctggattggcagcttgaaactagtattacaaaaccttttgatgagtgtggaggaactacccatgttcttagattgtcctggtcccctgatgggcactacctggtctccgcacatgcaatgaacaattcagggcctacagcgcagatcatagagcgggagggctggaaaacaaatatggactttgttgggcacaggaaagcagtgacagtggtgaaatttaatcctaaaatttttaagaaaaagcaaaagaatggttcttcagccaaaccgagctgcccctactgctgctgcgcggtgggttccaaagaccgcagcctaagtgtttggctcacctgcctcaagcggccattagtcgtgattcatgagctgttcgataaatcaataatggatattagctggactctaaatggtctcggaattctagtatgtagcatggacggttccgtggcatttctcgacttcagccaggatgaactgggagacccactgagtgaagaggagaaaagccggatccatcagagcacatatggtaaaagcttagccatcatgaccgaggctcagttgagtacagccgtgattgaaaatccagagatgctcaaatatcagcggcgacagcagcagcaacaactggaccagaaatcagcagccacgagagagatggggtccgccaccagcgtggccggagtggtgaacggtgaatctctggaagatataaggaaaaacttgttgaagaagcaggttgagactcggaccgcagatggccgtaggcggatcaccccactctgtatcgcccaactagacaccggcgactttagcacggcattctttaattcaatccctctgagcggcagcctggccggtactatgctgagctcccactcgagcccccagctgctgccgctcgatagcagcaccccaaactctttcggggcttctaagccctgcaccgagcctgtagtggcagctagcgcgagaccagccggagacagcgtgaacaaagactctatgaacgccacctccactccggcagcgctgagtccaagcgtgctgacaactccatcaaagatcgagccaatgaaggcattcgacagccgattcacagagcgatcaaaggcgacaccaggagcgccagcactgacaagtatgacccctacggccgtggaacgattaaaagaacagaatcttgtgaaagaactaagacctagggatctgctcgaatcttctagcgactcagacgagaaagtgccactggcaaaggcctcctccctttccaaacggaagttggagctcgaggttgagacagtggaaaagaagaagaaagggcgtccgagaaaggatagtaggctaatgccggtaagcctctcagttcagagccctgctgctctgaccgctgagaaggaggctatgtgcctgagcgccccagctttagctctaaaactccctatacccagtccccagcgggcatttacactgcaggtttcaagcgacccatcaatgtacattgaggtcgagaatgaggtgaccgtggtgggtggagtgaagctcagccgcctcaaatgtaaccgtgaggggaaggaatgggaaacagtccttacatcccggatcttaacggccgctggctcgtgcgatgtggtctgcgtagcgtgtgagaaacggatgttatctgtgttttctacttgtggacgtagactgctgtctcccatcctgctgccctccccaatctcaacactgcactgcactggaagctatgtcatggctctgaccgccgcagcaaccttgtcagtgtgggatgtgcaccggcaagtggtggttgtgaaagaggagtcccttcatagcatcttggccggaagcgatatgaccgtatcccagatattgctgactcagcatggtatcccagttatgaatcttagcgacggcaaggcatattgtttcaatccttcactgtctacctggaacctcgtaagcgacaagcaggattcactagcccagtgcgcagattttcgtagttcacttccctcccaggacgcaatgctctgctcgggacccctggcaatcatacaagggaggacgtcaaatagcggaaggcaggccgctagactctttagtgttcctcacgtggtacagcaagaaaccacgctcgcttatttggaaaaccaggtggcagcggcacttacactacagtcatctcacgagtacaggcattggctcctcgtgtacgccaggtacctggtgaacgaaggtttcgaatatcgcctgcgagagatctgcaaggatctcctgggtcccgtacattactcaaccggatcccagtgggaaagtaccgtggtcggtctcagaaaacgagaactattgaaagagcttttacccgtgattggtcagaacttgaggttccagcgcctgttcactgaatgccaggagcagctggacatactgcgtgacaagtag

SEQ ID NO: 226096 - DNA, 2433 bp, Artificial Sequence
  Description of Artificial Sequence: Synthetic coding sequence
atgaaattgctcaagccaacctgggtgaatcataacggtaagcccattttctctgtcgatatccacccagatggcacgaagtttgcaaccggaggccaggggcaggactctggaaaggtcgttatttggaacatgtcgcccgtgctgcaggaagatgatgagaaagacgagaatatcccaaaaatgttgtgtcagatggacaatcacttagcatgtgtgaactgcgtgagatggtcgaactccggcatgtatttggcctctggaggcgatgacaaacttattatggtgtggaaacgcgcaacttacataggcccatcaactgtatttggatcttctggtaaacttgccaacgtagaacaatggaggtgcgtgtcaatcctccgcaatcacagtggtgacgtgatggacgtggcttggtccccgcatgatgcatggttggcatcttgctcagtcgataataccgtggtcatttggaacgccgtcaagttccctgagatcctagctacactcaggggccacagcggccttgtgaaaggtctcacctgggatcccgtgggcaagtacatcgccagccaagcagacgaccgctcactaaaggtatggcgaacactggattggcagctggaaactagcattactaagccgttcgacgagtgtgggggaacaacacacgtgctgaggctgtcatggtccccagatggacattacttggtgtccgcccacgcgatgaacaacagcggccctacagctcaaatcatcgagcgcgaaggatggaagacaaacatggatttcgtggggcaccgaaaagcggtcaccgtagtgaagtttaatcctaaaatctttaaaaaaaaacagaagaatggatcctccgccaaaccttcctgcccatactgctgctgcgccgtaggaagcaaggataggtccctgtctgtgtggctgacatgtttgaagcgcccacttgttgttatccatgagctgtttgataaaagcattatggatatctcctggactttgaatggattggggatattggtgtgtagcatggacggatctgtagcctttctggacttcagccaagacgagcttggtgatcctctgagcgaagaagagaagtctagaattcatcagagtacatatgggaagtccctggccatcatgaccgaggcccagctttctacggctgtgatcgaaaatcctgaaatgctgaagtaccagagaaggcagcaacaacagcagcttgaccagaaaagcgctgccacccgcgaaatgggaagtgccactagtgtggccggtgtggtgaatggcgaaagtctggaggacatccgcaagaacctgctgaagaagcaagtagagactaggactgcggacggacggaggaggatcacacccctgtgcatcgcccaattagacacgggggatttctcgacggccttttttaattctatccccctgtcaggatcccttgccggaacgatgctgtcttcacacagctcacctcagctgctgcccctggacagtagcactcccaactcttttggcgctagcaagccttgtaccgaaccagtggttgctgcgtccgctaggcctgccggagattccgtaaacaaagattctatgaacgctacttcgacacctgccgctctctcccctagcgtcctcacaaccccctctaaaatcgagccgatgaaagcgtttgatagccgcttcactgaacggtcaaaggctacccctggcgctccagcgctcactagcatgacccccaccgccgtggaaagggatgtgcacaggcaggttgttgtggtgaaggaagaatccctccattccattcttgctgggtcagacatgacagtgagtcaaattttgttgacccagcacggcattcccgtcatgaatctctctgacggaaaggcatattgctttaacccatccctgtctacctggaaccttgtgtccgacaagcaggacagcctggcacaatgcgcggattttcgatcatctctgccgagtcaagatgcgatgctgtgtagcggcccacttgctatcatccagggtaggacctctaatagcgggagacaggccgctaggctgttttccgtcccgcatgtcgttcagcaagagactaccttggcatatctggagaaccaagtcgccgctgccctaacactgcaaagctcacacgagtataggcactggctgcttgtgtacgcccgttacctggtaaacgagggattcgaatatcggctgagggagatttgtaaggacctgctgggcccagtgcactactctacaggcagccaatgggagtctaccgtggtcggcctgaggaagcgggaactgctcaaggaactgctacccgttataggccagaatctgagattccaacgacttttcaccgaatgccaggaacagctggatatccttcgcgataagtag

SEQ ID NO: 226097 - DNA, 1815 bp, Artificial Sequence
  Description of Artificial Sequence: Synthetic coding sequence
atgctgtcttctcattctagcccccaattattgcccctggactccagcacacctaacagttttggagcaagtaagccctgcacagagcccgtagtggcggcaagcgcccgacctgctggggacagcgtgaataaagattcgatgaacgccacatcaacaccagccgctttgtctccttccgtgcttaccaccccctctaagatcgaacccatgaaggccttcgactcacgctttactgagagatcaaaggccacacctggtgcaccggcactgacttctatgactcctaccgcggtggaacggctcaaggaacagaacctcgtcaaagagctcaggcctcgggatctgttggaatcaagttctgatagcgacgaaaaggtgcctcttgctaaagccagtagtctgtccaagcggaaactggaactggaagtcgagacagtggaaaagaaaaaaaaaggccgacctagaaaagactctcgcctcatgccagtgtccctctcagttcagtcgcctgctgccctcactgccgagaaagaggcaatgtgtctctctgcccctgccttagcgctgaaattgcccatcccatcgcctcagagagcgtttactctgcaagtgagcagtgatccttcaatgtacatcgaggtggagaacgaagtcacggtggtaggtggcgttaagttatcacggctgaagtgcaatagagagggcaaggagtgggaaacagtgctgacatcaagaatcctaacagccgcaggcagttgcgacgtcgtgtgcgtggcatgcgagaagagaatgctctccgtgttctccacttgcggcagaagattgctttctccaatactcctcccctctccgatctccactctccactgtacaggcagctacgtgatggcacttacagctgctgccactctttccgtgtgggacgttcacaggcaggtagtggtggtcaaggaagaaagcctgcactctatcctcgcaggctctgatatgacagttagccaaatactgctgacccagcatggcatccccgtaatgaacctctcggatgggaaggcctactgctttaatccatctctgagcacttggaatctggtgtcggataaacaagactcccttgcacagtgtgcagacttcaggtctagcttgccgagtcaggatgctatgctgtgcagtgggccactggcaattattcaagggcgtacaagtaattctggaagacaggcagcacggcttttttcggtgcctcatgttgtgcagcaagagacaacactggcctatctggaaaatcaggtcgcagccgctctgactttacaaagctctcacgagtaccggcactggctgctggtttacgcgaggtacctggttaacgaaggctccgccgaggagggtgccgcagaaggggcagccacatcccacagggccgagcctcctattcccgcacccctgcaccgtgtctccggaaccgcccgacatcctgaagggcaggtcgcttgtccaagcctcccatggctgcaacaaggtcaggggcacactctggctgctgatgatatgcaagatagactgtcacccgaccaggccgtagggggaggcgatacaggaaggcgctgcgccgtgctgcatcaaaggcagccttctagcctaggccgatgtgcgctctgtccaggctctgacatcgcttctggagggggatcttcttcactgccgccatccccacgctgcggtgccagggcgggagcacttccacgctgcccgggtgcctcaaaagccgtgccaggcctgccatctcccgctcgaccacagggagggcactag

SEQ ID NO: 226098 - DNA, 2922 bp, Artificial Sequence
  Description of Artificial Sequence: Synthetic coding sequence
atgtccccggttctgcaagaagacgatgaaaaggatgaaaacattcccaagatgctgtgtcaaatggacaatcatctggcctgtgttaattgcgtccggtggagcaattccggaatgtatctggcctcaggaggtgacgacaagctgatcatggtgtggaaaagagcgacctacattggtccttcaacggtattcggaagctccggaaaactggctaacgtggagcagtggcggtgtgtgtcaattctacggaatcactccggagacgtcatggatgtggcgtggtccccgcatgatgcttggctcgcatcttgctcggtagacaataccgtggtgatatggaatgccgtcaagttcccagaaattcttgcaacactgcggggacacagcggccttgtaaaggggttgacctgggacccagttgggaagtatatcgccagccaggctgacgacagaagcctgaaagtgtggaggacactcgattggcagctggaaaccagtataaccaaacctttcgatgagtgtggtggcactactcatgtccttcgcctgtcttggtctccggatggtcactacctcgtcagtgctcatgcaatgaacaactctgggccaaccgcacaaattatcgaaagagaaggatggaagaccaacatggattttgtgggccatagaaaagcggtgactgtcgtgaagtttaaccctaaaattttcaaaaagaagcagaagaacggctccagtgcgaagcccagctgcccctattgctgttgcgccgtgggcagcaaggacagatctctgtcagtctggttgacctgtctgaagagacctctggtggtcattcacgagctgtttgacaagtctattatggacatcagctggaccttgaatgggttgggcattctggtgtgctctatggatggttcagttgcctttctggacttcagccaggacgagctgggcgatccgctgtccgaagaggagaagtctaggatccaccagagcacatatggcaagtccttggccataatgacagaggctcagctgtccacagccgtgattgaaaatccagagatgcttaaataccaacggcgacagcagcagcagcagcttgaccagaagagcgccgcaacccgcgagatgggatcggctaccagcgtggctggcgtcgtgaacggagaaagcctcgaagatatccggaaaaaccttttgaaaaagcaggtggaaacgcgcactgccgacggaagacgcagaataaccccactttgtatagcccagctggataccggggatttctccaccgctttctttaacagcataccgctgtctgggtccctggcaggcaccatgctgtcctcacattcgtctcctcagctcttacccttggatagctctacacctaacagtttcggcgcttctaaaccatgcaccgagcctgtggtcgctgctagcgctcgccctgccggtgactctgtgaacaaagattctatgaacgctacgtctactcccgcagcattgtctccctctgttctcacaacacctagcaagatcgaacctatgaaggccttcgactctaggttcaccgaacgatctaaggcgacccctggcgcacctgctctgactagtatgactccaacagccgtggagcgattgaaggagcagaatctcgtgaaggaactccggccaagggatctcctggagtcctctagtgacagcgatgagaaagtacctctagccaaagccagtagcttatccaaaagaaaacttgaactagaggtcgagacggtcgaaaaaaaaaagaaaggaaggcctcgcaaagatagtcgtctgatgcccgtgtctttatcagttcagtcgccggctgccttgacggctgagaaggaagctatgtgcctgtctgcacctgcattggctttgaagctcccgatacccagtccccagcgggcttttacgctccaagtcagctccgaccccagtatgtatattgaggtggaaaatgaagtcacggtggtcggcggtgtaaagttatctagactgaagtgcaaccgcgaaggaaaggaatgggaaaccgtgctgacttcgaggatcctgactgcagctggatcatgcgacgtggtgtgcgtcgcttgtgaaaaaagaatgctctctgtgttttccacttgtggcaggagattgctttcaccaattcttcttccatcaccaatcagtacgcttcactgtacgggttcttacgtaatggctctaactgcggctgccaccctctctgtgtgggacgtccatcgtcaggtggttgtggtcaaagaagagtccttgcactcgatcttagcaggtagcgatatgaccgtgagtcagatcctcctaacccaacatgggattccggtcatgaacctctctgacggaaaagcttattgttttaatccaagcctttccacgtggaacttggtttccgataaacaggattcccttgcccagtgcgctgatttccgcagttcactcccatcgcaagacgccatgttgtgtagcggcccattggcaattatacagggtcggacatccaacagtggacgacaagcggcaaggctattcagcgtcccccacgtggttcaacaggaaacgaccctggcatacctggagaaccaggtggccgcagcgctgaccttgcagagctctcacgaatacagacattggctcctagtgtacgcccgttatctggtcaacgaggggtttgagtatcggctcagagaaatctgcaaggatctccttggacccgtacactacagcacagggtcacagtgggagagcaccgtggtcgggctaagaaagagagaactgctaaaggagttactgcctgttataggacaaaatctgcgttttcagagactgtttactgaatgccaggaacaattggatatattgcgggataaatag

SEQ ID NO: 226099 - DNA, 2421 bp, Artificial Sequence
  Description of Artificial Sequence: Synthetic coding sequence
atgtcacctgttctgcaggaagacgatgagaaagatgaaaatattccgaagatgttgtgtcagatggacaatcacctggcctgcgtcaactgtgtgaggtggtctaattcagggatgtatctcgcatcaggcggagacgacaagctcatcatggtctggaaacgggcaacatatatcggccctagcaccgtttttgggtcttccggcaagttggccaatgtggagcaatggagatgcgtgtctatactccgtaatcattctggtgacgtgatggacgttgcttggtccccgcacgacgcctggctggcctcatgttccgtcgacaatactgtggtgatctggaacgcagtcaagttccccgaaattctcgcaactctccgagggcactcaggcctggtcaagggactgacctgggaccccgtaggaaagtacatcgccagccaggctgacgaccgtagcctgaaagtctggcggacactagactggcaactcgaaacgagtatcaccaaaccctttgatgaatgtggaggaaccacccacgtcctgcggctttcttggagtccagacggacattatttggtgtctgcgcatgcgatgaataatagtggaccaactgcccagattatcgaaagagaaggctggaaaacaaatatggactttgtcgggcaccgaaaagctgttacagtagtaaaattcaatcccaagatttttaagaagaagcagaaaaatggttcaagtgccaagccaagctgcccctattgctgctgcgcagtcggctcaaaggaccgtagtcttagtgtgtggctgacctgcttgaagagaccccttgtggtgatccacgaacttttcgataaaagtattatggacattagctggaccctcaacggactgggtattctcgtgtgttcaatggacggcagcgtggcgttcttggacttctctcaggatgaactaggcgaccccctgtctgaggaagagaagagtagaattcaccagtctacttatgggaaatccctagccatcatgacggaggcccagctgagcacagcggtcatcgagaacccagagatgctgaagtatcagcgcagacaacagcagcagcagttagatcagaaaagcgctgcaacacgagaaatggggtcagccacttcagtagctggggtcgtgaatggcgagagtctcgaggacattagaaagaatctgctcaaaaagcaggtcgagacacggacggccgacggtcgacgcaggatcacacctctgtgcattgcccagcttgacaccggcgatttctcaactgctttcttcaacagcatcccactatccgggtctctcgctggcaccatgctcagctcccactcctctccccagctgctaccactcgacagcagtaccccaaacagttttggggcttccaaaccatgtactgagccagttgttgcagcaagcgctagacctgctggggactcagtcaacaaggactctatgaacgcgacatctacgccagccgctctgagtcctagcgtgctcacaaccccttcaaagattgaacccatgaaggcttttgacagtcgtttcacggagcggtcaaaggccacaccaggggcacccgcactcacgtcaatgacacccactgcagtggagcgtttaaaggagcagaacctggtcaaggagttacgccctagagatctgctggagtcgtcctcggactcggacgagaaagttccactcgcaaaggcttccagcctgtccaaaagaaaactggaactggaggtcgagactgtcgagaagaagaaaaagggtcgaccaaggaaggactctcggctgatgcctgttagcctctctgtgcagtcccccgcagccttgactgcagagaaagaggccatgtgtctctcagcaccggctctggcactgaaattgcctataccaagtccccagagggctttcacattgcaggtgagcagcgacccaagcatgtacattgaagttgagaatgaggtgacggttgtaggtggagtcaaactctccagactgaagtgcaatcgagaggggaaggaatgggaaaccgttttaacatcgcgtatactgacagctgcgggtagctgtgacgtcgtttgtgtagcctgtgaaaagcgtatgctttccgtctttagcacctgtggaagacggctgctatcaccaatcttgctcccttcaccaatctctaccctccactgcactggctcttacgttatggctctcacagctgccgctactctcagtgtctgggacgtgcatagacaagtggttgtcgtgaaggaggaatccctgcattcaattttggcaggcacttggtttcttacatcacggacccattggctgagcgttcaaacactgggggcagcctgccatcctaggaccccatgctgcgctcaggatcgctag

SEQ ID NO: 226100 - DNA, 156 bp, Artificial Sequence
  Description of Artificial Sequence: Synthetic coding sequence
atggccagctcaatgaggagcctgttcagtgatcatggaaagtacgttgaatcttttcgcagatttctgaatcattctacagaacaccaatgcatgcaggagttcatggacaaaaaactgccgggaattatcggacggtaccaaaactgctgctag

SEQ ID NO: 226101 - DNA, 879 bp, Artificial Sequence
  Description of Artificial Sequence: Synthetic coding sequence
atggcctcaagcatgcgctcgctgttcagtgatcacggaaaatacgtggagagtttccggaggttcttgaatcacagtacggagcaccagtgtatgcaggaatttatggacaaaaagttacccggtatcattgggaggatcggtgatacgaaatcagaaatcaaaattctctccatcggtggaggagcaggagagattgatctgcaaatactgagcaaggtgcaagcacaataccccggtgtgtgcatcaataacgaggtggtggaacccagtgcagaacagatcgccaagtacaaggagctcgtggcaaagaccagcaacttggaaaatgtcaagtttgcatggcataaggagacatcaagtgaataccaatcaagaatgttggaaaagaaagagctccagaaatgggattttattcatatgatccagatgttatattacgtgaaggatatccctgctactctgaagtttttccacagcctcctcggcaccaatgccaaaatgctcatcatcgtggtgtccggttcctcaggatgggacaaattgtggaagaagtatggatcacgctttccacaggatgatctgtgtcagtatattacatcggacgatctgactcagatgcttgataatctggggctcaagtatgaatgctacgatcttcttagtactatggacatctcagattgttttatagatggcaatgagaatggcgacctgctttgggacttcttgacagaaacctgcaatttcaacgctactgcaccgccagatcttagggcggagctgggcaaggacttacaggagccagaattcagcgctaagaaagaaggcaaagttctctttaataatacactcagtttcatcgtaatcgaggcgtag

SEQ ID NO: 226102 - DNA, 381 bp, Artificial Sequence
  Description of Artificial Sequence: Synthetic coding sequence
atggcaagctctatgaggagcctttttagtgatcatggtaaatacgttgagtccttcagaagattcttaaatcattctaccgaacaccagtgtatgcaagaatttatggacaaaaagttgccagggataattggtaggatcggcgacactaagagtgaaattaaaattctaagcatagggggtggcgctgattgcctgataaggggcagcagtagggtcttaaaaagaaatagctgttttatcctttgttctactcgccagaaagacaaacctggaatgagaatccacgatgaacgatcttcagaactccctttcggggcagccaggttggaatccaaatctgcttttccgagttttctggtctcattcattcttttctag

SEQ ID NO: 226103 - DNA, 879 bp, Artificial Sequence
  Description of Artificial Sequence: Synthetic coding sequence
atggcaagctccatgagatctttgttctcagatcacggaaagtacgtggagtctttccggagattcttgaaccattctactgagcaccaatgcatgcaggagttcatggataaaaagttgccaggcataataggaagaatcggggatacaaagtccgagattaaaatactttccattggtggtggagcgggtgagatcgacctccaaatactcagtaaagtgcaggcccaatatcccggagtttgcatcaacaatgaggtggtggagccttccgcagaacagatcgctaaatacaaagaactggtcgctaaaacgagcaacctggagaatgtgaaattcgcctggcacaaagaaacaagttcagagtatcagtcccggatgctcgagaagaaagaacttcagaagtgggactttattcacatgattcagatgctttattacgttaaggatattccagctactctaaagttttttcactcattactgggcactaatgctaagatgcttatcatcgtggtgtcggggtcctcaggctgggacaagctctggaagaaatacggatccagattcccacaggacgacctctgccagtacattaccagtgacgatcttactcaaatgctggacaatctggggctcaaatatgagtgctacgatcttctgtccacaatggacatctcagactgttttatagacggcaacgaaaacggggatttattgtgggattttctgacagagacttgtaatttcaacgctacagctccgccagacttgagggccgagcttggcaaggatttacaggaacccgaattcagcgccaaaaaggaagggaaggtcctgttcaacaacactctgagttttatagtgatcgaagcctag

SEQ ID NO: 226104 - DNA, 1464 bp, Artificial Sequence
  Description of Artificial Sequence: Synthetic coding sequence
atgtctctgccaaacagctcttgccttctggaagataaaatgtgcgaagggaataaaactacaatggccagcccacagctgatgcccctagtcgtagtgctgtctactatatgtttagttacggtgggactgaaccttctggtcctgtacgctgtgaggagtgagaggaagttgcatacagtgggtaacctgtatattgtgagtttgtcagttgccgacttaattgtcggagccgttgttatgccaatgaacatcttgtatcttctgatgtccaaatggagcctggggaggcccctttgtttgttctggctgagtatggactacgttgctagtaccgcttcaatcttttcagtgttcattctctgcatcgacaggtacagatccgtacagcagcccctgcggtatctaaaatatcgcactaagacccgggcatccgccactattctcggtgcgtggttcctgtccttcctctgggttattcccattctgggctggaatcacttcatgcagcaaacgtcagtgcgcagagaggataagtgcgaaacagacttttatgacgtcacctggttcaaggtgatgaccgcaattatcaacttctacctgcccacgcttctcatgctgtggttttacgccaagatctataaggctgttaggcagcattgccaacatcgtgagctcatcaaccgaagcctcccttcattttctgagatcaaactgagacctgagaatcctaagggagatgccaaaaagccgggtaaagaaagtccatgggaagtgcttaaacgcaagcctaaagacgctggcggaggttctgtgctgaagagccccagtcagacaccaaaggaaatgaagtcccccgtggtattcagccaggaggatgacagggaggtggacaagctctactgctttcccctggatatagtccacatgcaggccgctgctgagggctcttctcgcgattatgtggcagtgaacagatctcacgggcagctgaagaccgatgagcaagggctgaatacccacggcgcatcagagatttccgaggatcaaatgctgggagacagtcagtctttctctagaacagacagtgacacgaccactgaaaccgccccaggcaaaggtaagctaagatcagggagcaatactggcctcgactacataaaattcacctggaaaagactaagatcacactcaaggcagtacgtgtccggattgcatatgaaccgggaacgcaaggccgcaaaacaactgggtttcatcatggcagcatttatactgtgctggatcccttattttatcttctttatggtgatcgccttctgtaaaaactgttgcaacgagcatctgcatatgttcaccatatggttaggatatattaattccactcttaacccattgatctacccactgtgcaatgagaacttcaaaaaaaccttcaagagaattctccacattaggtcttag

SEQ ID NO: 226105 - DNA, 39 bp, Artificial Sequence
  Description of Artificial Sequence: Synthetic coding sequence
atgagcttacccaattcatcatgcttactcgaggactag

SEQ ID NO: 226106 - DNA, 1464 bp, Artificial Sequence
  Description of Artificial Sequence: Synthetic coding sequence
atgtccctacctaacagttcatgtctgctggaggacaaaatgtgtgaaggaaacaagaccaccatggcatcacctcaattaatgcctctggtggtagtgctgtcgacaatttgcctcgtcacagttggattaaatttattggtgctgtatgcggtacgcagtgaacgcaaactgcacacggtcgggaacctttacatcgtgagcctatccgtagcagacttgattgtgggagccgttgtgatgccaatgaatatattgtacctgctgatgagtaaatggtcactagggagacccctgtgtctattttggttatctatggactacgttgcgtccactgcatccatattttcagtctttatcctgtgcatcgacaggtatagatcagttcagcagcctctaagatacttaaaatatcgaaccaagaccagagcttcggcaacaattctgggggcttggttcctgtctttcctctgggtaattccgatcctgggatggaaccattttatgcaacagaccagcgtccggagagaagataagtgtgagacggatttctacgatgttacctggttcaaggtgatgacagctatcatcaatttttatctgcccacgctgctcatgctgtggttctacgcaaaaatttacaaagccgtacgacagcattgccagcacagggagctgatcaatcgtagtctaccctccttctctgaaatcaaacttaggcctgagaatcccaagggagatgcaaagaagcctgggaaggagtcgccatgggaggtgcttaaacggaaaccgaaagacgcgggaggtggatctgtgctcaaaagcccctcccagactcccaaagaaatgaagtcgccggtggttttctctcaggaggacgatcgagaagtcgacaaactgtattgttttccactggacattgtccacatgcaggcagctgccgagggctcttctagggattatgtggcagtgaatagatctcacgggcagctgaagacagacgagcaggggctgaacactcatggtgcttccgaaatcagtgaagatcagatgctgggagactcccagtcattctcacgcaccgattccgacactacaaccgaaactgccccaggaaaaggcaaactgcggtctggcagtaatacagggcttgattatattaagtttacatggaagcggttgaggagccatagccgacagtatgtatcaggcctccatatgaatcgagaaagaaaggccgcaaaacagctcgggttcattatggcggcttttatcctgtgttggatcccctactttatcttttttatggtcattgccttttgtaaaaactgctgtaatgaacatctccatatgttcacaatctggctgggatatattaactcaacacttaaccccctgatttacccactgtgtaatgagaattttaagaagacttttaaaaggattttgcacattagaagttag

SEQ ID NO: 226107 - DNA, 1464 bp, Artificial Sequence
  Description of Artificial Sequence: Synthetic coding sequence
atgtcgcttccgaacagcagttgtcttctcgaggacaagatgtgcgaaggaaacaaaaccaccatggcgagtccgcagctcatgcccttagtcgtggtgttgagtaccatctgtctagtaactgtcggtttgaatctcttggtgctgtacgctgtcagaagcgagcggaagctacacactgtggggaacctttacattgtgtccctatctgtggctgatctcatcgtgggagcggttgttatgcctatgaacattctgtatctcctgatgagcaaatggtctctgggcaggcccctatgcctgttctggctgagcatggattacgtcgcctctacagcaagcatattctcagtcttcattctgtgcattgatagataccggagtgtgcaacaaccactcagatacttgaaatacagaaccaaaacgcgggcatcagccacaattctgggcgcttggttcctcagtttcctgtgggttatcccaatcttgggatggaaccactttatgcagcagacgagcgtacggcgagaggataagtgcgaaaccgatttttacgatgtgacctggttcaaggtcatgacagccattatcaatttttacctgcctactcttttgatgctttggttctacgccaagatctataaggccgtcaggcagcactgccagcaccgcgaactcatcaacaggtccctccctagtttttctgagataaagctgcggccagaaaaccccaaaggtgacgcgaaaaagccaggcaaggaaagcccatgggaggtgctgaagcggaagcctaaggatgccggaggaggcagcgttctcaaaagccctagccagacgcctaaggaaatgaagtctccggtggtgttttcacaggaggatgatagagaggtggataagttgtactgctttccacttgacattgtccatatgcaggccgcagctgagggaagttcaagagattacgtagcagtgaaccgatcacatgggcaacttaaaactgatgaacaaggattgaatacacacggggcatccgagatctctgaagaccagatgttaggggactctcagagcttctcacgtacagatagtgacaccactactgaaaccgcccctggcaagggcaagctacgttccggctctaacacaggcctcgattacatcaagttcacctggaagaggttgcgatctcacagtaggcagtatgtgagtggattacatatgaatcgagagaggaaggcggcaaaacaactcggctttatcatggcagctttcattctttgctggattccctactttatcttttttatggtaatcgccttctgtaagaattgctgtaacgagcacctccatatgtttaccatttggttaggctatatcaactctaccttaaaccccctcatctatccgctgtgcaacgaaaacttcaagaaaacgtttaagcgaatacttcacattcggagttag

SEQ ID NO: 226108 - DNA, 816 bp, Artificial Sequence
  Description of Artificial Sequence: Synthetic coding sequence
atggcggctcctcaggacgtacacgtccggatctgtaaccaggagattgtgaagttcgatcttgaggtcaaggcgttaatacaggatattcgtgattgcagcggaccactgagcgcactgacggaactaaacaccaaggtgaaagagaagtttcaacaacttaggcacaggatccagcctgtcttataccagcgcgcatttatatggaccgcttcgaccttctttttcaaactgacatattcactgaccgatttctcgagcactcagcatgactttaactctccgactacacctgtaaccttttctgacctggagcagctcgccaaagagcaggataaagaatccgagaaacagctgctccttcaggaggtggaaaatcacaaaaaacagatgctcagtaatcaagcctcctggcggaaggcgaaccttacatgcaagatagccatagataaccttgaaaaagccgagttactgcaggggggtgatcttttgaggcagcgcaagacaacaaaggagtcactggcacagacgtcttctactatcactgaaagcttgatgggcatctctcggatgatggcccaacaggtgcagcagagcgaggaggccatgcaatctttggtcacaagtagccgtacgattcttgacgctaatgaagagttcaaaagcatgagtggtaccattcagctcgggcgaaaactcatcaccaagtacaacagaagagagttgacggataagctcctgatattcttggcactcgcactgttcctggcaaccgttctgtatattgtgaagaagagacttttcccgtttctttag

SEQ ID NO: 226109 - DNA, 1194 bp, Artificial Sequence
  Description of Artificial Sequence: Synthetic coding sequence
atggccccaaacggcactgcatccagcttctgtctggatagcacagcctgtaaaatcacaatcacggtcgttctcgccgtgctgatcctgatcacagttgccggaaatgtggtggtatgtctagcggtcgggctgaataggagattacgcaacttaaccaactgttttatcgtgagcctcgctatcacagaccttctgctcgggctactcgtgttgccgtttagtgcaatttatcaactctcttgcaagtggtccttcgggaaagtgttctgcaacatatacacgtctctcgacgttatgctgtgcaccgcaagtatcctaaacctatttatgatctccctggacaggtactgcgccgtaatggaccccttaagatacccagttctcgtaacccccgtcagagtggcaatctcccttgtgctaatttgggtgataagcataactctgtcttttctgtccattcacctcggttggaactcaagaaacgaaacgagcaagggcaaccacaccacttcaaaatgcaaggtccaggtaaacgaggtgtacggactggtggacggccttgtgactttctacttgccccttctgattatgtgcatcacgtattataggatttttaaggtcgcgcgtgatcaagcaaagcggattaatcatatctcaagttggaaagctgccacaattagagagcacaaagctacagtgactcttgcggcagtaatgggcgcttttatcatctgttggtttccatattttaccgcttttgtctataggggcctgagaggcgatgatgccatcaacgaggtgctggaagcaattgtgttgtggctggggtatgcaaacagtgccctcaacccaatactctacgcagcccttaaccgggatttccgcaccggataccagcagctcttctgctgtcggctggccaaccggaatagtcacaagacttcccttcgatccaacgcgagccagctctctcggacccagtctcgggaaccacgccaacaagaagagaaacctctgaaacttcaagtgtggtccggcaccgaggtgacagcacctcagggagctaccgatagaccctggctgtgcctcccagagtgctggtcagttgagctcacacactcattcattcacttattcatccacagcttcgcgaatatccaccctattccaaccacatgtcaggagctctag

SEQ ID NO: 226110 - DNA, 1173 bp, Artificial Sequence
  Description of Artificial Sequence: Synthetic coding sequence
atgcccgataccaattctacaattaacttgagtttaagtacccgtgtgacactggcctttttcatgagcttggtggccttcgctattatgctaggcaatgccctcgttatcctggctttcgtcgtcgacaagaacctgcgacacaggtcaagctatttctttctgaatctagctattagtgacttcttcgtgggcgtaatctcaatacccttgtatatcccgcacactttgtttgagtgggacttcggaaaagagatctgtgtgttctggctgacaacagactatctgttgtgcactgctagcgtctacaatattgtcttgataagctacgaccggtatttgtcagtctccaatgccgtatcctatcggactcaacacaccggggtgctgaaaatcgttacattgatggttgcagtgtgggtactggcgtttctggtgaacggccctatgatactggtctcggagtcctggaaagatgagggcagcgagtgcgagcctggtttcttctccgaatggtacatcttagccatcacatcttttctcgaatttgtaatacccgtaatattagtcgcttattttaatatgaatatatactggagtctctggaagcgtgaccatctgtctaggtgtcaaagccaccccggattgactgctgtgtcttcaaacatctgcggacacagtttccgagggcgactctcctcacggagatcactgtcagcctcaacagaagttccagcctcattccactccgagagacagagaaggaagagttcgcttatgttttcctctcgtactaaaatgaatagtaacaccatcgcctcgaaaatggggtcctttagccagagcgactcagtggccttacaccagagggaacacgtggagctgttgcgggctcgcaggttggccaagagcttggctatactactcggcgttttcgcagtgtgctgggccccatacagcctgttcactatagtgctgtctttctactcctccgcgactggccctaagagcgtgtggtaccgtattgcattttggcttcagtggttcaattcatttgtgaatcctctgctgtatcccctatgtcataaaaggtttcagaaggcatttcttaagatcttctgcattaaaaagcagcccctgcctagccagcactcccgatctgtctctagctag

SEQ ID NO: 226111 - DNA, 909 bp, Artificial Sequence
  Description of Artificial Sequence: Synthetic coding sequence
atgcccgatacaaacagcactataaacctgtctctcagtacaagggtgacactggccttttttatgagtctagttgcctttgcgatcatgctgggaaatgcactggtgatcctcgcatttgtggttgacaaaaacctgcgccataggagtagctactttttcctaaacctcgccatctctgacttcttcgtggtctcagaaagctggaaggacgaggggtcagagtgtgagccaggtttcttcagtgaatggtacatattggctatcacctcattcctggagttcgttattcctgttattcttgtggcgtacttcaacatgaatatttactggagcctctggaagcgcgaccacctgagccggtgtcagtctcatccaggcctgacagctgtgtcttctaatatctgtggtcacagctttcgcggaaggctgagctctcggaggagtctgagcgccagcaccgaagtacctgcttcatttcactccgagcggcagaggaggaagtcttcacttatgttctctagccggaccaagatgaacagcaataccatcgctagcaagatgggttcattctcacagagtgacagcgttgctcttcaccagcgtgagcacgtggagctgctccgtgccaggcgcttggctaagtccctggcgattttgctcggcgtctttgccgtctgctgggctccctacagcctgtttactattgtgctgagtttttattcttccgccaccggacctaagagtgtctggtaccgaatcgctttctggcttcaatggttcaactcctttgtcaaccctctgctgtacccgttgtgccacaaacggttccagaaggcctttttaaagatcttttgcataaagaagcaaccgctgcctagccagcactccagatcagtaagtagctag

SEQ ID NO: 226112 - DNA, 174 bp, Artificial Sequence
  Description of Artificial Sequence: Synthetic coding sequence
atgaagttcttcgtttttgccctggtattggctctcatgatctctatgatctctgccgacagccacgaaaagcgccatcacgggtaccgacgtaaatttcacgaaaaacatcattcccaccgcgagttcccattttacggtgactacggatcaaattacctttatgacaattag

SEQ ID NO: 226113 - DNA, 174 bp, Artificial Sequence
  Description of Artificial Sequence: Synthetic coding sequence
atgaaattcttcgtttttgctctcgtgctggccctgatgatctccatgatatcagccgactcacacgaaaagaggcatcacggatatcgcaggaaattccatgagaagcaccactcccatcgcgagttccccttctacggtgattacggctcaaactacctgtacgacaactag

SEQ ID NO: 226114 - DNA, 156 bp, Artificial Sequence
  Description of Artificial Sequence: Synthetic coding sequence
atgaagttttttgtcttcgctttaatcctagcgctaatgctcagtatgaccggagcagattcacacgccaaaaggcatcacggctacaaaaggaagtttcacgagaaacaccactcacatcggggataccgcagtaattacctttacgacaattag

SEQ ID NO: 226115 - DNA, 156 bp, Artificial Sequence
  Description of Artificial Sequence: Synthetic coding sequence
atgaagttcttcgtttttgcactgatcctggcactcatgctctcaatgactggcgctgactcacacgctaaacggcaccatggttataaaaggaagtttcatgaaaaacatcactcacacagggggtaccggtccaattacctgtatgacaactag

SEQ ID NO: 226116 - DNA, 1989 bp, Artificial Sequence
  Description of Artificial Sequence: Synthetic coding sequence
atgatggaaccagaagaataccgagagcgtggtcgggagatggtggactacatttgtcaatatttgtctaccgtgcgagagaggcgcgtgacgccagatgtgcagccgggatatctgcgagcccaattgccagagtctgcacccgaggaccccgactcttgggatagcatcttcggagacattgaacgcatcataatgcctggggtggtgcattggcagtccccccacatgcatgcatattaccctgccttaactagctggccctctctgctgggcgatatgttggccgacgctattaattgtctggggtttacatgggcatcttcccctgcatgtacagaactggagatgaatgtcatggattggctggctaagatgcttgggctccccgaacatttcttacaccatcatccctcctcccaaggcggaggtgttttgcaatccacggtgtcagagagtacattgattgccctgctcgccgcaagaaagaataagatcttagaaatgaaaacctcagaaccagacgcagatgaaagctgcttaaatgcgcgtcttgtcgcgtacgcatctgaccaggcacacagttcggtggagaaagctggcctgatctctttagtcaaaatgaaatttctacctgtggacgacaacttttcgctgcgcggagaggctctgcaaaaagccatcgaagaggataaacagcgcggtctggtcccagtcttcgtgtgtgctacactagggaccaccggagtgtgcgccttcgactgcctttccgaactagggccaatttgtgccagagaggggctgtggctccatatcgacgctgcttatgctggaacagcattcctgtgtcctgagttcaggggcttcctgaagggtatcgaatacgccgattctttcacctttaatccgtcaaaatggatgatggtgcacttcgattgcacagggttttgggtcaaggacaaatacaaattgcagcaaacattttctgtcaatcccatctacctgaggcacgcaaacagcggtgtcgccacagacttcatgcattggcaaataccactgagtagaaggtttaggagtgttaaactgtggttcgtgatccgatccttcggtgtcaaaaacctgcaggcacacgttcggcacggtactgaaatggccaagtactttgagtctctggtgcggaatgacccctctttcgaaattccggcaaagcgacatctagggctggtagtattccgcctgaaaggacccaactgtctaacggagaatgttttaaaagaaattgccaaggccggtaggcttttcctcattcctgctacaattcaagacaagctaataatccggttcaccgtgactagccagttcactacaagagacgatatcttgcgggactggaaccttattagggacgccgctactctgatactaagccagcactgtacttctcaaccctctcctcgagttggtaacctaatttctcagattagaggagcgcgtgcttgggcctgcgggaccagcctccagtcagtttctggcgctggagatgaccccgtgcaggctcgaaagattattaaacagccccagcgggtgggcgctgggcctatgaagagagagaacggcctgcatctcgagacattgcttgaccctgtcgacgactgctttagtgaggaggcacccgacgccacaaaacacaagctgtcaagctttttattctcttacctgtcagtccagacaaaaaaaaaaacagtgcgtagtctctcttgtaactccgttcctgtcagcgcacagaagccactgccaaccgaggcatctgttaagaacggcggttcaagccgcgtgcggatcttctccagattccctgaagacatgatgatgttgaaaaagtcggcctttaaaaaactgatcaaattttacagcgtgccctcgttcccagaatgtagctctcagtgcggactgcagttgccttgttgccctctccaagccatggtttag

SEQ ID NO: 226117 - DNA, 2100 bp, Artificial Sequence
  Description of Artificial Sequence: Synthetic coding sequence
atggggcatcacaggccgtggctccatgcatccgtcctttgggctggagttgcctccttgctgttgcccccagccatgacccagcagttgcggggtgacggtctcggctttagaaatcgcaacaactctactggggtcgcaggactgagcgaggaagcttcagctgagctgaggcatcatctccacagcccgcgtgatcatcctgacgagaacaaggatgtgtcaaccgagaacggacaccatttttggtctcacccagaccgtgagaaagaagacgaggacgtaagtaaagagtatgggcatctcctccctgggcacagatcgcaagaccacaaggttggtgacgagggcgtgtcaggcgaagaagttttcgcagagcatggtggccaggctcgaggacaccgaggacacggctcagaagacactgaggatagtgccgaacaccggcaccatctgccatcacatcgatcacattctcaccaagatgaggacgaagacgaagtggtgtcttctgaacaccatcaccacatcctgcggcatggccatcgcggacacgatggtgaggatgatgaaggtgaagaggaggaggaggaggaagaggaagaggaagaagccagtactgaatacggtcaccaggcgcataggcacaggggacacggcagcgaagaggatgaagatgttagtgacgggcatcatcaccacgggccttcacacagacaccaggggcatgaagaggatgatgacgatgatgacgacgacgacgacgatgacgacgatgacgacgttagtatcgagtaccggcatcaggctcaccgtcaccagggccacggaatcgaggaagatgaagatgtgtcggacggacaccaccatcgggatcctagccatagacatcgatctcacgaagaagatgacaacgatgacgatgacgtcagtaccgagtacggccaccaggcgcatcgccaccaggaccaccgtaaagaggaagtcgaggcagtgagcggagaacaccaccaccacgtccccgatcatagacatcagggccaccgggatgaagaagaagatgaggatgtcagcacagagcgctggcaccagggccctcagcacgtgcaccacggactggtagatgaagaggaggaggaggaagaaatcacggtacaatttggacattacgtggcgtcccaccaaccacgcggtcacaagagcgacgaagaagactttcaggatgagtataagaccgaggtgccccaccaccaccatcacagggtgccaagggaggaagatgaggaagtgagtgccgaattggggcaccaagccccttcacacagacagtctcaccaggatgaggagaccggacacggacaacgaggctcaatcaaggaaatgtcccatcacccaccgggacatactgtagttaaggacaggagtcacttaaggaaggacgatagcgaagaagagaaggaaaaagaagaagaccccggatctcacgaggaagacgacgagagctctgaacagggtgaaaaagggacacatcatggctccagagaccaagaggacgaagaggacgaagaggaaggacacgggctgtcactgaaccaggaagaagaggaggaagaagacaaggaggaagaagaggaggaggaggatgaggaaaggagggaggagagagccgaggttggcgctcctctctcgcctgaccattcagaagaggaagaggaggaggaagagggtctggaggaggatgagccacgctttactatcattcctaatcctctagaccggagggaggaagcaggcggagctagctctgaagaagaaagtggggaagacacaggcccacaggacgctcaggagtacggaaactatcagcccggatccctctgtgggtattgcagtttctgtaaccggtgtaccgagtgcgaaagttgtcattgcgatgaggaaaatatgggggaacattgcgatcagtgccagcactgccagttctgctatctgtgtcccctagtctgtgaaactgtgtgtgcacctgggagctacgtggactacttttccagcagtctataccaagccctggctgacatgctggagactccagaaccctag

SEQ ID NO: 226118 - DNA, 1170 bp, Artificial Sequence
  Description of Artificial Sequence: Synthetic coding sequence
gaagacgacaatgacgatgatgacgtgtctacagagtacggacaccaagcccacagacaccaggatcataggaaagaggaggtcgaagcggtgagcggggaacaccaccatcatgtgccggaccacagacaccagggccacagggatgaggaagaagatgaggacgtcagcaccgaacgttggcaccagggtcctcagcatgtgcatcatggccttgtggatgaggaggaggaagaagaagaaatcacagtccaatttggacactatgtagccagccaccagccaagaggacacaagagcgatgaggaggattttcaggacgagtataagacagaggtgcctcaccatcaccatcacagagtccctagggaggaggatgaagaggtgtcagctgagttggggcaccaggcccctagccatcgccagagtcatcaggatgaggagaccggccacggccaaagagggagcatcaaagaaatgtcccatcaccctcctggacacaccgttgtcaaagatcggtcacaccttcggaaagatgattctgaggaagaaaaagagaaagaagaagatcctggtagccacgaggaagatgacgaatcgtcagagcagggtgagaaagggacgcaccacggtagcagggatcaggaagacgaggaggatgaggaagagggtcacggacttagtctgaaccaagaagaagaggaggaggaggacgaggaaagacgagaagaacgggcagaggtcggtgctcccctgtcccccgaccacagtgaggaagaagaagaggaagaggagggacttgaggaagatgagccaaggtttaccatcatccctaaccctctggatcgcagggaggaggctggcggtgcaagcagcgaagaagaaagtggcgaagacacggggccacaggatgcccaagagtacggcaattaccagcccggaagcctgtgtggatattgttcattttgtaatcgctgcacagagtgcgagtcttgtcattgcgacgaagagaatatgggggagcattgtgaccagtgtcaacactgccagttttgctatttgtgtcctcttgtttgcgaaacggtgtgcgcacccggatcatatgtggactacttttcctccagtctctaccaggccctcgctgatatgctcgagacgcctgaaccctag

SEQ ID NO: 226119 - DNA, 1365 bp, Artificial Sequence
  Description of Artificial Sequence: Synthetic coding sequence
atggggcaccacagaccgtggttacacgcttccgtactctgggctggtgtcgcctccctcctgctgcccccagcgatgactcaacaactccgaggggatgggcttggattcagaaatcggaacaaggatgtcagcacggagaacggccaccacttttggagccatcctgatcgagagaaggaagacgaggacgtaagcaaggagtatggccaccttctgccgggtcaccggagtcaggaccacaaggtaggcgacgagggagtatcaggagaagaagtttttgccgagcatggtgggcaggcacggggtcaccggggacacggaagtgaagatacggaagactcagcagagcatagacatcaccttccatcccaccgaagccacagtcaccaagacgaggatgaggacgaagtcgtctcttcggaacatcaccaccatatcttgagacatggccacagaggacacgacggggaggatgacgaaggggaagaggaggaggaggaggaggaagaggaggaggaagcgtctaccgaatacggtcatcaagcccaccgccacagaggacacggatcagaagaagacgaagatgttagcgacggtcatcaccatcacggcccttcacatagacatcaaggacatgaagaagatgatgacgacgacgacgatgacgatgacgatgacgacgatgatgatgtcagtatagagtatcgccaccaggcccataggcaccaaggacatgggatcgaagaagatgaagacgtctcggatggccatcaccacagggatccgtctcaccgccaccgctcgcacgaggaagatgacaatgatgatgacgatgtgagcaccgaatatgggcaccaggcacaccgccaccaggaccaccgcaaagaagaggtggaggccgtaagtggcgaacatcatcatcatgtccccgaccacagacaccagggccaccgagatgaggaagaggatgaggacgtctcaacagagagatggcaccagggccctcagcacgtgcatcacggtctggtggacgaggaagaggaggaagaggagattactgtccagttcggacactatgtagcctcacatcagccccgtgggcacaaatcggacgaagaagactttcaggatgaatacaaaacagaggttccacaccaccaccaccatcgtgtgcccagggaggaagacgaagaagtctcagctgagctcggacaccaagccccaagtcataggcagagccaccaagacgaggagactggtcatgggcagagaggatctattaaagagatgagccaccatcctcctgggcacaccgtggttaaggacagatcccatctccggaaggatgacagcgaggaatag

SEQ ID NO: 226120 - DNA, 381 bp, Artificial Sequence
  Description of Artificial Sequence: Synthetic coding sequence
atggctgacgagatagccaaagcacaagtggcaagacctggcggagacactatttttggaaagataatccgtaaggaaatcccagcaaagatcatctttgaggatgatcgctgtttagccttccacgatatcagtccccaagccccaactcatttcctggtgatcccgaagaagcacattagtcagatcagcgttgctgaagatgacgacgagagcttgttaggtcatcttatgatagtgggaaagaaatgcgccgctgacctgggcctgaataaagggtataggatggtcgtaaatgaaggctctgatgggggacaatcagtctaccacgtccacttgcatgtcctagggggacgccaaatgcattggcccccaggctag

SEQ ID NO: 226121 - DNA, 492 bp, Artificial Sequence
  Description of Artificial Sequence: Synthetic coding sequence
atggccgctgctgtagtgctcgccgctgggttgagggccgctcggagagccgtcgcagccactggggtgcggggtgggcaagtccgcggtgcagctggcgtgaccgatgggaacgaggttgctaaggcacagcaggctacacctggtggcgctgcaccaacaatcttctcaagaatattggacaaaagcttaccagccgacatactgtatgaagaccagcagtgcctggtcttcagggatgtggcaccacaagccccagttcattttcttgtgatacccaagaagcctatcccacggatctcccaagcggaggaagaagaccagcagttgcttggccacctccttcttgtggctaaacagactgcaaaagccgagggtctgggcgacggatacaggttagtgataaacgacggcaaactcggcgctcagtcagtttaccatttgcacatacacgtgctcggtggaaggcagctgcaatggccacccggttag

SEQ ID NO: 226122 - DNA, 615 bp, Artificial Sequence
  Description of Artificial Sequence: Synthetic coding sequence
atggcgaaagttcaggtcaacaatgtggtggtccttgataacccatcaccattttataacccgttccagttcgagattaccttcgagtgtatcgaggacctgagtgaagacctggagtggaagataatctacgtaggatcagccgagagcgaggaatatgatcaggtactggacagcgtcttggtaggacctgtccccgctggacggcatatgttcgtcttccaggcagacgctccgaacccaggtctgattcctgacgctgatgcagtgggggttactgtcgttctgattacctgcacgtacagaggccaggagtttatcagagtaggatactacgtgaataatgaatacacggaaacggagctgcgagaaaatcccccagtgaagccagatttctctaaacttcaaagaaacatcctagcgtccaatcccagagtaactcggttccacattaactgggaagataataccgagaagctggaggacgcagaatctagcaatccaaacttacagtccctgctgtctacggacgctttgccctctgcatccaaagggtggagtactagcgagaactctctcaacgttatgctggagtctcacatggactgtatgtag

SEQ ID NO: 226123 - DNA, 1329 bp, Artificial Sequence
  Description of Artificial Sequence: Synthetic coding sequence
atggccggagaaggcgatcaacaggatgccgctcacaacatgggcaaccatctgccattgctgcctgcggagagcgaagaggaggacgaaatggaggtggaagatcaggactctaaggaggcgaagaaacccaatataatcaactttgatacctctctgcctacttcccacacttacctcggtgctgacatggaagaatttcacgggagaaccctgcacgacgacgactcctgtcaggtaataccagtgctgccacaggtcatgatgatcctgatcccaggacagacattaccactacagctgtttcacccacaggaggtgagcatggtccgcaacctgatccaaaaggacagaacattcgccgtgctcgcctactcaaatgtccaggagagggaagctcagtttgggaccaccgctgagatctacgcttacagggaggagcaggattttggaattgagatcgtaaaggtgaaagcaatcggtcggcaaagattcaaagtgttggaactgaggactcaatctgatgggatccagcaagcaaaagtgcagattttacctgaatgcgtgctgccctccacaatgagcgccgtgcagctggagtcgcttaacaaatgccaaatcttcccctccaagcctgtttctcgtgaagaccaatgctcttataagtggtggcagaaataccagaagagaaagttccactgcgcgaatttaacaagttggccacgctggttgtattccctttatgacgccgaaacactcatggaccgcattaagaaacagctgcgcgagtgggatgagaacctcaaggacgattctttacccagcaatcccatcgacttcagctatagggtggccgcttgtttacccatagatgacgttctgagaatccagctgctcaaaatcggcagtgcgatccagagactacggtgcgagctcgatattatgaacaagtgtacatctttgtgctgcaagcagtgccaggagacagaaatcacgactaaaaatgagatattttctctttcactgtgtgggccaatggcagcctacgtgaatccacacggttacgtccacgagacactgacagtttacaaagcttgcaacctgaacttgataggtcgacctagcacggagcacagctggttcccagggtatgcttggaccgtcgcacagtgcaaaatctgcgcaagccatataggttggaagtttactgctacaaaaaaggacatgtctccacagaagttttggggcctaacccggtccgcactcctgcccaccatccccgacactgaagacgagatctcgcccgataaggttatcctatgcctgtag

SEQ ID NO: 226124 - DNA, 1308 bp, Artificial Sequence
  Description of Artificial Sequence: Synthetic coding sequence
atggcagagagagccgctctagaggagctggtgaaactgcagggggaaagagtccggggactgaaacagcagaaggccagtgccgagctcatagaagaggaagttgctaagctgttaaaactaaaagctcagctggggcctgatgaatctaagcaaaagttcgtgctaaaaacccccaagggcaccagagactacagcccacggcaaatggcagtacgggaaaaggtgttcgacgttatcatcagatgttttaaacgccacggggctgaggtgatcgacacgccagtgttcgagctcaaagacttcgacatcgctggtaatttcgaccccatgattcccgacgccgaatgccttaaaattatgtgcgaaattctttcaagcctccagatcggcgacttcttggtgaaggtgaatgatcgacgaattttagatgggatgttcgccatatgcggggtgagcgactccaaatttcgtacaatctgctcttccgtcgacaagttagataaggtgtcatgggaggaagtcaaaaacgagatggtgggtgaaaagggactggccccagaggtggccgaccggatcggggactacgtccaacagcacgggggagtcagtctagttgaacagcttctgcaggaccccaagttgtctcagaacaagcaagccctggaggggctgggggatcttaagctcctgtttgagtacttaacactcttcggcatagatgacaaaatttctttcgacctgagcctggcgagggggctcgactactacactggcgtcatttacgaggctgtgctgttgcagaccccagctcaagcaggcgaggagccgttgggcgtaggttcagtggccgcaggtggcaggtatgatgggctggtcggcatgtttgacccaaaaggcaggaaagtaccatgcgtaggcctgagcataggtgtcgaaagaatattcagcattgtggaacaacgcctggaggcccttgaggagaagataaggactactgagacacaggtgctcgtggctagtgcacagaagaaactcctagaggagcgcctgaaactggtctcggaactgtgggatgcaggcatcaaagccgaacttctgtacaagaaaaaccccaaactgctgaaccagttgcagtactgcgaagaagccggtattccactggtggcaatcataggggagcaagaactgaaagatggggtaatcaagctgcggtctgttaccagccgcgaggaggtcgacgttcgcagggaagatctcgttgaggaaattaagcggagaacaggtcagcctctctgcatttgctag

SEQ ID NO: 226125 - DNA, 1188 bp, Artificial Sequence
  Description of Artificial Sequence: Synthetic coding sequence
atggctgaacgtgcagctctcgaagaattggtcaagctgcagggtgagagagtaagagggttaaaacagcaaaaagccagcgctgagttaatcgaggaagaagtcgctaaactcctgaagctcaaggcacaactgggaccagatgagtccaagcagaaattcgtcttaaagacccccaaggattttgatatcgctggtaacttcgatcccatgatcccagatgccgaatgtctgaaaataatgtgtgaaatcttatcttctctacagataggtgacttcctcgttaaggtgaacgatcgtaggatcctggatggcatgtttgctatctgtggggtgtcagattccaaatttaggaccatctgttcttctgtagataagctggataaagtgtcttgggaagaagttaagaatgaaatggtgggggaaaaagggcttgcacctgaggtcgccgatcggatcggagattatgtccagcagcacggcggagtgtccctggtcgaacagttgttacaagaccccaagttgagccagaataaacaggccctggaggggctgggagacctgaagttactctttgagtacttgacgctgtttggcattgacgacaaaattagcttcgacctgtctctggcccgtggcctcgactactatacgggagtcatatacgaagcagtcctattgcagacccccgctcaagcgggtgaagaacccctgggcgtcgggagcgtagcagctggcggtagatatgacgggttagtgggcatgttcgatcccaaggggaggaaggtgccctgtgtggggctgtctatcggcgtggagaggattttctctatagtcgagcagcgcctggaggcgcttgaggaaaagatacgtactacagagacacaagtcctcgttgcaagcgcccagaaaaagctgctggaggaacggctgaaactcgtgtccgagctgtgggacgccggaattaaggccgagttgctctacaaaaagaatccgaagctcctgaatcagctgcagtattgtgaggaagccggtatccccttagtggccatcattggcgagcaagaactcaaggatggtgtaattaagctgagaagcgtgaccagtagagaggaggtagacgttcgcagggaggacctggtagaggagatcaagaggaggactggacaacccctctgcatctgttag

SEQ ID NO: 226126 - DNA, 1410 bp, Artificial Sequence
  Description of Artificial Sequence: Synthetic coding sequence
atggctgaaagggccgctcttgaggagctggtgaaactacagggtgagcgggtacggggtcttaagcaacagaaggcttcagcagagctgattgaagaggaagtcgccaagttacttaaattaaaggctcagttgggacccgatgaaagcaaacaaaaattcgtgctgaagactcccaaggaaacgctgatgggcaagtacggcgaagactccaagctgatttacgacctgaaagaccagggaggggagctgttgagccttcgttatgacctgactgtaccctttgcccgataccttgctatgaacaagttgacgaatatcaaaagataccacatcgctaaggtttacagacgggataatccagctatgaccagaggtaggtacagagagttctatcaatgtgacttcgacattgccggtaactttgacccgatgatccccgatgcagaatgcttgaagattatgtgcgaaattctctcaagcctgcagattggcgactttcttgtcaaggtcaatgacaggcgcattctcgacggtatgttcgctatctgcggcgtgagcgacagtaagtttagaacaatatgctcgagtgttgataaattggacaaggtgtcctgggaggaggtgaagaatgagatggtgggggaaaagggactcgcccctgaggtagccgaccggatcggcgattatgttcaacagcacggaggagtgtcgctcgtagagcagctattgcaggatcccaagttaagtcagaacaaacaagctctggagggcttaggagatttaaaactgctgttcgaatacctgacactgttcggaattgatgataagataagctttgacttgagcctggcccgaggtctagactactatacaggcgtgatctacgaggcagttctgcttcaaacacctgcccaggcaggagaagagccactgggcgtcggctctgttgcagctggaggtaggtacgatgggctggtcggtatgttcgaccccaagggtagaaaagtcccgtgtgttggcttgtctattggagtggaaaggattttctccattgtggagcaacgcttggaggccctggaggagaaaatcaggacaaccgaaacccaagttctagtggcctcagcccagaagaaattgttggaagaacggctcaaactggtaagtgaactgtgggacgcaggaatcaaggccgaacttctttataagaaaaaccccaaactcttgaaccagttgcagtactgcgaggaggccggtatccctcttgtggccataatcggcgaacaggagctgaaagacggcgttataaagctccggtcagtaacttctagggaagaggtggatgtcaggagggaggatctggtagaggagattaagcgacgtactgggcaacccttgtgcatctgctag

SEQ ID NO: 226127 - DNA, 945 bp, Artificial Sequence
  Description of Artificial Sequence: Synthetic coding sequence
atgacccggggacgctatcgagaattctaccagtgtgactttgatatcgccggtaatttcgaccctatgatccccgacgccgaatgtctgaaaattatgtgtgagattctgagcagtctgcaaataggggatttcctagtgaaagtttcatgggaagaggttaagaatgagatggtgggcgagaagggtctggccccagaggtcgccgatcgaattggggattacgttcaacaacacggtggagtgtcattagtggaacagctcctgcaggacccaaaactcagtcagaataaacaggccctcgagggactgggagacttgaagctgctgttcgagtacttgactctcttcggcatagacgataagatctccttcgacctgagccttgctaggggattggactactatacaggggtaatctatgaggccgtgctcctgcagacccccgctcaagcaggtgaagaaccactaggagtcggcagcgtggctgccggtggcagatacgacggcctggtaggtatgtttgatccaaagggcaggaaagttccctgcgttgggctttcaatcggagtggagcgcatttttagtattgtggaacagcgactggaagcgctcgaagagaagatcaggacaacagagacacaggtactggtagcctcggctcagaaaaaactcctggaggaacggcttaagctggtttccgagctgtgggacgcaggcattaaggctgagctgctgtacaaaaagaacccgaagctcttgaaccagctacagtactgtgaagaggcgggaattccgttggtggctattattggagaacaagagctgaaagatggcgtcattaaacttcgatctgtaacaagtcgcgaggaggttgatgtaagacgcgaggatctagtggaagagattaagcggagaacagggcaacctctatgcatttgctag

SEQ ID NO: 226128 - DNA, 1530 bp, Artificial Sequence
  Description of Artificial Sequence: Synthetic coding sequence
atggcggagcgggctgctctagaggaactagtgaagctgcagggagagagggtgcgcggtttgaagcagcagaaggcctcagccgagctcatcgaggaggaagtggccaaactgctcaagctgaaagcacagctgggccctgacgagagtaagcagaagtttgtcctgaaaactcccaagggaactagggattacagcccaaggcaaatggctgtgcgcgagaaggtgttcgacgtaataatccgttgctttaaacggcatggggcagaagtaattgatactcccgtcttcgaactgaaagagaccctgatgggcaagtatggggaggactccaagctgatatacgatcttaaagaccagggcggtgagttgttgtcccttaggtatgacttaaccgtgccctttgccagatatctggcgatgaacaagctaacaaatatcaagagataccatatagccaaggtgtatcggagagacaaccccgctatgaccaggggcaggtatcgtgagttctaccagtgcgacttcgacattgccggaaacttcgatcctatgatccccgacgcagagtgtttgaaaattatgtgcgaaatcctgtccagcctgcagatcggggatttcctggtcaaagttaacgataggcggatcttggatggtatgtttgctatatgtggcgtgtccgacagtaagtttcggaccatctgttcttctgttgataaactagataaagtttcctgggaggaggtcaagaatgagatggtcggagaaaaggggttagcacctgaggttgccgacagaataggggattatgtgcagcagcacggaggcgtgtcactggtggaacagctgttacaggacccaaaactgtcccagaacaaacaggctctggagggcctgggcgatctgaagctgctctttgaatacctgacactgttcggcatagatgataagattagtttcgatcttagcctcgcaagaggattggactactatactggggtcatttatgaagcagtcctcctccagaccccagcccaagccggagaggagcccttgggtgtagggtcagtggcggctggtggaagatatgatgggctcgtgggcatgttcgaccccaagggacgcaaggttccatgtgtgggcctcagcattggagtggagcggatcttcagcatcgtcgagcagaggttagaagccctcgaagaaaaaataagaactactgagacacaggtactcgtggcctccgcgcagaaaaagctcctggaggagagactgaaactggtaagtgaactctgggacgctggtattaaggccgaactcctgtacaaaaaaaatccgaagctactgaatcaactgcagtattgcgaggaggccggaattccgctggttgctatcattggggaacaggagttaaaggacggagttatcaaactcagatccgtgacttctagagaggaggtagacgtccgcagggaggatctggtggaggaaattaaaagaagaactggacagcccttgtgtatatgttag

SEQ ID NO: 226129 - DNA, 1323 bp, Artificial Sequence
  Description of Artificial Sequence: Synthetic coding sequence
atggcggtgcgagagaaggtgtttgacgttatcattcgctgcttcaagcggcacggcgctgaggtgatcgatacccccgtgttcgagcttaaagagaccttgatgggcaagtatggcgaggatagcaaactaatttacgatctgaaggaccagggaggtgagcttctctcccttcggtacgaccttaccgttccttttgccagatatcttgcaatgaacaaactgaccaacatcaaaagatatcatatcgccaaggtgtacaggcgggataacccagctatgacaaggggtaggtatcgtgagttctaccaatgcgactttgatatagcaggcaacttcgatccaatgatcccagatgcggagtgtctgaagattatgtgcgagattctttcatcgttgcaaatcggtgactttttagtcaaggtgaacgaccgacggatcctggatggaatgttcgccatttgtggggtgagtgactccaagtttcgcaccatctgtagtagcgtcgacaaacttgacaaagtgtcttgggaggaggttaaaaacgaaatggtgggagagaaaggccttgctccggaggttgctgatcgcatcggcgattatgtccagcaacacggtggcgtctcactggtggaacagcttttacaggacccgaaattgtcccaaaacaaacaagccctggaggggctcggcgacttgaaactcttgttcgaatacctcaccctgttcggcattgatgataagatcagctttgacctcagcttggctcggggtttagattactacaccggggttatctatgaggcggtcctcctgcaaactcccgctcaggctggcgaagaacccctcggggtgggctccgtagctgcaggcggacggtacgatgggctggtgggtatgtttgatcccaagggaagaaaagttccgtgtgtgggactcagcataggggtcgaaaggatatttagcattgttgagcagaggttggaggctttggaagagaagattcgcacaaccgaaacccaggtgctggtggcttctgctcagaagaaattgctggaagaacggttaaagttggtgtctgagctctgggatgctggaataaaagctgaactgctctacaaaaaaaaccccaaactcctgaaccagctgcagtactgtgaggaagctgggatcccacttgtagccattatcggggagcaggaactcaaggatggagtgattaaactgagaagtgtgacaagcagggaagaagtagatgtacgcagagaggatcttgtggaagaaatcaaaaggcggacagggcaacctttatgtatctgttag

SEQ ID NO: 226130 - DNA, 867 bp, Artificial Sequence
  Description of Artificial Sequence: Synthetic coding sequence
atggcagaaagggccgcactagaggaactggtcaagctgcagggtgagagggtccggggactgaaacagcagaaagcttctgccgagctgatagaagaggaggtcgcaaaactgttgaagctaaaggcccaactgggacctgacgagtccaagcagaagtttgtgcttaagacccccaagggcacacgggactacagcccaaggcagatggcggtcagagaaaaggttttcgacgttatcattcggtgttttaagcggcacggtgctgaagtaatcgatacccccgttttcgaattgaaggtgaacgacaggcgcatccttgacggcatgttcgccatctgcggcgtgagcgatagcaaatttcgcactatatgttccagtgtggataaattggataaggtgtcttgggaagaagtgaaaaatgaaatggtgggggaaaagggactcgctccagaggtggctgatagaatcggagactatgtgcagcaacacggaggagtgtcgctcgtggaacagctcctgcaggaccccaaactgtcacagaacaagcaagcattagaagggctcggggatcttaagctacttttcgagtatctgaccctgttcgggatcgatgataagatctcctttgatctgagcctggccagaggtctagactattatactggcgtaatctacgaggccgtccttcttcaaacacctgcccaggctggggaagaacccctcggtgtgggcagcgttgccgctgggggacgctatgacggcctggtcggcatgttcgatccaaaagggagaaaagtgccatgcgtcggcctctccatcggggttgagcgaatcttcagcatcgtggaacagcgattagagtag

SEQ ID NO: 226131 - DNA, 1350 bp, Artificial Sequence
  Description of Artificial Sequence: Synthetic coding sequence
atggcagagcgagcagctctggaagaactggttaagctgcaaggagagagggtacgcggacttaaacaacagaaggcttcggccgagctgattgaggaggaggtggctaagttgctgaaacttaaagcacaactaggcccagacgagagtaagcaaaaattcgtcttgaaaacccctaaagaaaccctcatggggaaatacggggaagatagcaaactaatctatgacctgaaggatcagggaggcgagttgctgtccctcagatacgacctaaccgtcccattcgccagatatcttgccatgaataagttgacaaacataaagcggtaccacatagctaaggatttcgacatagctggcaatttcgacccaatgattcccgatgccgaatgcctgaagatcatgtgcgaaatactgagctctctccagatcggtgactttttagtgaaggtcaatgacaggcggatactggatgggatgttcgccatttgcggagtaagcgattcaaaattccgcacaatttgcagctcagttgataaactggataaggtgagttgggaagaggttaagaatgaaatggtgggagagaaagggctggctcccgaagttgccgaccggatcggagactacgtacagcaacacgggggtgtgtcactggtcgaacagctacttcaggatcctaagctgtcccaaaacaaacaggctttagagggcctgggagaccttaaactgctatttgaatatcttaccctgttcggcattgacgacaaaatctcattcgatctttccctcgcacgcggtcttgactattataccggtgtgatttacgaagcagttctgctccaaacccctgcccaggccggtgaggagccactgggcgtgggaagcgttgcagcgggaggacgctacgatggacttgtgggaatgtttgatcctaaagggagaaaagtcccttgcgtcgggctctccataggggtggaaagaattttttccattgtggagcagcggctggaggcccttgaggagaaaatccgaacaactgagactcaagtgctcgtcgcgtcggcacaaaaaaaactgcttgaggagcgcctgaagctagtgagcgagctctgggatgcagggattaaagcagaactgctatataaaaaaaacccaaagctcctcaaccagcttcagtattgcgaagaggccggaatacccctggtcgcaattatcggcgagcaggagctgaaagacggagtgatcaagttgagatccgtcacttcccgagaggaagtggatgttcgcagagaagatctcgttgaagagattaagaggagaaccggacagcccctgtgtatttgttag

SEQ ID NO: 226132 - DNA, 1470 bp, Artificial Sequence
  Description of Artificial Sequence: Synthetic coding sequence
atggctgaacgggctgcactcgaagagctggttaaattacagggtgaacgcgtgcgcggattgaagcaacagaaggctagcgccgaactgatcgaggaagaggtggcaaagctgctcaagctgaaggctcaactgggtcctgacgagtcaaagcagaagtttgtgttgaaaacccccaagggcacacgggactactcgccacggcagatggctgtcagggagaaggtgttcgatgtcattatcaggtgtttcaaaagacacggcgctgaagtcatcgataccccagtctttgagctcaaggaaaccttgatgggaaagtatggggaggactctaagttgatttacgatcttaaggaccagggtggagagctcctgagcctgcgctacgacctgaccgtgccattcgccaggtacctggctatgaataagctgaccaacattaagcgatatcatatcgcgaaggactttgatattgccggtaatttcgaccccatgatccccgacgccgagtgcctaaaaatcatgtgtgagatcctcagtagtcttcaaatcggtgacttcctagtgaaggtgaacgacaggcggatcctggacggcatgttcgctatttgcggtgtcagcgactcaaaatttaggaccatatgttcgtcagtggacaaactggataaagtgtcttgggaggaggtcaagaatgagatggtcggggagaaaggtctcgctcctgaggttgctgacagaattggcgattatgtccagcagcacggtggagtgtccttggtagagcagctactgcaggatcctaaattgagtcagaataagcaggccctggagggcctgggcgatctcaagctgctgtttgaatacttaaccctgttcggcatcgacgacaagattagctttgacctttctttggccagaggcctcgactactatacgggagtgatttacgaggccgtgctactgcagaccccagcccaggctggggaggaaccactgggcgttggctctgtggccgcaggcggtcgctacgatggtctggtaggtatgttcgaccctaagggaagaaaggtaccctgcgtcggcctgagtattggggtggagcggattttttcaattgtggaacagcggctggaggctctagaagaaaaaattagaactaccgagacccaggtgcttgttgcctccgctcaaaaaaagctcttggaggagcggctgaaactcgtgagcgaactttgggacgcgggaatcaaggcagaactgctgtataagaagaacccaaaactcctgaaccagctccaatattgtgaggaagccggtattcccctcgtcgcaatcatcggcgagcaggaactgaaggatggggtgatcaagctgaggtctgttacctctagggaggaggtcgacgtccgcagggaggacctcgtcgaggagatcaaacgacgaacaggtcaacccctgtgcatttgctag

SEQ ID NO: 226133 - DNA, 1017 bp, Artificial Sequence
  Description of Artificial Sequence: Synthetic coding sequence
atgatggcaatgaattcaaagcaaccattcggaatgcacccggtcctgcaagagcccaaattcagctccctccatagcggctccgaagcaatgaggagggtctgtcttcctgctcctcagcttcaaggcaacatttttggctcctttgacgagtctctgctggcgagggcggaagcactggctgccgtcgatattgtctcccatggtaagaaccaccctttcaaacccgatgccacatatcacaccatgagctctgtgccatgcacctctacttctagtaccgttccgatctcccaccctgctgcattgacatctcatccgcatcatgctgtgcaccagggacttgagggtgacctcctggagcatatttcccccaccctgtctgtttctggcctcggcgctcccgaacactcggtgatgcctgcacagatccatcctcatcatctgggcgctatggggcatttacaccaggccatgggtatgagccatccccatacagtggcccctcatagcgccatgcccgcttgcctgtcagacgtagaatcggatccaagggagctcgaagcatttgccgaacgctttaaacagcgtcggataaagctgggggtgacgcaggcagatgtgggggctgccctcgctaacttgaagattccgggagtcggcagcctgtctcagagcacgatttgcagatttgagtctctcacattgtcccataataacatgattgcactgaagcctgttctgcaagcttggcttgaagaggctgaggcagcatatagagagaaaaattctaagccggagctgttcaacggttccgagagaaaacgaaaacgcacttcgattgccgctcctgagaaaagatcattggaggcttattttgctattcagccgagaccttcttccgaaaaaatcgctgctattgccgagaagctcgatttgaagaaaaatgtggtccgagtctggttctgtaaccaacgccaaaagcagaaaaggatgaaatattccgccgttcattag

SEQ ID NO: 226134 - DNA, 1038 bp, Artificial Sequence
  Description of Artificial Sequence: Synthetic coding sequence
atgacgctccttgaagtgccattcgcgcgataccttgccatgaataaggttaagaaaatgaaacggtaccatgtgggcaaagtatggagaagggaatcccctacgattgttcaagggcgatatagggaattttgccagtgcgattttgatatcgccggacagttcgatcccatgatccctgatgctgaatgtttgaagattatgtgcgagatactatccggcctgcagctaggagattttctgataaaaatggcgtggaaagatgtgaggcacgaaatggtagttaaaaaaggccttgctcccgaggtagcagataggataggcgattacgtgcaatgtcacgggggtgtgagcctcgtggaacagatgtttcaggatcctcgcctttcccagaataaacaggcccttgagggcttgggcgatctaaagctgctttttgaatacctgacactgtttggaatcgcagataagatcagcttcgacctgtcactcgctaggggattggactactacacaggcgtcatctatgaagctgtcctgttgcagacaccaactcaggctggggaagagccactgaacgtggggagcgtcgccgctggcggaagatacgacggtcttgtggggatgtttgatcccaaaggtcacaaggtgccctgtgtaggcctatctatcggtgtcgagcgaatcttttatatcgtggaacaaaggatgaaaacgaagggagagaaggtccgcacgacagaaacgcaagtgttcgtggctacgccccagaagaacttcctacaagagcggctgaaactaattgccgaactgtgggactccggtatcaaagccgagatgctttacaaaaacaatccaaagctgctaacccaattacattattgtgaaagtacaggtattccactcgtggtgatcattggggagcaagagctgaaggaaggagtcattaagatccgatctgtggcctccagagaggaggtcgccattaagagggaaaatttcgtggcagaaatccagaaaagactgtccgaaagctag

SEQ ID NO: 226135 - DNA, 1179 bp, Artificial Sequence
  Description of Artificial Sequence: Synthetic coding sequence
atgcctctactggggttactgcctcgccgagcttgggctagcctcctgagccagcttctgcgccctccctgtgcctcctgtaccggagctgtgcggtgccagtcacaggtagcggaggcagtattgacctctcaactgaaagcccaccaagaaaaacctaacttcattatcaaaactccgaaagattttgatattgctggtcagtttgaccccatgatcccagatgcagagtgcctgaaaattatgtgtgagatcctgtccgggttgcagctgggcgacttcctgatcaaagtaaatgataggaggatagtcgacgggatgttcgctgtgtgcggggtcccagagtctaagtttcgcgcaatttgcagctctatcgacaagctcgacaagatggcgtggaaggatgtgaggcacgaaatggttgtcaagaaaggattagccccagaggtggctgacagaattggagattatgtgcagtgtcatggcggagtcagtctggtggaacaaatgttccaggacccaaggctatcccagaataagcaggccctcgaaggcctgggagacttaaagctgctcttcgaatacctcaccctgttcggcatcgcagacaagatctcttttgatctcagcctcgcacggggattagactactataccggagtaatctacgaagcggtcctgctacaaacacccactcaggccggtgaggagcccctcaatgtgggtagcgtggccgctggaggccgttatgacggactggtggggatgttcgatcctaagggtcacaaggtaccctgcgttggtctgagcattggggtggagcggattttttacatcgtcgagcagcgaatgaagactaaaggcgagaaggtgagaactacagaaacccaagtgttcgtagccactcctcaaaagaactttctgcaggagcggttaaaactcattgccgaactttgggactcaggcatcaaagccgaaatgttatataaaaataaccccaagctcctgacacaattgcattattgtgaatcaacaggcatccctctcgttgtcatcatcggcgagcaggagctgaaggagggggttattaaaattaggtccgtcgcatctcgcgaagaggtcgcaattaaacgcgagaattttgtggcagagatccagaaacgtctgtccgaatcctag

SEQ ID NO: 226136 - DNA, 1401 bp, Artificial Sequence
  Description of Artificial Sequence: Synthetic coding sequence
atgcctcttctgggattactccctcggagagcctgggcatctctgctgtctcagctgctcaggccaccctgtgcatcttgcacaggcgctgtgcggtgccagagtcaagtggcggaagccgtgctcacgagtcaattaaaagcccatcaggagaaacccaacttcataatcaagactcctaaggagactctgaccgagaaatatggcgaagacagcggacttatgtatgatttgaaggaccaaggtggagagctcctgtccttgaggtatgacctcacagtccccttcgccaggtacctggctatgaacaaggtgaagaaaatgaagcgctatcacgtgggaaaagtctggcggagggagagcccaaccatagtgcagggtcggtaccgggaattctgtcagtgcgacttcgatatcgccggacagttcgatcctatgattcctgacgccgaatgcttaaagatcatgtgcgaaatcctgagcggcttgcagttgggcgatttcttaattaaagtcaacgacaggcgaattgttgatggaatgttcgcggtgtgcggcgtacccgagagcaagttcagggccatttgctcctcaatcgataagttggacaagatggcctggaaggacgtccgccacgagatggtggtgaaaaagggcttggcccctgaagtggccgaccggattggggattatgttcaatgtcacggcggagtgtcactggtcgagcagatgtttcaggatcctcggctcagccagaataaacaagctctcgaagggttaggggacctgaagcttctcttcgagtatctcactctgttcggtatcgctgataaaatcagttttgacctgtccctcgctcgagggctcgattactacacaggcgtgatttacgaggccgtgcttctgcagacaccaacccaggctggggaggagccgttgaacgtaggatccgtggcagccggtgggagatatgacggactggtcggaatgtttgacccgaaaggccataaagttccctgcgtcggattgagtatcggggtggaacgaatattctatatcgtagaacaacgaatgaagactaagggggaaaaagtccggactaccgagactcaagtgtttgtggccactccacagaagaatttccttcaagagagattaaagttgatcgcggagctttgggacagtggcatcaaggccgaaatgttgtacaagaacaaccctaagttgctgacacagctccactactgcgagagcacaggcataccattagtggttatcataggagagcaggaacttaaagaaggagtgataaagataagatccgtggcttctcgcgaggaggtggctatcaagagggaaaacttcgtggctgagattcagaaaagactctctgagtcttag

SEQ ID NO: 226137 - DNA, 1005 bp, Artificial Sequence
  Description of Artificial Sequence: Synthetic coding sequence
atgccactcctgggcctgttacctaggcgagcgtgggctagcctgctctcacaactgttacgcccaccctgtgcaagctgtactggagccgtcaggtgccagagccaggacttcgacatcgctgggcagtttgaccccatgattcccgacgccgagtgtctgaaaattatgtgtgaaatcctatccgggcttcagctgggcgactttctgataaaaatggcatggaaggatgttcggcatgaaatggtcgtcaaaaagggtctggctcctgaagtggctgaccgaatcggagactacgtccagtgtcacgggggtgtgagtctggtcgagcagatgttccaagatcctaggttgagtcaaaacaaacaggccctggagggcctcggcgatttgaaacttctttttgaatacctgactctgttcgggatcgcagacaagattagctttgacctgtcactggcacgaggcttggattactacacgggcgtaatttatgaggcagtgttgctccagaccccaacacaggctggggaagagcccctgaacgtcggatccgtagcagctggcggacgctacgacggcctggtgggaatgtttgaccctaagggccataaggttccttgtgtcgggctctctattggagtcgaacgaattttctatattgtcgagcagaggatgaaaacaaagggcgagaaagtgaggaccacagagacgcaagtctttgtcgcaaccccacagaagaatttccttcaagaaaggctgaagctaatcgcggagctttgggactccgggatcaaagccgagatgctgtataaaaacaatccaaagctgctgacccagctgcattactgtgaaagcaccggaattcctcttgtggttattatcggagaacaggaactaaaggagggggtgatcaagattagatctgtcgcgtctagggaggaggtggccatcaaacgcgagaattttgtggcggagatacagaagcggttgtccgagtcctag

SEQ ID NO: 226138 - DNA, 1446 bp, Artificial Sequence
  Description of Artificial Sequence: Synthetic coding sequence
atgcccttgctggggctgcttcctcggagagcctgggctagcctccttagtcaattacttcgcccaccctgtgcatcttgtactggcgcagtgcggtgtcagtcccaagggacaagagacctgagcccacaacatatggtcgtgagagaaaagatcctggatctggtcatcagctgcttcaaacgccacggcgctaagggaatggatactcccgctttcgagctcaaagaaaccctgacagaaaagtatggagaggactcaggtctaatgtacgatctgaaagatcaaggcggtgagctactctctctcagatacgatctgactgttcctttcgccaggtatctggcaatgaacaaggtaaaaaaaatgaagcgctatcatgtgggtaaggtttggagacgggagtcacctaccatcgtacaaggacggtaccgggagttttgtcagtgtgacttcgacatcgctggccaatttgatcctatgattcctgacgccgaatgcctcaaaatcatgtgcgagatcttatctggattgcagctcggagactttctcattaaagtcaatgataggagaatagtggacggtatgtttgccgtctgtggtgttcccgagagcaaatttcgcgctatctgtagctccatcgataagctggacaagatggcctggaaggacgtacgccatgaaatggtcgtgaagaaagggcttgctcccgaggttgcagatcgaattggggactacgtgcagtgtcacggaggcgtcagcctcgttgagcagatgttccaggaccctagactttcacaaaacaagcaagcccttgagggattgggggacctgaaactcctgtttgagtacctgactttgtttggaatcgccgacaagatcagcttcgatctcagcctggcacggggattggattactatactggtgttatctatgaagccgtgttgctgcagacacccacacaagcaggtgaagagccgcttaacgtcggctctgtggcggctgggggtcggtacgacgggctcgtagggatgtttgacccgaaagggcataaggtgccctgcgtcggcttaagcattggcgttgagcgaattttctatatcgtggaacaacgaatgaaaactaagggggaaaaggtcagaaccacggagactcaggtattcgttgctacgccacagaagaattttctccaggaaagattaaagttgattgctgagctgtgggatagtgggataaaggccgagatgctgtataagaacaaccctaagctcctcactcagcttcattattgcgagtctacagggatcccattggtggtgataatcggagaacaggagctgaaagaaggggtgatcaagattagaagcgttgcctcgagagaggaagtcgccatcaaaagggaaaacttcgttgctgaaatccagaaacgccttagtgagtcctag

SEQ ID NO: 226139 - DNA, 1185 bp, Artificial Sequence
  Description of Artificial Sequence: Synthetic coding sequence
atggactctgcactgtctgatccacataatggcagcgccgaggcaggagggccaacgaactcaacgactagacccccatccacccccgagggaattgctcttgcatacggatcactgttgctgatggccttactccctatcttctttggtgctcttaggtccgtcaggtgtgcaagaggtaaaaacgcatctgacatgcctgagactatcacgtcgcgggacgcggctaggttcccaatcatcgctagctgtacactgttggggctgtacctgttctttaagattttcagccaggagtacatcaaccttcttttgtctatgtacttctttgtgctgggaatcctggccctgtctcacacgatttcacctttcatgaacaaattcttccccgcaagcttccctaaccgacagtaccaactgcttttcacacaagggagtggagaaaacaaggaggagatcattaattacgaattcgacaccaaagacctggtttgtctgggtctgagcagcatcgtgggcgtatggtatttgctgaggaagcattggatcgcaaacaatctctttggactagccttcagcctcaacggcgttgaactcttgcacctcaataacgtaagtacggggtgcattctgcttggcggactgttcatctacgatgttttttgggtgtttggcaccaacgtgatggtgaccgtggccaaatcattcgaggccccaattaaactggtgttcccacaggatctacttgagaaagggctggaggctaacaatttcgcaatgttgggattaggtgacgtggtgattcctggcattttcatcgcccttctgcttcgcttcgacatctcactgaagaagaatacacacacctatttttacacctcattcgctgcctacatctttggtcttggcctgacgatcttcatcatgcacattttcaagcatgcccaacctgcgctgctatacctggttccagcctgcataggcttcccggttctagtagcactggccaaaggcgaagtgaccgagatgttttcctacgagagctcagctgagattctaccccacacgccgcgactaacccattttcctaccgttagcggctcaccggcatccctggccgatagcatgcagcaaaaattagctggcccaaggcggaggaggcctcagaatccctctgctatgtag

SEQ ID NO: 226140 - DNA, 1134 bp, Artificial Sequence
  Description of Artificial Sequence: Synthetic coding sequence
atggattcagccctttccgaccctcataacggatcggccgaggccggaggacctacgaacagcacaacgcgcccaccatccacacctgagggtatcgctctggcatacggaagcctgctcttgatggcattgctcccaattttcttcggcgcactacgctccgttcggtgtgctagaggaaagaatgccagtgatatgcccgagaccattacctctagggatgctgccaggtttccaatcatcgcctcgtgcacgctcctgggcctgtacctgttcttcaaaatcttcagtcaggagtacatcaatttgctgctgagcatgtacttctttgtgcttggcatcctcgctctcagtcatacgatatcacccttcatgaacaaattcttccccgcttccttccctaaccgacagtatcagctcctattcacccaggggtcaggagaaaataaggaagagataattaactatgaattcgatacgaaagacctggtatgtttgggactgagctctatcgtcggggtgtggtatctattgagaaaacactggatcgcaaataacctgttcggcctggctttctcactcaacggcgtagaacttttgcacctgaacaatgtttctacaggttgtattctgctcgggggactctttatctatgacgtattctgggtctttggcactaacgtcatggtcacagttgccaagagcttcgaggcccctatcaaactggtcttcccccaggacctgctcgaaaagggattagaggcaaataactttgccatgttgggactgggcgacgtggtgattcccggtattttcatcgcattgctgctccggtttgacatttcactgaaaaagaatacgcacacttatttttatacgtcttttgccgcttacatcttcggactcgggctcaccatttttattatgcatatcttcaagcacgcccagccagcactactctacctcgttccagcgtgtataggcttcccggtgttagtcgctctggccaagggtgaagtgacagaaatgttttcatatgaggaatcaaaccctaaggatccggcagcggttactgaatccaaagagggcacagaagccagcgcttccaagggacttgagaagaaagagaaatag

SEQ ID NO: 226141 - DNA, 1008 bp, Artificial Sequence
  Description of Artificial Sequence: Synthetic coding sequence
atggattctgccctcagtgatcctcataacggctctgcagaggcgggtggacccacaaactctacaacacgccctccatcaacacctgagggtatcgcgcttgcatacggtagcctgttactgatggccctcctgcccatcttctttggtgcgctccgcagcgtccgctgcgcaagggggaaaaatgcctctgatatgccagaaaccatcaccagccgtgacgcagcccgatttccaattatcgcctcctgtacactattaggcctctacctctttttcaagattttctcacaagagtacattaacctgttgctgagtatgtatttcttcgtcctgggcatcttagccttgagtcatacaatcagtccgttcatgaacaagtttttcccagcctcattcccaaataggcagtaccagctcttatttacacagggatcaggggaaaataaggaggagataatcaactacgagttcgacacaaaagacctggtgtgcctcggcctgtcgtccattgtaggagtgtggtacctcctccggaaggtatttggtactaatgtgatggttaccgtcgccaagtcgttcgaggctccaatcaaattggtgttcccccaggacctgctggagaaaggcctggaggccaacaactttgccatgctcggccttggggatgtggtcatcccaggtatctttatcgccttattgctgcgcttcgatatctcattaaaaaagaacacgcatacctacttttacacctccttcgctgcttacattttcgggttggggctaacaatttttattatgcatattttcaagcacgcccaaccagctttgctctatctggtccctgcctgtatcgggttcccagttttagtggctctggctaaaggagaagtcacagagatgttttcctatgaagaatctaatccaaaagatcctgctgcagtgacagaatcaaaagagggcacagaagcctcagccagtaaaggactggaaaaaaaagaaaagtag

SEQ ID NO: 226142 - DNA, 1281 bp, Artificial Sequence
  Description of Artificial Sequence: Synthetic coding sequence
atggactcggcactttcagatccccacaatgggtcagcggaggcagggggtcccacaaattctactactcgtcccccaagtacgcctgagggaatcgctctcgcatatggttccctactgctaatggctctgctgcccattttttttggtgcccttaggtctgtcaggtgtgcccgagggaaaaatgcctcagatatgcctgagacaattacgtcccgagatgccgctaggtttcctattatcgcttcctgcaccttactgggcctgtatctgttcttcaagatcttttcacaggaatatataaatctcctgctatctatgtacttctttgttctcggaatactggccctgagccatactatctcaccttttatgaataagtttttccctgcctcgtttcctaaccgtcaataccagcttctcttcactcaaggcagtggagagaacaaagaagaaatcatcaactatgagttcgacacaaaggaccttgtatgtttgggcctgtccagcatcgtaggcgtgtggtatcttttacgcaaacattggattgctaataacctgttcggcttggccttctccctaaatggcgtcgagttgttgcatctgaacaatgtgtctacagggtgcatcctcctggggggtctcttcatttacgacgtgttctgggtcttcggtacaaatgtaatggtgaccgtggccaaatctttcgaggccccaattaagctagtgttcccacaagatctcctggagaaggggctggaagcaaacaattttgctatgctgggcctgggagatgtcgtgatccctggaatctttatcgcactcctgctccgcttcgatattagtttaaagaaaaatactcatacatacttttatacctctttcgccgcttatatctttgggctggggctgacgatttttatcatgcacattttcaaacatgcacagccggcacttctctacctggtgcctgcgtgtatcgggtttcccgttctcgtggcacttgccaagggtgaagtcaccgaaatgttcagctatgaatccagtgctgaaattttgccacacacccccagactgactcattttcccaccgtctccggtagtcctgcctccttagccgatagcatgcagcagaaactggctgggcctcggagacgaagaccgcagaaccctagcgcgatatacgaagaatctaatccaaaagatcccgcagctgtgaccgagagtaaggaggggactgaagcatccgcgagcaagggcttggagaagaaggaaaagtag

SEQ ID NO: 226143 - DNA, 3411 bp, Artificial Sequence
  Description of Artificial Sequence: Synthetic coding sequence
atgttttcccgtaagaaaagagagctgatgaaaaccccctctattagcaagaaaaatcgggcagggtcaccaagccctcagccttctggtgaacttcccagaaaagacggtgccgatgctgtgttcccagggccaagcctggagccaccagctgggtccagtggtgtaaaagctacggggaccttgaaacgtcctacttcactgtcgaggcatgcatctgctgcaggctttccactgtccggggcagcatcttggaccctgggcaggtcacatcgcagtcctttgacggctgctagtcccggtgaactccctaccgaaggagccggtcctgacgtggtcgaggacatatctcatttgctcgcagacgtagcccgattcgccgaagggctggagaagctaaaggaatgcgtcttgcgcgacgacttgcttgaggccagacgcccaagggctcacgaatgtttgggcgaggcactgcgagtcatgcatcagatcatatctaagtaccccctgctcaatacagtggagacgctcacagccgcaggaaccctgatagccaaggtgaaagccttccattatgagtctaacaacgaccttgaaaaacaggagttcgagaaagcgttagagacaatcgctgtcgcgttcagctctacagtctccgaattcttgatgggagaggtggacagtagcaccttgctagctgtgccgcctggtgacagctcccagagcatggaatcactgtacgggccaggatccgagggaacacccccatctcttgaggactgcgacgccggttgcctgcctgcggaggaggttgacgtcttacttcagcgctgcgaaggaggcgtggacgccgcactgctttacgccaaaaacatggctaaatatatgaaagacttaatttcctatttggaaaaacggaccaccctcgagatggaatttgctaagggtttgcaaaagattgcacacaattgcagacagagcgttatgcaggagccccatatgccgctcctctctatctactcactcgccctagaacaagatctggagttcgggcacagcatggtgcaagcagtgggtactctccagacgcagacctttatgcaacctctgactctccgacgcctggagcacgagaagagacggaaggaaattaaggaagcatggcatcgcgctcaaaggaagctgcaggaggccgaatcgaatctgagaaaggctaagcagggttacgtgcagagatgcgaagaccacgataaagctaggtttctcgtggcgaaagctgaggaggaacaggccggtagtgcacccggagctgggagcacagctacgaagacattggacaagaggcgtcgcctggaagaagaggcaaaaaataaggcggaggaggcaatggcgacttacaggacgtgcgtcgccgacgctaaaactcaaaagcaggaactggaggatactaaagtcacggccttacgacagatacaggaagtaattcgccagtcagatcagactatcaaatcggccaccatctcctattaccagatgatgcatatgcaaaccgcccctctgcccgtccatttccagatgctgtgtgaatccagtaaactgtatgaccccggacagcagtacgcatcccatgtcagacagctccagagagaccaggagccagacgtgcactatgactttgagcctcacgtgtccgccaatgcctggtctccggtcatgcgcgctaggaagagctcattcaacgtctctgacgtggctcgaccggaggcagctggatcacccccagaggagggcggatgcaccgaggggactcccgcaaaggatcaccgggctggtcgcggtcatcaggtacataaaagttggccactgtccataagcgactcagacagcgggctggaccccggtccgggtgcaggggatttcaaaaagtttgagcggacctctagctctggaactatgtcatccaccgaggagttggttgatcctgatggcggagctggagcgtcagcctttgagcaagcagatctgaacggaatgacccctgagttgccagtggctgtgccgtctggcccttttaggcatgaaggactgtcaaaagcagctcgcacgcaccggttgcgaaagctgagaacacctgcaaagtgccgcgagtgtaacagctacgtgtatttccagggggcagaatgtgaggaatgttgcctcgcctgccataagaaatgtttggagaccctggccatacaatgcgggcacaagaaactgcaaggaaggctgcagctctttggccaggattttagtcacgccgcaaggtctgcgcctgacggggttccattcatagttaagaaatgcgtttgcgagattgagagaagggccttgcgtacaaaaggtatctatagagtgaatggggtgaagaccagagttgagaaactctgtcaggcctttgaaaacggtaaggaactcgtggagctaagccaggcttcaccacacgatatctcgaatgttctgaagctgtatttgaggcagctacctgaacctctgatcagctttcgtctgtatcatgaactcgttggactcgctaaagacagcctaaaggctgaagctgaggccaaagcagcctccagaggaaggcaggatggctcagagagcgaggcagtcgccgtggccctggccggtcggctcagggaactgcttagagatttacctccggagaaccgggctagtctacagtatctcttgagacatttgcgacggattgtcgaagtggagcaagacaacaaaatgacaccaggcaatcttggaattgttttcggaccgacactgctacggcctagaccaaccgaagccacagtatctttgtcatccctcgtggactatccgcaccaagctcgggtcatagagaccctgattgtgcactacggcttagtctttgaagaagaaccggaggagacaccgggtggacaggatgagtccagcaaccaacgggctgaggtcgtggtacaggtgccctatctggaagccggagaagcagtggtctaccccctccaggaggccgctgccgacggctgtcgggagagccgagtggtgtccaacgacagcgattctgacctcgaggaagcttccgagctgctgtcaagttccgaggcatcagcactgggtcaccttagcttcctcgagcagcaacagtccgaggcatcactggaggtagcaagtggaagtcactcaggctctgaagaacagttagaggcaacggccagggaagacggcgatggggacgaagacggtcctgcacagcagcttagtggttttaatacaaatcagtcaaataacgtgctgcaagctccactccctcctatgcggctgcggggaggccgtatgacgctcggatcttgccgggaacgacaaccagagtttgtctag

SEQ ID NO: 226144 - DNA, 3393 bp, Artificial Sequence
  Description of Artificial Sequence: Synthetic coding sequence
agttactcaccctacagggctggccgacaggggcctcagcagagaggaagagatccaggtatccaactcacagagctgccgaggaaggacggcgcagacgctgtgtttcccggacctagtctcgagccccctgccggttcctcaggcgtcaaggctaccggaactctgaagcggcctactagcctgagtcgccacgctagcgctgctggattccctttgtcaggcgctgcaagctggaccctgggccgttctcaccgctccccattgacagccgcaagcccgggagaattacccacagagggagcaggccctgacgttgtggaagacatatcccaccttctcgccgatgtggctagatttgctgagggtcttgagaagctgaaagaatgtgtgttgcgcgatgatctcctggaagcacgcaggccccgagcacatgagtgcttgggcgaagcactaagggtaatgcatcagataatttccaagtaccctctgttaaataccgttgagacactcacagctgcagggacactgattgctaaggtgaaagcgttccattacgagtcaaacaacgaccttgaaaaacaagagtttgagaaagcattggagacaatcgcggtggccttctcctccacagtttctgagttcctgatgggcgaagttgactcgtctaccttactggcggtgcctccaggggactccagtcagtcaatggagtctttgtatggacccggaagtgaaggtacccccccaagtcttgaagactgtgacgccggttgtctgcctgctgaggaggttgacgtcctattgcagagatgcgagggaggagttgatgccgcacttctgtatgctaaaaatatggccaagtatatgaaggacctgatttcatatctggagaaacgcaccacattagagatggaatttgcgaagggactccaaaaaatcgctcataactgccggcagtctgtcatgcaggaaccccatatgcctttactgtcaatctattccctggctctggagcaagacttagaatttggccattctatggtccaggcagttgggactttgcaaactcagacattcatgcaaccgctgacgctacgtaggctggaacacgagaaaaggaggaaggagattaaagaagcctggcacagagctcaaaggaaactacaggaggccgaatccaatctgcgcaaagctaagcaaggttacgtccagagatgcgaagaccatgacaaggctcgctttctggttgccaaggctgaagaagagcaggccggaagcgctcctggcgcagggtcaactgcaacaaagacattggacaagcggagacggttagaagaggaggccaagaacaaagccgaagaggccatggctacatatagaacttgcgtggcagacgctaaaacccagaagcaggagcttgaggacactaaagtgaccgcccttcgacaaattcaggaggtcatcagacagagcgatcagaccattaaatccgccacgatatcctactaccaaatgatgcacatgcagacggcacctctccccgtgcacttccaaatgctctgcgaaagtagcaaactgtatgaccccggtcagcaatatgcctcccacgtgagacagctgcagagagatcaagagccagacgtgcattacgatttcgagccccacgtctccgcaaacgcttggagtcctgtcatgagagccaggaagagtagctttaatgtgtccgatgtggccagacctgaggcagctggatcaccacctgaggaaggcggatgcacagaagggactccagccaaggatcatcgtgctggtagagggcaccaggttcataagtcatggccactttccatctccgactccgacagcggcctggaccccggacccggagccggtgatttcaaaaagtttgaacgcaccagctcctcaggaactatgtccagcacagaggagcttgtggaccccgatggcggagccggtgcgtctgcttttgagcaggcggaccttaacgggatgactccagagctgccagtggcagtcccttccggacccttcagacatgaggggctgtccaaggccgcaaggactcaccgactgagaaaattaagaactccagctaaatgcagggagtgcaattcgtacgtgtactttcagggggctgagtgcgaggaatgttgcctggcctgtcacaaaaaatgtctcgagacactggctattcagtgtggtcacaagaaactgcaggggcgacttcaacttttcggccaggactttagtcacgctgcacgctcagctcctgacggtgtgccatttatcgttaagaaatgcgtgtgtgaaatcgagcgtagggcactcaggactaaaggtatttaccgggtgaacggggttaagacgcgggtggagaaactgtgtcaagccttcgagaacggaaaggagttggtggaactctcccaggctagcccccatgacattagtaatgtgctgaagctctacctgcgtcaactcccggagcccctgatctccttcagattgtatcatgaactcgtcggattggccaaggactcgttaaaggccgaggccgaggctaaggctgcttcccgtggacgccaggacggtagtgaatcagaagctgtcgccgttgctctggcgggtagacttcgagagctgcttcgggacctgccacccgagaaccgggcttcactccagtatcttcttcgccacctgaggcggattgtggaggtagagcaggataacaaaatgacccccggaaacctcggaatcgtttttggccctaccttgctgcgccctcgccctactgaagccaccgttagtctgtctagtctggtggattacccacatcaggctcgcgtgattgaaaccttgatcgtgcactacgggctcgtcttcgaggaggagccagaggaaacgcccggaggacaggatgagagcagtaatcagagggccgaggtggttgtgcaggtgccctatctcgaggcaggcgaagcagtggtgtaccccttgcaggaagccgcagccgacggatgtcgggaaagccgagtcgtaagcaatgatagtgacagcgatctggaggaggcgtcagagctgctgtctagctctgaggccagcgctcttggccacttgagcttcttagaacagcagcagagtgaggcatccctggaagttgctagtggaagtcactctggttcagaggaacaacttgaggccacggctagggaagacggagatggagacgaggatgggcctgcccagcagctgagcgggttcaacactaatcagtcgaacaacgttcttcaagccccactgcctcctatgagactgcgaggcggaaggatgacgcttggcagctgccgggagcggcagcctgagttcgtgtag

SEQ ID NO: 226145 - DNA, 3015 bp, Artificial Sequence
  Description of Artificial Sequence: Synthetic coding sequence
atgcaccaaattatcagtaaatatcctcttctgaacaccgtggagactcttaccgcggcaggcaccctgattgccaaagtgaaagcatttcactatgaaagtaacaatgacttggagaagcaagagttcgagaaagctctggagactattgctgtggccttcagctctactgtttctgagtttctgatgggcgaggtcgactcctctaccctgctggccgtccctcccggagactcttcccagagcatggagtccctctatggtcccggatccgagggcacaccacccagcttggaagattgcgatgcgggttgcctccctgccgaggaggtggacgtcctgctccagagatgcgaaggtggagttgatgcggctctgctgtacgctaagaacatggccaaatacatgaaggatctgatcagttacctcgagaagcgaactacactggagatggagtttgcgaaggggttacagaaaatcgctcacaactgccgccagtccgttatgcaggaacctcatatgccgttgctcagcatttattccctcgcactggagcaggacttagagttcggccactccatggtgcaagcagtcggcacactacaaacccaaaccttcatgcagccgcttacccttcgcaggctggaacatgagaagcggaggaaagagataaaggaggcatggcatagagcccagcgtaaactgcaggaggctgagtccaacctgagaaaggccaagcagggatatgttcaacgctgtgaggaccatgacaaagctcgcttcctcgtggcaaaagcggaagaagagcaggccggtagtgcccctggggcaggcagtaccgccaccaaaaccctggataaacgccgtagactggaggaggaggccaagaataaagccgaggaagccatggccacctataggacctgcgtggccgacgctaaaacgcagaaacaggagttggaggacacaaaggttactgccttgagacaaattcaagaagtgataagacaatctgaccaaaccatcaagagcgctactatttcctactatcaaatgatgcatatgcaaacggcccctctccccgtacactttcaaatgttatgcgaaagctccaaattgtacgacccaggacagcagtatgcttcccacgtacgacaacttcagagggaccaggaacctgatgtccactatgacttcgagccccatgtctcagccaacgcctggagtccggttatgagggctagaaagagctcgtttaatgtgtcggacgttgcacgaccagaagccgcaggttcaccacctgaggaaggtggctgtaccgaaggaacccccgcaaaggaccaccgaggagagtgtcctgcagggcctagggggggtcgctggctcccagctacacatcctggtcccagccccgagactccacttagccctgccggtcgcggtcatcaagtgcacaagagttggcccctgtcgatcagcgacagcgattccggcttagaccctggtcctggagctggggatttcaagaaatttgagcgcacttcctcttccggtacaatgagctctactgaagaactagtcgatcctgatggaggcgcaggggcaagtgcttttgagcaggccgacttaaatggaatgactcccgaactgccagtagccgtaccctctgggcctttccggcacgaaggactctcaaaggcagccaggacccacaggttacgtaaattaagaacccctgccaaatgtcgcgaatgtaactcatatgtgtactttcaaggcgctgaatgtgaagaatgctgtctggcatgccacaagaagtgcttggaaaccctggctattcagtgcggccataaaaaattacaaggaagactgcagcttttcggacaggatttttctcacgcagccagatctgctcctgatggcgttccgtttatagtaaagaaatgtgtgtgtgaaatcgagagacgggctttgcgtacgaagggaatttatcgcgtgaatggtgtgaagacgcgcgtggaaaaactgtgccaggcctttgagaacggcaaagaactcgttgaactctctcaagctagtcctcacgacatttcaaacgttctcaagctttacctgagacagctgcctgaacctcttataagctttcgcctgtaccatgaactcgttgggctggcgaaagacagcctgaaggccgaagccgaggcaaaggctgcttctcggggacgtcaagatgggtctgaatctgaagccgtcgccgtcgccctcgccggtagacttcgcgaactgctgcgagatttgccgcctgaaaaccgggcatcgctccagtatttactccgacacttacggagaatcgttgaagtggagcaggacaataaaatgacacctggaaatctgggtatcgtatttggtccaacgctactgaggccacggccaacggaagctaccgtgtcactttccagcctcgtggattatccccatcaagccagagtgatcgaaactctgattgtgcactatggactggtgttcgaagaagaacctgaagaaactcccggaggccaggacgagagtagcaaccaacgtgccgaagtcgtggtacaggttccttatctagaggcaggagaagccgtagtatacccattgcaggaagctgcagccgatgggtgtcgggagtcccgggttgtgagtaacgattccgacagtgatctggaagaggcctcggaactcctgtcatcatccgaggccagtgccctggggcatcttagctttctcgaacagcagcagtcagaggccagtctcgaagtggcctccggttctcattcgggcagcgaggagcagctggaagccaccgctcgtgaagacggcgatggcgatgaggatggccctgctcagcagctgtccggcttcaacactaatcagtcgaacaatgtcctccaggcaccactcccacctatgagacttcggggaggtcgcatgactctagggagttgcagagagcgtcagcctgaatttgtttag

SEQ ID NO: 226146 - DNA, 3459 bp, Artificial Sequence
  Description of Artificial Sequence: Synthetic coding sequence
atgtcaagaggtcagcgtgtgctgaaaggcctgctggggtgggtttgtacgtggacctgggcctggcgggcacgattgggcgctcgtggctgcggactgcatgtgttatgtccaagagacctgcctttgcctcccgaagaactcccgaggaaggacggcgcagacgcggtgtttcctggaccttcactagagcctccagctggaagcagcggggttaaggccacaggaactctgaagcgccctacctcactgtctagacacgctagcgcagcaggattccctctcagcggggcagcatcctggaccctgggtcggtcccatcgatcgcccctcaccgccgcttccccaggcgagttacctaccgaaggggcaggtccagatgtggtcgaggatatcagtcatctcctcgccgacgtcgccagattcgcagaagggctcgaaaagttgaaggaatgtgtgcttcgggacgatcttttggaagcaaggcggccacgggcacacgagtgtctaggggaggccctgagggttatgcaccagattatctctaagtatcccctgctcaacaccgttgagacattgactgccgcaggaacactgatcgccaaagtgaaggcttttcattatgaaagtaataacgatctggagaagcaagagttcgagaaagcgctggaaaccatcgccgtcgccttctcatcaactgtatcagaattcctgatgggtgaggtcgatagttccaccctgttggccgtgccccctggcgattcttcgcagtcaatggagtctctgtacggcccaggatcggaggggacgcccccttctttagaggactgtgatgccggttgtttgcccgctgaggaagtcgacgtcctcttacagcggtgcgagggaggtgtggacgcggctcttttgtacgccaagaatatggcgaaatatatgaaggatttgatatcgtatttggagaagaggaccacgctggagatggagttcgcaaaaggcctgcaaaaaattgcccataactgtagacagtctgtgatgcaggaaccccacatgcccctgctctccatctattccctggccttggagcaagacctggagttcggtcacagcatggtgcaagcagtcggcacacttcagacccagacatttatgcagcctctcacgctgagacgtctcgagcatgagaagaggcgcaaagagattaaagaggcctggcatagggcccaacggaagctgcaggaggctgaatccaacctgcgcaaagcgaaacagggttatgttcaacggtgcgaagaccacgacaaagccagatttcttgtggccaaggccgaagaggagcaggccggtagcgcacccggtgctggcagcactgcaaccaagacactggacaagaggcgtcggttggaggaggaagctaagaataaagctgaggaggccatggctacatatagaacatgcgtcgctgatgcaaaaacacagaagcaggaactcgaggataccaaggtgacagcccttaggcagatacaagaggtcattcggcaaagcgaccaaactatcaagtcagccactatctcttactatcagatgatgcacatgcagacggctccattgccagttcatttccagatgctgtgtgagagctccaagttgtatgaccctggacagcagtacgcaagccatgtcaggcaactccagcgagaccaggaacccgacgttcactacgactttgaacctcacgtctcagccaacgcctggagtccagtgatgcgggctcggaaatcctccttcaatgtctcagacgtcgcaagacccgaggccgctggcagtcctccagaagaaggcggatgcaccgagggcactcccgcaaaggatcaccgtgccggaagagggcatcaagtgcataaatcgtggccgctgtcaatctccgatagcgatagtggcctcgatcctgggccaggagccggtgacttcaaaaaattcgagcgaacttctagttctgggaccatgtcatccacagaagagttagtggacccagacggcggtgccggagcaagtgcattcgaacaggcagatctgaacggcatgactcctgagctcccggttgccgtcccgtccggcccttttcgccacgaggggttgtccaaggcagcgcgtactcacagactgagaaaactgagaacccccgctaagtgccgcgagtgtaactcatacgtgtattttcagggggcagaatgcgaagagtgttgtctcgcatgccataagaaatgcttggaaacactggcaattcagtgcgggcacaagaaattgcaggggcgactgcaattattcggtcaggatttctctcatgctgcccgtagtgcacctgatggcgtgccttttatcgtcaagaagtgcgtttgtgaaattgagcgcagggcactgcgaacaaagggcatttacagagtgaatggagtgaaaacccgggtagagaaactgtgccaggcatttgagaacgggaaggagctggtcgaactctcccaagccagccctcatgacatctctaacgtgcttaaactttatctgcgacagctgcccgaacctctgatctcttttcgtctctatcatgaactggtggggttggcaaaggactctctgaaagctgaggctgaggcaaaagctgccagtagggggaggcaggacggatccgagtctgaggcagtggctgtagcacttgccggtcgcctccgagagctgttacgggacctcccacctgagaaccgggcttcccttcagtacctgttacggcatctgcggagaatcgttgaagttgagcaggataacaaaatgactcccggtaacctcggaattgtgtttggccctaccctactccggcctaggcccactgaagcgacagtcagtctctcaagtttggttgattatcctcaccaggctcgggtgatcgagacccttatcgtccattacgggttggtgttcgaagaggagcccgaggaaactccaggcggacaggatgaaagctccaatcagagggcagaagttgtcgttcaggtgccttatctggaagccggagaagccgtagtgtatcccctccaggaagcagcggctgatggttgtcgggagtcaagagtggtgtccaacgactccgactccgacctggaagaagcaagcgagctgctctcatcctcagaagctagcgcactagggcacctgtcctttctggagcagcagcagtccgaggctagtttggaggtcgcatccggaagccactcgggaagtgaggagcagctcgaggcgaccgcgagggaggacggtgatggcgacgaagatggacccgctcagcaactgtctggctttaacactaaccagtccaataatgtccttcaggcacccctgcccccaatgcgacttcggggtggccgaatgaccctcggcagctgccgagaacgccagcctgagtttgtctag

SEQ ID NO: 226147 - DNA, 3060 bp, Artificial Sequence
  Description of Artificial Sequence: Synthetic coding sequence
atgtgcatttgtggcaccgcgcatccagttctggacgaaggccctgtgcgttgtcgcgctgggcctagagatctccttgaggccaggcgacctagagctcatgaatgtcttggcgaggccctgcgggtgatgcatcagattatctctaaatatcctctcctgaacacagttgagactcttactgccgctggcacgttgatagctaaggtgaaggcatttcactacgagagtaacaacgacctagagaaacaggaatttgagaaggctctcgagaccatcgcagtggccttctcctctacggttagcgagttcttgatgggtgaagttgattcctccacactcttggcggtccccccaggcgattcatctcagagcatggaaagtctgtacggccctggcagtgaggggacgccccctagtcttgaagattgtgatgcaggctgcctgccagctgaggaggtggacgtgctgctgcagcgctgtgaagggggagttgacgctgcactgctgtacgccaaaaatatggccaagtatatgaaagatcttattagctacctggagaaacgtaccacgctggagatggaattcgctaagggcctgcaaaagatcgcacacaactgccgtcaatccgtcatgcaggagccacatatgcctctactgtctatctactcccttgcattggagcaggatctcgagtttggacatagtatggtgcaagcggtcggcacgctacagacacagaccttcatgcagcctctgaccctgcgccgtctagagcacgagaaacgccgaaaggagattaaggaggcatggcatcgagcccagcgtaaactccaagaagcagaaagtaatctcagaaaggccaaacaggggtatgttcagcggtgcgaggatcacgacaaggcacgctttctggtcgctaaggccgaggaagaacaggcaggctccgcaccgggagccggatccacagcgactaagaccctcgataagagaagacggctggaggaggaggctaaaaacaaagccgaggaggctatggctacgtaccgcacatgtgtggccgatgccaagacccaaaagcaggagctggaggacactaaagttacagcgctccgccagattcaggaggtgattaggcagagcgaccagactatcaagtccgctactatctcttattaccaaatgatgcacatgcagacagctcctctcccggtgcattttcagatgctttgtgaaagtagcaaactgtacgaccctggccaacaatatgcttcccacgtccggcagttacagagggaccaagagcctgatgtgcattatgatttcgagccccatgtgtctgccaacgcctggagcccagtgatgagagctcggaagtccagctttaacgtgtctgacgtcgcccgacccgaagctgctggttccccaccagaagaaggtgggtgcaccgaggggacccctgccaaggaccacagagctgggaggggccaccaggtgcacaaaagctggccgctgagcatcagtgactccgatagcggtcttgatcccggtcctggggctggtgacttcaaaaaattcgagagaactagttctagcggcactatgtccagcacagaggaacttgtggaccccgatgggggagccggagcgtctgcctttgaacaggcggacttgaatggaatgacaccggagttacctgtggcagtcccaagtggcccattccggcacgaaggcttaagtaaagccgctcgcacacaccgcctgcgaaagctgagaaccccagccaagtgccgagagtgcaattcttacgtttactttcagggggctgagtgtgaggagtgctgcttagcttgtcataagaaatgccttgagacgctcgcaatccaatgcggccacaaaaagcttcagggacggcttcaactcttcgggcaggatttcagtcacgccgctcgctccgccccagacggggtgccattcattgtgaagaagtgcgtgtgcgagatcgaaaggagggcactgcggacaaaaggcatttatcgggtgaacggggtaaagacaagggtggagaagctgtgtcaggcctttgagaacggcaaagagcttgtcgagctctcacaagcttcaccgcacgacatttcaaacgtcctgaaattatacttacgccagctgcctgaacctttgatttcatttcggctgtaccacgagctggtcggtctggctaaagattcacttaaagctgaagcagaagccaaggcggcttccaggggacgccaggatggtagtgagagtgaagcagtagcggtggccctggccggtagactgagagagctgctacgggacctcccaccagaaaaccgggcatctctccagtatttgctccgacacctccgaaggatcgtggaagtcgagcaagacaacaaaatgacccccggtaacctcggtattgtgtttggacctactttgttacgccctcgacctacggaagcaacggtgtcgctctccagcctcgtcgattatccacaccaggcacgtgttatcgagaccttaatcgtgcactacgggctcgtgttcgaggaagaaccagaggagacacccggtggtcaggatgaaagcagtaaccagcgcgctgaggtggtggtgcaggttccttacctggaggctggggaagccgttgtgtatcccttgcaagaggctgcagccgacggctgtcgtgaaagtcgggtggtgtctaacgattctgactctgacttagaagaagcatccgagcttctttcaagttcagaggcctctgcactgggtcaccttagtttcctcgagcagcagcagagcgaggcctcactcgaagtggcgtctggcagccacagcggatctgaggagcagctggaggccacagcaagggaggacggtgatggcgatgaggacggtcccgcacagcaactctctggcttcaatactaaccagtctaacaacgtgcttcaggcgccacttcctcctatgcggctgagggggggaagaatgactttggggtcatgccgagagcgccagcctgagtttgtgtag

SEQ ID NO: 226148 - DNA, 2847 bp, Artificial Sequence
  Description of Artificial Sequence: Synthetic coding sequence
atgtttagccgaaaaaaaagagaactgatgaagactccctccatcagcaaaaaaaaccgcgcaggctctccctcacctcagccgagcggagagttaccaagaaaggacggagccgacgctgtgtttcctggcccaagtctcgagccccctgcgggatcgagcggagtaaaagcaaccggcaccttgaaaagacccaccagtctgtcacgacatgcttccgctgctggatttcccctgagcggcgctgccagttggaccttaggaaggtcccaccgcagtcctcttactgcagcatccccgggtgaactgcccacagaaggagctggcccagatgtcgtggaagatatttctcatcttctggccgatgtggccaggtttgctgaagggttggaaaaactcaaggagtgtgtgctgcgggatgacttgctcgaagccagacggcctagggcgcacgaatgccttggcgaagcgctcagagtcatgcaccaaattatatccaagtaccctctactgaacacggtggagaccctgacggctgcgggtacattgattgccaaagtgaaggccttccattacgagtctaataatgaccttgagaagcaagagttcgaaaaagccctggaaacaatcgctgtggcgttcagctctacagtaagcgaatttttgatgggagaggtagattccagcaccctgttagcagtgccacctggagatagttcccagagtatggagtcgctttatgggccaggttccgagggcacgcctcctagcttggaagattgtgatgccggatgcttgccagccgaggaagtcgatgtcttgctgcaaagatgtgaggggggtgtggacgcggctctgctctatgccaaaaatatggccaaatatatgaaggatttgatctcatacctggagaagcggacaacactggagatggagtttgccaaaggccttcagaagatcgcacataactgccggcagtccgttatgcaggaaccccatatgccattgctatcaatttattccctggctttggagcaagatctggagtttggtcattctatggtgcaggctgtcggaaccctgcagacccagacgttcatgcaaccgttgaccctgagacgactcgagcacgagaaaagacgcaaggaaatcaaggaggcctggcatagggcccagcgtaagctccaggaggcagaaagcaaccttcgaaaagccaagcagggttatgtccagcgctgtgaagaccatgataaggctcgcttcttggtggccaaggctgaggaggaacaggctgggtctgcacctggggctggaagcactgccacaaagaccctcgataagcggagaaggttggaggaggaggccaaaaacaaggcagaagaagccatggctacttaccgcacctgtgtcgccgacgctaagacacagaagcaggaacttgaggatactaaggtgacggccctgagacagatccaggaagtcattaggcagtcagatcagactattaaaagcgccaccattagctactaccaaatgatgcacatgcaaacagctccactgccggtgcacttccagatgctgtgtgagagctccaagttatacgaccctggccagcaatacgcgtcacatgttcgccagcttcagagagaccaggagccagacgtccactacgacttcgaaccccatgtgagcgctaatgcctggagtcccgtgatgagagctcggaagtcatcctttaacgtcagtgatgtcgccagaccagaggccgctgggtccccgcctgaggaagggggatgcactgagggcacacccgctaaggaccaccgagcgggaaggggccatcaggtgcacaaaagttggccgctcagcatctccgattctgacagcggtctcgacccaggccctggggctggggatttcaagaagtttgaacggacctccagctccggcacaatgagctcaaccgaggagcttgttgaccctgacgggggagccggagcatcggcgttcgagcaggctgatctgaacgggatgacccccgagctacccgtggccgtgccttccggcccatttaggcacgaaggtctcagtaaagcggctcgaacccaccggctccggaaattgagaacacctgctaaatgtcgcgaatgtaattcttacgtgtactttcagggagccgaatgtgaggagtgttgtttggcatgccacaagaagtgcctcgagacactggcgatccaatgcggccataagaaactgcagggcagactacagttgttcggtcaggacttctcacacgctgcaagatccgctcccgatggagtgccgttcatcgtgaagaaatgtgtgtgcgagatcgaaaggagggctctgcgcaccaaaggtatttatcgggtgaatggggtgaagacacgcgtggagaaattatgccaggcgtttgaaaacgggaaggagctcgtggaactgagccaagcttcgccacatgatatcagtaacgtgctcaagctttatctgcgacaacttcctgagcccctgatatcttttcgcctctatcacgaactggtgggtctggctaaggacagcctgaaggcggaagcagaggccaaagccgctagtagaggtaggcaagatggaagcgagagcgaagccgtagcagtggctcttgccggtagacttagagaacttctgagagatttgcctccggagaatagggcttctttacagtacctgctccggcacttgcgaaggatagtcgaggttgagcaggacaataagatgactcccatgcgcctgaggggtggccgaatgacgttgggaagttgtagagaaaggcagccagagtttgtatag

SEQ ID NO: 226149 - DNA, 3492 bp, Artificial Sequence
  Description of Artificial Sequence: Synthetic coding sequence
atgttttcacggaaaaagagagaactgatgaagacgccctccatctccaagaaaaaccgcgctggttcccctagtcctcagccatcaggcccacacttcatttctggagaaacagaggcagtcagcagacccgaaaatcctttcaacgaactgccatcagatcttccaaaggagttgccaaggaaagatggggctgacgccgtctttcctgggcctagcctggaaccacccgctgggtccagtggcgtaaaagccacaggcaccctcaagagaccaacaagtctcagtcgccacgcttccgctgccggattccctctgtcaggagccgcatcttggacgctcgggaggtcgcaccggagccccctcaccgctgccagtccaggagagctacctaccgaaggcgcagggccagacgtggtcgaggatatcagccacttgctggcagacgttgcacggttcgcagaggggcttgagaagctcaaggaatgcgtgctaagagatgacctactggaggccaggagacccagggcccatgagtgtctgggtgaggcccttcgggtcatgcaccagattatttcaaaatacccactcctcaatacagttgagacactgactgccgcaggtaccttgattgccaaggttaaggcttttcactatgagtccaataacgatctcgagaagcaggagtttgagaaagctcttgagactatcgccgtggcgttctctagcaccgtctccgagtttttgatgggcgaggtggattcatcgacccttctcgcggttcctccaggtgattcatcacagagtatggaatcattgtatggtccaggctctgaagggacccccccatccttggaggattgcgacgcaggatgtctgcccgctgaagaagtggatgttcttcttcagcgctgtgagggcggtgtggacgccgcactgctttatgccaaaaacatggcgaagtacatgaaagatcttattagctacttggagaaaagaactaccctggagatggagttcgcaaagggcttacagaagattgctcacaactgtaggcaaagcgtgatgcaggagccacacatgccccttctgtctatttattccctggccctggagcaggatttggaatttggccactcaatggtccaggcagtaggtaccttgcaaacacaaacattcatgcagccgctgacactcagaagactcgagcacgagaaaaggcgaaaggagattaaggaggcatggcatagggcacagcgaaaactccaggaggcagaatctaatctccgaaaggccaaacaggggtatgttcagaggtgtgaagatcacgacaaggccaggtttctggttgccaaagcggaggaggagcaggccggatccgccccaggggcaggctctacagcgacaaagactctcgataagagacgtagattagaagaggaggcaaagaacaaagctgaagaggctatggctacctacaggacatgtgtggctgacgcaaaaacacagaagcaagaattagaagataccaaagtcactgctctcaggcagatacaagaggtgatccgtcaatcggaccagacaataaagagcgctacaatttcctactatcagatgatgcacatgcagaccgccccactgccagttcattttcaaatgctgtgtgaaagcagcaagttgtacgatccgggacaacagtacgcctctcacgtacggcagcttcagagggaccaagaacccgacgttcattatgactttgagccccacgtatccgccaatgcttggagccccgtgatgagagccagaaaaagctcctttaacgtctcagacgtcgctcgcccagaggccgcaggaagtccacctgaggaagggggttgtactgagggcactcccgcaaaggaccaccgagcagggcgaggccaccaggttcacaaatcatggcccctgtcaatctcagactccgactccggccttgacccagggccaggggcaggcgactttaagaaattcgagcggacttcaagttctggcacgatgtcctcaactgaggaattagtcgaccccgacgggggagctggtgcctctgctttcgaacaggccgatctgaatggaatgacgcctgagctgcctgtggctgtcccaagcggacccttcaggcacgaagggttgtccaaagccgcacgaacccacaggctgagaaaactcagaaccccagcaaagtgtagggaatgcaattcatatgtatattttcaaggcgcagaatgcgaggagtgttgcttagcgtgtcataagaaatgtctcgagaccctcgcgatccagtgtggacacaagaagcttcagggaagactgcagttgtttggtcaggacttttcccacgctgctcgtagcgctccagacggcgtcccttttatcgtcaaaaaatgcgtctgcgagatagaacgcagggccctacggaccaaaggaatatatcgcgtgaatggtgtgaaaaccagggttgaaaaattgtgccaggcatttgaaaatggaaaggagctggtcgagctgagccaggcctcccctcacgatatctccaacgtcctaaagctctatctcagacagcttccggaaccactgataagtttcaggctgtatcacgaattagtcgggctggctaaagactcccttaaggcagaagccgaggccaaggccgcttcaagaggacgacaggatggcagtgaatccgaagcagtggccgtagcactagcaggacggctgcgggaactgttacgggatttgcccccagaaaatcgggcaagcttgcagtacctgcttaggcacctaagaagaatagttgaggtggaacaggacaacaagatgacacctggaaatctggggatagtctttggaccgacactgttgcggcctcggccaactgaagccacagtcagcctgtcatccttagtggattacccccatcaggcccgtgtcatcgagaccctgatcgtgcattacggcctagttttcgaagaagagccagaagagacccccggtggtcaggacgagagcagtaaccagagagccgaagtcgtcgttcaggtaccatacctggaagccggtgaagccgtggtgtaccctctccaggaggcagcagccgatggctgcagagaaagcagggtcgtgagtaacgactctgactcggaccttgaggaggcctctgagctgttgagcagctctgaggcatccgcactcgggcatctcagttttctagagcagcaacagtctgaagcctcactcgaggtggccagcggatctcactcggggagcgaggagcagctggaggctacagcacgggaggatggtgacggcgacgaggacggacccgcacagcagctttccgggtttaacactaaccagtctaataacgttctgcaggctcccctgccacccatgaggcttcgcggaggcaggatgactcttgggtcgtgtcgagaacgccagccggagttcgtgtag

SEQ ID NO: 226150 - DNA, 420 bp, Artificial Sequence
  Description of Artificial Sequence: Synthetic coding sequence
atgagtataagcagtgcgttggctatggtcttcatgggggcaaaaggaaacactgcagcccagatgagtcaggccctctgtttttccaagattgggggagaggacggggatatccatcggggatttcagtccttgttggtggcaattaacagaacagataccgaatatgtgttgaggacagcgaacgggctttttggcgagaagtcctacgactttctgactggattcaccgattcatgtggcaaattttatcaggctactataaagcaactggatttcgtcaatgataccgagaagtctaccacccgcgtaaattcttgggtcgcggacaagaccaagggggagaacatattgctgttctacttcgataatatcttgaactccttcatcgtgtctagcctgcagaactgtcagatatag

SEQ ID NO: 226151 - DNA, 162 bp, Artificial Sequence
  Description of Artificial Sequence: Synthetic coding sequence
atggagatctttatcgaggtgtttagtcattttctgctacagctcactgaactgacactgaacatgtgcttagagttaccaacagggtctcttgaaaaaagcctgatgataagctctcaggttctgcagatccccgtagctaactccaccaagcaaagatag

SEQ ID NO: 226152 - DNA, 648 bp, Artificial Sequence
  Description of Artificial Sequence: Synthetic coding sequence
atgagtgagactgtgccccctgctccagctgctagtgcagcccctgaaaagcccctggccggaaaaaaagccaagaagcccgcaaaagccgctgccgcttccaagaagaaacccgctgggccttcagtgtctgagttgatcgtgcaggccgctagctccagtaaggagagagggggagtgagtctcgcagcgttgaagaaagctctggcagctgcaggctacgatgttgagaagaacaactctcgcatcaaactaggtattaaaagtctggtatcgaagggcacactggttcaaactaagggcacaggcgcatctggatcattcaaattaaataaaaaggctagctccgtcgagaccaaaccaggcgcatctaaagttgctacgaagaccaaagccaccggagcttcgaaaaagttgaagaaggcaaccggcgcatctaagaagtctgtcaaaactccaaaaaaggctaagaagccagccgcaacccgcaaatccagtaagaatccaaagaagcctaagacagtgaagcctaaaaaggtcgcaaaatcgccggctaaggcaaaagccgtcaagcccaaagcagcgaaagcaagggtgactaagcctaaaacggccaaaccaaaaaaggctgcgcctaaaaaaaaatag

SEQ ID NO: 226153 - DNA, 681 bp, Artificial Sequence
  Description of Artificial Sequence: Synthetic coding sequence
atgagcgagactgctccggcagagaccgctactccggctcccgtggaaaagtctcccgcaaagaagaaggctaccaaaaaggccgcaggcgcaggcgcagcgaagagaaaagcgactgggccacctgtctctgaactgatcaccaaggctgtggcagcttccaaagagcggaatgggctttctctggccgctttaaagaaagcactggcagccggtggctatgacgtcgagaaaaacaacagtagaataaaactcggtctcaagtctctcgttagcaagggcaccttggtccaaaccaagggtactggcgctagcggaagtttcaagttgaacaaaaaagccgcatccggcgaagccaagcctaaggccaagaaagcaggggctgccaaggccaagaaacccgctggcgcaacccctaagaaggctaaaaaagccgcaggcgcaaaaaaagcggttaagaagacacccaaaaaagcaaaaaagcccgctgctgccggagtaaaaaaggttgctaagtcccccaaaaaggctaaggccgctgcgaagcctaaaaaagcaactaaatctcctgccaaacctaaggccgtgaagccaaaggctgcaaaaccgaaggcagcaaaacctaaagccgcaaaacccaaggccgctaaagccaaaaaagccgctgctaaaaagaagtag

SEQ ID NO: 226154 - DNA, 642 bp, Artificial Sequence
  Description of Artificial Sequence: Synthetic coding sequence
atgtccgagactgcccctgctgccccagcagcggctcctcctgcagagaaagctccggttaagaaaaaggctgctaagaaagccggtggtacccctagaaaggcctcaggacctcctgtgagtgagctgatcacgaaggctgtagccgcaagcaaagagagatctggggtgtctcttgccgctctgaagaaagctctagctgccgcaggctacgatgtggagaaaaataattcacggatcaagctcggcctgaaatccctggtgagtaagggcacgttggtccaaactaagggcacaggcgcatctgggtcttttaagctaaacaagaaagccgcatccggcgaagctaaaccaaaggtaaagaaagccggaggcacaaagcccaaaaagccagttggcgctgctaagaagcctaaaaaggcagccggaggtgccacccctaaaaaatccgcgaagaagacgccaaaaaaagcaaaaaaacccgctgctgccaccgttaccaaaaaggtggccaaaagccctaaaaaggccaaggtggcaaaacccaagaaagcagccaaaagcgctgccaaagcagtgaagcccaaggccgctaaacccaaagtggtaaaaccaaaaaaggcagcaccgaagaaaaaatag

SEQ ID NO: 226155 - DNA, 666 bp, Artificial Sequence
  Description of Artificial Sequence: Synthetic coding sequence
atgtcggagaccgccccattagctcctaccattcccgctccagccgagaaaacccctgtcaagaaaaaggctaagaaagccggtgccactgctggcaaaaggaaagccagcggaccccctgtgtcggagctcatcacaaaagccgtagctgcttccaaagagcgctcaggggtctctctcgctgcccttaagaaagccttggccgctgctgggtatgatgtagagaagaataacagccggatcaagctcggactcaagtctctggtcagcaaagggaccctcgtgcagacaaagggcacgggtgcctctgggagctttaaactgaataagaaagctgcctcgggcgaagggaaaccaaaggcaaagaaagcaggagctgcaaagcctaggaagcctgccggagcggctaagaagcctaagaaggtcgcaggggcagccacccccaagaagagtatcaagaaaacaccaaaaaaggtgaaaaagcccgctaccgctgctgggaccaaaaaagtcgcaaaatcagccaagaaagtaaagacaccccagccaaagaaggccgcaaagagccctgctaaagccaaggcccctaaacctaaggccgcaaaacccaagtctgggaagcccaaggttactaaagccaagaaagcagcacctaagaaaaagtag

SEQ ID NO: 226156 - DNA, 660 bp, Artificial Sequence
  Description of Artificial Sequence: Synthetic coding sequence
atgtcagagaccgcacctgccgcacctgccgctcctgctcccgcagagaagacacctgtgaagaagaaagcccgtaaaagcgccggagctgcaaagcgaaaggctagtggaccgcctgttagtgagctcatcactaaggccgtcgcagcaagtaaggagcgctcaggagtgtctcttgctgccctcaagaaggccctggccgctgctggctatgatgtcgaaaagaacaatagtcgcattaaactcggcctaaaaagtctcgtctctaaaggcacattggttcagacgaagggcacaggtgcgtctggcagttttaaattaaataagaaggctgcctcaggagaggcgaagccaaaagccaaaaaggcgggagctgccaaggccaagaagccagctggggctgctaagaaacctaaaaaggccaccggggcagcaacaccaaagaaatccgcaaaaaagacacccaaaaaagcgaagaaacccgcagccgcagccggagccaagaaggccaagagtcccaaaaaggcaaaagccgcaaaaccaaaaaaagcaccgaagtctcccgctaaggctaaagccgtcaaaccaaaggccgctaagcccaagactgccaagcccaaagcggcaaaacccaaaaaagccgcagctaaaaaaaagtag

SEQ ID NO: 226157 - DNA, 624 bp, Artificial Sequence
  Description of Artificial Sequence: Synthetic coding sequence
atgtccgagaccgttccagcggcttccgcaagtgcgggtgtcgctgccatggaaaagctcccaaccaagaaaagaggaagaaagcccgcagggttgatttctgcgtcccgcaaagttcctaatttaagcgtgtcgaagctgatcacggaggcattgtcggtctcacaagagcgcgttggaatgtctttggttgcgcttaaaaaggccctcgcggctgccggatacgatgtggaaaagaacaatagtaggattaagctttcacttaaatcccttgtgaacaaggggattttggtacagacgcgcggtaccggagcaagtggttccttcaaattgagtaaaaaggtgatacccaaatcaaccagatcaaaagcgaagaagagcgtctcagctaagacgaagaaacttgtattgtccagggactccaagtcccccaagaccgccaagacaaacaagagggcaaaaaaaccccgagcaaccacccctaagaccgtgcgctctgggaggaaagccaagggagcaaaaggcaaacagcaacagaaaagcccagtgaaggccagagcatcaaagtccaaactgactcagcaccacgaggttaatgtgaggaaggccacctccaagaagtag

SEQ ID NO: 226158 - DNA, 393 bp, Artificial Sequence
  Description of Artificial Sequence: Synthetic coding sequence
atgtctggcagaggtaagcaggggggaaaagcacgcgctaaagcaaaaacccggtcgagccgtgctggcttgcagttcccggttggacgcgtgcaccgcctgcttcggaagggcaactattcagaaagggtgggggcaggggcaccagtttacttagccgctgtgctagaatatctgaccgcagagatcctggagctcgcaggcaatgcagctcgggacaacaagaagaccagaataattccacggcacctgcagctcgccatccggaacgacgaggagttgaataagttgcttggtcgtgtgacaattgctcagggcggtgtgctgccaaacatccaggctgtcttactacctaaaaaaaccgagtctcatcacaaagccaagggcaagtag

SEQ ID NO: 226159 - DNA, 393 bp, Artificial Sequence
  Description of Artificial Sequence: Synthetic coding sequence
atgtccggccgtgggaaacagggaggaaaagcgcgagccaaggccaaatcccgctctagccgggctgggcttcaatttccagtcggtcgcgttcataggttgttaagaaagggtaattatgcagaacgggtgggcgcaggcgcaccagtatacctcgccgctgtgctcgagtacctgacagccgagatcctcgagttggccggtaacgctgccagagacaataagaaaactcggattatcccccgacatctgcagttagctatcagaaatgatgaggagctcaacaagcttctcggtagagttactatagcccaaggcggagtgctaccgaatattcaagctgtgcttctgccgaagaagactgagagtcatcacaaagcaaagggaaaatag

SEQ ID NO: 226160 - DNA, 393 bp, Artificial Sequence
  Description of Artificial Sequence: Synthetic coding sequence
atgtctggacgcggaaagcagggagggaaggcacgagccaaggcaaaaagccgcagttctagggctggtctgcagttccctgtgggaagggtgcaccgcctgctgagaaagggcaactatgcggaaagagtgggagcgggtgcaccagtgtatctagctgccgtgctagagtaccttactgcagagatactggaactggcaggcaacgccgctagagacaacaagaagacacggattatccctcgccatcttcaactggcaattagaaatgatgaagagttgaacaaattgctcggaagggtcaccatcgcccagggtggcgtcttgccaaatatacaggcagtgctgctgcctaaaaagactgaatcacatcataaggcgaaaggaaagtag

SEQ ID NO: 226161 - DNA, 393 bp, Artificial Sequence
  Description of Artificial Sequence: Synthetic coding sequence
atgtcaggcagaggcaagcaaggagggaaggctcgggcaaaagccaaaaccagatcatcccgagctgggctgcagtttccagtaggaagagtgcataggctactgcgtaagggtaactattctgagagggttggagccggagccccagtgtacttagcggctgtgctggaatacttgaccgcggaaatactggagctggccggaaatgcagccagagataataaaaaaacccgaattatacctaggcatctgcagctagctatccggaacgacgaggagctgaataaattactggggaaggtcacaattgcccaaggaggcgtactacctaacatccaggctgtcctgctgcccaagaaaaccgagtcccaccataaagcaaaaggcaaatag

SEQ ID NO: 226162 - DNA, 393 bp, Artificial Sequence
  Description of Artificial Sequence: Synthetic coding sequence
atgagcggcagggggaagcaggggggaaaagccagagctaaggcgaaaacacgcagttcccgagcaggcctgcagttcccggttgggagggtgcaccgactgctgaggaaggggaactattccgaaagagttggcgcaggagcccctgtgtatctagccgctgtacttgagtacctgaccgctgaaattttggaactggccggaaacgcagctagggataataaaaagacaagaataatccccaggcatctgcagttggcgattagaaacgatgaagaactaaataagctgctgggtcgtgtcacgatcgcacaaggtggtgtactgccaaacatccaggcagtgctacttcctaaaaagaccgagagccaccacaaggctaagggaaagtag

SEQ ID NO: 226163 - DNA, 393 bp, Artificial Sequence
  Description of Artificial Sequence: Synthetic coding sequence
atgtccggcaggggcaagcagggtggaaaggcacgagcaaaggctaagacccgttcgtccagagctggactccagttcccagtgggcagagtccatagactcttacggaaggggaattatgcggaaagggtgggcgctggtgcccctgtgtatctcgctgccgtgttggagtacctcacggccgagattcttgagctggctgggaacgctgctcgcgacaacaaaaaaacccgcataattcccagacacttgcagctggcaatacgcaatgatgaggagcttaacaagctgctaggaaaagtgactatcgctcagggaggggtgttgcctaacattcaagcagtgctgttacctaaaaagacggagagtcaccataaagccaaggggaaatag

SEQ ID NO: 226164 - DNA, 387 bp, Artificial Sequence
  Description of Artificial Sequence: Synthetic coding sequence
atgtcggggcgaggaaaacaggggggaaaggcaagagccaaggccaaaactcggagttctcgcgctgggctgcagtttccggtaggtcgagtccataggttacttagaaaaggtaattacgcggagagggtcggggcaggcgctcctgtgtatttggccgcagtgctcgagtatctcactgcagaaatcttagagctagctggaaacgcagctagagacaataagaaaactagaattatcccaaggcatctgcagctggcaattcggaacgacgaagaattaaataaattgcttggtaaggtgacaattgctcagggcggtgtcctgccaaacatccaggctgtcctgctgcctaagaaaactgaaagtcatcataaaacgaagtag

SEQ ID NO: 226165 - DNA, 393 bp, Artificial Sequence
  Description of Artificial Sequence: Synthetic coding sequence
atgtcgggccgaggaaaacaaggcggtaaagccagggccaaggccaagaccaggagctccagagccggactgcaattccccgtagggagggttcacaggctactgagaaaggggaactacgctgaacgggttggggctggggctccagtgtatctggccgctgttctcgagtacctgactgccgagattctcgagttggcaggaaatgctgcgagagataataagaagactcggataatcccccgtcatttgcagttggctatcaggaacgatgaggagctgaataagctcctcggtaaggtgaccattgcgcaaggcggagttctcccaaatattcaggcggttctgctgcctaaaaagaccgagagccaccacaaagccaagggcaaatag

SEQ ID NO: 226166 - DNA, 393 bp, Artificial Sequence
  Description of Artificial Sequence: Synthetic coding sequence
atgagcgggagagggaagcagggtggtaaggccagagctaaggccaaaacgcgcagcagcagggctggattacagttccctgtgggtagggtccataggctgttacgaaagggaaattacgcagaacgcgtcggggcaggcgcacccgtctacctcgcagccgtactcgagtatctcactgccgaaatactagaactggccggaaatgccgcacgggacaacaagaagacccggatcatccctagacatcttcagctagccatacggaatgatgaggaattgaacaagctgctgggtaaggtcaccatcgcccagggcggagtgttgcccaatatccaggcagtcctgctccctaaaaaaacagagagccaccacaaggccaaaggtaaatag

SEQ ID NO: 226167 - DNA, 393 bp, Artificial Sequence
  Description of Artificial Sequence: Synthetic coding sequence
atgagcggacgcggaaagcaaggaggcaaggccagggcgaaggcaaaaacaaggtcctctagagctggccttcagttccctgtcggacgtgtgcacaggctgctgcgtaagggtaattacgccgaaagggtgggggcaggggctcccgtataccttgctgccgtgcttgagtatttgaccgctgagattctggagctcgcgggtaacgcagctagggataataaaaagactcggattatccctagacacctccagctggcaatcaggaatgacgaagagcttaataagcttcttggtaaagtgaccatcgcacaggggggtgtgctgcccaatatacaggccgttctgctgccaaagaaaacagaatcacaccataaggccaagggcaaatag

SEQ ID NO: 226168 - DNA, 384 bp, Artificial Sequence
  Description of Artificial Sequence: Synthetic coding sequence
atgcctgaagtctcatccaaaggtgccaccattagcaaaaagggttttaaaaaagcagtggttaaaacacagaagaaagaaggcaaaaagcggaagcgcactcgcaaggagagttattctatttacatttataaagtgctaaagcaagtgcatccagacactggcatcagctccaaagctatgagcatcatgaatagcttcgtcaccgacatctttgagcgcattgcctctgaggcatctaggttagcacattactccaaaagatccacaatctcctcacgagagatccagactgcagtcaggttattgctgcccggtgagctagccaaacacgccgtttccgaaggcacgaaggccgtcaccaagtatactagtagcaagtag

SEQ ID NO: 226169 - DNA, 381 bp, Artificial Sequence
  Description of Artificial Sequence: Synthetic coding sequence
atgcccgaaccctctaaatccgcacctgcccctaaaaaagggtcaaaaaaagctatcaccaaggctcagaaaaaagatggaaaaaagaggaaacgatcacgcaaggaatcctactctatatatgtgtataaggtacttaagcaggttcaccctgacacgggtatcagctctaaagccatgggaattatgaattcgtttgtcaatgacatcttcgagaggatcgccggtgaggcctccagactggcccattacaataagcgatctaccatcaccagccgcgaaattcagacagctgttagacttctgttgccaggcgaactcgccaaacacgccgtttccgagggaaccaaggctgtgacaaagtatactagttctaaatag

SEQ ID NO: 226170 - DNA, 381 bp, Artificial Sequence
  Description of Artificial Sequence: Synthetic coding sequence
atgcctgagcctgcaaaatcagcccctgctccgaagaagggcagcaaaaaagcagtgacaaaggcgcagaaaaaggacggaaagaaacggaagcgatcccgaaaggaaagctactctgtgtatgtttacaaagtcctcaaacaggtgcacccagataccggcatcagcagcaaggccatgggtattatgaatagtttcgtgaacgacatctttgagcgcatcgctggggaggcgtctcggttggcccattataacaagaggtctacaatcacatcacgggagatccagaccgcagtgcgccttcttttgcctggcgagctggctaagcacgccgtctcagaaggaacaaaagcagtaaccaagtataccagctcgaaatag

SEQ ID NO: 226171 - DNA, 381 bp, Artificial Sequence
  Description of Artificial Sequence: Synthetic coding sequence
atgccagagcccgcaaagagcgcaccagccccaaaaaagggttcaaagaaagctgtgacaaaggctcaaaagaaagatgggaaaaagcgtaagaggtcacgaaaggagtcttacagcgtgtacgtttataaggtgcttaaacaggttcaccccgacacagggatcagttcaaaagcgatgggcatcatgaactcattcgtgaatgacattttcgaaagaatcgctggcgaagcgagtcggctcgcacattacaataagcgatcaacgatcactagtagggagatacaaactgccgtcaggctgctgctgcccggtgagcttgcaaaacatgctgtcagtgaggggaccaaagccgtcactaaatataccagctctaaatag

SEQ ID NO: 226172 - DNA, 381 bp, Artificial Sequence
  Description of Artificial Sequence: Synthetic coding sequence
atgcccgagccaacaaaatccgcccctgctcccaaaaagggtagcaagaaggctgtgactaaagcccagaaaaaggatgggaaaaagagaaaacggagccgcaaagaaagttattctgtgtatgtgtataaggtcctgaagcaagtgcatcctgacaccggaataagttccaaggccatgggaattatgaatagcttcgtgaacgatatattcgaaagaatcgccggagaagcctctcggctggcgcactacaacaaaaggagtacaataacaagcagggagatccagactgctgtgcgcctcctgctgccaggcgagctggccaagcatgccgtgtctgaaggcacgaaggcagttactaaatacacttctagcaaatag

SEQ ID NO: 226173 - DNA, 381 bp, Artificial Sequence
  Description of Artificial Sequence: Synthetic coding sequence
atgccagagcccactaagagtgcacccgcacccaagaagggttcaaaaaaagccgtgaccaaagcgcagaaaaaagacggtaaaaagaggaaacggtcgaggaaggagtcgtattcagtatacgtctacaaggtgctgaagcaggtccaccctgacacaggcatctccagcaaggccatgggaatcatgaacagtttcgttaacgacatctttgaacgtatcgctggcgaagcctcacggctggcccactacaataagcgttccaccatcacctcccgagaaatacagacagcagtgcgactgttactgccaggagagctagcaaagcacgccgtgtccgagggtaccaaagcagtcaccaagtatacaagtagtaagtag

SEQ ID NO: 226174 - DNA, 381 bp, Artificial Sequence
  Description of Artificial Sequence: Synthetic coding sequence
atgccagagccagcgaagtccgctccagctcctaaaaaaggatctaagaaggccgtcacgaaggcacaaaaaaaggatggaaagaagcggaaaaggagccggaaggagagctacagcgtctatgtttacaaggtcctgaagcaggtgcatcctgatacaggcatatctagtaaagcgatggggatcatgaactcattcgtaaatgacatatttgagcgtatagcaggtgaggcctcgcgattagcgcattataataagaggtcaaccatcactagtcgcgaaatccagactgccgttagactgttattacccggagagctggccaaacatgccgttagcgaaggaacgaaagcggtcacaaagtatacgtcatccaaatag

SEQ ID NO: 226175 - DNA, 381 bp, Artificial Sequence
  Description of Artificial Sequence: Synthetic coding sequence
atgcctgagccagccaagagcgcgccagcacctaagaagggttcaaagaaagctgtgacaaaagctcaaaagaaagatggcaaaaaaaggaaacgctcacggaaggagtcttacagcgtctatgtttataaagtcctcaaacaggtacatccagacaccggcatctcatccaaggccatgggtataatgaactctttcgtgaacgacatttttgagcgaatcgccggtgaagcctcccgtttggctcattataataaacgttccaccatcacctccagggagattcagaccgcagttcgtctgctgctccctggcgaactagctaaacacgcagttagtgagggcaccaaggcagtgaccaagtacactagctcaaagtag

SEQ ID NO: 226176 - DNA, 381 bp, Artificial Sequence
  Description of Artificial Sequence: Synthetic coding sequence
atgcccgaacccgcaaaaagtgccccagctcctaagaaaggctcaaaaaaggctgtgactaaagcccaaaaaaaagacgggaagaaaaggaagaggtcccgcaaggagtcctacagtgtttatgtatataaagtcctgaagcaggttcacccagacaccggcatctcttcaaaggccatggggatcatgaactcctttgtcaacgatatcttcgaacggatcgccggagaagcctctagactggcgcattacaacaaaagaagcactatcacatctcgtgaaatacagactgctgtgcgcctcctgctacctggtgagttagctaagcacgcagttagcgaaggtacgaaggcggtcacaaagtatacaagctcaaagtag

SEQ ID NO: 226177 - DNA, 381 bp, Artificial Sequence
  Description of Artificial Sequence: Synthetic coding sequence
atgcctgacccagccaaatctgcacccgcacctaagaagggcagtaaaaaggcagtgaccaaagcccagaaaaaggatggcaagaagcgcaaaaggagcaggaaagagagttactcagtatacgtctataaagtccttaagcaggttcaccccgacactggcatatccagcaaggcgatggggatcatgaacagctttgtgaatgacatttttgaaaggatcgcaggagaagcatcccgccttgcccactacaataaacggagcacaatcactagtagggagatccagaccgcagtgcgcctcttgcttcccggagaattagccaaacatgccgttagcgagggaactaaagccgtgaccaaatacacatcctcgaagtag

SEQ ID NO: 226178 - DNA, 381 bp, Artificial Sequence
  Description of Artificial Sequence: Synthetic coding sequence
atgcccgaacctgccaaaagcgcgcctgcgccaaaaaagggcagtaaaaaagcagtgacgaaggctcaaaagaaagacggaaaaaaacgcaaacggtctcgaaaagaatcatactctgtatatgtgtataaagtattgaagcaggtccatccagataccgggatttcttctaaagctatgggcattatgaactcctttgtgaatgacatcttcgagcgaattgcaggagaagcctcgcgtttggcccattataataagagaagcactattaccagcagggagatacagacagccgtgaggcttttgttgcctggcgaacttgccaagcacgcggtgtcggaaggaaccaaggccgtgaccaaatataccagtagcaaatag

SEQ ID NO: 226179 - DNA, 381 bp, Artificial Sequence
  Description of Artificial Sequence: Synthetic coding sequence
atgcccgagctggccaagagcgcacccgctcccaaaaaagggtctaaaaaagccgtgaccaaagctcagaagaaagacgggaaaaagaggaaacggagcagaaaggagtcatacagtgtctatgtgtacaaggtgctcaaacaggtccatcccgacaccggaatttcctcaaaggccatgggaatcatgaattccttcgtcaatgatattttcgagcgtattgccagtgaagccagccgactagcacattataacaagagaagcaccatcacttcccgggaaattcagacagcggtcaggttgttattgccaggtgagctggccaaacatgctgtgtctgagggaactaaggctgtgacaaagtatacatcatccaaatag

SEQ ID NO: 226180 - DNA, 381 bp, Artificial Sequence
  Description of Artificial Sequence: Synthetic coding sequence
atgcccgagcccgtgaagagtgcacccgtgcctaagaagggcagcaagaaggccattaacaaggcgcagaaaaaggatggcaaaaaaagaaagaggtctcgcaaagaaagctattccgtttacgtgtacaaggtcctgaaacaggtgcatcctgataccggaatctctagcaaggcgatgggcatcatgaactcctttgtcaatgacatattcgagcgaatcgccggagaagccagccgcctggcccactacaataagcgttctacaattacctctagggagattcagaccgccgtgagattgctactacccggagagctggccaaacatgcagtatccgagggcactaaggccgttaccaagtatacatcctctaagtag

SEQ ID NO: 226181 - DNA, 381 bp, Artificial Sequence
  Description of Artificial Sequence: Synthetic coding sequence
atgccggagccctcaaaaagcgcccctgcaccaaaaaagggcagtaagaaggccgtgaccaaggctcagaaaaaagatggtaagaagaggaaacgctctcgaaaagagagctattctgtgtatgtatataaagtacttaagcaggttcacccggatacaggaatatcttccaaggctatgggtataatgaacagcttcgtgaacgatatctttgagaggatagccggagaggccagtaggttagctcactacaataagcgcagcaccattaccagccgcgagatacagaccgcagtccggctcctcttaccaggcgaactggccaaacacgcagtctcggagggcacaaaagctgtgactaagtacacctcatcaaagtag

SEQ ID NO: 226182 - DNA, 381 bp, Artificial Sequence
  Description of Artificial Sequence: Synthetic coding sequence
atgccggagcctagtaaatccgcccctgctccaaaaaagggcagcaagaaagccgttacgaaggctcaaaaaaaagatgggaagaaacgtaaaagaagtcgcaaggagagctatagtgtgtatgtttataaagtactcaagcaggtgcatcccgacactggtattagctccaaagccatgggtataatgaatagtttcgtcaacgacatttttgagcggatagccggagaagcaagccgactagcccactataacaaacgaagtactatcacctctcgggagatacagaccgctgtgagattactgctgcccggtgaactggccaaacacgctgtgtccgagggaaccaaggccgtgacgaaatatactagcagcaagtag

SEQ ID NO: 226183 - DNA, 381 bp, Artificial Sequence
  Description of Artificial Sequence: Synthetic coding sequence
atgcccgacccagcgaagtcagctcccgcacccaagaagggctcaaagaaggctgtgacaaaggcccagaaaaaagatggcaaaaaaaggaagcgatccaggaaagaaagctattctatctacgtttacaaggtcctcaaacaggtccaccctgacacgggcatctcctctaaggcaatgggtatcatgaactccttcgttaatgatatcttcgagcggatagctggtgaggcctcacgccttgctcattacaataaacggagcacaatcacctccagagaaattcaaacagctgtccgcctcctgctccctggtgaactggccaaacatgcagtttcagagggcacgaaggctgtgaccaaatataccagtagcaaatag

SEQ ID NO: 226184 - DNA, 411 bp, Artificial Sequence
  Description of Artificial Sequence: Synthetic coding sequence
atggccaggactaaacaaacagctcgaaagtccaccggcggaaaagccccacggaagcagctggctactaaagcagcgagaaagtctgctcctgcgaccggtggcgtgaagaaaccccacaggtacagaccaggtaccgtggcattgcgtgaaatcaggcgttaccagaagtccacagagctcctgatacgtaaactgcccttccaaagattggtccgggagattgcccaggacttcaagaccgacttacgcttccagagcagcgcagtgatggctctccaggaggcttgcgaagcttacctggtgggactttttgaggacaccaacctgtgcgccatccacgcaaagcgcgtcaccatcatgcctaaagatatccagctggcaaggcggattagaggagaacgtgcatag

SEQ ID NO: 226185 - DNA, 411 bp, Artificial Sequence
  Description of Artificial Sequence: Synthetic coding sequence
atggcaaggaccaaacaaaccgcacggaagagtaccggaggcaaggcccctcgaaagcaattagctaccaaggcagctagaaaaagcgcccctgctaccggcggtgtgaaaaagcctcatcggtatcggcctgggaccgtggctctgcgcgagatcagaaggtaccagaagtcaaccgagttgctcatcagaaaattgcccttccaacgccttgtgagagagatcgctcaagattttaagaccgatctaagattccagtcttccgcagtgatggcattacaggaggcttgcgaagcctacctggtcggattgttcgaggacaccaatctgtgcgccattcatgccaagcgtgttaccattatgccaaaagatatccagctggcccgaaggatcagaggggaacgggcttag

SEQ ID NO: 226186 - DNA, 411 bp, Artificial Sequence
  Description of Artificial Sequence: Synthetic coding sequence
atggctcgcactaaacagaccgcgaggaagagtaccggaggaaaggcaccacgaaagcagttagcaaccaaagctgcaagaaagtccgcacccgcaactggtggagttaaaaagcctcataggtacaggccaggcaccgtcgccttgcgagagatcaggcgctaccagaaaagcaccgaacttttaatccggaagctgcctttccagcgcctcgtgcgagagattgcacaggatttcaaaacagacctacggtttcaaagttcagccgtcatggcccttcaggaagcctgcgaggcatacctggtcggattgtttgaagacacaaatctttgtgccatccatgctaagcgagtcacaattatgcctaaagatattcagctggctcgacggattcgcggagagcgggcatag

SEQ ID NO: 226187 - DNA, 411 bp, Artificial Sequence
  Description of Artificial Sequence: Synthetic coding sequence
atggcacgcacgaagcagacagccaggaagagcactggcggtaaggctcccaggaagcagttggctacaaaggccgcacgtaagtccgctcccgctactggtggggtcaaaaagccccatagataccgaccaggcactgtcgccttacgcgagatccggcgatatcaaaaatccacagaactgctaatcaggaaactaccttttcagagacttgtccgggagatcgcccaggacttcaagacggatcttcgatttcagagcagtgccgtgatggctctgcaagaagcttgcgaggcgtacttggtcggcctgtttgaggacactaacctgtgcgcaatacacgccaaaagggtgactattatgccaaaggacatccagctcgctaggaggatacgtggagagagggcatag

SEQ ID NO: 226188 - DNA, 411 bp, Artificial Sequence
  Description of Artificial Sequence: Synthetic coding sequence
atggccagaaccaagcagacagctcgcaaatcaacagggggaaaggcccctagaaagcagctggcaacaaaggctgccagaaagagcgctccggctacagggggtgtcaaaaaaccacacagatataggcctggtactgtggccttgagagaaatccgcagataccaaaagtcaactgaactgttgattcgaaaacttcctttccaacgccttgtgcgagaaatcgctcaagacttcaagacggatctgcgattccaatcctcagctgtgatggctctgcaggaagcctgtgaagcatatctggtcggccttttcgaagatacaaatctgtgcgccatccacgccaagcgggtgaccattatgcctaaagatatacaactcgccaggcgcattcgaggggagagagcatag

SEQ ID NO: 226189 - DNA, 411 bp, Artificial Sequence
  Description of Artificial Sequence: Synthetic coding sequence
atggccagaaccaaacaaactgcgagaaaatcaaccggcggtaaggctcctcggaaacagctcgctacaaaggctgccaggaaaagtgcccctgctacagggggagtgaaaaagccacaccggtaccggccaggcacagtggccctgagggagatacggagatatcagaagtccacagagctgttgattcgcaagctgcccttccaacgcctcgtgcgcgaaattgcccaagatttcaaaactgacctcagattccagtcgtccgctgttatggctcttcaagaggcttgcgaggcatacctggttggattgtttgaagacactaatctgtgtgccatccatgccaagcgagtgaccatcatgcctaaagacatccagctcgcacgcagaatacgcggagaaagagcttag

SEQ ID NO: 226190 - DNA, 411 bp, Artificial Sequence
  Description of Artificial Sequence: Synthetic coding sequence
atggctcgaaccaagcaaactgcacgtaaatctactgggggaaaggccccacggaagcagctcgccacaaaggccgctcgcaaaagtgccccagcgactggcggtgtcaaaaagccccacaggtaccgaccgggtacagtggcccttcgcgaaatcaggagatatcagaagagcaccgagctactgattcggaaactcccttttcagcggctcgtgcgggaaattgcacaagactttaagactgaccttcgcttccagagctccgcagtaatggcccttcaggaagcttgtgaggcttacctagtcggacttttcgaggacactaatctgtgtgcaatccatgccaagagggtgacgattatgcccaaagatatccagcttgctaggcgaataagaggtgagcgtgcctag

SEQ ID NO: 226191 - DNA, 411 bp, Artificial Sequence
  Description of Artificial Sequence: Synthetic coding sequence
atggcgagaaccaagcagaccgctcgcaagtcaaccggcggtaaagctccgagaaaacagcttgctaccaaagccgcacggaaaagtgcgccagcaactggcggtgtcaagaaaccccatagataccggccaggcaccgtggccctgagggagatcagaagataccagaaaagcactgaactgttaatccgtaagcttccattccagcgcctggtgagagagattgcacaggattttaagacagatttacgctttcagtcttcagctgtgatggctctccaggaggcctgtgaagcctacctcgtggggctgttcgaggacacaaacctgtgcgccatccacgcgaaacgcgtgacaatcatgccgaaagatatccagctggccaggcgtatccgcggagagagagcctag

SEQ ID NO: 226192 - DNA, 411 bp, Artificial Sequence
  Description of Artificial Sequence: Synthetic coding sequence
atggcacgtactaagcaaacagctagaaagagtacaggcggtaaggcccctcggaagcagctggccactaaggccgcacgaaagtcagccccagcgacgggtggcgtgaaaaagccccaccgataccgtcctggaactgtcgcccttagggagatcagacgctaccagaagagcaccgagttgctcattagaaagctccccttccaaaggctggttagggaaatcgctcaggacttcaagacagacctgcgatttcaaagctcagctgtcatggctctccaagaagcttgtgaagcgtacctggtagggctttttgaggacacaaatctttgcgcaattcacgccaagagagtaacaatcatgccgaaggacattcaactggcacgcaggattagaggggagcgggcttag

SEQ ID NO: 226193 - DNA, 411 bp, Artificial Sequence
  Description of Artificial Sequence: Synthetic coding sequence
atggccaggactaaacagacagcgagaaagagcacagggggaaaggcacccaggaagcagttggctaccaaggcggctaggaagtctgcccctgctacaggaggcgtcaagaagccacatcggtaccggccaggtaccgtggcccttcgggagatccgcaggtaccagaagagcacagagcttttgattcgaaaactgccttttcagcgcttagtgagggagattgctcaggatttcaagacagatctccggttccaatcttctgccgttatggccctacaggaagcatgcgaggcctaccttgtagggctgttcgaggacaccaacctatgtgcaattcacgctaaaagagtcaccattatgcctaaggatattcagttggccagaaggataaggggggaaagggcctag

SEQ ID NO: 226194 - DNA, 411 bp, Artificial Sequence
  Description of Artificial Sequence: Synthetic coding sequence
atggcccgtaccaagcagaccgcacgcaaatccacaggcggtaaagctcccagaaagcagctagcaactaaagctgcgcgaaaaagtgctccggcaaccggcggagttaaaaaaccgcatcggtacagacccggtacggtcgcgctgagggagatcagacggtaccaaaaatccacggagttgctgatccgtaagctgcctttccagagactggtgagggaaatcgcgcaggacttcaagaccgacctgcgctttcagtccagcgctgtgatggcccttcaggaggcatgcgaggcatacttagtgggacttttcgaggacaccaacctttgcgctatccatgccaagcgggttaccataatgcctaaagacatacagttggccagacggatcagaggagagagggcctag

SEQ ID NO: 226195 - DNA, 339 bp, Artificial Sequence
  Description of Artificial Sequence: Synthetic coding sequence
atgtccggcagaggaaaaggcggaaagggtctggccaaagccaaaacatgtagctctctacccggtctccaatttcccggtagagtccgccacctgttccggaaaggcaattattttgagcccgtaggagctggtgcacccgtgtacttacagtatcttgcagccgaaattttggagttggttggtagcgcaatccgcgacaagacacgctccatcataccgagacacttacagcttgccatccgaaatgatgaggaggtcaacaaacagctcggcaacgtcactatcgcccagggtggggtccttagtaacattcaggctgttcttctgccaaagtag

SEQ ID NO: 226196 - DNA, 312 bp, Artificial Sequence
  Description of Artificial Sequence: Synthetic coding sequence
atgagcggaagaggcaaggggggaaagggtctgggtaaggggggtgcgaagagacatcggaaggtgctgcgagataatatccaaggcatcacaaaaccagccatccggcgtctggcacgccgagggggagtgaagcggatttccggactgatttacgaggagactcgcggtgtgctgaaggtttttttggagaacgtgatcagagatgccgttacatacacagagcatgcaaaacgcaaaactgtgactgctatggacgtcgtttacgccctcaaacggcagggcaggacactgtacggatttggtgggtag

SEQ ID NO: 226197 - DNA, 312 bp, Artificial Sequence
  Description of Artificial Sequence: Synthetic coding sequence
atgtcgggacggggaaaggggggtaaagggttgggcaagggtggcgctaagcgccacaggaaagttctgcgggacaatattcagggcatcaccaagcccgcaatcagaagactggctcggagagggggagttaagcggatctccggcctgatctacgaggaaacacggggagtcctgaaagttttcctggaaaatgtgatcagagatgccgtgacttatacagagcatgctaagaggaagaccgtgactgccatggatgttgtgtacgctctgaaacgacagggcaggacactgtatggcttcggcggatag

SEQ ID NO: 226198 - DNA, 312 bp, Artificial Sequence
  Description of Artificial Sequence: Synthetic coding sequence
atgtcgggacgtggcaaggggggaaagggcctcggcaagggaggcgcaaaacgccatcgaaaagtgctgcgggacaatatccaaggcatcaccaaaccagcgatccggcgactggctaggcgtggaggcgttaagcggatctctggtcttatctacgaagaaaccaggggagtgctgaaggtgtttcttgaaaatgtgattagagacgctgtgacatacactgaacatgcaaagagaaaaacagtcacagctatggacgtggtgtacgcccttaaacggcagggtaggactctctacggattcggcggttag

SEQ ID NO: 226199 - DNA, 312 bp, Artificial Sequence
  Description of Artificial Sequence: Synthetic coding sequence
atgtcgggcaggggaaagggaggcaaaggcctggggaaaggcggagcaaagcggcacagaaaagttctcagagacaatatccagggcattacaaagcccgcaattcgccgacttgctcgaagagggggagtcaaaaggatcagcggcctgatatatgaagaaactcggggagtcttgaaggtctttctggaaaatgtgattagggatgccgtcacctacaccgagcacgcgaagaggaaaactgttactgctatggatgtggtttacgctctaaagcgccagggcaggactttgtatggattcggtggatag

SEQ ID NO: 226200 - DNA, 312 bp, Artificial Sequence
  Description of Artificial Sequence: Synthetic coding sequence
atgagcggcagggggaaaggtggcaagggcctgggaaagggaggagcaaagaggcaccgcaaggtcctccgggataacatacagggaatcacgaaaccggcaatcagacgactggcccgaagggggggtgtgaaacgcatcagtggactcatctatgaagagacccgcggagtgcttaaagtcttcttggaaaatgtcatccgtgatgccgtcacttacacggagcatgccaagagaaaaactgttacagccatggacgtggtttacgcattgaagaggcagggtaggaccctgtatggatttggtggctag

SEQ ID NO: 226201 - DNA, 312 bp, Artificial Sequence
  Description of Artificial Sequence: Synthetic coding sequence
atgtcgggcaggggcaagggaggtaaggggctgggcaagggtggtgctaagcggcaccgaaaagtgctccgcgataatattcagggcatcacgaagcccgctatcaggcggctggcaagacgagggggtgtgaagcggatctctggtctgatttatgaggagacaaggggcgtcttgaaagtctttctagaaaacgttataagggacgccgtcacctacacagagcatgctaaacgcaaaactgtcaccgctatggatgtagtgtatgctctaaagcgacaggggagaaccctttacggatttggtgggtag

SEQ ID NO: 226202 - DNA, 297 bp, Artificial Sequence
  Description of Artificial Sequence: Synthetic coding sequence
atgtctgtgcgcggaaaagcgggtaaaggcctaggcaaaggaggcgcaaagtgtcaccggaaagtgctctccgacaatattcaggggatcacaaagtgcaccattcgacgtctcgcacggcacggtggggtgaagagaattcttggtctgatatatgaggaaactagacgcgtgttcaaggtgttcctcgaaaacgtgatatggtacgctgtcacaaacacagagcatgccaagagaaagactgtgacagctatggcggtggtttacgtcctgaagcgccaggggaggacgctctag

SEQ ID NO: 226203 - DNA, 312 bp, Artificial Sequence
  Description of Artificial Sequence: Synthetic coding sequence
atgtctggacgaggtaaaggcggaaaaggcctggggaaaggaggtgctaagagacatagaaaagtgttacgagacaacatccaggggatcaccaaacctgccatcaggcgcctggcaaggagaggcggtgttaagagaatttctggcctgatctacgaggagacacgtggtgtattgaaagtttttctagagaacgtcatccgcgacgctgtgacgtacacagagcacgctaagaggaagaccgtgaccgctatggacgtggtgtacgctctgaagcgtcagggcaggacactgtacggattcgggggatag

SEQ ID NO: 226204 - DNA, 312 bp, Artificial Sequence
  Description of Artificial Sequence: Synthetic coding sequence
atgtccggccgaggaaagggaggaaaagggctcggaaagggcggtgctaaaaggcatcggaaagtgctgcgggataacattcagggtatcacaaagccagccatccgaaggctggcgaggcgcggaggagttaagcggattagtggccttatttacgaggaaactaggggggttctcaaggtcttcctagaaaacgtgatccgagatgcggttacttacacggaacacgcaaagaggaagaccgtgacagcaatggatgtggtgtatgccctcaagaggcaggggcgaacactgtacggcttcggcggatag

SEQ ID NO: 226205 - DNA, 312 bp, Artificial Sequence
  Description of Artificial Sequence: Synthetic coding sequence
atgagcggtcgtggcaaaggtggaaaaggactgggcaagggcggagctaaaagacaccggaaggttctgagagacaatatccagggcatcacgaaaccagcaattaggcggctcgcgaggaggggtggagtgaaaagaatttccggcctcatctatgaggagacccggggtgtactgaaagtgtttctggaaaacgtgattcgggacgccgttacctataccgagcatgcgaagcgaaaaaccgtgaccgctatggatgtcgtctacgcactgaagagacaggggagaacactgtacggtttcggtggctag

SEQ ID NO: 226206 - DNA, 312 bp, Artificial Sequence
  Description of Artificial Sequence: Synthetic coding sequence
atgtccggcagagggaaagggggaaagggacttggaaagggtggtgcaaaaagacaccgaaaagtgctgcgggacaacatccaaggtataaccaagcccgctattaggcgactggctagacgaggtggcgtcaagaggatctcaggcctcatttacgaagagacacgaggcgtgctgaaggtgttcctggaaaacgtgataagagatgccgttacctatacagagcatgccaagaggaaaactgtgactgccatggacgtcgtgtacgctctgaaacggcaaggtcggaccttgtacggattcggaggatag

SEQ ID NO: 226207 - DNA, 312 bp, Artificial Sequence
  Description of Artificial Sequence: Synthetic coding sequence
atgtccggacggggtaaaggtgggaaaggactgggcaaaggcggagccaagcggcataggaaagtgttgcgtgataatattcaagggattacaaagcccgcaattcgccgactggccagacgcggaggtgtcaagagaatttccgggctcatttatgaagagacacgtggcgtgctgaaggtgttcctggagaacgttataagggatgctgtgacgtatactgagcatgcaaagcgaaaaactgtcaccgcaatggacgtggtatatgctctgaaaaggcagggtaggacactgtacgggtttggcggatag

SEQ ID NO: 226208 - DNA, 312 bp, Artificial Sequence
  Description of Artificial Sequence: Synthetic coding sequence
atgtcaggtcgcggtaagggtggcaaaggcctaggtaagggtggggctaaacggcacaggaaggtactcagggacaacattcagggcattaccaaacccgctatccgacggctggcgcgacgcggaggtgtgaagcggatctctggtctgatttacgaagagactaggggcgtgctgaaggtgttcttggagaatgtgattcgagacgcggtgacctatacagaacacgccaaacgtaagactgtgacagctatggatgttgtctatgccctgaagcgacaaggacgcacattgtatggattcggtggttag

SEQ ID NO: 226209 - DNA, 390 bp, Artificial Sequence
  Description of Artificial Sequence: Synthetic coding sequence
atgagtggcaggggaaaacagggcggtaaggcgagggcaaaggcgaaaagccgctcttccagagccggactgcaatttcccgtagggcgtgtccaccggctccttcggaagggtaattatgcggaacgcgtgggagccggagctcccgtgtatatggctgcagtgctggaatatctcaccgctgagatcctggagctggcaggaaacgcggctcgggataataaaaaaacccggattatcccacgccacctccagctggcaatcaggaatgatgaggaactcaataaacttctcggtaaggtgaccattgcacagggaggcgtgctcccgaacattcaagccgtgctactgccaaagaagacagagtcacacaaggccaagtcaaagtag

SEQ ID NO: 226210 - DNA, 381 bp, Artificial Sequence
  Description of Artificial Sequence: Synthetic coding sequence
atgcctgagccagccaagtcagcgcctgcacctaagaagggatcaaaaaaggctgtgactaaggcacagaaaaaagacggtaagaagagaaaacggagccgcaaggagtcttactctatttacgtgtataaagtattgaagcaagttcacccagataccggtattagcagtaaggcgatgggcatcatgaattcattcgtaaatgatatttttgagagaatcgcaggcgaagcctcacggctggctcactacaataagcggtccactatcacttcgagagagatccaaacagccgtgagactgctgcttcccggagagcttgccaaacatgcagtgtccgaggggaccaaagccgttacaaaatatacaagctcaaaatag

SEQ ID NO: 226211 - DNA, 411 bp, Artificial Sequence
  Description of Artificial Sequence: Synthetic coding sequence
atggcccgtacgaagcaaaccgctcgaaagagcactggcggaaaggcaccacggaagcagctggcaaccaaagctgctcgcaagagcgcaccggctacagggggagtaaaaaagccacaccgctatcgacccggaacagtggcattgagagaaatccgcagataccagaagagcactgagctgttaataaggaagctcccgttccagcgactcgtcagggagatcgcacaagacttcaaaaccgaccttagatttcaatcctctgccgtgatggctcttcaggaggcttcagaggcatacttggttggactgttcgaagacactaatctctgtgccatacatgctaagcgcgttacgatcatgcccaaggacattcagctggctaggcgcattagaggcgagagagcttag

SEQ ID NO: 226212 - DNA, 411 bp, Artificial Sequence
  Description of Artificial Sequence: Synthetic coding sequence
atggccagaactaagcaaaccgcccgaaaatcgaccggcggtaaggcccctcggaaacaactggctaccaaagttgccagaaagagtgcccctgccaccgggggagttaaaaaaccacacagatatagacctggaacagttgctctgcgcgaaatcaggagatatcagaaatctacagaactgttgatccggaagctgccattccagaggctgatgagagagattgcgcaggactttaagaccgatctgagattccaatcctctgctgttatggcactgcaagaagcgtgcgaatcttatctggttggactttttgaggatactaacttgtgtgtgatccacgctaagagggtgaccatcatgcctaaggatatacagctggctagaaggattcgaggagaacgggcttag

SEQ ID NO: 226213 - DNA, 684 bp, Artificial Sequence
  Description of Artificial Sequence: Synthetic coding sequence
atggagggtcagtcaggccgatgtaaaattgtcgtggtaggggacgccgagtgcggaaagacagctctacttcaggtgttcgccaaggacgcataccccggttcatatgtcccaaccgtcttcgaaaactatacagctagtttcgagattgacaagcgcaggatcgaattgaatatgtgggacacctctgggagctcttattacgacaacgtgagaccattggcctatccggatagtgatgcagttctaatttgttttgatattagccggcctgaaacactagactccgttctgaagaagtggcaaggtgaaactcaggaattttgtccaaacgctaaagttgtgctggtgggctgtaagctagatatgaggacagacctggctactctgagagaactcagtaagcagcggctcatccccgtaacacatgagcagggaacagtgcttgctaagcaggtgggggctgtgagctatgtggagtgctctagccggtctagcgaaaggagcgtacgggatgtcttccatgttgcaaccgtagccagtcttggaaggggtcataggcagctacgtaggacagactcaagaaggggcatgcagaggtccgcccagcttagtggacgcccagatagaggcaacgaaggggagattcataaagacagagccaaatcatgtaacctcatgtag

SEQ ID NO: 226214 - DNA, 3114 bp, Artificial Sequence
  Description of Artificial Sequence: Synthetic coding sequence
atgaacagccccaacgaatccgacggaatgtccggcagagaaccaagtctcgaaatactgccacggacatccctgcatagtatccctgtgacggttgaggtgaagcctgtgctcccgcgagctatgccttcttccatgggtgggggtgggggtggaagtccctcacccgtggagttgagaggagccctggtcgggagcgtggacccaaccttgagggaacaacaattgcagcaggaattgctcgcgctgaaacaacagcagcaattacagaagcagctgctgtttgccgaatttcagaagcagcacgaccatctgacacgccagcacgaagtgcagctacagaagcacctcaagcagcaacaagagatgttagcagctaagcaacagcaagagatgctggcagccaagcgccaacaggagctggaacaacagaggcagagggaacagcagcgtcaagaagagttggaaaaacaacggctcgagcagcaattgctgatcctgaggaacaaagaaaagagtaaggaatccgccatcgctagcactgaagtaaagctgcgactccaggagtttctcctttccaaatccaaagaacctaccccaggcggactgaaccattcgctcccacagcaccccaaatgttggggcgctcatcacgcctcactggatcaaagctctccacctcaaagcgggccaccaggaacgcccccaagttataagctgcctctacccggaccttacgatagccgcgacgacttccctctgaggaaaaccgcatccgagccaaatttaaaagtgcggagtaggctcaagcagaaagtggctgaacgtcgatccagccccctcttgaggaggaaggacgggacagtcatctccaccttcaagaaacgagctgtggagatcactggggcaggaccaggagcttcatcagtgtgcaactcagcccctgggtccggtccctcttctccgaactcctcccactcgaccatcgctgaaaatgggttcacaggatctgtgcctaatattccaaccgaaatgctaccacagcaccgcgctctgcctctggactcttcgcccaatcagttttctctgtacacgagtccctcactgcccaacatcagcctagggctccaggccaccgtgaccgttactaatagtcacctcacagcaagccctaaactgtcgacacagcaagaggcggaaagacaagcgctccagtcacttcgccaagggggtaccctcactggcaagttcatgagcacatcctccatacctgggtgcctgctgggagtggccctagaaggcgacggatcacctcacggccacgcttctctgctgcaacatgtccttctactggagcaagcaagacagcagtctactctgattgccgtccccctgcacggacagtccccgctggtgacgggggagagggtggctacctcaatgaggaccgtgggaaaacttccccgacatcggccactcagcagaactcagagctcccctcttccgcagagccctcaggccctccaacaactggtcatgcagcaacagcaccagcagttcctagaaaaacagaaacagcagcaactacagctgggtaaaatcctcaccaaaactggcgagttgcccagacagcccaccactcaccccgaggagactgaagaagagctgaccgagcaacaggaggtacttttgggagaaggcgcactcacaatgccgcgagagggcagcacagaatccgagtcaacccaggaggatctggaggaagaagacgaggaggacgacggggaagaggaagaggactgtattcaagtgaaggatgaagagggcgaatcaggcgcagaggagggaccagacctggaggagcctggtgcgggttataagaaactgtttagtgacgcacagcctctccagccccttcaggtatatcaggcaccactgtccctggctactgtgcctcaccaggcactcggtcggacacagtcttcccccgcagcgcctggtggcatgaagtcaccaccagatcagcccgtaaaacatctgtttactacgggacccatatctcagaagatgtacgcagtcctcccgtgcgggggtatcggggtggacagtgacactgtgtggaatgagatgcacagctctagtgctgttagaatggcagtgggatgtctgcttgagctggccttcaaggtggcagctggggagctgaagaacggcttcgccattattcggccaccaggccatcacgccgaggaaagcaccgctatgggtttttgcttctttaactctgtcgccatcaccgcgaagctcctccaacagaaactcaatgttggaaaagtcctaattgtggattgggacatccaccatgggaatggcactcagcaggctttttacaacgatccgtccgttctgtatatctccttgcatcgctacgataacggtaacttcttccctggtagtggagcccctgaagaggttggcggaggacctggagtgggttataatgtcaacgttgcctggactggcggtgttgaccctccaatcggcgatgttgagtacctaacggccttcaggacagtggttatgccaatcgcacacgagtttagtcccgatgtcgttctggtctctgcgggttttgatgccgtcgaaggccacctgagccccctcggcggatactccgttaccgcgagatgcttcgggcatttgacacggcagttgatgaccttggcaggcggacgggtggtccttgcccttgagggaggtcatgatctaaccgctatctgcgatgcctcagaagcgtgcgtctcagcactcctgagtgtggaactacagcctttggacgaggcggttctgcagcagaagcccaacatcaatgctgtggccacattggagaaagtgatcgagatccagagcaaacattggagctgcgttcagaaattcgctgctggcttgggtagaagtctaagagaagcccaagcgggtgagaccgaggaggcagaaaccgtgagcgcaatggctcttttgtctgtgggagccgagcaggctcaagcagcagcggcacgagagcactctccgagacccgctgaggagcccatggaacaagagccggctctgtag

SEQ ID NO: 226215 - DNA, 3369 bp, Artificial Sequence
  Description of Artificial Sequence: Synthetic coding sequence
atgaatagccccaacgagtccgacggaatgtcaggcagagaaccaagcctcgagatcttgcctaggacgagtctccacagcatacctgtcaccgtggaagtcaaacctgtcctgccccgtgccatgccatcttccatggggggtgggggagggggttcaccatctccagtagagctgagaggggctctagttgggtccgtagacccgaccctgagggagcaacagttgcagcaagaactgctggcgttaaagcagcaacagcagctacaaaagcaactgttgttcgccgaattccagaaacaacacgatcacctgacgcgacaacacgaagtgcagttgcagaaacacctgaaacagcaacaggagatgctggctgccaagcagcaacaagaaatgttggcggctaagcgccagcaggagcttgagcagcagcggcagagagagcagcagcgccaagaagagctcgagaagcagcggttggagcagcagttattgattctccgaaacaaggaaaagtccaaagaaagtgcaattgccagtactgaagtcaagcttaggttacaggaatttctcttatccaaatccaaagagcctactcctggtgggctgaatcatagcttgccccaacacccaaaatgttggggcgctcatcacgcctctctggatcagagctccccaccccaatctggcccacctggcactccaccatcctacaaacttcccttgccagggccttacgacagtcgggatgacttccctctgcgaaagacagctagtgaacctaatttgaaggtgagatcgagactgaagcagaaagtggccgagcgcaggagttctcccctcctacgaaggaaagacggcacagtgatctcgaccttcaaaaagagagcagtcgagattacaggagccggacctggggcaagttccgtgtgcaactcggcccctggtagtgggccatcaagtccaaatagctcacattccaccatagcggagaacggattcacaggctccgtgcctaatattccaactgagatgcttccacagcacagggcacttcctctcgattcgtccccaaatcagttttccctgtacacttcaccttcccttcctaatattagcctggggttacaggccactgtaacagtaaccaatagccacctgactgcctcccctaagctttccactcagcaggaagcagagcgccaggccctgcaaagtctccgccagggcggaaccctgaccgggaagttcatgagcacgagcagcatacctggatgtttgctcggcgtggcgttggagggtgatggatcaccacacggccatgcctctctcctgcagcacgttctgctactcgaacaggcaagacagcagagcaccctgattgccgtgcctctgcacggacaaagcccgttggtaacaggggagagggtcgccacctcaatgagaacagtcggtaaactccctcgtcaccgccctctgtctaggacccagtcctcaccccttccgcagtcaccacaggcgctgcaacaactggttatgcagcaacaacatcagcagttcctcgaaaagcaaaaacaacagcagctacaactcggcaaaatactgacaaagacgggggaactgccaaggcagcccactacacaccccgaggagactgaagaagagctgacagagcagcaggaggtgctcctgggcgagggtgctcttacgatgccccgtgagggctctaccgagagcgaatccactcaggaagacctcgaggaggaagatgaagaagatgatggggaagaggaagaagactgcattcaagttaaggacgaggaaggagagtctggcgcagaggagggaccagatctcgaagagccaggagctgggtataaaaagctgtttagtgatgcacagcccctgcagccacttcaagtttaccaggcgcctctgtcactcgccacagttcctcatcaggccctgggacgaacccagagctcacccgcagcacctgggggaatgaaaagtcctcccgaccagcctgttaaacatctgtttactacaggcgtggtgtacgacacatttatgttgaagcaccagtgcatgtgcggcaatactcatgtccaccctgagcatgctggccgtattcagtccatttggtctaggctccaggagacaggacttctgtccaaatgcgaaaggatacggggaagaaaagcgacgctggatgagatccaaacagtgcattccgagtatcacaccctgctgtacggcacttcccctctgaaccgtcaaaaactggatagtaagaagctcctcggtccaatctcccagaagatgtatgccgtactgccttgtggaggtatcggggtggattcagacaccgtttggaacgaaatgcatagtagttccgcagttagaatggctgtcggttgccttttggaactggctttcaaagtcgccgcaggagaacttaagaatggattcgccattatccgcccaccagggcaccacgccgaggaatcaaccgcgatgggtttttgcttctttaattcagtggccatcaccgccaagttacttcagcaaaaactcaatgtcggaaaggtcctgatagttgactgggacatacaccatggaaatggcactcagcaggccttttacaacgatccttccgtgctgtatatctcactccatagatacgataatggtaatttttttcccggttcgggagcgcctgaagaagtcggtggtggacctggggttgggtataacgtgaacgtggcctggactggaggagtggacccccctattggggacgttgaatacctaaccgcgttccgaacagtcgtaatgccaatagcgcatgagttcagtccagatgtggttcttgtgtcagctggcttcgatgccgtggagggacacctgtcgcctttgggaggttattctgtaaccgccagatgcttcggacacctcactaggcagttaatgacgttggctggtggacgcgtggttttagcacttgaaggtggacacgacttgaccgccatctgtgacgcttcggaagcgtgcgtctcggccctactgagtgtggagctccaacccttggacgaggccgtgctgcagcaaaaacccaacatcaatgccgtggcgacacttgagaaagtgatagagatccagagcaagcattggagctgcgttcagaagtttgcagccggtcttggacgctctctccgcgaggcccaggctggcgaaacagaagaagccgaaaccgtgagtgctatggccctcctatccgtcggtgctgaacaggcccaagcggcagcagctagggagcacagtccgagaccagccgaggaaccgatggaacaggaacctgcactgtag

SEQ ID NO: 226216 - DNA, 1776 bp, Artificial Sequence
  Description of Artificial Sequence: Synthetic coding sequence
atgatgtcctcacctgcccagagtaggagccctgacctgatgtggaacctggttccctgggtgctgttctgcggttgctgcagaatcttccctgatggggtggccggacgcgagcaacttcttgcacagcagaggatgcacagcatgatctcaagtgttgatgttaagtcggaagtccccgtgggtctcgagcccatcagccccctggacctgcggactgatcttagaatgatgatgcccgttgtcgaccccgtagttagagaaaagcagctccagcaggaactcctgctcatccagcaacagcagcagatccagaagcaattactgatcgccgagtttcaaaagcagcacgagaatttgactcgccaacaccaggctcagcttcaggagcatatcaaagagttgctagcgatcaagcagcagcaggaactccttgagaaagaacagaagctggaacagcagcgccaggaacaagaggtagagaggcataggagggagcagcagctgccaccacttcgtggcaaggatcgtggacgtgagcgagcggttgcttccacagaggtgaagcaaaaacttcaggagtttcttttgtccaaatctgccaccaaagatacccccacaaacggcaaaaaccactctgttagtagacatccgaaactctggtatacagccgcacaccacacaagtttggaccagagctccccacctttaagcggtaccagccccagttacaagtatacgctacctggggcacaggatgccaaagatgatttccccttgcggaaaacggagtccagtgtatcctcgtcctctcccggatctgggccttccagtccgaacaatggtcccacaggctcagtgaccgaaaatgagacatccgtcctccctcccaccccccacgctgaacagatggtctcccaacaacgaatcctcattcacgaggacagcatgaacctcctaagcctgtatactagcccctcccttcctaatatcacccttgggctgccagcagtcccttctcaactaaatgcaagcaacagtctcaaggagaaacagaagtgtgaaacacagaccctgcggcaaggggtgcccttaccgggacaatacggcggatccatccccgcttcttccagccacccacatgtcaccctggagggcaagccgcctaactcttcccatcaagctctcttacaacacctcctcttgaaggagcaaatgcgccagcagaagctgttagtggcaggcggagtgcctctacaccctcagtctcccctagcgacaaaagaacggatcagccccggaatccggggtacccataagcttcccaggcaccggcctctgaaccgaacccagtcagcccctctcccccagtcgactctcgcccagctcgtgatccagcaacagcatcagcagtttttagaaaaacagaagcagtatcagcagcaaatccacatgaacaaattgctgtctaagagtattgagcagttgaaacaacccggtagtcacctcgaggaggccgaggaagagctgcagggagaccaggccatgcaggaagatcgagcacccagcagcgggaactcaacgcggagcgattcttctgcttgcgtggatgataccctggggcaggttggcgctgtgaaagtgaaggaagagccagtggattcagacgaggacgctcagatccaggagatggagtccggcgaacaggccgcattcatgcaacaggtgatcgggaaagaccttgctcctggctttgtgatcaaggtgataatctag

SEQ ID NO: 226217 - DNA, 2772 bp, Artificial Sequence
  Description of Artificial Sequence: Synthetic coding sequence
ctgcataagctgtcaagtctggtggacgtgaagtctgaggtccccgtcggtctggagccaatcagccctctggacttgcgcacggatctccggatgatgatgcctgtcgtcgatcctgtggtgcgtgagaagcaattgcagcaggaattgctgttgatccagcagcaacaacaaatccagaagcagcttcttatagccgagttccagaagcagcatgagaacctcactcgccagcaccaggctcaacttcaggaacacattaaagagttactggccattaaacagcagcaggaacttctggaaaaagagcaaaaacttgaacagcagcgccaggagcaggaggtcgaaagacaccggcgagagcaacagctgcccccacttcgagggaaggatagaggtcgggaaagggcagtggctagcacagaggtgaaacaaaaactgcaagaatttctactgtccaaatctgctacaaaggacacccccactaatgggaaaaatcatagtgtgtcacggcatcctaaactttggtacaccgcagctcatcacacctctctagaccagtcttctcctccattgagcggaaccagcccgtcttacaagtatacactgcccggagcacaggatgcaaaagacgacttcccactccgcaaaaccgcgagtgagcctaatctgaaggtgagatctcgcctcaaacagaaggttgccgagcggcgatcttctcctctactccggcgtaaggacggaaacgttgtaacatcgtttaagaagagaatgttcgaagttaccgaatcaagtgtaagcagctcgtcgccgggaagcgggcctagcagtccgaacaacggtcccaccgggtctgtgaccgaaaacgagactagcgtccttccacctaccccccacgccgagcagatggtgtcacagcaacgcattctcatccacgaagatagcatgaacctcctgagcctctacacctctccaagcctccccaacatcaccctgggtctgccagctgtgccctctcagcttaacgccagtaacagcctgaaggaaaaacagaagtgtgagactcagactctacggcagggggtgcctctacctggccaatatggaggtagcatccccgcttcaagcagccacccccatgtgacgctcgaaggcaaaccaccaaactcctctcatcaagcactgctacagcacctgctgttgaaagaacagatgcgacagcagaagctcctcgtggcaggtggtgtgccactgcatccgcagtctcctttggctactaaagagcgcatatcccccggaatccgcggaacccataagctcccgagacacagacccctaaaccgcacccaaagtgcacccctgcctcagtctacactggctcaactggtcatccagcaacagcaccaacagttcctcgagaaacagaaacaataccagcagcagattcacatgaacaaaccattcttggaaccgacccatactcgggctctatcagtgaggcaggcaccacttgcagcggtgggaatggacgggctggaaaagcacagactggtcagtcgcactcacagttcgcccgctgcctcagtgttgcctcatcctgctatggatagacccctccagcccggatccgctactggtatcgcttacgaccccttaatgctgaaacaccagtgcgtctgcggtaactccactacccatcccgagcacgctggccgaattcagagcatctggtctagacttcaggaaaccggcctcctcaacaaatgcgaaaggatccaggggaggaaagcttctctcgaagaaattcaactggtccacagtgagcaccactccctcctctacggaacgaatccacttgatggccagaagttggacccacgcattctgcttggagacgacagtcagaagttcttctcttccctcccttgcgggggactgggcgtcgatagtgacacaatctggaatgaacttcactctagcggagccgcacgtatggccgtcggctgtgtgatagaattagcctccaaagtcgcctccggggaactgaaaaacggatttgcggtggtgaggcctcccggtcatcatgcagaagagtccaccgcaatgggtttctgtttcttcaacagcgtggccatcactgctaagtaccttagagatcagctcaatatatccaagatcttgattgtcgatctcgacgtgcatcatggcaatgggacccagcaagccttttacgctgatccaagtattctgtacatttctctccaccggtacgatgaggggaatttcttccccggatccggggctcctaacgaggtggggaccggactgggagaggggtacaatattaatattgcctggacaggcggtcttgatccaccaatgggagacgtcgagtacctcgaagcctttcgtaccatcgtcaaacctgttgccaaagaatttgatcccgatatggtgttagtctcagctggatttgacgctctggaaggccacaccccacctctgggtggctacaaggtgacggcgaagtgttttggacaccttactaagcaactaatgacattggcagacggcagagtcgtcttggctctcgagggaggccacgatctcactgcgatttgcgatgcatctgaggcctgtgtgaacgcgctcctcggcaacgagcttgagcctctggcagaggatatcctgcaccagtcccccaatatgaatgcggtcatatccctccagaagattatcgagatccagtctatgagtttaaagttttcatag

SEQ ID NO: 226218 - DNA, 3078 bp, Artificial Sequence
  Description of Artificial Sequence: Synthetic coding sequence
atgcacagcatgatctctagcgtggatgtcaagtccgaggtgcccgtagggctggagccaatcagtcccctcgatctgaggaccgatctccgcatgatgatgccagtggtcgacccagttgtgagggagaaacagctgcagcaggaattgttgctgattcagcaacagcagcagatccagaaacagctcttaatcgctgagttccaaaagcagcacgaaaatctgacaaggcagcatcaagcccagctgcaggagcacattaaattacagcaggagctgttagctattaagcagcaacaggagctattggagaaggagcaaaaactggagcagcagcgccaggaacaggaggtggagaggcacagacgagagcagcaattgcctccactacgcggtaaggaccgtgggagggagagagccgtggcatctacagaagtcaagcaaaagctgcaggagtttcttctcagcaaaagtgctactaaagatactcctacgaacgggaaaaaccattctgtgagtcgacatcctaaactctggtacacagcagctcaccatacctcattggaccaatcttcccccccactcagcggaaccagtccaagctataagtatacactacccggagcacaagatgccaaggacgacttccccttgcgtaaaacggagtcctccgtgtcatcctcctcaccaggctccggaccctcgagtcccaacaacggcccaacagggtcggtcaccgagaacgaaaccagcgtgctccctcccacacctcacgctgagcagatggtgtcacagcagaggattctcatccatgaggatagcatgaatctgctcagtttatataccagtccctcgctgccaaacatcaccctgggcctgcccgctgtcccctcccagctgaacgccagcaattctctgaaggagaaacagaaatgtgagacccagaccctgcggcagggagtgcccctgcccggacagtacggtgggagcataccggcatcctcgtcccatccacatgtgacccttgaggggaagcctccgaattcatcccaccaggctttgcttcaacacttactcctgaaagagcagatgcgccagcagaagttgcttgtggccggtggagttccactccacccccagtcacctctggcaacaaaagaacgcatcagtcccggaattagagggacacataagctccccagacaccgcccactcaatagaactcaatccgccccactccctcagtccaccctcgcgcagttggtgattcagcagcagcaccagcagttcttagaaaagcagaaacagtaccagcaacagattcacatgaacaaacttctgtctaagtctattgagcagctgaagcagcccggttctcacttggaggaggcagaagaagaactccagggagatcaggccatgcaagaggatcgcgctccttcttccgggaacagtaccaggtctgactcttctgcctgcgtcgatgataccctcggtcaagtcggcgctgtgaaggtgaaagaagagcccgtggacagcgatgaggacgcgcagattcaggagatggagagtggcgagcaggccgcattcatgcagcaaccatttctggagccaacccacacacgcgcattgagcgtgcgtcaggcgccactcgccgcagtgggcatggatggtctcgagaagcacagactggtctcaaggacacactccagtcccgcagcttctgtgctgccacatcctgccatggatcggcctctgcagccgggaagcgcaaccggtatagcttatgacccattaatgctgaaacatcagtgcgtatgtggaaactctactacccacccagaacatgcaggtcgtatccagtctatctggagcagactacaggagactggactgctgaacaagtgtgagaggattcagggtcgaaaggcatcactggaggaaattcagcttgtgcactctgagcaccatagcctgctgtatggcactaaccctctcgacggccagaaactggatcccagaatcctgctgggagatgattcccaaaagttcttcagctccctcccgtgtggcggattaggagtggattcggatacaatttggaatgaattgcacagcagcggagccgctcgcatggccgttggctgtgtcatcgagctggcctctaaagtcgcctccggagaacttaagaacggttttgccgtagtgcggccaccaggacatcacgcagaagagtccactgccatgggcttttgtttttttaacagcgtggcaatcaccgccaaatatttacgagaccagctgaatatatccaagattttaatcgtcgatttagatgtgcatcacggcaatgggactcaacaagccttctatgccgacccttctattctttacatttctctgcacagatacgacgaaggcaatttcttccccggaagcggtgcacctaatgaagtcggaaccggtctgggagagggctacaatatcaacattgcttggaccggaggacttgaccccccaatgggcgacgtcgagtacttggaagcgtttcggacgatagtaaagcccgtagctaaagagttcgacccagatatggtcctcgtgagcgcaggtttcgatgcactggagggccacacccctccactgggagggtataaggttacagcaaaatgctttgggcatctgaccaaacagttgatgacactggctgacggaagagtagttctggccctggaaggagggcacgacctcaccgctatctgcgacgcaagtgaggcttgtgtcaacgccctgcttggtaatgagctggaacccctagctgaggacatcctgcatcagagtcctaacatgaacgcggtaatttctctccagaaaattatcgaaatccagagcaagtattggaaaagcgttcgcatggtcgctgtgcctaggggatgcgcccttgcgggagcacagctgcaagaggaaactgagactgtgtccgcgcttgccagcttaacagttgacgtcgaacagccctttgcccaggaggattcccggacagctggagagcctatggaagaagagcctgctctgtag

SEQ ID NO: 226219 - DNA, 1773 bp, Artificial Sequence
  Description of Artificial Sequence: Synthetic coding sequence
atgcatagcatgattagtagtgtcgacgtaaagagcgaggtgcccgtaggcttagaaccaatctcgcctcttgatctgcgcacagacctgaggatgatgatgccagttgttgaccctgttgtgcgggagaagcaactacagcaggaacttctgttaattcaacagcagcagcaaatccagaaacaattgctcattgctgagtttcaaaagcagcacgagaatctgacaagacagcaccaggcccagttgcaggaacatataaaggaactcctggccattaaacagcagcaggaactgcttgaaaaggaacagaagctggagcagcaaagacaagagcaggaagttgagcggcatcggagagagcagcagttaccgcctctgcgtgggaaagacagaggccgagaaagagcagtggcttccaccgaagttaagcaaaaactgcaggagtttttgttgtcaaagagtgcaacgaaggacacccctacaaacggcaaaaatcactctgtcagtcggcaccccaagctgtggtataccgctgcacatcatacctcactcgatcagtcatccccgccactttcgggcacaagccctagctataagtatacactaccaggcgctcaggatgctaaagacgatttccccctaagaaaaacagccagtgaaccaaacctgaaggtgcgatcacgccttaaacaaaaagtggcagagaggcggagttccccactccttcggaggaaagacggaaatgttgtcacctcatttaagaagaggatgtttgaggtcaccgagtcctcagtgtcgagctcaagtcccggatccggacccagcagccctaacaacggcccaaccggtagcgttacggagaacgagactagcgtccttccaccaactccacacgcagagcaaatggtcagccagcaacgtatattgatccatgaagattccatgaatctactaagcttgtacacaagtccctctcttcccaacatcactctggggctgcccgcagtcccttctcaattaaacgcatcaaactccctgaaagagaagcagaagtgcgaaacacagaccttaagacagggcgtccctctacccggacagtatggcggttcaattccagcgagctcctcccatcctcatgtcacccttgaagggaaaccccctaatagcagtcatcaggctttgctgcaacatctgcttctaaaggagcagatgagacagcagaagctgttggttgcagggggtgtgcccctccatccacagagcccactggctaccaaggaaagaattagccccggaatcaggggcacacacaaactccccagacacagacctctgaatcggacccagagtgccccattgcctcagtcaaccttagcccagttggtgatccagcaacagcatcagcagttcctggagaagcaaaagcagtaccagcagcagattcatatgaacaaattgctttctaaaagcatagaacagctgaaacagcctggatcacatctcgaggaagctgaggaagaactgcagggcgaccaagccatgcaggaagatagagccccaagttcaggcaactcaacaagatctgacagcagcgcttgcgtagacgatacgttgggacaggtcggagccgtgaaggtgaaggaggaacccgtcgattcagatgaagacgctcagattcaggagatggaatccggcgagcaggccgcatttatgcaacaagtcatcgggaaggatctcgcccctgggtttgtgattaaggtcattatttag

SEQ ID NO: 226220 - DNA, 1734 bp, Artificial Sequence
  Description of Artificial Sequence: Synthetic coding sequence
atgctgcaaacgatctacgagtcagactcttgcttttctagcgatggcgtcgcgggaagagaacagctacttgcccaacagcgcatgcacagtatgatctcaagtgtggatgtgaagtccgaggtgccagttggtctcgagccaatctcccctttagacctgagaacggacctaaggatgatgatgccggtagttgatcctgtcgtgcgcgaaaaacagctgcaacaggaactattactcatccaacagcagcagcagatacaaaagcaacttctgatagccgaatttcagaaacagcacgagaatctaacccggcagcaccaggctcagttgcaggagcacattaaactgcaacaggagctgctggctatcaaacagcaacaggagcttctggagaaggaacaaaagctagaacaacagagacaggaacaggaggttgaaagacatcgccgtgagcagcaacttcccccactccgaggcaaggacagaggtagggaaagggccgtcgcttctacagaggtcaagcagaagttacaggaattcctgctgtctaagtcagcaaccaaagacacaccgaccaatggtaagaaccactccgtgtcgagacaccccaagttgtggtacaccgcggctcatcacacctcattggaccagtcctccccacccttatcagggacgtctccgagctacaaatacaccttacccggtgctcaggatgccaaagatgatttccctctacggaagactgaatccagcgtcagttctagctctcctggatccgggcctagctcccctaataacgggccaacaggctctgtgactgaaaacgaaacatcagtgttgcctccaacaccccatgcagaacagatggtcagccagcaaagaatcctgatccacgaagatagcatgaacctgctatccctttacacgtcccccagcctacccaacattactctgggcctccccgcagtcccaagccagctgaatgccagcaattctctcaaagaaaagcaaaaatgtgagacccaaacattacgacagggtgtgccattaccaggtcaatatggcggaagcatccctgccagctctagtcatccacatgttacactggagggtaaaccacccaatagctctcatcaggctttattgcaacacctcctcctaaaggaacagatgcgacagcagaaactactggttgccggtggggtacccttacacccacagtcccctcttgcaactaaggagagaatctcccctggaatcaggggaacccacaagctacccaggcaccgccctctcaacagaacccagtctgcacctttgcctcaatctaccttagctcagctggtgatccagcagcagcatcaacagtttctggagaagcagaagcagtatcagcagcaaattcacatgaataaattgctctccaaaagcatcgagcagttaaagcaacctggcagtcacctagaggaagctgaggaagagcttcagggcgaccaggctatgcaagaagaccgggctcccagctctgggaatagcacccgctctgattcgagtgcctgtgtagacgatactttgggtcaagtcggcgctgtcaaagtcaaagaggaaccggtcgatagcgacgaggacgcccaaatacaggaaatggagtctggggagcaggctgcatttatgcagcaggtgattggaaaagatctggctcccggtttcgttattaaggtcatcatttag

SEQ ID NO: 226221 - DNA, 3201 bp, Artificial Sequence
  Description of Artificial Sequence: Synthetic coding sequence
atgcattctatgatatcaagcgtcgatgtgaagagcgaggttccagttggactagagccaattagccccttggacctccgaaccgatctgaggatgatgatgcctgtagtggatcccgttgtgcgcgagaaacagctccaacaggagctcctgcttattcaacagcagcagcagattcagaagcagctgctcatcgctgagttccagaagcagcacgaaaacttgaccagacagcaccaggcgcaacttcaggagcatatcaaggagctcttggcaattaaacagcagcaggagctgctggagaaggagcagaaacttgaacagcaacgtcaggagcaggaggtggaacgccaccggcgagaacagcaactccctcccctgaggggaaaagatcggggacgggaaagagctgtggcttccaccgaggttaagcaaaagcttcaggaatttctgctcagcaaatctgcgacaaaggatacacctacgaacggtaaaaatcatagtgtgtctcgccacccaaagctgtggtacacagcggctcatcacacaagtctggatcagtccagtccccctctaagcgggactagtcctagctataagtatacgctcccgggtgcccaggacgctaaggacgacttccctctgcgaaaaaccgcttccgagcctaatctcaaggtgagaagccgactgaagcagaaggtggccgaacggagatcttcacccctgctgaggcgcaaagatggcaatgtagtgacgagctttaaaaaacggatgtttgaagtgactgagtccagtgtgtcctcatcgagtccaggctcaggacctagttcccccaacaacgggcctaccggatccgtgacagagaacgaaactagtgtgctgccacctacacctcacgcagaacagatggtgtctcagcagaggattctgatacacgaggactcaatgaatttgctgtcgctctatacttcaccgagcctgccaaatatcacactggggctgcccgcagtcccgtcccagttgaatgctagcaacagtctaaaagaaaagcagaaatgcgaaactcagactctgcgccagggagtgcctctgcccggtcaatatggaggatctatcccggcttcgagtagtcacccacatgtgacccttgagggtaagcctccaaattctagtcaccaggcccttttgcaacatttgttgttaaaggaacagatgcggcaacagaagctgctcgtggccggaggggtgccactccatcctcagtccccactcgctaccaaggagcggatttcccccggaattcgcggaacacacaaactgccccgacatcggccactgaatcgcacccagtccgctccgctacctcagagtaccttggcccagctcgtgattcagcagcagcaccagcagttcctggagaaacaaaaacaataccaacagcagatccatatgaacaaactgttgtctaagagcattgaacaattgaaacaacccggttcgcatcttgaggaggctgaagaggaactgcaaggtgatcaggctatgcaggaagatcgcgcaccttcaagcggcaactccacacgatcggattcctccgcttgcgtggacgataccttaggccaagtgggggctgtcaaggtgaaagaggagcccgtggactctgatgaggatgcacaaatccaggagatggaaagtggtgagcaggccgcattcatgcagcagcccttcctagagcctacacatactagagccctgagcgtccgccaagccccactggctgctgtcggcatggacgggctggagaagcataggctcgtgtctaggacacattctagtccagccgcttctgtacttccccacccagccatggatagacctctgcagcccggaagcgcgaccggaatcgcgtacgatccactgatgcttaaacaccaatgcgtgtgtggcaacagtaccacgcatccagagcacgctggcagaatacaaagtatctggtctcgcctccaggagactggtctcctgaacaaatgcgaaaggatacaagggagaaaggccagcctggaggaaatccagttggtccactccgaacaccacagtctgctttacggaacaaatccgctggacggacagaagctggacccaaggattctgctgggagatgactcccagaaattctttagctcgctaccctgtgggggactgggggtcgatagtgacacaatctggaatgagctgcatagttctggggctgcgagaatggccgtaggatgcgtcattgaactggccagcaaggtggccagcggcgagctgaagaatggcttcgccgttgtgcgccctccaggccaccacgcagaagagtcaacagcaatgggattctgtttcttcaacagtgtagctattactgcaaagtacctccgcgaccagctgaacatttccaagatcctgatcgtggatcttgacgtacaccacggaaatggaactcagcaagccttttacgctgatccttccattctgtatatcagcttacaccggtacgatgaagggaatttcttccccggatccggagcacctaacgaagttggtactgggctaggggaggggtacaatatcaatatcgcctggacgggcggactcgacccacccatgggtgatgttgaatacctcgaagcctttcggaccattgttaagcctgtagcaaaagagttcgaccccgatatggtcttggtgtctgccggattcgacgccctcgagggacacacgcctccactggggggatacaaggtgaccgctaagtgttttggacacctcaccaaacaacttatgaccctggctgatggaagagttgttctggccctggaaggcggtcatgatctcacggccatctgtgatgcctccgaggcatgtgtgaatgccctcttaggaaacgagctcgaaccactggccgaagatatccttcatcaaagcccaaacatgaatgcagtgatcagtctccaaaagattattgaaatacagagtaagtattggaaatctgtaaggatggtggccgtgccaaggggttgcgccctggccggtgcccaactacaagaagagaccgaaaccgtgagtgcattagctagcttgaccgtcgacgtggagcagccatttgcacaagaagactcaagaaccgcaggtgagcccatggaggaggagccagccctctag

SEQ ID NO: 226222 - DNA, 447 bp, Artificial Sequence
  Description of Artificial Sequence: Synthetic coding sequence
atgcattcaatgatcagctctgtcgacgtcaaaagcgaagtgcccgtcggccttgagcccattagccctctggacttaaggacagacctaaggatgatgatgccagtcgttgatccggtggtcagggagaagcaactacagcaagagttattgctcattcaacagcaacagcagatacagaagcagctgctgatcgctgaattccagaagcagcatgaaaacttaacacgccagcatcaggcgcagttgcaggagcacattaagctgcaacaggaactccttgccataaagcagcagcaggagctcctcgaaaaagaacaaaagctagaacagcaacggcaagagcaggaggttgagcgacatagaagagagcagcagctccctccactgcggggaaaagacaggggccgagagcgtgctgtcgcatccacagaggtgaagcagtag

SEQ ID NO: 226223 - DNA, 417 bp, Artificial Sequence
  Description of Artificial Sequence: Synthetic coding sequence
atgcatagcatgatttccagcgtggacgtaaaatccgaggtgcctgttgggctggaacccattagccctctggacctgagaactgacttgaggatgatgatgcctgttgtggacccggtcgtgagagaaaagcagcttcagcaggaactcctgctgattcagcaacagcagcagattcagaaacagctcctgatcgccgaatttcagaagcagcatgaaaacttgacacggcagcaccaggcacagttacaggagcatattaagctccagcaggaattattagctattaagcaacagcaagaattgctcgaaaaggaacagaagctggagcagcaacggcaggagcaagaggtcgagcgccaccggagagagcagcaactgcctcctctgaggggcaaagatcggggacgtgagtag

SEQ ID NO: 226224 - DNA, 1767 bp, Artificial Sequence
  Description of Artificial Sequence: Synthetic coding sequence
atgatgtcgtcaccagcgcagccagaccttatgtggaatttggtcccgtgggtacttttttgcgggtgttgccgaattttccctgatggggtcgccggacgagaacaactgctggcacagcaaagaatgcatagtatgatcagctcagtggatgtcaagtctgaagtgccagtggggctggaacctatatcccctctagatctgcgcaccgacctgagaatgatgatgccggttgtagaccctgtcgtgagggagaaacagctccagcaggaattgctgctgatacagcagcaacagcaaatacagaagcagctgttaatagctgagttccaaaagcagcacgagaatctaacaagacagcatcaggcacaactgcaggaacacattaaagaactgctggctatcaagcagcagcaggagcttctagagaaggagcagaagctggaacagcagcgtcaggagcaggaggtggagcggcatcggcgagagcagcagctgccaccgctgagagggaaagacaggggcagagaacgagctgtggcaagcaccgaggttaaacagaagctgcaggagtttctgctgtctaaaagcgcaacaaaggatacaccgacaaacggcaagaaccattccgtctcaagacaccctaagttatggtacaccgccgcacatcataccagcttggaccaaagcagtcccccactctcaggaactagcccaagttacaaatacactctgccgggagcccaggacgcaaaagatgatttccctctcagaaagaccgagagcagcgttagcagttccagccctggctccggcccatccagcccgaataatggccctacaggcagcgtaaccgagaacgagacatccgtgctaccacccaccccccatgccgagcagatggtcagtcaacaaagaatcctgatacatgaggactccatgaatttacttagtctttatacctcaccttccctccctaacatcacactggggctgcctgctgtgccgtctcagttgaatgcttctaacagtctgaaagagaaacagaagtgcgagactcagaccttgagacagggcgtccctctaccaggccaatacggcggatccattccagcctcctcttcgcatcctcatgtgactctggaaggcaaacctccaaactccagtcatcaggccctgcttcagcaccttctgttgaaggagcagatgcggcagcagaaactgctcgtggcaggcggagtgccactgcacccacagagccctctggctactaaggagcggatatcacctggcatccgtggtacgcacaagctgccccgacaccgtccgctaaaccgaacccagtctgctcccttgccccagagtacactggcacagctcgtcattcaacaacagcaccagcaatttttagaaaaacagaaacagtatcagcagcagattcatatgaacaaactcctgtctaagtccattgagcagctcaagcagcccggatcgcatctggaagaggcagaggaggaactacagggcgatcaggccatgcaggaagatagggctccgagttccggcaattccacccgctcggactccagtgcctgcgtcgacgacacgttgggacaggtgggggctgtgaaggtgaaagaggagcccgtcgatagcgacgaagacgcccagattcaggaaatggagagtggagaacaagcagcgttcatgcaacaggttatcggcaaggatcttgccccaggctttgtgataaaggttataatttag

SEQ ID NO: 226225 - DNA, 1641 bp, Artificial Sequence
  Description of Artificial Sequence: Synthetic coding sequence
atgcactccatgatctcctccgttgatgtgaagagcgaagtccccgtgggattagaaccaatctctccccttgacctccgaaccgaccttcggatgatgatgccggtggtcgatcctgtggtgcgggaaaagcagctgcagcaggaactcttattaatccagcagcagcagcagatccagaagcagcttcttatcgccgaattccagaaacagcacgagaacctcacaaggcagcaccaggcccagctgcaagaacatataaaggaactcctcgctattaagcagcaacaggaactgctcgaaaaagaacagaagctggaacagcagcgccaggaacaggaagtagagagacatagaagggaacaacagctgccgcctcttcgcggaaaggacagagggagagagcgagcagtggccagtaccgaagtgaaacagaagctgcaagaattcctcctgtctaagtccgcaacaaaggacacccctaccaacggcaagaatcacagtgtgtctcgccacccgaagttgtggtacactgccgcacaccacacttccctcgaccaatcctcaccacccttaagtgggaccagcccttcttacaaatatacgctgccaggtgcgcaggatgcaaaggacgactttccactgcgcaagacggagtcttccgtctcttcctccagtcccggaagcggaccttcttctcctaataacggcccaacgggaagcgtcaccgagaatgagacctctgtcctcccccctacaccgcacgctgaacagatggtgtcccaacagaggatcctgatccatgaagacagtatgaaccttctgtccttgtatacgtcgcccagcttgcctaacattacattgggtctgcctgcggtacctagtcagctgaatgcctccaactccctgaaagagaagcagaagtgcgaaacccagactctgcgacaaggtgtccctctccctggtcaatacggaggatccatcccagcgtccagttcccacccacacgtgacacttgaagggaaacctcctaacagtagccaccaggctttgctccagcatctattgcttaaggagcagatgcgacagcaaaagctgcttgttgcagggggtgtgcccttgcatccacagagccctctggctaccaaagaaagaataagcccaggcatcagaggtacacataaactacctagacacagaccgctcaaccgtacccagagcgccccactgccacaaagcacactcgctcagttagtgatccaacagcagcaccagcagtttctggagaagcaaaaacagtatcagcagcaaatccatatgaataagctcctgtctaaatccattgagcagctgaagcagccaggctcccatctggaggaggctgaggaggagttacagggagatcaggcaatgcaagaagatcgggctccaagttctggaaacagcactcgctctgactcatccgcttgcgtggatgacacgctggggcaggtgggcgctgtaaaagtcaaagaagaacccgttgacagcgacgaggacgcgcagattcaggagatggagagtggagagcaagctgcatttatgcagcaggtcatcggaaaagatctcgcgccaggttttgtgataaaagtgatcatttag

SEQ ID NO: 226226 - DNA, 3036 bp, Artificial Sequence
  Description of Artificial Sequence: Synthetic coding sequence
atgcattccatgatatccagcgtggacgtaaaatcagaggtgcctgtcggactggaacccatctcacccttggacctccgcacagacctaaggatgatgatgccagttgtagatcccgtggtcagggaaaagcagttacaacaggagctgttattaattcagcagcaacagcagatccagaaacagctgcttatcgccgagtttcagaagcagcacgagaacctgacacgacagcaccaggcgcagcttcaagaacatattaaagagctgctagccattaagcagcaacaagagctgctggagaaggaacagaagctggaacaacagagacaggagcaagaagtcgaacgtcaccggagagagcaacagctgccccctctccggggaaaggatcgaggtcgggaacgggcagtggcttccactgaggtaaaacagaaactccaggagtttctactgtcaaagagtgctactaaggacacacccaccaacgggaagaatcactccgtatctcgccaccccaaactatggtatacggcagcgcaccatacgtctctagatcagtcttcaccccctttgagcggaacttccccatcctataagtatacattgcccggtgcccaagacgccaaggacgatttccctttgagaaagacagcatctgaaccaaacctgaaggtgagatccagactcaagcagaaagtggccgagcgcaggtccagcccactccttcggaggaaggatggaaatgttgtgacatctttcaaaaagagaatgttcgaggttactgagtcttccgtgtccagtagtagtcccggatccggcccatcaagtccgaataatggcccaaccggctcagtcacagagaacgagacctctgtcctacctccaacaccacatgcagaacagatggtaagccagcaacggatccttattcacgaggactctatgaatctcctgtcattatacacttcgccatccctgcccaacatcaccctcggtttaccagcagtgcctagtcagcttaacgcctctaactcacttaaggagaagcagaagtgcgaaacgcagactcttagacagggggtccccctgccgggacaatacggtgggtccatccctgcatcatctagtcacccccacgtgacactagaagggaaaccccctaactcttcccaccaagcgctgcttcagcatctcttactcaaagagcagatgcggcagcaaaagttgctggttgccggaggggttcctctgcacccacagtcccctctggccactaaggaacgtatctctccagggatcaggggcacacacaagttgcctcggcatcgaccacttaacagaacacagtccgcgccactcccccagtctaccctcgcccagcttgttattcagcagcagcatcagcagttccttgagaagcagaagcagtaccaacagcagatccacatgaacaagttactctccaagtcaatcgagcagctcaagcagcccggatcccaccttgaagaggcagaagaagaattgcagggcgaccaggcaatgcaagaggatcgcgcaccgtccagtggaaattctactaggtcagacagtagcgcttgtgtggacgacacactgggccaggtaggagccgtaaaagtaaaggaagagcccgtggattcagacgaagatgctcagatccaggagatggagagcggagagcaggccgcattcatgcagcagcccttcttagagcccactcacactagggctctgtctgtgagacaggcgccactggcagcagtgggaatggacggtcttgagaagcatcggcttgtcagccgaacccactcatctccggctgccagcgtgttgcctcaccctgctatggatagaccactgcaaccagggtctgcaacggggatcgcctatgatcctctaatgctcaagcatcagtgcgtctgcggcaactcaacgacacatcccgagcacgccggtcgaattcagtccatatggtctagactgcaggaaacagggctcctgaacaagtgtgaaaggatccaaggtcgtaaagccagcctggaagaaatccagctggtacacagcgaacaccactccctgctgtacggaactaacccccttgacgggcagaaattggaccctagaatcctccttggggatgattcccagaagttcttttcatctctgccatgtggcggactaggagttgatagtgacaccatttggaacgaacttcacagttctggcgcagctcgcatggccgtcggatgtgtgatcgaactcgcctccaaagtcgctagcggtgagctcaagaacggattcgcagtcgtgaggcctcctggacatcacgcagaggaaagcacggctatggggttctgtttcttcaacagtgttgccataaccgccaagtatttgcgcgatcagctgaacatcagtaaaatacttattgtggatctagatgtccatcatggcaacggcacccagcaggcattctatgctgacccaagcatcctgtatatatcattgcatcgctacgacgagggcaattttttccccggaagcggcgctccaaacgaagtaggtacaggcctgggcgaaggttacaacatcaatatcgcgtggaccggcggactggacccgccaatgggcgatgtagagtatctggaagcttttcgaaccattgtcaaacccgttgctaaagagtttgacccggacatggtattggtgtccgccggattcgatgctcttgaaggacacactccccctttggggggttacaaagtgaccgcaaaatgcttcggtcatctgacaaagcaacttatgactctcgccgatgggagagttgtgcttgccctcgagggagggcacgatttgacagcaatttgtgacgcctcagaagcctgcgtaaatgcacttttagggaacgagcttgagccgcttgccgaggacattctgcatcagtctcccaacatgaatgcagtcatcagccttcaaaagatcatcgagatccagtcgatgtctttaaagttcagctag

SEQ ID NO: 226227 - DNA, 72 bp, Artificial Sequence
  Description of Artificial Sequence: Synthetic coding sequence
atgcactctatgatcagcagtgtggacgtcaagtccgaggtcccagtcggactggaacctatcagtccgtag

SEQ ID NO: 226228 - DNA, 3210 bp, Artificial Sequence
  Description of Artificial Sequence: Synthetic coding sequence
atgcacagcatgatttcttctgtcgacgtgaaaagcgaggttcccgtgggtctggagcccatatctcccctggacctgcgcactgatttgcggatgatgatgccagtagtcgaccctgtggtaagagagaagcagctgcaacaagagctcctgctgattcagcagcaacagcagattcagaagcagttattgatagcagagtttcagaaacagcatgaaaatttaaccaggcagcaccaggcccagctgcaggagcacattaagctgcagcaagagctgcttgccattaaacagcagcaagagcttctggagaaggagcagaagcttgagcagcaacgacaggagcaagaagtagaacggcaccgacgggaacagcaattaccccctctccggggaaaagataggggaagggaacgcgctgtcgccagtacggaggttaaacagaaactgcaggaattcctcctgtcaaagtccgccacaaaggacacccctacaaatggcaagaaccactcagtgtctcgacacccgaagttatggtatacagctgcacatcacacaagtctggaccagagtagccctcctttaagtggaacatcaccttcctataaatatacgctgccgggagcacaggacgctaaggacgatttcccgctacgtaagacagcgtccgaacctaatctgaaggtgcgatcacgattgaaacagaaagtagctgagcgtcggagctcccctttactcagacgtaaagacggaaatgtcgtaacaagcttcaagaaacggatgtttgaggtaacagagagttcggtctcgagttcctctcctggcagtgggccaagctcacccaacaacggcccaaccggcagcgtgaccgaaaatgaaacaagcgtcctgcctcccaccccccatgccgagcagatggtgtctcaacagcggattctgattcatgaagacagcatgaaccttctcagcctttataccagtccttccttgccaaatattacgctgggattgccggcagtaccgtcccagctgaatgccagcaatagcctgaaagaaaaacaaaagtgtgagacacaaaccttaagacagggtgtaccactgcctggacagtacggcggttccattccagcttcctcttcacacccacatgtcaccttggaggggaaaccacctaacagttctcatcaggccttgctccagcatctgcttctgaaggagcaaatgcggcagcagaaactcctggtggcaggaggagtgcctttacatcctcagagcccattagccactaaggagagaatcagcccaggaattagaggcactcataaactgcccagacatagaccgctcaaccgtacccaaagcgctcccctcccccagagtacactggctcagctcgtgatccaacagcaacaccagcagtttctcgagaaacagaagcagtaccagcagcagattcatatgaacaaactgctaagtaaatccatcgaacagctgaagcagcctggatctcatctggaggaggctgaggaagagctccaaggggaccaagcaatgcaggaggatagggcccctagctctggcaattcgacccggagcgactctagcgcatgtgtcgatgacaccttgggccaagttggcgcagtaaaggtgaaagaagagccagtggattcggacgaagatgcccagatccaggagatggaatccggggaacaggccgctttcatgcaacagcctttcttggaaccaacccacactcgggctttgtctgtgcgccaggctcctctcgcagccgttggtatggatgggctcgaaaaacaccgcctggtcagtcgcacccacagctccccggctgcctctgtcctccctcatcccgcaatggatcgacctctccagcctggaagcgcaacaggcattgcttatgaccccctgatgctcaaacaccagtgcgtatgtggaaatagcacaacacacccagaacatgccggacgtatccagtccatatggtctcgtttgcaggagacgggactgcttaacaagtgtgagcgcatacaagggaggaaagctagcctggaagagatccagctcgtgcatagcgaacatcattccctgctttacggaaccaatccacttgacggtcagaagctcgatcctcgaatcctgcttggggacgacagtcagaagtttttttcatccctcccctgtggcggactcggggtggattcggacacaatctggaacgaacttcattccagtggtgccgcacgcatggccgtcgggtgtgtgatcgagcttgctagtaaagttgcctcaggcgagctgaagaatggctttgctgtcgtgcgaccacctgggcatcatgcggaggaatctaccgccatggggttttgttttttcaactctgttgccattacagcgaaatatctgcgtgatcaactgaatatcagcaagatactgatcgtggacctcgacgtccatcatggaaatgggactcagcaggcattctatgcagatcctagtattttatatatctcacttcatagatatgacgagggaaactttttcccgggtagtggtgccccaaacgaagtgggtacggggctgggagaggggtataacattaacatcgcgtggacagggggactggatccccctatgggcgacgtggaatacctcgaggcgttcaggaccatcgtaaagccagtagccaaggaatttgatccagatatggtgctggtttccgcaggatttgacgctcttgaggggcacactccccctctgggtgggtataaggtgacagctaaatgtttcgggcaccttacgaaacagctgatgacgctcgcggacggcagggtggtcctggccctggaaggcggtcacgatctaactgcaatatgcgacgcttccgaggcttgtgtgaatgcccttctcggtaacgaactggaacctcttgccgaagacatcctgcaccaatcacctaacatgaatgctgtgatcagtctgcagaaaatcatcgagattcagagcaagtactggaagagcgtcagaatggtcgctgttccacgcggttgtgcactggcaggagcacagctccaggaggagactgaaactgtttccgcattagccagcctaaccgtggacgttgagcaaccttttgcacaggaggatagtcgcacagccggtgaacccatggaggaagagcctgcactctag

SEQ ID NO: 226229 - DNA, 1689 bp, Artificial Sequence
  Description of Artificial Sequence: Synthetic coding sequence
atgatgatgcccgtggtagacccggtcgtgcgagaaaaacaattgcagcaagagctgttacttatacagcaacagcagcaaatccagaagcaactgctgatagccgagttccaaaagcagcatgagaatctgacaagacagcatcaggcgcagctccaggagcatatcaagctgcagcaagaattgcttgctattaaacagcaacaggagctgctggagaaggaacagaagctggagcagcaacggcaagaacaggaggtcgaaagacatcggagagaacaacagctacccccactgcgcggtaaggacagagggcgtgagcgtgctgtggcttctacggaggtgaagcagaaactacaggaatttctgctgagtaaatccgccacaaaggatacgcctacaaatgggaagaatcattcagtgagtagacaccccaagttgtggtacactgctgctcaccatacgtctcttgatcagtcttcgcccccactgtcgggtacttcaccttcttacaagtatacactgcccggtgcccaggacgctaaagatgattttcccctcaggaagacggcctccgaacctaacttaaaggtgcgcagccggctcaagcagaaggttgcagagaggaggagcagccccctgttgaggaggaaggacggcaacgtggttacctctttcaagaagcgaatgtttgaagttaccgaatcttccgtgtccagttctagcccgggatcagggccatcttcgccaaacaatggtcccactggtagtgtcaccgagaatgaaacatccgtgctgccaccaacacctcacgcagagcaaatggtttctcagcagcgcattctgatacatgaggacagcatgaacctgctcagcctgtacacatctccgagcttaccaaacattactcttggattacctgccgtgccctcccagttaaatgcaagcaatagccttaaggagaaacagaaatgtgagacccaaactctgaggcagggcgtgccactccccggacagtatgggggaagcatcccagcctcctcatcccacccgcacgtcacactcgaaggcaagcccccaaattcgtcgcaccaagcattgcttcagcatttattattaaaagaacaaatgaggcagcaaaaacttctggttgctggcggtgtgcctctccaccctcagagccccctcgctactaaagaacgcatttcacccggaattagaggaactcacaaactgcctaggcacaggcctctgaatcggacgcaatctgcccctttgccacagtccaccctggctcaactcgtcattcagcaacaacaccaacagttcctggagaaacagaaacagtatcagcaacagatccatatgaataagctcctgtccaagtcgattgagcagttaaaacagccaggttcacaccttgaagaagcagaagaagaacttcagggagaccaagccatgcaggaggacagagctccatccagcgggaactcaacacggagtgactccagcgcatgcgtcgatgacacccttgggcaggttggcgctgtgaaagttaaggaggaaccggtggatagcgatgaagacgctcagatccaggaaatggaatccggcgagcaggctgcattcatgcagcaggtgatcggtaaggacctcgctcctggattcgtcattaaagtcatcatatag

SEQ ID NO: 226230 - DNA, 1542 bp, Artificial Sequence
  Description of Artificial Sequence: Synthetic coding sequence
atgatgatgccagtggtggatccagtggtaagggagaagcagctccaacaggaactgctgctgattcaacagcaacagcaaatacagaaacagctcctgatcgcagagttccaaaagcagcatgaaaacttgactcgtcagcatcaggcccaactccaagagcatataaaggagttgcttgccattaagcagcaacaggagctgctcgaaaaagagcagaagctggagcagcagcgacaggagcaggaagtggagcgccatcggagagaacagcagctgccaccgctgcggggaaaggaccggggacgcgaacgtgcagtggccagcacagaagtgaagcagaaactccaggagtttcttctatctaagtcagcaacaaaggacacacctactaacggtaagaaccactcggtgtccagacaccccaagctctgggccgctcaccatacctctctggaccagagcagccctcccttgagtggtacctcacccagctacaaatacactttgccgggagcccaggacgcgaaggatgacttccctctgagaaaaacggagagcagcgtgtcaagttcatcacccggatcgggaccttcaagcccgaacaatgggcctaccggatccgtaaccgagaacgagacttcagtgcttccacctacccctcacgcagagcagatggtctcacagcagcgcattctgatccatgaagacagcatgaatctgttgagcctctacactagtccaagcttacccaacatcaccctgggcttacctgccgtgccaagtcagcttaacgcctccaattcacttaaagagaaacaaaagtgcgaaacgcaaacacttcgccaaggggtacctcttccgggacagtacggcggatcaattcctgctagttcatcgcacccccatgtcaccctagagggcaaacctcccaatagcagtcatcaggctttgctgcagcatctgctgctgaaggagcagatgcgtcagcaaaaactgctggtggccggtggcgtccccctgcatccacagtcccctctcgccaccaaagaacgcatcagccctggcattaggggaacacataagctccctcggcacaggcctctgaaccgcacgcaatctgcgcctctcccacaatctacccttgcacagcttgtaattcagcagcagcaccagcagttcctcgagaagcaaaagcagtaccagcagcagattcacatgaacaagctgctgagcaagtccattgaacaactcaaacagcccggttcccacctggaagaagctgaagaagaactgcagggagatcaggcaatgcaggaagaccgcgctccatcttcggggaacagcactaggtccgattcgtcagcatgcgtcgatgacaccttgggtcaagtgggcgcagtaaaggttaaggaagagccagtggattccgacgaggatgcacaaatacaggagatggagagcggggagcaggctgccttcatgcagcaagtcataggtaaggatctggcgccaggatttgttatcaaggtaataatctag

SEQ ID NO: 226231 - DNA, 1980 bp, Artificial Sequence
  Description of Artificial Sequence: Synthetic coding sequence
atgcgcgtcaaccatactgtgtcaacgatgctgcctacatgtatggtccaccgacagacaatgtcatgtagcggggcaggaggcatcaccgctttcgtcgccttccgcgacgtggccgtctacttcacacaggaagaatggcgcctgttgagccctgctcagcggaccttgcatcgcgaggtcatgctagagacctataatcatttggtttcattagaaatcccatccagcaagcctaagctgattgcacagctggagcggggagaggcgccatggcgcgaggagcgcaagtgtcccctggatctatgtccagagagtaaacctgagatacaactgtcccccagctgtccactgatcttctcaagccagcaagccctctcgcaacatgtgtggttgagccatctgtcacaactgtttagttcattgtgggccggaaacccccttcacctaggcaagcattatccagaggatcagaagcagcagcaagatccattttgcttctccgggaaagctgagtggattcaggaaggtgaggacagtcgactgctgtttgggagggttagcaaaaatggaacaagcaaggccctgagtagccctcctgaagaacagcagcccgctcaatctaaagaagacaacaccgtggtggacatcgggtctagtcctgagcgtcgcgcagacctggaggagactgacaaagtgttgcacggcttagaggtctccggttttggagagattaaatacgaagaatttggaccaggattcattaaggaatccaatctcctgagtctgcaaaagactcaaaccggggaaaccccttacatgtatacagaatggggtgactcgtttggtagcatgtcagtgctcatcaagaacccacggacacatagcggcggaaaaccgtacgtgtgtcgcgagtgcggcagaggttttacatggaagtcgaacctgattactcaccaaagaactcattctggcgaaaaaccatacgtgtgtaaggactgcggacgtgggttcacttggaagagcaacttgtttacccaccaacgtacacactctggcctgaaaccttatgtatgcaaagaatgtggacagagtttcagtctgaagagcaacctaatcacacaccaaagagcacataccggagaaaagccttacgtttgtcgcgagtgcgggagggggtttcggcagcattctcacttagtgagacacaagcggacacatagcggcgaaaaaccctacatttgtagggaatgtgagcaagggttctcccagaaaagccacttgattcggcacctgaggacacataccggggaaaagccctacgtttgcactgaatgtggccgacacttctcttggaagtcaaacctgaaaacgcaccagagaactcattccggtgtgaaaccatatgtttgtttggaatgcgggcaatgctttagcctgaagtctaatttgaataagcatcagagatctcacacaggtgagaagcccttcgtctgtactgagtgcggccgagggtttacgaggaagtctacattgagtacacatcagcggacacactcaggcgagaaaccgtttgtatgcgctgagtgcgggaggggttttaatgacaaatcaaccctgatcagccaccagaggactcacagtggagaaaaaccatttatgtgcagagagtgtggacgcaggttccggcagaagcccaacctttttagacataagcgggctcacagcggagctttcgtatgtcgcgaatgtggacaggggttttgcgccaagctcacactgatcaaacatcagcgggctcacgcgggaggaaaaccccacgtttgccgcgaatgcggacaaggcttctcgagacaatcccatctgatcagacatcagcgaacccatagcggggagaaaccatacatctgtcgaaaatgcgggaggggatttagccgcaagagcaatctcattaggcatcagaggacgcacagtggttag

SEQ ID NO: 226232 - DNA, 1923 bp, Artificial Sequence
  Description of Artificial Sequence: Synthetic coding sequence
atggctacgggactgctgcgcgcaaagaaggaggcattcgttgctttcagagacgttgccgtctactttacacaagaggaatggcgtctgctgtctccggctcagcgaacactgcaccgcgaggttatgctcgagacctacaatcacctggtcagtctcgagatccccagcagcaaaccaaagctgatcgcccagctcgagcggggagaggccccatggcgggaagagcgaaaatgtccgctcgatctctgtcccgagagcaaacccgagatccagctgagtcccagttgtccactcattttcagctcacagcaggccctttcccagcacgtctggctgtcccatctgagtcaattattttcctcgctttgggcgggaaacccgctgcacctcggaaaacactatcctgaggaccaaaagcagcagcaggaccccttctgcttctctggaaaagcagagtggatccaggaaggagaggatagtcgcctgctgttcggacgtgtttctaagaacggcacctcgaaagccctgtcatcaccccctgaagagcaacaacccgcacagtcaaaagaagacaatacggtagtggacatcggcagctctcccgaacggcgagccgatttggaggagacggacaaagtgttgcacggcctggaggtgtcaggatttggggaaatcaaatacgaggaatttggacccggtttcatcaaggaatctaatctattgagtctccagaagacacagaccggagaaacaccttacatgtacacagagtggggagactcctttggcagcatgagtgtgcttattaagaaccctaggacccacagtggcggaaaaccctatgtgtgcagagaatgtgggaggggattcacctggaagtctaacttgatcactcaccaaaggacccactcaggagagaagccctacgtgtgtaaagactgtggtagagggttcacgtggaagtccaatcttttcacgcatcagaggacccacagcggcctgaaaccctacgtttgcaaagaatgtggccagtccttctctctcaagagtaacctcatcacacaccaacgggctcatactggcgaaaaaccttacgtgtgccgtgaatgcggacgaggttttcgtcagcactcacatcttgttaggcacaagaggactcatagcggagagaagccctacatatgtcgcgaatgcgaacagggattttctcagaagagccatctgattcgacacctgaggactcacaccggagagaagccatatgtctgcactgagtgtggacggcacttttcatggaagagcaatcttaagacacaccagcgcactcactctggagtaaaaccctacgtatgcctcgagtgcggccaatgcttctcgctgaagtcaaacttgaacaagcatcagcggagccatactggcgagaaaccttttgtgtgcacggaatgcggaagaggattcacacgcaaaagcaccctctccacacaccagcgtacacacagcggtgagaagccattcgtctgtgcggagtgtggacggggatttaatgataaatcaactctgatcagccaccaacgcactcactccggtgagaaaccctttatgtgtcgagagtgcggacggaggttccggcagaaacccaacctattccgccacaagcgcgctcatagtggcgcattcgtgtgtagggagtgcggacagggattctgcgccaagttaaccctgatcaaacatcagagggctcatgctggtggcaagcctcacgtctgccgagaatgtggccagggtttctcccgacagtcacatcttatcagacaccaacgcacccactcaggggagaagccttatatttgccgaaaatgcggtcgaggattctccaggaaatctaacttgattaggcatcagcgaacccattccggatag

SEQ ID NO: 226233 - DNA, 1317 bp, Artificial Sequence
  Description of Artificial Sequence: Synthetic coding sequence
atgctggagacctacaaccacttggtttcattggagatccccagtagtaagccaaagctgatcgcccaacttgaacggggtgaggctccctggagagaggagcgtaagtgccctctggatctctgtcccgaatccaagcccgagattcagctctccccgagctgtcctctgatattcagctcccagcaggccctaagccagcacgtgtggctttcccacctgagccagctcttttcgtctctgtgggcaggcaaccctctgcaccttggtaaacactaccctgaggaccaaaaacagcaacaggatcccttctgttttagcggcaaggccgagtggattcaggaaggcgaagattctcggctgctatttgggagagtctctaaaaacggcactagcaaggccctgagtagcccgccagaggaacaacaacccgctcagtctaaggaagataacactgtggtcgatattgggtcttctcccgagaggagggccgacctagaggaaactgacaaggtgcttcacggcctggaagtttcggggtttggggaaatcaagtacgaggagtttggccctgggttcattaaggaaagcaacttgttgtctctgcaaaagtcccaccttatccgccatctgcgcacacacaccggagaaaaaccatatgtttgcacagagtgcgggcgtcatttttcctggaagtccaacctgaagacccatcagcggacccactctggggtaaagccgtacgtctgcttggagtgcgggcagtgcttctctctcaagtccaacttaaataaacaccagaggtcccacacaggagaaaagccttttgtgtgtacagagtgcggcaggggcttcaccagaaagtcaaccctttcaacgcatcagcgcactcacagcggtgaaaaacccttcgtctgtgcggaatgcgggagaggctttaatgacaaatcaaccctgatcagtcatcagcgtacacattctggagagaagcccttcatgtgtagggagtgcggcaggaggtttcgccaaaagcctaacttattccgtcacaaacgagcacactccggcgcattcgtgtgtagagagtgcgggcaggggttttgtgccaagcttactctgattaagcaccaaagagcccatgccggagggaagccccacgtctgccgtgagtgcgggcaagggtttagtaggcagtcacaccttattaggcaccagaggacccacagcggcgagaaaccctatatttgcagaaaatgcgggcgtggattttctagaaagtcaaacctgatccgccaccagcgaacccattctgggtag

SEQ ID NO: 226234 - DNA, 1797 bp, Artificial Sequence
  Description of Artificial Sequence: Synthetic coding sequence
atgcttgagacttataatcacttagtgtctctagagatcccatcttccaaaccaaagcttatcgcccagttggagaggggggaggctccctggcgcgaagagcgcaaatgcccattggatctatgccccgagtcaaaacctgagatccaattgtcacctagctgtcccctgatcttcagctcccagcaggctctgtcccaacatgtctggttgtcccacctttcccaactcttttcctctctctgggcaggcaaccccctgcacctcggcaaacactatcctgaggatcagaagcagcagcaggaccccttttgttttagcgggaaagccgagtggattcaagaaggcgaggactcccgtttgctctttgggcgtgtttctaagaacggcacatccaaggccctgtctagcccccctgaagagcaacagcctgcccagtcaaaagaggataatacggtggtagacatcggatcgtctccggagagacgcgcagatctggaagagaccgataaggtgttgcacgggttagaggtcagcggattcggtgaaattaagtacgaggagttcgggcctggttttattaaagagtcaaatctcctctctctacaaaaaacccagactggagaaacaccttatatgtacacagagtggggggactccttcgggtccatgtccgtacttatcaagaacccgagaacccactctggaggaaaaccttacgtgtgtagagaatgcggtagaggattcacttggaagagcaatctgattacccatcaacggactcattccggcgaaaagccctacgtatgtaaggactgcggtcgtggatttacatggaaatccaatctgtttacgcatcagcgcacccactccggcttgaagccctacgtgtgcaaagaatgcggacagagcttttccctgaaaagtaacctgataacacatcagcgtgcccacactggggaaaagccatacgtatgtagagagtgtggcagaggcttccggcaacactcccacctggtgcggcacaaacgcacccatagtggagagaagccatacatctgccgcgagtgcgagcaaggattctcccaaaaaagtcaccttattaggcacttgagaacccatacaggtgagaaaccctatgtttgtaccgagtgtgggcgtcatttctcatggaagtccaatctgaaaacacaccagaggacgcatagcggagttaaaccttacgtgtgcctcgaatgcggccagtgcttctcactgaagtctaatttgaataaacatcagcggtcacacacgggtgagaagccgttcgtttgcacagagtgcgggagaggttttactcgtaagtccactctcagcacgcaccaacgcactcactccggggagaaaccgtttgtatgcgcggaatgcgggcgtggctttaacgacaagtctactctgatctctcaccaacggacccacagcggcgagaagcccttcatgtgtcgcgagtgtggcaggcgcttccgacagaagccaaatctgttccgacataagagggcccactctggtgccttcgtatgcagggaatgtggccaaggattttgcgcgaaactgaccctaataaagcatcagagagcccatgcaggcggtaaacctcacgtgtgccgagagtgtggccagggcttctccaggcagagtcacctcatccgacatcagcgcacgcactcaggggagaagccatacatctgccgcaagtgtgggcgagggtttagtcgcaagagcaatctcattagacatcagaggactcatagcggctag

SEQ ID NO: 226235 - DNA, 2190 bp, Artificial Sequence
  Description of Artificial Sequence: Synthetic coding sequence
agctggctgggtcctgggaaagcctccttgctgcgctcattcccccatttgtgcacattgctgccagatttccgtctgcaggacccgcaacgagccccagcattccacctgtccagtgaaactcttcctttctctagaaaaagcactcaggaaacgagaaagatggctactggactgcttagggccaagaaagaggcatttgtggcattccgtgatgttgctgtgtactttacacaagaggaatggagactactctccccggctcagagaacactacaccgagaggtgatgcttgagacatataaccatctcgtgtcccttgagatcccgagtagcaaaccaaagctaatcgctcagctggaaagaggcgaggctccctggcgcgaggagcggaaatgtcctttagacctctgccctgccgagagcaagccagagatccagttatctccgtcttgtcccttgatcttctccagccagcaggccctgagccaacacgtatggctgagccacctctcacagctgtttagttccttatgggccggtaatcctctccatctgggaaagcattatccagaggatcagaagcagcagcaggacccattctgcttctctggaaaagcagagtggatccaggaaggggaagattctaggctcctgttcgggagggtcagtaagaatggaacaagtaaggcgttgtccagcccaccagaagaacagcagcccgcacagtcaaaggaggacaatactgtcgttgatatcggtagttctcccgaaaggagagcagacctggaggaaacagacaaggtgcttcacgggcttgaggtctcaggctttggggagatcaagtacgaagagtttgggccaggttttatcaaagagagtaatctgttatccctgcagaagactcagactggagagacaccatacatgtacacggagtggggagatagcttcgggagcatgtccgttttaattaagaatcccagaacccactctgggggtaagccttatgtttgtcgggagtgcggcagagggtttacctggaagagcaacctgataacccaccagagaactcacagcggcgagaaaccctacgtgtgcaaggattgcggacgcggttttacgtggaagtcaaacctgttcactcatcagagaacccatagtggtcttaaaccctatgtgtgcaaggagtgcggtcaatctttctccttgaaaagcaatctgatcacacatcaacgagcccatacaggtgagaaaccatacgtgtgtagggagtgtggaaggggcttccgccagcattctcatttagtgcggcataaacgcactcattcaggggaaaagccgtatatctgccgcgagtgtgaacaaggtttcagccagaagagccacttgatccgacacttgagaacccacaccggagagaagccatacgtgtgtacagaatgtggtcggcacttttcctggaagtccaaccttaaaacccatcagcgtacgcatagcggtgtgaaaccatatgtctgcttagaatgcggccaatgtttctccctcaagtccaacctgaataagcaccagaggtcacataccggcgaaaagccgttcgtctgcaccgagtgcgggcgtgggttcactcggaaaagcaccctgtcaactcaccagagaacccattctggagaaaagccattcgtgtgcgctgagtgtggtcggggtttcaatgataaaagcacgcttattagccaccagcgaacacactccggcgagaagcccttcatgtgtcgagaatgcggcagaaggttcagacagaaaccgaatctgtttcgtcataaacgggcacacagcggggcttttgtttgtagggagtgcggccagggattttgcgccaagctcactttgataaaacatcagcgggctcatggagggtcattgatgtgcgcaggctcagtaggtaaggccctggccggatcccatacatccctggacactcgcggtcatattcaggaacgttccctgatctttgctgaatcagtggatggggctcttgtgggatcaccaacattgtccgatataagaggccacacccaggatcgcaacttcatgtgtattggtaatgtggtgcagcctttggctcgatcccatacctcttccgatacccggggacatacccagtgttgcggatttttctctcactgctag

SEQ ID NO: 226236 - DNA, 1161 bp, Artificial Sequence
  Description of Artificial Sequence: Synthetic coding sequence
atgtataccgagtggggcgactcctttggtagtatgtcagtcctcattaagaatccaagaacccactctggcggtaagccgtatgtttgccgagaatgtgggagagggttcacctggaagtcaaacctgattacccaccagcggacacactccggcgagaaaccttacgtctgtaaggattgcggccgtggttttacatggaagagcaacttgttcacccatcagcggacccattccggacttaaaccttacgtgtgcaaggaatgcggccagtcattttctcttaagagtaatttgatcacccaccagcgcgcacacactggagagaaaccttacgtgtgtcgagagtgcgggagaggatttagacagcacagccatctggtgcggcacaaaagaacccactctggggaaaagccgtatatatgccgagaatgtgaacaaggattcagtcaaaaatcacacctgatcaggcatctccgaacccataccggggagaaaccctacgtctgtacagaatgcggccgtcacttctcttggaaatcaaacttgaaaacccatcagaggactcattctggagtcaagccctacgtttgcttggagtgtggacagtgcttctctcttaaatctaatctgaacaaacaccagagatctcacaccggggaaaagcctttcgtgtgtactgagtgcggaaggggctttacgaggaagtccaccctgtctactcaccagagaacacacagcggtgagaagccttttgtgtgcgcagaatgcggacggggattcaacgacaagtcaaccctgatcagccaccaacgtacacattccggggagaaaccttttatgtgtcgcgaatgtggccgtcgcttccgacagaagccaaatttatttcggcacaagagggcccacagcggtgcctttgtctgccgagagtgcgggcagggattctgtgccaagctgacactgatcaagcatcaacgagcccacgcgggaggtaagccacatgtgtgccgggagtgcggccaaggcttttcgagacagtcccatctgatccgccaccagcgaactcattctggagagaaaccctacatttgccggaaatgtggtagagggttctcccggaagagtaatttaattcgccaccagcgtacccactccggatag

SEQ ID NO: 226237 - DNA, 612 bp, Artificial Sequence
  Description of Artificial Sequence: Synthetic coding sequence
atgggtggaagtctgcgagtggcagtcttgggcgcacctggcgttggcaaaaccgctataattcggcaatttctgtttggggactaccctgagaggcacaggccgactgacgggcctagactctatcgaccagccgtgctgttagacggcgcagtttacgaccttagcatcagggacggtgatgtggccggaccaggctcctctcctggcggtccagaggagtggccagatgccaaggattggtccctgcaagatacagacgcctttgttctggtatacgacatctgctccccagactctttcgattacgtcaaggctcttcggcagcgcattgccgagacccgacccgctggtgcacccgaggctcccatcctggtagtgggaaacaaacgggaccgtcagcgtttgcgttttggtccgaggcgggctctggcagcccttgtgaggcgcggatggagatgtggctatttggaatgctcagctaaatacaactggcatgtgctgcgactctttcgtgagctcttacggtgtgcactggtccgggctcggcctgcacatcccgctctccgactgcaaggagcacttcatcccgctaggtgttccctgatgtag

SEQ ID NO: 226238 - DNA, 1479 bp, Artificial Sequence
  Description of Artificial Sequence: Synthetic coding sequence
atggatttgctcaaggctattacgtcacccttagcggcaggtagcaaaccttcgaagaagactggcgaaaagtcaagtggcagcagcagtcattccgaaagcaagaaggagcatcatcgcaagaaggtttctggcagttccggcgagctccctcttgaagacggcggatctcataaatccaagaaaatgaagcctctctacgtgaacacagagacacttactcttagggaacccgacgggcttaagatgaagcttatcctctctccgaaggagaagggatcaagctctgtggatgaggagtcctttcagtaccccagtcagcaagcaaccgtcaaaaaatcaagcaagaagtctgctagagatgagcagggcgctctgctgctaggccacgagctccaatccttcctgaagacggctcggaagaaacacaagagttccagtgatgcccatagctcgccagggccagaaggctgtggaagcgacgcttcccagttcgcagagagccattccgctaatctggatctgtcaggcctagagcccattctcgttgaatcggacagtagctccggtggcgaactggaggctggtgagttggtcattgacgattcctatcgtgaaatcaaaaagaaaaaaaaatctaaaaagagcaagaaaaaaaaagacaaagaaaagcataaggagaagagacactccaaaagcaagagaagcttgggcctgagcgcagtgccggtgggagaggtgacagtgacaagcggaccccctcctagcattccctacgccggagccgctgccccaccactccccctgcccggtctccacactgacgggcactctgaaaagaagaagaagaaggaggaaaaggataaggagagagagaggggggagaaacctaaaaaaaaaaacatgtcagcctaccaggtgttttgtaaagagtaccgcgtgacaattgtggcggatcaccccggaatcgacttcggcgaactttcaaaaaagcttgcagaagtgtggaagcagctgcccgaaaaagataagctcatttggaagcaaaaagcacagtacctgcagcacaagcagaataaggctgaagctacgacggttaagcgaaaagcctcatccagtgaggggagcatgaaagtcaaggcgagcagcgtcggcgtgctgagcccacagaagaaatcacctcccaccaccatgttactgcctgcctcacccgctaaagcacctgagaccgaacctattgatgttgctgctcatttacaattgcttggagagagccttagcctaatcggtcatcgcctccaggagacagaggggatggtcgccgtgtcaggctccctgagcgtattgctcgattccataatttgtgccctgggaccccttgcttgcctgactacccagcttcccgaactgaacggctgtccaaaacaggttttaagcaatacccttgataacatagcgtacattatgcccggtttgtag

SEQ ID NO: 226239 - DNA, 1896 bp, Artificial Sequence
  Description of Artificial Sequence: Synthetic coding sequence
atggtgagcaagctgagtcagctccaaacagagctgctggctgctcttttggaaagcgggctttctaaagaagccttgattcaggcactcggtgagcctggcccttatctgctggccggtgaagggcctctagataaaggcgagagctgcggcggaggtaggggcgaacttgcagagctcccgaacggtctgggcgaaacaagaggctcagaggatgagaccgatgacgatggagaggactttacacctcctatcctcaaagaactggagaacctgagcccagaagaggcagctcaccagaaagcagtggtggagactcttctacaggaggatccgtggagggtcgctaagatggtgaagagctacctgcagcagcataatataccacagagggaagttgttgataccaccgggctgaaccagagccatcttagtcagcacttgaataaaggcacacccatgaagacacagaaacgggctgccttgtacacatggtatgtgcgcaaacagcgggaggtggcccaacaatttactcatgctggacagggcggtttgattgaggagccaacaggcgatgagctgcctactaagaagggtcggaggaaccggtttaagtggggtcccgcaagccagcagatcctgttccaggcgtacgaacggcagaaaaatccctctaaggaggagcgggaaacactcgtagaggagtgtaaccgggctgagtgcatccaaaggggcgtgtctccttctcaggcgcagggacttggaagcaacctggtgacagaggtacgagtttataattggtttgccaataggcgaaaagaggaagcattcaggcataagttggccatggatacctactctggcccacctcctgggcctgggccaggcccagccctgcctgcccacagctcccccggattgccaccacccgcactgagtcctagcaaagttcatggagtcaggtatggccagcctgcaacatccgagaccgcggaggttccttctagtagcgggggacctttagtaacagtaagcacccccttacaccaagtctctccaactgggctagagcccagtcactccctactgagcactgaggccaagcttgtcagcgccgcaggcggtcctctgccgccagtgtcaaccctaaccgctctccattccttagagcagaccagcccaggactcaatcagcagccgcagaacctgatcatggctagccttcccggtgtgatgacaatagggcctggggaacccgcatccctgggcccaacgttcacgaatacgggcgcttccactcttgtgattggacttgcgtccacgcaggctcagagcgtcccagtcattaactctatgggctcatcgctcactaccctgcaaccggtccaattctcccagcccctgcacccctcctaccaacagcctctgatgcctcctgtacagtcccacgtgacacaaagtcccttcatggccacaatggcccagctccagagcccccacgcactgtatagccataagccagaggtggctcagtacacccacacaggtctgctcccgcagaccatgctaatcactgatactaccaatctgagcgcactggcctccctgacccccaccaagcaagtgttcacctcagacacggaagcgagcagtgagtccggcctgcatacacccgctagtcaggcgactacgcttcacgtcccctctcaagaccctgctagcatccagcatttgcaaccagcacaccgcctgtccgcaagccctaccgtaagtagcagctccctcgtactctatcaatcttccgatagctccaatggtcaatcccacctcttgccatccaatcattccgttatcgaaacctttatatctactcagatggcttcatcaagtcaatag

SEQ ID NO: 226240 - DNA, 1719 bp, Artificial Sequence
  Description of Artificial Sequence: Synthetic coding sequence
atggtttctaagctgtcgcagctgcagaccgagctgcttgccgctcttctcgagagtgggttatccaaggaggcactgatccaggcactgggcgaaccaggaccatatctcctcgctggagaagggcctcttgataagggagagtcatgcggaggagggcgaggggaactagctgaactgcccaatggcctgggcgagacccgaggctcagaggacgaaacggatgatgatggagaggactttactccccctatcctaaaggagcttgagaacctatcccccgaggaggctgctcaccagaaagcagtggtggaaaccctccttcaggaggacccctggagagttgccaaaatggtcaagagctacctacagcagcataacataccgcagcgagaggtggtggatacaaccggactgaatcagagtcatctatctcagcacttgaacaagggcaccccaatgaaaacgcaaaagagagcagccctttacacatggtacgtacggaagcagagggaagttgctcagcaatttacgcatgcgggacaggggggacttattgaggagcccaccggagacgagctgcctactaagaagggccgaagaaaccgtttcaaatgggggccagcatctcagcagattctgttccaagcctacgaaagacagaagaatccgtctaaggaggaacgagaaactctggtggaggagtgtaacagggccgaatgcatccagcggggtgtctctccttcacaggcccagggtctcggctccaatcttgtgaccgaagtgcgcgtctataactggttcgctaatcgcagaaaagaggaagcctttcgccataaactggccatggacacgtattccgggcctccccctggacccggtcctggtcccgctcttcccgctcatagcagcccaggccttcccccacctgcactgtcacccagtaaggtgcacggggtgcgttatgggcagccggcaacatccgaaaccgccgaagtgcccagcagtagtggcggacctctggtgaccgtcagcactcccttacaccaggtgagccctaccgggctagaaccaagccactcactgctttcaactgaggccaaattggtttctgcggctggcggtcccctgcctcccgtctctacccttaccgccctgcattcactggagcaaacaagcccagggctgaaccagcagcctcagaatttaatcatggcgagccttcccggtgtgatgactatcgggccaggcgagcctgcaagcctgggccctacctttactaatactggtgcttcgactctcgtaatcggcctcgcctccacccaagcccagtccgtgccagtgatcaacagcatggggtcttcactcactacccttcagcccgtccagttctcacaaccacttcatccctcgtatcagcagcccctcatgcccccagtgcaatcccacgtgacacagagcccttttatggcaaccatggcacagcttcaatctccacacggagaacgtcctgtccctcacaccgcgggtgacgacgatagaggctggctgtcgatggatgctggagaacgtggagcttggcaggctctgcagagcgcttgtgtcagtgggacttcagtatttccttactctagtaacggtcagagccacctgctcccaagtaaccattcggtgatcgaaacttttattagtacgcagatggcatcaagcagtcagtag

SEQ ID NO: 226241 - DNA, 1566 bp, Artificial Sequence
  Description of Artificial Sequence: Synthetic coding sequence
atggtgtctaagctgtctcagctccagaccgagctgctcgccgctctccttgagtcaggcttgagcaaggaggcattgattcaggctttgggcgagccgggaccctacctcctggcaggtgaaggcccactcgacaaaggagagagttgtggcggtgggcgaggggagctcgcggagctgcctaacggcctaggagagacaaggggtagtgaggatgagacagacgacgatggcgaggactttactccacccattctgaaagagctcgagaatctgtcacccgaggaggcggcacaccaaaaggctgtggtagagacgctgctacaagaagacccatggcgggtggccaaaatggtgaagtcatatctccagcagcataacattccacagcgggaggttgtggatacgaccggattgaatcaatcacatctcagtcagcatctgaataagggaactcctatgaaaacccagaagcgtgccgctctctatacttggtacgtgcgtaaacagcgggaggtggcccaacaatttacccacgcgggacagggagggctgatcgaggagcctaccggcgatgaactgccaactaagaagggcaggcgtaaccggttcaagtggggccctgcatcccagcagatattgttccaggcatatgagaggcagaagaacccctctaaggaggaaagggagactctggtagaagagtgtaatcgggcagaatgtattcagagaggagtttctccttctcaggcacaaggcttaggctcaaacttggtcacagaggtcagagtgtacaattggtttgcaaataggaggaaagaggaggcatttcggcataagctcgcgatggatacgtattcagggccaccaccaggacccggaccaggaccagcgctgcccgctcacagttctcccggattgcctcctccggcactgtcacccagcaaagtgcatggcgtgcggtacggccagcccgcaaccagcgagaccgctgaagtgccttccagtagcggcggaccactggtaacggtgtccacacccctgcaccaggtgtcacctacaggccttgaacccagccatagtctcctgtcaacagaggccaaactggtaagtgccgcagggggacctctgccacctgtttctaccctcacggcgctccacagccttgagcagacatcgcctggactcaaccaacaaccacaaaacttgatcatggcttccctgcccggagttatgactattgggccaggtgaaccagccagtcttggcccaacgtttactaatacaggggcttccacactcgttattgggaagctcgtcggtatggggggacatctgggcggaagactcatgggccaacctcagaacccgggagcaggaagggctacaggcacccattctttcatccaccaacatgtgttcattcaatgcctgctctggacaagtcattgtgccacaagtgtgatccccggagactcaagtaatggccagagtcacctgttaccttcgaatcatagcgtcatcgagactttcatctccacgcagatggcctctagctcccagtag

SEQ ID NO: 226242 - DNA, 1572 bp, Artificial Sequence
  Description of Artificial Sequence: Synthetic coding sequence
atggttagcaagctgtcacaactgcagactgaactgctagccgcacttctggagagcggtctctcgaaagaggcactgatccaagccctcggcgaacccggaccttatcttctggctggggaaggccctttagacaaaggcgaatcgtgtgggggagggagaggggagctcgcagaactccctaatggcctgggggagacgcgtggatccgaagacgaaaccgacgatgatggggaggatttcacgcctcccatcctgaaggaactcgagaacctgtccccggaagaagccgctcaccagaaagctgtggtcgagacgctgttgcaggaggacccctggcgagtcgcaaagatggttaaaagctacttacagcagcacaatatcccacaacgagaagtggtagacaccaccgggttgaaccagtctcacttatcccagcatcttaacaagggaactccaatgaaaactcagaaacgggcagctctgtatacgtggtacgttaggaaacagcgtgaggtggcccagcagttcacccacgccggtcagggagggctcattgaagaaccaacaggggatgaactgcctacaaagaaaggtcgcagaaacaggtttaagtggggccctgcctcacagcagatcttgttccaggcctatgaaagacagaaaaacccttcgaaagaggagcgcgaaaccctggtcgaggaatgcaatagagcggaatgtattcaaagaggcgtatcaccatctcaggcccagggactcgggtccaacctcgtcacagaggtctctgcagccggtgggccactcccacccgtctcgacgctgactgctctgcactctctggaacagacttctcccggactaaatcagcagccacagaatctgataatggcatcgcttccaggggtgatgaccatcggccctggtgagcctgctagccttggcccaactttcacaaatacaggggcatctacgctggtcattggcctggcttctactcaagctcagagcgttcccgtgattaacagtatggggagcagtcttactaccctgcagcctgtgcagttctcccaacccctgcatcccagttaccagcagccattgatgccacccgtgcagtcccacgttactcagtcccctttcatggcgacaatggctcagctgcaaagccctcacgctctgtactcccataagccagaggtcgcccaatatacccataccggcctgctcccccagactatgctcatcaccgacactactaatctgtccgctttggccagccttacacctaccaagcaagtttttaccagcgacaccgaggcttccagcgaatccggactgcacaccccagcatctcaagctacaaccctccacgtgccgtcccaagaccccgcttcaatccagcacctgcagccagcacatcgattgtcagcaagtcctacggtttcgtcttcttcactagtgttataccagagctctgactcaagcaatgggcagtctcatctgctaccctccaaccatagtgtgatagagacctttatctctacccaaatggcctctagctcccaatag

SEQ ID NO: 226243 - DNA, 1812 bp, Artificial Sequence
  Description of Artificial Sequence: Synthetic coding sequence
atggtaagcaaattgtcacaactgcagacggagttgctggcagctcttctggagagcggactgtcaaaagaggcacttatccaggcactgggggagccaggcccttatctcctggcaggcgagggaccattagataaaggggaaagctgtggcggagggcgaggcgagctggctgagctgccaaacgggcttggtgaaaccagggggtccgaggacgaaactgacgacgacggcgaagattttacacccccaattttgaaggagctggagaacctgtccccagaggaggctgcacaccagaaggctgtggtggagactctactgcaggaggatccgtggcgggtcgcaaagatggttaaatcctacctgcagcagcataacatccctcagcgggaggtggtcgacaccacagggctgaatcaatcgcacctctcacagcacttaaataagggtacccccatgaaaactcagaagagagctgcgttgtacacatggtacgtaagaaagcaacgggaagtggcccagcagtttacacatgcagggcaaggtgggctgatcgaagagccaaccggagatgagctgccgacgaagaaaggcaggcgcaaccgctttaaatgggggcctgcttctcagcagatcttgtttcaggcctatgagaggcagaaaaatccttcaaaggaggaacgcgagaccctcgtggaagaatgtaatcgggctgagtgtattcagagaggagtgtccccgtctcaggcccaaggcctgggatcaaacctggtcaccgaagtccgagtgtacaattggtttgcaaatcgcaggaaggaagaagcctttaggcacaaactcgccatggacacttatagcggccctcctccagggccaggccctgggcctgcactgcccgcacatagctctcctggtttacccccacctgctttaagcccatctaaggttcacggcgtcagatatggtcagccggcaacctccgaaacagcggaagtgccctcttcatcgggcggacccctggtcactgtttctactcccctgcaccaagtgtcccctaccggcctggagcccagtcacagcttactgtctacagaggcaaaattggtgtctgccgctggcggaccacttccgccagtcagtacactgacagcactgcactctcttgagcaaacctcaccaggcctcaatcagcagccacaaaacttgattatggcctctcttccgggagtgatgaccatcggtcctggcgagcctgcttcattagggcctactttcacgaatacgggcgcatctaccttagtcatagggctcgctagtacccaggcacagtcagtaccagtcattaatagcatgggatcctccttaacgacactgcagccagtgcagttttctcagccattgcacccctcctaccaacaacctcttatgccaccggtgcagtctcatgtcacacagtctcctttcatggcgacgatggcccaacttcagagtccgcacgccctgtattctcacaagccggaagttgcacagtacacacatacagggctgcttccacagactatgttgataaccgataccactaatttgagcgccctggcttctctgactccaacaaagcaggtctttacaagcgacactgaggctagctccgagtctggactgcacacacctgccagccaggcaaccactctccacgtcccttcccaggaccctgcctccattcagcacctccagccagcccacaggttgtctgcatccccgactgtttcatccagttcactggtgttataccaatccctcggattatag

SEQ ID NO: 226244 - DNA, 837 bp, Artificial Sequence
  Description of Artificial Sequence: Synthetic coding sequence
atggtctccaagctcagccagctgcagacagagttgctggcagccctcctcgagtctgggctgagcaaagaagccctcatacaggctttgggagaaccgggtccctatctgttggctggagaaggcccactagacaagggtgagagctgcggtggcggacggggtgagttggccgagctacccaacgggttgggcgagacaaggggctctgaagatgagactgatgacgatggtgaagacttcacacccccaattcttaaggagctggagaatctcagcccagaggaagccgctcaccagaaggcagttgtggaaaccctactgcaagaggacccctggcgggtggcaaaaatggtcaagtcttaccttcaacaacataacatcccccagcgggaagtcgtggatacaacaggcttgaatcaatctcatctgtcacaacacctgaacaaggggacacctatgaagacccaaaagagagctgctctttacacttggtatgtcagaaagcaacgcgaggttgcacagcgacgcaacgccagccgggaaggatgtcctcaccacaggcaccgcggatgggccccaacaagcagcagaaggtgcgtctctactactggactgcctactggggctaaaaagaaacctagcggtaccagctggccctggacacgtacagccggtccccctcaagggcaggctagagatctgcgttgccctctgactgcaccgttggcttgtctgcatctccccagtcctccggtgagatctaccgtttgtgccatggactctctccgccctgtaaggcttcagaagtacccccaggcagccgctgtcccttag

SEQ ID NO: 226245 - DNA, 360 bp, Artificial Sequence
  Description of Artificial Sequence: Synthetic coding sequence
atggttagtaagctgtcacaacttcagacagagcttctggccgctctgctcgaaagtggactgagcaaggaagccctgatccaggctctcggagaaccagggccttacctccttgccggtgagggcccattggataaaggtgagagttgcggcggtggaagaggagaacttgccgagctgcctaatggcctcggagaaacgagaggtagcgaagacgagactgacgacgacggggaggactttacaccgcctattctgaaggaactggagaacctgtcacccgaagaggccgctcaccagaaggccgttgtggagactttactgcaggtacatccttgccgcgctggccgagccgactag

SEQ ID NO: 226246 - DNA, 1989 bp, Artificial Sequence
  Description of Artificial Sequence: Synthetic coding sequence
atggtatctaagctctcccagctgcagactgagctgttagccgctttactcgagagcgggctgagcaaagaggccctgattcaggccctgggtgaaccaggcccttaccttctggcaggggaaggaccactggacaaaggcgaatcttgtggcggtgggagaggcgaactagctgagctgcccaacgggctgggagaaacccgcggaagcgaggatgaaaccgatgatgacggtgaagattttactcctcccatactcaaggagctcgagaacctgagccccgaggaagctgctcatcagaaagcagtcgtggaaacactcctgcaggaagacccttggcgagtcgccaaaatggtgaaaagctatctacagcagcacaacatcccacagagggaggtagtggacacaactgggctcaaccaatcccacttatcccagcacctgaacaagggcactccaatgaaaacacagaaaagagccgctctctatacttggtacgtcagaaagcaacgggaggtggcacagcagttcacccatgctggtcaaggcggtctcatcgaagaaccaactggggatgaactccctaccaagaagggcaggcgcaacagattcaagtggggaccagcctctcagcagattctgttccaggcttacgagaggcaaaagaatccctctaaagaagagcgggaaacccttgtggaagagtgtaatagagccgagtgtatccagagaggagtgagcccgagccaggcgcaaggacttggcagcaacctcgtcaccgaagtgcgagtctacaattggtttgcaaacagacgcaaggaagaggcttttcgccacaaactcgctatggacacatacagcggccctccgccaggcccaggacccggtcccgcactgcctgcgcacagctcccccggattgccccctcctgccctgtctccatctaaggtccatggcgtgaggtacggccagcccgctaccagcgaaaccgccgaggtgcccagctcttctggagggcctcttgtaaccgtgtcaactccccttcaccaggtgtcccctactggcttagaaccatcccactcactgctgtcgacagaggctaaactggtgtctgcagccggagggccactccccccagttagtaccttaacggccttgcattctctggagcagacttcacccggtctcaaccagcagccacagaatctcatcatggcctctctgccgggagtcatgacaatcggtcctggcgagccagccagcctgggacccacttttactaataccggggcttctactttagtgatcgggctggcttccacacaggctcagagtgttccagtgatcaacagcatggggagcagcttaaccacactccagccagtgcagttcagccagccattacatccgtcatatcagcagccccttatgccacctgtgcagagccatgtgacgcagagcccttttatggccacaatggcccaactgcaatcaccacacgccttgtactcccataagcccgaagtggcacagtacacccacaccggccttctaccccagaccatgctgatcacagatacaactaacctcagtgctctggcttctctaacacccacaaagcaggttaggagcaggcccgctggacctcctctagcttgtgatcgcgcaccacatcctcatatccccagggcacaggaggcagcattacttccgcaggtgttcaccagcgacacagaggccagttcagagtctgggcttcacacacccgcaagtcaggcaacaacgttgcatgttccttcccaggaccctgctagcatacagcacctgcagccagctcatagactgtctgcctccccaaccgtgtcttccagctcgctggtcctgtatcaaagctccgatagcagtaatggccaatcacacttactgccatccaaccactcagtgatcgagacattcatctcgacacagatggcctcctctagccagtag

SEQ ID NO: 226247 - DNA, 744 bp, Artificial Sequence
  Description of Artificial Sequence: Synthetic coding sequence
atggtaagtaagctgagtcaacttcagaccgaattgcttgctgccttgctggagtctggcctaagtaaagaggcgctgatccaggcactcggggaaccaggcccttatttgcttgccggagagggacctttagacaagggagagagctgtggtggagggaggggcgagctggccgagcttcccaacggcctcggcgagactcgagggagtgaagacgagaccgacgacgacggcgaggatttcaccccacccattctgaaggagctcgagaacctgtctcccgaggaagctgcccaccagaaggcggtggttgagaccctccttcaagaggacccctggcgggtggcgaagatggttaagtcttatctgcaacagcataatataccccagcgtgaagtcgtggacaccactggcctgaatcagtcccacttaagccagcatctgaacaagggtactccaatgaaaacccaaaaacgggctgccctgtatacttggtatgtgcgaaaacagagggaggtggctcagcagtttacccacgctggccagggtggactcatcgaagaaccgacaggcgatgaactgcccactaagaaagggcgtcgcaatcggttcaagtggggacctgcctctcagcagatactgttccaagcctacgagcgacagaaaaatccctcgaaggaagagcgtgagaccttagtcgaagaatgcaataggtgcgcactctggacagcttgcgaccagtag

SEQ ID NO: 226248 - DNA, 1359 bp, Artificial Sequence
  Description of Artificial Sequence: Synthetic coding sequence
atggtgtcgaagctctctcaacttcagactgagctgctcgccgctttgctcgagagcggcctctcaaaagaggcactgatccaggccctgggtgaacccggaccctatcttctagcaggcgagggaccactggataagggggagtcatgtggagggggacgcggtgaacttgccgagctacctaacggtctgggtgaaacccgcggtagtgaagatgagaccgatgacgacggcgaggatttcactcctcccattttaaaggaacttgaaaacctctcccctgaggaggcagcccaccagaaagccgtcgtggagacgcttctgcaggaggatccctggcgcgtggctaagatggtgaaatcatacctgcagcagcacaatattccccagcgggaagttgtggacaccaccggactgaaccaatcacatctcagtcaacatcttaataagggcacccccatgaagacccagaaacgtgccgctctctatacatggtacgttagaaagcagcgagaggtcgctcagcagttcacccatgcaggacagggtggactgatcgaggagcctaccggcgacgaactccctaccaagaaggggaggagaaatcggttcaagtgggggccagcatcccagcagaccagcccgggtctcaaccagcagccccagaacctgatcatggccagcctacctggcgtgatgactatcgggccaggggagcccgcaagcctaggaccaacctttaccaacactggcgctagcactctggtgattggtctggcctccacccaggcgcagtcggtccccgtcatcaatagtatggggagctctctgaccacattacagccggtgcagttctcgcagccgcttcacccctcctaccagcaacctttgatgcctccagtccagtcccatgtcacccagtctcccttcatggccacaatggctcagctgcaatctccacacgccctgtactctcataagccagaggtggcccagtacacacacactggcctgctgccccagacaatgctgattaccgataccacgaatctgagcgctctggcctctctgactccaacgaagcaagtcttcacatctgatacagaagctagttccgagtctgggctgcacacacctgctagtcaggctacaactctgcatgtgcctagccaggatccagcgagtatccagcatctgcaaccggcacaccggctgtctgctagcccgacagtaagcagttcgtctctggtgctgtaccagtcctcagattcctcaaacgggcagtcacatctgctgccttcaaatcactcagtaatcgaaactttcatatcaactcagatggctagctcatcccagtag

SEQ ID NO: 226249 - DNA, 1212 bp, Artificial Sequence
  Description of Artificial Sequence: Synthetic coding sequence
atggtcaaaagctatctacaacaacacaacatacctcagcgagaagtcgttgatacaactggactgaaccagagtcatctgtcacaacacctgaacaaaggcacccccatgaaaacccagaagagggccgctttgtatacatggtacgttagaaagcaacgagaggtggcacaacagttcacccatgccggtcaaggaggactgattgaggagcctaccggagatgagctgccaacaaaaaagggaaggcgtaatcgctttaagtggggacccgctagtcagcagattctgtttcaggcatacgaaaggcagaagaatccctctaaggaggaaagagaaaccctggtcgaggagtgtaaccgcgcagaatgcattcaaagaggcgtctcgcccagtcaggcccaggggctgggaagtaatctggtaacagaagtccgtgtgtacaattggttcgccaaccggaggaaagaggaagcttttcggcataaactcgccatggacacatacagcgggccaccaccgggaccagggccaggcccagccctacccgctcacagcagcccagggctcccccctccggcacttagtcccagtaaagttcacggggtaagatacggacagccggcaactagcgaaaccgccgaggtcccttctagcagtgggggacccctggtgaccgtcagcactcctctgcaccaggtaagccctactggcttagagccctctcactcactgctttcaaccgaggccaaactcgtctctgcagcgggaggtcctttacctccggtgagcactctcacagctctgcactcgttggaacagacctcccccggactaaatcagcaaccacagaacctcatcatggcctcactacctggagttatgacgatcggcccaggtgagccagcttccttgggccctacttttaccaatactggtgccagtaccctagttatcggtaaactggtggggatgggtggacacctcggaggaaggctgatggggcagcctcaaaacccgggagccggaagagctactgggacccacagtttcattcatacgacgtgtatttacccggtaccaaccctcgatcaatccctttgctacatctccgatacgtgggtgaatcagacggaccagaatctctccaacagctcaagagaggccggaactaagcataacacttctattttatggtacttgagacggtag

SEQ ID NO: 226250 - DNA, 1185 bp, Artificial Sequence
  Description of Artificial Sequence: Synthetic coding sequence
atggtcagcaagctgagccagctccagaccgagttgctcgctgctctactggagtccggcctttccaaggaggcgctgatacaagcactgggagaaccagggccatacctgctagctggagagggacccttagacaagggggaaagttgtggtggcggtcggggtgaactcgcagaattgcccaacgggctgggagaaacgagggggagcgaggacgagacagacgacgatggtgaagatttcacaccacctattctcaaggaactggagaatctgagtcctgaggaggccgcacaccagaaggcggttgttgagacactgctgcaggaggatccctggagggtcgcaaagatggtgaagtcctacctgcagcagcacaacattccccaacgcgaagtggtggacacaacagggctcaaccagagtcatctgagccagcatttgaacaagggtactcccatgaaaacgcagaaaagagcagccctgtatacatggtatgtacgtaaacagcgcgaagtggcccagcaatttactcacgcaggccagggcggtctaattgaggaacccacaggagacgagctccctaccaaaaagggcaggagaaatagattcaagtgggggcctgcgtcccagcagatactgtttcaggcctacgagagacagaagaaccccagcaaagaagagagggagactctggtggaagagtgcaacagggcagagtgtatccagcggggagtgagcccttcgcaggcccaaggcttgggttcaaatctggttaccgaagtgagagtgtataattggttcgccaatcgtcggaaggaggaagccttccgacacaaactggccatggacacatacagcggtccaccaccaggtccgggaccaggccctgcgttgcccgcacactcctcgcccggactgccacctcctgcactcagcccttccaaggttcacggggtgaggtacggacagcccgctacgagcgagacagcagaagttcctagctctagtggaggacctcttgtgacggtgtcaacacccttgcatcaggtgtcccccacagggctggagcccagtcactcgctgctgtccactgaagcgaagcttgtgagtgccgctgggggaccacttcccccagcagcctgtagccagccagggagagtcgcgagactttttaacttctag

SEQ ID NO: 226251 - DNA, 1917 bp, Artificial Sequence
  Description of Artificial Sequence: Synthetic coding sequence
atggtttctaaactttcccagctacagactgagctcctcgctgccctacttgaatcaggactttctaaggaagccttgatccaagcattgggcgaacccggtccatatttactggccggtgaggggccacttgataagggggaatcctgcggaggcggaaggggagagctggctgagctgccaaacggcctgggagagacacggggtagcgaggatgagactgacgatgacggcgaggactttacaccccctatcctgaaggagctggagaacctctcacccgaggaagcggctcaccagaaagcggtggttgagaccttactacaggaagacccatggcgcgtggctaagatggtgaagtcttatctgcagcagcacaacattcctcagagagaggtggtggacacaacagggcttaatcagtcacacttaagccagcacctgaacaagggtacacctatgaaaacccagaagcgggcagccctatacacctggtatgtgcgcaaacagagggaggtggcccagcagtttacacatgccggtcaggggggattgattgaggagccaaccggggacgagctgcctactaaaaaaggtcggcgaaaccggtttaaatggggaccagcatcacagcagatcctatttcaggcttatgagcgacaaaagaatccctctaaggaggaacgagaaacccttgtagaggaatgcaatcgtgccgagtgcatacagagaggcgtgtctccgagtcaagcccaagggctgggatctaacctggttacggaggtgagagtctacaactggtttgcaaatcggaggaaagaggaagcgtttagacacaagctggccatggacacgtactccggcccacctccaggcccaggtcctggacccgctctacccgctcacagtagccccggtttgccaccccctgcactctcacccagtaaggtccacggtgtccggtacgggcaaccggctacctccgagacagctgaggtgccatcaagcagtggtgggcctctggtgaccgtgtccacgcccttgcaccaagtgtctcctaccgggctcgagccttcacatagtctcctctctactgaggcaaaactggtctccgctgccggtggacccctgccccctgtatctaccctgaccgccctgcactctctggaacagacgtcaccgggtctgaatcagcagcctcaaaacctcatcatggcctcgctgccaggggtaatgactatcggacccggtgaaccagccagcctgggcccaaccttcacaaacactggagcttcaaccctggttataggcttagcgtcaactcaagcgcagtctgtgcccgtaataaatagcatggggagttctcttactaccctacagcccgtccagtttagccaaccccttcacccttcctatcagcaaccgctgatgccacccgtccagtcccatgtgacgcagtcaccctttatggccacaatggcccagctgcagtctccacacgccctttacagccacaagcctgaggttgcccaatatacccataccggcctactcccgcagaccatgctcataaccgacacaacaaaccttagcgccctcgcttcccttacccctaccaagcaggaggcagctctcttgccccaggttttcaccagcgacacagaagctagtagcgagtctgggctgcatactccggcatcgcaggcaacaaccttgcacgtgccctcccaggaccctgccagtattcaacatctacagcccgcacacaggctgtcagctagccccactgtttccagttcaagcctggtgctgtatcagtcctcagattcatccaatgggcaatcgcatcttctgccttcaaatcactccgtaatagagactttcataagcactcagatggcatcttcatcacagtag

SEQ ID NO: 226252 - DNA, 1416 bp, Artificial Sequence
  Description of Artificial Sequence: Synthetic coding sequence
atggtatctaaactgtctcagttgcaaacagagctacttgccgctcttttagagtccggcctcagtaaggaggccttaattcaggcccttggagagccaggtccttacctgttagccggtgaggggccactggacaagggtgaatcttgcggagggggtaggggtgaactggcagagctccccaatggcctgggagagactagaggtagcgaggacgaaaccgacgatgatggtgaggactttacccctcccatcctcaaggagcttgaaaacctgtcaccagaagaggcagctcaccaaaaagcagtagttgaaacccttctgcaagaggacccgtggagggtggccaagatggtaaagtcctacctccagcagcacaatatccctcagcgcgaagttgtggacactacaggtctcaatcagtcacacctgtctcagcacctaaataaaggtactcccatgaaaacccaaaagagggccgctctttatacctggtatgtcagaaaacaacgagaagtcgcgcagcagttcacgcatgctggccaggggggactgattgaggagccgacaggggatgaactgccgaccaaaaaaggcaggaggaaccggtttaaatgggggccagcttctcagcagatattgttccaggcttacgagagacaaaaaaacccaagtaaagaggaaagagagaccctggtggaagagtgtaaccgagccgagtgcatccagaggggggtctccccatcccaggcccagggtctcggcagcaacctcgttactgaggtacgagtgtacaattggttcgcgaacagaaggaaagaagaggcatttcgtcataagttggctatggacacatactctggtccgccaccgggaccgggaccagggcctgccctcccagcccattcatcacccggactcccccctcccgctctctccccctctaaggtccacggcgtgagatatggacagccggcaacttccgagacagccgaggttcccagttcctccggcggtccattagtcacagtatctacacccttacaccaggtgagcccaacaggtctggagccatctcatagcctgctgtctaccgaggccaaacttgtgtcagccgcaggtggcccacttcccccagtctcaaccttaacagctcttcacagcctggaacagacctcaccgggtctgaaccaacaacctcagaacctgattatggcttctttgcccggagtgatgaccatcggtccaggggaacctgcctcacttggcccaaccttcacaaacacgggtgcttccacactggtaattggactggcatccacccaggcccagtctgtgcctgtgatcaattcaatgggctctagcctcacgacacttcagcccgtgcagtttagccagcagggacctagctcctag

SEQ ID NO: 226253 - DNA, 1359 bp, Artificial Sequence
  Description of Artificial Sequence: Synthetic coding sequence
atggtgagcaagctgtctcagctgcagaccgagttgttggcagctctgttggaaagcggcctatcaaaagaggccctgatacaggctcttggcgagcctggtccctatctgctcgcaggtgaggggcctcttgataagggagagtcctgtggaggcggacgcggtgaactcgccgagctgcctaatggcctgggggagacccgaggaagtgaagacgagaccgacgacgatggcgaagactttacgccacccatcctgaaggaattggaaaaccttagccctgaggaagcggctcaccaaaaagccgtggtagagacgctgctgcaggaggatccttggagagtagcgaagatggtaaagagctatctgcaacagcacaacataccccaacgtgaggtggtggataccactggactgaaccaatcgcatctgtcgcaacacctaaacaaaggaacacctatgaaaactcagaaacgtgcggctctgtatacatggtacgtgagaaagcaacgagaggtcgcgcagcagtttacgcacgcaggccagggtggactgatcgaggagccaaccggagatgagcttccaacaaaaaaagggagacgtaacagatttaaatgggggccagccagccagcagattctcttccaagcgtacgagaggcagaagaacccttctaaagaggaaagggaaacacttgtggaagagtgtaatagagcagagtgtatacaaaggggagtgtctcctagtcaggcacaggggctggggtcaaacttagtcacagaagtccgggtatataattggttcgccaatagaaggaaggaggaagcgttcagacacaaacttgccatggatacatactctggccctcctccgggacctggccctggtccagcactgcccgcacacagctcccctggattacccccacctgcactgagtccctccaaggtgcacggcgtgcgttatgggcagcctgctacctcggagaccgccgaggtgccgtcaagttctggcggtccactcgtgaccgtctccaccccattgcatcaggtctctccaacagggcttgagccttcccattcactgctgagcactgaggcgaaattggtatctgcggcaggagggcctttgcccccagtgtccacacttaccgcccttcactctctagaacaaacgtctccgggtctgaaccagcagccccaaaacctgattatggcgtctttgccgggagttatgactatcgggccaggcgagcccgcaagcttagggcctacttttacaaatacaggcgcttccacacttccactattcggagctggggtggcagagctcacgcggcagcagggacccagtagctag

SEQ ID NO: 226254 - DNA, 1071 bp, Artificial Sequence
  Description of Artificial Sequence: Synthetic coding sequence
taatggctggtcgggttttggggcggtagtgggtgcaaggagtttggcctgtgcttgccagctggccgacaaacccaacccaccaggtggggcaggaggctggcttggtggacaagggctgcatggccatgtgggagccgggcaatggtctcaaaactttctcaactgcagacagagctgctggctgccctgttggagagtgggctaagtaaggaggccctgatccaggccctcggcgagcctggcccatacctgctggcaggcgaaggacctctggataagggagagtcctgcgggggtggccgtggcgagctggcagaactgcccaatggcttaggggagacacggggttcagaggacgagactgacgacgatggcgaagattttacgccccctatccttaaggagctggaaaacctatcgccagaggaggccgcacatcagaaggccgtggttgagactttgttgcaggaggacccttggcgggtagctaagatggtcaaatcttacctccagcagcataacatcccccaacgagaggtggttgacaccactggcctgaatcagtcacacctctcacagcacctgaataaagggaccccaatgaagacgcagaagcgggctgctctgtacacctggtatgttaggaagcagagagaagtggcacaacagtttacccacgctggccaggggggattgatcgaagagccaactggggacgaactgccaacaaagaaggggagaaggaataggtttaaatggggacctgcaagtcagcagattctgttccaggcttacgagaggcagaaaaatccttctaaagaggagagagaaaccttagttgaggaatgtaaccgggcagaatgcattcagaggggagtttccccaagccagccacaacccgcagagtaccgcagccaggctgggttaagtagctggggtcctcctcctccctgccagcaccctgactcaaccgcccagctgggcgcagatatccctcgccctcagccagcagctcccgaaccccaccacggtctcacttcctggggccatgatcaccgcgcttggtag

SEQ ID NO: 226255 - DNA, 2247 bp, Artificial Sequence
  Description of Artificial Sequence: Synthetic coding sequence
atgctcggtactctgagggctatggagggagaagacgtcgaagacgaccagctgctgcagaaattgcgggcatcccgcaggcgcttccagcgcagaatgcagagattgattgagaagtataatcagccatttgaagacacccccgtggttcagatggcgacattgacttacgagacaccccagggcctgaggatatgggggggacgcttgatcaaggagcgtaatgagggggaaattcaagattcatcaatgaaacctgctgatagaacagacgggtccgttcaggctgctgcctggggccctgaactgccctctcatcgtaccgtgttgggcgctgactcgaagtccggcgaggtcgacgccacatcagaccaggaagaaagcgtcgcgtgggctctggcccctgccgtgccccagtcccccctgaagaacgagctccggcgtaaatacttgacacaagttgacattcttcttcagggcgcagaatactttgagtgtgctgggaacagagctggtagagacgtgagagtcactccgctgccatctctcgcgtctcccgctgttcccgctccaggctattgttccaggatcagtcgcaaaagcccaggcgaccccgcaaaacccgcaagctcaccaagagagtgggaccctttacacccatcttccactgatatggccttggtcccccgtaatgactccctctccctccaggaaacctcctcaagctccttcctgagcagccagccgtttgaggacgatgacatctgcaacgttaccataagcgacctctacgcagggatgttgcatagcatgtccagattactatccactaaacccagttccataattagcactaagacgttcatcatgcagaactggaacagccggaggaggcacagatataaaagccgcatgaacaagacttactgcaagggcgctcgcagatctcagaggagttccaaggagaacttcattccctgcagtgagccagtcaagggcacaggggcactgagagactgtaagaacgtcttggacgtcagctgcagaaaaaccgggctgaagctggaaaaggcctttctggaggtgaatcgtccacagatccataagctggacccttcatggaaggaaaggaaagtcacaccgagcaagtattcgtcccttatctattttgactcttctgccacctataatctagacgaggaaaatcggttccgaaccctgaaatggctcattagccctgtgaaaattgtcagccggccaaccatacggcaaggtcatggcgagaatcgccagcgcgaaatagaaattcgctttgaccagctgcaccgggaatactgcctgtccccaaggaaccagccgagaaggatgtgtctgcccgactcttgggctatgaatatgtatcgcggtggcccagcatcaccagggggtctgcagggtcttgagaccagaagactctctctgccctctagcaaagccaaggcaaagtctctgtccgaagcttttgaaaacctcggaaaaaggtctcttgaagctgggcgttgcctgcctaaaagcgactcatcgtcctctctcccgaagaccaacccgacccatagcgctacccgaccccaacagaccagcgatctgcacgtccaaggaaattcttctggcatcttccggaaaagtgtgtccccctcaaaaaccttgtcagtgcccgacaaggaagttcctggccacggtaggaatcgttatgatgagatcaaggaggagtttgataagctgcatcagaaatattgtctgaaaagccctggacagatgaccgtgcccctctgtatcggagtcagcacggataaggccagtatggaggtgaggtaccagactgaggggttcctcggtaaactgaaccctgatccccactttcaagggtttcagaagctgcccagttcaccacttgggtgccgcaaatctctgttggggtcgacagctatagaggcaccgtcgtccacctgcgtggctcgggctatcacacgcgacggcacccgcgatcaccaattccctgccaaacggcctcggttgagcgagccccagggttcaggcagacaggggaacagtttgggtgcttcggacggagtcgataacaccgtgcgtcctggtgaccaggggtcatcttcacaaccaaattcagaggaaagaggggaaaacacctcctataggatggaggaaaaatcagacttcatgctagaaaaattggaaaccaagtctgtgtag

SEQ ID NO: 226256 - DNA, 2085 bp, Artificial Sequence
  Description of Artificial Sequence: Synthetic coding sequence
atgctaggcaccctgcgtgctatggagggggaggatgttgaagacgatcaacttctgcagaaactgagagcgtcccgtagaagattccagcggcgaatgcagagactaatcgagaagtacaatcaaccttttgaagacactcccgttgtacaaatggccacgctgacatacgaaactcctcaaggcttgaggatttggggcggtagattaataaaggagcgcaatgagggagagatacagcctgcggttcctcagtcacctctcaagaatgagctacggagaaaatatctgacccaggttgacatcctattacagggggcagagtacttcgagtgtgccggaaatagggccggacgggacgtaagagtcacaccactgccgagtctggccagccccgctgtgcccgctcccggatattgctctcgcattagccggaagagcccaggcgatccagcgaagccggctagtagcccccgtgagtgggatccactgcaccccagctccaccgatatggcactcgtgccacgtaacgacagcctgtcacttcaggagacttcatcctcatcctttctgtcgagtcagcctttcgaggatgacgatatctgtaatgtcacaatttccgatctgtatgcaggcatgctgcacagtatgtccaggcttctgagcaccaaacctagtagcattatctcaacaaagacgttcatcatgcagaattggaacagcaggcggaggcatcgctataagagtcgaatgaataagacttattgtaagggagcacggcgatcccagaggtcatctaaggagaacttcatcccctgtagtgagcccgtgaaaggtaccggcgctctccgcgattgcaaaaatgttctggacgtcagctgcagaaagactggcttgaagctggaaaaggccttcctcgaggtgaaccgcccacaaattcataagctagacccctcctggaaggaaagaaaggtgaccccgtctaagtactcttcccttatttatttcgactcaagcgccacttacaatttagacgaagagaaccgttttcgcacactgaaatggctaatcagtccagtcaaaatcgtgtcacgccctacaatcagacaagggcacggggaaaaccggcagcgcgaaatcgagattaggtttgaccagctgcaccgcgagtattgtcttagccccaggaatcagccacggcgaatgtgtctccccgacagctgggctatgaatatgtatcgcggaggtccagcctcaccagggggacttcagggcctagaaactaggagactaagcctaccctcttctaaagcgaaggccaagtcattgtctgaggcctttgaaaatttgggaaagcgaagtttagaggccggtagatgcctgcccaagtcagactcttcctcctccttacctaagacaaatcctactcatagcgcaacgaggcctcagcaaacatctgatctccacgtacaaggcaactcctcgggtatctttcgcaagtcagtaagccccagcaagacccttagtgtccccgataaagaagtgcccggacacggcaggaacaggtatgatgagattaaggaagaatttgacaaactgcatcagaagtattgcctgaagtcacccggacagatgacagttcccctttgtatcggtgtgagtactgataaggcatccatggaggtgcggtaccagactgaaggattcttgggcaaactcaatccggatccgcatttccagggctttcaaaaactgccatcatctccgctgggatgtaggaaatctctcctcgggtcaactgccattgaagctccatcatcaacctgcgtagcccgagctatcaccagggatggtacaagggaccaccaatttcctgcaaagcggcctagattatcagagccccagggttcaggcaggcagggtaattcactcggcgcatccgatggcgtcgataataccgttagacctggcgatcaggggtctagctctcagcctaactctgaggaacgaggcgaaaacacaagctatagaatggaggagaagagcgatttcatgctggagaagctggagactaaaagcgtgtag

SEQ ID NO: 226257 - DNA, 1992 bp, Artificial Sequence
  Description of Artificial Sequence: Synthetic coding sequence
atgttgggtactctgcgcgcaatggaaggagaggacgtggaagacgatcagctgctccaaaagctacgagcaagcagacgaaggtttcaaagaagaatgcagcgtctaatcgaaaaatacaatcagccattcgaggacactccagtcgttcagatggccactctaacgtatgagacccctcaggggctccgcatctggggcggtcgtctcatcaaggaacgcaacgagggcgaaattcagtgcgctggcaaccgtgcaggcagggatgtgcgcgtgacccctctgccatccctcgcatctcctgccgtgccagccccagggtactgtagcaggatctcacggaagtccccaggggaccccgcaaaaccagcaagctccccccgagagtgggaccctcttcacccctcaagtacggacatggccctcgttcctcggaacgactcgctgtccttgcaggagacttcctctagttctttcctgtcaagccaacccttcgaagatgatgacatttgcaacgtcactatatctgacctatacgccggaatgctccattcaatgtcccggctcctgagcactaaaccgtcaagtatcatctcgactaagacctttataatgcagaactggaactccaggcgccgacacagatacaaatccaggatgaataaaacttactgcaagggggcaagaagatcccagaggtcttcaaaagagaacttcattccgtgtagcgaacccgtgaagggcaccggggctctccgcgactgcaaaaatgttctggatgtttcctgtcggaaaaccggattgaaactggagaaggcctttctggaagtcaataggccgcagattcacaagcttgatccaagttggaaagagcgcaaggtcactcctagtaagtactccagtctcatatactttgattcaagcgccacttacaatctggatgaggaaaaccgctttcgcaccctaaagtggctgatttcgcctgtaaagatcgtgtcccgtccgaccatcaggcaaggacacggggagaataggcaaagggaaatcgagatccgctttgatcaattgcaccgcgagtactgtctctctccaaggaaccagccacgacgcatgtgtctgcctgattcttgggctatgaacatgtacagaggaggcccagcctctcccggaggcctacagggcctcgaaacacggaggctgagcctgccaagtagcaaagccaaggcgaagagcctgagtgaggcctttgagaatctgggcaaacggagtctcgaagccggacgctgcttaccaaagagtgactcgtccagtagcctgccaaaaaccaatccaacacactccgctacgaggcctcagcagacaagcgatcttcacgtgcagggaaactcttctggaatatttcgaaagagcgtttccccatctaagacactgagtgtgcctgacaaagaggtgccaggtcacgggagaaaccgctacgacgaaatcaaagaggaattcgacaagcttcaccagaagtactgtctgaagtctccaggtcagatgacagtgcctctgtgcatcggcgtgtctactgacaaagcctctatggaggtccgatatcagactgaaggctttctcggtaaactgaatcctgatccacacttccagggtttccagaaattaccctcatcccccttaggatgccggaaaagcttgctcggatctacggccatcgaggcaccatccagtacttgtgtcgccagggcaataacgagggacggaacccgagatcaccagtttccggctaaaaggccacgcctctctgaaccgcaagggtctggacggcaaggtaattcactgggtgccagtgatggcgtggataacactgtgaggcctggcgaccagggctcttcatcccaacccaatagcgaggagcgaggggagaacacgagttataggatggaagagaagagcgatttcatgctcgaaaagctcgagactaagagtgtgtag

SEQ ID NO: 226258 - DNA, 2181 bp, Artificial Sequence
  Description of Artificial Sequence: Synthetic coding sequence
atggaagaccgcctgcacatggacaatgggctggtccctcaaaaaatagtgtctgtacatcttcaagatagtacactgaaggaggtcaaggaccaggtgtccaataaacaggcccagattcttgaacctaaaccagaacctagcctggaaatcaaacctgagcaggacgggatggagcatgtggggagggacgatcccaaagcccttggggaagaaccaaagcaaaggagaggcagcgcatccggcagcgaacctgccggagactccgacaggggcggtggaccagtggagcactaccatctgcacctgtcaagttgccacgagtgtcttgagttggaaaatagcacaatcgaatcggtgaagttcgcatcggcagagaatattccagaccttccctacgactacagctcctccctcgagagtgtggcagatgaaaccagccccgaaagagaagggaggagagtcaatctaaccggaaaagctccaaacatcttactgtacgtggggtcagactcccaggaggcgctgggcagattccacgaggtgcggtcagtgctggccgactgtgtggacatcgattcttacatactgtatcaccttctggaggactcagctcttcgcgatccgtggaccgataattgtttgctgcttgtgatagcgactcgggagagcatccctgaagacctctatcagaaattcatggcttatctgtctcagggagggaaagtgcttggccttagcagtagctttacattcggtggcttccaggtcacaagtaagggcgctctacataaaacagtgcagaatttagtgttttctaaagccgatcagagtgaagtgaagctttccgtcttaagttcagggtgcagataccaggaaggcccagtgagactctcaccaggcaggctgcagggtcacctcgagaacgaggataaagatcggatgatagtgcacgtgcctttcggtactagggggggtgaagctgtgttgtgccaggtgcacctggaactgccacctagcagtaacatcgtgcaaactcctgaggatttcaacctcctgaagagctctaatttccggagatatgaagttttgagagagatcctcaccaccctcggactttcatgtgacatgaaacaggtgcccgcactcaccccgctgtatctgctgtctgccgcagaggaaattcgggacccgctgatgcagtggcttggtaaacacgtggacagcgaaggggaaatcaagagcggtcagctgagtctccgatttgtttcctcctacgtcagcgaagttgagatcacaccctcttgtatccccgtggtgacaaacatggaggccttttcaagtgagcatttcaacctggagatatacaggcagaacctgcagaccaagcagcttggaaaggtgatcctgtttgctgaagtgaccccaacaactatgcggttactggacggcctgatgttccagacgcctcaggaaatgggtctaatcgtgatcgccgcaaggcagacagaaggaaagggacgcggaggcaatgtttggctgtcccccgtgggctgtgccctctccacactgctcatctccattcctcttagaagccaattgggccaaaggattccctttgttcagcacctcatgagcgttgccgtggtggaggccgtgcgatcaatacctgaataccaagacatcaacctgcgagtgaagtggcccaatgacatctattactccgacctcatgaaaattggcggagtcctggtcaactctacgctgatgggcgagacattttatatcctgattggttgtggcttcaacgtgacaaactccaatccaacaatctgcatcaatgacttaatcacagagtataataagcaacacaaagcagagctcaagccattgagggctgattatcttatcgcccgagtggtcactgtgttagaaaagcttattaaggagttccaggacaagggccctaactcagtgctccccctgtattatcggtactgggtgcattcagggcagcaggtccacctggggagtgcggaaggccctaaggtctcgatcgtcggactcgatgattctggattcctccaggttcaccaagagggaggagaagttgttaccgtgcatcccgacggtaactcctttgatatgctacgcaatttgatactgccaaaaaggcggtag

SEQ ID NO: 226259 - DNA, 2181 bp, Artificial Sequence
  Description of Artificial Sequence: Synthetic coding sequence
atggaagaccggcttcatatggacaacgggctggtaccacagaaaatcgtgagcgtgcacctccaggattctactctgaaggaggtcaaggatcaagtgtcaaataagcaggcccagatcttggagcccaaacctgagccaagtctggaaattaagcctgagcaggatggaatggagcacgtaggtcgggacgatccaaaggcccttggggaggaacccaaacagcggaggggatccgcctcagggagtgaaccagcaggggacagtgacagagggggaggcccagtggagcattaccacctccacctgtctagctgtcacgagtgccttgagctcgaaaattcaactatcgagtctgtaaagttcgcaagcgccgagaacatccccgacctgccctacgactattccagttctctcgagagcgtggccgacgagacaagccctgagcgcgagggcaggcgtgttaatctgacaggtaaggcacccaatatcctgctctacgtggggagcgacagccaagaagcgctgggacgatttcatgaggtaagatccgtgctggctgattgcgtggacattgactcttatatcctgtaccatctcctggaggactctgccctccgggacccctggacagacaattgtctgctgctggttatcgcaacaagggagagcattcctgaagacttatatcagaagttcatggcctatctgtcccagggcggaaaggttttaggactgtcgtcttcctttacattcggaggcttccaggtaacgagcaagggagcactgcataaaacagtccagaacctggtgttctccaaggctgaccagtctgaggtgaaattgagtgtgctttcctcgggctgccgttaccaagagggacctgttcgattgtcccctggccgtttgcagggtcacctcgagaatgaggataaagacagaatgattgtccacgtgcccttcggaactcgcggtggagaggctgtcttgtgccaggtacatctcgagctaccccctagttcgaacatagtgcagacccctgaagatttcaatcttctgaagtcctccaacttccgtagatacgaagttctcagggaaatcctaacaaccctgggactctcttgtgatatgaaacaggtgcctgccttgactcctctgtacctccttagcgccgctgaagagatccgcgacccgctgatgcagtggctggggaagcatgtggactccgagggagagattaaatcagggcagctgtctctgaggtttgtgagcagttatgtctcagaggtagagataacacccagctgcattccggtggtgacaaatatggaggcctttagctcggaacatttcaacctcgaaatctatcgccaaaacctccagacaaagcagcttggaaaagtcattttgttcgccgaggttactcctaccactatgcgactgctagatggcctgatgttccaaactcctcaggagatggggctgatcgtcattgctgcacgacagaccgagggcaagggaagaggcggtaatgtgtggctatctcctgtgggatgcgcattaagtactctgctgatttcaattcctctgcgttcacagcttggccagaggattccttttgtccagcacctcatgtcggtcgcggtggtagaggctgtcaggagcatcccggagtaccaggacatcaacctgagagtgaagtggccaaacgatatttactacagtgatctgatgaagattggcggagtgctggtaaactcaaccctaatgggcgagactttttatattctgatcggttgcggattcaacgtcaccaattccaacccaactatctgcattaacgatttgattacggaatacaacaaacaacacaaagccgaactgaagcccctccgggctgactacctcattgcgagagtggtgacggtgctggagaagctgataaaagaattccaggataaaggacctaactccgtgcttcccctctattataggtattgggtccatagcggccagcaggttcatctcgggtccgccgagggtccaaaggtgagcattgtaggtctggacgattcaggcttcctccaggtgcatcaagagggaggcgaggtggtcactgttcaccctgacggcaattctttcgatatgctacgcaatttgattctgccaaaaagacgatag

SEQ ID NO: 226260 - DNA, 264 bp, Artificial Sequence
  Description of Artificial Sequence: Synthetic coding sequence
atggaggaccgtttgcatatggacaatgggttggtgcctcagaagatagtaagcgtccacctccaggacagtacgctgaaggaagtgaaggaccaggtgagcaataaacaggcacagatactagagccgaagccagaaccctctcttgagataaagccggagcaggacgggatggagcacgtgggcagggacgatcctaaagcactgggggaggaacccaaacagcgtcgaggcagtgcctccgggagtgaaccagctggatag

SEQ ID NO: 226261 - DNA, 234 bp, Artificial Sequence
  Description of Artificial Sequence: Synthetic coding sequence
atggaggaccgcctgcacatggataatgggctggtcccccaaaagatagtttcagtgcacctgcaggactccacccttaaagaagtgaaggaccaagtaagcaataagcaggcacagatcctcgagcctaaacccgagccatcccttgaaattaagcccgaacaagatggcatggagcacgtaggaagggacgatcctaaagccctgggggaagagccaaagcagaggagatag

SEQ ID NO: 226262 - DNA, 279 bp, Artificial Sequence
  Description of Artificial Sequence: Synthetic coding sequence
atggaagaccgcctgcatatggacaacggactggtgccacagaaaatcgtttccgtgcatctacaagattctacactcaaagaagtcaaggatcaggtatctaacaagcaagctcagatccttgaacccaagccagaaccctccttggagatcaagcctgaacaggacgggatggagcacgtgggacgagacgaccctaaggcactgggcgaagaacctaagcagcgacgtggctcagcctctggatctgagcccgcaggcgattccgaccggggatag

SEQ ID NO: 226263 - DNA, 807 bp, Artificial Sequence
  Description of Artificial Sequence: Synthetic coding sequence
atgggtttgtccccgtccgctcctgcggtggccgtccaggcttccaacgctagcgccagtcccccatccgggtgtccaatgcacgaaggcaagatgaagggttgcccagtgaacactgaaccaagtggacccacctgtgaaaaaaagacctactcagtccccgctcaccaggagcgagcctatgaatacgtagaatgtccaattcggggaacagccgctgagaataaagagaaccttgatccatcaaacctgatgccacctcctaatcagacgccagcaccagaccagcctttcgcccttagcactgtccgggaggaaagttccatccccagagctgacagcgagaagaagtgggtgtacccaagtgagcagatgttttggaatgccatgctgaaaaagggttggaagtggaaggacgaggacatttcgcagaaagatatgtataacatcatccgcatccacaatcagaacaacgagcaggcctggaaggagattctgaagtgggaagccctccatgcggcagagtgcccctgtgggccatcactgattaggtttgggggtaaggccaaagagtattctcccagggcacgcatccgtagctggatggggtatgaactgccttttgatagacatgactggattatcaatcgctgtggaacagaagtccggtatgtcatcgattactatgatgggggagaagtcaacaaggattaccagttcaccattttggacgtccgtccggcattagacagtctgtctgccgtatgggaccggatgaaggtggcctggtggagatggacctcatag

SEQ ID NO: 226264 - DNA, 807 bp, Artificial Sequence
  Description of Artificial Sequence: Synthetic coding sequence
atgggcctgagcccaagcgctccagcggtggctgtccaggcttctaatgcttcagcaagcccaccttctgggtgtcccatgcacgaggggaagatgaagggttgccccgttaacacagaacccagcggcccaacttgcgagaagaaaacgtattctgtccctgcccaccaggaacgtgcctatgaatatgtcgagtgccccattcgcggaacggccgcagaaaataaggaaaatctagaccctagcaatctgatgcctccccctaatcaaacccccgctccggaccagccttttgccttgtccacagtgcgcgaggagagtagtattccgagagcagattctgagaagaagtgggtctacccgtccgagcagatgttttggaacgcaatgcttaagaaggggtggaagtggaaggacgaagacatctcccagaaagatatgtataacatcatacgtattcacaatcaaaataatgaacaggcctggaaggagatcttgaagtgggaggcgctccatgccgctgagtgcccatgtggcccttccttgattagattcggaggtaaagccaaggaatattctccaagagcaaggatccgcagctggatgggttatgagcttccgtttgacaggcacgattggattattaacagatgtggcaccgaggttagatatgtgattgactattacgacggaggcgaggtgaacaaggattatcagtttacaatactggacgtgcggcctgcgctcgattctttgagcgctgtatgggacaggatgaaagtcgcttggtggcgatggacctcctag

SEQ ID NO: 226265 - DNA, 807 bp, Artificial Sequence
  Description of Artificial Sequence: Synthetic coding sequence
atggggttgtctccctcagcacctgccgtggctgtgcaggcgtccaacgcctcagctagccctccaagtggatgcccaatgcatgaaggtaagatgaaaggatgcccggtcaacaccgagccatcaggcccaacctgtgaaaagaaaacatacagtgtgcccgctcaccaggaaagagcgtacgagtatgtggagtgtcccatccggggtaccgccgcagaaaataaagaaaatctggatcctagtaatttaatgccaccacccaaccagacacccgcacctgaccaaccttttgccctttctaccgtgcgagaggaatcatccatcccacgcgctgacagcgagaaaaagtgggtttatccctctgaacaaatgttttggaatgcaatgctgaaaaaaggatggaaatggaaagacgaagatatctctcaaaaagatatgtacaacatcattcgaattcataaccagaataatgagcaggcttggaaggagatcctaaagtgggaagctctgcacgccgcagaatgcccctgcggaccaagtttgatccggttcggcggaaaagctaaggagtacagcccaagagcccgaattcggtcatggatgggctatgagttgcccttcgacagacacgattggattataaatcgatgcggcaccgaagtgcgatacgtgatcgattattatgatggtggagaggtgaacaaggactatcagtttaccattctggatgtgaggccggcactggattcactgtctgcagtgtgggacaggatgaaggtggcatggtggcgatggacatcttag

SEQ ID NO: 226266 - DNA, 1008 bp, Artificial Sequence
  Description of Artificial Sequence: Synthetic coding sequence
atggacaatgccaggatgaactccttcctggagtatcccatcctctccagcggcgatagcgggacctgctccgctcgggcataccctagcgaccatcgcatcaccacattccaaagctgtgcggtgtccgcaaacagctgcggaggtgacgatcgatttctcgtcgggcgtggagtgcaaatcggctctccgcaccaccatcaccaccaccaccaccgacacccccagcctgccacatatcagactagcggcaaccttggagtgtcttattcacactcctcatgtggtccaagctatggtagccagaattttagcgctccgtattctccatacgcgctgaatcaggaggctgatgtctcagggggttaccctcagtgcgctccagctgtctattctggcaatttgtcctctcctatggtccaacatcatcaccaccaccaaggttacgccggaggggctgtaggatctccacagtacatccatcacagctatggccaagagcatcaaagtctcgctttggctacatacaacaactccctgtcacctctccacgctagccatcaggaagcctgtcgttcacccgcttcggagacctcaagccccgcacaaacctttgactggatgaaagtgaagcgcaaccctcctaagacagggaaagtgggggaatacggatatcttgggcagccaaatgccgtccggacaaattttacgaccaagcagctcactgagctggagaaggagtttcactttaacaagtatctcaccagagcacgacgggttgaaatagctgcttcgcttcagttgaatgagacccaagtcaagatctggttccagaataggagaatgaaacagaaaaagcgagagaaggagggcctgttgccgatctcacccgcaactcctcctggaaatgacgaaaaggcggaggagtctagcgaaaaatcctcctctagcccatgcgtgccttcccccggatcctcaacctcggacaccctgacaacctcccactag

SEQ ID NO: 226267 - DNA, 414 bp, Artificial Sequence
  Description of Artificial Sequence: Synthetic coding sequence
atggacaatgcccgaatgaacagctttctcgagtaccctattctgtctagtggcgattcaggaacctgctcggcgcgtgcatacccatccgatcataggattaccacctttcagtcttgcgccgtctctgcaaatagctgtggaggcgatgatcgcttccttgtgggtcgtggagtgcagattggctccccccatcatcaccaccatcaccatcaccgacacccacagccagcgacttatcaaacctctggtaatcttggtgtttcgtatagccacagttcatgcgggccaagctacggttcacaaaactttagcgctccatacagcccttatgccctcaatcaggaggccgaccccccacgttccctgtctcttccacgcattggtgacatcttctctagtgccgacttctag

SEQ ID NO: 226268 - DNA, 1233 bp, Artificial Sequence
  Description of Artificial Sequence: Synthetic coding sequence
atgtctgccaggaaaggctatttactcccatccccaaattatccgacgacgatgagctgcagcgagtcgcctgctgcgaattcatttttagtggactctctgatttcgagtggcaggggggaagccggaggaggcggaggaggtgctggaggcggtggtggagggggttattacgctcacgggggagtgtatttacccccagcagccgatttaccgtatgggctgcaatcttgcggcttattcccgacattgggaggcaaacggaatgaggcagcctctcctggatctgggggagggggaggcggactgggtcccggagctcacggttatgggccatcacctatagatctatggctcgatgccccaagaagctgtcgtatggagccacccgacggccctccgccacctccccagcagcaaccccctcccccacctcagccgcctcagcccgctccacaggctactagctgcagctttgcccaaaatatcaaggaggagtcctcctattgtttgtacgattcagccgacaaatgccctaaggtgtcagcaaccgcagccgagttagcccctttccctagagggccaccacctgatggctgtgctttgggcacgtctagtggagtgcctgttcctgggtatttccggctgagccaggcatatggcacggcaaagggatacggtagtggaggtggtggagcccaacagttgggggctggcccatttcctgcacagccacccggacgcggttttgatctgcccccagccctggcgagcggatccgccgacgccgctagaaaagagagggcacttgacagccctcccccacctaccttagcctgtggatccggaggagggagtcagggagacgaagaggctcatgcatcatctagcgctgcagaggagttgtcacctgctccctctgaaagttctaaagcaagcccagagaaggattctttgggaaattccaagggagaaaacgccgcaaactggctcaccgcgaaaagtggtcgtaaaaagagatgcccgtacactaaacatcagacactggaattggagaaggaattcctcttcaatatgtatttgacacgggaacgacgtctcgaaatatctcgctccgtgcacctgactgaccgccaggtgaaaatctggttccagaaccgccgtatgaagctcaaaaagatgaatagagagaatcgaatcagggagctgacagctaatttcaatttcagctag

SEQ ID NO: 226269 - DNA, 609 bp, Artificial Sequence
  Description of Artificial Sequence: Synthetic coding sequence
atgtcttgtagcgaatcccctgccgcaaactcatttctggtagattcactgatctcaagcggcagaggtgaggctggtgggggagggggaggtgccggaggcggaggaggcggtggatattacgcccacggtggggtctacctgcctcccgctgccgatctgccttacggtctgcagagctgtgggcttttccctacgcttggtggtaagcgtaacgaagcagcctctccaggttccggaggcggagggggtggcctcggtcctggtgctcatggctatgggccaagtccaatagatctctggctagacgctccacgatcatgccggcgtagggctgctactcggggatggcctgtgcctagagccgctcctggcgctcgcttccggtcacctgcacgggcaagcctgcgcctcggacggtgtggtcctgagggggcatcccctcggttcgccgctgctccacatgcaggcctgaggcagcgaaggggcttagccggaagaagaggaggcgcaagggtggtcttaggccgaggtggggcactcccaggtcctttccgcgagcagcagtctctcgctggagaggggttccctggccaattccaacggtag

SEQ ID NO: 226270 - DNA, 285 bp, Artificial Sequence
  Description of Artificial Sequence: Synthetic coding sequence
atgtgtcagggaaactccaaaggcgaaaatgcagcgaattggctcacagcaaaatctggcagaaaaaagcggtgtccatatactaaacaccaaactctagagctggagaaggaatttcttttcaacatgtacctgaccagggagcggagacttgagatcagccggagtgtccacctgactgatcgtcaggtcaaaatctggttccaaaatagacggatgaagctgaagaagatgaaccgcgaaaaccggatcagggaattaacggcaaattttaatttttcttag

SEQ ID NO: 226271 - DNA, 942 bp, Artificial Sequence
  Description of Artificial Sequence: Synthetic coding sequence
atggatttcgatgaaagagggccatgttcgagcaacatgtatctgccgagctgtacttattacgtgagtggccctgatttcagctcactgccttcctttctccctcagacaccttcctctcgaccaatgacctattcctactccagcaacctcccccaggtgcaacccgtgcgagaggtcacgttcagggaatatgcaatcgagccggcaactaaatggcaccccaggggcaacctcgcccattgttattctgcggaggaactggtacatcgtgactgcttgcaggctcccagcgccgctggtgtccctggagacgttctggccaagagctccgctaatgtgtatcatcaccccaccccggcagtatcctccaacttttactctacagtcgggagaaatggggtcttgccccaggcattcgaccaattttttgaaaccgcctacggcacaccagagaacctggcttcctctgactacccaggcgacaagtctgctgagaaggggcctccggctgccaccgcgacaagcgccgctgccgcagccgctgccacaggtgcgcctgccactagttccagtgacagcggtggtggcggtggctgtagagaaacagctgcggcagccgaagagaaagagaggcgccgtagaccagagtctagctcaagtcctgagagctcttccgggcacacggaggataaggccggaggatcctcaggacaacgaactaggaagaaacggtgtccgtataccaaatatcagatcagagaattagagagggagtttttcttctcagtgtatattaataaagagaagaggctgcagctgtctagaatgttaaacctgaccgatcgccaggtgaaaatctggtttcagaatcggagaatgaaggaaaagaaaatcaatcgcgatcgacttcagtattattcagctaaccccctgctctag

SEQ ID NO: 226272 - DNA, 918 bp, Artificial Sequence
  Description of Artificial Sequence: Synthetic coding sequence
atggctagagaagacagtgtcaagtgtctgcggtgtttactgtacgccttgaacctgctgttctggctgatgtctatatcagtcctcgccgtctccgcttggatgagggactacctaaataatgtcttgacccttacagctgagacccgcgtggaagaagcagtcatcttgacctatttcccagtcgtccatccagttatgattgctgtctgctgcttcctcattatagtgggcatgttgggttactgtggaactgtaaagaggaatttgctcttactggcctggtattttggttccttgctcgtgatattctgcgtcgaactggcctgcggagtgtggacatacgagcaggagctaatggttcccgtgcagtggtcagacatggtaacactaaaggcgcgtatgacgaattacggcctccctagatacaggtggcttacccatgcgtggaatttcttccagcgcgagttcaagtgctgcggagtcgtgtactttaccgattggctggaaatgaccgagatggattggcctccagacagctgctgtgtccgagagttccctggttgtagcaagcaggcacaccaagaagatctttccgacctgtatcaagagggatgcggaaagaagatgtacagttttctccggggtacaaagcaacttcaggttcttcgattcctgggaattagcattggtgttacccaaatcctagccatgatactgacaataacactgctctgggcgctgtactacgaccgtcgcgagcccggaacagatcagatgatgagtttgaagaacgacaattcacagcacctcagctgtccgtccgtcgaactgctgaaaccctccttgagcaggatttttgagcacacatctatggcaaactcgtttaatacccactttgagatggaagagttatag

SEQ ID NO: 226273 - DNA, 489 bp, Artificial Sequence
  Description of Artificial Sequence: Synthetic coding sequence
atggggctggagaccgagaaggctgacgtgcaattgtttatggatgacgacagttactctcatcattccggactggagtatgctgaccccgagaagttcgccgatagtgaccaggacagagatccgcataggctgaattctcacctgaaattggggttcgaggatgtgattgctgaacccgtaactacccattcgtttgacaaggtttggatatgtagccacgccttgttcgagataagcaagtatgtgatgtacaaatttctaaccgtctttttggctatcccgctggcctttatcgctggcattttatttgcaacactgagctgtttgcacatatggatcctgatgcctttcgtgaaaacgtgcctgatggtgctcccatctgttcagacaatctggaaaagtgtcacagatgtcatcatcgcccctttgtgtactagcgtggggaggtgtttcagcagcgtctcattgcagctctctcaggactag

SEQ ID NO: 226274 - DNA, 963 bp, Artificial Sequence
  Description of Artificial Sequence: Synthetic coding sequence
atgactatgagctcattcctgataaactcaaactacatcgagcccaagttccccccattcgaggaatacgcgcagcatagcggttcaggtggcgcagatggcggacctggcggaggtccaggctaccaacagccccctgcacctccgactcagcaccttcctcttcagcaacctcagctgccacacgccggtgggggtagagagccaaccgcttcttattacgctcccaggactgctagggaacctgcttaccctgccgctgctctgtaccccgctcacggagcggctgacaccgcttacccctacgggtatcgaggtggcgcaagccccggaagaccccctcagcctgagcaacctcccgctcaagccaagggcccagcccatgggctgcacgcctcccatgtcctacaaccacagttaccaccccctttgcagcctagagccgttccgccagccgctcccaggagatgcgaagcagcccctgccacccccggtgtgcccgctggcggttcagcgcctgcgtgcccgctactgctggccgataagagcccacttggccttaagggtaaggagcccgttgtctacccatggatgaagaagattcacgtttccgccgtcaaccctagttataatggaggagagcccaaaaggtctaggaccgcttatacgaggcagcaggtgctcgaattggagaaggagttccatttcaatcgttatcttaccaggagaaggcgtattgaaattgcacacacactgtgtctgtctgagcggcaggtgaagatatggttccagaaccgaagaatgaaatggaagaaagaccacaagttgcctaacaccaagatgcggagcagcaattctgcctcagcctcagccggaccacctggaaaagcccagacacagtcaccacacctgcatccacatccccatccctcaacttcaacccccgtcccctcatctatctag

SEQ ID NO: 226275 - DNA, 963 bp, Artificial Sequence
  Description of Artificial Sequence: Synthetic coding sequence
atgacaatgagctctttccttatcaattctaattatattgagcccaagtttcccccttttgaagagtatgcgcagcactctggtagcggaggggctgatggtgggccaggcggaggacctgggtaccagcagcctcctgcccctcctacccaacatctgccgttgcaacagccccagctgcctcacgcaggagggggacgcgagccaacggcttcttattatgctcctcggacggcgagagagcccgcatacccagccgctgcgctctaccccgctcatggcgcagcagatactgcctacccttatgggtatagaggaggagcctcccccggaaggccccctcagcccgagcaaccgcctgcgcaagccaagggcccagcccacggcttacatgctagtcatgtgctccagccacagttacctcccccacttcagcctcgcgcagtccccccagcagctccccgaagatgcgaagctgcgccagccaccccaggcgtccctgcgggtggatcagcaccagcatgcccactccttttggcagacaaatctcctttaggactaaaaggaaaagagcctgtggtttacccttggatgaagaagattcatgtaagtgccgtcaacccctcttataacggcggagagccaaagcggagtcgcaccgcgtacactaggcagcaggtcttagagcttgaaaaagagtttcatttcaaccgctatctcactaggagacgacggatagaaatcgcccacacactgtgcttgagtgaacgccaggtcaagatctggtttcagaacaggcggatgaaatggaagaaggaccataagctaccaaacaccaaaatgcgctccagtaattcggcttccgcatccgccggacccccaggaaaagctcagacacaatccccccatctccatccgcatcctcacccaagtacttcaactcctgtgccttcaagcatttag

SEQ ID NO: 226276 - DNA, 1140 bp, Artificial Sequence
  Description of Artificial Sequence: Synthetic coding sequence
atgctgaaacggtgtgggaggcgcctccttctggctctcgccggtgctctcttggcttgtctgctcgttctgactgcagatcctcctccaccacccctgcccgctgagagaggaaggcgtgctctgagatcactggcaggcccagccggagctgctccggctcctggactgggggctgcagcagccgcaccaggtgctttagtgagagatgtgcattctctgagtgagtacttctccctcctcacccgggcacggagggatgccggaccccctcccggagctgcgccaaggccagccgatgggcaccccagacctctggcggagcccctggcccctagggacgtgttcattgcagtgaagaccactaagaagtttcatcgtgcacgcctcgatctccttcttgaaacatggatcagtagacacaaggagatgaccttcatcttcacggatggcgaggatgaagcattggctcggcatacaggcaatgttgtgatcacgaactgctcggctgctcattctcggcaggcattgagttgtaagatggccgtggaatatgacaggttcattgaatctggtaggaagtggttttgtcacgttgatgatgataattatgttaacctgagagctcttctcagactgctggctagttatccacacactcgggatgtgtacgtaggaaagccctcgcttgaccgcccaatccaggcgatggagcgagtttctgagaataaggtgagacctgttcatttctggtttgctacaggaggggctggcttttgcataagtagagggctagcactgaaaatgtctccctgggctagtggcggacacttcatgaacacggctgagcggatcagattacctgacgactgcaccatcggctacattgtggaagcactgctcggtgttccccttatacggtctggcctgtttcactcacacctcgaaaatctccagcaggtgccaactagcgaactacatgaacaagtaactctctcttacgggatgttcgaaaacaaacgaaacgcggtccatgtgaaaggccctttttccgtcgaggccgacccaagcagattcagaagcatccattgccatctctatcccgacaccccatggtgccctcggaccgctatcttctag

SEQ ID NO: 226277 - DNA, 813 bp, Artificial Sequence
  Description of Artificial Sequence: Synthetic coding sequence
atgtccagttactttgtgaattcattttgcggccgttatccaaacgggccagattatcagctccacaactacggagaccattcctccgtgtccgaacagttcagagatagtgccagtatgcatagtgggaggtatgggtatggatataatggcatggacctcagcgtaggcagaagtggctccggacatttcgggtcgggtgaacgggctcggtcatatgcagcctcggcgtcagccgcaccagccgaacctcgctattctcagcccgctacctctacacacagtcctcaacctgaccccttgccctgttccgctgttgcgccaagtccagggagcgatagccatcatggcggtaagaactctctgtcaaacagttcaggtgcatcagcagatgccggaagtacccatatatcttcccgagaaggcgttggcacggcttccggtgctgaggaggatgcacccgcatcctccgaacaagctagtgcccaatctgagcctagccccgcaccccctgcacagccacagatttacccctggatgcgcaagttacatattagccatgataacatcggcggtccggaaggcaagagagctcgcacagcttacacccggtatcagacactggagctggagaaggagtttcatttcaatcgctacctcacaaggagaagacgcattgaaatagctcatgccttatgtctcagtgagcgacagatcaaaatttggtttcaaaacaggaggatgaagtggaagaaagacaacaagttgaaatccatgtccatggcagccgctgggggagcgtttcgtccttag

SEQ ID NO: 226278 - DNA, 693 bp, Artificial Sequence
  Description of Artificial Sequence: Synthetic coding sequence
atgtcaagctcctattatgtgaacgccctgttctctaaatacacagctggagccagcctgttccagaatgctgagccgacttcatgctcattcgcaccaaattctcagaggtctggatacggggctggcgcaggagccttcgcttctacggtaccaggtctctataacgtgaattcgcccctgtaccagtctcccttcgcctccggttacggcctgggggctgatgcttacggcaatcttccttgcgcaagttacgaccagaatattcccggtctgtgtagcgatttggccaagggagcctgtgataagactgacgagggggctctgcatggtgcggcagaggccaattttcggatttatccatggatgagatcatcaggacccgatcgaaaaaggggcagacagacctatacgcggtaccaaacccttgagctagaaaaagagttccactttaatcgatatctgacccgccgtaggcggatcgagatcgcgcatgcactctgtctgacagagcgacagatcaagatctggttccagaaccgcagaatgaaatggaagaaggaacacaaagatgagggacccaccgccgcagcagcacccgagggggctgtgccctcagccgcagcaaccgcggcagcagacaaagccgacgaagaagatgacgacgaggaggaggaggacgaggaagaatag

SEQ ID NO: 226279 - DNA, 93 bp, Artificial Sequence
  Description of Artificial Sequence: Synthetic coding sequence
atgagctccagttactacgtaaacgccttattttctaaatataccgcgggtgcctccctcttccagaacgctgaacctacatcttgctcctag

SEQ ID NO: 226280 - DNA, 792 bp, Artificial Sequence
  Description of Artificial Sequence: Synthetic coding sequence
catcattggggaggcaactactacgttgactcatttcttctgggcgctgatgccgctgacgaactcagcgtgggaatgcgccgaggtccatggcctcccagacaagccgcaaccttggccgaacatcccgacttttccccgtgtagttttcaatcaaaagctacagtgtttggcgcaagctggaacccagtacatagagcccctaccttatatccggtgtaccatcaccaccaccatcacccctacgtacacccacaggcacctgttgcagccgcagctcccgacggtcgatatatgcgaagttggcttgagcctacccctggggctttgtccttcgcgggattgcctagctctcgcccttacggtattaaacccgagcccctgtccgctcgcaggggagattgcccgaccctcgacacccatactctgtctctgacagactatgcttgcgggagcccaccggtggatcgcgaaaagcagccctccgagggggctttctctgaaaacaatgcagaaaacgagtctggaggagacaagccccctattgaccctaacaatcccgcagccaactggctccatgctagaagtactcgtaaaaagcggtgcccatacactaagcatcagaccttggaactggagaaggaattcctgttcaacatgtatttgacccgcgacaggcgctatgaagtggcgcgactgcttaatctgacagaacggcaagttaagatctggtttcagaatagacggatgaagatgaagaaaatcaacaaagacagggctaaggatgagtag

SEQ ID NO: 226281 - DNA, 819 bp, Artificial Sequence
  Description of Artificial Sequence: Synthetic coding sequence
atggcgacaactggcgctcttggaaattactacgtagacagcttcctgctcggagcagacgccgctgatgagttgagtgtggggaggtacgctcctggtactctgggacagcccccacgacaggccgctaccctggcggagcaccctgattttagcccctgctcgttccagtctaaagccacagtcttcggagcctcatggaaccctgtgcacgccgcaggggctaatgccgttcctgccgcagtgtatcaccaccaccaccatcatccttacgtgcaccctcaggccccagtagcggcagctgcccctgacggccgatacatgcgctcttggctggaaccaacacctggagctctgagctttgccggattgccctcttctcgaccatatggtattaaacctgaaccactgtctgcacggaggggtgattgtcccacgctcgacacccacacgctgagtttgaccgattacgcctgcggaagtcctcctgtggatcgggaaaaacagcctagcgaaggggctttttcggagaataatgccgaaaatgagtcaggcggagacaagcctccaattgatccaaataaccctgctgctaactggttgcacgctaggtcaactaggaagaaaagatgcccctatacgaagcatcaaacacttgaattggaaaaggagtttctgttcaatatgtacctgactagggaccggagatacgaagtggcacggctcctgaacttgaccgagcggcaggttaagatatggtttcaaaaccgacgtatgaaaatgaagaagataaataaggatcgagccaaggatgagtag

SEQ ID NO: 226282 - DNA, 591 bp, Artificial Sequence
  Description of Artificial Sequence: Synthetic coding sequence
atggccggattcagtccctggcggcgtaggcagcgtcgtcggagacggagacggagagcccgacagagccgggcagcacccgaactcgtcggggatctgggtagtttcctgctcctggggtcaacattcctgagtaccgccagacattgcttcattacttcagtggagattgtgtccaggtatctgtgcgctcgtggcagcggtcgggcagggcatcatggcccaggacgtgcacgccctgccgtggccacttctgcttttccagcccaagagccacgtgtctttctccgatctgcactgcctgcgggacggttaagcccctcaacaacacacctacatcttgttaccgcagataacccggctgccaactggctgcacgcgaggagtacccgcaaaaaacggtgtccttatacaaagcatcagacactggagctggagaaggaatttctcttcaatatgtacctgacgcgggaccgacgatacgaggtcgccagattgctcaacctgacggagcgccaggttaaaatctggtttcagaaccgcaggatgaagatgaaaaaaatcaacaaggatagggccaaggatgaatag

SEQ ID NO: 226283 - DNA, 906 bp, Artificial Sequence
  Description of Artificial Sequence: Synthetic coding sequence
atggattacaatcgcatgaattcatttctcgaataccccctctgcaaccgagggccatccgcctatagcgcacactctgcccctacttcttttcctccgtctagcgcacaagccgtggattcttacgcctccgaaggcagatacggaggtggactgtctagtccggcattccagcagaattccggatacccagctcagcagcctccctcaactctgggggtcccattccccagcagcgcacctagtggctatgccccagctgcctgttcaccgtcttatgggcctagccagtactaccccctcggccagagtgagggagatggaggctactttcatccctcctcttatggcgcacaactcggaggattgtctgacggctatggggcaggcggagcgggtcccggtccataccctccacaacaccctccatacggcaacgagcagactgcctcattcgcgcctgcctatgccgacttattgtcagaagacaaagagaccccctgcccctcagagcctaatacaccaacggcaagaacattcgactggatgaaagtcaaaagaaatcctcccaaaactgcgaaggtatcagagccaggccttggctctccatccggcctgaggaccaacttcaccacacgtcagctgacggagctcgagaaagaatttcactttaacaagtatctgagccgagcaagacgcgtagagatagctgccacactggagttaaacgagacacaggtgaagatctggttccagaaccggcgaatgaagcaaaaaaagagagaaagagaagaaggacgtgtccctccagctccaccagggtgtcccaaggaagctgcaggtgatgccagtgaccaatccacatgtactagccctgaagctagccctagttctgtaacatcctag

SEQ ID NO: 226284 - DNA, 855 bp, Artificial Sequence
  Description of Artificial Sequence: Synthetic coding sequence
atggaacccggaaattacgccaccttggatggggctaaggatatcgagggccttctgggcgcaggtgggggtcggaacctagtagcacactcccctctgacatcccaccctgcggctcctaccctgatgcccgcagtgaactatgccccactggacctccccggatcagctgaaccacctaagcaatgtcacccttgccccggtgtgcctcagggaactagccctgcccctgtcccgtatggctactttggaggagggtactactcctgtcgcgtgtctagaagttcactgaagccatgcgcccaggccgcaacactcgcagcctatcccgctgaaacccctaccgccggtgaggaatatccgtccagaccaacggaatttgccttctaccctggctatcccggtacataccaaccaatggcctcatacttggacgtgagtgttgtgcagactttgggtgctcccggagaacccagacacgacagcctgctgcctgtggactcctaccagtcgtgggcactagccggtggttggaatagccagatgtgctgccagggggaacagaatccacccggtcccttctggaaggcggcatttgcggactccagtggccagcatcctcctgatgcgtgtgctttccgcagagggaggaaaaagcgaatcccctacagtaagggtcagctgcgtgagcttgagagagaatacgctgcgaacaaattcattacgaaagacaagcgcagaaaaatctcggccgctacctcactgtctgagcggcagattacaatctggtttcagaaccgccgagtgaaagagaagaaggttcttgctaaagttaaaaactctgcaactccctag

SEQ ID NO: 226285 - DNA, 531 bp, Artificial Sequence
  Description of Artificial Sequence: Synthetic coding sequence
ccgagatgcccacctggccctcgtgtgccactcgacgagagggaggagatcagacaagagacgcagccaatcagacacgtgtcattttcaggacgactgaggcgttcgggaggagtcgggagccccgctgacggccttggcagacgtttggtagccgctggacaggcggctcacgggctgcaccaacacgcagccgctggcactggtgagttccattttaacaagtatctgtgtaggccaaggcgcgtggagatcgcagcccttctggatctcaccgaacgccaggtcaaagtctggtttcaaaatagaaggatgaaacacaagaggcaaacacagcatcgtgaacccccagacggcgaacctgcgtgtcccggagctctcgaggatatttgcgatcccgcagaggagcctgctgcatctcccggaggacctcttgccggaggcgtggggagcctgctttcgcccgctggaggtggagcgggtgggcttaaacgcggaccacccgctttctctaggtcactgagaggttag

SEQ ID NO: 226286 - DNA, 1071 bp, Artificial Sequence
  Description of Artificial Sequence: Synthetic coding sequence
atgaacttcgagttcgagagggaaatcggattcatcaacagccagccgagcctcgccgagtgtctgactagtttccctgctgtgcttgagaccttccagacctctagcattaaggaaagcaccctgattcctccacctcccccttttgagcagacatttccctccctacagccgggagcctcaaccttgcagagacccagaagccagaagcgcgctgaagatggccctgctctgccaccccctccaccaccacctctccccgcagctccaccagccccagagtttccctggatgaaggaaaagaaaagcgccaaaaagccctcacaatccgccacttccccgtccccggcagctagcgccgttcccgcaagtggcgtgggcagtcctgctgatgggctgggactgcctgaggcaggagggggtggcgctcgcaggcttaggaccgcttataccaatactcagttactggagttggagaaagaattccatttcaataagtatctatgccgaccacggagagtggaaatagccgctctactggatctcaccgagcggcaggtgaaagtgtggtttcaaaaccggagaatgaagcacaaacggcagacccaacacagggagcctcctgacggagaacccgcttgcccaggtgccctcgaagacatctgcgacccggcagaggaacccgctgcctccccaggtgggccttcagcaagccgagcggcttgggaagcttgctgccaccccccagaggtagtgcccggagccttgagtgcagacccccgtcctctggctgtgagactcgagggggctggagccagctctcctggctgcgccctgagaggagccggtggactggaacccggacccttgccagaggacgtttttagcggtcgacaggactcgccatttctccctgacctgaacttcttcgccgctgattcttgtctccagttgtccggtgggctttcaccatctttacagggctctctggacagcccagtgcccttctcagaggaagagcttgatttcttcacatctacgctgtgtgccatcgatctgcagttcccctag

SEQ ID NO: 226287 - DNA, 1296 bp, Artificial Sequence
  Description of Artificial Sequence: Synthetic coding sequence
atgcagaaggcgacatactatgataatgcagctgcggcattgtttggaggatactcatcatatcccggatccaatgggtttgggtttgacgtgccacctcagccaccattccaggctgctacccacctcgagggcgactatcagagaagcgcttgtagtctccagtccctgggcaacgctgctccccatgctaagtcgaaggagctgaatggttcatgtatgaggccaggactcgcccctgaaccgttaagtgcaccacccggaagcccccctccttctgcagctccaacgagcgcaaccagcaatagtagcaacggaggcggtccatctaagtccggacctcctaagtgcggacccggaaccaattcaaccctgaccaaacaaatcttcccttggatgaaagagagcagacagacttccaaactgaagaacaacagcccaggaacagccgagggctgtggtggtggtggagggggaggtggaggcggaggctccggtggctcaggagggggaggagggggtgggggaggcggtgacaaatctcccccaggatccgctgcctccaaacgagctaggaccgcctatacttccgcccaacttgtggaactcgagaaggagttccacttcaacagatatctctgtaggcctcggcgagtggagatggctaacctcctaaatctatccgaacggcaaatcaaaatttggtttcagaaccgcaggatgaaatataagaaggatcaaaaagctaaagggctggcttcttcaagcggcggaccgagtccagctggatcccccccacagcccatgcagtctaccgccggatttatgaatgctcttcacagcatgacaccctcgtacgaatccccctctccaccggctttcggaaaagcccaccagaacgcttatgctctgccaagcaattatcaaccccctcttaaaggctgtggggctccgcagaagtacccaccaacgcccgctcccgagtacgagcctcatgtgctgcaggcgaacgggggtgcttatgggacccctaccatgcagggatcaccagtgtacgtgggtgggggtgggtatgccgaccctctacccccaccagcaggtccatccttgtatggcctgaaccacctgtcgcatcatccaagcgggaatctggactacaacggcgctccccctatggcaccctcgcagcatcacggcccttgtgagccacatcctacttataccgatctcagtagtcaccacgctccacctccacagggcaggatccaggaagctccaaagctgacccacctgtag

SEQ ID NO: 226288 - DNA, 900 bp, Artificial Sequence
  Description of Artificial Sequence: Synthetic coding sequence
atgaaagaaagccgacagacaagcaagctgaagaacaatagtcctggtacggcagaggggtgcggaggcggaggcggtgggggaggcggtgggggatcagggggatctggcggtgggggaggcggtggagggggtggggacaaatcgcctcccggaagtgccgcaagcaaacgtgctcggaccgcttataccagcgcccaactcgtggaattggaaaaggaattccatttcaatcggtacctgtgccgtcctcgtagagtcgagatggctaatctgttaaatttatctgagagacaaatcaaaatttggtttcagaataggaggatgaagtataagaaggaccagaaagcaaaaggtctggcctcatccagtggcggtccctcccccgctggctcgccaccccagccaatgcaatccacggccggttttatgaatgcactgcattcaatgaccccttcatacgagtctccgtcgccccctgcttttggcaaagcacaccagaacgcctacgcccttccttccaactaccagccacccttgaagggctgcggtgcccctcagaagtacccccctacgccagcacctgaatacgaaccccatgtgcttcaggccaatggcggagcatacgggaccccaacgatgcaggggtcccctgtctacgtgggcggtggaggttacgccgatccactccctccacctgctgggccatcactttatggcctcaatcacctgtctcatcatccttccggaaatttggattataatggagcacccccaatggctccctcccagcaccatggtccatgtgagcctcaccccacatataccgatctttcatctcatcatgcaccccctccacaggggagaattcaagaggctcccaagctaacccatctttag

SEQ ID NO: 226289 - DNA, 1296 bp, Artificial Sequence
  Description of Artificial Sequence: Synthetic coding sequence
atgcagaaggctacttattatgacaatgctgctgccgcattattcggaggctactcaagctacccaggcagtaacggtttcggcttcgatgtcccacctcagcccccattccaggcggcaacccatctggagggcgactatcagcggtcggcctgttcactgcaatctctcggtaacgctgcaccccatgccaaatccaaagaactgaatgggtcgtgcatgcgccctggcctggcccctgaacctcttagcgcccctccaggatctccacccccaagcgcagcccctactagtgctacatctaattcctctaacggcggaggtccttccaagtccggcccaccaaaatgtggcccaggcaccaatagcactctgaccaagcagattttcccttggatgaaggagtctagacaaacatctaagctgaaaaacaattcacctggaaccgccgaaggctgcggcggtggagggggtggcggagggggaggtggcagcgggggatccggcggaggaggtggaggaggtggtggaggggataaatcccctccaggtagcgctgcctccaaacgggctcggaccgcttacacgagtgcccaattggtggaattggagaaggaattccacttcaatagatacctctgccggccacgtagggtcgaaatggccaatctgctgaatctgtctgaacgtcagatcaaaatctggtttcagaacaggagaatgaagtacaaaaaagatcagaaggcaaaagggctggccagctcctcaggcggaccctcacccgctggctcccctccgcagcccatgcagtccacagccggtttcatgaacgcactccactccatgacgcctagctacgaaagtccaagtcctcccgcatttgggaaagcccaccagaacgcatacgctcttccatctaattaccagcctccgctgaaggggtgcggcgcaccccagaagtatccgcctactcctgccccagaatacgaacctcatgtgctccaagccaatgggggtgcttacggcacaccgactatgcagggctctcctgtctacgtgggcggaggcggatatgccgatccacttcctccccctgccggaccctctctctacggacttaatcacctgagtcaccacccctctggcaacctcgattacaatggggctcccccaatggcgccatcccagcaccacggaccctgtgagcctcacccaacgtataccgacctctccagccatcacgccccacctcctcagggcaggatccaggaagcgccaaagttaacccacttgtag

SEQ ID NO: 226290 - DNA, 1077 bp, Artificial Sequence
  Description of Artificial Sequence: Synthetic coding sequence
atgagaccaggacttgcgcctgagcccctttccgccccacctggaagcccacccccatcagcggcaccgacgtctgccacaagcaattcttccaacgggggaggcccttccaagtccggcccacccaaatgtgggcctggtacaaacagcacgctaacaaaacaaatcttcccctggatgaaggaatctcgtcagacatccaagctcaaaaataacagccccggaacggccgaaggctgtggcggtggcggtggcggtgggggagggggtgggagtggcggaagcggcggaggagggggtggcggaggcggaggggacaagagccctccaggttccgcagcaagcaagcgtgcacgcacagcctacacatctgcgcagctggtggagttagaaaaagagtttcatttcaataggtatctgtgtaggcctaggagagtcgagatggccaaccttctgaacctgtcagaacgacagattaaaatatggttccaaaacagaaggatgaaatataagaaggaccaaaaagcaaaaggcttggcgtctagcagtggcggacctagcccagccggtagcccgccacaacccatgcaaagtacagcagggtttatgaacgcccttcattctatgacacctagttatgaatctccgtctcccccagcattcgggaaagcgcaccagaacgcctacgccttaccatccaactatcaaccaccactgaaagggtgcggggcaccacagaagtacccacccacaccggctccagagtatgaacctcacgtgctgcaggcaaatggtggggcttacggtacacctaccatgcagggctcccccgtctacgtgggaggcggtgggtacgcagacccattgccgcctccggcagggccaagtctgtatggcctcaaccacctcagtcaccaccctagcggcaatctggattataatggagcccctccaatggcgcctagtcaacaccatggaccctgcgagccacatccaacttacacggatctgagtagccaccacgccccaccacctcaagggaggatacaggaggcacctaagctcacacacctgtag

SEQ ID NO: 226291 - DNA, 1296 bp, Artificial Sequence
  Description of Artificial Sequence: Synthetic coding sequence
atgcaaaaagccacatactacgacaacgccgcagctgccctttttgggggttactcgagctaccctgggtcaaatggctttggctttgatgttcctccccagccaccctttcaggcggcaactcacctagagggcgattatcaaaggtccgcgtgctcgcttcagtcgctagggaatgccgctccacatgctaaatcaaaagagttgaacgggagctgtatgcgaccagggctagccccagagcccctgtcagctccacccggaagccctcccccttccgccgctcctacttccgcgacctccaatagcagcaacgggggtggaccatctaaatccggccctccaaagtgtggcccagggaccaattctacgctgacaaaacaaatatttccctggatgaaagaaagccgacagaccagcaagctcaaaaacaactcccccggaaccgctgaggggtgtggcggtggcggaggcggaggaggcggaggcggaagcggcggaagtggcggtggaggagggggtggtggaggaggggacaaatctcctccgggttcggcagctagcaagagggccaggacagcctatacctcagcccagctcgtggagctggagaaggaatttcactttaatcggtacctatgtaggcctagacgtgtggaaatggccaacctcctgaacctgtcagaacggcagattaaaatctggtttcagaatcggcgtatgaagtataaaaaagaccaaaaggcgaaggggctcgcatctagtagcggcggaccctccccagctggttcaccaccccagcctatgcagtccaccgctggtttcatgaatgcattgcattcgatgactccctcatacgagtccccctctccccctgctttcggtaaggcacaccagaacgcctatgctttgcctagcaattatcaaccccctctgaaaggctgcggggctccccagaaataccccccaacacctgcaccagagtacgaaccccatgtcctgcaagctaatgggggagcgtacggaacacctactatgcaaggctccccagtctacgtcggcggaggaggttatgccgatcctcttcccccacctgcagggcctagtttatatggattaaatcacttatcccatcacccgtcggggaatctagattacaatggcgctccacccatggccccatctcagcaccacggcccttgcgagccgcatcccacctacaccgacttgtcctctcaccatgctcctccccctcagggacggatacaggaggcgcctaaactcacacatctgtag

SEQ ID NO: 226292 - DNA, 900 bp, Artificial Sequence
  Description of Artificial Sequence: Synthetic coding sequence
atgaaggaaagtcgacagacgagcaaactgaaaaacaattcacctggaaccgctgagggctgcggcggtggcggaggaggaggcggaggcggaggctctggcggaagtgggggaggtgggggaggcggaggcggtggcgacaagagtccccctggatccgcagctagcaaacgtgccagaacagcttacactagcgcacagctggtggagctggaaaaagagtttcattttaaccgttacctgtgcagacctcggagagtggagatggctaacctactaaacctgtcagagagacagatcaagatttggttccaaaacaggcgcatgaagtataaaaaggaccagaaagctaagggcctcgcatccagctcagggggaccatctccagccggttcaccgccacagcctatgcaaagtacagccggattcatgaacgccctccactcaatgacgccctcatacgaatcccctagtcccccagcttttggcaaggcacatcagaatgcctatgctcttccttcaaattatcaacctccactcaaggggtgcggcgcaccccaaaaatatcctcctactcctgctcctgagtacgaaccgcacgtcttgcaggcaaatggcggagcttatgggacacctaccatgcagggcagccctgtctacgtcggaggtggcggttacgccgatcctcttccaccaccagcgggaccctctctatacggtctcaatcatctgagtcaccatccctcaggtaatcttgactacaatggggctccaccaatggccccttcacagcaccacggcccatgcgaaccgcacccaacttacacagatttatcttcccaccacgctcctccacctcagggacgcattcaagaggccccaaagctcacgcatctgtag

SEQ ID NO: 226293 - DNA, 1077 bp, Artificial Sequence
  Description of Artificial Sequence: Synthetic coding sequence
atgaggcctgggctggcgcctgagccactcagtgctccccctggctcacctcctcccagcgccgcacctacttccgccacttctaactcaagcaacggaggtgggccttccaagtcagggcctcctaaatgtgggcctggaactaattctacactcacaaaacagattttcccatggatgaaggagtctcggcagaccagcaagcttaaaaacaattcacctggcacagccgaggggtgcggaggcggaggcggagggggagggggaggaggcagcggcggatctggaggtggtgggggaggaggcggtggcggtgacaaatctccacccggatccgccgcatctaaacgggcacgaaccgcctacaccagtgcacagctggttgaactggagaaggaattccacttcaaccgctatctttgcaggccgaggcgagtggaaatggccaatctcttgaatctgtcagaaaggcaaattaagatctggttccagaataggcgtatgaaatacaaaaaagatcagaaagctaaagggcttgcctcatcatccggtggaccaagtcctgccggaagtccccctcagcctatgcagagcaccgcaggcttcatgaacgcactccattccatgactccttcctacgaaagtccctccccaccagctttcggaaaggcccaccagaacgcttatgccttacccagcaactaccaaccacccctaaagggctgcggggctcctcaaaagtatcccccaacgcctgctcctgaatatgagcctcacgtactccaggctaacggaggtgcctatgggactcctaccatgcagggaagcccagtgtatgtggggggagggggatacgccgatcccctgcctccacctgctgggccatcactgtatggtctgaatcatttgtcgcatcacccttctgggaacctggattacaacggagccccaccgatggccccttcccaacaccacggtccatgcgaaccgcacccaacatatacagacctgtcctcccatcatgctccaccacctcagggacgtatacaggaagcccctaagctcacccatctgtag

SEQ ID NO: 226294 - DNA, 1296 bp, Artificial Sequence
  Description of Artificial Sequence: Synthetic coding sequence
atgcaaaaggccacttattacgacaatgccgcagcagcgctgtttgggggatatagctcgtatccaggtagcaacggattcggatttgatgttccccctcaaccgccttttcaggcggcaacacatctcgagggagactaccagcgcagtgcatgcagccttcagagtcttggtaatgcagcgccacacgccaagtctaaagagctaaatgggtcatgcatgaggccaggtttggccccagagccactttctgcaccgcctggctccccccctcccagcgcagccccaaccagtgccacatccaatagcagtaatggtggcggaccatcaaaaagtggcccacctaagtgcggccctggcacgaactctacactgacaaaacaaatttttccttggatgaaagaaagtagacagaccagtaaacttaagaataacagtcccggaactgccgagggatgcggcggaggagggggagggggtggaggaggaggcagcgggggtagtggcggtggaggaggtggcggaggtggaggcgataaaagtcctccgggaagcgcagcctcaaaacgagcccgtaccgcctacacctctgcccaattagtggaactggagaaggagttccacttcaatcgctatctgtgcaggccgaggcgagtggagatggccaacttgctgaacctttctgagcggcagatcaagatttggtttcagaatagaagaatgaagtataaaaaggatcagaaggcaaaagggctggccagttcgagtggcggtccatcacctgcagggagccctccacagcctatgcagtccactgccggttttatgaacgctctgcactctatgactccttcctatgaaagccccagccctcccgcattcggcaaagcccaccagaacgcatacgccctcccgtccaattaccagccaccacttaagggctgcggcgcaccccagaaatatccacccactccagcccctgaatatgagccccatgtgctgcaggccaacggtggagcgtacggcacccccacgatgcaggggtcaccggtgtacgtagggggtggcggttacgctgatcccctccctccccctgctggaccgagcttatacggactcaatcacctctcccatcaccctagtggcaacctcgactacaatggcgcaccacctatggccccttcacagcaccatggaccctgtgagccacatcccacctacacagacctgagctcccaccatgcacctcccccacaggggagaatccaagaagcgcctaaattgacacacttatag

SEQ ID NO: 226295 - DNA, 756 bp, Artificial Sequence
  Description of Artificial Sequence: Synthetic coding sequence
atggccatgtccagcttcttaatcaactcaaattatgtcgatccgaagtttccaccttgcgaggagtattcccaatcggactatctgcccagcgaccatagccctgggtactatgccggaggtcagaggcgggagtcatccttccaacccgaggccggattcggaagacgcgctgcctgtaccgtgcagcgatatgccgcttgccgagacccaggtccaccgccacctccccctcctcctcctccacctcccccaccacccggactgtctcccagggcccctgcccctccacctgccggagcccttcttcctgaaccaggacagcgctgcgaagcggtatccagcagtccacctccacccccttgtgcacaaaatcccctccacccaagtcccagtcactctgcatgtaaggaacccgtggtgtacccttggatgcgaaaagtgcacgtgtctacagtcaaccctaattatgctgggggagagccaaaaagatcaaggaccgcatacactagacaacaggttctcgaactggaaaaggaatttcattacaaccgctatctgacccgtagacggagggtggagatcgctcacgctctatgcctgtcagaaagacagataaaaatttggtttcagaatcggaggatgaagtggaaaaaggatcacaagttacccaacacgaaaatccgttctggaggagccgcagggtccgcgggtggacccccaggtcgcccaaacggtgggccacgcgcactctag

SEQ ID NO: 226296 - DNA, 810 bp, Artificial Sequence
  Description of Artificial Sequence: Synthetic coding sequence
atgtcaagttatttcgttaacagcttttcagggcgttatcctaacggccctgattaccagcttctgaattatggctccggttcgagtctatccggcagttatcgcgatccggctgccatgcacactggcagttatggatataattataatggcatggacctgagcgtgaatagaagctcggcttcctcttctcacttcggcgcagttggagaaagctcaagggcctttcccgctcctgcccaagaacccagattccgacaggccgctagctcttgctctttaagctctccagaatccttgccatgtactaacggggacagtcacggggcaaagccctctgcttcctccccttctgaccaggcaacctccgcctcttcttcggctaacttcactgagatcgatgaagcaagtgcatcctccgagcccgaagaggccgcaagccagttgagctctccaagtttggccagagcacagcctgagcctatggcaacatctaccgcggctcctgaaggccagactccacagatctttccatggatgagaaagttgcatataagccacgatatgacaggtcccgacggcaaacgagccagaacagcctacacgcggtatcaaacactcgaactagaaaaggaatttcattttaatcggtacctgacccgacgcaggcgcattgagatcgcccacgctctttgcctttcagagcggcaaattaagatctggttccaaaatcgacggatgaaatggaagaaagacaacaagcttaagagtatgagtctcgcaactgcgggaagcgccttccagccttag

SEQ ID NO: 226297 - DNA, 1179 bp, Artificial Sequence
  Description of Artificial Sequence: Synthetic coding sequence
atggccgctcttcgccagcctcaggtagccgaattgctcgctgaagcacgacgggctttccgcgaagagttcggcgctgaacccgaacttgccgtgagcgctcccggtagggtgaacctgatcggtgagcataccgattataaccagggactggtccttccaatggctctggagcttatgaccgttctcgtcggctcaccccgaaaggatggactggtgagcctgcttacaacaagtgaaggggctgacgaacctcaacgccttcagtttcccctgccgacagcacagcgatctttggagccgggaacaccgcgttgggccaattacgtcaaaggtgttatccagtattatcccgctgcacctctaccaggtttctctgccgtggtggtatctagtgtccctctgggcggtgggctgtcctcctctgctagcctcgaggtcgcaacatatacatttttgcaacagctgtgccctgactccgggacaatcgctgcacgcgcacaggtctgccagcaggctgagcattccttcgccggaatgccctgcggtatcatggatcagtttatatccctcatggggcagaaaggccacgctctactgattgactgccggagcctcgagacctctcttgtgcctttatcagatcctaagctggcagtcctcatcacaaatagcaatgttaggcacagcctggcctcctctgagtatccagtacggaggaggcagtgtgaggaggttgctcgagcgctgggcaaggagagcctgcgcgaagtgcagctggaggaactcgaggctgcacgtgatttggtgtcaaaggagggcttcaggcgggctagacacgtcgtaggcgaaattcggaggacagctcaggccgctgcggctttgcggaggggagattaccgagcatttggcagactcatggtcgaatcccatagatctctaagggacgactacgaggtttcatgtcccgagcttgaccagcttgtcgaggctgctctcgccgttcctggggtgtacggcagtcgtatgaccggaggcggtttcggcggatgtaccgtgacattactcgaagccagcgctgcccctcacgcgatgcggcacattcaggagcattatggaggtaccgcaactttttaccttagccaggcagctgacggtgccaaggtgctgtgtttatag

SEQ ID NO: 226298 - DNA, 675 bp, Artificial Sequence
  Description of Artificial Sequence: Synthetic coding sequence
atgagtagctactttgtcaattcaacattcccagtgactctcgcctccggtcaggagtcctttctggggcagctcccactgtatagctctggatatgctgaccccctgagacattacccagctccctatggcccaggcccaggccaagacaaaggcttcgccacttcaagctactaccctccagctgggggaggctatggaagagcggctccatgtgactacggcccagccccagcattttatagagagaaagagagtgcttgcgctctgtccggcgctgacgagcaaccgccttttcatcccgaacctcgcaagtctgattgcgcacaagacaagagcgtctttggcgagacagaggagcagaagtgtagtacccctgtgtacccatggatgcagcgcatgaactcctgcaattcctcgtcttttggcccatctggacgcagaggccgtcagacctatacaaggtaccaaacactcgagctcgagaaggagttccattacaaccgttacctgaccaggcgcaggagaattgaaattgctcatgcactctgcctcacagaaagacagataaagatctggttccagaaccgtcggatgaagtggaagaaggaaagcaaactgctctccgccagccaactgtccgctgaagaggaagaagaaaagcaggccgagtag

SEQ ID NO: 226299 - DNA, 654 bp, Artificial Sequence
  Description of Artificial Sequence: Synthetic coding sequence
atgagctccctctactacgccaacaccttgttttcaaagtatcccgcaagcagctcggtgtttgctacgggcgctttcccagagcagacctcctgcgcctttgcctccaacccacaacgtccagggtacggggcaggctccggcgctagctttgctgcctccatgcagggactgtaccccggaggcggaggcatggccggtcagtccgcagccggtgtctacgccgctggctacgggctcgagcctagctcttttaacatgcattgtgccccttttgaacagaatcttagcggagtgtgtccaggggacagtgcaaaggcagcaggagccaaggagcagagggactccgacctcgcagctgagtccaatttcaggatatacccttggatgcgtagctctggcaccgatcgcaaaaggggccgtcaaacgtacactaggtatcagaccctcgagctcgaaaaagaattccactataatcggtatcttactagacggagacggattgaaatcgcccataccctttgtctgacagaaagacaaattaagatttggttccagaatcggagaatgaaatggaagaaggaaaacaagacagctgggcctggcaccaccggacaggatcgggctgaagctgaagaagaggaagaagaatag

SEQ ID NO: 226300 - DNA, 87 bp, Artificial Sequence
  Description of Artificial Sequence: Synthetic coding sequence
atgaagtggaagaaggaaaacaaaacagccggaccaggcactaccggccaagacagggccgaagccgaggaagaagaggaagagtag

SEQ ID NO: 226301 - DNA, 732 bp, Artificial Sequence
  Description of Artificial Sequence: Synthetic coding sequence
atgtcgtcctatttcgtaaattccctgtttagcaaatacaagaccggggagtcactcagacctaattattacgattgcggattcgcccaggacttgggaggacggcctacagtggtatatggcccttccagcggtggatcattccagcatcccagtcaaatacaggagttttaccatggacccagtagcttgtccaccgctccttatcagcagaatccctgtgcagtggcttgtcatggggatcccggaaacttttacggatacgatccgcttcaaagacagagtttgtttggcgctcaggatcccgatctggttcagtatgctgattgcaaactggccgctgcctctggtttgggtgaggaggctgaaggctccgaacagagccctagcccaactcagctatttccatggatgcgcccacaagctgcggcaggtcgcagaaggggaagacagacttatagccggtatcaaactctcgagctcgagaaagaatttctgtttaatccgtatttgacccgtaagcgacgcatcgaagtgagccatgcgcttggcctcaccgagcgacaagtgaaaatatggtttcagaatagacgcatgaagtggaagaaggaaaacaacaaggataagttccctagctccaagtgcgagcaggaggaacttgagaaacagaaacttgagagagcgcctgaagccgcagatgagggcgacgcccagaaaggggacaaaaagtag

SEQ ID NO: 226302 - DNA, 753 bp, Artificial Sequence
  Description of Artificial Sequence: Synthetic coding sequence
atgagtatcagcggcactctctcaagctactatgtggacagtatcatttctcacgagtcggaggatgctccgcctgctaagttccctagcggccagtatgccagcagtagacagcctggccacgccgagcatctcgaattcccttcttgcagtttccagcccaaagcccctgtcttcggtgctagctgggcccctcttagtcctcacgcctcaggctctctgccatctgtctaccatccatatattcagccgcaaggggtgcctcctgctgagtccagatacctgcgcacctggctggaaccagcccctagaggtgaggctgctcctggccaggggcaggccgctgtaaaggccgagccactcctgggcgcaccaggcgagctgttgaaacagggcactcctgagtatagcctcgagacctctgccggtcgagaggccgtgttatctaaccaacgtcccggttacggagacaataagatctgcgaggggagcgaggacaaagagcggccagaccaaactaatccgagtgcgaactggcttcatgccagaagcagtagaaagaagagatgcccttacacaaagtaccagaccctcgaactcgagaaagagtttttatttaacatgtacctcacccgggataggagacacgaggtggccagattgttaaacctctccgagcgccaggtcaaaatctggttccagaatcgacggatgaagatgaagaaaatgaataaagaacagggtaaggagtag

SEQ ID NO: 226303 - DNA, 387 bp, Artificial Sequence
  Description of Artificial Sequence: Synthetic coding sequence
atgtcgatttctgggactctgagctcatactacgttgattccatcatttcacacgaaagcgaggatgccccacctgctaagtttcctagtggccaatatgctagcagtagacagcctggtcacgctgagcatctggaattcccatcatgctcatttcaaccgaaggcccctgttttcggagctagctgggcaccgttgagcccccacgcatctgggtcactgccatccgtgtatcacccctacatacagccccaaggtgttccgccagcagagtcacgctacctaaggacctggttggagccagccccacgagggggagctgcgcagacaggtcatgccagagtgcagtttggtaatttcggaggacagggaggacgcgctgtatag

SEQ ID NO: 226304 - DNA, 1029 bp, Artificial Sequence
  Description of Artificial Sequence: Synthetic coding sequence
atgacctgtccacgcaacgttacacccaactcctatgccgagccactggctgcacctggcggtggcgagcgctattctcggagtgcaggcatgtacatgcagtcaggatcagatttcaactgcggtgttatgcgcggatgcggtctcgctccatctctctcgaagagggatgaaggaagctcccccagcctggccctgaacacttatcctagttacctctcccaattagatagctggggagacccaaaagccgcttaccgtctggagcagccagttggccgacccctgtcctcttgtagctatcccccttctgtgaaggaggaaaatgtctgctgtatgtatagcgctgaaaaacgtgccaagtcagggccagaagccgctctgtactcacaccctctcccagagtcatgtttgggcgagcatgaagtgccagtaccatcctactaccgcgctagcccaagttacagtgccctggacaagaccccacactgcagcggagctaacgattttgaagcccctttcgaacaaagggcgagtctgaaccctagagctgaacacctcgagtcgccacagctggggggaaaggtgtccttcccagagacccccaagtccgacagccagacaccgtcccctaacgagattaaaacagagcagagcctggctgggccaaaaggatcccctagcgagtccgagaaagaacgggctaaagccgcagacagctcaccagacacttcagataatgaagccaaggaggagattaaagcggagaacacaaccggcaattggcttacagctaagagtgggcgaaagaagaggtgcccatataccaaacaccagaccctggagcttgagaaggagttcttgttcaatatgtacttgacgcgggaaagaagacttgagatttctaagacgattaatctgaccgatagacaagtcaaaatctggttccagaatcggaggatgaagctcaaaaaaatgaatcgcgagaacagaattagagaactgactagcaactttaattttacatag

SEQ ID NO: 226305 - DNA, 915 bp, Artificial Sequence
  Description of Artificial Sequence: Synthetic coding sequence
atgtttaattctgttaacttgggtaacttctgtagcccctcgcgcaaagagagaggcgctgacttcggggagcgagggtcctgtgcatctaacttgtacctgccatcttgcacctactacatgcccgaattcagcacagttagcagctttttgccgcaggcaccctctaggcagatctcttacccctatagcgcccaggttcctccggtgagggaggtcagctacgggcttgagccaagtgggaagtggcatcacagaaattcgtactctagttgttatgctgccgcagacgaactgatgcaccgcgaatgcctgcctccttccactgtgaccgagatccttatgaaaaatgaggggtcctatgggggacaccatcaccctagcgcaccacacgctacccctgccggattctatagcagtgttaataagaactcagtactgccacaggctttcgataggttttttgataatgcttattgtgggggaggtgacccgcctgcggaaccaccatgctccgggaagggtgaggctaaaggcgaaccagaggctccccctgccagcgggctcgcatcccgggcagaggcgggagcggaggcggaagcagaagaagagaatactaacccatcatcatctggcagtgcacatagcgtcgccaaggaacctgccaaaggggctgcgcctaacgctccacgcacacgtaaaaagcgctgcccttactccaaattccagattcgcgagttggagcgggagttcttctttaacgtgtacatcaataaggagaaaaggttgcagctaagccgcatgctcaatttaactgaccgtcaagttaagatatggttccagaatcgccgtatgaaagagaagaaactcagtcgggataggctgcagtatttctctgggaatcccctgctctag

SEQ ID NO: 226306 - DNA, 849 bp, Artificial Sequence
  Description of Artificial Sequence: Synthetic coding sequence
atgggggaacacaacttgcttaatccaggctttgtggggcctctcgtaaatattcatacaggagatacgttttacttccccaatttcagggcatctggcgcacaactgcccggattgcctagtctgtcctatccccgtcgggataacgtttgttcactgagttggccgagcgctgagccttgcaatggttacccccagccatatctcggatctcctgtgtctctgaatccacctttcgggcgaacctgcgaacttgcacgagtggaagacgggaaaggctattacagagaaccttgtgctgaggggggagggggtggtctgaagcgagaggagcggggtagggatcctggggctggcccaggcgctgctctgttgcctctggagccgtccgggccacctgctctggggtttaagtacgattacgctgctggagggggaggaggtgacgggggtggaggggctgggcctccccacgatccacccagctgccaaagcctcgaatcagattcctcatcctctctgctgaacgaaggcaacaagggagccggagctggggacccaggttcactggtgagtccactgaatcccggaggagggctgtctgcgagcggcgctccatggtatcctatcaacagcagaagtcggaagaagaggaagccttattctaaactccaactagccgagctcgaaggcgagttcctggtgaacgagtttattaccaggcagcggaggcgggaactctcagatagattaaatttatcagaccaacaagttaaaatctggttccagaataggaggatgaagaaaaagcgcttgttgctcagagaacaagccctgtccttcttttag

SEQ ID NO: 226307 - DNA, 993 bp, Artificial Sequence
  Description of Artificial Sequence: Synthetic coding sequence
atgacaaccagtctgctactacacccacgctggcccgagagtctgatgtacgtgtacgaagattctgcagctgagtccgggatcgggggtggcggagggggaggaggcggaggcaccggcggagcgggaggcggatgcagtggtgcatcaccgggaaaagctccatcgatggacgggttggggtcatcatgtcctgcctcccactgcagggatttactcccgcatccagtgttggggcgacccccagcccctcttggcgctccacagggcgctgtctatacggacatcccagccccagaagctgcgcgacagtgtgccccaccccctgctcctcccacctcctccagtgccacgctgggttacgggtacccttttggcggatcctactacgggtgccggcttagccataatgtgaacttgcagcagaaaccctgcgcctaccaccctggggacaaatatccggagccttccggtgccctcccgggagatgacctctcttccagagccaaggaattcgccttttacccatcatttgcctcttcgtatcaagcgatgccgggatatctagacgtaagcgtggtgccgggaattagcggacaccctgaaccaagacacgacgcccttatccccgtcgaaggctatcagcactgggcactgagcaatggttgggactctcaagtttactgctctaaggagcagtcccagagcgctcatctgtggaagtccccctttcctgacgtggtgcccctccaacctgaggtgtcgtcgtacaggagggggagaaagaagcgggtaccctacaccaaagtgcagctgaaagaactggagaaagaatatgcagccagcaagtttattacaaaagaaaagcggagacgtatatccgctactacaaatctgtctgaacgccaagtcacgatatggttccagaacagaagagttaaggaaaaaaaggtggtcagtaaaagtaaggccccacacctacatagtacatag

SEQ ID NO: 226308 - DNA, 795 bp, Artificial Sequence
  Description of Artificial Sequence: Synthetic coding sequence
atgatcatgtcttcctatctgatggatagcaactatatcgatcctaaattcccaccttgcgaggagtactcccagaactcatatatacccgagcactcccccgagtactacggcagaactcgcgagagcggcttccagcatcatcatcaggagttgtacccaccgcctccacctagacccagttatcctgaacgtcagtattcatgtacaagcctgcaggggcctggaaactcgagggggcatggcccagcccaagccggacaccaccacccggagaagtcccagagcctttgcgaacccgcacctcttagcggggcttcagcctctccctcccctgcgccaccagcgtgttcccagccagctcccgaccatccgagcagcgctgccagcaagcaaccgattgtctatccctggatgaagaagatccatgtgtccactgtcaaccccaactacaacggaggcgaaccaaagcggtctagaacagcatacaccaggcagcaagttctggaactcgaaaaggagtttcattataatcgctacttgaccagacgcagacggatagaaatcgctcactccctgtgtctgtcggagagacagatcaaaatatggttccagaatcgcaggatgaaatggaaaaaggaccataggctgccaaacacaaaggtgcgctcagctcccccagctggggctgccccaagtacgctctccgccgcaacccccggaaccagtgaagaccactctcagtctgctaccccacccgagcagcagagggcagaagacataacaaggctgtag

SEQ ID NO: 226309 - DNA, 795 bp, Artificial Sequence
  Description of Artificial Sequence: Synthetic coding sequence
atgataatgagttcttatctaatggacagcaattatatcgatccgaagttcccgccttgtgaagagtactcacagaactcttacatccccgaacactcaccggagtactacggtaggacaagagagtccggattccaacaccatcatcaggagctttatcctccgccacctcctcggccatcataccctgaaagacaatattcatgtaccagcctgcagggacctggtaatagtcgcggtcatggtcccgctcaggcaggccaccaccaccctgaaaagtcacaatccctatgcgaacctgcacctctgagcggagcttccgcttctcccagccctgcccctcccgcttgttcgcagcctgccccagaccatcctagttcagctgcatccaagcaaccgattgtttacccctggatgaaaaagatccacgtgtctaccgtgaatccaaattacaacggcggtgagcccaagcggtctcggacagcctacactcgtcagcaggtcctcgagctggagaaggaattccattacaatcgctatctgacacgcagacggcgaattgagatagcccactccctgtgtctgagtgaacgccagatcaaaatatggttccaaaatcgacgaatgaagtggaaaaaagatcacagactgccaaataccaaggtccgctctgcgcctccagctggggctgcaccgtccactctgtcagctgcaactcctgggacatcagaggaccactcacaaagcgcgacgccccctgagcagcagagagccgaggatatcacccgcctgtag

SEQ ID NO: 226310 - DNA, 669 bp, Artificial Sequence
  Description of Artificial Sequence: Synthetic coding sequence
atgtctagctatgttgccaactctttttacaaacagtcccctaatattcctgcatacaatatgcagacgtgcggaaactacggatctgcgtccgaagttcaggcctctaggtactgttatgggggtctcgatctgtcaattaccttcccaccacctgcccctagcaactccttacatggtgttgatatggccgcaaacccacgcgctcaccccgatcggcctgcatgttccgcagccgctgccccaggacacgcccctgggagggacgaggccgcacccctcaatcccggtatgtattcacagaaagcggctcggccagcgctggaggagcgtgccaaatcttctggagagattaaagaagaacaggcacagaccgggcaacccgctgggttgagtcaacccccagcaccaccacaaatctacccatggatgacaaaactacatatgagccatgagaccgacggcaaacggagccgcaccagttacacaagataccagacactggagctggaaaaagagtttcatttcaatcgctacctgactaggcgccgaagaattgaaatcgccaacaatttgtgtctaaacgagcgtcaaatcaagatttggttccaaaatagaagaatgaagtggaaaaaagatagcaaaatgaagagcaaggaagccctgtag

SEQ ID NO: 226311 - DNA, 708 bp, Artificial Sequence
  Description of Artificial Sequence: Synthetic coding sequence
atgaatagctacttcactaatccgagtctgagctgtcatttggccggtggccaggacgtactgccaaatgtcgcgctaaactctacagcctacgatccagtacggcatttcagcacttacggggcagcagttgcccagaatcgtatctattcaacacccttctatagcccccaagagaatgtggtgttttcatcttcaagaggtccatatgactatgggagcaactctttttaccaggaaaaggacatgctctccaactgtcgacaaaataccttgggccataacacacagaccagtatcgcccaggatttctcctccgaacaaggtaggacggcacctcaggaccagaaggcttctattcagatatacccatggatgcagcgcatgaatagccactccggcgtgggctatggcgcagatagaagacgtggccgtcagatctacagccgatatcagactctcgagcttgaaaaagaattccactttaatcgataccttactcgccgaaggaggatagagatcgccaacgcactctgtctgactgagcggcagataaagatctggtttcagaatcgccgaatgaagtggaaaaaggaatctaacctgacctctacactcagcggcggaggagggggagctactgcggattccctgggaggcaaggaggagaagcgcgaggagaccgaagaggagaagcaaaaggagtag

SEQ ID NO: 226312 - DNA, 462 bp, Artificial Sequence
  Description of Artificial Sequence: Synthetic coding sequence
atgctgtccaattgtcgccagaacacccttgggcacaacacgcagacgagtatcgcccaggacttcagttcagagcaaggcagaaccgctccacaggatcagaaggcatcaattcagatctacccttggatgcagcggatgaattcgcattctggagtcggttacggtgcagacagaaggcgcggaaggcagatatactctcggtaccagaccttggaactggagaaagagttccatttcaaccggtatctaactcgtcgaaggagaatagagatagcgaacgctctgtgcctcaccgagcggcagatcaaaatctggtttcagaacaggcgtatgaagtggaaaaaggagtccaacctgacgagcaccctgtccggcggaggcggtggagctacggctgacagcttaggcggaaaggaggagaagcgcgaggaaacagaggaggaaaagcaaaaagaatag

SEQ ID NO: 226313 - DNA, 159 bp, Artificial Sequence
  Description of Artificial Sequence: Synthetic coding sequence
atgttgtcaaactgtagacagaacactttgggacacaatactcagacttcaatcgctcaagactttagctccgagcaagggaggactgcccctcaagaccagaaagcctcaatccagatttacccatggatgcagagaatgaactcccactcaggctag

SEQ ID NO: 226314 - DNA, 216 bp, Artificial Sequence
  Description of Artificial Sequence: Synthetic coding sequence
atgctgtctaattgcaggcaaaataccctcggtcacaatacacaaacgtccatcgcacaggattttagctctgagcagggcaggacagctccgcaagatcagaaagcgtccatacaaatctacccttggatgcaaagaatgaactcccacagtgtgtgcttcgtgcccggatctctaggggtggggtacggcgcagacaggcggcgtggacgttag

SEQ ID NO: 226315 - DNA, 729 bp, Artificial Sequence
  Description of Artificial Sequence: Synthetic coding sequence
atgagtagctacttcgtaaaccctttgttctctaagtacaaggctggtgagtctcttgaacccgcatactatgactgccgctttcctcagagcgttggacgatcacacgctctggtctacgggccaggcggaagtgcccctgggtttcagcatgccagccaccatgtgcaggatttttttcaccatggaacttctggcataagcaattctggctatcagcaaaacccttgttctctgagttgccacggagacgcgtcaaagttctacggctacgaggccctccctcgtcagagcttgtacggcgctcagcaagaggcatcagtcgtgcagtatccagactgcaagtctagtgcaaatactaactcttccgagggccagggccacctaaatcaaaatagctctcccagcctcatgtttccctggatgagacctcacgcaccagggcgaagaagtggtagacaaacatatagtaggtatcagactctcgagttagaaaaagagttccttttcaacccctacctgacccgaaagcggcgaatcgaagtgtcccatgctctgggtctgactgaaagacaagtcaagatttggtttcaaaatagaagaatgaaatggaagaaagaaaacaataaggacaagctgcctggcgcaagagatgaggagaaagtggaagaagagggtaacgaggaagaggagaaagaggaagaggagaaggaggaaaataaagactag

SEQ ID NO: 226316 - DNA, 783 bp, Artificial Sequence
  Description of Artificial Sequence: Synthetic coding sequence
atgtctgccactgggcctatttccaactattatgtcgactcgttaatctcacatgataacgaggacttgttggccagcagattccctgccaccggagctcatcccgctgccgctaggccctcaggacttgtacccgactgtagtgactttccatcttgttcattcgcccctaagccagccgtattttccacttcctgggcccctgttcctagccagagcagcgtggtgtaccacccatacgggcctcagccccatctgggcgctgatacccgctatatgcgcacttggctggagccactgtctggcgcagttagtttcccctccttcccagccggaggacgtcactacgctctcaaacccgacgcctacccaggacggagggccgattgcggacccggagaagggaggagttatcccgattatatgtatggaagcccaggggagctgagggaccgcgcaccacaaaccttgcccagtccggaagccgacgcactggcaggatctaaacacaaagaggagaaggctgatctcgatccttctaacccagttgctaattggatacatgctcggagcacccgcaagaaacgatgtccttacactaaatatcagacgttagaattagaaaaagagtttttgttcaatatgtatctcacacgggataggcgctacgaggtcgcacgcgtcttaaacctaacggagcggcaggtgaaaatatggtttcagaataggagaatgaagatgaaaaagatgaataaggagaaaactgacaaggagcagtcatag

SEQ ID NO: 226317 - DNA, 783 bp, Artificial Sequence
  Description of Artificial Sequence: Synthetic coding sequence
atgtctgcaacaggtcctataagcaattactatgtggacagcctaatcagtcacgacaatgaagacctccttgcttctcgtttcccagcaacaggagctcaccctgccgctgccaggccctccggattagtccccgactgtagtgattttccaagctgctctttcgctccaaagccagctgtattcagcaccagttgggctcccgtaccatcccaaagcagtgtagtctatcacccatatgggcctcaacctcatctcggagctgacacgaggtacatgcgaacttggctcgagccattaagcggagcggtttctttccctagcttccctgcaggtgggaggcattatgccctcaaacctgacgcttatccagggaggagggcagattgtggacccggagaaggccgatcctatcctgactacatgtacgggtccccaggcgaactgagggacagggccccacagactctccccagtcctgaagcagatgcactggctgggagcaaacacaaggaagaaaaggccgatctggacccatctaatcccgttgctaactggattcacgcaagatctaccaggaagaaaagatgtccgtacacaaaataccaaacactcgaactcgaaaaggagttcctctttaatatgtacttaacaagggacaggagatacgaagtggcacgagtcctcaacctgactgagcgtcaggtaaagatttggttccagaatcgcagaatgaagatgaaaaaaatgaacaaggaaaagaccgataaagagcaaagctag

SEQ ID NO: 226318 - DNA, 987 bp, Artificial Sequence
  Description of Artificial Sequence: Synthetic coding sequence
atgtccagttatctggaatatgtgagttgctcctcatccgggggagtagggggagacgtgctctctctggccccaaagttctgcaggtctgacgccagaccagttgctctccagcctgcattcccactgggtaacggggacggcgcttttgttagttgtttacctcttgctgccgctcgtcccagcccctcaccgccagccgcacctgcaagacctagcgtacctcctccggcagcccctcagtacgcacagtgcacgctggaaggcgcttatgaaccaggagcagcccctgcagctgctgctggcggagccgattacggatttctcggttccgggccagcctacgattttccaggggtgcttggtagggccgcagatgatgggggatcgcacgttcactacgctacaagtgctgtcttctccggaggcggaagtttcctgctcagtgggcaggtggactacgcagcatttggggagcctggtcccttccctgcatgcctgaaggcatccgccgacggacatccgggagcatttcagacggcctcccccgctcctggtacatatccaaaatcagtcagccctgcctccggacttcctgctgcattctccactttcgagtggatgaaggtgaagagaaacgcttccaagaaaggcaagctggcggagtatggggcagcttctcctagcagtgctatcagaacaaacttttccacaaagcaactgacagagctcgaaaaagagtttcatttcaacaaatacctcacaagggcccgtcgcatagagattgctaactgcctacaccttaacgacacacaggtgaaaatctggtttcagaacaggcgcatgaagcagaagaaaagggaaagggagggcttgctggcaaccgccattcccgtcgcaccactgcagctgcccctgtccggcacaacgcccacaaagtttatcaagaatcccggatctcccagccagagccaggagccatcctag

SEQ ID NO: 226319 - DNA, 630 bp, Artificial Sequence
  Description of Artificial Sequence: Synthetic coding sequence
ctggaaagggccgctcgcgtggagagggccggtggggctgcacaaacagccgctgtgcttctctccctttgtcccgctccctattctgggccaggactcagaccccacctggcattcgcccctgggcgaccccgagcagctgtccgtacagcgagcggacgggctcccgttcgggctgtgcatccaggaggtgggctgcgtacttggtgccgtacttgtcgcggttcttgggggagaggccttcgcctgcccggtgttcgagctggggtccgactccctgggagagccggagccggagggccatttcccgcttgcctgaaagcctctgctgacggccatcctggtgcgtttcagacagcaagtcctgccccaggcacctatcccaagagcgtgagtccggcatctggtcttcctgctgccttctcaacatttgaatggatgaaagtgaagagaaacgctagcaaaaaggacagcggtttggggtttgttgaggagacccggagccgagcgaatagtatggagagtgcatcctccacagatagcgaaaatgtgcccggaattgaaaagatatccggcagaagttctccctggaatttctcgtggcagacccgcagagtgtggggcaggtag

SEQ ID NO: 226320 - DNA, 1023 bp, Artificial Sequence
  Description of Artificial Sequence: Synthetic coding sequence
atgtcatttcctaacagcagtcccgctgcaaacactttcctggttgattctctcatcagcgcatgcaggtccgatagcttttattcatccagcgcttctatgtatatgccacccccaagtgctgacatgggtacctatgggatgcaaacatgcggacttctaccttctttggctaagcgcgaggtgaaccatcagaatatggggatgaacgtgcacccttacatcccccaggtggactcctggaccgatcccaataggtcttgcagaattgagcaaccagtgacacagcaggtgccaacatgcagcttcacgaccaatatcaaagaagagtctaattgttgcatgtattccgacaagaggaacaaactcatcagcgccgaggtgccttcttatcagcgcctggtgcctgagtcctgccccgtggagaatccagaagtgccagttcccggatatttccggctttctcaaacgtatgcaaccggaaagacacaagaatataacaactcccccgaaggatccagcacagtgatgctgcagctaaaccctagaggcgctgctaaaccacagctctcagcggcacagctgcagatggagaagaaaatgaacgagcctgtgagtgggcaggagccgactaaagtgtctcaggtggaatcacccgaggcgaaagggggactgccagaggaacggtcttgcctagccgaagttagcgtctcatctcctgaggtgcaagagaaggaaagtaaagaagagatcaaatcagacactccaacctctaactggctcacagcaaaatcaggccgtaaaaaacgctgtccctacacaaagcaccagaccttggaattggagaaggaattcttattcaatatgtacctgacaagggagagacggttggagattagcaaatcagtgaacctgactgacagacaagttaagatctggtttcagaaccgccgtatgaaactgaagaaaatgtcgagggagaaccggattcgggaacttacagccaatcttacattcagctag

SEQ ID NO: 226321 - DNA, 1017 bp, Artificial Sequence
  Description of Artificial Sequence: Synthetic coding sequence
atgaacgattttgacgaatgcggccagtccgccgctagcatgtaccttcctgggtgtgcatattatgttgcgccatcggacttcgcctccaagccctccttcctgtcacagccctcttcatgtcagatgacgttcccgtatagttccaacctcgctccccatgtgcagccagttagggaggttgcgtttagggactacggattggaaagagccaagtggccatatcgcggaggaggaggaggaggaagtgccggtggcggatcgtccggaggagggccaggcggagggggaggcggagcgggtggttatgcaccctactacgccgctgctgccgcagctgccgcagcagcggcagccgctgaagaagccgcaatgcagcgcgagctgctgccaccagctggccgtcgaccagatgtgctctttaaagcccctgaaccagtctgcgctgcacctggtccccctcacggcccagcgggagcagccagcaatttttacagcgccgtgggtaggaatggcattctgccccaggggttcgatcagttttatgaagccgcacccggtcccccttttgccggtcctcaaccaccacccccaccagcccctccccagcctgagggggcagctgacaagggagatcccagaactggcgctggaggtggcggtggcagcccgtgtacaaaagccactccgggatccgaaccgaagggggctgctgaaggctccggcggtgacggagaggggcctcccggtgaagcaggcgcagagaaaagctcctccgctgtggctccgcagcgctcacggaagaagcggtgcccctataccaagtaccagattcgggaactcgagagggaattctttttcaatgtctacatcaacaaggagaaaaggctgcagctcagccggatgttaaacctgacggataggcaagtcaaaatctggtttcaaaaccggaggatgaaggaaaaaaagctcaatagagaccgattgcaatacttcacgggcaatccgctgttctag

SEQ ID NO: 226322 - DNA, 480 bp, Artificial Sequence
  Description of Artificial Sequence: Synthetic coding sequence
atgtatctgcccggatgcgcctattacgtagctcctagcgatttcgctagcaagccctcctttctgagccagccatcttcctgtcagatgacctttccttactctagcaacctggcccctggaggaggttccccctgtacaaaggctacccccggatcagaacctaaaggcgctgccgagggaagtggaggggatggggaaggccctcctggggaggcaggcgcagaaaagagctcctccgccgttgcaccccagcgcagtaggaagaagcgctgcccctacacgaagtaccagatccgggaattggaacgggagttctttttcaacgtgtacatcaacaaggagaagcgtctccagctctccaggatgctaaaccttactgaccggcaggtcaaaatctggttccagaacaggaggatgaaagaaaagaaactaaatcgagataggctccagtactttactggtaaccctctattttag

SEQ ID NO: 226323 - DNA, 813 bp, Artificial Sequence
  Description of Artificial Sequence: Synthetic coding sequence
atgtgcgagcgctccctttaccgcgctggttatgtgggatctctgttaaatctccagtccccggatagtttctatttctccaacctgcgaccaaatggcggacagttggccgctctgcccccaatttcttacccccgaggggctcttccatgggcggctacccccgcttcatgcgcccctgctcaacccgcaggggctacggcctttggcggattctcccagccatatttagcgggatccgggcctttgggcctccagccccctacagcaaaagacggaccggaggaacaggcaaaattctacgctccggaggctgccgctggaccagaagaaaggggccgtactcggccttctttcgctcccgagtcgtccctggcaccagctgtcgcagccttgaaggccgcaaaatacgattatgctggggtcggacgggctacaccaggatccactactcttttgcagggcgcaccttgtgcccctggtttcaaggatgatactaaaggaccgctcaatcttaacatgacagtccaggccgctggtgtcgcttcctgtcttcggccttctttaccagatgggctcccttggggcgcagccccaggccgtgccagaaagaaacggaagccttatacaaaacagcagatcgcagaacttgagaatgaattcctggtgaatgaattcataaaccggcagaagaggaaagagctgagtaatcgattgaatctgagtgaccagcaggtcaagatctggttccaaaatcgcaggatgaagaagaagagagtggtcctacgtgaacaagccctcgctctatactag

SEQ ID NO: 226324 - DNA, 1299 bp, Artificial Sequence
  Description of Artificial Sequence: Synthetic coding sequence
atgctgttcgagcagggtcagcaggctctagaactgcctgaatgcacaatgcagaaggccgcatattacgagaatcctggtctcttcggcggatacggttatagtaagaccacagacacttacggatattcaactcctcatcagccctacccgcctcctgccgctgcgtccagcttggacaccgactatcctggctccgcttgcagcattcagtcctcagcaccactcagggctccagcccacaaaggtgccgagttgaacggcagctgtatgcggccaggcactggcaacagtcaagggggtggagggggtagtcagccccctggtttaaattccgagcagcagccccctcaacccccaccaccaccccctacgctgccaccctcgtctcccactaacccagggggaggggtgccagccaagaagccgaaaggaggcccaaacgcttccagctcttcggcaaccatcagcaaacagatctttccgtggatgaaggaaagccggcagaacagcaaacagaagaactcatgcgctaccgccggagagtcctgcgaggataagtcacctccaggacctgcaagtaaaagagtgcggacagcctatacgagcgcccagctggtggagctggagaaggaattccattttaaccggtacctctgccgccctaggcgggtcgaaatggcaaacctcctgaacctgactgaaagacagataaaaatatggttccaaaatcgaagaatgaagtacaaaaaggatcaaaaggctaaagggattctgcactccccggcttcccagtcgcccgagcggagtccccctttggggggagccgcagggcacgtagcctactccggacaactcccacctgtgcccggtctggcgtacgacgccccaagcccacccgcatttgcgaagagccaacccaatatgtacggcctcgcggcttacacggctccgttgagctcctgtctgccgcaacagaaaagatacgccgctccagagttcgaacctcatccaatggcttcaaatggaggcggatttgcttcggccaatctgcaaggcagccccgtctatgtaggcggtaatttcgttgagtcaatggctccagctagcgggcctgtgttcaacttagggcacctaagccatccaagctcagccagcgtggattattcttgcgcagcgcagatccctggcaaccaccaccacggaccatgcgacccacacccgacctacacggatctgagtgcccatcactcatcgcagggtcggctccccgaggctccgaaactgacacacctttag

SEQ ID NO: 226325 - DNA, 1299 bp, Artificial Sequence
  Description of Artificial Sequence: Synthetic coding sequence
atgctctttgaacaaggacagcaggccctcgagctgccagagtgcacaatgcagaaagcggcatattacgaaaaccccggactgtttgggggatatggttattccaaaacgacggacacatatggatattcgaccccccatcagccatatccacctcctgcggctgcgtctagtctggacacagattatccaggctccgcatgctccattcaaagcagcgcacccctgagagcgccagcacacaaaggggcagagttaaatgggagttgtatgcgtccaggtacagggaacagccaaggtgggggtggaggaagccagccacctggcttgaactctgaacagcagccccctcagccccctccacccccacccaccctgccaccaagttcacccaccaatcccggtggcggtgtgcccgctaagaagcccaaagggggtcccaacgcatcttcatcatcagctaccatctcgaagcagatcttcccctggatgaaggaatctcggcagaacagcaaacagaagaacagctgcgctacagccggagagagctgcgaggataaatccccacccggaccggcttcaaagcgagtgcgcactgcttatacttctgctcagcttgtcgagctcgagaaagaattccactttaaccgatacctctgccgccctcgcagagtcgagatggctaatctgcttaacctgaccgaacgacagatcaaaatctggttccagaatcgaaggatgaagtacaagaaggaccagaaagcgaaaggtatccttcacagcccagctagccagtctccagagagatctccaccattaggcggagccgcagggcatgtggcttactcagggcagttgccccctgtacctggactggcctatgatgccccatccccacccgcattcgcaaagtcacagcctaacatgtatggattggctgcctatacggctcctttgtcctcttgtctcccacagcagaagcggtacgctgcacccgaatttgagccacatccaatggcttccaacggcggtgggtttgccagcgccaatctgcagggctcccctgtttacgtcgggggtaacttcgtggaatcgatggccccagcgagcgggcctgtgtttaacctgggacacctcagccacccatcctcagcctcagttgactattcctgcgccgcacagatccccggaaatcaccaccacgggccttgtgatcctcaccccacatacacagatttatcggcacatcactctagccagggtagactgcctgaggcccctaagctcacccacctgtag

SEQ ID NO: 226326 - DNA, 303 bp, Artificial Sequence
  Description of Artificial Sequence: Synthetic coding sequence
atgttgttcgagcagggtcaacaggccttggagcttccagagtgtaccatgcagaaagctgcatattacgaaaaccctgggttgtttggaggatatggatactctaaaactactgacacctacggctactctactccccaccaaccttaccccccaccagccgcagcaagctctctcgacaccgactatcccggtagtgcttgctcgatccagtcaagtgccccactccgagctcccgctcataaaggagccgagctgaacggcagctgtatgaggccgggaacggggaattcccaaggatag

SEQ ID NO: 226327 - DNA, 1299 bp, Artificial Sequence
  Description of Artificial Sequence: Synthetic coding sequence
atgctctttgaacaaggacagcaggcccttgaacttcctgaatgcactatgcagaaggctgcctactacgaaaaccccggtctgtttggcggttacggatactctaagactactgatacctacggctatagcactcctcaccagccgtatccccctccggcagcagccagctccctggacaccgattaccccggatcagcttgcagcatccagtcttctgcgcctctgcgggctccggctcataagggtgcagagttgaatggcagttgtatgagaccaggaaccggcaatagccagggaggcggtggaggcagccagccaccaggcctgaatagcgaacaacagccaccccagccaccacccccacccccaactttaccgccttcaagtcccacaaaccctggtgggggtgtccccgctaagaagccaaaagggggacccaatgcgtcttctagtagcgcaactattagcaagcagatttttccgtggatgaaggagtctcgtcaaaactcaaaacaaaaaaattcttgtgcaacggcaggagaatcctgcgaggataagagtccgcctgggcctgcatccaagcgcgtacgtacagcctatactagcgctcagctggtcgaactcgagaaagaatttcattttaatcgatatctttgccggccaaggcgagtcgaaatggccaacctcctgaaccttaccgagagacaaatcaaaatctggtttcagaacaggcgaatgaagtacaagaaagaccagaaggctaagggcattctgcactccccagccagccagagccccgagaggtctccacctctaggcggagccgctggccacgtagcatattccggccagctgcctccggttcccggactcgcgtacgacgcccctagccctcccgcatttgcgaaaagccagccaaacatgtatggcctggctgcatacaccgccccactctcttcctgcctgccgcagcagaagcgttacgccgctcctgaattcgagcctcaccccatggcatcaaatggtggcggattcgcctcagccaacttgcaggggtctccggtatatgtggggggtaactttgtggagtcgatggctccagccagcggcccagtctttaacctcggccaccttagccatccatcctccgctagtgttgactacagttgtgctgctcagattccaggcaatcatcaccacggaccatgtgatccccatcccacatacactgaccttagtgcccatcactcgagccagggtcgcttgcctgaggcacctaaactcacacacctctag

SEQ ID NO: 226328 - DNA, 768 bp, Artificial Sequence
  Description of Artificial Sequence: Synthetic coding sequence
atggtgatgtcctcgtacatggtgaattcaaaatacgtagaccccaagtttcctccctgtgaggagtacctgcagggtggctatctgggggagcagggggcagattactacgggggtggggcacagggcgctgacttccaaccaccaggcctgtatcctagacccgattttggcgagcagcctttcggaggcagcggacccggacctgggagcgccctgcctgcaagggggcacggccaggaacctggcggtccaggagggcattatgccgctccgggagaaccctgtcctgcaccccctgcacctcctcctgccccactccccggtgccagggcgtattcgcagtcagaccccaaacagcctccatccgggacagctctgaagcagccggcagtagtgtatccatggatgaagaaggttcacgttaactcggtgaatcccaactacacaggcggtgagccaaaacgctccaggactgcttacactcgccagcaggttttggaactggagaaggaattccattttaaccgctatttgactcggaggcgaagaattgagatcgcccacaccctctgcctcagcgagagacagataaagatttggtttcaaaacagaagaatgaaatggaaaaaggatcataaattgccgaacacaaagggacgtagcagctcctcgagctcttcctcttcctgcagtagcagcgtcgccccttcacaacatctgcaacccatggcgaaagaccaccataccgatctcaccaccctgtag

SEQ ID NO: 226329 - DNA, 873 bp, Artificial Sequence
  Description of Artificial Sequence: Synthetic coding sequence
atgtctagttacttcgtgaatcccttatatagcaaatacaaggccgcagcggcagctgcagctgccgcaggcgaagctattaacccaacatactacgattgtcattttgccccagaagtaggcggaagacacgcggctgccgctgccgcactgcagctgtacggcaactcggcagccggattcccacacgctcctccgcaggctcacgcccatccccacccttcacctccaccctcagggactggctgtgggggacgcgaaggacgtggacaggaatacttccatccagggggaggatcccccgcagctgcctaccaggccgctccccctccaccgcctcacccgcctccaccccctcccccacctccatgcggcggtatcgcctgccacggggaaccggcaaaattctatggatatgacaacctccagaggcagccaattttcacaacccagcaggaagctgagctggtacagtacccagattgcaaaagctcaagcggaaacatcggggaggatcccgaccacctgaatcagtcatcaagcccatcacagatgtttccctggatgaggcctcaggccgctccagggcgaaggcggggtcggcaaacctactctcgctttcagaccctcgagctggagaaggaattcttgtttaatccatacctgaccaggaagcggaggatagaggtttcgcacgccctcgctctcaccgagcgccaggtcaagatctggttccagaaccggcgtatgaagtggaaaaaggagaacaacaaagataagtttcctgtgagccgtcaagaggtgaaggacggtgaaactaagaaggaggctcaagaactggaggaggatcgtgccgaggggcttaccaattag

SEQ ID NO: 226330 - DNA, 870 bp, Artificial Sequence
  Description of Artificial Sequence: Synthetic coding sequence
atgagcagctactttgtgaatccactgtattccaaatataaggccgcagcagccgcagccgctgccgctggggaagccattaacccaacatattatgactgtcactttgcccctgaggtcgggggtcggcacgcagccgctgctgcagctctccaactttacgggaactcagcagccggtttccctcatgcccctccacaggcccacgctcatccacacccttcaccacccccatcagggaccgggtgtggcggtagagaaggacgcggtcaagagtacttccaccccggagggggatctcctgcggcagcgtatcaggcagcgccaccgccacctcctcacccccctcctcctccccctccccctccatgcggcggaatcgcatgtcatggcgagcctgcgaagttttatgggtatgacaacctgcagcggcagccaatctttaccacccagcaagaagctgagttggtacagtaccccgattgtaagtctagtagcggaaatattggggaagatccagaccacctgaaccaatcctcctcaccgagtcagatgttcccctggatgcgcccacaggcgccagggaggagacgtggtcgacaaacatactccagattccagacactcgagctggaaaaagaattcctctttaacccctacctgaccaggaaacgtagaatagaggtcagtcacgcccttgccctgacagagagacaggtgaagatctggttccagaaccggcgaatgaagtggaaaaaggagaataacaaagacaagttcccggtgtcacgacaggaggtcaaggacggcgagaccaagaaagaggcccaagaacttgaggaggacagggcggaaggcctgacgaactag

SEQ ID NO: 226331 - DNA, 870 bp, Artificial Sequence
  Description of Artificial Sequence: Synthetic coding sequence
atgtcatcttatttcgtgaaccccctgtactctaagtataaggcggcagcggcagcagccgctgccgctggcgaagccattaatccgacctactacgactgccactttgctccagaagtggggggtcggcatgccgcagccgcagccgctctgcagctctacggtaattcggccgctggcttccctcatgctccccctcaggcacatgcccatcctcaccccagcccgccaccctccggaacaggctgcggtggcagggagggaagggggcaggaatacttccaccccggtggcggaagccccgctgccgcttaccaggctgccccacctcctcctccccatccaccaccccctccaccccctccaccatgcggcggtatcgcctgccacggcgagcccgcaaaattttacggctacgacaatctccagaggcaaccaatcttcacaacgcaacaggaggccgagctagtccagtacccggactgcaagtcaagtagtgggaacattggggaggaccccgatcatctgaaccagtcgagctctccatctcaaatgtttccgtggatgaggcctcaggccccagggcgacggagagggaggcaaacatactcccgatttcagactctggagctggagaaagaatttttgtttaatccctatctcacccgcaagcgcaggatcgaagtatcacacgctctagcactaactgagagacaggtcaagatctggtttcagaacaggaggatgaagtggaagaaggagaacaacaaagacaagttccctgtctccaggcaggaggtgaaagacggtgaaactaagaaggaagctcaggaactcgaggaagatagagcagaaggcctgaccaactag

SEQ ID NO: 226332 - DNA, 321 bp, Artificial Sequence
  Description of Artificial Sequence: Synthetic coding sequence
atgttcccctggatgaggccacaggccgcacccggtcgccgacgagggagacaaacatactcccggtttcaaaccctcgagctcgaaaaggagtttctgttcaatccctacttaacccgcaaacgaagaatcgaagtgtctcacgctctcgctctgaccgagcggcaagtaaagatctggttccaaaaccgcaggatgaaatggaaaaaggagaacaacaaggataaatttcccgtgtctcgtcaggaagtcaaggatggggaaacaaagaaagaggcccaagaactggaggaggaccgggctgagggcctcactaactag

SEQ ID NO: 226333 - DNA, 1059 bp, Artificial Sequence
  Description of Artificial Sequence: Synthetic coding sequence
atgcttggcggttccgcgggacggctcaagatgtcctctagcggcactctgtcaaactattacgtagactcactcatcggccacgagggggatgaggtgttcgccgctcgcttcggtccccctggccctggcgcacagggacgaccagcaggggtggctgacggcccagccgctaccgcagccgagttcgcaagctgctcgttcgctcctagatctgccgtgttcagcgcttcatggagcgccgtccctagccaaccccctgcagcagccgcaatgagcggcttataccacccctatgtgcctcccccacccttagccgcttcagcctccgagccaggaagatacgtgcggagttggatggaacccctgcccggttttcccggaggggctggcggtggcggaggtggtgggggagggggacctggtaggggtccatccccgggtccttctggtccagctaacggcagacattatggaatcaagcctgaaacccgcgctgcgccagccccagctacagccgcaagcacaacaagctcatcatccaccagcctttcttcaagcagcaaaagaactgagtgcagcgtggcccgtgagtctcagggctcttctggccctgagttctcttgcaactctttcctccaggagaaagctgcggctgctaccggaggcacagggccaggtgccggtatcggggctgcaaccggcactggcggttcatcagagccctccgcctgttccgaccacccaatccctgggtgttcactgaaggaagaggagaaacagcactcccaaccgcagcaacagcagttggatcctaacaatcccgcagcaaattggatccatgcaaggtctactcgaaagaaacgttgtccatataccaagtatcagacattagaacttgaaaaagagtttctctttaacatgtatttgacacgtgaccgcagatacgaggttgcgagaattctcaacttaacggagcggcaagtgaagatttggttccagaatcggaggatgaagatgaagaaaatgagcaaagagaagtgcccaaaaggggactag

SEQ ID NO: 226334 - DNA, 2757 bp, Artificial Sequence
  Description of Artificial Sequence: Synthetic coding sequence
ctgcagcccgtgtacgagagcatggcctctcatgtccaggttttctcaccacatactctgcagagctcagcattttgtagcgtgaaaaaactgaaaattgaaccctcctccaattgggacatgactggttacggctcgcattccaaagtgtactcccagagtaagaacattcctctatcacaacctgctaccactacagtttccacgagcctacccgtgcccaaccctagcctaccttacgaacagactattgtgtttcctgggagcactggccacattgttgtgacttcagccagcagcactagtgtgaccgggcaagttctgggcggaccccataacttgatgagacgctccacagtctcgctgttggatacctaccaaaagtgtggtctcaaacggaaaagcgaagagatagagaacaccagcagtgtccagatcatcgaggagcatccgccaatgattcagaacaacgcgtcaggagccactgtcgccacagcaacgacctctacggcaaccagcaagaatagtgggtcaaattcagaaggtgattatcagctggtacagcacgaagtgctctgcagcatgacaaatacctatgaggtgttggagtttttgggccgtgggacctttgggcaggtggtcaaatgttggaagagggggactaatgagatcgtggctatcaagatccttaagaaccatccatcctacgccaggcagggtcagatagaggtctccattctcgctcgcctatctaccgagagtgcggatgattataacttcgtccgtgcttacgagtgctttcaacacaagaaccatacctgtttggttttcgagatgttggaacagaatctttatgatttcctcaagcagaataaatttagcccccttccactcaagtacatccgacctgtcctgcagcaggtagccaccgccctgatgaagctcaaaagccttggactaattcacgccgacctgaagcctgaaaacattatgcttgtggacccgagcaggcagccttaccgtgtgaaggtcatcgactttggtagcgccagtcatgttagcaaggcggtctgtagcacttacctgcaaagtagatactatcgggcacctgagatcatcctgggcctacccttttgcgaggccatcgacatgtggtcactcggctgtgtgatcgccgagttgttcctcggatggcctttgtatccaggcgcttcggagtacgaccagatacggtatattagccagactcaaggactgcccgcagaatacctcctgagtgctgggacaaagaccacgcgcttttttaacagggatactgacagcccctacccgctatggaggctgaaaaccccagatgaccacgaagccgaaaccggcatcaagtctaaagaagcgcgtaaatacatttttaattgcctagatgatatggctcaggttaatatgacgacagacttagagggcagcgacatgcttgtcgagaaggccgaccggagggaattcatcgatctattaaagaaaatgttgacgatagacgccgataagcggattaccccaattgagacgcttaaccacccgttcgttactatgacacacctgctggactttccccacagcacccacgtgaagagctgctttcaaaacatggaaatttgcaaacgtcgtgtaaatatgtatgatacagttaaccagagcaaaaccccttttattacacacgtggcgccatctacctccacaaatctgactatgacctttaacaaccagctgactaccgttcacaatcaagctccctcctcaactagtgctactatttcccttgcaaatcctgaggtgagcatcctcaattatccctccacgctttatcagccatccgccgcatcaatggccgcagttgcccagcgttctatgccccttcagactggtacagcccagatatgcgccagaccagacccatttcagcaagccctgatcgtttgcccccctggcttccagggcctacaagctagtccctccaagcatgctggatacagtgtgcgaatggagaacgccgttccgatcgtgacgcaagctcccggtgcccaacccctgcagatacagcccggactcctggcacagcaagcatggcccagcggcacgcaacagatccttttaccgcctgcatggcaacaactgacaggagtggccacacacaccagcgtgcaacatgctactgtaattcccgagaccatggcaggtacccaacagctggcagattggaggaatacccatgcgcatggctcccattataaccccatcatgcaacaacctgccctgttgaccggccacgtgacgctgcccgctgcacaacccttgaacgttggtgtagctcatgtgatgcggcagcagcccacctctaccaccagctcccgcaaaagcaagcaacatcagtcatcccagcgcaagaacgtgatatcttgcgttactgtgcatgactctccttactcggacagctcgagcaacacaagcccctactccgtgcagcaacgtgcaggccacaacaacgcgaatgcattcgatacaaagggatcgctggaaaaccactgtaccgggaatccacgaacaattatagtgccacccttgaagacccaggccagcgaagtgctggtggagtgcgatagtttagtcccaggcaatctgggtccgggtcagggcagaaatctttccttagagtctggattccctgcctttctgctgcttgaaatgctcctgtacggctcctag

SEQ ID NO: 226335 - DNA, 3596 bp, Artificial Sequence
  Description of Artificial Sequence: Synthetic coding sequence
atggcgccagtatacgaggggatggctagccacgtgcaagtcttcagccctcataccctgcagagttccgcgttttgctcagttaaaaagctaaaaatagagccttcctctaattgggatatgactggttacggatctcattctaaagtgtactcccagagcaagaacatccccctgagtcagccagccactaccacggtgagcacatcgctgcctgtgcctaatcccagcctgccttacgagcagaccatcgtctttccgggatcaacaggacatatcgtggtaactagcgctagcagcacatctgtcacgggccaggtgctgggaggcccacataacctcatgcgccgttccacggtttctctcctggatacctaccaaaagtgtggactgaagcggaaaagcgaggaaatagagaatacgagttctgtgcagatcattgaagaacatcccccaatgatccaaaataatgcctccggagcaacagtcgcaacagctaccaccagtaccgctaccagcaaaaatagcgggagtaacagcgaaggcgactatcagctcgtgcagcatgaggtgttgtgcagtatgacgaatacctacgaagttctggagtttctggggcgaggcacctttgggcaagtcgtaaagtgttggaagaggggaacaaacgagatcgtggcgataaagatcctgaaaaatcatccttcttacgccagacagggtcagatcgaagtctccatcctggcacgactgagtactgagtcagcagatgactataatttcgtgagagcctatgagtgttttcagcacaagaatcacacttgtctcgtatttgagatgctggagcaaaacctctatgattttcttaagcagaacaaattctcccctctgcccctcaagtacattagaccggttctacagcaagtagcgaccgccttaatgaagctaaagagcctgggtctgatccatgccgacctgaaaccggaaaacatcatgttagtcgatcctagccggcaaccatacagggtaaaggtcatcgattttggatccgcgagccatgtcagtaaagccgtgtgcagcacgtacctccagtcaaggtactatagagctcccgagatcattctgggcctgcccttttgtgaggccatcgatatgtggtccctaggctgcgtgattgctgaattattcctcggatggcctctatatcccggagccagcgaatatgatcaaatccgctacatttcacagacacaagggctcccagccgaatatcttctgtcggccggaacgaaaacaacacgcttttttaaccgggataccgactctccctacccactgtggcgtctgaaaactcccgacgatcacgaagcagaaacgggcattaaatccaaggaagccagaaaatacatcttcaattgccttgacgacatggcacaggttaacatgaccaccgatctcgaggggtccgacatgctggtggagaaggctgatcgacgagaattcatcgacttgttgaaaaaaatgcttaccattgacgctgacaagcgcataacccccattgagacactgaaccaccccttcgtgactatgacccatttgcttgattttccgcactccacacatgtcaaatcttgtttccagaatatggagatttgcaaaagacgggtgaacatgtatgatacagttaaccagtccaaaaccccctttattactcatgttgcaccttccacctctactaacctcactatgactttcaacaaccaacttacaacggttcataatcaggcgccaagctcaaccagtgctaccatttccttggcgaatccggaggtgtccatcctgaactaccccagtaccttatatcagcccagcgctgcctccatggccgctgtggcccaacgtagtatgcctttgcagacaggaactgcgcagatatgtgcgaggcccgacccctttcaacaggctcttatcgtatgccctccaggcttccaaggtctccaggcctctccctcaaagcatgccggatactctgtgcgcatggagaacgctgtgcctatagtgactcaggctcccggtgcccaaccactgcagattcagcctggtttactggcccaacaagcttggccctcagggactcagcagattctactcccccctgcgtggcagcagctgacaggagttgcaacgcacacatctgtgcaacacgccactgttatccctgaaacaatggccggtacacagcaactcgcagactggcgcaatacacatgcgcacggcagccactacaaccctatcatgcagcagcccgctctacttactggacacgtgacacttcccgctgcccagccactgaacgttggtgtggcccacgtcatgcgacagcagcctacaagtacaacttcaagccggaagtctaaacagcatcagtctagcgtccggaacgtgtctacctgcgaggtctcaagtagccaggcaatctccagccctcaaagaagtaaaagggtgaaagagaacacaccccctagatgcgccatggtacattctagccctgcgtgcagtacctctgtgacttgcggctggggggatgtggcgagcagcacaacgcgggaacgccagaggcaaaccatagtgatacctgacacaccaagccctactgtgtctgttattaccatctccagtgatacagacgaagaggaagaacagaagcatgcacctactagcacagtcagcaagcagcgtaaaaatgtgatttcctgcgtgacggtgcacgatagcccgtatagcgacagctccagcaatacctcgccctattcagtgcagcaaagagcaggacataataatgcaaatgccttcgacactaaggggagtctggaaaatcactgcacagggaatccgcgaacgatcatcgtcccacccctgaagactcaggctagcgaggttctagtcgagtgcgacagcctcgtgcccgtgaatacttcacatcacagttcctcatacaagtccaaaagctctagcaatgtgactagcacaagtggacactcttccggaagtagctccggagctatcacctataggcagcagcgccctggcccacacttccagcagcagcagccattgaacctgtcccaggcacagcaacatatcacaacagaccggactggatcgcatcgccgacaacaggcctacattacccctacgatggcacaagccccttatagcttcccccataacagcccgagtcatggaaccgtccatccacacctggcagcggcagcagcagccgcacacctgcctacccagccacatttgtatacatatactgcccctgccgcactgggttctacagggacggtagctcacctggtggcttctcaaggtagcgcgaggcacaccgtgcagcatactgcgtatcctgctagcatcgttcatcaggtgcccgtgagcatgggccctcgtgtgctcccttcacccaccatccaccccagtcaataccccgctcagtttgcccaccagacttacataagtgcctcccccgcttcaacagtgtatacgggatacccattgtctcccgctaaggtgaaccagtacccatacatcta

SEQ ID NO: 226336 - DNA, 3516 bp, Artificial Sequence
  Description of Artificial Sequence: Synthetic coding sequence
atggccccagtctatgagggtatggcttctcacgtgcaggtgtttagccctcataccctgcagtccagcgcgttctgctccgtgaagaagctgaagatagagcctagtagcaactgggacatgactggctacggttcccactctaaggtctatagccagtcgaaaaacattcccctaagccagccagcaactacaaccgtcagcacttctctgccggtcccaaatccgagcctgccttacgaacaaactatcgtgtttccgggaagcacgggacacattgtggttaccagtgcttcctccacctctgtcacaggccaggtactcggtggaccgcataatctaatgcgacgttccaccgtctccctcctggatacataccaaaaatgtggtctcaagcgcaaaagtgaagaaattgagaacacatccagcgtgcagatcatagaggaacatcccccaatgatccagaacaatgcatccggcgcaactgtggctacagcaaccaccagcacggctaccagtaagaactccggcagtaactcagaaggggactatcagctcgtgcagcatgaagtcctgtgttctatgactaacacctatgaagtgctagagtttctggggagggggacattcggacaggtggtgaagtgctggaagagaggcaccaatgagattgttgcgatcaaaatcctgaaaaatcatccttcttatgcccgtcaaggccagattgaggtatcaatccttgctaggctatccactgaatctgcagacgattataacttcgtgcgggcttacgaatgtttccagcataagaaccacacttgccttgtgtttgaaatgctcgagcaaaatctctacgatttccttaaacagaacaagttctcccccttgcccttgaaatacatacgccctgtgctgcagcaggtcgctacagccctcatgaaactgaagtcgcttggcctcatccacgcagacctaaagcccgagaacataatgcttgtggatccctccaggcagccgtaccgcgtgaaagtaattgacttcggcagcgccagtcatgtttcaaaagctgtgtgttctacatacctgcagtctagatattatcgagctcctgaaattatcctgggactgcctttctgcgaggcaatcgatatgtggtctctgggctgtgtgattgcagagttgttcttggggtggcccttgtaccccggtgctagcgagtacgatcagatcagatatataagccagacgcaggggttgccagccgaatatctgttgagcgcaggcaccaagaccaccaggttcttcaaccgggatacagattcaccttacccactatggcggctgaagactccagatgaccatgaggctgagaccggtattaaaagtaaagaagccagaaagtatatattcaactgtctcgatgacatggcccaggttaacatgactaccgatctcgaaggctctgacatgctggtcgagaaggccgaccgccgagagtttattgacctactaaagaaaatgttaaccattgatgctgataaaagaatcacacccattgaaaccttgaaccatccattcgtgacgatgacacacttgttagactttccccattccacacacgtgaaaagctgctttcagaacatggagatctgtaagcggagagtgaatatgtacgacaccgtcaatcagagtaagacacccttcatcacgcatgtcgccccatctacctctacgaaccttaccatgacctttaataaccagctgactactgtccataaccagccttccgctgccagcatggcagcagtggcccaaaggagcatgcccttgcagaccgggaccgcccagatttgcgccagaccagacccctttcaacaagctctgatcgtgtgtcccccaggtttccagggactccaggcatcaccatcaaagcacgcgggttactccgtgcggatggagaatgcggtacccatagtgacgcaggcacccggagctcagcctctgcagatccagcctggtttacttgcccagcaggcttggccgagcggcacccagcagatattgctgcctcctgcgtggcagcagctgaccggggtggctacccacacgagcgtgcaacacgccactgtcatccctgaaaccatggcgggtacccagcagcttgccgactggaggaatactcacgcccacggatcacactataatccaattatgcagcagcccgcactacttacaggacatgtcacactgccagctgctcaaccactgaatgttggtgtggcccacgttatgcgccaacagcccacctcgaccacgtctagcagaaaatctaagcaacatcaatcctccgtacgcaacgtttcgacttgtgaggtcagttcatcgcaggccattagttcaccgcaaagatcaaaacgagtgaaggaaaacacaccacccaggtgcgcaatggtacactcctcgccagcctgtagtacaagcgtgacatgcggctggggggatgtggccagcagcactacgagggagagacaaaggcagacaatcgtcattccagacaccccctccccgaccgtcagcgtcattactatctctagcgacactgacgaagaagaggagcagaagcacgccccaaccagcacggtgagcaaacagagaaagaatgtgatctcctgtgtcacagttcacgactctccctattctgattcctcaagcaatacatcaccctactctgtgcagcagagagccggacataacaacgcaaatgcattcgataccaagggatctttggagaatcactgtaccgggaacccgcgtacgattatagtgcccccattgaagactcaggcaagcgaggtcctggtggaatgcgattccctcgtaccggtgaacacatcacatcattcatcctcatataagtcaaaaagcagcagcaatgtgacttccaccagcggccacagttctggaagtagctcaggagcaatcacctatcgccagcagagacccggaccacacttccagcagcaacagcccctgaacctctcccaggcccagcaacacatcacaactgaccggacgggctcccataggcgtcaacaggcctatatcacacctactatggctcaggcgccttattcgtttccgcataactccccgagtcatggaaccgtgcatccccacttggcggctgccgctgctgccgcacatttacctactcagccacacttgtacacctacaccgcccctgctgcccttgggagcacagggacagtggcccacctggttgcctctcagggctcggccaggcatactgtacagcacacagcgtatccggcatccatcgttcatcaggtaccggtgagtatgggacccagggtcctgccatcgcccaccatacacccttcccagtatccagctcagttcgcccaccagacttatatctctgcctccccggcttccactgtttataccggctaccctttaagccctgccaaagtgaaccagtacccctacatttag

SEQ ID NO: 226337 - DNA, 3648 bp, Artificial Sequence
  Description of Artificial Sequence: Synthetic coding sequence
atggcatcacaggtcttggtctacccgccttacgtgtatcagacacaatcctctgccttttgttccgtcaagaagctgaaggtcgagccgtcgtcgtgtgtctttcaggaacgtaattatcctaggacgtatgtgaatgggagaaacttcgggaacagtcacccacctaccaaggggagcgcatttcagaccaaaattcctttcaatcggccacgcggacacaactttagtttgcagacctcggctgtagtgttgaagaatacagcaggcgctactaaggttatcgcggctcaggcccagcaggctcatgttcaggccccacagattggagcctggcgtaacaggctgcattttcttgaaggtccacaacgatgtggtctgaagaggaagtccgaggaactagacaaccactcctccgcaatgcagatcgtggacgaattgagtatcctaccagcaatgcttcagaccaatatgggcaacccagtaacagtggtcacggctacaacgggatctaagcagaactgtacaactggcgagggcgattaccagctcgtgcaacacgaggttttgtgctcaatgaaaaacacatacgaggtgctcgatttcctgggcaggggaacgtttggacaggtggtgaagtgttggaagcggggtaccaatgaaatcgtggccatcaagattctgaaaaatcatccgtcgtacgcccgacaaggccagatcgaagtcagcatcctggcacgactaagcactgaaaacgccgatgaatacaactttgttcgggcttacgaatgctttcagcacaggaatcatacatgccttgtgttcgaaatgctcgagcagaacttatacgactttctcaaacagaacaaattttctcccctgccccttaaagtcatacgtccaattcttcaacaagtggccacagcactaaaaaaactgaagagcctggggctcatccatgccgacctcaagccagagaacatcatgcttgtggacccagttcgacagccctacagggttaaagtgatagacttcgggagtgcctcccacgtcagcaaaaccgtatgttctacctacctacagagtcgctactatcgcgcaccagaaatcattttgggactccccttctgcgaggccatagatatgtggtccctgggctgcgtaatcgcagagttgtttctggggtggccattgtaccctggagcgctcgagtacgaccagatccggtacataagccagacccaaggcctcccaggggagcagctcctgaatgttgggaccaagagcactaggttcttttgtaaggagaccgacatgagccattccgggtggaggttaaagacattggaggagcatgaggccgagacggggatgaaaagcaaagaagccagaaaatacatcttcaacagcctagatgacgtggcccacgtaaatactgtcatggatctggaaggctccgatttactcgccgagaaggctgatcgccgagagtttgtttccctcctcaagaaaatgctcctgatcgatgccgatcttcggattacgccggcagagaccttgaatcacccattcgtcaatatgaaacacttgctcgacttcccccattcaaatcacgtgaagtcctgcttccacatcatggatatctgcaaaagccacttaaactcatgtgatactaataatcataacaaaacctccttactcaggccagtcgccagctcttccactgccaccctaacagctaattttaccaaaatcggcaccctccgcagccaggctctgactacatctgctcactctgttgtgcatcacggcatccccttgcaggctggaacagcccagttcgggtgcggggacgcatttcagcagaccctgatcatttgtcctccagcgatacaaggaatccccgctacccacgggaagcctacaagttactcaatccgggtggataataccgtgccacttgttacccaggcccctgctgtccagcccctgcaaatccggccaggcgtcttatcccagacatggtccggtagaacacagcagatgttggttccagcgtggcagcaagttacccctctagcccctgctacaactacgctgacaagtgagtccgttgcgggttctcatcgtctaggggattggggcaagatgatctcttgctccaaccactataactctgtgatgccacagccattgctgacaaaccagattaccctgagcgctccgcaacccgtctctgtaggcatagcacacgtcgtttggcctcagcccgcaacaactaagaaaaataagcaatgtcaaaataggggaatattggtgaagttaatggaatgggaacccggtcgcgaggagatcaatgcattcagttggagtaacagcctgcagaacacaaatattccccattcggcatttatctctcccaagattataaatggcaaggacgtggaggaagtaagttgcatcgagacccaagacaaccagaattcagagggcgaggcacgaaactgttgtgagacatcgatcaggcaggactcagatagctctgtgtcagataaacagagacaaactattatcatcgctgactcaccgtccccagccgtgtccgtgataacaatcagcagtgacactgacgaggaggagacctctcagcggcacagtctgagggagtgtaagggctctcttgattgcgaagcgtgtcagagtactctgaatattgatagaatgtgcagtttgtccagtcccgactcaaccctgagcacttcctcctccggtcagagcagcccctctccttgcaagagacctaacagcatgtcggacgaggagcaggaatcttcttgcgataccgtcgacgggagtcctacaagcgactctagcggccatgattccccatttgccgagtcaacctttgtggaagacacccatgagaacaccgaacttgtctcaagcgctgatacagaaacgaaacctgcggtctgcagcgtcgtggtgccacctgtagagctagaaaatggcctgaacgctgacgaacacatggccaacactgactcgatatgccagcccttaattaaaggtagaagcgcccctggaagactgaatcaaccctctgctgtcggtacccgacagcagaaactaactagtgctttccagcagcagcacctgaatttcagccaggtccagcactttggttctggccaccaggagtggaacggtaacttcgggcacagacgccagcaggcttatatcccgacgtctgtgacatccaatccattcacattgtcccatggctctccgaatcacaccgccgttcacgcacaccttgccggaaacacgcacctgggcggacagcccacactgctgccctatccctctagtgcaactctcagctctgctgcacctgtggcccatctcctggcctcgccatgcacaagtagaccgatgctccagcatcccacgtacaatatatcgcacccatctggcatcgtccaccaggtgccagtgggcttaaatcccagactgctgccaagtcccaccatccaccagactcagtacaagcccatattccctcctcactcctatatcgctgcctctcccgcatacactggatttccgctctcccccactaaactcagccagtatccctatatgtag

SEQ ID NO: 226338 - DNA, 3585 bp, Artificial Sequence
  Description of Artificial Sequence: Synthetic coding sequence
atggcctcccaggtattagtctacccaccatacgtataccagacacagtcctcagccttttgctcagtgaagaaattgaaggtggagccctcttcgtgtgtcttccaggagcgtaattaccccaggacctacgtgaatggcaggaactttggcaactcccatcccccaacaaagggatctgccttccaaactaagatcccattcaaccgaccacgaggtcataacttcagcctccagaccagtgcggtggtgcttaagaacaccgccggagctaccaaggtgattgccgcacaggcgcagcaggcacacgtccaagcccctcagataggcgcttggaggaaccgcctgcatttcctcgaaggtccccaacgctgtggactgaaaagaaaaagcgaagagttggacaatcactcaagcgctatgcaaatcgttgacgaattgtcaatactcccggcaatgttacaaacgaacatggggaatccagtgaccgtggttacagctacaactggttccaagcagaactgtaccacaggagagggcgactatcagctggtccagcatgaggtgctatgttccatgaaaaatacctatgaggtgctggacttcttgggcaggggaaccttcgggcaagtggtgaagtgctggaaaaggggtaccaatgagatcgtggccataaaaattcttaagaatcaccctagctatgccagacaaggccagatcgaagtctccatcttagcaagactctccacggaaaacgcggatgagtacaacttcgtgagagcctacgaatgctttcagcatcgtaatcatacatgcttagtattcgagatgctggagcagaatctgtacgatttccttaagcagaacaagttcagccctctgcccctcaaggtcatacggcctatcctgcagcaggtggccacagctctaaagaagcttaaaagcctcggcctgatccatgccgacctcaagcccgagaatatcatgctggtagacccagtgagacagccctaccgagtaaaagtgattgacttcggttcggcctcacacgtttctaaaaccgtctgttcaacctacctgcagtctcgatattaccgcgcaccggaaataatattaggactccccttctgtgaagctatcgacatgtggtctctgggctgtgtgattgcagaattatttctgggctggcccctgtatccgggtgccctggagtatgaccagatccgatacatatcgcagacccagggcctgcctggtgaacaactgttgaatgtgggtacaaagtctactagattcttttgtaaagagacggatatgagtcattcaggctggagactgaaaacacttgaggaacatgaggcagagaccgggatgaaatccaaagaggccagaaagtacatattcaatagcctggacgatgtcgctcacgtcaacacagtgatggatttggagggcagcgatctcttagccgaaaaggctgatagaagggagtttgtgtcactgctcaagaagatgctgctgatcgatgctgatttgcgaatcacccctgcagaaacactgaatcacccattcgtgaacatgaagcatcttctggattttcctcacagcaaccatgtgaaaagctgcttccacatcatggacatttgcaaatcccaccttaactcctgtgacacgaacaaccataacaaaaccagcctgctccggcctgtggccagcagttccaccgcaacattgactgcaaattttaccaaaatcgggactctgaggagtcaggcactcactacgtcagcgcattctgtcgtccatcacgggatcccactgcaggcaggcacggctcaattcggctgtggagacgcatttcaacagacgttgatcatttgtccacctgctattcaaggcatacccgcaacccatggcaagcctaccagctattccatccgtgtggataatacagtgccactagtgacgcaggcgccagcggtccaacccctgcagatccgcccaggcgtgctgtcccaaacctggtcggggcgaacacagcagatgctggtgccagcctggcagcaggtgactcctctagcgccagcgaccacaaccttgaccagtgagtcagtcgcaggctcccacagactaggcgactggggaaagatgatctcgtgtagcaaccattacaactccgttatgccccagcctctcttgactaatcagattaccttatccgccccacagcctgtgtccgtaggcatcgctcacgtggtctggccacaacctgctaccacaaagaaaaataagcagtgccagaatcgaagcaacagtctccagaacactaacattccccactccgcttttatctcgcccaaaatcatcaacgggaaagacgttgaagaagtctcatgcattgaaactcaggataatcagaattcagagggggaagccaggaactgttgtgaaaccagtatccggcaggactccgactcctctgtgagcgacaagcagcggcaaacgattatcatcgccgactccccatctcccgcagtatctgtgataactatctcaagcgacaccgacgaggaagagaccagccagcgccatagcttacgtgaatgcaaaggatccctagactgcgaagcttgtcagtccaccttgaatatagatcggatgtgctctctctcaagtcccgattccactctctccacctccagtagcgggcaaagcagcccgtccccctgtaagcgccctaattccatgagcgatgaagagcaagaatcaagttgcgacactgtagacggatccccaacctccgactcctctgggcatgattcaccttttgcggagtcaacctttgtcgaagacactcatgaaaatactgagctggtctcaagtgcagacactgaaacaaaacccgcagtgtgcagcgttgttgtgccacctgtggagctggagaacggactgaacgcggatgagcacatggccaatactgactctatttgccagcccctcatcaaagggcgaagtgccccaggccgtttgaatcagccttctgcagtgggaactcgacagcagaaattgacatcagcctttcagcagcagcaccttaatttctcacaagtgcagcattttggatccggccaccaggaatggaatgggaacttcgggcatcggagacagcaggcatatattcctacaagcgtgacaagtaatcctttcactctgtcgcacggctcccctaatcacactgccgtccatgcccatctggccggtaatacccatctggggggacagcccaccttattaccatatcccagctccgccactttgagcagtgctgcaccagtggctcatctcctggcgtcaccctgcacttctcgaccgatgttacaacacccaacttacaacatttcacatccctcagggattgtccaccaggtgccagtgggtttaaatcctaggctgctaccatcaccgactattcaccaaacccagtacaagccaatcttcccaccccacagttatatcgccgctagtcccgcatataccggtttcccactctccccgacaaaacttagtcagtacccctacatgtag

SEQ ID NO: 226339 - DNA, 3585 bp, Artificial Sequence
  Description of Artificial Sequence: Synthetic coding sequence
atggcttctcaggttctggtctatcctccctatgtttaccagacgcagtcaagcgcgttctgttcggttaagaaactgaaagtagagccttcttcttgtgtattccaggagagaaattacccaagaacgtatgttaatgggagaaacttcggtaacagtcacccaccaaccaaaggttctgcctttcagacaaagatcccatttaatcgcccaagggggcataacttcagcttgcaaactagtgcagttgtccttaagaatacagctggggctactaaggtgatcgctgctcaggcccagcaggcccacgtccaggccccacagattggagcatggcgcaacaggcttcattttctagagggtccacaacgctgtgggttgaaacggaaatccgaagagttagataatcactccagcgcaatgcaaattgtggacgagctgtctattctgcccgctatgcttcagacaaacatgggtaaccccgtaaccgtagtgacagctaccaccgggagcaaacagaactgtacaaccggagagggagactaccagctcgtccagcacgaggttttgtgcagcatgaaaaacacctatgaagtactggacttccttgggagaggtacctttgggcaggtggtcaagtgttggaagaggggaacaaacgagatcgtcgcaattaaaattctgaaaaatcacccaagttacgcgagacaggggcagattgaggtgtccatactggccagactctccactgaaaacgccgacgaatacaacttcgtgagggcttacgagtgctttcaacaccggaatcatacttgcctagtattcgaaatgctggaacaaaatctgtatgattttctaaaacagaataagttttcccccctgcctcttaaggtcattaggccaatcttgcagcaggttgctactgcgctgaagaagctgaaatcgctgggactcattcatgcagacttgaagcccgagaatattatgctcgtggaccccgttcgccagccctaccgtgttaaagtaattgatttcggaagcgccagtcatgtgtctaaaaccgtatgttcgacctaccttcaatcacgatattaccgagccccagagattattctgggattaccattctgtgaagcaatcgacatgtggagcctcggctgtgtgatagcagagcttttcttgggttggcctctctaccctggtgcattggaatacgatcaaatccgctatatatcccagacgcaaggactgcctggtgagcaactcttgaatgtggggaccaaaagcacccgattcttctgtaaagaaactgacatgtcacacagcgggtggaggctgaagacactcgaggagcacgaggccgagacagggatgaagagcaaggaggcccgtaagtatatctttaatagtctagacgacgtggcccacgtgaacaccgtgatggaccttgaaggatctgatctcctggctgagaaagcagacagacgagagtttgtgagcctactgaaaaaaatgctccttatcgatgccgacctcagaataactcccgcagagacactgaatcatccattcgttaatatgaaacacttgctcgatttcccgcactctaatcatgtgaagtcctgttttcacattatggatatctgtaaatcacacctgaactcttgcgataccaacaaccataacaaaacctctcttcttaggcccgtggcaagttcctccaccgccacgcttactgcaaatttcaccaagattgggactcttagatcccaggccctgacaacctccgcccactctgtggtccaccacgggatcccactgcaggctggtacagcccagtttgggtgcggggatgccttccagcagacccttatcatttgcccacccgcaattcagggcatccctgcaacacatggtaagcctacatcatactctatcagggtagataacacggtgccacttgtcactcaggcaccggcagtgcagcctttacagattaggcctggagttctcagccagacatggtccggccgtactcaacagatgttagttcccgcttggcagcaagtgaccccgctggcgccagctacgaccacgctgacctccgagagtgtggcagggtcccaccgactgggcgactggggtaaaatgattagctgttctaatcattacaactccgtgatgccccagcccttactgacaaatcagattactctgagtgccccacagcctgtaagcgtcggcattgcccacgtagtctggcctcagccagccactaccaagaagaataagcagtgccagaaccgctcaaatagtctgcagaacactaacataccgcactctgccttcatttcaccaaaaataataaatggcaaagatgtcgaggaggtgtcctgcattgaaacccaggataaccaaaattccgaaggcgaggcacgcaactgctgtgagacatcaattagacaggacagcgacagctctgtgtctgacaagcagaggcaaaccattatcatcgcagatagcccaagccccgcagtatctgttattaccatcagctccgataccgacgaagaagagacctcacagagacacagtctgcgggaatgtaaaggaagcctagactgcgaggcctgtcaatccacactgaatattgaccgcatgtgcagtctgtctagtccagacagcactcttagcacctccagctcaggacaatcctcccccagtccgtgtaagcgcccaaatagtatgtccgatgaagaacaggaatctagttgtgatactgtggatggttctccaacatcggacagctccggtcatgatagcccatttgctgaatctacctttgtggaagacacccacgaaaacactgagctcgtgtcttccgccgacaccgagaccaagccagccgtctgcagcgtcgttgtgccacccgtcgaactagaaaatggccttaatgcagatgagcacatggcgaatacagattctatctgccagcccctgatcaaaggtcgcagcgctccaggacgtctaaaccagccgtctgctgtggggacgcgacagcagaagctcacttccgcttttcagcaacagcatctgaacttttcccaggttcagcatttcggttcaggacaccaggaatggaacggtaattttggacaccgccgacagcaggcctatattccaacaagcgtgacgagcaatcctttcacactgtctcatggttccccaaaccacactgctgtgcatgctcatcttgccggtaacacacacctgggcggtcagcctacactgctgccataccccagctcagcaaccttatcttcagcagccccagtggctcatttgcttgcctccccttgcacatcaaggcccatgctccagcaccccacatacaacatatctcaccctagtggcatcgtgcaccaggtaccagtcgggctcaatccgcgtctgctcccatcccccaccatccatcagactcagtataagcccattttccctcctcacagttatattgcagcatcacctgcctatacaggcttccccctgagcccaactaagctttcccagtacccctatatgtag

SEQ ID NO: 226340 - DNA, 3585 bp, Artificial Sequence
  Description of Artificial Sequence: Synthetic coding sequence
atggcttctcaagttctcgtttatccaccttatgtgtatcagacacagtcaagtgcattctgtagcgtgaagaaattaaaggtggaaccaagttcttgcgtattccaggagcgcaactaccccaggacctacgtgaatggtaggaacttcggcaattcacatccacccacaaagggctctgcgttccagacaaagatcccgttcaaccgaccacgcggacataatttctccctccaaacatccgccgtcgtgctgaagaacactgcgggtgcaaccaaggttatcgctgctcaggctcaacaggcacacgtacaagctccccaaatcggggcttggaggaaccggctccatttccttgagggccctcaaaggtgcgggctaaaaaggaaatccgaggagcttgataaccacagcagcgcaatgcaaatcgttgacgagctgtcaatcctgcctgccatgctgcagactaatatgggcaatccagtgaccgttgtaaccgcaaccactgggtcaaagcagaactgcactactggcgaaggggactatcagctggtacaacatgaagtgctatgctccatgaagaacacttatgaggtgcttgatttcttgggtagagggacattcggacaggtcgtgaagtgctggaaaagagggaccaacgagatcgtcgcgatcaagatattgaagaatcatccaagttacgcccgacagggccaaatagaggtttccattctggccaggctctcaacagagaatgcggacgaatacaattttgtaagagcttatgaatgcttccaacatcgcaatcacacttgtctggtgtttgagatgttggaacagaatctctacgactttttaaagcagaacaaattttcacccctccctttgaaagtgatccggccaatactgcagcaggtcgcaaccgccctcaagaagctaaagagtttaggactgatccacgccgacctgaagcctgaaaatatcatgctggtggacccagtgcggcagccttatcgggtcaaggtgatcgacttcggaagcgcatctcacgtctccaaaaccgtgtgttctacatacctccagtcaaggtattacagggcccctgagattatattgggtttgcccttctgcgaagcaattgatatgtggtctctcgggtgcgtgatcgccgaactattccttgggtggccactgtacccgggagccctggaatatgatcagatccgatacataagccaaactcagggactgccaggagagcagctcctgaacgtgggcacgaagagtaccagatttttctgcaaagagaccgacatgagccattctggctggaggctgaaaacactggaggagcatgaggcagaaaccggaatgaagtccaaggaagccaggaaatatattttcaattctctggatgacgtggcccacgtgaataccgtgatggacctggagggatccgacttgctggcagagaaggctgacagaagggaattcgtgtctctgctgaagaagatgctcctgattgatgcagaccttagaataaccccagctgagaccctgaatcaccctttcgtgaacatgaaacacctactcgactttccccattctaatcacgtaaagtcctgtttccacattatggacatttgcaaatctcatctcaactcatgtgacaccaacaatcataataaaacgagcctgctgcgccctgttgcatcctccagcaccgctacgttgactgccaactttaccaagatcggaaccctgaggtctcaggccctcaccacttccgcgcactccgtggtacatcacggcataccgctgcaggcaggaaccgcccagtttggctgcggtgacgccttccagcaaacgctcatcatctgccctccagccatccaaggaatcccagctacgcacggaaaaccaacatcctatagcatccgcgtggataataccgtaccgctggtcactcaggctcccgctgtccaacctctgcagataagaccaggtgttctgtctcagacttggtcaggtaggacccagcagatgttagtaccggcttggcaacaagtcacccccttggcgccagccacgactaccttgacaagtgagtctgttgccggaagccacagactcggcgactggggcaagatgattagctgttctaaccattacaatagtgtaatgccgcagccgctgttaacaaaccagatcaccttgtcagcaccccaacccgtgagcgtgggaattgctcacgttgtatggccacagcccgctaccacaaaaaagaataagcaatgtcagaatcgaagtaattcactgcagaacactaatataccacactctgcattcatcagtccaaaaattattaacggtaaggacgtggaagaggtttcatgtattgagacacaagacaaccagaatagcgagggcgaagccaggaactgctgtgaaacctccatccgtcaggatagtgattcatccgtgtctgacaagcaacgccaaacaataattattgctgattccccatcacctgccgtcagcgtaatcacaatctcttccgatactgacgaggaagagacatcccagcgacatagtctacgcgaatgtaaggggtctctggattgtgaagcctgccaaagcaccctgaacatagacaggatgtgttccctgtctagcccagactctaccttgagcacctcatccagtggacagtccagtccttcgccttgcaaacgccctaacagcatgtccgacgaagaacaagagagttcttgtgataccgtggatgggagcccaacctcagattcctctgggcatgactcacccttcgcagagtcgacatttgtggaagatacccatgagaatacggagctggtgtcgagcgccgacactgaaacaaagcctgctgtttgcagcgtcgtggttcctcccgtggagctggaaaacggcctcaatgcagatgagcacatggccaacaccgactcaatctgccagcctctgatcaaaggcaggagcgcacccggtaggctgaaccaacctagtgcagtcggaactaggcaacagaagttgacctctgccttccaacagcaacacctgaatttctctcaggttcaacacttcggttcagggcaccaagagtggaacggcaactttggccatcgcagacagcaagcctacatccccacatccgtgacgagtaaccccttcactttgtcccacgggagtccaaatcacacagccgtacacgctcacctcgcaggaaacactcatctggggggacagccgactttgctcccttacccttcctcagcaactctatcttccgccgcacctgtcgcgcatctgcttgccagcccctgtaccagcaggccaatgttacagcatcccacatacaacatctcccatcccagcgggattgtgcaccaggtgccggtaggccttaatccccgacttctgccatccccgacgatccatcaaacacagtacaagcccatctttccgccacactcttacattgctgcatcaccagcatacaccggctttcccctctcccctacaaagttaagccaatatccttacatgtag

SEQ ID NO: 226341 - DNA, 231 bp, Artificial Sequence
  Description of Artificial Sequence: Synthetic coding sequence
atggcatcccaggtgctggtgtatccaccgtacgtgtatcaaacacaaagttcagcattctgctctgttaagaaattgaaagtggaaccttccagctgtgtgttccaggagagaaactatcctagaacctatgtgaacggcaggaatttcggcaacagccacccacccaccaaaggtagcgcctttcagaccaagataccgtttaacagaccccgtggccataatttttag

SEQ ID NO: 226342 - DNA, 1851 bp, Artificial Sequence
  Description of Artificial Sequence: Synthetic coding sequence
atgtctacgatccaatctgaaacagactgctacgacatcatagaagtcctgggaaagggaacgttcggcgaggttgccaaaggctggcgtagatcaacaggcgaaatggtggcaatcaagatcctgaagaacgacgcttaccgcaacaggattattaaaaatgagttgaagcttttgcattgcatgcgcggattagaccccgaagaagcccacgtgattagattccttgaattcttccacgatgctctcaagttctacttggtgttcgaacttctcgaacagaacttgtttgagtttcagaaagaaaataactttgcaccattgccagctagacatatccgcaccgtgaccttgcaggtgcttaccgctcttgcgaggctgaaggagctggccattatccacgctgacttgaagccggaaaatattatgctggtggatcaaaccaggtgtccatttcgcgtgaaggtgatcgactttgggagcgctagtatattttctgaggtcagatatgtgaaagaaccctacatccagtcaaggttctatcgggcaccagaaatcttactggggctgccattctgtgaaaaggtagacgtgtggagccttggctgcgttatggccgaactgcaccttggttggcctctataccccggaaacaacgagtacgatcaagtgcgctacatttgtgaaacccagggtctgcctaagccgcatctcttgcatgcggcatgcaaagcccaccatttttttaagagaaatccgcaccccgatgccgctaacccatggcagctaaagtccagcgcagattatctggcagaaactaaggtccgcccacttgaacgaaggaagtacatgttgaagagtctcgaccagattgagaccgttaatggtgggtctgtagcttcccgcttgaccttccccgatagagaagcattagccgaacacgcggatctgaaaagtatggtagaactgatcaagaggatgctcacttgggagagccacgaacgcatcagtccttctgcagcgctccggcatccgtttgtctctatgcaacagctgcgttcagcgcacgaaacaactcactactatcaattgagtctgcgatcatataggttgtccctccaggtggagggcaaaccccctaccccggtggtggccgctgaggacggcaccccatactactgcctagctgaggagaaggaagcagccggaatgggaagtgttgccggaagctcgccctttttcagggaggaaaaggccccagggatgcagcgggcaattgaccagttggatgatctgtccttacaggaagccggacacgggctgtggggtgagacatgcacaaatgccgtgagtgacatgatggttcccttgaaggctgctattaccggtcaccacgttcctgacagcggacccgagccgatcctcgctttctactctagccgcctggctgggaggcacaaggctcgaaagccacccgctgggagcaaatcggactccaatttcagtaatttaatccgtctgagccaggtgtcacctgaagatgaccggccatgtagaggaagttcctgggaggaaggcgagcatctgggggcttcagctgagcctctcgccattctgcagagagatgaagacggccctaatatagataacatgaccatggaggcagagcggcctgatccagagctgtttgacccgtctagttgtcccggtgagtggctatccgagcctgattgcactctggagtccgtgaggggtcctagagctcagggtttacctccaaggcgtagccaccagcatggtccacctagaggggctacatccttcctgcagcacgtgacaggacatcactag

SEQ ID NO: 226343 - DNA, 1746 bp, Artificial Sequence
  Description of Artificial Sequence: Synthetic coding sequence
atggtggccatcaaaattcttaagaatgacgcctacaggaacagaataataaagaacgaactaaaactgctgcactgcatgagagggctcgaccccgaggaagctcacgtgattcgattcctggagtttttccacgatgccttgaaattttatctggtcttcgaactgcttgagcagaacctctttgagttccagaaggagaacaatttcgcccctctgcctgctaggcatattaggactgtcactcttcaagtactcaccgctcttgccaggctgaaagaactggctataatacatgccgacctgaagcccgaaaatatcatgctcgtggaccaaaccagatgtccctttcgcgtgaaagtaatagattttggaagcgcaagcattttctcagaggtccgatacgttaaggaaccatacattcagagcaggttttatagagctcccgagatcctcttgggcctgccattttgcgagaaagtcgacgtgtggtcccttggctgcgtgatggccgagctccacctcggttggccgctttacccagggaataatgagtacgaccaggttagatacatttgcgagactcaggggctcccaaagcctcacttgttgcacgccgcatgcaaggctcaccatttcttcaagaggaatccacatcctgacgcggctaacccctggcagctgaagagctctgccgactatctcgcggagacaaaagtgcgtcccctcgagaggaggaaatatatgctgaagagcctggatcagattgaaacagtgaacggaggctccgttgccagcaggttgaccttcccagatcgtgaggctctcgctgagcatgcggatctcaagtctatggttgagctgataaaaagaatgcttacttgggagtctcacgaacgcatcagccccagcgccgctctgcgtcacccatttgtgtcaatgcagcagctgcggtcagcccacgagactacccactattatcagctttcgctaagaagctaccggctttcactccaggtggagggcaaaccgccaactcccgtagtggcagccgaagacggcacaccttattattgtttggccgaggaaaaggaggcagccggaatgggatcagtggccggatcatctccttttttccgcgaagagaaggcaccaggcatgcagcgcgctattgatcagctcgatgatctgtccctccaggaggccggacatggactgtggggcgagacttgcacaaacgccgtctccgatatgatggtgcccctcaaggccgctattaccggacatcacgtgccagatagcggaccagagcctatcttagccttctactcatcaagattggcgggacggcataaagcaaggaagccacctgcgggttccaaaagcgacagtaattttagcaatctcattcgcctgtcacaggtttccccggaggacgaccggccttgtcggggatcatcatgggaggaaggggagcacctgggagcgtccgccgaacctcttgccattttacagagagatgaggatgggcctaatatcgacaatatgactatggaggcagaacgccctgatcccgagctctttgacccaagctcatgcccaggcgagtggctctcagagccagattgcactctggaaagcgtccgcggtccacgtgctcaaggacttcctcccaggagaagtcatcagcacggtcctcccagaggagccacatctttccttcagcacgtgaccggccatcactag

SEQ ID NO: 226344 - DNA, 675 bp, Artificial Sequence
  Description of Artificial Sequence: Synthetic coding sequence
atgggtgaacagccgatctttagcactcgagctcacgtgttccagatcgacccgaatactaagaagaattgggtgccaacttccaaacatgccgtgaccgtgtcttatttttacgactcaacccgaaatgtgtatcgcatcattagtctggatggatccaaagccattattaacagtactatcacgcccaacatgacgtttaccaagaccagccagaagtttggccagtgggccgacagtagggccaacacagtctatggtctcggctttagttcagaacaccatctgtcgaaggtgaccgaactcgagtgcgtttcaagtcaggcgaatgctgtgcacacccataaaaccgaactgaatcagaccatccaagagcttgaagagactttgaagttgaaggaagaggaaatagaaagactgaagcaggaaattgataatgccagagagctgcaggaacagagagactcattgactcagaaactgcaggaggtggaaatccgcaataaagatcttgaggggcagctttctgacctggagcagagactggaaaagtcacaaaacgaacaggaggctttcagaaacaatctgaaaactctcttagagattcttgatggtaaaattttcgagttaactgagctcagagacaatctcgccaagctgctggagtgttcttag

SEQ ID NO: 226345 - DNA, 1065 bp, Artificial Sequence
  Description of Artificial Sequence: Synthetic coding sequence
atgggagagcagccgattttctcgacaagagcacacgtgtttcagatagacccgaatacaaagaagaactgggtgcccaccagcaagcatgccgtcactgtgtcatacttctacgactcaacccggaacgtgtaccggattatttcactcgatggcagcaaggccattatcaattcgaccattacccctaacatgaccttcacgaagacatctcaaaagtttggtcagtgggcagacagtagagcgaacaccgtgtacggcctcggcttctcttctgagcatcacctttctaagtttgcggaaaaatttcaggagtttaaggaggctgccaggctggcaaaggagaaaagccaggagaaaatggaactgacaagcacccctagtcaagaatccgcgggaggcgacctgcagtctcctctgacaccagaatctattaacggcaccgacgatgaacgcacccccgacgtgacacagaacagcgagcctagagcagagccaactcagaatgctctgccgttctcacactcctcggctatttccaagcactgggaggcggagttggcaactctcaaaggcaacaatgctaagctaaccgctgcacttctggagagcacagcaaatgtgaaacagtggaaacagcaactggcggcatatcaggaagaagcagagaggttgcataaaagagtgaccgagctcgagtgcgtgtcttcccaggcgaacgctgtgcacacacacaaaacagaacttaaccagacaattcaagaattggaagagaccctgaagctgaaggaagaggagatcgagaggctcaagcaggaaatcgacaatgctcgcgaactgcaagaacagagggatagtctcacccaaaagctgcaggaggtcgagatccgaaataaggatctagaaggccaactgtcagatcttgaacagagactggagaagtcacaaaacgaacaggaggcttttcgaaataaccttaagaccctgttggaaattctcgacggcaagattttcgaactaaccgagttacgagataatcttgccaagttactggaatgctcatag

SEQ ID NO: 226346 - DNA, 534 bp, Artificial Sequence
  Description of Artificial Sequence: Synthetic coding sequence
atgggggagcagcctatcttcagtacgcgcgcacacgtgtttcagattgaccccaacacaaagaaaaactgggtacctaccagtaaacacgccgttacagtttcttacttttatgactccacgcgaaacgtttatcggatcatctctctcgacggaagcaaagcaattatcaactcaaccataacccccaacatgacattcactaaaaccagtcagaagttcggccagtgggccgacagtcgggcaaacaccgtctacggtttagggttttctagcgaacaccatctgtcaaagttcgccgagaaatttcaggagtttaaagaggccgcacggttagctaaagaaaaatcacaggagaaaatggaactgacttcaacccctagtcaagaatcggcaggcggagatctgcagtccccactgacaccggaatccataaacgggacagacgacgagagaacacctgatgtcactcagaatagcgaacctcgtgccgagcccactcagaatgctctgcccttctctcatagaaaatag

SEQ ID NO: 226347 - DNA, 543 bp, Artificial Sequence
  Description of Artificial Sequence: Synthetic coding sequence
atgggatctgccataagtaagcactgggaggccgagcttgccacactgaaaggaaacaacgcaaagctaaccgccgctttgctggagtctaccgcgaacgtgaagcagtggaaacagcaactagctgcataccaggaagaggccgagcgccttcacaaacgcgtcacagaactggagtgcgtctccagtcaggcaaatgccgtgcatactcacaagacagagttgaaccagacaatacaggaacttgaggaaacattaaaacttaaggaggaagagatcgaacggctgaagcaggagatcgacaacgctagggagctgcaggagcaaagagactcactaacacagaagctgcaagaggtagagatccgaaacaaggacttagaggggcagctgtccgacctagaacagagactggagaagagccagaatgagcaagaggcattccgcaataacttgaaaacactattagagatcctggatgggaagatctttgagctgaccgaattaagggacaatctggccaagctgctggagtgcagctag

SEQ ID NO: 226348 - DNA, 1065 bp, Artificial Sequence
  Description of Artificial Sequence: Synthetic coding sequence
atgggcgaacagccaatttttacgactcgagcacatgtatttcagatcgaccctaacactaaaaaaaactggatgcctgctagtaagcaggcagtaaccgtgtcctatttttatgacgtgactagaaactcttatcggatcatatcagtagatggcgctaaggtcataatcaactcaacaattaccccaaatatgactttcactaaaacctcacaaaaattcggccagtgggctgacagccgcgcaaatacagtgtttggtttgggattctcctctgagcagcagcttacgaaatttgctgagaaattccaagaagtgaaagaggccgcaaagattgctaaggacaaaacacaggaaaagatagagaccagctccaatcactctcaggagtccggccgagagactccaagcagcacgcaggctagctcagtaaatggcacagacgacgagaaggcgtctcacgcaggccctgctaacacccacctgaagtctgagaacgacaagttgaaaatcgccttaacacagagtgcagcaaatgtgaagaagtgggaaatcgagttgcagaccctcagagagagtaatgctcgtttgaccaccgctttacaggaatccgctgctagcgttgagcaatggaagcgtcagttcagcatctgtagggacgagaatgataggctgaggaataaaattgatgaactagaggagcaatgcagcgaaataaatagagagaaagagaaaaatacccagctcaaaagacggatagaggaactggaagcggaactgagggagaaggagaccgaactcaaagatttacgcaaacagtccgagattatcccccaactgatgtccgaatgcgagtacgtgtccgaaaaattagaagccgcagagagggacaaccagaatctggaggataaggtgagatctctgaaaacagacatcgaggagtcaaaataccggcaacggcatcttaaagtggagctgaaatctttcctagaggtgctggacggcaagattgatgatctccacgattttcggagaggtctctcaaaattgggtaccgacaactag

SEQ ID NO: 226349 - DNA, 867 bp, Artificial Sequence
  Description of Artificial Sequence: Synthetic coding sequence
atgggcgaacagcccatctttactactcgagcccatgttttccagatcgatccgaacaccaagaagaactggatgcccgctagcaagcaggctgtgacagtctcttacttctacgacgtcacacgtaatagctacaggataatttcagtggatggcgctaaagtgatcatcaacagcactatcactccgaatatgacctttaccaagactagccagaagttcgggcagtgggcagactctcgggcaaatacggtgttcggtctgggcttctccagcgagcagcaactcacgaagtttgctgaaaaattccaggaggtgaaagaggcggcaaagatagctaaagataagacacaggagaagatcgagacctcttcaaatcatagccaggcttcctcagtaaatggcacggatgacgagaaagcttcccatgccggtcctgctaacacccacctcaagtccgaaaatgataaattgaaaatcgccctaacacaatcagctgccaacgtgaagaacgagattaatcgggaaaaagaaaaaaatacacaattaaaacgcaggattgaggagctggaagcagagttacgggagaaagagacagagctcaaagacctgcgaaaacagtctgagatcattccacagttgatgagcgaatgtgaatacgttagtgaaaagctcgaagcagccgagcgcgacaatcagaatttagaagataaggttaggagtcttaaaaccgacatcgaagagtccaaataccggcaacgccatttaaaagtggaactcaaatccttcttagaggttttggatggcaaaatagatgatttacacgacttcaggcggggtttatcaaagttaggcaccgacaattag

SEQ ID NO: 226350 - DNA, 900 bp, Artificial Sequence
  Description of Artificial Sequence: Synthetic coding sequence
atgggcgagcaacccatctttaccactagagcgcacgtttttcaaatcgatccgaataccaagaaaaattggatgcccgctagcaagcaggccgttaccgtctcctacttctacgatgtgactaggaacagttataggatcatatccgttgatggcgcaaaggttattatcaatagcacaatcaccccaaatatgaccttcaccaagacaagccaaaagttcggccagtgggccgactcacgtgccaatactgtttttggactcggtttttcctcagagcagcaactgaccaaattcgcggaaaaattccaggaggttaaggaagctgccaagatcgccaaagataaaacccaggagaaaattgaaacctcaagtaaccattcccaagagtccggacgcgaaacacctagctctacacaggccagctcagttaacgggacggacgatgaaaaagccagccatgcgggaccagccaatacccacttgaagtccgagaatgacaagctgaaaatcgcactcactcagagcgcggctaacgtaaagaatgagatcaatagggagaaggaaaagaacacccaactgaagcggaggatcgaagagctggaagctgaattaagagaaaaagaaaccgagctcaaggacctgaggaagcaaagtgaaatcatccctcagctgatgagcgagtgtgagtatgtgtctgagaaactggaggcagcggagagagataatcaaaacctggaggataaagtacgttccttaaaaacagatatcgaggagtccaaatacagacaacgccatttgaaggtggaactgaagtcctttctggaagtattggacgggaagatcgatgacctgcatgatttcaggagaggtctgtccaaactgggcacagacaattag

SEQ ID NO: 226351 - DNA, 1032 bp, Artificial Sequence
  Description of Artificial Sequence: Synthetic coding sequence
atgggggagcagcctatattcacgacacgcgctcacgtgttccaaatcgatcctaatacaaaaaaaaattggatgcctgcttccaagcaggctgtgactgtctcttacttttatgatgtcacacgaaactcatataggatcatcagcgttgatggtgccaaggtgatcatcaattccacgattacccctaacatgacattcaccaaaacatcgcagaagttcggacaatgggctgattcgagagctaacacagtttttgggctgggcttcagctctgaacagcagcttaccaagttcgccgagaagtttcaggaggtgaaggaggccgcaaaaattgccaaggacaaaactcaggaaaaaattgaaacgtcttctaaccacagccaggcctctagcgttaatggcaccgacgatgaaaaagcctcacacgcgggaccggcaaacacacatctgaagagtgagaacgacaagctgaaaattgccctgacccagagcgccgctaatgtcaaaaagtgggaaatcgagcttcagaccctgagggagtccaatgccagactcacaacagccttgcaggaaagtgccgcttcagtggaacagtggaaaaggcagttttcaatctgcagggacgaaaacgatcgcctgagaaacaagatcgacgagctggaagagcaatgcagcgagatcaatcgcgaaaaagagaagaatacccagttgaaacggaggatcgaagaactggaggccgagctcagggagaaagagacagaacttaaggatctgagaaaacagtcagagattattccacaactaatgtccgagtgcgagtatgtctccgagaagttggaagcagccgaacgagataaccagaaccttgaagacaaggtgcgttctctcaagacagacattgaggagtccaaataccggcaaaggcatctaaaagtggagctcaaaagcttcttagaggtgctggacggtaagatcgatgaccttcacgactttcgcagaggcctgtccaagctgggaacagataactag

SEQ ID NO: 226352 - DNA, 15 bp, Artificial Sequence
  Description of Artificial Sequence: Synthetic coding sequence
tgaacagacaactag

SEQ ID NO: 226353 - DNA, 4176 bp, Artificial Sequence
  Description of Artificial Sequence: Synthetic coding sequence
atggcggttgagggatctactatcacaagtaggatcaaaaatttgctgaggagtccctctattaagctgcggagaagcaaggcgggtaacagaagggaagacctgtcgtccaaagtcaccctggagaaggtcctgggaatcactgtgtccggcggaagaggactagcttgcgacccgcgtagcggactcgttgcttacccagccggatgcgtggtggtgctcttcaatcctcggaagcataagcagcatcacattttaaactccagtcgcaagaccattactgccctcgcattctcacccgacggaaagtacttagtcaccggagaatctggacatatgccagccgttagggtgtgggacgtcgcggaacattctcaggtggccgagcttcaggagcacaagtatggagttgcatgcgtcgcattctcaccgagcgccaagtacatcgtgtccgtaggctatcagcatgatatgatcgtgaacgtgtgggcctggaagaagaacatcgtggttgcgtcaaacaaagtttcttcccgtgttaccgccgtcagctttagcgaggactgcagttatttcgtgacagcgggtaaccggcacatcaaattctggtacctcgacgattccaagacttcgaaagtgaatgctacagtgcccttgttgggacgcagcggactgctcggcgaattgcgcaacaacttgttcactgacgtggcttgtggtcggggaaaaaaggccgattctaccttctgcatcacctcatcaggcctgctctgtgagttctccgaccggaggctactcgataaatgggtggaactgcgggtgtatcccgaagttaaagattctaatcaggcatgcctccctccttcaagcttcatcacttgttccagcgataacaccatacgactatggaacaccgaaagcagcggagttcacggctctaccctgcacagaaatattctgtcctccgatctcattaagatcatttatgttgacgggaatacccaggctctgctcgataccgagctgcctggaggtgataaagctgacgccagtcttctggatccacgtgtgggtatccggtcagtgtgcgtgtcaccgaatggccagcatctggcatccggtgaccgtatgggaactctccgggtccacgagctgcagtctctgagcgagatgttgaaagtggaggctcatgacagcgagatcttgtgcctcgaatatagtaaacccgacacagggcttaagctgctcgcctcagcctccagggacagactcatccacgttcttgatgcaggccgagaatactctctgcagcagacgttggatgaacactcatcatctatcacagccgtgaagttcgccgcatccgacgggcaggtgagaatgatttcttgtggcgctgataagtccatctatttcagaacagctcagaagagcggcgacggggtccaatttactaggacacatcatgtcgtgcggaagacgactctgtatgacatggatgtcgagcctagctggaagtacactgctatcggatgccaggacagaaatatacgcatcttcaacatatcatctggcaaacagaagaagcttttcaaaggcagccagggggaagatggcactctcattaaggtccagacagacccatctggcatatacatcgccacttcctgttcagacaaaaatctttctatttttgacttttcctcaggcgagtgcgtagctaccatgttcggccattccgagattgtgacaggcatgaagttctccaatgattgtaagcacctgatatctgtgtcgggggactcttgcatttttgtatggcggctaagtagtgagatgactatttctatgaggcaaaggctggccgagctgcggcagcgacagcggggtgggaagcagcagggaccctcttcacctcaaagagccagcggcccaaaccgccaccaagctccatcgatgctgagcccaggacctgctttgagcagcgactcagacaaagaaggcgaggatgaaggcacagaggaagaattgcctgcccttcccgtcttagcaaaatcgacaaaaaaagcattggccagtgtgccctcccctgctcttcctagaagccttagccactgggagatgagccgggcacaggagtcagttggctttctcgacccagcgccagccgctaatccaggccctagacggagaggacgctgggtccagcccggagtggaactatcggtgcggtctatgctagacctgcgacagttagaaaccctggctccctcattacaagacccgagtcaggactcattggctataatccctagtggtccacgcaaacacggccaggaggcccttgaaacatctcttacttcccaaaacgagaaaccaccccgtccccaggcatcccaaccctgctcctatccccatattatccgtctattaagtcaagaagaaggggtttttgctcaggaccttgaacccgctccaatagaggacgggatcgtgtatccagaaccctccgataatcccaccatggataccagcgagtttcaggttcaggctccggctcgcggaacattgggacgtgtttaccccggttcaaggtctagtgaaaaacactcccctgattccgcctgtagtgttgactattcgtcttcttgcctgagctcccctgaacacccaacagaagattcagagagtactgagcctttatccgtggacggcatctctagcgatttggaggaacctgctgagggagacgaagaggaagaggaggaggagggaggcatggggccttatggactgcaggagggcagtcctcagacccccgatcaggagcagttcctcaagcagcatttcgagactctggccagtggggcagctcccggagccccagtgcaggtgccagaacgttcggagtccaggtccatctcctcccggtttctgttgcaggtgcagacgagaccccttcgtgagcctagtcctagcagttcttccttggcactgatgtctaggcccgctcaggtccctcaagcatccggcgaacaacctcggggaaacggagccaatccacccggtgcccctcctgaagtggaaccctccagcggtaatcctagcccccagcaggcagcctcagtgctactgcccagatgcagactcaatccagactctagctgggctccaaagagggtggccacagcgagtcccttttctggtttgcagaaagcccagagtgtccactccctggtgccgcaggagaggcatgaagcgtccctccaagccccttcaccaggcgctctcctaagccgcgagatagaagcccaggacggtcttgggagcctgccaccagccgacggaagaccaagcaggccccacagttaccagaatccaacaacgagtagcatggctaagattagcaggagcattagcgtcggagagaatttaggactggtggctgagccacaggcccatgctcccatcagggtctcgcccctgagcaaactcgcgttacccagcagggcccacctcgtgttggatatacctaagcccctgcctgacaggccaactctcgccgcattctcacctgtcacaaaggggcgtgcccctggagaagccgaaaaacccggatttccagtggggttaggcaaagcccactccaccacggaacgttgggcttgcttaggagagggcacgacgcccaagcctagaactgaatgccaggcccaccctggtccttcaagcccctgtgcccaacagttaccggtttctagtctcttccaaggcccagaaaatctacagcctccccctccggagaagacccctaaccccatggagtgcacaaagcccggtgcagcattatcacaggactccgaacctgccgtgtccctcgaacaatgcgaacagttggtcgccgagctacgaggatctgtaagacaagcagttaggttgtaccatagtgttgccggatgtaagatgccaagcgccgagcagagcagaatagcgcaacttcttcgagacaccttcagttctgttcgccaggagctggaagctgttgcgggagccgtgttgtccagccccggttcatcgcctggggcagtaggcgctgaacagacccaggccttgcttgagcagtacagtgagctgcttttaagagcggtggaacggcgtatggaacggaaattgtag

SEQ ID NO: 226354 - DNA, 1077 bp, Artificial Sequence
  Description of Artificial Sequence: Synthetic coding sequence
atgtccacagccagagagcagcccatcttctcgacgcgggctcatgtattccagattgatccagctaccaagaggaactggattcccgctgggaagcatgcactcacagtatcttatttctacgacgccacaaggaacgtttacaggatcatctccataggcggagccaaggcaatcatcaactctactgtgactcccaatatgacctttactaaaacaagtcaaaagtttggacaatgggccgattctagggccaacactgtgtatggcctcggctttgccagtgagcaacacctcacgcagttcgctgagaaatttcaggaggtgaaggaggcagctagactggccagggaaaagtcccaggatggaggtgagctcacatcccctgccctgggacttgcctcgcaccaagtgccccctagccctcttgttagcgctaatggccctggagaggagaaactgtttcgcagccagagcgccgacgcgcctggacctacagagcgtgaacggctcaaaaaaatgctctccgaagggtccgtgggtgaagtgcagtgggaagccgaattcttcgccctccaggactcaaacaataagttggcgggtgccctgcgcgaagccaacgccgctgccgcacagtggcgccagcagctagaagcgcaacgagctgaagctgagaggctgaggcagcgcgttgccgagctggaggcccaggctgcctcagaagtcacccccaccggcgaaaaggaggggctaggacaaggacagagcctggaacagctcgaggctcttgtccagacaaaagatcaggaaattcagacactcaagagtcagaccggcggtcctagggaagctttagaggccgctgagcgggaggaaacgcaacaaaaagttcagactcgcaacgctgagctggaacaccaattacgggcaatggagagaagtctggaggaggccagggccgagagagagagggctcgagccgaagtagggagggcagcccagctgcttgacgtgagtctgtttgagctgtctgagctgagagagggcctggccagacttgctgaagcagctccttag

SEQ ID NO: 226355 - DNA, 438 bp, Artificial Sequence
  Description of Artificial Sequence: Synthetic coding sequence
atgtccaccgcaagagaacagccaatcttctctaccagggcgcatgtttttcagattgacccggcaaccaaaagaaactggattcctgctggtaagcacgcattgacggtttcctatttttacgatgctactcgaaacgtgtaccggatcatatccattgggggagcaaaagccattattaattccactgtcacccccaacatgacatttacaaaaacttcccagaagttcggacagtgggctgacagccgcgctaataccgtatacgggctgggattcgcttcggagcagcatcttacccagttcgctgagaaatttcaggaggttaaagaagccgcacggctggcaagagagaagtctcaggatggttggggcggaccccaatctgctttggttgtcgggtctttcggtgctgtattcgagcttctgatcgtctag

SEQ ID NO: 226356 - DNA, 1086 bp, Artificial Sequence
  Description of Artificial Sequence: Synthetic coding sequence
atgtctacagccagggaacagccgatcttctcaacccgggctcatgtcttccagattgaccccgctactaaaagaaactggattccggcagggaagcacgctctgactgtcagctacttttacgatgctacgcgcaatgtgtacagaataatttcaatcggcggagctaaagctattatcaactccacagtgacacccaacatgaccttcacgaagacatcgcagaagttcgggcagtgggccgatagtcgcgctaacacagtgtacggcttgggctttgctagtgagcagcatctgactcagttcgccgaaaaatttcaagaggtaaaggaggcggcacggcttgcccgtgagaagtctcaggatggaggagagcttacctctccagcattaggcctcgcatcccatcaggtgcctccgtctccccttgtctcagcaaacggtccaggagaagagaagttattcagatcccagtccgcagatgctccgggacctaccgaaagagaacggctgaagaagatgctttccgaaggctctgttggagaagttcaatgggaggcagagtttttcgccttgcaagacagcaataacaagttggccggagctctgagggaggcaaacgcagcggcagctcaatggagacagcaactcgaggcccaaagggcggaggcagaaagactgcgacaacgcgtcgcggaactcgaggcacaggcagcatccgaggtgacccctactggcgaaaaggagggcctgggccagggtcagtcactggaacagctggaagctctagtacagacaaaagatcaagaaatccagaccttaaaaagccaaacagggggtccaagagaggcccttgaggccgcagaacgcgaggaaactcagcaaaaggtgcaggacctggaaacccggaatgccgaactggagcatcagttacgagcaatggagagatccctggaggaagctcgagccgaaagggagcgcgcaagggcagaggtgggacgcgctgcccagctcctcgatgtgagcctctttgaactaagtgaattgcgcgaaggcctggcccgtctagcggaggcggctccctag

SEQ ID NO: 226357 - DNA, 1077 bp, Artificial Sequence
  Description of Artificial Sequence: Synthetic coding sequence
atgtctaccgcacgggaacaaccaatcttctctacacgtgcccatgtgttccaaatcgatcctgctacaaaaaggaactggattcctgccggtaagcacgcccttacggtgagttacttctacgatgctaccaggaatgtctataggattatctctattggtggagcaaaagccattatcaacagtactgtcaccccgaacatgaccttcacaaagacatcgcagaagtttggtcagtgggccgattcccgggcaaacaccgtctacgggctggggttcgcaagtgagcagcatctgacccagtttgctgagaaatttcaggaggtcaaggaggccgctagactggcacgcgagaagtcccaggatggcggagagctgacttcccccgcacttggtcttgccagccatcaggtgccgcctagtcctttagtttctgcaaacggacccggagaagagaagctgttccggagccagtctgccgatgccccaggaccaaccgaacgcgagcggctgaagaagatgctctcagaagggtccgtgggggaggttcaatgggaggctgaattcttcgccctgcaggatagcaacaacaagctggcaggcgcactcagggaagctaatgccgcagcagcccaatggcgacagcagctggaagcacagagggctgaagctgagcggttacggcaacgcgttgctgaactcgaagcacaggctgcctccgaggtgacccccaccggcgagaaggaaggcctgggacaaggtcaatccctggaacaactcgaagcactagtgcaaactaaggatcaagaaattcaaaccctgaagtcccagaccgggggaccccgtgaggccctggaggctgcagaacgcgaagagacgcagcagaaggtccagactagaaatgcggagctcgagcaccagttacgagccatggaacgttctcttgaggaggccagagccgaacgggaaagagcaagagcagaagtgggacgagccgctcagttacttgatgtatcactttttgagctctctgagctcagggaaggtcttgcacgactcgccgaagcagccccttag

SEQ ID NO: 226358 - DNA, 1086 bp, Artificial Sequence
  Description of Artificial Sequence: Synthetic coding sequence
atgagcacagccagggagcaacctatcttttcaacacgcgctcatgtctttcagattgatccggcaaccaagcggaattggattccagccggaaagcatgcactaacagtgtcctatttttatgatgcaacccgcaacgtttaccgtattatctctattggaggcgcaaaggcgattatcaatagcacagtcactccgaatatgactttcacgaaaacctcccagaagtttggacagtgggctgatagccgagccaatactgtttacggcctgggattcgcctctgaacagcatctgactcagtttgccgagaaattccaggaggttaaggaagccgcacgccttgctagagaaaaatctcaggacggcggagaactgacatcacccgcattgggcctggcctcccaccaggtgccaccatcgccattggtgtccgccaatggaccaggtgaggagaagttgtttcgcagccagagcgccgacgctccgggacctaccgagagggagcggttaaaaaaaatgctgtcggagggttcggtgggcgaggttcagtgggaagccgaatttttcgctctgcaggattccaacaacaagctcgcgggtgcgctgagggaagctaacgccgctgcggcacaatggcggcagcagctggaggcccagcgcgctgaggcggagcgacttcgccaacgagtggcagagctcgaagcacaggcagcaagtgaagtgacgccaacaggcgagaaggaggggttaggacaaggccagagcctggaacaattggaagccttggtgcagacaaaggatcaggagatccagacacttaagagtcagacaggcggtccacgagaagccttagaagccgcagaacgagaggagacccagcagaaggtgcaagatctggagacgaggaacgccgaactggaacaccagcttcgggctatggagcggtccctggaagaagccagggccgagagggagcgagccagagcagaagtcggcagggcagcacagttgctcgatgtcagtttgttcgagttatctgaactccgggaaggtttggcaagattagctgaagccgctccttag

SEQ ID NO: 226359 - DNA, 1086 bp, Artificial Sequence
  Description of Artificial Sequence: Synthetic coding sequence
atgagcacagcacgagagcagccaatcttttcgaccagggcccatgtgtttcagatcgatccagcaaccaaacgcaactggattccagccggaaagcatgcactcaccgtttcatatttttacgatgccactaggaacgtgtataggatcattagcatcggtggcgcaaaggctataatcaatagcacagtgacccccaacatgacgttcaccaagacctcccagaaattcggccaatgggccgatagccgagcgaatacggtttacgggctaggatttgcatcggagcagcacttgacacaattcgctgaaaaatttcaggaggtgaaggaagcggcaaggctggcccgagaaaagagtcaggatgggggtgaactcactagtcctgctctcggcttagcctcacaccaggtgccaccgagtcctttggtcagcgctaacgggccaggggaagagaaactcttccgttcccagagcgccgacgcccctggtccaaccgagcgtgaaaggctcaaaaagatgctgtccgagggttccgtaggtgaagttcagtgggaggcagagttttttgccctgcaggactccaataataagcttgccggagcccttagggaggctaacgccgcagctgcccagtggcgccagcagcttgaggcccaaagggccgaggctgagcgtctcaggcaacgggtcgcggagctggaggcccaggcagcctctgaagtgacacccactggcgaaaaggagggactcggacagggccagtcgctggaacagctggaagccttggtgcagactaaggatcaggaaatccagactctcaagtcccagaccggtggtcctcgggaagccctggaggcagctgaaagagaagagacacaacagaaggtgcaggacttggagacccggaacgcagagctggagcaccagttacgcgcaatggaaaggtccctggaagaagcaagagccgagcgcgaaagagcccgtgctgaggttggacgagccgctcagctcctagacgtgtctctgtttgaactgtccgagttgcgtgagggcctggcgagattggctgaagctgcaccgtag

SEQ ID NO: 226360 - DNA, 978 bp, Artificial Sequence
  Description of Artificial Sequence: Synthetic coding sequence
atgtctacggcccgagagcaacccattttctctactcgggctcatgtgtttcagatcgaccccgcaaccaaacggaattggatacctgctggcaaacatgccctgaccgtaagctatttctatgatgctacacggaacgtgtacagaatcatttccatagggggtgcaaaagctatcattaactcaaccgtgactcctaacatgacattcaccaagaccagtcagaagtttgggcagtgggctgactcaagggctaacacagtctacggtctggggtttgcttctgaacagcatctgactcaggtcccgccatccccactggtctctgccaacgggccaggcgaggagaagcttttccggtcccaatcggccgacgctcccggaccgacagaaagagagagactgaagaagatgttgagcgagggctccgtcggcgaggtccagtgggaagccgagtttttcgctcttcaggattctaacaacaagttagcaggagcattacgcgaggctaatgccgcagctgctcagtggcggcagcagctcgaagctcagagggctgaggcggaaagactgaggcaacgcgtggccgaattggaggcgcaggccgcttccgaggtcactccaaccggagagaaggaggggttgggacaggggcagtccctcgagcaactcgaagctctcgtgcagaccaaggatcaggagatccagactctgaaaagtcagaccggaggtccaagggaagccctggaggcagctgaacgcgaggagacgcagcagaaggtccaggacctggaaaccaggaacgccgaactagagcatcagctgcgcgctatggaaaggtccttagaagaggccagagccgagagggaaagagccagagccgaggtggggagagctgcccaactacttgacgtgtcattgttcgagctgtccgagctgagggagggcctggcgaggctagcggaggcggcaccctag

SEQ ID NO: 226361 - DNA, 1176 bp, Artificial Sequence
  Description of Artificial Sequence: Synthetic coding sequence
atggagtctgaaaccgaacctgaacccgtgaccctactggtcaagtcgcctaaccagcggcacagggatctggagctgtccggcgatagaggatggagcgtgggccacctcaaagcacatctgagccgcgtgtacccagaacggccacggcctgaggatcaacgcctgatttactccggaaaactgttactggaccaccaatgcctgagagatcttctaccaaagcaggaaaagcgtcatgtgctgcacctggtgtgtaacgttaagtccccgtccaagatgccagaaatcaacgcgaaagtggctgaaagcacggaagagccagcaggctctaatagaggacagtacccggaggactcatcatcagacggcttgaggcagcgtgaggttctccgtaatctgtcaagccccggatgggaaaacattagtcgtcctgaggctgcccagcaggctttccagggactgggacccggtttttcaggatacacgccctacggctggttgcagttgagttggtttcagcagatctacgcacggcagtattacatgcagtacctggccgcaacagccgcaagtggggcatttgttcccccaccgtcagcccaggaaatccctgtcgtgtccgccccagctcccgcacccatacataaccagttcccagccgagaatcagcccgcaaaccagaacgccgctccccaagtggtcgttaatccaggcgctaaccaaaatctgcggatgaatgcccagggaggccctatcgtcgaggaggatgatgagattaaccgcgattggctggactggacttacagtgctgccacattctccgtgttcctcagtatcctgtacttctattcatcactatcgcgcttcctgatggtgatgggcgctactgtagtgatgtacctgcaccacgtcggctggtttcccttcaggcccagacccgtccagaatttccccaacgacgggcctccacctgatgtggtgaaccaggaccccaataacaacctgcaggaaggcaccgaccccgagaccgaggatcctaaccacttgcctcctgacagggacgtgttagacggcgaacagacctccccgtcctttatgtccacagcttggctggtcttcaagacattctttgcttccctcctgcccgagggtccaccagccattgccaactag

SEQ ID NO: 226362 - DNA, 699 bp, Artificial Sequence
  Description of Artificial Sequence: Synthetic coding sequence
atggagtctgaaacggaaccagaacccgtaacgctgcttgttaaaagtccgaaccagagacaccgggatctagagttgtctggagatcggggttggagtgtcgggcatttaaaagcacacctctccagggtctatcccgagaggcctcgacctgaagatcaaagactcatctactctggaaagttgctgcttgaccaccagtgcctccgggatcttctcccaaaggagaagcgtcatgtgctccatttagtgtgcaacgtcaagtctccttcaaaaatgccggaaatcaacgcgaaagttgccgagtctactgaagagccagccggaagcaataggggtcaatacccagaggactccagcagtgacgggcttagacagcgcgaggtcctccgcaacctctctagcccagggtgggaaaatatctccaggcaccatgtaggttggtttccattccggccacggcctgtccagaattttcctaacgatggccctcctcccgatgtggtcaaccaagatcctaacaacaatctacaggaaggaaccgaccctgagactgaagatcctaaccacctgcctccagaccgggacgttttagacggtgaacagacctctccaagcttcatgtccactgcttggttagtgtttaagactttcttcgcctccttattgccagaaggaccacctgctatcgcaaattag

SEQ ID NO: 226363 - DNA, 1101 bp, Artificial Sequence
  Description of Artificial Sequence: Synthetic coding sequence
atggaatccgagactgaaccagaacctgtcacgctgctggtgaagagtcccaatcagcgccaccgcgacctcgaactgagcggcgacagagggtggtctgtcggccaccttaaggcacacttaagcagagtctacccagaacggcctcggcctgaagatcagcgactgatctactcagggaagttactgcttgatcatcagtgcctgagagacttgcttcctaaggtggccgagagcaccgaggagccagctgggtccaaccgcggtcagtacccggaggacagcagttctgatggtctcaggcagcgggaagtgctgcggaatcttagcagccccggatgggaaaacatttctaggcctgaagcagcccagcaagcattccaagggctgggtcctggcttttcggggtacactccgtatggatggctacaactgtcgtggttccagcagatttatgcgcgtcaatattacatgcagtatctagcagctaccgccgcaagcggagcatttgtccctcccccatcagcacaggaaatcccggtcgtgtcagctcctgcaccagcaccaattcataaccaatttcctgctgagaatcagcctgcaaaccagaatgccgctccgcaggtggtagtgaatccaggcgcaaatcagaacttgcgaatgaacgctcaggggggaccaatagtggaggaagatgacgaaataaaccgggattggctggactggacctattcagctgccacgttcagcgtgttcttgtctatcctatacttctactctagcctgagccgcttcttgatggtgatgggggcaacggttgtgatgtatcttcaccatgtcggctggttcccatttcgccctcgacctgttcagaattttcctaatgatggccctccaccggatgttgttaatcaggatcctaataacaacctccaggaaggcaccgaccccgagactgaggatccaaaccatcttccccctgaccgcgatgtgctggacggagaacaaacctctccatccttcatgtccactgcttggttggtcttcaaaaccttttttgcctctcttctaccggaaggccctccggctatagctaattag

SEQ ID NO: 226364 - DNA, 1173 bp, Artificial Sequence
  Description of Artificial Sequence: Synthetic coding sequence
atggagtccgagacagaacccgagccagtgactttactggtcaaatctccgaatcagagacacagagacttggaactgtccggtgatcggggatggtcagtaggtcacctgaaggctcatctgtccagggtctaccccgagcggcctcgccctgaggaccagcgcctcatttatagtggaaagttgctgttggatcatcagtgcctgagagatctcttaccgaaggaaaagcggcatgttctgcatctcgtgtgtaatgtgaagtctcctagtaaaatgcccgaaatcaacgcgaaggtggcagaatctacggaggagcccgcaggaagtaaccggggacagtatccagaagatagctcatctgacggactgcggcagcgagaagtcttacgaaatttgtcaagccccggatgggagaacatttcacgccctgaggccgcacagcaggctttccaggggctcggacctgggttcagtggctataccccatacggatggctccaactttcctggttccaacagatatatgccaggcagtattacatgcagtatctagccgctacagcagccagtggcgctttcgtaccacctccgtcagcccaagagatccctgtggtatccgctcccgctcctgccccaatacacaatcaattcccagctgagaatcaacccgcaaatcagaacgctgctccacaggtggttgtcaatccgggtgctaaccaaaacctccgcatgaatgcccaggggggtcccatcgtggaggaggatgatgagattaatagggattggctggactggacctacagtgccgctacgttctccgtgttcctgagcattttatatttttactcaagcctatccaggttcctgatggtcatgggggcaactgtcgtcatgtacctccaccacgtgggctggttcccattcagaccccgtcctgttcagaattttcctaacgatggcccaccaccagacgtcgtcaatcaggaccctaacaacaacctgcaggagggcactgatccggagaccgaagatcccaatcaccttccccctgatcgcgacgtgctcgacggcgagcaaacatcccccagcttcatgagcaccgcatggctggtgtttaaaaccttcttcgcgtctctgctgcctgaaggccctcctgctattgccaactag

SEQ ID NO: 226365 - DNA, 1338 bp, Artificial Sequence
  Description of Artificial Sequence: Synthetic coding sequence
atggccgagctgaaatacatatcaggtttcggtaatgaatgttcttcagaggacccacggtgcccaggaagcctgccagagggccagaataatccccaagtttgtccatacaacctctacgccgagcagctgtcaggaagcgcgtttacttgtcccagatccaccaataaaaggtcctggctgtatcggattttgccttctgtgtcccataagcccttcgaaagtattgacgaagggcaggtgacacataattgggacgaagtcgacccagaccctaatcaattacgctggaagccttttgaaatccctaaagcttcacagaagaaggtggattttgtgagcgggctgcacacactatgtggggctggggatatcaagagtaataacggactggctatacacatctttctatgtaacacatccatggagaataggtgtttctacaattctgatggcgacttcttaatcgtgcctcagaaaggcaacttgcttatttatacggaatttggtaagatgctagtgcaaccaaacgaaatttgcgtcattcagcgtggcatgaggttttctattgacgtttttgaggagacgcggggatatattctggaggtgtacggagttcacttcgaacttcctgatttgggcccaatcggtgccaatggcctcgctaatccacgagacttcttaattcctatcgcctggtatgaagacagacaggttcctgggggttataccgttattaacaaataccagggcaaactgtttgctgccaagcaagacgtttcaccatttaacgttgtcgcttggcacggcaattataccccttacaagtataacctgaagaacttcatggtgataaattccgtggccttcgaccacgccgacccatcaatttttaccgttctgaccgccaaatcagtgaggccaggcgttgcgatagcagattttgttatctttccacctaggtggggggtggccgacaaaaccttccggcctccctattatcaccgaaattgcatgtcagaatttatgggccttatccgcggacattatgaagcaaagcaggggggattcctacccggaggcggaagcctccattccacaatgacgccccacgggcctgacgcggactgctttgaaaaagcttccaaggtgaagctcgcacccgagcgaattgctgatggtacgatggccttcatgttcgaaagctccctgtccctggccgttacaaaatggggactgaaagctagccggtgcctggatgagaattaccataaatgttgggagcctttaaaaagtcactttacccctaacagtcggaatccagctgaacctaactag

SEQ ID NO: 226366 - DNA, 2187 bp, Artificial Sequence
  Description of Artificial Sequence: Synthetic coding sequence
atggaagaaacccagccacctccacagcctaaacttcccctgtgtgattctctaatgatttggcttcagactttcaacactgcctctccttgtcaggacgtgaagcagcttactagcggtgtcgccatggcgcaggtgctccaccagatcgacgccgcttggttcaacgaaagctggctcagccgaataaaggaggacgtcggcgacaactggaggatcaaggcctccaacgtcaagaaggtcctgcaggggattatgagctactaccacgagtttcttggacagcaaatttccgaggctctgatccccgacctgaaccagataactgaatgttccgacccagtcgaactcgggagattgctgcagttgatccttggatgcgccattaattgcgagaagaaacaggaacacattcaaaatattatgactctggaggaatcggttcagcacgttgtgatgactgcaatccaggaacttatgtccaaggagattctgagtagtcccccaaacgatgcggtgggcgagctggaacagcagttgaagcgggctttggaggagctgcaggaggcgctggccgagaaagaagagctccggcagcggtgtgaagagctagacatgcaggtgaccactttgcaggacgagaagaatagtctggttagtgagaacgaaatgatgaacgagaagctggaccaattggacggttcattcgacgatcctaatactgtggtcgcaaagaaatacttccacgcccagttgcaactggagcagttacaggaagagaattttcggttggaggctgcgaaagacgactatcgagtgcactgcgaggagctggaaaagcagcttatcgaatttcagcaccgcaacgatgagttgactagcctggcagaggagaccagagcacttaaggacgagatcgatgtactcagagccacctctgacaaggccaacaagcttgaatctacagtagaaatctacaggcaaaaactgcaagatctcaacgacctgagaaaacaggtcaagacattacaagagaccaacatgatgtacatgcacaacactgtgagtctcgaggaagagctgaagaaggcaaacgcagcacgcacacaattagaaacatataaacgtcaggttcaagatttacatgtcaaactgtcctcagagagcaagagagcagacacattggctttcgaaatgaaaaggctggaggagaaacacgaagccctccttaaagagaaggaacgcctcatcgaacagcgcgacactttaaaagaaaccaacgaagaactacgctgttctcaggtgcaacaggaccatttaaatcagactgacgcctcagctacgaaaagctacgagaacctggctgccgagattatgccagttgagtatcgagaagtcttcatccggctccagcatgaaaataagatgctaaggctgcaacaagagggttctgagaacgagcggatagaagaactgcaagagcagctggaacagaagcatagaaagatgaacgagctggagacggagcagaggctatcaaaagagcggatccgcgagctccaacagcagatcgaggatctgcaaaagagcctgcaggagcagggctccaagagcgaaggagagagctccagtaaactgaaacagaaattagaagctcatatggagaaactaactgaggtccatgaggagctccaaaaaaagcaggagcttatagaggacctgcagccagatataaaccagaatgtgcagaagatcaacgagctcgaggccgctctgcagaaaaaggacgaggacatgaaggctatggaggaaagatataaaatgtatctggagaaagcgagaaatgttatcaagacattagaccccaaacttaacccagctagcgctgaaatcatgctcctgcggaagcaacttgcagaaaaagagcgtcgcatcgagattttagagtcggagtgcaaggtggctaagttcagggactatgaagagaagctcatcgtcagcgcttggtacaacaagagtctagccttccaaaaactgggtatggagagtagattggtctctggtgggggtgcctgctcagacacaggggcatgcacgcctgcacggagttttctcgctcaacaaagacacatcacaaataccagacgcaacctatcggtcaaggttcctgcgactacgagcgactag

SEQ ID NO: 226367 - DNA, 2061 bp, Artificial Sequence
  Description of Artificial Sequence: Synthetic coding sequence
atggctcaggtgctgcatcaaattgacgccgcatggtttaacgagtcctggttgagcagaattaaggaggatgtcggggacaattggcgcattaaagctagcaacgtgaagaaagttctccaggggattatgagttattatcatgagtttctggggcagcaaatttcagaggcgctgattccggacctaaatcaaatcactgaatgcagcgatcccgttgagctgggacgcctcctgcagctgatccttgggtgcgctatcaactgcgagaaaaaacaagagcacatccagaatatcatgactcttgaagagtctgtccaacacgtggtcatgactgctattcaagaactcatgtcgaaggagatcctttccagtcctcctaatgatgcggtgggagaacttgagcaacagttgaaaagagctcttgaagagctgcaagaggctctggccgaaaaagaggaacttagacagagatgcgaggaactggacatgcaggttacaacattgcaggacgagaagaactcccttgtgtctgagaacgaaatgatgaacgagaagttagaccaattggatggctcgttcgatgacccaaacaccgtggttgccaaaaagtacttccatgcccagctgcagctggagcagctccaggaagagaacttccgattagaggccgcaaaggatgactacagggtgcactgtgaggaacttgagaaacaactgatcgagttccagcacaggaacgatgaactaacatcactggctgaggagacccgcgcactcaaagacgagatcgatgtcctgcgtgctacatccgataaggccaataagttggaaagcactgttgagatctatcggcagaaactgcaggatttaaatgacctccggaagcaggtgaagactctccaggagacaaatatgatgtatatgcacaacacggtgtctcttgaggaggaactgaagaaagccaatgcagccagaacacagttagaaacatacaaacgccaggtgcaggacctgcatgtgaaactgagtagcgagtcaaaaagggcggacactctggcattcgaaatgaagcgcctggaggagaagcacgaagctctgttgaaagagaaggagagactcatcgaacagcgggacacactcaaagagaccaatgaagaattacgatgctctcaggtccagcaggaccacctcaaccaaactgacgcaagcgcaaccaagtcctatgagaacctcgcggctgaaatcatgcctgtggaataccgggaggtgtttattcgtctgcaacacgagaataagatgctgagattacagcaggagggcagtgagaatgaaagaatcgaagaacttcaggagcagctggagcagaagcacaggaaaatgaatgaactggagacagagcagcggctctcaaaagaaagaatccgagagctacagcagcaaattgaggacctccaaaagtctctgcaggagcagggatccaaatctgaaggagagagctcgtcaaagctaaaacagaagctggaagctcatatggaaaaactaaccgaggttcacgaagagttgcagaagaagcaagaattaattgaggatctccagccagacattaaccaaaatgtgcagaagattaacgaactggaggctgctttgcagaagaaggacgaggacatgaaggcgatggaggaacggtataagatgtatcttgagaaagccagaaatgtaatcaagacactggatcctaaactgaaccccgcttcagcggaaattatgctccttaggaagcaactggctgagaaagaacgcaggattgaaattctggagtccgaatgcaaagtcgcaaagttccgcgattatgaggaaaaattgatcgtaagcgcatggtacaataaaagcctggccttccagaaactgggcatggagtctaggctcgtatccggcggaggggcttgctcagatactggagcttgcactcctgcacgttcttttctcgcacaacagcgccatattacaaacacacgcagaaatctgtccgtaaaggtcccggcaacgacgtctgattag

SEQ ID NO: 226368 - DNA, 414 bp, Artificial Sequence
  Description of Artificial Sequence: Synthetic coding sequence
atggaagaaacgcagccccctccacagcccaaacttcccctctgtgatagcctgatgatatggctgcaaacatttaacacggcaagcccttgccaggacgtcaagcagttaacttcgggggtggccatggctcaagtactgcaccagattgatgccgcatggttcaatgagagctggctctctaggattaaggaagacgtcggagacaattggcgaattaaggcctcgaatgtgaagaaggtgcttcaggggattatgagctattaccacgagttccttgggcagcagattagtgaagccctcattccagacctgaaccagatcaccgaatgttcggaccccgttgagctcggcaggctcctacagctcatcctgggttgcgccatcaactgtgagaagaagcaggaacactag

SEQ ID NO: 226369 - DNA, 2154 bp, Artificial Sequence
  Description of Artificial Sequence: Synthetic coding sequence
atgagcgtcgataaagccgaactctgcggctccctgctaacctggctgcagaccttccacgtgccatccccctgtgcgagcccacaggaccttagcagcggactggccgtcgcctacgttttgaaccagatcgacccttcatggtttaacgaagcctggctgcaagggatctcagaggaccccggtcccaactggaaattaaaagtgtctaatcttaaaatggttctgaggagtctggttgagtatagccaggacgtcctcgcccatccagtgtccgaggagcacctgcccgacgtttccctaatcggagaatttagcgatccagccgaactaggtaaattactccagttggtcttaggatgtgcgatttcttgtgaaaagaaacaggaccacatccaaaggatcatgacccttgaagaatctgtacagcacgttgtgatggaagctatacaagagctcatgactaaagataccccagattccctcagccccgagacatacggcaattttgacagccaatcccggagatactattttctgtccgaagaggctgaggagggggatgaattgcaacagcgctgtttggacctggaaagacagctcatgttgttgtcagaagaaaaacagtccctcgcccaggaaaatgctggactgagggaacggatgggtcgccctgagggtgaaggaaccccgggtctgactgcaaaaaagcttctgctgttgcagtctcagctcgagcagttacaggaggagaatttccgccttgaatctggacgagaggacgagcgcctgcgttgtgcagagctcgagcgcgaagtggcggagctccagcatcgcaatcaggcactcacaagccttgcccaggaagcccaggctctgaaggacgagatggacgagcttcgacagagcagcgagcgtgccggacagctggaggccactctgaccagttgcaggcgcagactgggggaactgagggaactcagaagacaggtgaggcagttagaggagagaaacgccggtcatgcagaacgcactaggcagttagaagacgagcttaggcgggctggctcactccgggcacagctcgaggctcagaggcggcaggtgcaagagttgcagggacagcgccaagaagaggcgatgaaggcagagaaatggcttttcgagtgtcgcaacctggaggaaaagtacgaatccgttaccaaggagaaggaacgcttacttgctgagcgtgactcccttcgggaggctaacgaggagttgcggtgtgctcagctgcagcctcgcggactcacgcaagcagaccctagtctggaccccacgagtaccccggtggacaatttggccgctgaaatcctcccagctgagctgagggagaccttactgcgcctgcagctggaaaacaaacgattatgtcggcaggaagcagctgacagggaaagacaggaggagcttcagcgtcacctcgaggatgctaaccgagccaggcacggcctggagacccagcaccgactcaaccagcagcagctgtccgaattgcgggcacaagtggaggacctgcagaaggcactccaagagcagggcggtaagaccgaagattcaattcttcttaagaggaaactggaggagcatctgcaaaaactgcacgaggcagatctcgagctacagcgaaaacgggaatacatagaggaactggaaccaccgaccgattcatctaccgcccgacgaatcgaagagctgcagcacaacctacagaagaaggacgcggaccttcgggcaatggaagaacggtaccggcgttatgtggacaaggccagaatggtgatgcagacaatggagcctaagcagcgcccagcagcaggggctccaccggaacttcattctctgcgcacacagctccgggagcgggacgtgaggataaggcatttagagatggacttcgagaaatcgaggagccagcgcgagcaagaagagaaactactgatttccgcgtggtacaacatgggaatggcactacagcagcgtgctggggaggagcgcgctcctgctcatgcacaatcgtttctggcacagcagcgcctcgctactaattcacgtcggggacctttgggtcgactggcctccctgaaccttaggccgacggacaagcactag

SEQ ID NO: 226370 - DNA, 2160 bp, Artificial Sequence
  Description of Artificial Sequence: Synthetic coding sequence
atgtctgtggacaaagccgagctatgcggctctcttctcacctggcttcagacgttccatgtcccaagtccttgcgcttctccccaggatctgtctagcggcttagcggtggcttacgtgctcaatcagattgatccatcctggttcaatgaagcctggttgcagggtatctcggaggatccgggacctaattggaaactgaaggtgagcaacttaaagatggtgctacgctcactggtggaatatagccaagatgtcctggctcaccccgtgtcagaagagcaccttcccgacgtatccctgatcggcgaattttcagaccctgccgaactggggaaactgctgcagttggtgctggggtgcgccatttcctgtgaaaaaaagcaggatcacatacagaggatcatgaccttagaagagtcggtacaacacgtagtgatggaggcaatccaggaactgatgactaaggatacacctgactcccttagtcccgagacttatggtaatttcgacagtcagagtaggcgatattatttcttaagcgaagaggcggaggagggcgacgaactccagcagcggtgcctggatctggagaggcagttgatgctgctgagcgaagaaaagcagagtctagctcaggagaacgctggtctccgggagagaatgggacgacccgagggcgagggaacccctggcctcactgctaaaaaactgcttctcctgcagagccaattagagcagctccaggaggagaatttcaggctggagtctggccgagaggacgaaagattgcggtgcgcagaattagaacgtgaggtggcagagctccagcacaggaaccaggccctgaccagcctcgcccaggaggcccaggcccttaaggatgagatggacgagctgcggcaatcatcagagcgcgcaggacagctggaggcaacactgacctcctgtaggcgacggctaggcgagctgcgcgagctgagacggcaagtgaggcaattggaggaacggaatgccggtcatgcagagcgcacccgccagcttgaggatgagctgcgcagggctggctctctgcgagctcagttagaggcccagcgccgtcaagtgcaagagctgcaagggcagaggcaggaggaagctatgaaggcggagaagtggctgtttgagtgccggaacctggaggaaaagtacgagagtgttacgaaagaaaaggaacgtttgttggctgagcgcgatagcctgcgtgaagccaacgaggaattaagatgtgcgcaactccagccccgagggctgacacaggctgacccctcacttgacccgacgagcacccctgtcgacaatcttgcagctgagatactgcccgcagagctgcgcgagacactgctgaggctgcagcttgagaacaaacgactgtgccggcaggaggcagcggatagagagaggcaggaggagttacaacgacatctcgaggatgccaaccgcgctcgccacggcctggagacacaacataggctgaaccaacagcagctgtccgaactgagagcacaggtcgaagacctgcagaaagctctgcaggagcagggaggcaagactgaggacgctatatctattttactgaaacgcaagttggaggagcacctccagaagttgcacgaagccgacctcgaactccagcggaagagagaatatattgaggagctggagcccccaactgacagctcaacagccagacgtattgaggaactgcagcataacttacaaaagaaagacgctgatcttagggcaatggaggagcgataccgcaggtatgtggacaaagcacgaatggtcatgcagaccatggagcccaagcagaggccggcagccggtgccccacccgagctgcacagtttaaggactcagctgagagaaagagatgtgcggatacggcatttggaaatggacttcgagaaaagccgttctcaacgcgagcaagaagagaagctgctcataagtgcctggtataatatgggcatggctttgcagcagcgggctggagaggagcgggctcctgcccacgcacagtcttttctggctcaacagcggctcgcaaccaattcaagacgtggcccactgggcaggctagcatctttaaatctgcgcccaactgacaaacactag

SEQ ID NO: 226371 - DNA, 2157 bp, Artificial Sequence
  Description of Artificial Sequence: Synthetic coding sequence
atgttctccgtagaaagccttgagcgagcagagctgtgtgaaagtctgctaacctggattcagacttttaacgtggatgcaccttgtcagacggtagaagatctgacgaatggagtggtgatggcacaggtgctgcagaagatcgacccggcttactttgatgagaactggctgaaccggatcaagactgaggtcggcgacaactggcggctcaaaatcagtaacttgaagaaaatactaaagggaatccttgattataatcacgaaatcttgggccagcagataaatgactttaccttgccggacgtgaatctcattggggaacattcagatgcagccgaattaggccgtatgctccagttaattttgggctgcgcagtgaattgtgagcagaaacaggaatacattcaggcgattatgatgatggaggagtccgtgcagcatgtggtgatgaccgccatccaggagctgatgagtaaggaatcacctgttagcgcgggaaacgatgcttatgtggatttagataggcagctaaaaaaaaccacagaggagctcaacgaggcactgagtgcgaaggaggaaatcgcgcaacgttgccatgaacttgacatgcaggtggccgctctccaggaagaaaagagttctctgttggccgagaaccaggtactcatggagagactgaatcaaagtgactcaattgaggatccaaatagcccagcgggtcgccgacacctgcagcttcaaacacagcttgagcagcttcaagaagagacatttcggctggaagcagccaaggacgactaccggatccggtgcgaggagcttgagaaagagatctctgaattgcgccagcaaaatgacgaactgactacactggccgacgaggcccagagccttaaagatgagatagacgttctaagacacagctctgataaagtgagcaagctagagggtcaggtcgaaagttataaaaagaagctggaggacctaggagaccttcgaaggcaggtcaaactgctcgaggagaagaatacaatgtacatgcagaacacggtgagcctggaagaggagctgcgcaaagccaatgccgcacgctcccagttagaaacttacaagagacaggtggtcgaacttcagaaccgtttaagcgaggaatccaaaaaggcagataagctggattttgaatataagcgcctgaaggaaaaggtcgatagccttcagaaagagaaagacaggcttcgcactgagcgcgacagcctcaaggagaccatcgaagagctccgctgtgtccaggcccaggagggacagctgaccactcaggggctaatgccactgggctcacaagagtcttcagactcactggctgctgagatcgtcacacctgagattagagaaaagctcattcgactgcagcatgagaataagatgctcaaactgaaccaggagggcagtgacaacgaaaagatcgctttgctccaaagccttctcgacgatgctaacctgcgaaagaacgagctggagacggaaaaccgtctcgtaaaccagaggctgctggaggtgcagtcacaggtcgaggagttgcagaaatcgttacaggatcagggcagcaaggccgaggactccgtgctcctgaagaagaagctggaggagcatctggagaagctacatgaggccaacaacgagctgcagaagaagagagccatcatagaggatctggagcccaggttcaacaattcgtctctgaagatcgaagagttgcaggaggccctgcgcaagaaagaggaggaaatgaagcagatggaggaacgatacaagaaatacctcgagaaagcgaaaagtgtcatacgaacgctggaccctaagcaaaaccaaggtgctgcccctgaaattcaagccctcaaaaaccagctgcaggagcgcgatcgtttatttcattcactcgagaaggagtacgaaaagactaaatcacagcgggagatggaggagaaatatatcgtgagcgcttggtataatatgggcatgaccttgcataaaaaggcagccgaagatcgccttgcatcaaccggttcaggccagagctttcttgcgagacaacggcaggcgacgagttcaagacggtcctatcccggtcatgtccagccagcaacagcaagatag

SEQ ID NO: 226372 - DNA, 222 bp, Artificial Sequence
  Description of Artificial Sequence: Synthetic coding sequence
atgtccgccgaaactgcctccgggcctacagaagaccaggtagagatcctggaatataatttcaacaaggttgacaaacacccggatagcacaaccctgtgcctgatcgcagctgaagcgggtctgtcagaggaagagacccagaagtggtttaaacagaggctggccaagtggcgacggtcagaagggttgccctctgaatgcagaagtgtcaccgattag

SEQ ID NO: 226373 - DNA, 222 bp, Artificial Sequence
  Description of Artificial Sequence: Synthetic coding sequence
atgagcgcagagacagcctctggaccgaccgaggaccaggtggagatccttgagtataacttcaataaggtggacaaacacccagatagcacaacgctgtgtctgatcgccgctgaagccggacttagcgaggaggagacacagaagtggtttaagcagcgattggccaagtggcgtcggagcgagggcctcccaagcgagtgcaggtccgtgaccgactag

SEQ ID NO: 226374 - DNA, 222 bp, Artificial Sequence
  Description of Artificial Sequence: Synthetic coding sequence
atgagtgcggagacggcttcaggacctaccgaagaccaggttgaaattctggagtacaacttcaacaaagtggacaagcatcccgacagcaccactttgtgtttgattgcagccgaggcgggactctctgaggaagagactcagaaatggttcaaacaaaggctggccaagtggcgcagatcagaaggactgccctcagaatgtcggtctgtgactgactag

SEQ ID NO: 226375 - DNA, 285 bp, Artificial Sequence
  Description of Artificial Sequence: Synthetic coding sequence
atgtctgcggagacagcgagtgggccaaccgaggatcaggtagagatacttgaatacaattttaacaaggttgacaaacacccagattcaaccactctctgtttgatcgctgcagaggccggtctttcagaggaggaaacacaaggatccgacctaatttcacgaagcaaaatctggcatcccgagtcaagccctcaaagagaaggatacccccatgactccttgccctgcctggccttcgactacttctctctcttgcctcctcaatgcaaagaaatggtgtag

SEQ ID NO: 226376 - DNA, 276 bp, Artificial Sequence
  Description of Artificial Sequence: Synthetic coding sequence
atgctcatatttcttggatgttaccgacgacgcttagaggagagagctggaaccatgtctgctgagacagcatcaggtccgactgaggaccaggttgaaattctggagtataatttcaacaaggttgacaagcacccggatagcacaactctctgcttgatcgcagccgaagcaggattaagtgaggaagaaacacaaaagtggtttaagcagagactcgccaaatggagacgcagcgaaggcctgcccagcgagtgccgttccgtgaccgattag

SEQ ID NO: 226377 - DNA, 222 bp, Artificial Sequence
  Description of Artificial Sequence: Synthetic coding sequence
atgtctgctgagactgcctctggaccaaccgaggaccaagtggaaattctggagtacaacttcaacaaagtcgataaacatccagactctacaaccctgtgtcttatcgctgcggaagcgggactttccgaggaggagacccaaaagtggttcaaacagcgcctggcaaagtggcgccgttctgagggactacctagcgaatgtcgttctgttactgattag

SEQ ID NO: 226378 - DNA, 285 bp, Artificial Sequence
  Description of Artificial Sequence: Synthetic coding sequence
atgtccgccgaaacggcgagcggtcctacggaggaccaggtggaaattctcgagtacaactttaataaggtggacaaacaccctgattctaccactctgtgtctcattgctgcagaagccggactctctgaggaggaaacacaaggatcagacctcatctcacggtcgaagatttggcacccagaatcttctccacaacgggagggttacccgcatgattccctcccctgcctggctttcgattatttttcccttctccccccacagtgcaaagagatggtgtag

SEQ ID NO: 226379 - DNA, 222 bp, Artificial Sequence
  Description of Artificial Sequence: Synthetic coding sequence
atgagcgcggagacagccagcggcccaaccgaggaccaggttgaaatcctggagtacaatttcaacaaggtcgacaagcaccccgatagtacaacgctgtgcctgatcgccgctgaagccggtctgtctgaggaagagacgcagaaatggttcaagcaacgtctagccaagtggcggagatccgagggcctgccttcagaatgcagatccgtcactgattag

SEQ ID NO: 226380 - DNA, 276 bp, Artificial Sequence
  Description of Artificial Sequence: Synthetic coding sequence
atgcttattttcctaggctgctatcgccgacggctggaggagcgggctggtacgatgagtgctgaaaccgcctcgggccctacagaggaccaggtggagatcctcgagtataacttcaacaaggtggacaaacatccggattccacaactctgtgtttgatcgccgcagaagccggtctctccgaagaggagacccagaagtggtttaagcagaggctggccaagtggagacgctccgaggggctgccctccgaatgtcggtctgtgaccgattag

SEQ ID NO: 226381 - DNA, 285 bp, Artificial Sequence
  Description of Artificial Sequence: Synthetic coding sequence
atgtccgcagaaactgcttcagggcctacagaagaccaagtggaaatcttggaatataacttcaataaagtcgacaagcatccagatagtaccacgctgtgcttaattgctgctgaagctggactgtctgaggaggagacgcagggtagcgacctgatttcgcgatcaaaaatctggcacccagagagctcaccccagcgagaggggtatccacatgatagcctcccttgtctggccttcgattatttcagtctgcttcctcctcaatgtaaggaaatggtgtag

SEQ ID NO: 226382 - DNA, 222 bp, Artificial Sequence
  Description of Artificial Sequence: Synthetic coding sequence
atgagtgctgaaactgcttccgggcctacagaggatcaggtggagattttggaatataatttcaataaagtcgacaagcatccagactccacaacactgtgcctgattgcagcagaagccggattaagtgaggaggaaacacagaagtggttcaaacagaggctggctaagtggcgtcgctcagagggattaccatccgaatgtagatccgtgacggactag

SEQ ID NO: 226383 - DNA, 222 bp, Artificial Sequence
  Description of Artificial Sequence: Synthetic coding sequence
atgagcgcagagacagctagtgggccaaccgaagatcaagtcgaaatactcgaatacaatttcaacaaggtggataagcaccctgattctaccaccctgtgtttgatcgccgctgaggccggactgagtgaggaagaaactcagaaatggttcaagcaacgactggctaaatggcggaggagtgagggactgccgtccgaatgtagatccgtaaccgactag

SEQ ID NO: 226384 - DNA, 339 bp, Artificial Sequence
  Description of Artificial Sequence: Synthetic coding sequence
atgctcatctttctaggttgctatagacgaaggctggaagaacgggctggcacaatgagtgcagaaacagcctcaggcccaaccgaggatcaggttgagatcctggagtacaattttaacaaggtagataagcatccggattcaaccacactgtgcctgatagctgcagaggctgggctgtcggaagaagagacccaaggctcagatcttatttcacgcagcaagatttggcatccagagagctcgcctcagcgagagggctacccccacgacagcctaccctgtctcgcttttgattacttttcacttcttccccctcagtgcaaagagatggtttag

SEQ ID NO: 226385 - DNA, 222 bp, Artificial Sequence
  Description of Artificial Sequence: Synthetic coding sequence
atgtctgctgaaactgcaagtggtcccaccgaagaccaggtggaaatcctagagtacaattttaacaaagtggataagcacccagatagtacaaccctatgccttatcgccgctgaggccggtttatcggaggaagagactcagaagtggtttaagcagagactggcaaaatggaggcggagcgagggcttaccgtcagaatgccgcagtgtgaccgactag

SEQ ID NO: 226386 - DNA, 222 bp, Artificial Sequence
  Description of Artificial Sequence: Synthetic coding sequence
atgagtgccgagactgctagcgggcctacagaagaccaagttgagatacttgagtacaacttcaataaagtggataaacaccctgacagtacgactctatgtctgattgcagcagaggcaggcttgtccgaggaggagacgcagaaatggttcaaacagcggttggccaagtggaggaggtcagagggactgccgtccgaatgtaggtccgttaccgattag

SEQ ID NO: 226387 - DNA, 222 bp, Artificial Sequence
  Description of Artificial Sequence: Synthetic coding sequence
atgagtgcagagacggcctctgggcctacagaggatcaggtggagatactggagtacaatttcaataaggtggataagcacccagatagcaccactctttgtctgatcgctgccgaggccggtctgtctgaagaggagacacagaagtggttcaaacagcgcctagccaaatggaggcgttcagaagggctgccttctgaatgccggagtgttaccgattag

SEQ ID NO: 226388 - DNA, 144 bp, Artificial Sequence
  Description of Artificial Sequence: Synthetic coding sequence
atgtctgccgagactgcttcaggacctacagaagatcaggtcgaaattctggagtataacttcaataaagtcgacaaacaccccgacagtaccacactgtgtctgatcgccgcagaggccggtctgtcagaggaagagacctag

SEQ ID NO: 226389 - DNA, 1164 bp, Artificial Sequence
  Description of Artificial Sequence: Synthetic coding sequence
atggccactgcacaacttcagcgcactccaatgtccgcccttgtctttcctaacaaaatttccaccgaacatcaaagcctggtactcgtgaagcgcctcctggcagtgtccgtctcctgtatcacttacctcaggggcatattccccgagtgcgcttatgggaccagatatctagatgatctgtgtgtgaaaatactcagagaggacaaaaattgcccaggctccactcagctggtgaagtggatgttggggtgctacgacgcattacagaaaaaatacgtatacacaaatcccgaggacccccagactatttcagaatgttatcagttcaagtttaagtacactaacaacggcccacttatggatttcatctccaaaaaccaatctaacgaatcaagcatgcttagcacagatactaaaaaggcttctatccttttaatccgaaaaatctacatattaatgcaaaatttgggacccctacccaacgacgtttgtcttacgatgaagctgttttactacgatgaagttacacccccagactaccagcccccaggatttaaagacggagactgtgagggagtaatctttgaaggagagccaatgtaccttaatgtaggggaggtcagtactcctttccacatttttaaggtaaaggtcacaaccgagagggagcggatggagaacatcgatagcaccatactgtcgcctaaacagattaagaccccgttccagaaaattctgcgtgacaaggatgtcgaagatgaacaggaacattacacctcggacgaccttgacatcgaaaccaagatggaggaacaggagaagaatcccgcatcctctgagctagaggaaccgagcctagtctgcgaagaggacgagatcatgagatctaaagaaagtccagacctgtccattagccactcacaagtagagcagctggtgaataaaacctctgaactcgacatgagcgaatcaaaaacccgctcgggcaaagtgttccagaataagatggctaacggtaaccaacccgtgaaatcctctaaagaaaatcgaaaacgttcgcaacatgagagcggtcgcatcgtgctgcatcattttgacagttcctcacaggagtccgtgcctaagcgtcggaaattctctgagccaaaagagcatatctag

SEQ ID NO: 226390 - DNA, 1185 bp, Artificial Sequence
  Description of Artificial Sequence: Synthetic coding sequence
atggccacagcccagctgcagcggacccctatgagcgccctggtattccccaacaaaatcagcacagaacatcagagtctggttcttgttaagcgcttgttggcggtgtccgttagttgcatcacctacttgagagggatatttcccgagtgcgcctatggtaccaggtacctggatgacctgtgcgtgaaaatactgagagaggataaaaactgcccgggttcaacgcagctcgttaaatggatgttgggttgctatgatgccttacagaaaaagtacctgagaatggtagtgctggctgtctacacaaatcctgaagacccccagacaattagcgaatgttatcagtttaagttcaagtacaccaataacggacctttaatggacttcatttctaaaaatcagtcaaatgagagctctatgctttccactgatacaaagaaggcctcgatcttacttatccgcaaaatctatattctaatgcagaatctcggtccccttccgaacgacgtttgcctgaccatgaagttgttttattacgacgaggtaacccccccagattaccagcctccaggttttaaggatggagattgtgaaggcgtaatctttgagggtgaaccgatgtatcttaatgtcggagaagtttccacccccttccatattttcaaggtgaaagtcaccactgaaagagagcgcatggagaacattgattcgaccattctgtcacccaaacagattaaaacacctttccagaaaattcttcgggacaaggacgtcgaggacgagcaagaacattacactagcgacgacctggacattgaaactaaaatggaggaacaggaaaagaatccggcaagttctgagttggaagagcccagcctcgtgtgtgaggaagacgagatcatgcgctcaaaagaaagcccggacctgagcatctctcatagtcaggtggagcagctcgtcaacaagacctccgagcttgacatgagcgaatctaagacaaggtccggcaaagtctttcagaataaaatggcaaacggaaatcagccagttaagagcagcaaggagaaccggaagcgatcacagcacgagagtgggagaatcgtgctacaccacttcgattcgagctctcaggaatcagtgcctaaacgacggaaattcagcgaacctaaagagcacatatag

SEQ ID NO: 226391 - DNA, 573 bp, Artificial Sequence
  Description of Artificial Sequence: Synthetic coding sequence
atgcggctgtggaacaagatatcacgttggatgctgggctgttacgacgctctgcagaaaaaatatttacgtatggttgtactcgctgtgtacaccaaccccgaggatccccagacaatttcggagtgctatcagttcaaatttaaatacacaaacaatggaccactcatggattttatcagtaagaaccagagcaatgaatctagcatgctctctacggacactaagaaagccagtatactgctaattagaaagatctatatattgatgcaaaaccttggcccactgcccaacgatgtgtgcttaacaatgaagctcttttactacgacgaggtgacccctcccgattatcagccaccgggtttcaaggatggagattgcgagggagtgatttttgagggtgagccaatgtatctgaacgtcggagaggtgtctacccctttccatatcttcaaggtgaaggtaaccacggagcgcgagcgaatggaaaatattgacagcactatcctttcccccaaacagattaagacaccattccagaaaattctgcgtgataaagatgtcgaggactag

SEQ ID NO: 226392 - DNA, 972 bp, Artificial Sequence
  Description of Artificial Sequence: Synthetic coding sequence
atgaggctgtggaacaaaatcagccggtggatgttgggttgctatgacgctcttcagaaaaaatatctgaagataatggagcttaccgtgtataccaatccagaggatccacagactattagtgaatgctaccaatttaagtttaaatatacgaacaacggccctctgatggacttcatcagtaaaaaccagtcaaatgagtccagtatgttgagcaccgatacaaaaaaggcttccattctgctgataaggaagatctatattctgatgcaaaatctcggacctctgcctaacgatgtttgcctgactatgaagctgttttactacgatgaagtgactcccccagactaccagccacctggattcaaggacggtgactgcgaaggtgttattttcgaaggggagccgatgtacctgaacgtaggcgaggtgagcacacccttccatatttttaaagttaaggtcactaccgagcgagaaaggatggagaacatcgactcaaccattctgagccccaagcaaataaagactcctttccagaagattttaagagacaaagacgtggaggatgagcaggaacattatacttccgatgacctggatatcgagactaaaatggaagaacaagagaaaaatcccgctagctctgagcttgaagagcccagcctcgtgtgtgaggaagacgagattatgcgttcaaaagagagccccgacctatccatatcccattctcaggtggagcagctagtcaacaagacatcggagctcgacatgtccgagagcaaaactaggtctgggaaagtcttccagaataaaatggcgaacggtaatcagcctgtgaaaagttcaaaagagaatagaaaacgttcccagcatgaatccgggcgaattgttctgcatcactttgacagctcaagccaggaatcagtcccaaaaaggcgtaaattctcagaaccaaaggagcacatctag

SEQ ID NO: 226393 - DNA, 1185 bp, Artificial Sequence
  Description of Artificial Sequence: Synthetic coding sequence
atggctaccgctcagctgcagagaacgccaatgagcgctttggtttttccaaataaaatcagcacggaacatcagtcccttgttttagtgaagaggctcttggcagtgtcagtgtcatgcataacgtacctgagaggtattttcccggagtgcgcgtacggaactcgttacctcgacgacctatgcgtgaagattctgagggaggataagaactgccctggtagtacccaacttgtcaaatggatgctgggatgctacgatgccttacagaaaaaatacctgaagattatggagctcacagtctacaccaaccccgaagatccgcagaccatatccgagtgctaccagtttaaattcaagtatacaaacaatggcccactcatggacttcatcagcaagaatcagtccaatgagtcctccatgctgtctacagatacaaagaaggctagcattcttctcatacgaaagatttacatcctgatgcagaacctcggccctctgcctaacgatgtctgcttaacgatgaagttattctattacgatgaagtcaccccacctgactatcagccgccagggtttaaagacggtgactgtgaaggcgtcatattcgaaggtgagccaatgtacctgaacgtaggggaagtgagtactccttttcacatctttaaagtgaaggtgacgactgaaagggagagaatggagaatatcgattccacaattctgagccctaagcagatcaaaactccattccagaagattctcagagacaaagatgtggaggacgagcaagagcattacacatctgacgacctggacatcgaaaccaagatggaggaacaggaaaagaatcctgctagcagtgaactggaagagcctagcctagtgtgtgaggaggacgagataatgaggagtaaggagtcccctgacctgtcaattagccattctcaggtagaacaattggtcaacaagacgtccgaactcgatatgtcagaatccaaaacgaggtccgggaaggtatttcagaacaaaatggcaaacgggaaccagcccgtgaagtcaagtaaagagaataggaaacgaagccagcacgagagcggacggatagtacttcatcactttgacagttcgagccaggagagtgtacccaagaggcggaagtttagcgagccaaaggagcatatttag

SEQ ID NO: 226394 - DNA, 945 bp, Artificial Sequence
  Description of Artificial Sequence: Synthetic coding sequence
atgagattgtggaacaaaattagcaggtggatgctaggctgctacgacgctttgcagaaaaagtacctccgaatggtcgtccttgccacaatatctgagtgttatcagttcaagttcaaatacaccaataatggcccactcatggattttatatccaaaaatcagtccaacgaatctagtatgctgtctaccgacacaaagaaagcgtcaatccttctcatccggaagatttatatactgatgcagaatctcggaccccttcccaatgacgtttgcctgactatgaaactcttctattatgacgaagtgacaccgccagattaccagcctcctggctttaaagacggagattgtgagggggtcatcttcgaaggggagccgatgtatctgaacgtgggagaggttagcacaccttttcacatcttcaaggtgaaggtaacaactgaaagggaacggatggagaacattgacagcacaattttatctccaaagcagattaaaacccctttccagaaaatattgagggataaagacgtagaggatgagcaggaacactacaccagcgatgatttagatatagagaccaagatggaagagcaggagaagaacccagcatcttcggaactggaagagccaagccttgtgtgcgaagaagatgaaattatgaggagcaaggaaagccccgacttgagcatatcccactcccaggtcgagcagttggtgaacaaaacctcagaacttgatatgagtgagtcaaagacacggtccggcaaggtgttccagaacaagatggctaatgggaaccagcccgttaagtcctccaaggagaatcgtaagaggtcacaacacgagagcggcaggatagtcttgcatcatttcgactcatcatctcaagagagcgtgcctaaacgtcgtaaattctctgagccgaaggaacacatctag

SEQ ID NO: 226395 - DNA, 495 bp, Artificial Sequence
  Description of Artificial Sequence: Synthetic coding sequence
atgcgcctgtggaacaagatttcaaggtggatgctgggttgttatgacgcactccagaagaaatatgtgtatacaaatcctgaagatccccaaactatcagcgaatgctaccaatttaagtttaagtacacaaacaacggcccactgatggattttatctccaagaaccagagtaatgaaagctccatgcttagcaccgatactaagaaggcctctattctccttattcggaagatctatatactcatgcagaacctcggacccctgcccaatgatgtgtgcctgaccatgaaactgttctactacgacgaggtgacccctcccgactaccagccaccgggattcaaagatggcgattgcgagggcgtgatcttcgagggagagcctatgtacctcaacgtgggtgaggtgagcaccccctttcacattttcaaggtcaaggtaaccactgagcgggaaaggatggaaaacatcgactcgactattctgtcttag

SEQ ID NO: 226396 - DNA, 945 bp, Artificial Sequence
  Description of Artificial Sequence: Synthetic coding sequence
atgcggctctggaataagatctccagatggatgctgggttgctacgatgccttgcagaagaagtatcttcggtactttttgttcaaaacgatcagcgaatgttatcaattcaaattcaagtacactaacaatggaccactaatggattttatcagcaaaaatcagtctaacgagtccagtatgctttccaccgacactaaaaaggccagcatactccttatcaggaagatttacatcttgatgcagaacctgggaccattacccaacgacgtgtgtctaacaatgaaactcttttactatgatgaagtgactcctccagactaccagccaccgggatttaaagatggagactgtgaaggagttatcttcgagggtgagccaatgtaccttaacgtgggagaggtctcaactcccttccacatatttaaagtgaaggtgactacggaacgagagcgcatggagaatatagatagtaccattttgtcgccaaagcagatcaagactccgtttcagaaaattttacgcgataaggatgttgaggacgagcaggagcactatacttctgacgacctggacattgaaacaaaaatggaagaacaggagaagaaccccgctagctcagagctcgaggaaccatcactcgtgtgtgaggaagacgaaatcatgcgaagcaaggagtcaccggacctttccatatcccacagccaagtcgaacagctggtgaacaaaacctccgagttagatatgtctgaaagcaagacacgctccggaaaagtatttcaaaataaaatggccaatggaaatcagcctgtcaaatccagcaaagagaatcgtaaacgatctcagcatgaaagcggacgcattgtgttgcatcattttgattcatcttcacaggagtcagtgcctaagcgtaggaagttcagcgagcctaaggagcacatctag

SEQ ID NO: 226397 - DNA, 6107 bp, Artificial Sequence
  Description of Artificial Sequence: Synthetic coding sequence
atggccagcgctgtaagcccagctaatctgcccgcagtactgctccagcccagatggaagcgcgtggttgggtggagcggcccagtgcccaggccgagacacggacacagggccgtggctatcaaggagcttattgtcgtttttggcggaggtaacgaaggcatcgttgacgagctacacgtgtacaataccgctaccaatcaatggttcatccctgcagtaaggggcgacattccccctggatgtgccgcatacggttttgtgtgtgatggaaccaggctcttggtttttggaggtatggtagagtacggcaaatactcaaacgacttgtacgagctgcaagcgagccgatgggagtggaagcggctcaaggctaagacccctaagaacgggccacctccctgtcctaggcttgggcacagtttctcactagttggaaataaatgctacctatttgggggtctcgctaacgattccgaggatcccaaaaataacattcctagatacctgaacgacctctatattctggaattaagaccaggaagcggcgttgtagcgtgggacatacccatcacgtacggagtactccctccacctagagagtctcacacagccgtggtgtatacagaaaaagataacaagaaaagcaaactggtaatctacgggggtatgagtggttgtcggctgggcgacctgtggactctggacatcgacacactgacatggaacaaaccatccctttcgggcgtggcccctctgcctcggtctttacacagtgccaccacgattggtaataagatgtacgtgtttggcggatgggtccccctggttatggacgacgtgaaagtggctacacacgaaaaagaatggaaatgtactaatacactggcttgccttaacctggacaccatggcatgggagacaatactgatggacactctcgaagataatattcccagagcgagggctggacattgcgccgtggccataaacacaaggttgtacatatggtcgggaagagatgggtaccgcaaagcctggaacaaccaggtttgttgtaaagatttgtggtatctggagaccgagaaacctcctccaccagccagagttcagctcgtgagagcgaataccaactcccttgaagtcagttggggggcagtggccaccgcagattcttatctgctccagcttcagaagtacgacatccctgccaccgcggctactgctacaagccccactccaaatccagtacccagtgtgcctgcaaaccccccaaagtcacccgcacctgccgcagccgcacctgctgtgcaacccttaactcaggttggaattacactacttccccaggccgcacccgctccaccaactacaactactatccaagttcttcccacagtgcctggctcttccattagcgttccaacagcagctcgtacccaaggcgtcccagctgtgctgaaggtgaccggtccgcaagctaccactggaacccctcttgtcactatgaggcccgctagtcaggctggtaaagctccagttaccgttacatcattgcccgctggagtgagaatggtggtccctacacagagcgctcagggtaccgtgatcggcagcagccctcagatgagcggcatggctgcgctcgcagcagccgcagctgctacccagaagataccgccaagctctgctcctactgtcctctccgttcccgctgggacaacaattgtaaaaaccatggcagtcacacctgggacgacaactctacccgcaactgtcaaggtggcttcctctccggtcatggttagtaatcccgctactcgtatgttaaaaaccgccgctgcacaggtgggtacctccgtgtcaagtgcaaccaacacctctactcgccctatcatcactgttcacaagtctggcactgtgacagtggctcagcaagctcaggtcgtgactaccgtggtgggcggtgtgacgaagacaatcaccctcgtcaagtctcccatctctgtgccaggcggatctgctcttatatctaatctcgggaaagttatgtcggtggtgcaaactaagcccgtgcagacctccgctgttaccggtcaggccagcacaggcccagtaactcagattattcagacaaaaggcccactgcccgctggtactatccttaagctggtaacatcagccgacggcaaaccaacgaccattatcaccactacacaagctagcggggctggtacaaaacccacgatcctgggcatcagtagcgtgagcccatcaacaactaagccgggaacaacgactataatcaaaaccatccctatgtcagccatcattacccaggctggtgcaacaggagtaactagcagccccggaatcaagtctcctatcacgattatcactacgaaagtgatgaccagcggtactggcgctcctgccaaaattatcactgctgtgcctaagatcgccacgggacacggacagcaaggcgtgacacaggtggttctcaaaggggcacctggtcagccgggtacaatcctgcgtaccgtccccatgggtggtgtaaggctggtgacccccgtgactgtcagcgccgttaagccggctgtgaccactttggtggtcaagggaactactggcgtgacaactctagggaccgtgactggtacagtctccactagcctcgcaggcgcagggggacacagtacctccgccagtttggccaccccgattacaacccttggaaccattgccacactcagtagccaggtgatcaatcctacagctattacagtctcagcagcccagaccacattgactgccgcaggtggccttaccaccccgactatcacaatgcagccagtctcccaacctactcaggtaactctgattactgccccaagtggggtggaagcacaacctgtgcacgatctcccagttagcatacttgcctcccccactaccgagcagcccacagcgacagtgacaattgccgattccggccagggcgatgttcagcccggaaccgtcaccctggtttgttctaaccctccttgtgaaactcatgagacaggcaccaccaatactgcaacaactacagtggttgccaacttaggcggacaccctcagcctactcaagtgcagttcgtttgtgatagacaggaggccgcagctagcctggtcactagtacagtcggccagcagaacggctctgtggtgcgtgtgtgctccaatcctccttgtgagacacatgaaaccgggacaactaataccgctactactgcaacatcgaacatggcgggacagcatggatgcagtaatcctccttgcgaaacccacgaaacaggcacaacaaatactgctacaaccgctatgtcaagtgtaggagccaatcaccagagggacgctcggagggcatgtgctgcaggaacccccgcagtgattaggatttcagtggctactggagcccttgaggccgcacagggtagcaagtcccagtgtcagactcgacagacaagtgccacctcaactacaatgactgtgatggccaccggggctccctgcagtgcaggcccattgttgggaccctccatggcgagggaacccggagggcgatctcctgccttcgtccagctggccccattatctagcaaagttcgcctgtcctctcctagtattaaggacctccctgccggtaggcatagtcacgccgttagcacagcggctatgactagatcatcagttggtgctggcgagcctcgcatggcccctgtgtgtgaatcccttcaaggcggttccccatccacaactgtcactgtgaccgcattggaggcattactgtgcccaagtgcaaccgtcacccaggtatgcagcaatccaccttgtgaaacacatgagaccggaacgactaatacagctaccacaagcaacgcaggttctgcccagcgtgtgtgctctaatcccccatgtgagacccatgagacaggaacgacacatacagcgacaactgccacctctaatggaggaacaggccagccggagggcggacaacagccaccggctggccgtccatgtgagacccaccagactacatcaacaggtaccacaatgtccgtgtcggtgggcgctcttcttcccgacgcaactagtagtcacagaaccgtggaatcaggcctggaggtcgccgcagccccttccgtcactccgcaggcagggaccgctcttttagcacccttcccaacccaacgagtctgcagtaatcccccatgcgaaactcatgagaccgggaccacccacacagctactacggttacctctaacatgagctccaaccaggatccacccccagccgcaagtgaccagggtgaggtagagtccactcaaggggatagcgttaatattacatcctcgtccgcaatcacaaccacagtgtcctcaacgcttactagagctgtgaccacagtgacgcagtccacacctgttcctggcccatccgtgccccctcctgaggagctacaggtctctccgggtccgaggcagcagctgcctcctaggcaactcctacaatcagccagcaccgcgctcatgggggaatccgccgaagttctgagcgcatcccaaacacccgagcttccggctgccgtggatctgagtagcaccggggaaccatcctctgggcaggagagcgccggtagcgcagtcgtcgctacagtggtagttcagcctcctccacctacccaatctgaggtagaccaactgagcctgccacaggagctgatggctgaggcacaggccggtacgaccaccctcatggtgaccggcctgactcccgaggaactcgctgtaaccgctgcagctgaagccgctgcccaggctgccgctaccgaagaagcacaggcgctggccatacaagccgtcctccaggcggcacagcaggctgtgatgggtaccggggaacccatggacactagcgaggctgccgcaactgttactcaagccgagctcggtcatttatctgccgaggggcaggagggacaggctacaaccatccctatagtcctaacccagcaggagctggcagctcttgtacagcagcaacagttgcaggaggctcaagcccagcagcagcaccaccacctgccaacagaggcactggcgccagccgacagtctcaacgatcccgctatcgagtcgaactgcctcaacgagttggccggaaccgtgccttctaccgtcgctcttctgccctccactgctaccgagagtctcgccccaagcaataccttcgtggcaccacagcccgtcgtggtggctagtccggctaagctgcaagctgccgcaaccttgacagaagtggccaatggaatagagtccctgggcgtaaagcccgacctgcctcctcctccctcgaaagcaccgatgaaaaaggagaatcagtggttcgacgtgggagtgatcaaaggaacaaatgtgatggtgacacactattttctgcctcccgacgatgccgtgccgtccgatgacgatctgggcaccgtgcccgactataatcagttgaagaagcaggaattgcaaccgggtaccgcctacaagttccgagtagccggaattaatgcttgtgggagaggccctttcagtgagataagcgcatttaaaacatgtctgccaggattccccggagcgccttgcgccattaaaatcagcaaaagccccgacggggctcatctgacctgggagccgccatctgtgactagcggtaaaatcatcgaatacagtgtttatctggcaattcagagttctcaggccggaggcgagctcaagagcagcacgcccgcacagctggcctttatgcgcgtgtattgtggtccctcccccagctgcctcgtgcaaagcagcagcctgtctaacgctcatattgattacacaactaaacccgcaatcatctttcggatcgccgctaggaacgaaaaaggatacggtccggctacacaggtgagatggcttcaggagaccagcaaggattcctcaggaaccaaaccagctaataagagaccaatgtcatcccccgagatgaaaagcgctcccaagaagtccaaggctgatggccagta

SEQ ID NO: 226398 - DNA, 5900 bp, Artificial Sequence
  Description of Artificial Sequence: Synthetic coding sequence
atggcttccgccgttagccctgcgaatctgcccgctgtgctcctgcagcccagatggaagcgggtggtgggatggagtggccctgtcccccgacctcggcacggccatagggctgtggcaattaaagagttgattgtagtgttcggtggcggaaatgaggggatcgttgacgaacttcacgtttacaatacagccaccaaccaatggttcatcccagccgtaaggggcgacatccctccagggtgcgccgcttacggcttcgtgtgcgatgggacgcggctccttgtctttggcggaatggtcgaatacggaaaatactccaatgatttatatgagttacaggcgtctaggtgggaatggaagaggctgaaagcaaaaacccctaaaaatggcccacctccatgtcctaggctggggcactcgttctcactcgtgggcaataagtgctacctttttggcggactggcaaacgattcagaggatcccaagaacaacattcccagataccttaacgacctgtacatcttggagctcagaccgggtagtggcgtggtcgcatgggatatcccaattacttatggagttcttcccccacccagggagtcccataccgctgttgtatacaccgagaaggataacaagaagtccaagctggtgatttatggaggaatgtccggttgccggctaggcgacctgtggaccctggatatcgacaccctcacatggaataaaccgagcctgtccggggtcgcacccctgcccagaagtctgcattcagcgactactattgggaataagatgtatgtgttcggtggctgggtccctctggtgatggatgatgtgaaggtcgctacccatgagaaagaatggaaatgcacaaatacactcgcatgtctgaaccttgacacaatggcctgggagactatattaatggacacgctcgaagacaatattccgcgtgcacgcgcagggcattgcgcagtggcaattaacacacgtctatacatttggagcgggagagatgggtacaggaaggcgtggaacaaccaggtttgctgtaaggatctatggtatctcgagacagagaaaccgcctcctcccgctcgcgtccagctcgtgagagcgaacaccaacagtctggaagccgcacccgcaccaccaaccacaaccacaatccaggtcttgcccacagtcccgggaagcagcatctctgtcccgacagcagcccgtactcagggggtccctgccgtgctcaaagttaccgggccacaggccactaccgggacgccactggtgaccatgagaccagcatcgcaggctgggaaggctccagtgactgtgacctcactacctgccggagtgcgaatggtggttcctacccagtcagctcagggcaccgtcatcggctcttcacctcaaatgagtggcatggctgctctggctgccgctgcggctgctacccaaaaaattcctccgtctagtgcacccaccgtcctgtccgtgcctgcaggtacaaccatcgtcaaaaccatggccgtgaccccgggaacaaccacactgcctgccactgtaaaggttgccagttcgcccgttatggtttctaacccggctactcgaatgctgaaaactgccgctgcacaggtgggaacgtctgtgtccagtgctactaacaccagtacaagacctatcatcacagtgcacaagtcaggaacggttaccgtagctcagcaggcacaggtggtgactacagtggttggaggagtaaccaagacaattactctggtgaagtctcctatttccgtgcctggcggaagcgctctcatctctaatcttggaaaagtaatgtctgtcgtccagacaaagcctgtgcagacctctgccgtgaccggacaggcttctacaggacctgttacccagattatccagacaaaaggtccgttaccggcaggaacaatactcaaactggtgaccagtgctgacggaaagcccacaacgataatcactacaacccaggcaagcggtgccggaaccaagccaaccattctgggaatctcctctgtgtcaccttcgaccactaaacccggtactacgaccatcatcaaaacaataccgatgtcggcaattatcacacaggctggcgcaacaggagtgactagcagcccaggaattaagtcaccaatcactatcattaccaccaaggttatgacttcaggaaccggagcccctgctaagattataaccgcggttcccaagatcgctaccggacacggccagcagggagtaacacaagtcgtcctcaagggagcacccggtcaaccaggaacaattttaagaaccgtccccatggggggagtgaggctcgtcacaccagttacggtgagtgctgtcaagcccgctgtgacaacattggttgtcaagggtactacgggagtaacaacgttaggcacagtcacagggacagtcagcacctctctggccggagccggaggccactcaacttctgccagcctggccacaccaattaccaccctgggaacaatcgccactctgtcctcccaggtgatcaatccaacagctatcaccgtgtccgctgcccagacaacgctgaccgctgctgggggtctgaccaccccaaccatcacaatgcaacccgtgagccagcctacccaagtcacgctcatcaccgcaccctctggcgttgaggctcagccggtccacgatcttcctgtttccatcctagcttccccaacgactgagcagcccactgcgaccgtgactatcgcagactccgggcagggtgacgtgcagcctggcacagtaacccttgtgtgttcaaatcccccatgcgagactcacgagactgggactacaaatacagccacgactacagtcgtggctaatctgggaggccaccctcagccaacgcaagtgcaattcgtgtgtgataggcaggaagctgccgcatccttggtcacttcaacagttggccagcagaacgggagcgtggtccgtgtgtgctcaaatcccccatgtgagacccacgagaccggaactaccaataccgcaaccacggcaacctcaaatatggccggtcagcacggctgttccaatcccccttgtgagactcatgaaactggcacaaccaataccgccaccactgctatgtcatccgtgggcgctaaccatcagagggatgctcgccgagcctgcgcagcgggaacgcccgcagttattagaataagcgtagcaactggggcactcgaagccgcacaggggtcaaagtctcagtgccagaccaggcagacttcggcgacttctactactatgactgtcatggcaactggcgcaccttgctctgcaggaccgctgttgggaccatccatggcccgagagccagggggtaggagccccgcttttgtccagctggcaccactttcctctaaggtccggttgtcctcaccaagcatcaaggacctgcccgctggacggcattcccatgctgtgtcaactgccgctatgacccgcagctctgtgggcgctggagaaccacggatggctccggtctgcgaaagcctgcaaggcggatctcccagcacaaccgtgacagtgacagctcttgaagctctactttgcccttctgcaacagtgacccaggtgtgtagcaatccgccttgtgaaacccacgaaaccggaacaacaaatacagcaaccaccagtaatgcgggatctgctcaacgtgtctgtagcaaccccccttgtgaaacccatgagacaggaactactcacactgctaccacagcgacctcaaacggaggcacaggacaaccggaagggggacagcagcctcctgccggacggccttgtgaaacgcatcagacaacctcaaccggtaccacaatgagcgtcagtgttggggcactactcccagatgcgacctcttcccatagaacagtcgagtctggcctcgaggttgccgcagccccttccgtgactccccaggccggaacagctcttctggcaccttttccgacccagagggtgtgtagcaatcctccgtgcgagacgcatgaaactggcaccacgcacacagccaccacagtgacctccaacatgtcttcaaaccaagatcccccaccggcagcaagcgaccagggcgaagtcgagtctactcagggtgacagtgtgaatatcacttcaagctctgcaatcaccactaccgttagctctaccctcaccagggcggttaccaccgtaacacagtccaccccagtcccaggcccatccgtgccacccccagaggaactccaggtgagccccggacccagacaacaactgccacctcgccaactgctccagtccgccagcactgccttgatgggcgagtcagccgaggtcttgtccgcctcacagacccctgaactcccagccgcagtagacctctctagcacaggcgaaccttcctccgggcaggagtccgctgggagcgcagtcgtcgcaactgtcgttgtgcagccccctccaccgacacagtcagaagtggatcagctgtccctgccccaggagttaatggccgaggctcaggctggaacaaccacattaatggtgactggtctgactcccgaagagcttgcagttacagctgcggctgaggccgcagcgcaggccgcagcaaccgaggaggcccaggccctggcaatccaggccgtgttgcaggctgctcagcaagctgtcatggggactggagaaccaatggatacctccgaggcagccgctactgtgacccaggcagagctcggacatttgtccgcggaggggcaagaagggcaggccacaacaataccgatcgtcctcacacagcaggaactcgcagccctcgtgcaacagcaacaacttcaggaagctcaggcgcagcagcagcaccatcacctgcctaccgaggctctggcccctgctgacagtcttaatgatccagccatagaatcaaactgcctaaacgagctggccggtacagtgcccagcactgtggccctgcttcctagcaccgcaactgaatcgctggcacccagtaacactttcgtcgccccacaacccgtggtcgttgccagcccagccaagctgcaggccgctgccaccctgacagaagttgcgaacggcattgaatcacttggtgttaagcccgacctccctcctccgcctagtaaggctccaatgaaaaaggaaaatcagtggtttgacgtgggtgtaattaaaggaacaaatgtgatggtgacccattactttctcccacccgacgatgctgttcctagcgatgatgacctggggacagtgcccgactataaccagctcaagaaacaggagctgcagcccggtactgcttataagtttcgggtagccggtattaatgcttgcgggagggggcctttttccgaaatcagcgcctttaaaacatgtctgcctggtttccctggcgctccatgcgccatcaaaatatccaagtcgccagacggcgcacacttaacatgggaacccccatctgtaacatccggcaaaatcattgaatattcagtgtaccttgccatccagtccagccaggcaggaggtgagctgaaaagttcaactccagctcagctggccttcatgcgagtgtactgtgggcctagtccgtcctgccttgtgcagtcgtcatcactgtctaacgcacacattgactacaccactaaacctgctataatctttcgtattgccgctcggaatgagaagggatacggcccagccactcaggtccgctggctgcaggaaacttcaaaagattcctctggtaccaagccagcgaacaagagacccatgtcttcgccggaaatgaagtcggccccaaagaaatcaaaggccgacggccagta

SEQ ID NO: 226399 - DNA, 6242 bp, Artificial Sequence
  Description of Artificial Sequence: Synthetic coding sequence
atggcctccgccgtctctccagctaatctcccagctgtgctcttgcagccccgttggaaacgagtcgtcggatggtccgggcctgtgccgcgtccgaggcacggacatcgagcggtagccatcaaagagttgatcgtagtctttggcggaggtaatgagggcattgttgatgagctccacgtttataacactgccacaaaccagtggtttattcccgctgtgagaggggatatccctcctgggtgtgcggcatacgggttcgtgtgcgatggaaccaggcttctggtttttggagggatggtcgagtacggcaaatattccaacgacctgtacgaactgcaggcatccagatgggagtggaagcggttgaaggctaagactccaaaaaatggaccgccaccctgcccacgcctgggtcactcattcagcttggtcggcaataagtgctatctgttcggcggtttggccaacgacagcgaggaccccaaaaacaatattccacgctatctcaacgatttatatatcctggaattgagaccaggatcaggggtcgttgcttgggacataccaataacatacggagtcctaccacccccacgggaatcacatacagcggttgtgtataccgaaaaagacaacaaaaagagtaaattagtgatatacgggggaatgtccggatgtcggttaggagatctgtggaccctcgatatcgacacattaacatggaacaaaccaagcctatcgggggttgcccctctccctcgctccctgcacagcgccaccaccatcggcaacaaaatgtacgttttcggaggatgggtacctttggtgatggatgatgtgaaggtggctacccacgagaaagagtggaagtgtacaaacacccttgcctgtctgaatctggacacaatggcctgggaaaccattttgatggacacactggaggacaacatcccaagagcacgcgctggtcattgcgctgtggccataaatactcgactgtatatatggtctggcagggatggctatcgaaaagcctggaacaaccaggtctgttgtaaggatctgtggtatctggaaaccgagaaaccaccgcctcccgcacgcgtacagttagtgagggcgaatacgaacagtttagaggtgagctggggtgccgtggctaccgccgattcttatctgctgcagctccaaaagtacgacatccctgcgacagctgcgacagctaccagccctacccctaatcccgtgcctagcgtgccagccaacccaccaaaaagcccagctcctgctgccgcagcccctgctgtgcagccacttactcaggtgggcatcaccttgctgcctcaggctgcacctgccccaccaacaaccactacaattcaggtcctccccacagtgcccggttcttctatctccgtgcccactgctgctagaacccagggcgtgcctgccgtactaaaggttacaggccctcaggcgactacagggacacccctcgttacgatgagacctgcatcccaggcgggaaaggctccagtcacagtgacgtccctccctgcaggagtgaggatggtcgtgcctacacaaagcgctcagggtaccgtgatcggatcctctcctcagatgagcggcatggccgctcttgccgctgcagcagccgcaacacagaaaataccgcctagtagcgcgcctacggtgctgagcgttccagccggaacaaccattgtgaaaactatggccgtgacgcccggaaccaccactttgcccgctaccgtgaaggtcgctagttcacccgtgatggtcagcaaccccgcaacccgcatgctaaaaacagcagcagcgcaggtgggaacttcagtatcctccgcaaccaataccagtactcggcctattattactgtgcacaaatccgggacggtgactgtggcacagcaagcacaagtagtgaccaccgtggtgggcggtgtgactaagactattactctggtaaagtcacctattagcgtgccaggcggatctgccctgattagcaacctcggcaaggtgatgtcagtagtgcagacgaaaccagttcaaacaagtgccgtgaccggacaagcgagcaccggcccagtcactcaaatcattcaaactaaaggcccactccctgcaggtactattttgaagctcgtgactagtgccgacggtaaaccgaccaccatcattaccaccacacaggcttccggtgcaggtacgaagcctaccattctgggcatttctagtgtgtcaccatctacaacgaagcccggaaccaccacgatcatcaagaccatccccatgtcagcaattatcacacaggccggagcaacaggggtaacctcttctccagggatcaaatcgccaataaccatcatcacaactaaggtgatgactagtggaactggcgcacctgctaaaatcatcacagcagtgcccaagatcgcaaccggccatggtcagcaaggagtgacacaggtcgtgctgaagggtgcacccggacagcccggtactatcctccggaccgtacctatgggtggtgtgcgtctggtgacaccggtaactgtttccgcggtaaagcccgcagtgacaacactggtggtcaaggggaccacgggggtcaccactctgggcacagttaccggcaccgtttcaacctctcttgccggtgccggtggccactcaacttcggccagtctggcaaccccaattaccacgctgggtaccattgctacgttaagcagtcaggtcatcaaccctaccgccattaccgtgtctgcagcccagacaacgctgacggccgctggtgggttgaccacacctactataactatgcagcccgttagtcaacccacgcaggtgacgctgattacggctccttcgggcgtagaggcccaaccagtgcatgacctgcccgtttcaatcctggccagtccgaccaccgaacagcccacagccactgtgaccatcgcggattctggacagggcgatgtgcagccagggacggtgacgctcgtttgctcaaacccgccatgtgagacccacgagacaggaaccactaataccgctacaaccacggtagtggccaatttaggcggacacccacagcctactcaggtgcagttcgtgtgcgatcgtcaagaagcagcggcttccctcgttacctccactgtggggcaacagaacggatccgtcgttcgggtctgcagcaacccaccttgcgagactcatgagaccgggactactaataccgccaccacggctactagtaatatggccggtcagcatggctgtagcaacccgccttgcgaaacgcacgagaccggaactaccaacacagcgacaaccgctatgtcatccgtcggtgctaatcatcagcgggatgcgaggcgggcttgtgccgcagggaccccagctgtgattagaatttctgtcgcaaccggggctcttgaagccgctcagggaagcaagtcccagtgccagacacgccaaacctccgccacatcgacaaccatgaccgttatggccaccggtgccccatgcagcgcgggacctctgttgggaccatctatggcaagagagcctggcggtaggtcccctgctttcgttcaattggcacctctgtcttctaaagtgcggctgagctcaccttcaataaaggatctcccagctgggagacattctcacgctgtcagtaccgcagctatgactcgaagctcagtaggcgctggtgagcctcgcatggcacctgtgtgcgaatcactgcagggcggaagcccctctaccaccgtgacagtgacggcgctagaggcactgttgtgcccatctgcaaccgtgactcaggtttgcagcaatccaccctgtgagactcatgaaacagggaccaccaacactgcgacaacgagcaacgctgggtccgctcagagagtgtgctcaaaccccccatgtgagacacacgagacgggtacaacccacacagcaacaacagcaaccagcaatggcggtacagggcagcctgagggcggacagcagcctccagccggacgaccctgcgaaacccaccagaccacatctactggcacaaccatgagtgtgtctgtgggtgcacttctgccagacgcaactagttctcaccgcacagtggagtctggcctagaagttgccgctgctccaagcgtcacacctcaggccggaaccgcgttgttggcaccgtttcccactcagagagtgtgtagtaatcctccatgcgagacccacgagaccggcaccacccataccgctacaactgtgacatccaacatgtcttcaaaccaagacccccctccagctgcctccgatcaaggggaagtggaatctacccaaggggattcagttaacatcacttccagctcagcaatcacaaccaccgtgagcagtactttaacccgcgctgttactaccgttactcagtcaacacctgtacccggtccatcagtccctaagatctcatctatgacagagacagctccacgggcactgacaaccgaggtacccatccccgctaaaattaccgttaccatcgccaatacagagactagtgatatgcctttcagcgccgtagatatattacagcccccagaagagctgcaggtaagcccgggtcctcgccagcaactaccacctcgacagctgcttcaaagcgcatccaccgctcttatgggtgagtccgcagaggtgttatccgccagccagacgcccgaactccctgcagccgtggatctgagctctacgggtgaaccatctagcgggcaggagtccgctgggtctgccgttgtagcgaccgttgtcgtgcagcctccgcctcccacccagagcgaggtggatcagctttcgctgccacaggagcttatggcagaggcccaggctggaacaaccacacttatggtgactggattgaccccagaagaacttgctgtgaccgccgcagctgaagctgcagcccaggcagctgccacagaggaggcccaggccctggccatccaggctgtgctgcaggccgcacagcaggcggtgatggctggcacaggcgagccgatggatacgtccgaggctgccgcaacggtgacccaggccgagcttggacacctgagtgccgaggggcaagaaggccaggccactactataccaatagtgctcacgcagcaggagttagctgctctggttcagcaacagcagttgcaagaggcacaagctcagcagcaacaccatcacctccccactgaagccctcgcccctgcagactctctcaacgatccagcaattgaatccaattgccttaatgagctggcaggaaccgtgccatccacagttgctctcctgccaagcacagccacagagagcctggccccaagtaacacattcgttgccccacaacctgttgttgttgcctccccagccaagctccaagccgcagctacactgactgaagttgccaatggaatcgagtcgctgggcgtgaaacccgacctgccacccccaccatcaaaggctccaatgaagaaagagaaccagtggttcgacgtgggagtcatcaagggcaccaatgtgatggttacccattacttcctccctccggatgatgctgttccaagcgatgacgaccttgggactgtccccgactacaaccaattgaagaagcaggagctccagcccggaactgcttacaagttccgggtggcaggcattaatgcctgcgggagaggaccattttcagaaatttctgccttcaagacctgcctaccagggtttccaggagctccctgtgccattaagatctctaagtctcccgatggagcccatttgacatgggagccaccatcagtgacatctggaaaaataatcgaatactcggtttacctcgccattcaatcctctcaggccggaggtgaattaaaatccagtacacctgcacaactagcctttatgcgtgtgtactgcggtcctagcccatcttgcctagtacagtcaagctctctgagcaacgctcatatagattacacgactaagccggctatcatttttagaatcgccgcacggaacgagaaaggatatgggccagccactcaggtgaggtggcttcaggaaacgagtaaggattcatctggtacaaagcctgccaacaaacgaccaatgagcagccctgaaatgaaaagtgcgcctaagaagagtaaggcagatggccaata

SEQ ID NO: 226400 - DNA, 1305 bp, Artificial Sequence
  Description of Artificial Sequence: Synthetic coding sequence
atggattctgtcgaaaagggggctgcgacctcagtgtcaaaccccagagggagacccagccgagggagaccgcctaagctccaaaggaactcaagagggggacaaggacggggtgtggagaaacctccacatttggctgcattgattttggctcgtggcggttccaaggggatacctctaaagaacataaagcacctggccggagtcccactgattggttgggtgctgagggctgcgctggactctggtgcttttcaatccgtgtgggttagcacagatcacgatgagattgaaaacgttgcaaagcagttcggcgcacaggtccacaggagaagttccgaagtgagtaaggattcatctacgagcttggatgccatcattgagttcctgaattatcacaatgaagtcgacattgttggcaatatacaagccacatccccttgtctgcatcctaccgaccttcagaaagtggccgagatgatacgcgaagaagggtacgacagtgttttcagtgttgttcggagacatcagttccgctggagcgaaatacagaaaggcgtgagagaggtgacagagcctctgaatttgaatcctgcaaagagaccccgacgacaggattgggacggtgaactgtacgagaacggctcgttttactttgcaaagcgccatcttattgaaatgggctacttacagggcggaaagatggcctattacgaaatgagggccgagcacagcgtggatatcgatgttgatatcgactggccgatagctgagcaaagagtgctgcgatacgggtatttcggaaaggaaaagctgaaagaaattaagcttctagtttgcaacatcgacggttgtctgaccaacgggcatatatacgtctctggcgaccagaaggagatcatcagctatgatgtcaaagacgcgatcggcatctcattgttaaaaaagtccggtatagaggtccggctcatttccgagcgggcttgttccaaacagactttgtcatctctcaagcttgattgtaaaatggaggtttcagtgtcagacaagcttgctgtagttgatgaatggagaaaagagatgggactgtgttggaaggaagtcgcttatctgggtaatgaagtctctgacgaggagtgtctgaagagggtaggactctccggtgccccagccgacgcctgctcgactgcccaaaaggctgtgggctatatttgcaaatgtaacggaggcaggggcgcaatccgcgaatttgctgagcatatctgtctcctgatggaaaaggtgaacaactcctgccagaagtag

SEQ ID NO: 226401 - DNA, 507 bp, Artificial Sequence
  Description of Artificial Sequence: Synthetic coding sequence
atggcattcaatgattgctttagcttgaattatccagggaacccctgcccaggtgaccttattgaagtgttcaggcccggttatcaacattgggctctgtacctgggagatgggtatgtcattaacattgcccctgttgatggcatccccgcatcattcacctctgccaaatcagtgttctcaagcaaggccctcgtcaagatgcaactgctcaaagatgtggtgggaaatgatacataccgtataaacaataaatacgatgagacctacccaccactcccagtagaggagatcatcaagagatcggagtttgtgattggccaagaagtggcctacaacctcttggtcaataactgcgaacactttgttactctgctcaggtatggtgaaggcgtatctgaacaggcaaaccgggctatcagtactgtggagtttgtgactgccgcagtgggggtcttctcctttctgggactctttcccaagggtcagcgtgctaagtattactag

SEQ ID NO: 226402 - DNA, 489 bp, Artificial Sequence
  Description of Artificial Sequence: Synthetic coding sequence
atggccctagctaggccccgacccaggctaggtgatttaattgaaatcagtcgtttcggatatgcccactgggcaatttatgtgggagacggatacgtggttcacctggcaccagcgagcgagatagccggtgccggtgctgcctctgtcttaagtgccctgaccaataaagccatcgttaagaaggagttactgagtgtggtggcagggggagataactacagagtgaataacaagcacgacgatcggtatacaccgttaccaagcaacaaaattgttaagcgagctgaagagctagtggggcaagagttaccatattcattgacatccgataattgtgagcacttcgtgaatcacttgcgctacggagtgagtcgctccgaccaggtgacaggtgctgtaactactgtgggcgtcgccgcagggctgttagctgccgcaagtctggtgggcatcctgctggccagatcgaaacgggagaggcagtag

SEQ ID NO: 226403 - DNA, 1023 bp, Artificial Sequence
  Description of Artificial Sequence: Synthetic coding sequence
atgaaggaagaccaggtcgttgcggaggagccgggatttcaagacgaggaggagtcgctctttcaagacatagatctcttgcagaaacatgggattaatgtggctgatatcaaaaagctcaagagcgtgggaatctgcaccatcaagggcatccaaatgacaacacgtagagccctttgtaacgtaaagggcctctctgaggctaaagtggacaaaatcaaagaagctgcaaacaaactgatagagccagggtttttgaccgcctttgagtatagcgagaaacgcaagatggtgtttcacattacaacaggaagccaggagtttgacaaattactgggcggtggcatagaaagtatggcaatcactgaggcattcggcgagtttcgcaccggcaagacccagctgagccataccctgtgtgtgaccgcacagctgcctggggctggaggctatcccggtgggaagattatattcatcgacacagagaacacttttaggcccgaccgcctccgagacatagctgatcgcttcaacgtggatcacgacgccgttttggacaatgttctttatgcccgtgcctatacatccgagcaccaaatggagctcttagactacgttgcagctaaatttcatgaagaggctggtatcttcaaactcctgatcatcgacagcatcatggctctctttcgggtcgactttagcggaaggggcgaattagcggaaagacaacaaaagttggctcagatgctctcccgccttcagaagatctcagaggagtacaacgttgctgtgttcgtcaccaaccagatgaccgcagatcccggagctaccatgaccttccaggcagatcccaaaaagcctattgggggacacatactggcccacgcttcaactacccggatttcactcagaaaaggtcgcggtgagctgaggattgccaaaatttatgactcacccgaaatgcctgaaaacgaagcaacctttgccatcaccgccggtgggatcggagacgccaaagaatag

SEQ ID NO: 226404 - DNA, 1080 bp, Artificial Sequence
  Description of Artificial Sequence: Synthetic coding sequence
atgtctgatgagggctctcgtggatcacgcctgcctctggctctccccccagccagtcagggctgctcatcggggggagggggtggtggcagctcagccggaggcagcggaaactctcgccctcctcggaatctgcagggcctgctgcagatggcaatcacggccggaagcgaggagcctgatcctcccccagagcccatgagcgaggaacggagacaatggctccaggaggccatgagcgccgcatttagggggcagcgtgaggaagttgagcagatgaagagctgtttgagggtgctgtcacaaccaatgccacctacagcaggggaggccgagcaggcagctgaccagcaggaacgggaaggggcacttgagctcctcgctgacctgtgcgagaatatggacaacgctgccgacttttgccaactgagcggaatgcacctcctggtcggtcgttacctggaggccggagcggctggactccggtggcgtgccgctcaactcattggcacttgtagccaaaacgtcgctgccatacaagagcaagtgctgggcctcggagctctgcgtaagctcctgcgtctgctggatcgcgatgcctgtgatacagttagagtgaaggccttgttcgctatctcttgcctagtaagggaacaagaggcaggactgcttcagttccttcggctcgatggattcagtgtattgatgcgagccatgcagcagcaggtccagaagctcaaggtcaaaagcgccttccttctgcaaaacctattggttgggcacccagagcacaagggaacactgtgctccatgggcatggtgcagcagctcgtggcattggtccggacggaacacagtccttttcatgagcatgttttgggggctctctgctctctcgttaccgactttccacaaggggtgcgggaatgcagggagcccgaattgggtctcgaggagctgttacgccacagatgtcagctgttgcagcagcatgaagaataccaggaagagctggagttctgtgagaagctgctccagacatgtttctcgtcgccagcagatgatagtatggatcgatag

SEQ ID NO: 226405 - DNA, 774 bp, Artificial Sequence
  Description of Artificial Sequence: Synthetic coding sequence
atgtccgatgaaggatcccggggaagtcggttacccttagccctaccccctgccagtcaaggatgtagcagtggagggggagggggaggctcttccgccggtgggtcaggcaatagcagaccacctaggaacctccaagggctcttacaaatggccattacagctggctctgaagaacccgaccctcccccagaaccgatgagcgaggaacgccgacaatggctccaagaagcaatgtcggctgcttttagaggccagcgcgaggaagtggagcagatgaaaagctgtctgagggttctgagtcagccaatgccacccaccgcgggagaggccgagcaggccgcagaccagcaggagagggaaggcgctcttgagctcctggcagacctgtgtgaaaatatggacaacgcggctgacttctgtcaattgtccggtatgcaccttctggtgggcagatatctcgaggccggagccgcaggtctccggtggagggccgctcagcttattggtacttgctcccagaatgtggccgctattcaagagcaggtgctcgggctcggcgcactgcggaaattgctacggctccttgatcgggatgcctgcgacacaggcgtgcgcgagtgccgagagccagaactgggcctggaagaattgctgcgacatcggtgtcaactgcttcaacaacatgaggagtaccaagaggagttggagttctgtgaaaagctcctgcagacctgtttttcctcaccggcagatgactctatggatcgttag

SEQ ID NO: 226406 - DNA, 1080 bp, Artificial Sequence
  Description of Artificial Sequence: Synthetic coding sequence
atgtccgacgaaggaagccgaggctctaggttgcctctcgcattgcccccagcctctcaaggatgcagctccgggggaggaggaggcggaagcagcgctggcggttcaggcaattcccggcctcctagaaatctccagggcctgctccagatggcgattacagcgggtagtgaagaacctgatccccctcctgaacccatgtctgaggagagacggcagtggttacaggaagccatgtctgccgctttccgtggccaaagggaggaggtagaacagatgaaatcttgtttaagagtgttgtcccagcctatgccacctaccgctggggaggccgaacaggctgcagaccagcaggaacgggagggagccctcgaattacttgctgacctctgtgagaacatggataatgcagcagacttttgccagctgtcaggaatgcaccttctagtggggagatacttggaagccggagctgccggattaagatggcgcgctgctcagctgatcggtacatgcagccagaacgttgccgcaattcaagaacaggtcctgggtctcggggcactgcgcaaacttctcagactgttggatcgggacgcatgtgatacggtcagagttaaagctctgttcgccatctcctgcctcgtccgtgagcaagaggctgggttgctccagttcctgaggcttgatggttttagcgttctcatgcgggctatgcagcagcaggttcagaagctgaaagtcaagtccgctttcctattgcagaatctcctggtcggtcacccagagcataagggtaccctgtgtagcatgggtatggtgcagcaacttgtagccttagttcggactgaacattcgccattccacgaacacgtcctcggagctctctgctcgctagtgacagattttccccaaggggtgagagagtgtcgggaaccggaacttggacttgaggagctgctgaggcataggtgccagcttctgcaacaacatgaagagtaccaggaggagttggagttctgtgaaaagctcctccagacctgcttctcctcaccggcagatgattccatggatcgatag

SEQ ID NO: 226407 - DNA, 1443 bp, Artificial Sequence
  Description of Artificial Sequence: Synthetic coding sequence
atgcagattcctagggcagcactcctaccccttctgttactgctgctggcggctccagcctctgcacaactgtctcgggctgggaggtccgcacctttggccgctggttgccctgaccgatgcgagcctgctcgctgcccccctcaaccagagcactgtgagggcggtcgagcacgggatgcatgcggctgctgtgaggtgtgcggggctccagaaggggcagcatgtgggctacaggagggcccatgtggggagggtctgcagtgtgtggttccattcggtgttcctgctagtgccacggtcaggcgtcgagctcaagcgggattatgtgtgtgcgcaagttccgagcccgtgtgtgggtctgatgctaatacctatgccaacctgtgccagctcagggccgcttcccggcgatctgaacgcctccacagaccacctgtgatagtgttgcagcgcggtgcctgtggtcagggccaggaggatccgaactccctaagacacaagtacaatttcattgccgatgtggttgagaaaatcgccccagccgtagtccacatagaactgttcagaaagttgccctttagtaagcgggaagtccctgtcgcaagtgggtcagggtttatcgtgtcagaagatggacttatcgtgaccaatgcccacgtggtgactaataagcatagagtgaaagtcgagttaaaaaatggtgccacctatgaagccaagattaaagatgttgacgagaaggctgatatagccctgattaagatagaccaccaaggaaaactcccagtgctgctgttgggaaggtcctcagaactgaggcctggcgaatttgtcgtagctatcggaagtcccttttcactgcagaacaccgtgaccaccggtatagtctcaacaacacagagaggcggaaaagagttaggtctcagaaacagtgatatggattacatccagaccgatgctataatcaattacggcaacagcggcggtcctctggtgaacctggacggcgaagtcataggaattaatacgctgaaggtgacagccggtatttcttttgcaattccctctgataagattaaaaaattcctcactgaatcccacgatagacaagccaaggggaaggctatcactaagaaaaaatatatcggtattcgcatgatgtctctcacaagctccaaagctaaagagctaaaagatcggcacagggacttccccgacgtcatttccggtgcatacattatagaggttatcccagatacaccagccgaagcgggtggactgaaggagaatgatgtcattatttccatcaacggacagtcggttgtgtcagccaatgacgtatcagatgtgatcaaacgtgagagtacattgaatatggtcgtccgcaggggtaatgaggatattatgataacggtcataccagaagaaatcgatccttag

SEQ ID NO: 226408 - DNA, 666 bp, Artificial Sequence
  Description of Artificial Sequence: Synthetic coding sequence
ggtaaactgcccgtgctccttctcggcagatcctcggagctgcgtcctggagagttcgttgtggccatcggatctccgttctccctgcaaaacacagtgactacgggcattgtttctactacacaacgcggaggcaaagaactcggactccgcaatagcgacatggattatattcagaccgatgctataataaactatggtaattccggtggaccacttgtgaatctggacggcgaagtgattggcatcaacacattaaaagttactgctggaattagctttgcgatcccctccgataaaattaaaaagttcctgaccgaaagtcacgataggcaggctaaagggaaagcaattactaagaaaaagtacattggaatccgcatgatgtcactgacctcatccaaagcgaaggagctgaaggacagacacagggattttccagatgtaatttccggagcttatatcatcgaggtaattccagacacacctgcggaagccggtgggctgaaagaaaatgatgtgataatatctattaacggccagagtgtggtatctgcgaatgatgttagcgatgtgataaaacgtgaatccactctaaatatggtggtccggcgtgggaatgaggacataatgatcaccgtgatcccagaggaaatcgatccatag

SEQ ID NO: 226409 - DNA, 1344 bp, Artificial Sequence
  Description of Artificial Sequence: Synthetic coding sequence
atggggtgggcagcccgaccacgggcactggccccagccgcacccgaggctctgcttcactcaccacgaaggaggagccccgctctcgcactctctgcagcaactgcagctgccgcacggggacccggacgggttcggctgctccggggagtgagaagagccagagggcgacgcgtcagacccgctggaggtcctgtcagacgcggagccgcagtgaggggcgctctcaggggcgcttccctcgggcacggagcggcagccagagccggaagacccctgtgtgtgcgccagcagctccgcgctgcaagcagacggtctgagaggctgcataggccaccggtgattgtcctgcagcgaggtgcctgtggtcaggggcaggaggaccctaatagcttgagacacaaatataatttcatagcagatgtcgtggagaagattgcacctgctgtggtgcatattgagctcttccgcaagctcccatttagtaaacgggaagttcctgtggcgtcgggatcagggttcatcgtttctgaggacgggctcattgttacaaatgcacatgtcgtgaccaataagcaccgggtgaaggtcgagctgaagaacggggctacgtatgaagcaaaaataaaggatgtggacgagaaggccgatatcgcgttaataaaaatagatcatcaagggaagctccctgtcctgttactggggaggtcgtccgagctgcggcctggagaatttgtggtagcaattggcagcccttttagcttgcagaatacggtcacaactggaatcgttagcacgacccagaggggtgggaaggagctgggactgcggaactccgacatggactacatccaaactgatgctatcatcaattatggaaattcaggcggtcccttggtgaatctggatggggaggtaatcggcataaacacactgaaagtgaccgcaggcatttcctttgcaatcccctccgataagatcaagaaatttctgaccgagtcccacgataggcaggctaaaggcaaggccataactaagaagaaatacatcggcatccggatgatgagcctgactagtagcaaagccaaggaactcaaggataggcaccgggactttcctgacgttattagcggcgcatatatcattgaagttatccctgacaccccagcggaggcgggaggccttaaagaaaatgatgttatcatatccatcaacgggcagtcagttgtgtccgctaacgatgtcagcgacgtgataaaaagagagtctacactaaatatggtggtccgcagagggaatgaagatatcatgatcacagtgataccagaggagatcgacccgtag

SEQ ID NO: 226410 - DNA, 1377 bp, Artificial Sequence
  Description of Artificial Sequence: Synthetic coding sequence
atggccgcaccaagagctggcagaggggcaggctggtctctgcgcgcatggcgtgcgttaggcggaatccgatggggcagacgcccaagactcacacctgatctgcgcgcacttctgactagcgggacttcggaccctagagctcgagtgacctacggaactccctccttgtgggccagactctctgtaggcgtgacagagcctcgtgcctgtctcacgtcaggcactcccggacctagagcccagctaaccgcggtcactccggatacaagaactagagaagcatcggagaattctgggacaaggtccagagcctggctcgcagtggcactcggcgcaggaggggcagtgctcttactgctctggggaggtggacggggacccccagccgtcctcgcagctgtcccctccccgccacccgcaagtcccaggagtcaatataacttcatcgccgatgtggtagaaaagactgctcccgctgtggtctacatcgaaatcttagaccggcatcctttcctgggtcgagaagtgcccatctctaacggctctggatttgtggtggcagcagatggtctgatagtcaccaatgcacatgtggtggccgatcgacgcagagtgcgagtgagacttctttcgggcgacacctacgaggccgtcgtgaccgcagtggatcctgtggccgatatcgcaaccctgcggattcaaacaaaggaacctttaccgaccctgcccttgggtcgcagcgccgacgtacggcaaggtgaatttgtggtggcaatgggaagccctttcgcacttcagaacacgattaccagtggtattgtcagcagcgcccagcgtcctgcgagggatttgggcctcccacagacaaacgtagaatacatccagacggacgctgcaatcgattttggcaacagcggcggtccgctcgtaaacctggatggagaagtgatcggtgtaaatactatgaaagtcaccgcaggcatctccttcgctattccgtctgaccgtctccgtgaattcctgcaccgcggagaaaagaagaattcttcaagcgggatttccggctcacagagacgctacataggggtgatgatgttgactctctctccatctatcctagccgagctgcagctcagagagccttcgtttccggacgtccagcatggagtactcatccataaggtgattctgggctcacctgcacacagggcaggccttcgaccaggggacgttatcttagcgatcggtgagcagatggtgcagaacgcagaggacgtctatgaagcagtgcgcactcagagtcaactggccgtacagataagaagaggaagggagactctgaccctctatgtgacccctgaggtgaccgagtag

SEQ ID NO: 226411 - DNA, 1086 bp, Artificial Sequence
  Description of Artificial Sequence: Synthetic coding sequence
atggcagcaccaagggcaggtcgcggagcaggatggtctttgagagcctggcgcgctttgggagggatcagatggggtcgaaggcctcgcctgacacccgatctcagagcgctgctgacctccggaacttccgatccccgtgccagagtcacttacggaactccatccttatgggctagactctcggtgggtgtgacggaacctcgggcatgcctgacctccggaacacccggacccagggcccagctgactgccgtcacccctgatactcggactcgggaagccagcgaaaattcgggcacacgctctagggcttggctagctgtagctctgggcgcaggaggcgcagtgcttctgctgctatgggggggtggacgaggaccaccggctgtgttagccgctgtgcccagccctcccccagctagtcctagatcccagtacaattttatcgctgacgtggtcgagaagacagctccagctgtcgtctacattgagattcttgatcgacacccctttctgggcagggaggtgcccatttccaatggaagtgggtttgtggtggctgctgacggcttaattgtgactaacgcccacgtggtagccgatcgtcggagagtccgggtcagactgctgagcggggacacctatgaagccgtagtgacggccgtcgatccggttgcggatatcgctaccctccggatccagaccaaattcggaaactccggtgggccactcgtgaatctcgacggcgaggtcatcggggtgaataccatgaaagtaaccgcagggatctccttcgccataccatccgacagactgagggaattcctgcacagaggagaaaagaagaattccagctctggcattagcggcagccagcgtcgttacattggggtcatgatgctcactctgtccccacgcgctggactccgacctggagatgtgattctggctataggggagcagatggtccagaacgcagaagatgtgtacgaggctgtgcgaacacaatctcaactggcggtgcagattaggcggggaagggaaaccctgacactgtacgtcacacccgaggtgactgagtag

SEQ ID NO: 226412 - DNA, 1362 bp, Artificial Sequence
  Description of Artificial Sequence: Synthetic coding sequence
atgcaggcacgggctctcctcttagctgctttggctgctctagcactagctagagaaccccctgcagccccatgtcctgctcggtgtgacgtgtcaagatgccctagccctcggtgtcccggtgggtacgtgcctgatctttgtaactgttgcctggtctgcgccgcttctgaaggggagccctgtggcggtccactcgatagtccttgcggggagagcctggaatgcgtgcggggactctgccggtgcaggtggagccacgctgtgtgcgggacagacggtcatacatacgcaaacgtgtgtgccctgcaagctgcttctagacgggcattacagttgagcggaacacctgtcagacagctccagaagggggcttgtcccctgggcctgcaccagttatcatcccctcgatacaagttcaatttcatagctgatgtcgtagaaaaaatcgctcccgcagtggtccatattgagctctttctcaggcatccccttttcggtcggaatgtgcccctttcatcagggtccggatttatcatgagcgaagcaggtctcattatcactaacgcccacgtggttagttctaacagcgctgcacctggaagacagcagctaaaggtgcagctccagaatggcgactcctacgaagctaccatcaaggatatagataagaagagcgatattgcgaccattaaaatacaccccaagaaaaagttgcccgttctgttactcggtcattccgccgacctgcgtcccggagaattcgtggtggccattggtagtcccttcgctctacagaataccgtgacaacgggcatcgtgagtacagcccagcgggaggggagggaactaggcctccgagacagcgatatggactacatacagacagacgccatcattaactatggcaattctgggggaccactggtgaacttagacggtgaagttatcggcatcaacacgcttaaggtgaccgcagggatctcgtttgccatcccaagcgatcggatcacacgctttctcactgaatttcaggacaaacagattaaggactggaaaaagaggttcataggaattcggatgcgaaccatcacgccaagcctggtggatgaacttaaagctagcaacccagattttcctgaggtgagctccggcatctatgtgcaggaggtggcccctaattcacctagccagcgagggggaattcaagacggtgatatcatcgtcaaggttaatgggaggccgctagtcgactccagtgaacttcaggaagctgtgttaaccgagtctcctctactactggaggttcgaaggggtaacgatgacctgctgttttccattgcccctgaggtggtcatgtag

SEQ ID NO: 226413 - DNA, 1431 bp, Artificial Sequence
  Description of Artificial Sequence: Synthetic coding sequence
atgatcaggccccaattacgcacagcgggactggggagatgtctcttacccggactcctgctgctgttggtgcccgttttgtgggctggtgcagaaaaattacacacacagccgagctgtcctgcagtttgccagccaacacgatgtcctgccctccctacttgcgctctgggaactactcctgtttttgacctgtgtaggtgttgccgggtttgtccagctgctgagagggaggtgtgcggtggcgctcaaggccagccctgtgccccaggcctgcagtgtttgcagccactccggccaggatttccctcaacttgcggatgccccacactgggcggagcagtgtgtggatccgacagaagaacgtatccaagtatgtgtgcgctgcgcgcagagaatcgcgcagctcgtagactgggaaaagtgccggcagtaccagtacagtgggggaattgtggcgatacgggcactaggagcgcaggccctctgcggcgtaactataattttattgcggcagtcgttgagaaagttgccccttcagtcgtccacgtacagctgtgggggcgtctgcttcatggcagtagactggtacctgtgtacagcggctccggtttcatagtatcagaggatgggctcatcattacaaacgctcacgtggtccggaaccagcaatggattgaggtcgtgctccaaaacggtgcgcgatacgaggcggtcgtaaaggatatcgatttgaagctggatctggcagtcatcaagatagagtctaacgccgagctccccgtgctcatgctgggcagatctagtgatttgcgggctggagaattcgttgtggccctaggaagccccttttcgcttcagaacacagccactgccggtatagtctctaccaaacaaagagggggaaaggagctcgggatgaaggacagcgatatggactacgttcagatagacgcaactatcaattacggtaattccggaggtccactggtgaacctggatggggacgttataggtgtcaactccctccgggttaccgacggtatttcattcgccatcccatccgaccgcgtacgccagtttctagctgaataccacgaacaccagatgaaagggaaagccttttctaataaaaagtacttgggcttgcagatgctgagtttaactgtcccattgagcgaagagctgaagatgcattacccagatttcccagatgtctctagcggagtctatgtgtgcaaagtcgttgaggggactgccgcacagagcagtggtctgcgggaccacgacgttattgtgaatatcaacggaaaaccgataacgacaacgactgacgtcgtgaaagcgcttgactcggatagtctcagtatggccgtactaagaggaaaggacaacctactcttgactgtcatacctgagacaataaactag

SEQ ID NO: 226414 - DNA, 8156 bp, Artificial Sequence
  Description of Artificial Sequence: Synthetic coding sequence
atgcccaggacaaaacagatccacccacgcaatctccgcgataaaatcgaggaggctcagaaagagcttaacggtgcagaggtgtcgaaaaaagagatattgcaggctggggtgaaggggacttctgagtccctgaagggcgtgaaacgaaagaagatcgttgccgagaatcacctgaaaaagattcctaagagccctctgaggaatccattgcaggccaagcataagcagaacacagaagaatccagcttcgccgtgcttcacagtgcctctgaatcccataagaagcaaaattatatccccgtcaagaacggaaagcagtttactaagcagaatggcgagactccagggataatcgctgaggcctcgaaatctgaggagtctgtctcccccaagaaacccctgttcctacagcagccgtccgagctccgaaggtggagatccgagggggcagaccctgcgaagttcagtgatctggatgaacagtgtgatagctcatctctgtccagcaaaacccggaccgataacagtgaatgcatctcatctcactgtggcacaacaagtccaagttacactaacaccgcctttgacgtacttctgaaggccatggaacctgagctgagtacactgtctcagaagggcagcccttgtgctattaaaaccgagaaattaaggcctaacaaaaccgctagaagcccccctaaactgaagaactcaagtatggacgcccctaaccaaacgtctcaggagttggtagcagaaagccagtcatcttgcacaagctacaccgtgcacatgtccgctgcacagaaaaacgaacaaggggcaatgcagtccgcgtctcacctgtatcaccagcacgaacacttcgtgcccaagtcgaatcagcacaatcagcagctgcccggatgtagtggatttactgggtccctcaccaacctccagaatcaagagaatgcaaaactcgaacaggtatacaatatagctgtgactagctccgtcggactcacaagtcccagttcaaggtctcaagtgacaccccagaatcagcagatggacagtgccagccctctcagcatcagtcctgcaaacagcacccagtccccgccaatgccgatttacaactctacccacgttgccagcgtcgtcaatcagtccgtagagcagatgtgtaatctgcttttgaaagaccagaaacccaaaaaacaggggaagtacatttgcgagtattgtaatcgcgcttgtgccaagccgtcagtccttcttaagcacatccgctcccataccggtgagcggccatatccttgtgtgacatgcgggttctcattcaagacgaaaagtaatctttacaagcacaaaaaatcacatgcccacacaattaagctggggctggtgctgcagcctgatgctggcggactatttctgagtcatgaatctcccaaagctctgtccatccatagtgacgtggaggattcaggagaaagcgaagaggagggtgccaccgatgaacgacaacacgatcttggagctatggagctacagcccgtgcacattattaaacgcatgtcgaatgctgagaccttactgaagagttcttttacgccaagttcaccagagaacgtgatcggggatttcctgctgcaggaccgctcagccgaatcccaagctgttactgaactgccaaaggtggtcgtgcatcacgtgacggtctccccgctcagaactgattccccaaaggctatggatccaaagcctgagctctcttctgcccaaaagcagaaagatttgcaagtaaccaacgtgcaacctttgagtgctaatatgtcacagggtggcgtctcccgcctggagacaaacgaaaactcgcaccagaagggagatatgaaccctttagagggaaagcaggactctcatgtcgggacagtgcatgcacagctccagagacaacaggcgactgattactcgcaggagcagcagggcaagctattgagtcccagaagcttggggtccaccgattcagggtacttctcccggagcgagagcgctgaccagacagtgtctcccccaacaccttttgccagaagactgccttctaccgagcaggatagcggccgaagcaatggccctagcgcagcactcgtgacaacttccaccccatccgcgcttcccactggggagaaggccctgttattaccaggccagatgagaccaccattggccacaaaaaccctggaagaaaggatctctaagctgatctccgacaacgaggctctggtcgatgacaaacagctggatagcgtgaagccacggcgaacttccttatcaagacggggatccattgattcgccaaaatcatacattttcaaagatagttttcaattcgacctgaagccggtcggcagacgcacatcctcatcctccgacatccctaagagtccctttaccccaacagaaaagagcaaacaagttttcctgctgtctgtcccttctctggactgcctgcctataacccggagtaactccatgccaacgacagggtatagtgcagttccagccaacattatcccgccaccgcatcctctccgtgggagccagtcttttgacgacaagattgggacgttctatgatgacgtttttgtctccggtccgaacgcccctgttccacaaagcggacatcccagaaccttggtccgccaagccgctatcgaggattcctccgccaacgaatcccatgtgctggggaccgggcagtccctggacgaatcccaccagggctgtcacgctgcgggagaagccatgtctgttcgtagtaaagctctggcacagggccctcacattgagaaaaaaaagtcacaccaggggagggggaccatgttcgaatgcgagacctgtcggaatcggtatcgcaaactggaaaatttcgagaaccacaagaagttttactgctctgagctgcatgggcctaaaacaaaggtagctatgcgcgagcccgagcactcacccgttcctgggggactgcagccccagattttgcactaccgtgtagctgggtcaagcggcatttgggaacaaacaccacagattaggaagcgtcgcaagatgaaatccgttggcgatgatgaggagctccagcagaacgaatccggcaccagtccaaaatccagcgaaggtctgcagttccaaaacgctctgggatgtaacccgtcactgccaaagcacaacgtgaccattaggtctgatcagcagcataaaaacatacaattgcagaattctcatattcatctcgtggccagaggcccagagcagactatggatccaaagctcagcacaatcatggagcagcagatctcatctgccgctcaggacaaaattgaactgcagagacatggaaccggcattagtgtcatccaacacaccaatagcctgtcccgaccgaactcatttgataagccagagccctttgagcgggctagcccagtgtctttccaagagctgaatagaaccggcaagtctggtagtctgaaagtaattggcatatctcaggaggagagccatccctcaagagatggctcccaccctcaccagctggccttgagtgatgcattacgcggagagctgcaggaatcttcccgcaaaagcccatctgaacgtcacgtactgggtcagccctcgcgccttgtgcggcagcataatatccaggtgcccgagatccttgttactgaggagcccgacagagatttagaagctcagtgccatgatcaggagaaatccgagaaattctcctggccgcaacgcagcgaaaccttaagcaagttgcctaccgaaaagttaccccctaagaagaaacgactgcggcttgcagagatagagcactcaagcactgagagcagctttgacagcacactgtcccggtctctgtctcgcgagtcatctctaagccacacaagttccttcagtgcttcacttgatatagaagatgtatccaaaacagaggcgtccccgaaaattgacttcttaaacaaagccgaattcctgatgattcctgccggactgaataccctcaatgttcctggctgccaccgggagatgcggaggactgcatctgaacagataaactgtactcagaccagcatggaggtatcagatttgagatccaaatccttcgattgtggttcaataacccctcctcagaccacacctcttacagaattacagcctccttcctcgccgtccagagtcggcgtcaccggtcacgttcctctcctggagcggagacggggacccttggtgcgccagattagcctcaatattgcacccgattctcatctttctcccgtgcatccgacatcatttcagaatactgctctgcccagcgtcaacgccgtgccatatcagggcccacagctgacatccacatctcttgccgaattctccgccaacacccttcattctcagacgcaggtaaaggacttgcaagccgagaccagtaattcttcttccactaatgtgttccccgtacaacaactctgcgacatcaacctgctgaaccagatccacgctccaccttctcatcaatctacccagctgtctttgcaagtctcgacgcagggatctaagcctgataagaattcagtgctatccgggtcttctaagagcgaggattgctttgcccctaagtatcagctacattgccaagtctttacttcaggaccttcctgctcctctaatcccgtacacagcttgccaaaccaggtgatctctgaccctgtgggtaccgatcactgtgtgacttccgccaccctgcctacaaaactgatagactccatgtctaattcccatcctcttctgccacccgaacttcggccactcggttcacaggtgcagaaagtaccatctagctttatgctcccaattagactgcaatcttccgtgcccgcttactgttttgccacattaacgtcactgccccagatcttagtgacccaggatctgccaaatcagccaatctgtcaaacaaaccactccgtagttcctataagtgaagaacagaattcagtcccaacactccagaaaggccaccagaatgccttgcccaatcctgagaaggagtttttgtgcgaaaatgtcttctccgaaatgtcacaaaactccagtttgtctgaaagtttgcctattacccaaaaaatttccgtcggcaggctatcacctcaacaagagtcctccgcctctagtaagcggatgcttagccctgcaaactcactggatatagctatggagaagcaccaaaagagggcaaaagacgaaaacggcgctgtgtgtgctacagacgtgagacctcttgaggcactctcttcccgtgtgaacgaagcgtctaaacagaagaaaccgatcttggtacggcaggtgtgtaccacagagcctcttgatggcgtgatgctggagaaggatgttttttctcagccagagataagcaacgaagctgtgaatttgactaacgtgctccccgcagataatagtagcactggctgctccaagtttgtggtaatagagccaatttccgaattgcaggagttcgaaaacatcaagtcgtcaacctctctgactcttacagttaggagcagccctgccccatctgagaatacccatattagcccactgaagtgtacagacaacaaccaggagagaaaatcccccggtgtcaaaaaccagggcgacaaagtgaacatccaggagcagtcacagcagccagtcacctctctgtcactttttaacataaaggacacccagcagttagccttccccagcctcaaaaccacaacaaattttacttggtgctatctcctgagacagaaatccctccatctaccacaaaaagaccagaagacttcagcctacaccgattggacagtcagcgcgagcaatcctaatcctctgggacttccaaccaaagttgcattggcgttgctcaactctaagcagaacactgggaagtccctatattgtcaggcaatcactactcacagcaagtctgatctgctggtgtattcttcaaagtggaaaagctcattgagtaaacgcgctctgggaaatcaaaaatccacggtggtagaattcagcaacaaagatgcctctgaaataaacagtgagcaggacaaagagaattctttgatcaaaagtgaacctaggcggatcaagatcttcgatggcggatacaaatccaatgaggaatatgtgtacgtacgcggacggggtcgaggcaaatacatatgtgaagagtgcgggataagatgcaaaaaaccctccatgctcaaaaagcacatccgcactcatacagatgtgaggccttatcattgcacgtattgcaatttttcgtttaagactaagggaaatctgacgaaacatatgaaatctaaggctcattcaaagaagtgtgttgatcttggcgtgagtgtgggactgatagacgaacaggacactgaggagtccgacgaaaaacagcgcttcagctatgagcggtctggctatgacctcgaagagtctgatggccctgatgaagacgacaatgaaaacgaggacgacgatgaagattctcaggctgaatccgtcctatcagccactccttctgtcacagccagccctcagcacctgcccagcaggtcttcactgcaggatccagttagcaccgatgaggatgttagaatcacggattgtttctccggtgtccataccgaccctatggatgtgttgcctcgcgcattgctaacccggatgacagtgctgtccaccgcacagtcagactataaccgaaaaacactttctcctggcaaagctcggcagagggctgcgagagatgagaatgatacaataccaagcgtggacacatccaggtctccatgtcatcagatgtctgtggactaccccgagtcagaggagatcctgagaagctctatggccggtaaagccgttgctatcactcagtccccaagctcagttcgcctgccgcctgcggcagcggagcacagcccacagaccgcagccggaatgccctctgtcgcaagcccacacccggacccacaagagcagaagcagcagattactctccagccaacacccggactcccttccccacacacccatctgtttagccacctgcctctccatagccagcagcagtcccggactccttataatatggtgccagttggcggtatccacgttgtgcctgccggtctgacttactcgaccttcgttccactgcaagccggtcccgttcagcttacaatccccgcagtcagtgtggtgcatagaaccctggggacacatagaaatactgttactgaagtgagtggtacaaccaatcccgctggggttgcagagctgagctctgttgtcccttgtatcccaattggtcagatccgggtgcctggcttgcagaacctgtcaacgccaggccttcagtctttgccttcgctcagcatggagacagtcaatattgtgggtctggcaaacaccaatatggctcctcaagttcatccaccgggactggcgctgaatgccgtcggcctccaggtgttgacggccaatccctccagtcagagctccccagcaccccaggcccatattcccggactgcagattctcaatatcgctctgcctaccctgatccctagcgtgtctcaggttgctgttgatgcccagggcgctcccgaaatgccagcatcccagtctaaagcttgtgaaacacagccgaaacagacctccgtcgcctccgctaaccaggttagccgcaccgagagccctcaaggccttcccacggtgcagcgggagaacgccaagaaggtgttaaaccctcccgctcccgcaggtgaccatgcgcgacttgatgggctgtctaagatggatacagagaaagccgcttctgccaaccacgtcaaacccaagcctgagttaacctccatccagggccagcccgcttctacttctcaaccactgctaaaagctcattccgaggtattcaccaaacccagcggccagcagacactgtctcccgatagacaggtaccacggccaacggcactgcccagaaggcagccaaccgtgcatttcagtgatgtctcgagtgacgatgatgaggatcgtcttgttatcgccacata

SEQ ID NO: 226415 - DNA, 387 bp, Artificial Sequence
  Description of Artificial Sequence: Synthetic coding sequence
atgccacgtaccaagcagattcatcccaggaacctgagagataagatagaggaggctcagaaagaactgaacggagccgaagtctcaaagaaagagatcttgcaggcaggtgtcaaaggcacttctgagagcctaaaaggggtaaagagaaaaaaaatcgtggcagagaatcatctgaaaaagattcctaaatcccctctgcgaaaccctctgcaggccaagcataagcaaaacacagaggaatccagtttcgccgttttacactcggcaagcgagtctcacaagaaacagaattacatccctgtcaagaacgggaaacagttcactaagcaaaacggtgagacacctggcatcatcgcagaggctagtaagtcagaggagtcctag

SEQ ID NO: 226416 - DNA, 429 bp, Artificial Sequence
  Description of Artificial Sequence: Synthetic coding sequence
atgccacgaacaaagcagattcacccgcgaaatctaagagacaagatcgaggaggcacagaaggaactaaatggtgccgaggtgtccaagaaggaaatactccaggcaggtgtgaagggcacaagcgaaagcctgaagggcgtgaaacgaaagaagatagtggcagagaatcacctgaagaaaatccctaagtcgcctctacggaaccccctccaggcaaagcacaagcagaacaccgaggagagctccttcgccgtactccacagcgcgtctgagtcacacaaaaaacagaactatattcccgtaaaaaatggaaagcagtttacaaagcagaacggcgaaacgcccggaatcatcgcagaggcttcaaaatccgaggagagcgtctcacctaagaagcccctcttccttcagcagccctctgaatag

SEQ ID NO: 226417 - DNA, 363 bp, Artificial Sequence
  Description of Artificial Sequence: Synthetic coding sequence
atgccacgcaccaagcaaatccacccacgaaatctgagagacaagattgaagaagcccagaaggaactgaatggagccgaggtgtcaaagaaagagattttgcaagctggcgtgaaaggaacaagtgaaagtttgaaaggcgtgaagcggaagaagattgtcgccgagaaccacttgaagaagatcccaaagagcccgttgcggaatcctctgcaggcaaaacacaaacagaatactgaggaaagcagcttcgcagtgctgcatagcgctagcgagagtcacaagaagcaaaactacatccctgtgaaaaatgggaagcaatttacaaagcaaaacggggaaactcccggaattatcgcatag

SEQ ID NO: 226418 - DNA, 1752 bp, Artificial Sequence
  Description of Artificial Sequence: Synthetic coding sequence
atgcttaagaaacacatacgtacccacaccgacgtcagaccatatcactgtacttactgtaacttctcattcaagacgaaagacgaaaagcagcgattcagctacgagcgttctggttatgaccttgaagagagcgatggaccggacgaggacgataacgaaaatgaggacgatgacgaagatagccaagcggagtctgttctgagtgccactccttccgtgactgcatcacctcagcacctgccgtctaggtcatcactccaagatcccgtaagtactgacgaggatgtcaggataacagattgcttctccggggtccacaccgacccaatggatgtcttgccgagggcgctactgaccagaatgaccgtgttgtccactgcccagagcgattacaatcgaaagaccctatctcctggcaaggcacgtcagcgagccgctcgggacgagaacgacacaataccttccgtggacacctcacgctccccgtgccatcagatgagcgttgactacccggaaagcgaagagatcctgagatctagcatggcaggcaaggcagtggccatcactcagtctcctagctccgtgaggctgccacccgctgccgcagagcactccccgcagacagcagctgggatgccgagcgtggcaagccctcaccccgatccccaggagcaaaagcagcagattactctccaacccacaccaggcctgccttctccgcacactcacctgttttctcacttacccctgcactctcaacagcagagcaggaccccctacaatatggtaccagtgggcggaatacacgtggtacccgctgggctaacatattctactttcgttccattgcaggccggtcccgtgcagctcaccattccagctgtcagtgtggtccaccgcacactcggaacgcatcgcaatactgtgaccgaggtgtccggaaccacaaaccccgcaggagtggccgagctatcctccgtggtaccttgcattcctatcgggcagattagagtacctggcctgcaaaacctgtccacccccggacttcagtcactgccatcactgagcatggagacggtcaacatagtcggcttggccaacacaaatatggctcctcaagtgcatccaccgggtcttgccctgaacgccgtgggcctgcaagtgctaaccgccaatccatcaagtcagtctagcccagctcctcaggcccacattcccggtctgcagattctgaacatcgcgctccctaccttgataccttccgtgtcacaggtggccgtagatgctcaaggcgcacctgaaatgcctgctagtcaatctaaggcttgtgagactcagcccaaacagacctctgtggcctccgccaaccaagtgtcaaggaccgaaagccctcagggcctgccgaccgttcaaagggagaacgcgaaaaaagtgctgaatccaccagctcccgcaggcgaccatgcgaggctggacggtctctcgaagatggatacggagaaggcggcttcagctaaccacgtgaaacccaaacccgagcttacttccattcaggggcagccagcctcaacgtctcagccactgctgaaggcccattccgaagtgtttacaaagccaagcggacagcagaccctgagtccagaccgccaagtgccaaggccgaccgccctgcctcgacggcaaccaacggtgcacttctccgacgtgagttctgacgatgacgaagaccgattggtaattgccacctag

SEQ ID NO: 226419 - DNA, 2103 bp, Artificial Sequence
  Description of Artificial Sequence: Synthetic coding sequence
ggggataagttctcattccaaagagccctggggaatcagaagagcactgtcgttgaattctccaataaggacgcctccgaaatcaattccgagcaggataaggaaaatagtctcattaaaagtgagcctcgcagaattaaaatcttcgatggtggttacaaatctaacgaagagtatgtttacgtgaggggaagaggccgaggaaagtatatctgcgaggaatgcggcataagatgtaaaaagccttcaatgctcaaaaaacacattcgaacacacaccgacgtgcgcccttaccactgcacgtattgcaacttctcttttaaaaccaagggtaacttgactaaacacatgaaatccaaagcgcacagcaagaagtgtgtcgatctgggagtctcagtcggacttattgatgagcaagataccgaggaatccgatgaaaaacagcgtttttcatatgagaggtcgggctatgacctcgaggaaagtgatggtcctgatgaggacgacaatgagaacgaagacgacgacgaagattctcaggctgagtccgtgctcagtgctaccccctccgtgacggcctcacctcagcacctccccagccggagttccctgcaggacccagtatctactgacgaagacgtgcggattacagattgtttctcaggcgtccatacggacccaatggacgtgctgccccgagctctactaactcgcatgacagtgttatccactgcacaaagtgactataaccggaaaactctctcgcctgggaaggctaggcagcgcgctgctcgtgatgaaaatgatactatcccatccgtggacacatccaggtcgccttgtcaccagatgagtgttgactacccagaaagtgaggagattttgcgcagcagtatggccggaaaagctgttgccatcacacaatcaccgtcatctgttcgccttcccccagccgctgctgagcactcccctcaaacagccgctgggatgccttcagtggcctccccacatccagatccgcaggagcagaaacaacaaatcactttacagcccactccaggtctacctagcccccacactcaccttttttcacaccttcctttgcatagccagcagcagtcacggacaccatacaatatggtgcccgtgggcggtattcacgtggtcccggcaggtctcacctattctacatttgtgcccttgcaggcaggccctgtacaactcacaataccggcagtctccgtggtgcaccgtaccctgggcactcatcgtaatacagtgacagaggtgtctgggaccactaaccccgcaggcgtagctgagctttcctcggtggtcccctgcatacccatcgggcagattcgtgtgcctggattacaaaacctgagtactcctgggctgcagtctttaccctccttgtctatggagacagttaatattgtaggcttggccaataccaacatggctcctcaggtccaccccccaggtctggctttaaatgccgtgggcttacaggtgctgaccgctaacccgtctagccagtcatctcctgcccctcaggctcacataccgggactgcagatccttaacatcgccctccccacactgattccttctgtgtctcaagtcgcagttgatgcccagggagctcccgaaatgccggcatcgcagtccaaagcctgtgagactcagccaaagcaaacatctgtcgcatctgccaatcaggtctcccgaactgagagcccacaaggcttgcccacggtgcagagagaaaatgccaagaaggtgctcaaccctccagcacccgctggcgaccatgccagactggacgggctttccaaaatggacactgagaaggccgctagcgccaatcacgttaaacctaagcctgagctgacgtctattcaaggacaacccgcatccacatcacagcctctcttaaaggcacactccgaagtcttcacaaaaccatcaggccaacaaacactgtccccagacaggcaggtgcctcgacctacggctctacctcgacgccagccgacagtgcacttttccgatgtgagttctgatgacgacgaggaccgtctggtgattgccacctag

SEQ ID NO: 226420 - DNA, 7341 bp, Artificial Sequence
  Description of Artificial Sequence: Synthetic coding sequence
atggatacaggcgatactgcccttggccagaaagccacctcacgatccggggaaactgacaaagcatcaggcaggtggaggcaggaacaaagtgctgtgataaaaatgagcacattcgggtcacacgagggacagagacagccgcagattgagcccgaacagatcggtaacaccgcttctgcacagctgttcggcagcggcaagcttgcgagcccatcggaagtggtgcagcaagtcgccgagaagcaataccctccacatcgcccttctccttatagctgccagcattccctgagcttcccgcagcacagcctcccacaaggagtgatgcatagtaccaaaccacaccaatctctcgaaggcccaccctggctgtttcccggaccactgccgagcgtggcctccgaggatctcttcccatttccgatacacggccactccggaggctacccaagaaaaaaaatttccagtctgaatcccgcatattcccagtacagtcaaaaatcaatcgaacaagctgaggaagcccataaaaaggagcacaagccaaaaaaacctggtaagtatatctgtccctactgctcgcgtgcatgcgccaaaccttccgttttaaaaaaacacattaggagccatacaggggaacgaccgtatccctgcatcccatgcggtttttctttcaagactaaatccaacctctataagcaccgcaaatctcacgcccatgcaattaaggcaggactcgtcccattcactgagtccgccgtgtctaaattagatcttgaggccggtttcatcgatgtggaagcggagatccatagtgacggggaacaaagtaccgacactgacgaggagtcttcactttttgctgaagctagcgacaagatgagtcccggaccccctattcctttggatatcgcctcaaggggcggttatcatggatctttagaagagtccctggggggtcccatgaaagtaccgatcttaataatcccaaaatccggcattcccctgcctaatgagagtagccagtacataggccctgatatgctgcccaatcccagcttaaacaccaaagccgacgactcacacaccgtcaagcaaaaactagccctacgcctgtccgagaagaaaggtcaggattctgagccttccctcaacttactgagcccacattcgaaagggagtaccgatagcggatatttttccaggagcgagtccgccgagcagcagatcagcccgccaaataccaacgctaagagttacgaggaaatcattttcgggaagtattgccggctatcccccagaaatgccctgtccgtaacaacaactagccaggaacgggctgccatgggcaggaaaggtatcatggagcctctgccccacgtaaacactcggctggatgtgaaaatgttcgaggacccagtatcccagctcatccctagcaagggagatgtagatccaagccagactagcatgttgaagtccaccaagtttaattcagagtcgcggcaaccacagattatcccctcatcgattcgcaatgaaggaaaattgtatcccgcaaattttcagggcagtaatcccgtgctgctggaagcgcctgtggatagcagtcccttaattaggagcaactctgtgccaacaagcagtgccactaacctcactatcccacccagcctcagagggagccactcatttgatgagcggatgaccggtagcgatgatgtcttctaccccggtaccgtcggaatccctccacagcgtatgctgaggaggcaggctgcatttgagctgccttcagtacaggagggtcatgtagaggtggaacatcatggcaggatgctaaagggaatctcaagttctagtcttaaagaaaaaaaactctcccccggtgaccgagtaggctatgactacgacgtgtgtcgtaagccttataagaaatgggaagacagcgagacaccaaaacagaactacagagatataagctgcctctcaagcctcaagcacggcggagagtacttcatggacccggttgttccccttcagggcgtaccttccatgttcggaacgacctgcgaaaaccgaaagcgccgtaaggagaagtccgttggcgacgaggaggatacaccaatgatttgttcttcaattgtgagcactcccgtcgggatcatggcatcagattacgaccctaaactacaaatgcaggagggagttaggtccgggtttgccatggcgggtcacgaaaatctcagtcacgggcatactgaaaggttcgacccttgccggcctcaactgcagccgggatcacctagcctcgtgtctgaggagtctccgtctgcaatcgattctgataagatgagtgatctcggcggtcggaagccccctggcaatgttatctccgttattcagcacacaaacagcctgtcacgccctaacagttttgagcgttctgagagtgcagaactcgtcgcttgcacccaggataaggccccatccccatctgaaacttgcgactcagagatcagcgaagcccctgtgtcacccgaatgggccccaccaggcgacggcgctgagtctgggggaaagccctctccctcccagcaggttcaacagcagagttaccacacacagccaaggcttgtcaggcagcacaacatccaggtccccgaaatccgggtgactgaggaacccgacaagcccgagaaagagaaggaggcgcagagtaaggagcccgagaaacctgtggaggagtttcaatggccccagcgaagcgagacactgagccaactgcctgctgagaagctcccaccaaagaaaaaaagactccgcctggccgacatggagcactccagcggcgagagcagctttgagtctaccggtaccggcctcagtcgcagccctagccaggaatcaaacctcagtcactcatcctccttctcaatgagcttcgaacgagaagagaccagcaagctgtccgctctgccaaagcaagacgaatttgggaaacactctgaattcctgacagttccagccggatcctacagccttagtgtccctgggcatcaccatcaaaaagaaatgcgacgctgttcgtcagagcagatgccatgcccccatcccgcagaagtaccagaggtgagatcaaagtcctttgactatgggaacctttctcacgcacccgtgagtggcgcagccgcttctaccgtgtcccctagtcgtgaaagaaagaagtgcttcttggtgagacaggcgtccttctccggcagccccgaaatatcacagggcgaggtgggtatggatcagtccgtcaagcaggaacagctggagcatctgcatgcaggcctgagatctggatggcaccacgggcctccagcagtgctgccaccccttcagcaggaggaccctggtaagcaggtggcgggtccttgtcctcctctcagcagtgggcctttgcacctcgcccaaccccaaattatgcacatggattcccaggaaagtctgagaaacccgctcatccagcctacatcatatatgactagtaagcacctgccagaacagccacatctgttccctcatcaggagacaatccccttctctcccatccagaacgccctgttccagtttcaataccccactgtctgcatggtccatcttcctgctcagcaacccccttggtggcaagcacactttccccatccatttgctcagcacccacagaagagctatgggaagccatctttccagacagaaatacatagttcttacccactggagcatgtcgcagagcacaccgggaaaaagcccgctgagtatgcacacactaaagagcaaacttacccatgttattctggagccagcggactgcaccccaagaaccttttgcctaaattcccaagtgaccagagctccaaatccaccgagacaccatccgaacaggtcctgcaggaggattttgcctcggccaatgccggaagcctccagagtctgcctggaaccgtggtcccagtgcgaattcagacgcacgtcccgtcgtacggttcagtgatgtacacatctatttctcagatccttggccagaactcacctgcaattgtaatttgcaaagttgacgagaacatgactcaacgaacgctcgtcaccaatgccgcaatgcagggaattggtttcaacattgctcaggttctcgggcagcatgctggcttggagaagtacccaatatggaaggcccctcagacgctcccacttgggttagaatcctctatcccgctgtgtctgcctagcacatccgattctgtagctacactgggaggctcaaaacgaatgttaagcccagctagctcactggaattgttcatggaaacaaagcagcaaaaaagggtaaaggaggagaagatgtatggtcaaatcgttgaagaattatccgctgtagagctgaccaactctgacataaagaaggacctcagtaggccccagaaaccccagctggtgcgtcaaggctgtgcctcggaacccaaggacggactacagtctggcagcagtagcttctcaagcctctcacccagcagtagtcaggactacccaagtgtgagcccatcctctagagagcccttccttccctcaaaagagatgctctccggcagcagagcccctctgcccggacagaaatcgtcaggcccatcagagagcaaagagagtagcgacgaactcgatatcgatgagactgcttccgatatgtccatgagtccccagtccagcagtctcccagccggtgacggtcagctggaagaggagggcaaaggccacaaacggcctgtcgggatgctggtgcgaatggctagcgccccttcggggaatgtagcggacagcaccctcctactgactgatatggcagattttcagcagattctgcagttcccaagtcttcgtactactacaactgtgagttggtgcttcctgaattataccaagcccaactatgtccagcaggctacattcaaatcgtcagtgtatgcaagttggtgcatcagtagctgcaatccaaatccatctgggttaaatactaaaaccacgctggccctccttcgaagtaagcagaaaattacagccgagatttacactctggctgccatgcatcgtccgggtacgggtaaactcacaagcagctcagcctggaagcagttcacgcagatgaaacccgatgcctccttcctctttgggtcgaagctggagaggaagctggtcggcaacatcctgaaagagaggggtaaaggcgacattcatggggataaggatatcggatctaaacagacagagcctatcagaatcaaaatctttgaggggggatacaaatccaacgaagactacgtctacgtgcgaggcaggggaagaggaaagtacatctgtgaggagtgtggcatccgctgtaaaaaaccctcaatgcttaagaagcacattaggacccatactgatgtgaggccttacgtctgtaagctgtgcaacttcgcgttcaaaacgaaaggaaatcttacaaagcacatgaaatctaaggctcatatgaagaagtgcttggagctgggcgtatcaatgacctctgtagatgataccgaaaccgaggaggcagaaaacctggaggacctccacaaagccgcagagaaacactccatgtctagcattagtactgaccaccaattctccgacgctgaagaatcagatggggaggatggggacgacaacgacgacgacgatgaagatgaggatgatttcgacgatcagggggacctgacccccaaaacaagatctcgctctacaagtcctcagcccccacggttctcctccctcccagtgaatgttggggcagtgccgcatggtgtcccttccgattcttctctggggcactcatctctgataagttatcttgtcaccctcccgagtatccgggtaacccaacttatgacgccttcagattcctgtgaggacacacaaatgactgagtaccagagactgttccaaagtaagtctacagattctgaacctgacaaagacaggttggacattccatcttgcatggacgaagaatgtatgctgccgtccgaaccaagctcaagccccagagacttttctccctcgagtcaccatagcagccctggttacgactccagtccttgccgggacaacagtcctaaacgctaccttattcctaaaggcgatttgtctccaaggaggcacctgtcgccccgtcgggacctgtcccctatgcggcaccttagtcccagaaaggaggccgctctgcggagggaaatgtcacagcgtgatgttagtccaagaaggcacctatccccacggcgtcccgtttcgccagggaaggacattaccgctcggagagatctatccccacgcagagagcggagatatatgaccaccatccgtgctccttctccaagaagggctctctaccacaatccaccacttagcatgggacagtatctgcaggcggaacccatcgtgctgggccctccaaacctcagaagggggcttcctcaggtgccatactttagcttatatggtgatcaagaaggagcgtatgaacacccaggcagctctctctttcctgaaggacccaatgactacgtgttttctcacctgcccttgcactcccagcagcaggtgagagcgccaattcccatggtacctgtggggggtatacaaatggtacactcaatgccccctgcactgtcaagtctacatccctccccaaccctcccattgccgatggaagggttcgaggagaagaagggtgctagcggagagtctttcagcaaggacccatatgtgctgagcaaacaacacgaaaagcggggacctcacgctctgcagagtagtgggccaccttccactccatcatcccctcgacttctcatgaaacaatccacaagtgaagacagcctgaacgcaactgagcgagagcaagaagagaacatccagacatgtaccaaagcaattgcttccctcaggattgccacagaagaggccgcacttcttggacctgaccagccagcacgggtgcaggaacctcaccagaatccactggggtccgctcacgtctcaattaggcacttttcgagacccgagcctggccaaccatgtacctcagctacacaccccgatctacacgatggggaaaaggataactttggtacttcacagaccccactggctcactccacgttctattcgaagtcttgcgttgatgacaagcaattggatttccactccagtaaagaacttagttccagcacagaagaaagcaaagacccttctagtgagaagagccagctgcactag

SEQ ID NO: 226421 - DNA, 7340 bp, Artificial Sequence
  Description of Artificial Sequence: Synthetic coding sequence
atggacactggagacaccgcgctgggccaaaaagcaacgtcacggagcggagagactgacaaggcatcgggcagatggagacaggaacagtcggccgtgatcaaaatgtccaccttcgggtcacatgaaggacagaggcagccccagattgagccagaacagattggtaataccgcgtcagctcagttgttcgggtcaggcaaactggcgtcaccaagtgaggtggttcagcaggtcgcggaaaaacagtacccccctcaccgacctagtccatactcttgtcagcactccctgtccttccctcaacacagtctcccacaaggtgtaatgcatagtaccaagccacatcagtctttggaagggccaccctggctattcccaggaccactgccctcagtggccagtgaggacctgttcccgttccctatccacggtcacagtggcggttatcctaggaaaaaaatttcctctttgaatcccgcttattcacagtacagtcagaaatctatcgagcaggccgaagaggcacacaagaaggagcacaagccaaagaagccaggaaagtacatttgcccttactgtagccgtgcctgcgcaaagccctctgtgctcaagaagcatatcagatctcacacgggcgagcggccttacccctgtatcccttgcggattctcatttaagactaagtctaacctgtacaagcacaggaaatcccatgcacatgccatcaaagccggactggtcccctttactgagagcgcagtgagcaagctggatcttgaggccggtttcattgatgttgaggccgagattcacagtgatggcgaacaaagcaccgatactgacgaggaatcgtccctttttgctgaagccagtgacaagatgtctcccggtccccctattccattggacatcgcttctcgcggaggataccatggatctcttgaagagagcctgggcggacctatgaaagtccctatcttgatcatcccaaagagcggtatcccgctgcctaacgagagctcccaatacatcggacccgatatgctcccgaatccctccctgaataccaaagcggatgattctcacaccgtgaaacagaaactggcactacgcctgtcagagaagaaaggccaggactcagaacctagtctgaatcttttatctccccatagtaaaggctcgacagattcgggctacttctcacggtcagagagcgctgagcagcagatatctcccccaaacactaatgccaaatcctacgaagaaatcatttttgggaagtattgccgcttgtctccaagaaatgcactgagcgtaaccactacaagtcaggagagagccgcaatgggacgtaagggtatcatggaaccgcttccacacgtcaacactcggttggacgtgaaaatgttcgaagatcccgttagtcagctcatcccttcaaaaggggatgtggacccttcccaaaccagtatgctaaaatccactaagttcaacagcgaaagccgacagcctcagataatacctagtagtatcaggaatgagggcaaactctatccagctaattttcaaggatctaatcccgtgctgctggaggcaccggtggattcctcccccctgatccgaagcaactcagttcccacatcgagcgcaacaaaccttacaatccccccaagtctgagagggtcccatagctttgacgaacgaatgactggcagtgacgacgtattctatccaggcaccgttgggatacctccccaacgtatgcttcgacgtcaagctgccttcgagctcccctctgtgcaggagggtcatgtggaggttgaacatcatggcaggatgttgaaaggcatttcaagtagctctctgaaggagaagaagctttctcccggagatagggtcggatacgactatgatgtctgtcggaagccatataagaagtgggaagactcagaaacccccaagcaaaactatcgcgatatctcctgtttgtcctcattgaagcatggtggggagtactttatggatcctgtcgtccctctgcaaggcgtgccgagcatgttcggaaccacatgtgagaatcgtaagagacgcaaagagaagtctgtaggcgacgaggaggatacccccatgatttgctcttccattgtttcgacacccgtgggtattatggcgagcgactatgaccccaaattgcagatgcaagagggcgtcaggtctgggttcgcaatggccggacacgagaacctaagccacggacatactgagcgcttcgatccctgtagaccccaactgcagccagggtcgccctcgctcgtgagcgaggaatccccttccgcaatcgactccgataaaatgtcagacctgggtggaaggaaacctccaggtaacgttatttcggttatccagcatactaacagcctgtctcggccaaattccttcgagcggtctgaaagcgcagagctcgtggcttgcacacaggataaagctccctctccatctgaaacctgtgattccgagatctcggaggccccagtttcacccgagtgggcccctcccggagacggagctgagagtgggggaaagccgtctccgtcacagcaggtgcaacaacagtcctaccatacccagcctagattagtgaggcagcacaacattcaggtgccagaaattcgcgttacagaggaacctgacaagcccgagaaagagaaagaagcgcagtccaaggagcccgaaaagccagtggaagaatttcagtggcctcagagatcggaaacactgtctcaactgcccgctgagaagttaccacccaaaaagaagcgtttgcggctcgctgatatggagcatagcagcggcgaatcctccttcgagtctaccgggactgggctgtcacgctccccgtcccaggagagcaacctctcccattccagtagctttagcatgagcttcgaacgggaagagacttccaaactgagcgccctgcccaaacaggatgaatttgggaaacattcggaatttctaacagtgcccgctggctcgtactctctgtcagtgccaggacatcaccatcaaaaagagatgcgcaggtgctccagtgaacagatgccctgcccacaccccgcagaggtgccagaagtgcgctccaaatcgtttgattatgggaacctgtctcatgcaccagtaagcggcgctgcagcaagtacggtgagcccatctcgcgaaaggaagaagtgttttctggttcggcaggccagcttctctggaagcccggagatttcccagggcgaggtcgggatggaccagtctgtaaaacaagaacaactggagcatcttcatgcagggttgagatccggctggcatcatgggccaccggctgtgcttcctccgttgcagcaggaagaccccggtaaacaggttgcaggtccttgtccccctctctcgtcaggtcctctgcaccttgcccagcctcagatcatgcacatggactctcaggaatccctgcgtaatcccctcattcagcctacatcctacatgactagcaagcatttacccgagcagccccatctattcccccaccaagagaccatacccttttcaccaatccagaacgctctgttccagtttcagtacccaacggtatgcatggtgcatctccctgcccagcagcctccttggtggcaagctcactttcctcatccatttgcgcagcatccccaaaagagttacggcaagccgagttttcagacagaaatccactcttcttaccctcttgagcacgttgctgaacatacgggtaaaaagccggcagagtatgcccatacgaaagagcaaacgtatccctgctactccggggctagcggccttcaccctaaaaatctgctgccaaagtttccttctgaccaatcctctaagtctacagaaactccttcagaacaggtgctgcaggaggacttcgccagtgctaatgcaggatcactccagtcgctcccgggaacagtggtcccagttagaattcagacgcacgtccccagctatggatccgttatgtacacatccatttcccaaatcctcgggcagaacagccccgctatcgttatttgtaaggtcgatgaaaacatgacgcagcgtacattggtgacgaacgccgcaatgcaggggatcggcttcaacatcgcccaggtgcttggacagcatgcaggccttgagaaatacccaatctggaaagctccccagacgctgcccctgggcctcgaatcctctatcccattatgtctgccatcgacatcagattccgtcgccaccctcggagggtccaagagaatgctgtcccctgcctctagcctggagttgtttatggaaaccaagcaacagaagagagtaaaagaagaaaagatgtacggccagattgttgaggaacttagcgcagttgaactgaccaacagcgacattaaaaaggatctgagccggcctcagaagcctcagttagtgagacagggctgcgcctctgaacctaaggatggattacagagcggcagttcgtctttttccagtctctctccaagctcaagccaggactacccatctgtctctcctagctctcgcgaacctttcctcccttcgaaggaaatgctgagcggaagtcgggctcctttaccaggccaaaagagttcgggcccatctgaaagcaaggaaagttctgacgagctggatattgacgagaccgcaagcgacatgtccatgagcccacagagtagttcccttcccgcaggagatggacagctggaagaagagggcaaggggcacaaacggccagtcggaatgctagttaggatggcctccgcaccgagcggtaacgtggccgacagcactttactgctcaccgacatggcagatttccagcagatacttcagttcccatccttgaggaccacaacaacagtgtcttggtgttttctgaattatactaaacctaattatgtgcagcaagcaacgtttaagtcttcagtgtacgcatcttggtgtatcagttcttgcaatcccaacccatccggcctgaatacgaaaactacccttgcgttactcagaagcaagcagaagatcaccgcagagatttacactctcgcagctatgcatcggccaggcacaggaaagctgacttcttcctccgcatggaaacagttcacacaaatgaagcctgatgcttccttcctcttcggaagtaagctggaacggaaattggttgggaacatcctgaaggagcggggaaagggcgatatccatggagacaaagatattggctctaagcaaacagagccaatccgaatcaaaatttttgagggcggatataaatctaatgaggattatgtctacgtccgaggaagagggagaggcaaatacatatgcgaggagtgtggaatcagatgcaagaagcctagtatgctaaagaaacacattcgaacccacacagacgtgcgaccctatgtgtgtaaactctgtaacttcgcctttaaaaccaagggaaaccttaccaaacacatgaagtcgaaggcgcatatgaaaaagtgtctcgaattaggcgtgtccatgaccagtgttgatgacacagaaactgaagaggctgaaaatctggaggatctccacaaagccgctgagaaacactctatgtcctctatcagcactgatcatcagttcagcgacgcagaagaaagcgatggcgaagatggggacgataatgatgacgacgacgaggacgaggacgactttgatgatcaaggcgacctcacccccaaaactcggagcaggtccaccagccctcagcccccaagattctcatccttgcctgtcaacgtgggcgctgtcccccatggcgtacccagcgattcctcccttgggcacagcagtctgatctcttacctggttacactgccttccatccgggtgacccagctgatgaccccgagcgacagttgcgaggacacacagatgacagagtatcaaaggctcttccagagtaagagcacggactcagagccagataaggatagactggacattcccagctgcatggatgaggagtgcatgctccccagcgagcctagctcatcgccacgcgatttcagtccgtcatcccatcattccagccccggatacgacagctccccatgtagggacaactccccgaagcgttacctcatccccaaaggagatctctcccctagacggcacctcagtccgcgaagggacctcagcccaatgcgtcatctgtcaccacgcaaggaagctgccctgcgcagagaaatgagtcagcgtgatgtgtcccccagaagacatctgtccccaagaagacccgtgagcccaggcaaagatatcactgcacgcagggatctgagtcccaggagagagagacgctatatgacgactattagggccccatctcccagacgcgcattataccataatcctcccctgagcatgggccaataccttcaggctgaacctatcgtgttaggaccacccaacctcaggagggggctgccccaggtgccttatttctctttgtacggcgaccaggaaggggcttacgagcatcccggatcctccttgttcccagaaggtccaaacgattatgtgttcagtcacctcccactgcattcccagcaacaggtcagggcccctattcctatggttcctgtcggaggtatccagatggtccattcgatgccacctgcactcagctcactacatccgtctcccaccctgcccctcccgatggagggtttcgaagagaaaaagggcgcatccggagagtctttcagcaaggacccctacgttttatccaaacagcacgaaaagcgtggcccacacgccctgcagagcagtgggcctcccagcacacccagcagtcccagactacttatgaaacaaagcacaagcgaggactctctgaatgccaccgaacgcgaacaagaagagaacatccagacctgcaccaaggctatcgcttcattgcgaatagctaccgaagaagccgctctgttaggacctgaccagcccgctcgggtgcaggagcctcatcagaatcctcttgggtctgcgcacgtcagcattagacatttctcgaggcctgagcctggacagccatgcacaagtgcaactcaccctgatctccacgatggggagaaggataactttggcaccagtcaaactcccctggcacattctactttttacagcaagagttgtgtggatgataagcagctcgactttcactcgtcaaaagagttatctagctcaaccgaggagtcgaaggatcccagtagcgaaaagtctcagttacacta

SEQ ID NO: 226422 - DNA, 7340 bp, Artificial Sequence
  Description of Artificial Sequence: Synthetic coding sequence
atggatactggggatactgcactcggccagaaggcaacttcccggagtggtgagacggacaaagcctctggtcgttggagacaggaacagagtgccgtcatcaaaatgagcacatttgggtctcatgagggccaacgccagccccagattgaacccgaacagatcggaaatactgcatccgcgcagctgtttggtagcggcaagttggcctccccatctgaagtggtgcaacaggtggctgagaagcagtatcctcctcacaggccatcaccatattcatgtcaacactcgctgtccttcccacagcatagcttgccacagggggtgatgcactccaccaagccccaccagtccctggaaggcccaccctggctgttccctgggccactgccctctgtggcctccgaggacctctttccatttcccatacacggccactcaggaggctaccctagaaaaaagatatcgtctttgaacccagcctattcacaatacagtcagaaatctatagaacaggcagaggaggctcataaaaaagaacacaaacctaagaagccaggaaagtatatctgcccatattgttctcgtgcatgcgctaagcccagtgttctcaaaaaacatatccgatctcataccggggaacgcccttatccttgtattccctgcggcttctccttcaagacgaagagcaatctgtataaacacagaaaaagccacgcacacgcgataaaggctggattggtgccatttacagagtcggccgtaagtaagctggacctggaagctggtttcatcgacgtggaggcagagattcatagtgacggggagcagtcaacagacactgacgaggagagcagtctctttgccgaagcaagcgataaaatgagtcctggaccgccaattcccttggacattgccagtaggggaggttatcacggatcactcgaagaatctctcggcggtccaatgaaagtccctattctcataataccgaaatccggtatccctctaccaaacgagtcaagccagtatatcggccctgacatgttgccaaacccgtccttgaacaccaaagctgacgactcccacaccgtgaagcagaaacttgctctgcgactatcggaaaaaaaaggccaggatagtgagccatctctgaatctactgtccccacacagtaagggttctaccgacagcggttatttctccagaagcgagtctgccgagcagcagatttctccgcctaataccaacgccaagtcttacgaggaaattatcttcggcaagtattgtcgcctaagtcctaggaacgctctgtctgtaactacgacaagtcaggagagagccgcaatgggcagaaaaggaatcatggagccgctaccccacgttaatacacggctggacgtgaagatgtttgaagaccccgtctcgcagctaatcccgtcaaaaggggacgtcgaccctagtcagactagcatgctgaagagcacgaagtttaattctgagtcaagacagccccagattataccaagttccatacggaacgaaggaaagctataccctgccaacttccagggctccaaccccgtgttgctggaagcacccgtggacagcagcccgctcataagatcgaactccgtgccgacttcctcagcaaccaatctcacaattccaccctcacttcgcggatctcacagttttgatgagagaatgaccggctctgacgacgtgttttatcctggaacagttggcatacccccacagcgcatgctgagaaggcaggccgcttttgagctcccatcggtccaggagggacatgtggaagtggagcatcacggccgaatgttaaaaggaatctcatcgtccagtcttaaggaaaagaaactctcccccggagaccgagtaggatacgattacgacgtgtgtagaaaaccctacaaaaaatgggaggactctgaaacaccgaaacagaattaccgggacatcagctgcctgagctccctgaagcatggtggggaatacttcatggatcccgtggttcccttacagggtgtcccctcgatgttcggtaccacctgcgagaatcgcaagaggcgcaaggagaagtctgttggagatgaggaggacactccaatgatctgcagtagtattgtatccacacctgttggcataatggcctccgattacgatcctaaactccagatgcaggaaggagtgaggagtggattcgctatggcgggtcatgagaacctcagtcacgggcacacagagcgctttgacccctgtcggccacagctgcagcctgggagcccgtctctggtgtccgaggagtccccttccgcaatagacagcgacaagatgtcagatctgggcggtcggaagccacctgggaacgtgatctctgttattcagcacaccaacagcctatcaaggcctaatagcttcgagaggtccgaatcggcagaactcgtcgcctgcacccaagataaggctccctcccccagcgagacctgcgattcagagatctccgaagctcccgtgtctcccgagtgggcacccccaggtgacggtgccgagtccggcggaaaacccagcccatctcagcaagtccaacagcaatcctatcatacacagcctcgactggtaaggcagcacaacattcaggtgccagaaatacgcgtcactgaggagccagataagcctgaaaaggagaaagaggctcaatctaaggagcccgagaaacctgttgaggaattccagtggccccagagaagcgagaccctgtcccaactgcccgctgaaaagctaccaccaaagaaaaaacggcttaggcttgccgatatggagcatagctctggggagtcaagttttgagagcacaggcacgggcctctcccgctctccctctcaggagagcaacctttcacacagttccagctttagtatgtcctttgagcgggaggagacttccaagctctcagcacttccaaaacaagatgaatttggaaaacacagcgaatttctgactgttcctgcgggatcctatagcctgtccgtgcctggacaccaccaccagaaagagatgcgaagatgcagctctgagcagatgccctgcccccaccccgctgaggttcctgaggtccggtctaaaagcttcgattatgggaatctctctcatgcccctgtgagcggcgctgctgccagcactgtatccccatctagagagaggaaaaagtgcttcctagtgaggcaggcttcattttccgggagcccagagattagtcagggtgaggtcggaatggaccaatcagtgaagcaagagcaacttgaacatctgcacgcaggactccggtcggggtggcatcatggtccccctgctgtgcttccacctttacagcaggaagaccccggaaaacaggtcgcgggaccttgcccaccacttagtagcggtccactccatcttgcacagccacagattatgcacatggacagccaagaatcactccggaatcccctaattcaacccacatcatacatgacttctaagcatctgcctgaacagccgcacctttttccgcatcaggagactattcccttctcgccgattcaaaatgcactgttccaattccagtatccaaccgtttgcatggtgcacctgcctgcacagcagcccccatggtggcaagctcacttcccccatccattcgcccagcacccccagaaatcttatggcaaacctagctttcagactgaaatccattcttcataccctttggaacatgttgccgaacatactggcaagaagccggcagagtacgcccacaccaaggagcaaacatacccttgctattcaggcgcatccggattgcacccaaaaaatcttctgcctaaatttccttcagaccagagttccaagtctaccgagaccccctctgagcaggtcctgcaggaggacttcgcttcagcaaacgctggctcccttcagtctctaccgggaacagtggtccctgtgagaatccagacccacgtgccatcatatggaagtgtcatgtatacatctatctctcaaatactgggacaaaacagcccagcgatcgtgatttgcaaagttgacgagaacatgacccaacgaaccctggtgactaatgccgctatgcaaggaattggcttcaatatagcgcaagttctcggccagcatgccggtctggaaaagtatcccatctggaaggctcctcaaaccctgcctcttggtcttgagagcagcattcctctttgcctcccctccaccagcgattccgtggccaccctcgggggtagcaagagaatgttatcacccgcttcctcactcgaactgtttatggagacgaagcaacagaagagggttaaggaggagaaaatgtatggccagatagtggaggagctgtccgccgtcgagctgacaaactccgacattaagaaggacctgagccgccctcagaagccgcagctcgtgagacaggggtgtgctagcgagcctaaagacgggctgcaatccggcagttcctccttttcctccctgagcccgagttcttcccaggactatcctagtgtgtcacctagcagtagggagccgtttttgccctcaaaagaaatgcttagcggatctagggcccctttgccgggacagaaatcttctggtccttccgagtctaaggaatcctcagatgaactcgacatcgacgagacggccagtgacatgtcgatgagcccccaatcctcctcattgcctgcaggcgatgggcaactcgaagaggaggggaaaggacataagaggcccgtgggtatgctggttagaatggcatcagctccctctggaaacgttgccgactcaaccctcctgctcaccgatatggctgactttcaacagatactgcagttccctagtttgcgaacaacaacaaccgtatcatggtgttttcttaactataccaaacctaattatgtccaacaggccaccttcaagagttccgtatatgctagttggtgtatctcctcctgtaaccccaacccgagcggcctgaatactaagaccactctggctctgctgcgttccaaacagaagataactgctgagatttataccctggctgctatgcaccgccctggtacgggtaaactcacatccagcagtgcgtggaagcagttcacacaaatgaagccagacgcatcgttcctgttcggctccaaactggagcgcaaactcgtcggaaacattttaaaagaaaggggaaaaggcgatattcatggggacaaggacatcggaagcaagcaaaccgagcccattcgtatcaagatttttgaaggcggatacaagtctaacgaagattatgtttacgtgcggggacggggtcggggaaagtacatctgcgaagagtgcggtattaggtgcaagaagccgtcgatgctgaaaaagcacattcgcacgcatactgacgtgcgtccttatgtttgtaaactatgtaatttcgcattcaaaactaagggaaacctgacaaaacacatgaagtccaaggctcatatgaaaaagtgtctggagctaggtgtctcaatgacctccgttgatgatacggaaactgaggaggctgaaaacctggaggatctgcacaaagccgctgaaaagcattctatgtcaagtattagcacagaccaccagttttctgacgcggaggagtccgatggtgaagatggcgatgacaatgatgacgacgatgaggacgaggatgactttgacgaccaaggagatctgacccctaagacaaggtcacgcagcaccagcccacagccgcctcggttcagttcactccccgtgaacgttggagctgtccctcacggcgtcccatccgacagctccctgggacactccagcttgattagttatctagttacactcccaagcattcgcgtgacccagcttatgacaccatccgactcatgtgaagacacccagatgaccgagtaccagcgtctgttccagtccaagtccacggacagtgaaccggacaaggaccgcctcgatattccctcttgcatggacgaggaatgcatgttgcccagtgagccgagctcctcacctcgcgatttctcgccaagctcacaccatagctcgcctggttatgacagttccccatgtagagacaactcaccaaagagatacctcatacctaagggagatctcagcccacggcgacacctgtccccacgaagggatctgtctccaatgagacatctgtccccacggaaggaagctgccctgaggagagaaatgtcacagcgcgatgtgtcacctcgtcgccacctgagtcctaggcgccctgtttctcccggaaaggacataacagctcgacgcgatctgagccccaggagggaaaggagatatatgacaaccattagagccccaagccctaggcgggctctttatcacaatcccccactgtccatggggcagtatcttcaggccgagccaatagtcctcggccctccaaacttacgaagagggctgccccaggtgccatacttttccttgtacggagaccaggaaggcgcttacgaacaccctggtagctccctgtttccagaaggacctaacgactacgtcttttcacaccttccacttcattcccagcagcaggtacgagctcccataccaatggtgcccgttggagggatccaaatggttcactctatgcctcccgcactaagttcccttcaccccagtcctaccttgcctctgccaatggagggctttgaggagaagaaaggggcttctggagagagcttttcaaaggacccctacgtgctgtcaaaacaacacgagaagagaggaccccacgctctgcagtcttccggccctccttctaccccttccagccccaggttgttgatgaagcagagcacctccgaagactccttgaacgccaccgagcgcgaacaggaagaaaacatccaaacttgtacgaaagccattgcgtccctgagaattgccaccgaagaagcggcactgttagggccagaccagcctgccagagtgcaggagcctcatcagaatccactcggaagtgcccatgtgtcaatcagacacttcagcagacccgaaccaggccagccctgcacatctgctactcaccccgacttgcacgacggcgagaaggataacttcgggacgtcccagacacctctggcccattctacgttctactcaaagtcgtgcgtcgacgacaagcagctcgatttccactcctcgaaggagctgtcttctagcactgaagaaagcaaggacccaagtagcgaaaagagtcaacttcacta

SEQ ID NO: 226423 - DNA, 7221 bp, Artificial Sequence
  Description of Artificial Sequence: Synthetic coding sequence
atggaccccgagcaaagtgtgaagggaacaaaaaaggccgagggcagccctaggaagcgcctgaccaaaggagaggccattcagacgtccgtctcaagcagcgtcccttacccaggcagtggaaccgctgctactcaggaatccccagctcaggaactgttggcacctcagcctttccctggaccttcatcggtgctcagagagggaagtcaggaaaaaactggtcagcagcagaagcccccaaaacggcctccaattgaggcatcagtccatatatcgcagctcccgcagcatccccttacacccgcattcatgtctccaggtaagccagagcacttgctggagggaagtacttggcagctcgtcgatcctatgcggcctggccctagtgggagctttgtagcaccaggcctacatccccagagtcagttgttgccatcgcacgccagcataatcccaccagaagatctacccggagtccccaaagtatttgttccgcgaccatcccaagtatccctcaagccaactgaagaagctcacaagaaggaaagaaagccccagaagcccggtaagtatatctgtcaatactgctccaggccatgcgcaaaacccagcgtgctccagaagcacatcagaagccatacaggggaaaggccttacccctgtggcccatgcggattttcttttaagactaagagcaacctctacaaacatcggaagagccatgctcaccgcattaaggccggactggcctccggcatggggggtgagatgtaccctcatgggctggagatggaacgcatccctggagaggagtttgaggagcctaccgaaggcgagagcactgatagtgaggaggaaacatcggccacttctggacaccctgccgagttgagcccacgaccaaaacagcctctactgtctagtggtctttatagctcaggctcacattctagctcacacgagcggtgcagcttatcacagtccagcacagctcagtcccttgaagatccaccccctttcgtcgaaccgtcttctgagcacccattaagccataaacccgaagacacgcatacaattaagcaaaagttagctcttagattgagcgaaagaaagaaggtcattgatgagcaggccttcctatccccagggagtaagggaagtactgagtctgggtacttctccagatccgaatccgccgagcagcaggtatcacccccaaacacaaatgcaaaatcttatgcagagattatctttggcaagtgtgggcgaattggacagaggaccgctatgctcaccgccaccagtactcagcctctgcttcccctgtcaacagaagacaagcctagcttggtgcccctctcagttcccagaacacaggtcatcgaacatattacaaaattgattactattaacgaagcagtggttgataccagcgaaatagacagtgtaaagcccaggcgtagcagcttgtctcgacgatcctcaatggagagccccaagtcctcgctgtaccgcgagccgttgtctagccattccgagaagacaaaaccggagcagtcactgttgtccctccagcatccgccatctaccgccccacccgtgcctctcctgcggagccactcgatgccttcagctgcctgcactatctccaccccacaccacccgtttagagggagctactcatttgatgatcacattactgacagtgaagctctatcacacagtagtcatgtttttacctcacatcctcggatgttgaagcggcagccagctattgaactccctctgggaggtgagtacagttctgaagagcccggaccctcctctaaagacacagcctcaaagccctcagacgaagtagaaccgaaagagagcgaactcacaaagaagacaaaaaagggactgaagacaaagggggttatctatgagtgcaatatttgcggggctcggtacaagaaacgggacaattatgaagcacacaaaaaatattattgcagtgagttgcagatcgcaaaaccgatctccgcaggcacccacacctcacccgaagccgagaagagtcaaatagagcacgaaccatggagccagatgatgcattacaagcttgggactactcttgaactgaccccgttgagaaagcgtcggaaggagaaaagtttgggggacgaggaggagcccccagcgttcgaatccaccaagtctcagtttgggtcacccggaccctccgacgctgcaaggaatctcccccttgagtccaccaagtccccagcagagccttcaaagtctgtcccaagcctggaaggcccaaccggcttccagcccaggacacctaagccgggtagtggatccgagagcggaaaggaacggcgaactacatcaaaagaaattagcgttatccagcatacctcaagttttgagaaatccgactctttagagcagccctcagggctggagggagaagacaagcccctggcccagtttccatccccaccacccgctccacacggcaggagtgctcattctttacagcccaaactcgtccgacagcctaatatccaggtccctgagatacttgtcacggaggagcccgaccgtccagatactgaaccggagcctcctcccaaggagcccgagaaaaccgaggaattccaatggcctcaacggtcccagacacttgcccaactccctgctgaaaagctgccaccaaagaaaaagagacttcggctagctgagatggcccaatcctccggagaatccagctttgagtctagcgtgcctttgagccggtctccaagccaagagtctaatgtctctctgagtggatccagcaggtctgctagtttcgaacgggacgatcatggcaaagcagaggcccctagcccaagctccgacatgagaccgaagcctctgggaactcacatgctgacagtgccctcacaccacccccatgctcgggagatgcgacgctccgccagcgaacaatcccctaacgtcagccactccgcgcacatgaccgaaaccagatccaagtcctttgactacgggtccctatctctgacaggcccatccgccccagctccagtggctcctcccgcaagagttgcccctcccgaacgacggaagtgtttcctagtcagacaggccagcctctctcgaccaccggaatccgagctggaggtggcacccaaaggtcgccaggagagcgaggaaccccagccatctagtagcaagcctagcgctaagagcagcctgtctcagatctctagtgcagccaccagccacggaggacccccaggagggaagggccctggccaggatagacctcctctggggcctacggtaccgtacaccgaggcccttcaagtgtttcaccatcccgttgcccaaacccccctgcatgaaaaaccctatctccctcctcccgtatctctgtttagctttcagcacttagtccaacacgagccaggtcagtccccagaattcttctcaactcaagcaatgagcagtctgctgtcctccccctatagcatgccaccactgcctccttccctctttcaagcccctccgctgccactgcaacccacagtgttacaccccggtcaattgcatctcccccaactgatgccgcacccagccaatatacctttccggcagcccccttctttcctgccgatgccctaccctacaagttccgccctctcaagcggcttcttcttacccctgcagtcacaattcgctctgcagctcccgggagatgtcgagtcacatttgcctcagattaaaacaagcctggcccctctggccaccggcagcgccggactgtccccaagtacagagtactcttccgatataaggctgccacccgttgctcccccagccagttctagtgccccaacttctgcccctccccttgccctgccggcatgcccggatacgatggtgtctctagttgtccctgtgcgtgttcagacaaacatgccaagttatggatcagcaatgtacaccacactgtctcagatattggtcacgcagagccagggctcaagtgcgactgtcgctctccctaaatttgaggagccaccatccaagggtaccaccgtatgcggggctgacgttcatgaagtggggcctggcccttctggattgagtgaggagcagagccgcgctttccctaccccttatttgcgtgtccccgtcactttacccgagagaaagggcacttccctgtcctctgagagtattctgtcgttggaaggctctagttccacagcaggtgggagtaaaagagtgctgagcccagctggatctctggagttgacgatggaaacacagcagcaaaagcgcgtgaaagaagaggaggccagcaaggcagacgagaaactggaacttgtgaagccttgctccgtggtactgacctctacggaagacggcaaacggcctgagaaaagccaccttggtaatcagggtcaaggccgacgtgagctggagatgctctcctcattgtcctccgaccccagcgacactaaggagatcccccctcttcctcatcctgcgctgagtcacgggaccgccccaggaagtgaggctctgaaggagtatccccagccaagcgggaagcctcaccggagggggttgaccccactgtcagtcaagaaggaggacagcaaggagcagcccgacctcccgtcactggctccacccagcagtctccccttgtcggagacttccagccggcctgcaaagagtcaggagggtaccgattccaaaaaggtgctgcagtttccatctttgcacacaaccaccaacgtcagctggtgctacctcaattacattaaacctaatcatatccagcatgctgataggcgatcttctgtttatgccggatggtgtatttcactctacaatccaaatctgccgggagtcagtactaaagcagctctcagcttactgaggtctaaacaaaaggtctcaaaggagacctatactatggcaaccgcccctcacccggaagccggacgattagtgccttccagcagcagaaagccccgaatgactgaagtgcatctgccctccctggtatcccccgagggtcaaaaagatctggccagggttgagaaggaggaagagcgacggggtgaacctgaagaggatgcacccgcatctcagcgcggtgagcctgcacggattaagattttcgagggaggctataagagtaacgaggaatacgtgtacgtacggggacggggtcgtggaaagtacgtttgtgaggagtgtggcatcagatgcaaaaagcccagcatgcttaagaagcatatcagaacccatacagacgttcggccttatgtgtgcaaacattgtcactttgccttcaagactaaggggaacctgaccaaacatatgaaaagtaaagctcactcaaagaaatgccaagagaccggggtcttagaggaattggaggccgaggaggggacatctgacgacctatttcaggattccgaaggtcgcgaaggatccgaggcggtcgaggagcaccaattttccgaccttgaagatagcgacagcgacagcgatctggacgaggatgaggacgaggacgaggaagaatctcaagatgaactatcgaggccgagttccgaggcaccaccacccggtccgcctcatgccctccgggcagattcatcccctattttaggaccccagccaccggatgcccctgcctcgggaactgaagcgacccgaggctcgtccgtgtctgaagccgagcggctgacggcatcctcatgctcaatgagtagccagtcaatgcccggacttccttggttgggaccggcacccctggggtcagtggaaaaagacaccggatccgcactcagctacaagccggttagcccgcgacgaccgtggtcaccttcaaaggaagccggatcccgaccccctctggctaggaagcactcacttacaaagaacgacagttccccccagcgctgctcccctgcgcgagaaccacaggcttccgcccctagtccccctggactacacgtagaccctggaaggggtatgggagccctgccatgtggatctcccaggctacagttatcccccctgactttgtgccccctcggtcgcgagctagctcctagagcgcacgtgctgtccaagctggagggtaccaccgatccaggcttgccgagatactcccccacacgaagatggtcccctggtcaggctgagtccccccctcgctctgccccacccggtaagtgggccctggccggacccggatcacccagtgccggagaacatgggccagggctcggcctcgatccgcgtgtgctgttccctcccgcaccactcccccataagctgctcagccggagccccgagacttgcgcatccccctggcagaaagctgagtccaggagcccaagctgtagtcctggcccagcccacccattgtcctcgcgcccattttccgccctgcacgatttccatggtcatattttggcccgaaccgaggaaaatatctttagccatttgcccctgcactcccagcaccttactcgagctccatgtcctctcatcccaataggcggtatccagatggttcaagctcggcctggagctcaccccaccctgttgccaggccctaccgcggcttgggtgtctggtttctcagggggaggatccgacctcactggggctcgcgaggcgcaggagcgcggaaggtggtcccccaccgagtctagcagcgcttctgtatccccagttgcgaaagttagcaagttcacactgtcctcggagctggaggggggtgattatccaaaagagcgcgaacgtaccgggggaggtcccggaaggccaccagattggacgccacatggcacaggcgcacccgcagagcccacccctacacattctccgtgcacacctccagacacgcttccaaggccacctcaggggagacgggctgcccaaagttggtctcccagactggagagcccccgagccccaacaaaccctgaaccctctgcaaccccccctctcgaccggtcatcaagcgtcggatgtttggccgaagcctccgccagatttccagcccgtacgcggaacctgtcaggagagccccgaacccgtcaggactctcctaagcccagcgggtctggcgaacctagggctcacccgcaccagcccgaggatagggtgccccctaacgcctac

SEQ ID NO: 226424 - DNA, 7220 bp, Artificial Sequence
  Description of Artificial Sequence: Synthetic coding sequence
atggaccctgaacagagcgttaagggtaccaagaaggctgagggttctccgaggaagagactaactaagggggaggctattcagacatccgtgagcagcagtgtgccttatcctggttcaggaaccgccgctacacaggaaagtccggcacaggaactccttgctccccagccattccccggaccttcttctgtactgcgtgagggctcacaggagaagacagggcaacagcagaaacctccaaagcgccctcctatcgaagccagcgttcacatctcccaactgccgcaacatcccctgacacccgcattcatgtctccaggtaagccggaacacctcctggagggctccacctggcaactggtggaccctatgaggccgggtcccagcggaagtttcgtggccccaggtctgcaccctcagagccaactactgccttcgcacgcctcaattatccctcctgaggatctgccaggggtcccaaaagtttttgttcccaggccgtcacaggtatctttgaaaccaacagaagaagctcataagaaggaacgtaagccccagaaacccggaaaatatatatgccaatactgtagccgcccatgcgctaagccatcagtacttcagaaacacatacggtctcatacaggagaaaggccgtatccttgcgggccttgtggtttcagctttaagaccaagagcaacctgtataaacacagaaagagccatgcacatagaattaaagcaggcctggcctccggcatgggcggagagatgtatccacatgggttggaaatggaaaggattcccggagaggaatttgaggagcctaccgagggggaaagcaccgacagtgaggaagagacttcagctacctctggacaccctgcggagctttctccaagacccaagcaaccactactctcctcgggactctactctagcgggagccactcctcctcacacgaaaggtgtagtctaagtcagtcttctacggcccagtcattggaagacccacccccttttgtggagccctcaagtgaacacccactaagtcacaagcccgaggatacccacacaatcaagcagaaactggcgctgagactttcagagagaaagaaagtgatcgatgaacaggcttttctaagcccaggcagtaaaggatccaccgagtctggatactttagcagaagcgagagcgctgagcaacaggtatcccctccgaacactaacgctaagtcttatgccgagataatctttgggaagtgcggacggattggtcagcggaccgccatgctgactgctacttcaacccagcctttgcttcccctctccacggaggacaagccgagtcttgtccctctgtccgtaccacggacgcaggtcattgagcatatcacgaagctaatcacgattaatgaggcggtagtagatacatcagaaattgactctgtcaaaccacgcaggtcctccctatcccgcaggtcctctatggagagtcccaagtcctctctctacagagaacccctgtcttctcattctgaaaaaaccaaacccgagcagtcactactcagccttcaacaccccccttctacagctccaccggttcctcttttacgttctcactcaatgccctcggctgcctgtacaatatcgaccccacaccatcccttccgaggtagctattcattcgatgaccacataacagactcagaggccttatctcactcttctcacgtcttcacaagtcacccgaggatgctcaagcgtcagccagcgattgaactcccactcggaggcgaatattctagcgaagagccaggacccagtagcaaagatactgcttcgaagccaagcgatgaggtcgagcccaaggaaagcgaacttacaaaaaagacaaagaaaggccttaagaccaagggcgtgatatatgagtgcaacatctgcggcgctagatacaaaaaaagagataattacgaagcgcacaagaagtactactgttccgagttgcaaattgcaaagccaatctctgcagggacccacacctccccagaggccgaaaagtctcaaattgaacacgaaccttggagccagatgatgcattataagctggggacaaccttggagctaactcctctgcggaaacgccgaaaagagaaatctctgggggacgaagaggaaccgccagcatttgaatccacgaagagccagttcggatctcctggccctagtgacgccgctaggaatctgccactggagagtactaaaagcccagctgaaccaagtaaatccgtgccctcactggagggacctaccggctttcagccccgtacacccaagcccggttctggttccgaatcgggcaaggagcgcagaaccacctctaaggagattagcgtgatacagcacaccagctcctttgaaaaaagcgactcgctggagcagcccagcggcctggagggagaggataaacctctggcacagtttccgagtcctccacctgcaccccatggcagatcagcacattccctacagcccaagctcgtaaggcagcctaatatacaagttcctgagattctggtcaccgaggagccggaccgccctgacacagagcccgaaccacctcctaaggagcctgagaagaccgaggagtttcagtggcctcagaggtctcagacgctggctcagttgcccgctgaaaagctgcctcccaagaaaaagcggctgagacttgctgagatggcccaaagctccggcgaaagtagtttcgagtcctccgtgccactgtctagatctccttctcaggagagtaatgtgagcctgtccggcagctctagatctgcttccttcgaaagagatgatcacggcaaagccgaagctccatccccatcctccgatatgagacccaagcctctgggcactcatatgctgacggtacctagtcatcacccacatgccagagaaatgcggaggagcgccagcgagcagtccccgaacgttagtcactccgcccacatgaccgagactcgatctaaatcatttgactatgggagcctatcactgaccggtcccagcgctccagcccctgtggcccctccagcacgcgtggccccacccgaaaggaggaagtgctttctcgtacggcaggccagtttaagtcggcctcctgagtccgaactggaggtcgctccaaagggtaggcaagagagtgaagagcctcagcccagtagcagtaagccttcagccaagagctcgctgtcccagatctctagtgccgcaaccagtcacggaggccctccgggaggcaaaggcccaggtcaggatcgacctccattggggcctacggtgccttacaccgaggccctgcaggttttccatcacccagttgctcaaacacctctccatgaaaagccttacctaccccctccggtatctctgttcagtttccagcatctggtgcagcacgaacctgggcaaagcccagagttctttagtacccaagctatgagcagtcttttatctagcccctattcaatgccccctctgccaccttcattgttccaggccccacccctgcccttacagccaactgtgctacacccaggccaactccacctcccccaattgatgccccaccccgctaacattcctttcagacagcctccttcttttctgccaatgccctaccctacctcaagcgccctgtcaagcggcttcttcctgcctctgcagagccaatttgccctccaactccccggtgacgttgaaagtcacctgcctcagatcaagacttccctcgcccctctagccacaggcagcgcagggttgagtccgtccacagagtactcatccgacatccggctcccccctgtcgctccacccgctagcagtagcgctcccacatcagccccacccctggctctgccagcatgccccgataccatggtgtcactggtcgtgccggtgcgagtgcagaccaacatgcctagctatgggagcgcaatgtacacaacactaagccagatacttgtaactcagagccaggggtcaagcgccacggttgcattgcccaagttcgaagagcccccaagtaaaggaaccacggtgtgtggggcagatgtgcatgaagtgggcccaggcccttccggcctcagtgaggagcagtcccgagctttccctacaccctatctgcgggtcccagtgactcttccagagcggaagggaacctcactgagttctgaatcaattctgtctctggaaggcagctcatctactgccggagggtctaaacgggtgctaagcccagcaggaagcctagaattgactatggaaacacaacagcagaagagggtcaaggaggaggaggcttcaaaggcagatgagaagctggaactggtaaaaccgtgcagtgtggtcctgactagtacagaggacgggaagcggcctgaaaagtcccatttggggaatcagggacaagggcgaagagaactggaaatgctgagctctttgtcttccgacccatctgatacaaaggagatccctcccctgcctcaccccgcactctctcacggtaccgcccctggtagcgaggccctcaaggagtatcctcagcccagcgggaaaccccacagaagagggctgactcccctgagtgtcaagaaagaggactcaaaagaacagcctgatctcccgtctctagcaccgcctagttcattacctctgtcagaaacgtcctctcgcccagccaagtctcaggaaggcacggattccaagaaagtgctgcagttccccagcctgcacacgactaccaacgtctcctggtgctacttaaactacataaaaccgaaccatattcagcatgcggaccggagatcctcggtctatgctggctggtgtattagtctttataacccaaatctgcctggtgtctcaaccaaagcggcactatcgttactaagatctaaacagaaggtttccaaggagacctacacaatggcaaccgcgcctcaccctgaagctggtcgccttgtgccttcatcctctcgaaaacctcggatgaccgaggtccacttgccctcactcgtcagccccgaaggccagaaggatctggcccgagtcgagaaagaagaagagcgcagaggtgagcccgaggaagatgcacccgcatcccaacgtggcgaacctgcaagaattaaaatttttgaaggcggttataaatctaacgaagaatatgtatatgtaagaggacgcggacgcggtaagtacgtatgtgaggagtgtggcattcgctgcaagaagccatctatgctcaaaaagcacatcagaacacataccgatgtgcgcccttatgtttgcaaacactgtcattttgcatttaagactaaaggtaacctcacaaaacacatgaaaagtaaggctcacagtaaaaagtgccaggaaacaggcgtcctggaggaattggaggctgaggaaggtactagcgatgacttgtttcaggatagcgaaggccgtgagggctccgaggcggtcgaggaacaccagtttagtgatctcgaggactcggattctgactctgaccttgacgaagacgaggatgaagatgaagaggagagccaggacgaactctcaaggcccagtagcgaggccccaccacctggccctccccacgctctaagggccgatagctccccaatattaggcccacagcccccagacgcccctgcatctggtacagaggcaacaagaggaagcagcgtgtccgaagccgagcgcctgaccgccagctcctgttccatgtccagccaatcaatgccagggcttccttggctaggtccagcgcctcttggatccgtggagaaggacacgggctccgcactgagctacaagccagtgtccccgaggagaccctggagccccagtaaggaagctggttctcgcccacccctggcacgaaagcactccctgacaaaaaatgactcatcccctcagcggtgttcacctgcaagggagcctcaagcttccgctccctccccgccaggcctgcacgttgacccgggtcgtggcatgggggctctgccctgtggatcacccagattgcagctgtcccctttaaccttatgtccactcggcagggagctcgccccaagggctcatgtgctgagtaagctggaaggaacaaccgaccccggtctgcctagatactcgccaacgcgtaggtggtcccctggccaggccgagagcccaccaagatctgcccctcccggtaaatgggcccttgcagggcctggctcgccttctgccggagagcacggcccaggcctcggcttggatccaagggtgttgtttccgccagcacctctgccacataagttgctgtccagatcgcccgaaacttgcgccagcccttggcagaaagctgagtcccgttccccttcgtgcagtccagggccagctcaccccctgagttccagacccttcagcgccttgcacgattttcacggccatatcctggctagaacagaagaaaatattttcagccacctgccactgcacagccaacacttaacccgagccccttgtcccttgatccccatcggaggcattcagatggtgcaggcccgtcccggagctcatcccactctgctgccagggccaaccgcagcatgggtctcaggattctctggaggcggtagtgatttgactggggctagagaggcgcaggaacgcggtagatggagtcccacagagagttcttcggcaagtgtgagccctgtagcaaaggtgtctaagttcacattgagctccgaattggaaggcggagactaccccaaggagagagagcggactggcggtggccctggcaggccaccggactggacccctcacggcacaggtgccccagcagagcccactcctacccatagtccatgcacccctcccgacacactgcctcgacctcctcagggtcgcagggccgcacagtcttggtccccccgtttagagagccctagggcccctaccaatccagaaccctctgcgacacctcccctagaccgctcaagctcagtgggatgccttgctgaagcttctgccagatttcccgcaagaactagaaacttgagcggagaacctcgcaccagacaggacagcccgaagccatcgggttctggtgaaccccgagcccacccacaccagccagaagatcgcgtgcccccaaacgcgta

SEQ ID NO: 226425 - DNA, 7217 bp, Artificial Sequence
  Description of Artificial Sequence: Synthetic coding sequence
atggatcctgagcagagtgtgaaagggaccaagaaggcggaagggtcccctcgaaagcgcctgactaagggggaagcgattcagacgtccgtgagctcgtctgtgccatatcctggcagtggcactgcagcgacacaggagagcccagcccaggagttgctcgctccacagcccttccctgggccaagttcagtcttgcgggagggcagccaggaaaaaaccggccaacaacagaagccacccaagcgtcctcccatcgaggcctctgtgcatatttctcaactgcctcaacatccgctgacaccagcttttatgtcccccggaaagccagagcacttattggagggaagcacctggcagctggtggatcctatgcggccaggaccctccggtagtttcgtggcccctgggttgcaccctcagtcccagttgctgccgagtcacgcctctatcattccacccgaggacctccctggcgtgcctaaagtttttgtgccacgtccgtctcaggtgtcgttgaagcctaccgaggaggcacacaagaaagagaggaagccacagaagccgggaaaatatatctgccagtactgctcccgaccttgtgctaagccatcagtgctgcagaaacacatccgatcacacaccggtgagcgcccttacccgtgtgggccatgcgggtttagcttcaaaaccaagtctaatttatacaaacatagaaaatctcatgcccacagaattaaggccggactggcgagcggaatgggcggagagatgtacccccatggcctcgaaatggagcgaatccccggtgaagagttcgaggagcccaccgagggcgagtccaccgactctgaagaggaaacaagcgccacatccggacatccagccgaactgagtccccgtcctaagcagccactcctatctagcggcctgtacagttctgggagccatagcagttctcatgaaagatgttccttgagccagtcttcaacggcccagtctctagaggatccgccacccttcgtcgagcctagctccgagcatccactaagccacaagcctgaggatactcacactatcaaacagaaactggctctaaggctgtcagaacggaaaaaagttatcgatgaacaggctttcctctcgcccggatccaaagggagcactgaaagcggttacttctctcggtccgaatctgctgagcagcaagtgtcaccaccgaatactaatgccaaatcttacgcggagattatcttcggaaagtgcggaagaattgggcagagaaccgcgatgttgactgctacttcaacccaacccctcctacccctctctactgaggacaagcccagcctggtgcctttatccgtaccacgaacgcaggtgatcgaacatattactaagctgataaccatcaacgaggcagtggtggacacttccgagatcgatagcgttaagcccagaagaagtagcctaagtcggcgaagtagcatggagtccccaaagtcatctttgtaccgcgagcccctgtcttcccacagcgaaaaaaccaaaccggagcaaagcctgttatctctacagcatccaccctccactgcgcctcctgtcccgctactgcgatcacactccatgccctcggccgcttgcactatctccacgccccaccatccgttcagaggctcatacagtttcgatgaccacatcacggacagcgaagccctgtcgcactcaagtcacgtcttcacatcccatcccagaatgctcaaacgtcagccggctatcgaactgccccttggaggggagtactcgagcgaggagcctggacccagctctaaggatacagccagcaagccaagtgatgaggttgagcctaaagaaagcgaactcacaaaaaagactaaaaagggactgaagaccaagggagtgatttacgagtgcaacatatgcggcgctaggtacaaaaagagggataattacgaagcacacaagaaatactactgtagcgagctccagatagctaagcccatctctgcaggaactcacactagccctgaggctgagaaatcacagatagagcacgagccctggtcccagatgatgcattataagttagggaccactttggagctgacccccctacggaaacgcagaaaggaaaaatctctcggcgacgaggaggagccacccgcatttgaaagcactaagtctcagtttggcagcccaggtccctccgatgctgcgagaaatctccccctagagtccaccaagagcccagccgagccgtccaagtcggtcccgagtttggaagggccaaccggtttccaaccaaggactcctaagccaggtagtggttctgaaagcggtaaagaaagaagaacgacgtcaaaggaaatctcagtgatccagcatacaagcagcttcgagaagtccgatagcctcgagcagccctctggcttggagggggaggataagcctctcgcccaatttccatctccacctcctgcccctcacggtagaagcgctcactccctgcaaccaaaactagtgcgccaaccaaacatccaagtgcccgaaatcctagtcactgaggaacctgaccggcctgataccgagccggagccccctcccaaagagccagagaaaactgaagaatttcagtggccacagcgctctcaaactctcgcccagttgccagccgagaaattgccgcctaagaaaaaaaggctcaggctcgcagagatggcacagtcatccggtgaatcctcgttcgagtccagcgtgccgctgagtcgaagcccgtcccaggaaagtaacgtctccctctctggttcttcgcggagcgcgtccttcgagagagacgatcacggcaaagccgaggcaccctctccttcatctgacatgcggcctaagccactcggtacacatatgttaacagtgccatcacaccatccccatgctagggagatgcggcgttctgctagtgaacagagccccaacgtgtctcacagcgcacacatgacggaaacacgctcaaagtccttcgactatggatctctgtccctgaccggacccagcgctcccgctcccgtcgctcccccagctcgggtggcccctcccgaaaggaggaaatgttttctggtgcggcaagcctccctcagccggccacccgagtccgaactggaagttgcaccaaagggacgccaggaatccgaggaaccacagccttcttcatctaagccctccgcaaaatcttcactttcgcaaatttcctccgcggcaacgtcccatggcggacccccaggcggtaaagggccaggacaagacagaccaccattggggccaactgtgccttacactgaggctctgcaggtttttcaccaccccgtggcccagacacccctgcatgaaaagccttatctgccacctcctgtgtcactcttctcttttcaacacctggtacagcacgaaccgggtcagtcccctgagttcttcagtacacaggcgatgtcgagtctgctcagcagtccttactccatgccaccgttgccgccaagtctgttccaggctccacccctgcccttgcagcctaccgttctgcaccccggtcaattacatctgccccagttgatgcctcaccctgccaacatcccattccggcaaccacccagctttctgcctatgccctatccaacgtcttccgcattatcatcagggttcttcctgcccttacagagccagtttgctctgcagctgcctggggacgtcgagagccatctgcctcaaattaaaacatctctggcccctttggccactggatcagccggattgtcaccaagcactgaatactcgtcagatatcaggctcccaccggtggccccacctgcctcaagctcggctcctacttccgccccacctctcgccctgcctgcttgccctgatacgatggtgtctctggtcgtccctgtccgagtccagaccaatatgccatcttatggatcggctatgtacaccacattatcccagatccttgtgacacaaagtcaagggagctcggcaacagtggcactacccaaatttgaggaacctcctagcaagggtaccacagtgtgcggcgcagacgtgcacgaagttgggccaggaccaagcggactgtctgaagaacagtctcgggctttccctaccccttatctgagagtgccagtaacacttcctgaaagaaaggggacttctctctcttcagaatctatcttgtctctagagggtagctccagcaccgccggaggctctaagagggtgctatctcccgcaggttcgctggagttaaccatggagacccaacagcaaaagagggtcaaagaagaggaagctagtaaggccgacgaaaagcttgagcttgtaaaaccttgttccgtggttctgacctccacagaagatggcaagaggcccgagaagagccacctcggtaatcaggggcaaggccgacgcgagctggagatgctcagtagcctgtcaagcgacccctctgacactaaggagatccctcccctgccacatccagctctctctcatggcaccgcgcctggaagcgaagcgcttaaggaatacccacaacctagtggcaaaccacacaggcggggactcacacctctgtccgtcaagaaggaagactccaaggagcagcctgatctcccctccctcgcaccacccagcagcctgccactgtcagagacctcctctcggccagcaaaatcacaagagggaaccgatagtaaaaaggtgttgcagtttccatctctgcatacaactaccaacgtgtcctggtgttatttgaattacattaaacccaaccacatccagcatgcggacagaagatcctccgtgtacgctggatggtgcatatctctttataatcccaacctgccaggagtgtcaactaaggcggctctgagcttgctccgtagtaagcagaaggtctcaaaggaaacctatactatggcgactgcccctcatcctgaggccggaaggctggtgccgtcaagctcgcgaaagccacgcatgacagaagtccatctgccatctctggtgtctcccgaagggcagaaagacctggcaagggtggagaaggaggaggagaggaggggggaaccggaagaagacgcgccagcttcacaacgcggtgagccagctaggataaaaatcttcgaagggggatacaagagcaacgaggaatacgtctacgtgcgaggacgcggaaggggcaaatatgtatgtgaagagtgtgggattcgttgtaaaaaacctagcatgttgaaaaagcatatccgcacccacaccgacgtacggccttacgtgtgtaagcactgccatttcgcgtttaagacgaaaggaaatctgactaaacatatgaagtccaaggcacatagcaaaaagtgccaggagaccggagtgctggaagagctggaggcggaagagggtacctctgacgatctcttccaggattccgagggcagggaaggctctgaggctgtggaggaacaccagttttctgacctcgaagattccgacagcgactctgacctggacgaggatgaggacgaggacgaggaagagtcacaagacgaactttcaagaccatcctccgaggctcctcctcctgggcctccccatgccctgcgggcagattccagtcccattctgggcccacaacccccagacgctccggcatcaggcaccgaggcgacacggggtagcagtgttagcgaagcagagcgcctgacggcaagcagctgtagtatgagcagccagagtatgccgggtctaccttggctgggacctgcgccactgggttctgtggaaaaggatactggttctgcgctctcctacaagccagtgagtcctcgccgaccatggtcgccatctaaggaagcaggtagccggcctccactggccagaaaacactccctcaccaagaacgatagcagcccacagaggtgcagtccggctcgcgaaccacaagcgagtgcccctagcccacctgggttgcacgtcgacccgggtagagggatgggagctctcccatgcggctcccctcgcctgcagctgtcacctcttacgctttgtcccctgggtagagaactcgctccacgggctcacgtgctgtcaaagctggaagggactacagaccccggactgccgaggtattctcccacgagaaggtggtccccaggccaggccgaaagccctcccagatcagccccacctggtaaatgggccctggccggaccaggctccccctctgctggagaacatggccctgggctcgggctagaccccagagttctgttcccaccagccccactcccacacaagctgttgagcaggtcacccgagacttgcgctagcccttggaaggcagagtcccgtagcccctcgtgctcacctgggccagctcatccattatcctcaaggcccttttccgccctccatgactttcatgggcacattttagccagaaccgaggagaatatattcagtcacctcccactgcactcccaacacttgacccgggctccgtgcccacttatccctatcggtgggatccagatggtgcaagcacggccaggtgcacatccgactctgctcccaggccctacagcagcttgggtaagcggtttttctggcggtggtagcgatctcacgggtgcgcgagaagcccaggagcggggaaggtggtcacccactgaatcgtcatcagcgtctgtctccccggtagctaaggtttccaaattcacactctcttccgagctggaaggtggcgactatcctaaggagagggagcggaccggtgggggtcccggtcgcccaccagactggacccctcacgggacaggggcacctgctgaaccgactccaacacacagcccatgtactccaccggacaccctgcccagacccccacagggtagaagggctgcccaaagctggagcccccgattggagtcacccagggcccctaccaaccctgagccaagtgcaacaccaccactcgataggagcagctctgtgggatgtctggccgaggcttcggcgagattccctgcccgaacccggaatctctctggggaacctcgaactagacaggattctcccaagccctcagggagcggagagccacgcgctcacccccaccagcccgaagatcgcgtaccacccaatgccta

SEQ ID NO: 226426 - DNA, 7217 bp, Artificial Sequence
  Description of Artificial Sequence: Synthetic coding sequence
atggatccggagcaaagcgtcaagggcaccaagaaagcggagggctcaccgaggaaacgtttaacaaagggggaagccatccagacctctgtgtcttcctcagtcccatatcctggttccggtaccgctgccacgcaagagagccctgcacaggagctgcttgctccacagccattccccggaccaagcagcgtgctgagagagggatcacaggagaagaccggccagcagcagaaaccacctaaacgccctcccattgaagcctccgttcatatttcccagctcccacagcatcccctaacacccgcttttatgtctccaggcaagccagagcaccttctcgaggggtcaacctggcagctggtggaccccatgcgtccgggtcccagtggctcatttgtggctcccggactccatccccagtcccagctcctgccttcacacgctagcattatacctccggaggacctgccaggagtcccaaaggtatttgtcccccgaccctcacaggtgtctctgaagccaaccgaagaggcgcataagaaagaaagaaagccgcaaaaaccagggaagtacatctgccagtattgtagtagaccatgcgccaaaccatccgtcctccagaaacacattcgcagccataccggtgagagaccttatccatgtgggccttgcggattctcattcaagacaaagagtaatctgtataaacaccggaaaagtcacgcccatcggattaaagcagggctggcttccggaatgggcggagaaatgtaccctcacggtttagagatggagaggattccaggtgaggagtttgaagagcctacagaaggtgagtccaccgactcagaggaggaaacatctgcaacctctggtcatccagccgagttatcacctagaccaaaacaacccctcttgtcatctgggctgtatagcagtggcagtcacagcagttctcacgaacggtgcagtctgtcccaatcctctacagcccagtcattagaagaccccccaccttttgtggagcctagcagcgagcatcctctatcgcacaagcccgaggacacccatacgataaagcagaagctcgcgcttagactttcagagcgtaagaaggtcattgacgagcaggcgttcctgtcccctgggagcaagggctctaccgagagcgggtacttttccaggagtgaatcagccgagcagcaggtaagtcctcccaataccaatgccaagtcctatgcagagatcatcttcggcaagtgcggtcgaatcgggcagcgtactgcaatgctgactgctactagcacccagcccctgctgccgctctcgacagaagacaaaccttccttagtacctttgtctgtacccaggacacaagtcatcgaacacataacaaaactcatcactatcaatgaagccgtcgtcgacacctcagaaatagatagcgttaagccaaggagaagctctctatcacgaagatcctctatggagtcaccgaaatcctcactgtaccgcgagccccttagctcccattccgagaaaacaaagcccgagcaaagcctgctgagcttgcagcatcccccaagcaccgcaccacctgtgccccttctgaggagccacagcatgccttccgcagcatgtaccattagcactccacaccacccgttcagaggtagttacagtttcgacgatcatatcaccgacagcgaagcactaagtcattcttctcacgtttttacttcacatccacgtatgttgaagcgtcagcccgcaatagagttgccacttggaggagaatacagctctgaagagcctgggccaagcagcaaagataccgcttccaagcctagcgacgaagtggagccgaaggagagtgagctcaccaaaaagacaaaaaagggactgaagactaaaggggtaatctatgaatgtaacatatgcggtgccaggtataaaaagcgggataattacgaggcccacaagaagtactactgcagcgaactgcagattgcaaaaccgatttctgccggtacacacaccagtcccgaagccgagaaatctcaaatcgaacatgaaccatggtcacaaatgatgcactacaagctgggaacgaccctggagctaacaccgctgagaaaaagacgaaaggagaagagcctgggggacgaagaagaacccccagcttttgagtcaacaaagtcacagtttggcagcccaggacctagtgacgcagcgcgaaacttgcccctcgagagcacgaaatctccagccgagccttccaaatctgttccatcattagagggacccaccggtttccaacctcgcacccctaaaccagggagcggctcagaatctggcaaggagcgcagaaccacatccaaggaaattagcgtgatccagcatacaagtagtttcgagaaatccgattctcttgaacaaccatccggattagagggtgaagacaaaccacttgcacagttcccctccccgcctccggcaccccacggacgatccgctcactctctgcagcctaagctagtacgccagcctaacattcaggtcccagagatcctcgttacagaagagccggatagacctgatactgaacctgaaccccctccaaaggagccagagaagacagaggagtttcaatggcctcaaaggtcacagacactggcccagctgccagctgagaagttgccaccaaaaaaaaagaggttgcggctggcagagatggctcaaagcagtggagagagcagttttgaatcctctgtcccactgtcacgaagcccgtcacaggaaagtaatgtcagtctgagcgggagctcaagaagtgccagcttcgaacgcgatgatcatggtaaagcagaggccccttccccatcatccgacatgcgcccaaagccactaggcacccatatgttgacagtcccaagccaccacccacatgcgcgtgagatgcgtcgctctgccagcgaacagagtcctaatgtctcacacagcgctcacatgacggaaaccagaagtaaaagttttgactacggcagcttgtctttgaccgggccatctgctcctgccccagttgcgccaccagcccgtgtggcccctccagaaagacgcaaatgcttcttggtccgacaggcatccctctctcggccaccagaatccgagctggaagtcgcacctaaagggcgtcaggaatcagaggaacctcagcctagcagctcaaagcccagtgccaaaagtagcctctcccaaattagctcggcagcgacatcacatgggggaccccctggtgggaaaggtcctgggcaggacaggccgcctctcggccctactgttccatatactgaggcgctgcaggtgtttcaccatcccgtggctcaaacacctcttcatgaaaaaccatatctacctccaccagtgagcctattctcttttcagcacttagtccaacacgagccaggccagagtcccgagttcttctccacacaggcaatgtccagtctgctgtcctccccctactctatgccccctcttccacccagccttttccaggcccctccccttccactacagcccactgtgctgcaccctggccagctccatctgcctcaactgatgccacaccctgctaatatcccttttcgtcaaccccctagttttctgcctatgccatatccaacctccagtgccttgtcctccggattcttcttacctcttcaaagccagttcgccttgcagctgccaggtgacgtggaatcccacctgcctcaaattaaaacctctctggccccactagccacaggctccgctggccttagcccgtctacggagtacagctctgacattcgattgccccctgtggctcccccagcatcctcatccgccccaacctcggcgccaccattagctctgccagcgtgcccggatacaatggtttcattagtcgtccccgttcgggtccagacgaacatgccgtcctacggttcagccatgtatacaactttgtcccagatactcgtgacacaatcacagggctcatcggccacggtcgcactgccaaagttcgaagagcctccgagcaagggaaccactgtctgcggcgctgatgtgcatgaggtcgggccaggcccttccggtctatccgaggagcagtcacgagcctttcccactccatacctacgggtgccagtcactcttccggagagaaaagggacctcactctcttccgagtctattctgtcactggagggcagtagttctaccgccggtggatcaaagcgggtcctgagtcctgcgggtagtctcgagttaacgatggagacacagcagcagaagagggttaaagaggaggaggccagcaaggcggacgagaagctggaattggtaaaaccttgctctgtggtgctgacgagtactgaggatgggaaacggccagaaaaatcgcatctcggcaaccagggacaagggaggcgtgaattggaaatgttaagctctctttcatctgacccatccgacaccaaagagatcccgcctcttccccacccagccctgtctcatggcacagcccctggcagtgaagctttgaaggagtatcctcagccatcagggaagcctcaccggaggggactgaccccccttagcgtcaagaaggaggattctaaggaacagcccgatctgccaagccttgctcctccttcatccttgccgcttagcgagacttcaagccggccagctaaatcacaagaaggtaccgatagcaaaaaagtgctgcagtttcccagtctgcacactacgaccaacgtgagttggtgttacctcaattacattaaacctaatcacatccaacatgccgataggcgcagcagcgtctacgccggatggtgcatcagcctttacaaccctaacttacccggagtgtccaccaaggccgctctgtcattgctgaggtctaagcagaaggtgtccaaagagacttacacgatggccactgcacctcatccagaagctggtagactcgtgccatcatcctcgaggaagcccagaatgacagaggtgcacctgcccagcctggtgagccctgaagggcagaaagatctggctcgggtggagaaggaggaagagagacgtggagagcctgaggaagacgcacccgcatctcaacgcggagaaccagccaggattaagatatttgaaggcggatataagagcaatgaagagtacgtctacgtccgtggaagaggccgaggcaaatacgtgtgcgaggagtgcggaattcgttgcaaaaaaccatcgatgcttaaaaaacatatccgcacccacactgatgtgcgtccctacgtttgcaagcattgtcattttgcgttcaagactaaggggaacctgactaaacacatgaaatcaaaagcccactccaaaaaatgccaggagaccggagtgttggaggagttggaagccgaagaaggcacaagtgatgacctgttccaggacagtgagggtcgcgaagggtccgaggccgtggaggaacaccagttctccgacctcgaagactctgacagtgattcggaccttgatgaagatgaagatgaagacgaggaggaatctcaagacgagctgtcccgcccaagtagcgaggccccacctcccggaccacctcatgctctgcgcgcagactcctcgccaattttgggtcctcagcccccagacgctccggcaagcggcacagaagcaactcgcggttcatcggtatctgaggccgagagactaacagcgtcgagctgttcaatgagctctcagtccatgccagggctgccttggctgggtcctgcgcctctcgggagcgtggagaaggatacagggagcgccttgagttataaacccgtgtctccaagaagaccttggagtcccagcaaggaggcagggagccgccctccactggcgaggaagcatagcttgactaagaacgactcttcaccccagcgatgtagccccgcaagggaaccccaggcctccgccccaagccctcccggtctgcacgtcgatcccggaagggggatgggggctctgccctgcggatctcccaggctgcaactttcccctctgaccctgtgcccgcttggccgtgaactggctcctcgagcccatgttctgtccaagctggaaggcactaccgatccaggacttcctaggtattcccccacccggagatggagccccggacaggcggagagccctcccagaagcgcccctcccggtaagtgggcccttgccggtccaggaagcccttccgccggagagcacggacccggtctcggcttggatccacgcgtactctttcctcctgccccactcccacataaattattgagcaggtcccctgaaacctgcgcctccccgtggaaagctgagtcaaggtcaccctcatgctctcctgggcctgctcatccactgtccagcagaccgttttctgccctacacgacttccatggacacattctcgctcgcacagaggagaatatcttttcgcatttacccctgcactcacaacatctcacgagagctccttgccctctcatccccataggaggtatccaaatggtccaggctcgtcctggagctcatcccacgctgctccctgggccaacggccgcttgggtcagtgggttcagtggaggcggttccgatctgaccggggctagagaagcacaagagagagggaggtggagcccgactgaaagcagctctgcatctgtcagccctgtggccaaggtcagcaagttcacactaagtagtgagctggaagggggagactaccctaaggaacgggagcggacaggagggggtcctgggagacctcccgactggacacctcacggcacaggtgccccagcggagccgactcccacgcattctccatgtacccccccagacacactcccaaggccaccacagggcagacgggctgcacagtcgtggtcacctcgactggagagccctagagctcccacgaaccccgaacccagcgccacacccccactcgatcgctctagctccgttgggtgtcttgccgaggcaagtgcacggttcccggctcgcactcggaacctttccggtgaaccacgaacacgccaggacagccccaagcccagcggctctggagagccgcgagcacatccacaccagcccgaagatcgggtgcccccaaatgccta

SEQ ID NO: 226427 - DNA, 9428 bp, Artificial Sequence
  Description of Artificial Sequence: Synthetic coding sequence
atggcaactctggaaaaacttatgaaagccttcgagagtctgaagtcattccagcaacagcagcagcagcagcaacagcagcagcaacagcagcagcaacagcagcagcagcagccaccacccccaccccctccaccgcctcctccccaactccctcagccgcctccccaagctcagcctctacttccccagccacagcctcctcctccgccacccccaccaccgcctggccctgccgtagccgaggagcccctccaccgccctaaaaaggaattaagcgccaccaaaaaagacagagtgaaccactgtctgactatttgtgagaatattgttgcgcagagcgtgaggaatagtccagaattccagaagttacttgggatcgccatggaactatttctcctctgctccgacgatgctgagagtgacgtgcgaatggtggccgatgagtgtctcaacaaagtcattaaggcgctgatggattcgaatctgccacggctccaactggagctgtataaggagatcaagaagaatggggcacccagatcgctgagggccgcattgtggagatttgcagagctggcgcacttagtgcggcctcagaaatgtcgtccttatctggtgaatctccttccttgcttgacacgtaccagcaagcgtcctgaagagtccgtgcaggaaaccttggctgccgcagtacccaagattatggcttcattcgggaatttcgcaaatgataacgagatcaaggtgcttctcaaagcgttcatagccaacctaaagagcagttcccccacaattaggcggactgccgctgggagcgctgtgtctatatgccagcattccaggcgcacacagtacttttattcttggcttttgaacgtcttgctggggctgcttgtgcccgtagaagatgaacacagtactttgctcatccttggcgttctgctgacactgagatatctcgtgcccctgttgcagcaacaggttaaggacacatctttgaagggctcctttggcgttacacggaaagaaatggaagtatcacccagtgccgagcagctcgtgcaggtgtatgaattaacactacatcatacccaacaccaagatcacaacgtcgtcacaggtgctttggaacttctgcagcaactgttcagaacaccgcctcctgagttgcttcagacactgactgccgttggaggaatcggccaactcacagcagctaaagaggagtccggaggcaggtcgcgaagcggatctatcgtggaactgatcgcagggggaggatcctcctgcagtccagttctgagtaggaagcagaagggaaaagtgcttcttggtgaggaggaggccctggaggacgactcagaaagccgttcagatgtgtctagtagtgctctgaccgcctcagtgaaggatgaaataagtggagagctcgcagcatccagcggcgtctccactcctggttctgccggacatgacatcatcaccgagcagccccgtagccagcacaccctgcaggccgactctgtggacctggcaagctgtgacttaacatcatctgccaccgacggggatgaggaggacatcctttctcactcgagctcacaagtaagcgccgtgccttccgatccagccatggacctgaacgacgggacccaggcttcctcaccaatctcggacagttcccaaaccacaacggaagggcctgacagcgcagtgacccccagcgacagctcagagatagtactcgatggcactgataatcagtacctagggctccaaatcgggcagcctcaggacgaggatgaagaagccactggcatcctcccggacgaagccagcgaagccttcagaaactcctcaatggccctgcagcaagcacacctgctgaagaatatgtcccactgtagacagccctccgactcttcggtcgacaagtttgtgctacgcgatgaagccaccgagccaggtgaccaagagaataagccgtgtcgaattaaaggcgacattggacagagtaccgatgacgacagcgcacccctcgtccactgtgtgcgtctactgtcagcctcttttctcctgacgggaggaaaaaacgtcctggtgcccgaccgggatgtgcgtgtgtccgtgaaagctcttgcgctgtcatgtgttggagccgctgtggccctccatcctgaaagtttcttctctaagctgtacaaagttcccctcgatactactgagtacccggaagagcagtacgtgagcgacattttgaactacatcgatcacggcgaccctcaggttcggggagcgacggcaattctatgcggcaccttaatttgtagtattctgtccaggtctagattccatgtgggggactggatgggcacaattaggacacttacgggaaacacattcagtctggccgattgtattccactcctgcgcaagactctcaaggatgaaagtagcgttacatgtaagttagcttgcacggccgtaagaaattgtgtaatgtcattatgctcctcctcttatagcgaattaggtctgcagttaatcattgatgtcctgacgcttcgaaactccagctattggctggtcagaacagagctgttggaaaccctcgctgaaatcgatttcaggctcgtcagtttcctcgaggccaaagccgagaaccttcaccgaggggcacatcattacaccggcctactcaaactgcaggagcgcgtgctcaataatgttgttatacacctgctgggcgacgaggaccctcgtgtccgccatgtagctgcagcctcactgattaggctggtgccgaagcttttctacaagtgcgatcagggccaggcagacccagtggtggcagtcgcccgagatcaatccagtgtctaccttaagctgctgatgcacgagacacagcctccaagtcacttttcagtctcaaccattaccagaatttatagggggtacaatctcttaccttccatcacagatgtgacaatggagaataatctttcaagggttatcgccgcagtcagccacgaactcattacgagtacaactagagcccttactttcggatgctgcgaagccctctgcctgctaagcaccgcctttccggtgtgcatttggtccctcggatggcactgcggagtacctcctctctccgctagcgacgagagtagaaagtcctgcactgttgggatggcaaccatgattcttacattactgtcatctgcctggtttcccttggacctttcagcacaccaggacgctctgatcttagctggcaatctgctggctgcgagtgctcctaagagtcttaggtcaagttgggctagcgaagaagaagcaaaccccgcagctacaaaacaagaggaggtctggccagccttgggcgacagggcccttgtgccaatggttgagcaacttttcagccacctcctgaaagtgatcaacatctgcgctcacgtcctggatgacgtggctcccggacctgccatcaaagccgctcttcccagtctgactaatcctccgtcgctcagccctatacgtagaaagggtaaggagaaagaacccggagaacaggcatctgtgcctctaagtcccaaaaagggaagcgaggcatcagcagcctctcgccagagtgatacaagcgggcctgttactaccagtaagagctcctctctcggcagcttttaccaccttccttcttacctgaagctgcatgatgtgcttaaggccacgcacgccaattataaggtcaccctggacctccagaacagcaccgaaaaatttggaggttttttgagatccgccttggacgttctttctcagatattggagttggcaactctccaggatattggaaaatgtgtggaagaaatattggggtacctcaaaagctgtttttcgcgagaaccaatgatggctaccgtgtgtgtgcagcagctgctgaagacactgtttggcactaacttagcatctcagttcgacggactgtcaagcaacccttccaagtcccagggcagagcccagaggctgggcagctcctctgttcgccctggtctgtaccactattgtttcatggctccatacacccacttcacacaggccctggctgacgcctccctacgcaatatggtccaggcggaacaggaaaacgacacgtcaggctggttcgacgtgctccaaaaggtgagcacccaactcaagaccaatctcacatctgtcacaaaaaatcgcgcagataagaacgctatccataaccacatccgcctgttcgagccactggtgataaaggctcttaaacagtacactacaactacttgtgtgcagctacagaagcaggtactagacctactagctcaacttgtccagttacgtgttaactactgtctgctggattccgaccaggtgtttattggatttgtactcaagcagtttgaatatatcgaagtcgggcagttccgggagagtgaagctatcattccaaatattttcttctttctggtgttgctctcatacgaacgctaccattccaagcaaataatcggaatccccaaaataatacagctctgtgacggcattatggcaagcggcagaaaggcagtgactcatgccatccctgccctgcagcccatcgtgcatgatctctttgttctcaggggcaccaacaaggctgatgccggaaaggagctggagacacaaaaagaggtggtggtctctatgctgcttagactaattcagtatcaccaggtgcttgaaatgtttatactggtcttgcagcagtgccacaaagagaacgaagataaatggaagcggctttccaggcagattgctgatattattcttcccatgctcgcaaagcagcagatgcacatcgatagccacgaagcgttaggagtcctcaacacccttttcgagattcttgcgccatccagcttacgccctgttgacatgctgctgcggtcaatgtttgtgactcctaataccatggccagcgtttcaacagtacagctgtggatctctggtattttggctatcctgcgggtcctgatttcccagagtaccgaggatattgtcctatcaaggatacaggagctgagcttttcaccctatttgatctcttgcactgtgatcaacagattgcgcgatggagatagcacaagcacacttgaggagcacagcgaggggaagcagatcaagaatctcccggaggaaacattttcacggttcctccttcagcttgtgggaatcctgcttgaggacattgtgacaaaacagctaaaagtggaaatgtctgagcaacagcataccttctactgccaagagttaggaactttgttgatgtgcctcatacatatctttaagtcgggcatgtttcggcgtatcacagctgccgctacccgcctctttcgcagcgatggctgtgggggttccttttatactctggattcgctgaatcttagagccagaagcatgatcacaactcatcccgcacttgtgctgctttggtgtcaaattctgctgctggtgaatcataccgattatagatggtgggctgaggtgcaacagacccccaagcggcactcattgagtagtaccaaattattgtcacctcaaatgagcggtgaagaagaggactcagatctagccgcaaaattaggtatgtgtaaccgagagatcgtgagacggggtgctttaatccttttttgtgattacgtgtgccagaatcttcatgactcagaacacctcacctggctcatcgtcaaccatatacaagaccttatctcattgtcccatgaaccccctgtgcaggatttcatcagcgccgtacataggaatagtgccgctagcggactttttattcaggcaatccagtccagatgtgagaacctgagcaccccaactatgttgaagaaaacattgcagtgcctggaaggcatccacctgtctcagtcgggtgccgttctgacattatacgtcgacaggttgttgtgtacacctttccgcgtgttggccaggatggtcgatatactggcatgccgcagagtggaaatgctgctggctgccaatctgcaatcctctatggctcagctgccaatggaagagctcaaccgtatccaggaataccttcagtctagcggactggcgcagcgccaccagcgcttgtacagcctccttgatcgcttccgcctctcaacaatgcaagactccctttcacccagccccccagtctctagtcaccccctggacggcgacggccacgtatctttagaaactgtgagccccgataaggactggtacgtacatcttgtgaagagccaatgctggaccagaagcgactctgcattgcttgagggggcagagctggtcaataggatccctgctgaggatatgaatgcatttatgatgaacagcgagttcaatttatctttactggcaccttgcctgagtttgggcatgagtgaaatcagcggcggacagaagagcgccctgttcgaagccgcacgggaagtgaccttagcacgtgttagcggaacagtgcagcagctgccagccgtgcatcacgtgtttcagccagagctgcccgctgagccagccgcttattggtctaagttgaacgacttgtttggagatgcggctctataccagtcccttccaaccctagcgagagctctggctcagtatctggtcgtcgtgagtaaacttcctagccatctgcacctgccacctgaaaaagaaaaggatattgtaaaattcgtcgtcgccacgctggaggcgctctcttggcacctcatacatgagcagatacctctcagcctggatctgcaggccggactggattgttgttgcctcgccctccagctccccggactgtggtcagtcgtgagttcaacagaattcgttacgcacgcgtgctctcttatatattgcgtgcacttcattcttgaggcagtcgcagtgcaaccaggcgagcagctgctctcacccgagaggaggactaatacccccaaggccatctccgaggaggaagaagaggtggatcctaacactcagaatcccaagtacatcacagccgcatgcgagatggtcgcagagatggttgaatctttgcaatccgtgttggctctgggacataaacgcaactccggagtccccgctttcctgactccgttacttaggaatatcattatcagtctggcccgactccccctggtgaacagctatacacgggtgccgcctctagtatggaagctgggatggagtccaaaacccggaggtgactttggcacagcatttccggaaatacctgtggagtttctgcaggagaaggaagtgtttaaagagtttatttacagaattaacacattaggatggacctcacgcacccagttcgaggagacatgggcaacactactaggtgttctagttacacaacctctggtcatggagcaagaggagagtcctcctgaagaagacacggagcgcacgcagattaacgtgctcgcagtgcaagccatcacctccctggtcctctccgcaatgacagtgccagtagccggaaatccggctgtctcatgtttggaacagcaaccacgcaataagccccttaaagcacttgacaccaggtttggacgaaagctgagcatcattagagggattgtcgaacaagagatccaagcaatggtatccaagcgggagaatatcgcgacccatcacctgtatcaagcttgggatcctgttccatctctttctcccgcaaccaccggagctcttattagtcatgaaaagctgcttcttcaaatcaatcctgagcgtgagctcgggtccatgtcctataagctcggtcaagtgtctatccacagcgtgtggcttggaaattccataactccgctaagggaggaggaatgggacgaagaggaagaagaggaggccgatgccccagctccgagctccccacctacaagcccagtgaactctagaaagcaccgcgcaggggtcgacattcattcttgttctcagttcctgctggagctttatagccgctggattctgcctagtagttctgcgcgacgtactccagccattcttatcagcgaagttgttcgtagtctcctggtcgtctctgacctgtttacagagaggaaccagttcgagttaatgtatgtaactctgactgagttacggcgtgtacacccaagcgaggacgaaatcctcgctcagtaccttgtgcccgctacctgtaaggcagcagcagtgctggggatggacaaggcagtggccgagcctgtttcccgcctcctggaaagtaccctgcgttcctctcatctaccatctagggtcggagctttacatggtgtgctgtatgtgctcgagtgtgacctcctcgacgataccgcaaagcaacttatccctgtcatctccgactacctccttagcaatctcaaaggtattgcccactgcgtgaacattcactctcagcagcatgtcctggtgatgtgtgccaccgccttctatctgatcgagaactatccacttgacgttgggcctgaattcagcgcttccatcatccagatgtgtggtgttatgctgtcaggttcggaggaatccactccatcaattatttaccactgcgccctcagaggcttagagaggctgctgcttagcgagcagctcagccggctagatgctgaaagtttggtcaagctgagtgtcgaccgagtgaacgtgcactctccccatcgtgccatggcagccctcggcctaatgcttacctgcatgtataccggcaaagagaaagtgtcccctggaagaaccagtgacccgaacccagcagcgcctgattccgagagtgtgattgtagccatggaacgagtcagcgtcctcttcgatcgcattcggaagggtttcccatgcgaggccagagtggtggctagaattctgccacagttccttgacgactttttcccgccacaggacattatgaacaaagtcatcggcgaattcctctctaaccagcagccctatccccagttcatggccaccgttgtgtataaggtgttccagacccttcactccacaggacagtccagtatggtgagggattgggttatgctgtccttatccaacttcacccaaagagcccctgtggcaatggcaacctggagcctttcttgcttttttgtatccgcgagcacctcaccgtgggtggccgcaattcttcctcacgtaataagccgaatggggaagctcgagcaggtcgatgtcaatctgttctgcctcgttgcaacagacttctataggcaccagatagaagaggaattagatcgaagggcgtttcagtccgtactcgaggtagtggctgcgcctggctcaccctaccatcggctgctgacctgtctccgtaatgtacacaaggtaacaacatgcta

SEQ ID NO: 226428 - DNA, 3114 bp, Artificial Sequence
  Description of Artificial Sequence: Synthetic coding sequence
atggatcgaatggcatcaagcatgaagcaggtgcccaaccctcttcctaaagtgctgtcccgcagaggtgtgggtgctggcctcgaagctgctgaaagggagtcatttgagaggactcaaaccgtttccattaataaggctatcaacacacaggaagtggccgtgaaggaaaagcacgctcgaacatgcatacttggcactcaccacgaaaagggggctcagaccttctggtctgtggtgaacaggcttccactaagttccaacgcagttctgtgctggaaattctgccacgtctttcacaagctgctgagagatgggcaccctaatgtcctcaaggactcgcttcgatatagaaacgaactctctgacatgagcagaatgtgggggcacctctccgagggctatggtcaattgtgctccatttacctcaaattactgagaactaaaatggaataccacaccaagaatccaaggtttcctggaaacctgcagatgtcggaccggcagcttgacgaagctggggagagcgacgtgaataatttcttccagctaaccgtcgagatgtttgattaccttgagtgtgaactgaatctgttccaaacagtgtttaacagtctggatatgagccggtcagtgagcgtcacggccgcaggtcaatgcagactggctcctctcatccaggtgattctggattgctcccacctgtatgactatacagtcaagctactctttaagctgcactcatgtctccccgctgatacactgcaaggccatcgggataggtttatggaacagttcaccaagctaaaagacctgttctacagatcttcgaacctgcagtactttaagcgcttgatccagattcctcaactccccgagaaccctcctaacttcctgagagctagtgccctctccgagcatatttcccctgttgtcgtcattcccgctgaggctagcagtcctgacagcgagcctgtgctagaaaaagatgatcttatggacatggatgcaagccaacagaacctgtttgacaacaaatttgacgatatttttggcagttcgttctcctctgatcctttcaattttaattcacagaatggggtcaacaaggatgagaaggaccacctgatcgaaaggctgtatagagagatctccggattgaaagcccagcttgaaaatatgaaaactgagagccagcgggtggtcttacaattgaagggtcacgtctccgaactggaagcggatctggcagaacagcagcacctgcgccagcaggcagccgacgactgcgaattcctccgggctgaactagacgagctcaggcgccagcgtgaagacaccgaaaaggcccagcgctcgctgtcggagatcgagcgcaaagcacaggcgaatgaacagcggtactctaaattgaaagaaaaatactccgaactcgtgcagaatcacgcagatctcctgcgtaagaacgccgaggtgacaaagcaagtgtctatggcacgccaggctcaggtggatctcgaacgcgaaaaaaaggaactggaggactccctggagagaatcagtgatcaagggcagagaaaaacccaggaacagctcgaagtactggagagcttgaagcaggagctcgcaaccagtcaacgtgaactgcaggtgcttcaaggctcattggagaccagcgcccagtctgaggccaattgggccgctgaattcgcggagctcgaaaaggagagagattctcttgtgtccggcgctgcccatcgggaagaggagttatccgctctgaggaaagaactgcaagatacgcagctaaaactggcctccaccgaagagtccatgtgccaactggcgaaggatcagcggaagatgctgcttgtgggatcgaggaaggcagcggagcaggttatccaagatgcgctgaaccaactggaggagcctcctctgattagctgcgcagggtctgccgaccacctgctgtcaacggttacaagcatcagcagttgtattgaacaactggagaagtcttggtctcaatacctcgcttgccctgaggacatttcagggctccttcacagtatcaccttgctggcgcatctgacaagcgacgctattgcgcatggggctaccacgtgcttacgcgcaccacctgagccagccgactccctgactgaagcttgcaaacaatacgggagagagactctcgcatacctggcttctttagaagaggaaggctccctcgagaacgctgactccaccgccatgcgaaactgcctttccaaaataaaagccatcggagaagagctcttgcctagaggattggatattaagcaagaagagctgggagacttggtggataaggaaatggcagccacctctgcggcaatcgagaccgccaccgcaaggatcgaggaaatgctgtcaaaaagtagggctggagacacaggcgtgaaactggaggtcaacgagcgcatcttaggatgttgtaccagcttgatgcaggcaatccaggtgctgattgttgccagcaaagatttacaacgggagatcgtcgagtccggaagaggaacggcttcgccgaaagagttctacgcaaagaactccaggtggacggaggggttaatcagtgcgtccaaggccgtgggctggggcgctacagttatggttgatgccgctgacctcgtcgtgcagggtaggggcaagttcgaagaactgatggtgtgcagtcatgaaatcgccgctagtactgcccagctcgtggccgcttcaaaagtcaaagccgataaagacagtcccaacttggcccagttgcagcaggcctctaggggagtgaaccaggccaccgccggagttgttgcctcaaccatatcaggcaaaagccaaattgaagagacagataacatggactttagctccatgacactgacccaaattaaacggcaggagatggactcacaggtgcgcgtcctggagctggagaacgagttacaaaaggagcgacagaaattaggagaattgagaaagaagcattatgaactagcgggagtggccgagggctgggaggagggcacagaagcatctccccctaccctccaggaggtcgtgacggaaaaggagtag

SEQ ID NO: 226429 - DNA, 2961 bp, Artificial Sequence
  Description of Artificial Sequence: Synthetic coding sequence
atggatcgcatggcatctagcatgaagcaagttcctaatccccttcctaaggtcctatccagacggggtgtaggagccggactagaggcggcagaaagagagtccttcgagagaactcagaccgtatctatcaataaggcgattaacactcaggaagtagccgttaaggagaagcacgcaaggacttgtattctgggcacccaccacgagaagggagcccagactttttggtctgtggtcaatcgcctgcccctcagcagtaacgccgtcctttgttggaaattctgtcatgtgttccataaactgctgagagacggacaccctaatgtgctgaaggactccttaaggtaccgaaatgaactgtctgatatgagccgtatgtggggacacctcagtgaaggctacgggcagctctgctcaatttatcttaaactcctgaggactaagatggaatatcataccaaaaacccgcgattccccggtaatctacagatgtctgatcgacaactcgatgaagcaggggagtccgatgtgaacaacttctttcagttaacagttgagatgtttgactacctggaatgtgaacttaacctgttccagactgtgtttaacagtctggacatgagccgcagtgtgtctgttacagcagcgggacagtgccggttagctccactaatccaggttatactggattgttcgcacttatatgactacaccgtgaaactgctctttaagctgcacagctgcttgcccgctgatacccttcaaggccatcgggaccgatttatggagcagtttaccaaattaaaggacttgttctatcgctcgtcaaacttgcagtatttcaaacgcctcatccaaatacctcagctgcctgaaaatcctcctaatttcttacgggcatctgccctgagcgaacatattagccctgtggtggtaatccccgcagaggcatcgtcacccgacagtgagccggtactggagaaggacgacctgatggatatggacgccagccagcaaaacttatttgataacaagttcgatgacatattcgggtcctctttctcgtcagaccccttcaacttcaactctcagaatggagtcaacaaggacgagaaggaccacctgattgagcgcctgtaccgtgagatcagtgggttgaaggcccagcttgagaatatgaaaactgaatcccagcgcgtcgtattgcagttgaagggccacgtgagtgaactagaagccgatctggccgaacaacagcacctgcgccagcaggctgctgatgattgtgagttcctccgggcagaactcgatgagctgcgtcgacagagagaagatacagaaaaagctcagagatcactgtcagagatcgaacggaaggctcaggccaatgagcagcgatattcgaaactgaaggagaagtactcagagttagtgcagaaccatgcagatctcctcagaaagaatgccgaggttacaaagcaggtgagtatggccagacaggcgcaggtggacctggagagggagaaaaaagagcttgaagactccctggaaaggataagtgaccaagggcagagaaaaacacaggagcagcttgaggtcctggagagcttgaagcaggagctggcgaccagccagagggaactgcaggtcctccagggctctttggagacttcggctcagagcgaagccaattgggccgctgaatttgcggagttagagaaagaaagagacagcctcgtctcgggcgctgcccatagggaagaagagctgtccgccctcaggaaggaactgcaagatacacagctgaaactagccagtacagaagaaagcatgtgtcagctggcaaaagatcaaagaaagatgctgctggtgggctcccggaaggcggctgaacaggtgatccaggacgcattgaaccagctggaggagccccctctcatttcctgtgccggttcagctgaccacttgctgtcgactgtgacatccattagtagctgcattgagcagctggagaaaagctggagccagtatctggcctgccccgaagatatctccggcctcctgcactcgattacactgctcgcccacttaacctcggatgccatcgcgcacggagcaacaacatgccttagggcaccacctgaacccgctgatagtctgacggaggcctgcaagcagtatggtagggagaccttggcttaccttgctagcctggaagaagaagggtctttggaaaacgccgactccaccgctatgcgcaactgcctcagtaagattaaagccatcggggaagaactattgccaagggggctggacataaagcaggaagaactgggtgacctggtggacaaagaaatggcagctaccagcgccgcaattgaaacagccacagctcggattgaaggcaccgcttctcccaaagaattttatgctaagaactctagatggacagaaggactgatttcagcctccaaggccgtcggatggggcgctacagtgatggtcgacgccgctgacctggtcgtacagggtagaggtaagttcgaggagctgatggtgtgtagtcacgaaatcgctgcatccaccgcccagctggtggcagccagtaaagtgaaagcggataaggactcaccaaatcttgcccagcttcagcaagctagccgtggggtgaatcaggccaccgcaggcgtggttgcctcgaccattagcgggaaaagccagatcgaggaaacagataatatggacttttctagcatgactttgacgcagattaaaagacaggagatggatagccaagtgagggtccttgagctggagaacgaactgcaaaaggagcgccagaaacttggcgagctgaggaagaaacactatgagcttgcaggtgtagcagagggctgggaggagggcactgaagcttcacccccaacactccaggaggtggtgactgagaaggagtag

SEQ ID NO: 226430 - DNA, 3207 bp, Artificial Sequence
  Description of Artificial Sequence: Synthetic coding sequence
atgaacagcatcaagaacgtgcctgcccgagtgctaagtcggagacctggacatagcctggaagccgaaagagaacaatttgataagacccaggccatcagtatttcaaaagcgataaacacccaggaagccccagtaaaagaaaaacacgctaggcgaatcatcctgggcacccaccacgagaaaggcgcattcactttctggagctacgctataggtctaccgttgccctcatcttccattctttcctggaagttttgtcatgttctgcataaggtcctccgcgacggtcatcctaatgtgctgcatgactgtcagagataccgcagcaacatcagggagatcggcgacctgtggggccacctgcacgacaggtatgggcagcttgtaaatgtttacaccaaactgctcctcactaaaatctcctttcaccttaagcatcctcagttccctgctggcctcgaggtgaccgatgaggttttggagaaggctgccggtacagacgtcaacaacatcttccagctaactgttgagatgttcgactacatggactgtgaattgaaattgagcgaaagtgtctttagacagcttaatacggccattgccgtgtcccaaatgtccagcggccagtgccgcctggccccattgatccaggtcattcaggactgtagtcatctgtatcactacacagttaaattactgtttaagctccacagttgcctaccggcagatactctccagggacatagagataggtttcatgagcaattccactctctgcgcaactttttccggcgtgcctctgatatgctgtactttaaacggctcatccagatccccagactgcccgaagggcctcccaactttctgagagcgtctgcgctagccgagcacattaagcccgtggtggtaatacctgaagaggcccctgaagatgaggaacctgaaaacctcatcgagatttcgactggcccacccgcaggcgaacctgttgttgttgctgatctgttcgaccagacgttcggacctccaaatgggtctgtcaaagacgacagagacctccagattgagtctttgaaaagggaagtggagatgctccgtagtgaactggagaagattaagttggaggcacagcgttacattgcacaattgaaaagccaggtaaacgcccttgaaggcgaacttgaagaacagcgcaaacaaaagcaaaaggccctcgtggacaacgaacagctgcgacatgaattggcacagcttagggccgctcaactggaaggtgagcgctcgcaggggttgcgcgaagaggctgagagaaaagcctctgcgaccgaggccaggtacaataaactgaaggaaaagcattcagagttagttcacgtccacgccgagttactgcgaaagaatgcagatactgcaaagcaactgactgtgacccagcagagccaagaagaagtggctagagttaaggaacagttagcgttccaggtcgagcaggtgaaacgggaatcagagctgaagctcgaggaaaaatccgatcagttagagaagctgaaaagggaattggaagctaaagccggtgagctagctcgagcccaagaggccctaagtcacacagagcaatctaaaagcgagctgagctcgagattggatacactgagcgccgagaaagatgccttgtccggcgctgtgcggcagagggaggccgatctccttgccgctcagtccctggtgcgagagactgaggccgctctttctcgggagcagcagaggtctagtcaggaacagggcgagctgcaggggagactggccgaaagagagagccaggagcagggactcaggcagagactccttgacgagcagttcgccgtactgaggggagctgcagctgaggcggctggcatattacaggatgccgtgtccaagctagacgatcctttacatcttcgctgcacttcctcaccagattacttggtctctcgggctcaggaggcgttggacgccgtctcaacattggaggaaggacacgcccaatacctgacctcccttgcagatgcttcagccctggtcgccgcattaacgagattttctcatttggccgcagataccataattaacggcggtgcaactagtcacctggccccaaccgatcccgcagaccgcttaatagacacgtgtagagaatgtggagccagggcattggagctgatgggccagctccaagaccagcaggctctgcgacatatgcaggccagcttggtcagaactccgctgcaggggatcctccagctgggacaggagttaaaacctaagagcctggatgtgaggcaagaggaactcggcgctgtggtggacaaggaaatggcagccacaagtgccgctatagaggatgcggtgcggaggatcgaagatatgatgaatcaagctaggcacgcctcctctggcgtcaaattagaagtgaacgaaaggatcttaaactcttgcaccgacctcatgaaagccattaggctgctagtgacgacatccaccagtttacagaaggagatcgtggagtccggcagaggagcagccacccagcaggaattctatgccaagaactcgagatggacggaggggctcattagcgcaagcaaagcggtgggctggggcgctactcaactcgttgaagccgctgacaaagtagtactgcacaccggcaaatatgaggaactcatcgtctgctcgcacgaaatcgcagctagtacagctcaactagtcgccgcaagcaaggttaaggctaataagcattctccccacctttctaggcttcaggagtgttccaggacggtgaacgagcgggcagctaacgtggtagctagtacgaagagtgggcaggaacagattgaggatcgcgacaccatggacttctccggcctgagtctgattaagttgaaaaaacaagaaatggagactcaggttcgcgtattggagctggaaaagacactggaggcagagagaatgcgtctgggagagctgagaaaacagcactacgtccttgccggagcctcagggtcccctggagaagaggttgcaatcagaccatcaaccgcgcctcgctccgtaacaaccaaaaagccaccattggcccagaagccatctgtggccccacgccaggatcaccagcttgacaaaaaggacggcatatatccagcccagctggtgaactactag

SEQ ID NO: 226431 - DNA, 753 bp, Artificial Sequence
  Description of Artificial Sequence: Synthetic coding sequence
atggcccacgtgggaacttcaagggtggggagcgtgctgagcatgagtctttcaatacaccttctcgttcccacgatgacgaagggggaaaccggaaagcctgggcaccatgaggcccctcgcaccctacaggcctttccctggacttgggcacgtgcatctcctggggtttctgtggacatgtctgctgggcttccccagtcactgctttgctggccaggagcaccactcctccccactcccccactgccttctgccacctacgtaggccattcactgggcctacctagagctggttcatctgtgggcccttggttcagtgggaggtgggtgggcggtgctctggttcaatggccgctcggcggaggtgggcctggcagcgtagccgcaggcctcggaggtccactcgtgcgctggctcctcggcggaggtgctctggtgagatggccactcggaggagggggtcccggatcagttgctgctggatggggcggaccttggtttggaggccgatgggtgggcggacctcctggctccgtcgccgcaggttgggggggacctgtgcggtggccactcgggggtggtgggcctggaagcgtggccactggatggggaggtccctggtttggcggtcgttgggtgggtggcccaccaggcagtgtggctgccggttgcggcggagccttggtgcagtggcccttgggcggaggaagtttgcacagcattccttcctttcccagagcttggcggtag

SEQ ID NO: 226432 - DNA, 2016 bp, Artificial Sequence
  Description of Artificial Sequence: Synthetic coding sequence
atgcggccaaagcgattgggcagatgttgcgccggatcccgcctgggcccaggcgaccctgctgctttaacttgcgccccatctccttcagcaagcccagctcctgagcccagcgcgcagcctcaggcgagggggacaggccagagggtgggctcccgcgctacatctgggagccagtttctctccgaggctagaacaggagcaaggccagcctctgaggctggcgcaaaagccggagcgaggagaccaagtgcttttagtgctattcagggcgacgttagaagcatgccagacaattccgacgcaccatggacccgcttcgtattccaaggcccttttggaagcagggcaactggacggggaacaggcaaggcagcgggaatctggaagacccccgcagcctacgttggcagacgcccaggggtgagtggcccagagcgggctgccttcatccgagaacttgaggaagcattatgccctaacctccctccacctgttaagaaaataacccaggaggatgtgaaagtgatgctgtacctgcttgaggagctcctaccccctgtgtgggagagcgttacctacggaatggtgctccagcgagagagggacctgaataccgcagctcgtatcggccagtcactggtcaaacagaatagcgttctgatggaagaaaactcaaagctggaggccctgttaggttcagcaaaggaggagattttgtacctacgccaccaggttaacctccgcgatgagctactgcagctgtattcagatagcgatgaggaagatgaggatgaggaagaagaagaagaggagaaggaggctgaagaggagcaggaggaagaggaagccgaagaagatctacagtgcgcccacccatgtgacgcccctaagctgatctctcaagaggccttgctccaccagcatcactgcccccagctcgaagccctccaagaaaagttaagactcctcgaagaggaaaaccatcagctgcgggaagaagcaagccaactcgatacactcgaggatgaggaacagatgctaattctagagtgcgtggaacagttttcagaagccagtcagcagatggctgaactgtcagaagtcctggtgttgcggctggagaactatgaacgacagcagcaggaagtcgccagacttcaggctcaagtcctgaaactgcagcaacgatgccgaatgtacggcgcagagacagaaaagttgcagaagcagctggcatctgagaaggaaatacagatgcagttgcaggaggaaagcgtatgggtgggtagccaactccaagaccttagggagaagtatatggactgcgggggaatgttgattgaaatgcaagaggaggtgaaaacactgcggcagcagcctcctgtgagtactggctcagcaacacactatccatacagtgtacccctggagacactgccagggtttcaggaaacacttgctgaagaactccggacatcactgaggcgtatgatctcagatcccgtgtacttcatggagaggaattatgagatgccgaggggcgatacaagttcccttcgatacgattttaggtactctgaagatcgtgagcaggtgaggggattcgaagcagaggagggcctcatgcttgctgcagatatcatgagaggtgaagactttactccagcagaagagtttgtaccccaggaggagctgggcgctgctaagaaagtgcccgctgaagagggtgtaatggaagaggccgagctggtgagcgaagagaccgagggatgggaggaggtggagttggaattggatgaggcaacccggatgaacgtcgttaccagcgccctggaagcctccggactgggacctagccacttagatatgaactacgtcctgcaacaactcgccaactggcaggatgcccactaccggagacagttgcggtggaaaatgctgcaaaaaggcgaatgcccacatggggctctgccagcggcatcacgaactagctgtaggagctcctgccgctag

SEQ ID NO: 226433 - DNA, 1809 bp, Artificial Sequence
  Description of Artificial Sequence: Synthetic coding sequence
atgaggccaaaaagactgggcagatgttgcgcaggatctcgcctcggcccaggggacccggctgctctgacctgtgccccatccccttccgcaagtccggcacctgagccgtcagcacagccacaggcgagaggcacagggcagcgggtgggctccagggcaacgagtggtagccagttcctgtcagaggctaggaccggagcaaggcccgcaagcgaggctggcgctaaggccggagccaggagaccctctgctttttcagccatccagggcgatgtgagatcaatgcctgataactccgacgccccatggactcgctttgttttccaggggccttttggcagtagggctacaggcagggggactggcaaggccgcaggaatttggaaaaccccagcggcttatgtgggcaggcggcctggcgtttcgggacccgagagggctgcattcattcgggagctcgaggaggcattatgccctaatctgccaccaccagtaaagaagatcacccaggaagatgtgaaggtgatgctgtacttgttagaggaggtctgtaccgcctttctgatccaactgctcccaccggtgtgggaaagcgtgacatacggaatggtcttgcagcgcgagcgcgatttgaacaccgctgctagaataggccagtctctcgttaagcagaacagcgttcttatggaggaaaactccaaactggaggccctccttggctcggccaaagaagagatcctttatctgcgacaccaggtcaacctgagggatgaattactgcagctgtactccgattccgatgaggaggatgaagacgaggaggaggaggaagaggagaaagaagccgaggaggagcaggaggaagaagaagctgaggaagacctccagtgcgctcatccttgcgatgcacccaagctcatatcacaagaagcactccttcatcaacaccactgcccacagctggaggcattacaagagaaactgcgactgctggaggaggagaaccaccagttgcgcgaggaagctagccagctcgacactctggaggacgaagagcagatgctgattcttgaatgtgtggagcaattttccgaggcctctcaacagatggcggagctttcggaagtgctcgtcctgcggctggagaattacgagcgccagcaacaagaggtcgccaggctgcaagcccaggtactcaaactgcaacagcggtgtaggatggagactctccccggattccaagagactcttgcagaggagctgcgtacctctctcaggcggatgatctcagacccagtgtacttcatggagaggaactacgaaatgccacggggtgatacttcctccctgaggtatgatttcaggtacagcgaggacagagaacaggtgcggggtttcgaggcagaagaggggctgatgctcgccgcagacattatgcggggtgaggacttcaccccggcagaagagttcgtgcctcaggaagagctgggagccgcaaaaaaggtgccagccgaggagggggtgatggaagaagccgagctggttagcgaggaaacggagggatgggaggaagtggagctggagctggatgaagcaacaaggatgaacgtggtgacatctgctctggaggccagcgggctcggccctagccatctggatatgaattacgtgctgcagcaactcgctaattggcaagacgcacattatagaaggcaacttcggtggaaaatgctccaaaaaggcgaatgcccccacggagccctgcccgctgcctcaaggactagctgtcggtcctcttgtcgctag

SEQ ID NO: 226434 - DNA, 1860 bp, Artificial Sequence
  Description of Artificial Sequence: Synthetic coding sequence
atgagacccaagagactaggacgctgttgcgcaggcagccgcctagggcctggggatccagcggcactgacatgcgcccctagcccttccgctagcccagctcctgagccgagtgcccagcctcaagcccgagggactggccagagagttggttcacgcgcaacctccggatcccaatttctgtcagaggccaggacaggggcacgacccgctagcgaagcgggagctaaagctggggcaaggaggccttccgcctttagcgccatccaaggcgacgtgaggtcaatgcctgataattccgacgccccttggacccgcttcgtgtttcagggcccatttggctcacgcgctaccgggcgtggcacaggaaaggcagcaggcatttggaaaactcccgctgcgtacgtgggtagaaggcccggagtttccgggcctgaaagagccgcattcatcagggaacttgaagaggccttgtgtcctaacctgccacccccagtgaagaaaatcacccaagaggatgtgaaagttatgctatacctcctagaggaacttttgccccctgtatgggaaagcgtgacatacggcatggtgctgcagagagagcgcgacctgaataccgctgctcgaatcggccaatcattagtcaaacaaaactccgtgctgatggaagagaattcgaagctcgaagccctgttagggtccgctaaagaggaaatcttatatctgagacaccaggtgaatttacgggatgagctgctccaactctactccgacagtgatgaagaagatgaagacgaggaggaagaagaagaagagaaggaagccgaagaagagcaagaggaggaggaagcagaggaggatttgcagtgcgctcacccctgcgacgcacccaagcttattagccaagaagctttgctccaccaacaccattgccctcaactggaggcacttcaggagaaacttaggctgttagaggaggagaaccatcagcttcgcgaggaggcatcccagttggacactttagaagacgaggaacaaatgctgatcctggagtgcgtagagcagttctcagaggcctcacagcaaatggctgagctatctgaggttctggttctgagattagaaaattacgagcgccaacagcaggaggtggctaggttgcaagcgcaagtccttaagcttcagcaacgatgcagaatgtatggcgctgagaccgaaaaacttcaaaagcagctcgcctctgagaaggagatacagatgcagcttcaggaagaggagactctgccaggttttcaagagaccctggcagaggagctccgcacctcactccgacgaatgatctccgaccctgtctatttcatggagagaaactacgagatgccaagaggagatacctcgagcttacgctatgattttagatatagcgaagacagagagcaggtccggggattcgaagccgaagagggactgatgctcgctgcagatattatgcgaggtgaggattttactccggctgaggaatttgtaccccaagaagagttaggcgcagccaaaaaagttcctgcggaggagggtgtgatggaggaagccgagctcgtgagtgaggagaccgagggctgggaagaagtcgagctagagctggatgaggctaccagaatgaacgtggtgacatcagcactggaggcgtccgggcttgggccatcccatctggacatgaattacgtactgcagcaacttgcaaactggcaggacgcacattaccgcagacaactgcgttggaagatgttgcagaagggagaatgtccccatggcgcactgcctgctgcaagcagaaccagctgccgttctagctgccgctag

SEQ ID NO: 226435 - DNA, 1785 bp, Artificial Sequence
  Description of Artificial Sequence: Synthetic coding sequence
atgcgacccaagcgcttgggcagatgttgtgccggttcccggctgggtcccggagacccagcagcactgacctgtgccccttccccctctgcgtcccctgcccctgaaccgtccgcccagccccaggctaggggcacgggccaacgagtgggcagtcgagctacttcaggaagccagttcctgtctgaagcccgtacaggcgctcggcctgcctcggaagcaggagccaaagccggtgccaggaggccctctgccttttctgcaatacagggggacgtgagaagcatgcctgacaactccgatgctccctggacgcgcttcgtgttccagggacctttcggaagcagagcaacaggcaggggtacaggtaaggccgcaggtatctggaagactccggcagcctacgttgggagacggccaggggtgagcggccctgaacgggcagctttcattcgggagctcgaggaagcgctgtgtccgaacctcccccctccagtcaagaagattactcaggaggacgtgaaagtcatgctgtatctgctcgaggagctgctgcccccagtctgggagtctgtcacttatgggatggtcctgcaacgggaacgcgacctgaataccgccgctaggattggccagtccctggtgaagcaaaactcagttttaatggaggaaaatagcaagctggaagctctactcggtagtgcaaaagaggagattctgtatctcagacatcaggttaatctacgtgacgaattgttacagctgtatagcgatagcgacgaagaagatgaggatgaggaagaagaagaggaggagaaagaggctgaggaagagcaggaggaggaagaggcagaagaggaccttcagtgtgcacatccatgtgatgcacccaagcttatttctcaagaggctctcctccatcagcaccattgcccccagcttgaggcactacaggaaaagctaagattattggaggaggaaaaccaccagctccgagaggaggccagccagttggacacattagaagatgaggagcagatgcttatccttgagtgtgttgaacagttctcggaggcatcccaacaaatggccgagctgagcgaagtactggttttgcggctggaaaactacgagcgccagcagcaggaggttgcacgacttcaggcgcaggttctcaagttgcagcagcgatgccgaatggaaacgcttcctgggttccaggaaacactggcagaggaattgcggacttcactgagaaggatgatctccgacccagtgtattttatggagcggaattacgagatgcctcgaggcgacacatcaagcctgcgttacgacttccggtactctgaagatagggaacaggtcaggggatttgaagcggaagaaggtctgatgctggcggcagatataatgagaggagaggatttcacgccggcagaagaattcgttccacaggaggaactgggggctgccaagaaggttcctgcagaagaaggggtgatggaagaggctgagctggtgagcgaggagactgagggatgggaagaggttgaactcgagctggatgaggccacaaggatgaatgtcgtaacgtccgccctggaggcctccggtttaggaccaagtcacctcgacatgaactacgttcttcagcagctggccaattggcaggatgcccactataggcgccaactccgttggaagatgctgcagaagggcgaatgcccgcacggggctctacctgctgcaagtagaaccagctgcagatcatcctgtagatag

SEQ ID NO: 226436 - DNA, 837 bp, Artificial Sequence
  Description of Artificial Sequence: Synthetic coding sequence
atgaaattcagggccaagattaccggaaagggctgcctggaactgtttatccacgtatcagggaccgtggcaagactcgctaaggtctgtgtactacgggttagacctgattctctctgtttcggcccagccggatccggcggtttgcacgaagcccgtctttggtgcgaagttaggcaaggtgctttccagcagtttcggatggagggtgtcagtgaagatctggacgaaattcaccttgagctgaccgccgagcatctctcccgggcagcaagatccgccgcaggggcatcatctctgaagttacagcttacccacaaacgcagaccttcactgaccgtagccgtcgaacttgtttcttcgttgggacgggctcgctcagtggtgcacgatctgccggtacgagtgctccctaggagagtgtggagggactgcctccctccttcactccgagcttccgacgcatctattaggctgcctagatggcgcaccctgcgtagtatcgtcgaacggatggccaacgtcgggtcccacgttctggttgaagccaacctgagcggccgaatgacgctgtcgattgaaactgaggtggtgtcgatccagtcctacttcaagaatctcggcaaccctccacagtcagctgtgggagtgccggaaaatagagatctggaaagtatggtgcaggttcgggttgacaatcggaagttgcttcaattcctggagggtcagcagattcatcctacgactgcgctgtgcaatatctgggacaacacactgctgcaattagtactcgttcaagaggacgtctcactacagtacttcatccccgctctgtag

SEQ ID NO: 226437 - DNA, 1065 bp, Artificial Sequence
  Description of Artificial Sequence: Synthetic coding sequence
atgaagagcttgctgctcctcgtactcatctcgatatgctgggccgatcacctgagcgataattatactctggaccatgacagagctatccacatccaggcggagaacggaccccacctgctcgtggaagccgaacaagcaaaggtgttttcacaccggggaggcaacgtgaccttgccctgtaagttctaccgtgaccctaccgcttttggaagtgggattcataaaataaggataaaatggacaaaactcaccagtgactacctcaaggaagtggacgtgtttgtgtctatgggataccacaaaaaaacctatgggggataccagggcagagttttcctcaaaggcggaagcgattcggatgccagcctggtcattacagatctgaccctggaagattacggaaggtataagtgtgaggttattgagggtctggaagacgacacggtggtggttgccctcgacctccagggtgtagtgttcccatactttccccgactgggcaggtataatttgaacttccatgaagcccagcaggcctgtcttgaccaggacgcagtcattgcctcttttgatcagctgtatgacgcctggcggggagggctggattggtgcaacgccggttggctctctgacgggagcgtgcaataccctatcacgaagcccagggagccctgtgggggtcagaataccgtgccaggcgtgcgcaattacggcttttgggataaggacaagtctcgctatgatgttttctgtttcacatcaaatttcaacgggagattttattatctgattcaccctactaaactaacatacgatgaagccgtgcaggcgtgcctcaatgatggcgctcagattgcaaaagtggggcaaatttttgccgcttggaagatacttggttatgatagatgtgacgctggttggctggcagacggcagcgtgagatatcctatcagcaggcctaggcggaggtgcagcccaactgaggctgccgtgaggttcgttggcttcccagataagaaacataagttatatggggtttactgcttccgggcttacaactag

SEQ ID NO: 226438 - DNA, 549 bp, Artificial Sequence
  Description of Artificial Sequence: Synthetic coding sequence
atgaaatccttgctactgctggtcctcatttcaatttgttgggcagatcacctcagcgacaattatacactagaccatgatcgggcaatccacatccaggagaacggcccacacctgctagtggaagctgagcaggcaaaagtgttcagccacagagggggaaatgtgacgctcccctgcaagttttatagagatccaaccgccttcggctccggcattcataagatccggatcaaatggaccaagttaacaagcgattacctaaaggaagttgatgtgtttgtgtccatggggtatcataagaagacctatgggggataccaaggtcgggtgttcttgaaaggtggatctgattccgacgcttctctcgtgatcaccgacctgaccctggaagactatggccgttataaatgtgaagtgatcgaggggctggaggatgatacagtcgtggtagccctggatcttcagggggtagtgtttccctactttcctcgactgggtagatacaatctgaatttccacgaagcccagcaggcctgcctggactag

SEQ ID NO: 226439 - DNA, 477 bp, Artificial Sequence
  Description of Artificial Sequence: Synthetic coding sequence
atgaaaagtcttcttctccttgtacttatctcaatttgctgggctgatcatttgtccgacaattacaccctagaccacgacagagcgattcatatacaagcagagaatggaccacatctccttgtggaggccgagcaggcaaaagtattctctcaccgcggtggcaacgttacactgccctgcaagttttatcgcgatccaacagccttcgggagcgggatccacaagatccgtatcaagtggactaagttgacatccgattatctgaaggaagtggatgtctttgtctcaatgggttatcacaagaagacttatgggggttatcagggaagagtgttcttgaaaggtggctccgactcagatgcttcactggtgattaccgacctcaccctagaagattacggacgttacaagtgtgaggtaattgaaggacttgaggatgatactgtcgtggtggctttggatctgcaggggtag

SEQ ID NO: 226440 - DNA, 600 bp, Artificial Sequence
  Description of Artificial Sequence: Synthetic coding sequence
atgaagagcctgcttctcctggtgctgataagtatctgctgggctgaccatctgtccgataactacacactggatcatgatcgagcaattcacatccaggccgagaatggacctcacttgcttgtggaggctgaacaggccaaggtcttctcccatcggggtggcaacgtcacattaccctgcaaattctatagagatcccacagctttcgggagcgggatccataaaatccgcattaagtggacgaagctgactagcgattacctgaaggaggtggatgtgtttgtgagcatgggctaccataagaagacttacgggggatatcagggacgtgttttcctaaaggggggatcagatagcgacgcatctctcgtcatcacagacttaacattagaggattacgggaggtataaatgtgaggtaatcgaggggttggaagatgataccgtggtcgtcgcgctagatctccaaggcgtggtgttcccttactttccaaggctgggacgatacaaccttaacttccacgaagctcagcaggcttgcctggaccaggatgctgtaattgccagtttcgaccagctgtacgacgcctggaggtag

SEQ ID NO: 226441 - DNA, 777 bp, Artificial Sequence
  Description of Artificial Sequence: Synthetic coding sequence
atgaaaagtctgctgctgctggttctgatctcaatatgctgggcggatcatctctcggacaactacaccctggaccacgatagggccatacacatccaagctgagaacggccctcacctcctcgttgaagccgagcaggccaaggtctttagccaccggggaggcaatgtgacactcccatgcaaattctatagggatcccacagcgttcggctcaggcattcataagattcgtattaaatggaccaagctgacttcggattacctaaaagaggtcgacgtcttcgttagcatgggctaccacaaaaaaacgtacgggggatatcaaggcagggtgttcctcaaagggggaagcgactccgatgcttcactggtgatcactgatcttactctcgaggattacgggagatataaatgtgaagtcattgaaggactggaagatgacactgtggtggtggctctggacctacagggagtagtctttccctatttccctcggctggggcgatataacttgaacttccacgaggcccaacaggcctgtcttgaccaagacgcagtcatcgccagttttgatcagctctacgacgcatggagaggcggtctggactggtgtaacgccggatggctgagcgacggcagcgtgcagtacccaatcacgaagccccgtgagccttgcgggggtcagaataccgttcccggtgtgagaaattatggtttttgggataaagacaagagtagatacgacgttttctgctttaccagcaacttcaattag

SEQ ID NO: 226442 - DNA, 462 bp, Artificial Sequence
  Description of Artificial Sequence: Synthetic coding sequence
atgaagtctcttttattattggtgctgatcagcatctgttgggccgaccaccttagtgataattacaccttggaccatgaccgcgctatccatattcaagctgaaaatggccctcacctgctggttgaggccgagcaagcgaaagtcttttcccacagagggggaaatgttacccttccgtgcaaattctacagggaccctactgcctttggttccggcattcacaaaataaggatcaagtggaccaaattgacttccgattatttgaaggaagtggatgtgtttgtgagcatgggctaccacaagaaaacttacggaggatatcaggggcgagtgttccttaaaggaggttcggatagcgatgcttcattagtgatcaccgacctgacacttgaggactacggcaggtacaagtgcgaagtgattgagggcttggaggacgacacagtggtggtggcgtag

SEQ ID NO: 226443 - DNA, 1683 bp, Artificial Sequence
  Description of Artificial Sequence: Synthetic coding sequence
atgttcgcgcgtatgagcgacctgcatgtattactactgatggctctggtgggaaagactgcatgcggtttcagtctgatgtccctgctggagagcttagacccggattggacccccgaccagtacgattatagttatgaagattataaccaagaagaaaatacctcatcgaccttgactcatgctgagaacccagactggtattataccgaggatcaggccgatccgtgccaaccaaacccctgcgagcacgggggagattgcctggtgcatggctccactttcacttgtagctgtctggcacccttttccggaaataagtgtcaaaaagtgcagaacacctgcaaggacaatccctgtggcagaggacagtgtctgatcacgcaaagccctccctattatcgctgtgtctgcaagcacccctacaccggcccatcctgcagtcaggttgtcccagtgtgtaggcctaatccatgccagaacggagccacctgttcaaggcacaagcgtcgaagtaagtttacatgcgcgtgtccggaccagttcaaagggaagttctgtgagataggaagtgacgattgctatgtaggcgatggctatagctatcgcggaaaaatgaaccggacagtcaaccaacacgcatgtctttattggaactcacacctcctcttacaggaaaattacaatatgtttatggaggatgctgagacgcacggaattggcgagcacaatttttgtcgcaaccctgacgcggatgaaaagccttggtgtttcatcaaggttacaaatgataaagtcaagtgggagtactgcgacgtgagcgcctgtagcgcgcaagacgtcgcctatccagaggagagcccgacagaacccagcacaaagttgcctggtttcgattcttgtggcaagacagagatcgctgaacgaaagataaaacgcatctatggaggctttaaaagcacagctggcaagcacccctggcaggcctccctgcaaagcagtctgccgctgacaatatccatgccgcaaggacacttttgcgggggtgctctgatacatccgtgttgggtactaactgccgctcactgcaccgatatcaagacgcgtcacctgaaggtggtcttgggcgatcaagatctgaaaaaggaagagttccatgagcagagttttcgcgtggaaaaaatatttaaatattcacactacaatgaacgggacgagattccccataacgatatcgcactcttaaaactcaaacctgtcgacggccactgcgccttagagtccaagtacgtaaaaacagtgtgcctgccagacggctccttcccaagcgggagtgaatgtcacatttccggatggggcgtgactgagacagggaaaggaagtaggcagctactggacgcgaaagttaaacttattgcgaacactttatgtaactctagacagctttatgaccacatgattgacgactcgatgatctgtgcaggcaacctccaaaaaccagggcaagacacttgccaaggcgattccggcggtccactgacatgcgagaaagacggtacctattacgtatacgggattgtgtcctggggactggagtgtggaaaaaggcccggagtgtacactcaagtgacgaagtttctgaactggataaaggcaacaatcaagagcgaatccgggttctag

SEQ ID NO: 226444 - DNA, 534 bp, Artificial Sequence
  Description of Artificial Sequence: Synthetic coding sequence
atggaagagaattttatctgcagtaggaagaccatggctctgagctcaacctggattttatcgcccaagaagacaggtcctctgactagcatgataaccgcgacccgcatcatcattcgcaaaaggacaccagtggcgcacctccctactctgcggatattgactggcacaaccctgcgtactaagttaatccatgcctcgccgacaccagttaacactgtcggtacagcctccagcatgggggctccaagtcatgccgcagcttggctgctgagcctgggaatcagtgtacgaaaatgtaagattcgggcaaggaccacacatgtggcaggagccaacgtgtccctgcctcgcgtcctgccaacaactgccgtgagcgttaacaccctgacccaggtcccggctgcaccgaagtggttcctgtacgccggacagacgccagcaaggatggggctccctgcccctggtatttccggggacccgtctagccctgtccccgtgcccacctcctccaggggcaacagtgtgaagtag

SEQ ID NO: 226445 - DNA, 843 bp, Artificial Sequence
  Description of Artificial Sequence: Synthetic coding sequence
atgttcgctcgcatgtccgatctgcacgttctgctcctgatggctctagttggcaaaacagcctgtggttttagcctcatgtccctgctggagagccttgatcctgactggacaccagatcaatatgactacagctacgaagattacaaccaggaggaaaacaccagcagtacgttaactcacgcggagaatcccgactggtattacactgaagaccaggccgacccctgccaacccaacccatgtgagcatgggggtgactgtctggtacatggttccacatttacctgttcctgtctggcaccttttagtgggaacaaatgtcagaaagtacagaacacttgcaaagataatccctgtgggcgtggacagtgtttaataactcaaagtcctccctactaccggtgtgtatgcaagcacccttacacagggccatcttgctcccaggtagtaccagtttgtcgcccaaatccttgccagaatggagctacgtgttctagacacaagcgcaggtccaaattcacctgcgcatgtcccgatcagttcaagggcaaattttgcgaaatcgggtcagatgactgctacgtaggcgatgggtattcttaccggggaaagatgaacaggaccgtcaatcagcacgcatgtctctattggaactcccaccttctcctgcaggagaactacaatatgttcatggaagatgcagagacacatggaataggagaacataatttttgccgaaatcccgatgctgatgagaaaccctggtgtttcattaaagtgactaacgacaaggttaaatgggagtattgtgacgtatcagcttgctcagctcaggcctag

SEQ ID NO: 226446 - DNA, 1605 bp, Artificial Sequence
  Description of Artificial Sequence: Synthetic coding sequence
atgagcctgctcgagtctcttgaccccgactggacacccgaccagtatgactactcgtacgaagattataatcaggaggagaacaccagctcaactctgacccatgcggaaaaccctgactggtactacaccgaagatcaggccgacccctgtcaacctaatccctgcgagcacggaggagactgtcttgtacacggatcaacctttacttgttcgtgtctggcgccattcagtgggaataaatgccaaaaggttcaaaacacatgcaaagataatccctgtggcaggggacagtgtttgatcacgcagagccccccatactacaggtgtgtctgcaagcacccttatacaggcccaagttgtagccaggtagtccccgtttgtcgtccaaacccatgccagaatggagcaacttgctcccggcataagcgccgttcaaagtttacgtgtgcttgccccgaccagtttaagggaaaattctgcgagatcggctcagacgattgctacgtaggggacgggtacagttaccgagggaaaatgaatcgaactgtgaatcaacacgcttgcctgtattggaactcccacctcctgcttcaggaaaactacaatatgttcatggaagacgccgaaacacatggcataggggagcataacttctgtcgcaaccctgacgccgacgagaaaccttggtgtttcattaaggtcactaacgataaggtcaagtgggaatactgcgacgtctccgcatgttccgcacaggacgttgcctatcccgaagaatcccctactgagccgtcaacaaaacttccgggatttgactcttgcggcaaaacagaaatcgccgagcgaaaaattaagcgtatttatggaggcttcaaatcaaccgctggaaagcacccttggcaggccagccttcaatcctccctgccgcttacaatttctatgccacagggccatttctgcgggggtgccttgattcacccatgttgggtgctaactgctgcgcactgtacagacatcaaaacccggcatctcaaagtcgttctgggagaccaggacctgaagaaggaggaatttcatgaacagtcgttcagagtggagaaaattttcaaatattcgcattataatgagcgggatgaaatcccccataacgatatcgcgctgttgaaactgaagccggtcgacggccactgtgcactggaaagcaaatatgttaaaacagtgtgcttgccggacggctcattcccatccggcagtgaatgtcacatcagcgggtggggcgtgaccgagaccgggaagggctctcggcagctgctggacgccaaggtgaagctcattgccaacacactgtgtaacagtaggcagctgtatgatcacatgattgatgatagtatgatttgcgcaggtaacctgcagaagcccggtcaagacacatgccagggggacagcggcggtcccttgacctgtgagaaagacgggacatactacgtctacggaatcgttagttgggggttggagtgcgggaaacgcccaggcgtctacactcaagtaactaagtttttaaactggattaaggctaccatcaagtctgagagcggattttag

SEQ ID NO: 226447 - DNA, 1656 bp, Artificial Sequence
  Description of Artificial Sequence: Synthetic coding sequence
atgttgcccctcctgttgttgcccctgctttggggaggctcactccaggaaaagccagtgtacgaattacaggtgcagaagtccgtgacagtccaggaggggctatgtgttctagtgccctgttcctttagctacccgtggcgctcctggtatagctctccccctctctacgtctattggtttcgggatggcgagattccctattacgccgaggtcgtagctaccaataaccccgatagaagggttaagcctgagactcagggacgctttaggctgctaggggatgtgcagaagaagaactgcagtctctcaatcggcgatgcccgtatggaggacactggttcctacttcttcagagtcgagagaggtagagacgtaaagtattcctatcaacagaataaattgaatcttgaggttacagctctcatcgaaaagccggatattcactttctggaacccttagaaagtggccgacctactcgattgagctgttccctgcctggtagctgtgaggctggaccacccctgacattctcatggacaggcaacgcactgtcccctctcgaccccgagaccacaagatctagcgagctgaccttaactcccagaccagaagatcacgggacaaatctgacctgccagatgaagaggcagggtgcccaggtgactactgagcggactgtgcagctgaatgtaagttatgccccacaaacaattactatctttcgcaacgggattgctttggagatattgcagaatactagctacctccctgtcttggagggccaggcgctgaggctgctgtgcgatgctccttctaaccctccagcccacttgagttggtttcagggaagcccagccttgaacgctacgccaatatctaacaccggaattctggagctccgtagagtcaggagcgcagaagaagggggatttacatgtcgggctcagcatccacttggctttctgcagatctttctgaatctcagtgtttattctttgcctcagctactgggcccaagctgcagctgggaggctgaaggcttacattgtaggtgcagtttcagagctcggccagcaccctcgttgtgttggagactggaggagaaacccttggaaggcaactcatctcagggaagctttaaggtgaacagtagctcagcaggcccatgggcaaacagcagtctaatactgcacggcggtctatcttccgacctcaaagtgtcatgcaaggcatggaatatctacgggagccagtctggctccgtccttcttctgcagggtcggtcaaacctcgggactggcgttgttcctgcagcattggggggagccggagtgatggcactcctgtgtatatgtctgtgcctcattttctttttaattgtcaaggcgagaagaaaacaggccgctggcagaccggaaaaaatggacgacgaagaccccattatgggaacaatcactagcggctcaagaaagaaaccctggcccgacagccccggtgatcaggcatcacctccaggcgatgcccctcccttggaggagcaaaaggaattgcattacgcgtctctgtctttctcagagatgaaaagcagggagccgaaagaccaggaagctccctccacaacagaatacagcgagatcaaaacatcaaaatag

SEQ ID NO: 226448 - DNA, 558 bp, Artificial Sequence
  Description of Artificial Sequence: Synthetic coding sequence
atgttcagggaggtgtttgctgacgaggaccctgccacatatgtgtgggatggcaattatcatcaaccctgggagcctgctgctgcgggagcagtgggagccggagcttatagggaagtcgaggctgaagaccccggaagactggcggtggaagctcttgtccggactcgacgctgcgtctgcgtcgcccagcggtggggagggaaacgcgaggtcatgtacactgctttcaaagcccttggagatagcgttgattatgtgcagttttgtagagtgtgcgactctgatacaaggttagacccgatggcactattggaactggtgagggtgctcgatgaggacccgagggtgggcgctgtgggcggtgacgtgcgaatccttaatcctctcgattcctgggtctccttcctgtctagtttacggtattgggtcgcctttaacgtggagagagcatgtcaatcctatttccactgcgtgtcctgcatctccggtcctctgggcaccccaccaggacctgccgctacacagaggcgaccaagaccatcctgtggaggatag

SEQ ID NO: 226449 - DNA, 645 bp, Artificial Sequence
  Description of Artificial Sequence: Synthetic coding sequence
atgtttcgtgaggttttcgctgacgaggaccccgctacctatgtctgggacggtaactatcaccaaccatgggaacccgctgcagctggagctgtgggcgctggtgcttacagggaggtggaagctgaggatcctggcaggctggccgtcgaggctctggttcgcacacggagatgtgtttgcgtggcccagcggtggggaggcaagagagaggtcatgtacaccgcctttaaagccctgggagacagcgtagactacgtccaggtatgcgacagcgataccagactggatcccatggcgttgttagagctcgttcgggtcttggatgaggaccccagagtcggtgccgtagggggtgacgttcgcatcttgaaccctttagactcttgggtaagtttcctgagttccttgcggtattgggtcgcgtttaacgttgagcgcgcatgtcaaagttactttcattgtgtgtcatgtatcagcggaccactggagtcctgccccggtcctcgggagcacgccatgatgcccagtttcttagcccctgtccaggtgcacttgcaagtcccgcttctgctgagagatgccctggtgctgcccgcagtcgcggaaccagcagatactctggtgcaggtcgtcctaccatag

SEQ ID NO: 226450 - DNA, 1734 bp, Artificial Sequence
  Description of Artificial Sequence: Synthetic coding sequence
atgcggcaggacgctcctaaaccaacgcccgcagcctgtagatgttccgggctcgcacgccgtgtactcacaatcgccttcgctcttctcatcctcggtctcatgacgtgggcgtacgctgcaggcgtgccccttgcctccgatcggtacggcctgctcgcttttggattgtacggggcattcctgtctgctcacctggttgcccagagtcttttcgcatacttggaacacaggcgagtcgcggctgccgcaaggggcccattagacgccgctaccgcacggtccgtagcattaactattagcgcctaccaggaagaccccgcttacctacgccagtgtttggcaagcgcacgtgctttactgtatcccagggcccgtttgagggtcctaatggttgtggacgggaacagagctgaggacttatacatggtcgacatgttcagggaggtgttcgctgatgaagatccagctacatacgtgtgggacggaaattatcaccaaccatgggaacctgccgcagccggagccgtaggagcaggcgcttatcgggaagtggaagcagaagatcctggaagattagccgtggaggccctcgttcggacccgtcggtgtgtgtgcgtggcccagagatggggcggaaagcgcgaagtgatgtacacggcatttaaggccctgggtgattcagtggattatgttcaggtctgcgattccgatacacgcctagaccccatggctctcctggaactcgttcgggtcctagacgaagaccccagggtaggggctgtgggcggagatgtgagaatactaaatccgctggacagttgggtttcttttctgagtagcctgcgttactgggtggctttcaatgtagagagggcgtgccagtcttacttccattgcgtgtcatgtatttccggacctttgggcctctaccgtaacaatctactgcagcagtttctggaagcctggtacaaccaaaagtttctgggtactcactgtacatttggtgatgatcggcatttgaccaacagaatgttgagcatgggttacgccactaaatacacctcccggtcacggtgttactcagaaactcctagctccttcctcaggtggctgtcccagcagacgagatggagcaagtcctattttcgggagtggctgtataacgctttatggtggcaccgccatcacgcttggatgacttacgaggccgttgtctccggactgtttcctttttttgtggccgctaccgtgctaaggttgttctacgcgggaagaccatgggccctcctctgggttctgctctgcgtgcagggggtcgcattggccaaggcagcatttgcggcatggctacggggatgtctgcgaatggtactccttagcctctatgctccattgtacatgtgtgggctacttccagcaaaatttctggccctcgtaactatgaaccagtcgggatggggcacttcagggcgacggaaactcgcagccaactatgtccctcttctccctttggcgctctgggcactcctgctgcttgggggtctggtcagaagtgtcgcacatgaggcaagagctgactggtccggtccctccagggccgcagaggcataccatttagccgctggggctggcgcatacgttggttattgggttgcaatgttaaccctgtactgggtcggcgtgaggagactgtgtaggcggcgtacaggcggataccgcgtccaagtatag

SEQ ID NO: 226451 - DNA, 1659 bp, Artificial Sequence
  Description of Artificial Sequence: Synthetic coding sequence
atgcactgtgaacgttttctttgcatactacggataattgggacaaccctcttcggggtaagtctgttgcttggaattactgcggcatatattgtgggctaccaattcattcagacggataactattacttctccttcgggctgtacggcgcattcctcgcaagccatctgataatccagagcctgtttgcatttctggagcacaggaaaatgaagaagagcctcgagacccccatcaaactcaataagacagtggccttgtgcatcgctgcctaccaggaggatccagactatcttcgtaagtgcctccaatccgtgaagagattaacctacccagggataaaggtggtgatggtaatcgacggcaacagcgaggacgacctttacatgatggacatctttagcgaggttatgggaagggataagagcgccacgtacatttggaagaataactttcacgagaagggcccaggcgagaccgacgaatcacataaggagtctagccagcacgtgacccaactggtgctttccaacaagtcgatctgtatcatgcagaagtggggaggaaaacgcgaggttatgtataccgctttcagagccctggggaggtcggtggactatgtgcaggtatgcgattccgacaccatgctcgatcccgcatctagtgtcgaaatggttaaggtgttagaggaagatcccatggtgggtggagtgggcggtgatgtacagatcctgaacaagtatgatagctggatttccttcctttccagcgtgaggtattggatggccttcaacatagagagagcatgccagagttatttcggatgtgtgcagtgtatctctggaccactgggcatgtaccgaaattccctgctgcacgagtttgttgaggactggtataatcaagagttcatgggaaaccaatgttcttttggcgacgacaggcacttgacaaatagagtgctcagcctggggtacgctacgaaatacacagcccgtagcaaatgcctgactgagaccccaatcgagtaccttagatggttgaatcagcagacccgctggtctaaaagttatttcagggagtggctgtataatgctatgtggttccacaagcaccatctgtggatgacttacgaagcaattattactggcttcttccccttttttctcattgcaactgtcatccagctgttttataggggcaagatctggaacatcctcttgttcctgctcaccgtacaactagtggggttgattaaaagctcttttgcatcgtgccttagaggaaatattgtgatggtgttcatgtccctctactccgtgctgtacatgagctccctgctgcccgcaaagatgtttgcgattgcaactattaataaggccggatggggcacctcgggtaggaagacaatagttgtgaatttcattgggctgattcctgtgagcgtgtggttcactatcctgctgggtggtgtcatcttcacgatttataaggagtcaaaacgcccattcagcgagtctaagcagaccgtcctcatcgtgggaacactgctgtatgcctgttactgggtgatgctgctgacactgtatgtagtgttaattaataagtgcggtcggcgtaaaaaggggcagcagtacgacatggtactcgatgtctag

SEQ ID NO: 226452 - DNA, 951 bp, Artificial Sequence
  Description of Artificial Sequence: Synthetic coding sequence
atgcattgcgagcggttcctctgtatcttgagaatcattggcaccactttattcggcgtgagtctactcctcggcatcaccgcagcctatatagtgggatatcagtttattcagacagataactactacttttccttcgggctgtacggagcatttctggccagccacctgattatacagagccttttcgccttcctggaacacaggaagatgaaaaagagtttggaaacacccattaagctaaataagacagtagccctttgtatcgcggcatatcaggaggatcccgactatctgcgcaagtgcctgcaatctgtgaagaggcttacataccccggtatcaaggtggttatggtcattgatgggaacagtgaggacgatctctacatgatggacatctttagcgaagttatggggagggacaaaagtgctacgtacatctggaaaaataactttcatgaaaagggtcccggagagaccgatgagtcacacaaggagtcttctcaacacgtcactcagctggtgctgtccaataagtccatatgcatcatgcaaaagtgggggggtaagcgcgaagtcatgtatacggccttcagggccctgggacggtctgttgactatgttcaagtgtgtgactctgatacgatgctggaccctgctagcagcgttgagatggtcaaggtgttagaggaagatcctatggtgggcggagtggggggagacgtgcagattcttaataaatacgacagctggatcagcttcctgtccagtgtgcggtactggatggcctttaatatagagcgcgcttgtcaatcttatttcgggtgtgttcagtgtatcagtggtcctctaggcatgtatcgcaatagccttctgcacgtcctgacattcgcagttacacataataccctagtgccacttggcgcagtacagtattgcgggattaggtag

SEQ ID NO: 226453 - DNA, 1389 bp, Artificial Sequence
  Description of Artificial Sequence: Synthetic coding sequence
atggctcaggtgtctatcaataatgactacagcgaatgggacctgtctacagatgcgggtgagagagcccgattgcttcagtccccttgtgtggacactgcaccaaaatccgagtgggaagcatcccccggaggcctggacaggggaactacaagtaccctgggggcaatctttattgttgtcaatgcatgcctgggcgcaggcctactgaatttccccgctgcattttcgacagctggaggtgtggcggctggaattgcactgcagatgggaatgctggtttttattattagcggcctggtgattctggcctattgtagtcaggcgagcaatgaacggacctatcaggaggttgtgtgggctgtgtgtggcaaactgacaggtgtcctgtgcgaggtggccattgcggtgtacactttcgggacctgcatagccttcctgattattattggtgatcagcaagataagataatcgccgtgatggctaaggagccagagggagcctccgggccttggtacaccgatcggaaattcacaatctctttgacagcttttcttttcattctgcccttgtctatccccagggagatcggattccagaaatacgcctcttttctgtctgtggtgggaacctggtacgtcacagccatcgtaatcattaagtatatttggcccgataaagagatgaccccgggtaacattctcacaaggccagcgagttggatggccgtgtttaatgccatgccaactatatgtttcggcttccagtgtcacgtttcatcagtgcccgtcttcaactctatgcagcaacctgaggtaaaaacctgggggggagtcgtgacagccgcaatggtgatagctctggccgtgtatatgggcaccgggatctgcgggttcctgactttcggcgctgcggtggatccagacgttctgctatcatacccaagtgaggacatggctgtcgccgtcgctagggcgttcataattttatctgtactgacctcatacccgattttgcatttttgtggacgcgcagtggtggagggcctgtggctgagatatcagggggtgcctgtagaggaggacgtcggccgtgagagacgtagacgagtactgcagaccctggtctggtttctgctcacccttctgctggcactgttcatacccgacatcggcaaggtgatcagcgtgatcggaggcctggctgcttgcttcatattcgtgttcccaggcctgtgtctcatccaggctaagctgtcagaaatggaagaggtcaagcccgcttcatggtgggtgcttgtgtcctacggggttcttttagtcacacttggcgcatttatatttggccaaacaaccgctaatgctatctttgttgatctccttgcctag

SEQ ID NO: 226454 - DNA, 1662 bp, Artificial Sequence
  Description of Artificial Sequence: Synthetic coding sequence
atgccagttcagcttaccactgccttgagggtggtggggacatccctgttcgcacttgcggtcctgggcggaattctggctgcctatgtgaccggctaccaatttattcatactgagaaacactacctcagtttcggcctgtacggcgcaatcttgggactgcatctgctcatccaaagcctctttgccttcttagagcatcgcagaatgcggagagcagggcaggcgttaaagcttccctccccccgacgcggaagcgtggccctctgcattgctgcttaccaagaagatcctgactacttaagaaagtgtctaagatctgctcagcgtatcagcttccctgatcttaaagtggtgatggtcgtggatggtaatcgacaggaagacgcgtacatgcttgacatatttcacgaagttctggggggaacggagcaagctgggttttttgtgtggcgttctaattttcatgaggctggggaaggagaaaccgaggcctccctgcaggaaggtatggaccgtgtgcgtgatgtcgtcagagctagcaccttttcttgcatcatgcagaagtggggtggtaagcgggaggtcatgtacactgctttcaaagccctgggggatagtgtggactatatccaagtgtgtgacagcgataccgtgctggacccagcttgcacaattgagatgctcagagtccttgaagaagacccccaggtgggcggagtaggtggtgatgtgcagattctgaataaatatgactcctggatttcattcctttcctctgtgcggtactggatggcattcaacgtggaacgggcttgccagtcttactttggttgtgttcagtgtatttctgggccactgggtatgtatcgaaactccctgctccagcagttcctggaggactggtatcatcagaaattcctgggtagcaagtgtagtttcggcgatgaccgccaccttaccaaccgtgtcctatccctgggatatcggaccaaatataccgctcggtctaagtgccttacagagacgccaacaaagtaccttagatggctaaatcagcagacaagatggagcaagagctatttcagagagtggctctataattctctgtggtttcacaaacaccacctgtggatgacttatgagagtgtggtaacgggctttttcccatttttcttgatcgcaacagtcattcagctgttctatcgagggaggatttggaatattttgctcttcctcctcaccgttcaactggttggcatcattaaggccacatacgcctgtttcctccggggtaatgcagagatgatatttatgagtctgtatagtctcctttatatgagctccctacttccagcaaagatctttgcaattgccactataaacaaatccggctggggaacgtcagggagaaaaacgatcgtggtgaattttatcggtctcatccctgtcagcatctgggtagctgtgctgctgggtggtctagcgtataccgcttattgtcaagatctgttctccgaaactgagttggcttttttggttagcggggcaatactgtatggatgctactgggtggcacttctgatgctttacctggccataatcgctcgcagatgcggaaagaaaccagagcagtatagtttggctttcgcagaggtctag

SEQ ID NO: 226455 - DNA, 1308 bp, Artificial Sequence
  Description of Artificial Sequence: Synthetic coding sequence
atggccgcacaccttctgcctatctgcgcactctttctcactctgctggatatggcacaaggctttcggggacctctcctccccaaccgcccatttaccacggtgtggaacgctaatacacagtggtgtctcgagcgacatggtgtggatgtggatgtaagtgtctttgacgttgtggcaaatccaggacagaccttcagggggccagacatgaccatcttttatagctcccaactcggtacttatccatactatacgcctacaggagaacccgtttttggaggcctgcctcagaatgcatcgctgattgctcacctggctcgaacctttcaggacattctggccgcaatccccgctcccgacttctcaggccttgccgtcattgactgggaagcctggaggccgaggtgggcttttaactgggacaccaaagacatttacagacagcggagcagagccctcgttcaagcccaacacccggattggcctgcacctcaggttgaggccgtggcacaggaccagttccagggagccgcaagagcttggatggcaggcaccttacaactcgggagagccctgaggcccagaggcctctggggtttttacggcttccctgactgttataactatgactttctctccccgaactacaccggccaatgtccatccggaatccgggctcaaaacgaccaattaggctggctttggggccagtcacgcgcactataccccagcatttatatgccagccgtgcttgaggggacaggaaaaagtcaaatgtacgtgcagcatagagtcgccgaggcttttcgggtcgcagtggctgcgggtgaccccaacttacctgtgttgccttacgtacagatcttttatgacacaaccaaccatttcctgccactggatgagcttgagcattccctaggagagtcggccgctcaaggggctgcaggcgtcgttctgtgggtcagctgggaaaacacccgcaccaaagaaagctgtcaagccattaaggaatacatggacaccaccctgggcccttttatcctcaatgttacatctggtgcactgctgtgttcacaggccctttgttcaggtcatgggcgttgcgtccgtcgaactagccatcccaaggccctgctgttattgaaccctgctagctttagtattcagcttacccccggaggcggacccctctcgctgaggggagccctttctctggaagatcaggctcagatggcagtcgaattcaaatgcagatgctaccccggatggcaagcaccctggtgcgaacggaagtccatgtggtag

SEQ ID NO: 226456 - DNA, 1308 bp, Artificial Sequence
  Description of Artificial Sequence: Synthetic coding sequence
atggcagcccatttgttgcccatttgtgctctattccttaccctcctggatatggcccaaggcttccggggaccactcctgccaaaccgaccttttacaacggtgtggaacgccaacactcagtggtgcctggaaaggcacggagtcgacgtagacgtctctgtattcgatgttgtggctaatccaggtcagactttccggggaccagatatgacaattttttactcctcacagctgggcacatacccttactacactccaacgggtgagcccgtgtttggcggattgccacaaaatgcctccttgatcgcgcacctcgcaaggacttttcaagatatcctggccgctattcctgccccagatttctccggtttggccgtcattgattgggaagcatggcggcctcgctgggccttcaattgggacactaaagatatttatcggcagcgcagtagagctttagtccaagctcagcatcctgactggccggctcctcaggtggaggccgtggcgcaggaccagtttcaaggcgcagccagggcttggatggctgggactctgcagctgggcagagctctccggccaagaggcctgtggggcttttatggctttcccgactgctataattatgactttctgagcccaaattacacgggacagtgtcccagcggtattcgagctcaaaatgaccaactgggatggttgtggggtcagagccgcgcactgtacccgtctatctatatgcctgcagtgctggaaggtacggggaaaagccagatgtacgttcaacaccgggtagccgaggccttccgggtggcggtggctgctggcgatcctaacctgcccgtgctgccctatgtgcagattttctacgacacaaccaaccattttctacccctggatgagttagaacacagcctgggcgagtcagccgctcaaggcgctgctggcgtagtgctttgggtgagctgggaaaacactcggactaaggagtcttgccaggcaatcaaggaatatatggataccacattgggacctttcattcttaacgtaacctcaggggcactgctgtgcagccaggccctctgtagcggccatggaagatgtgtgaggcgcacaagccatcccaaagcacttctgttgctaaaccccgcatccttttctatccaattgacacccggtggagggcctttgagcctgaggggagccctgtcactggaggatcaagcccagatggcggtagagtttaagtgcagatgctaccccggttggcaggccccatggtgtgagcggaagtcgatgtggtag

SEQ ID NO: 226457 - DNA, 1218 bp, Artificial Sequence
  Description of Artificial Sequence: Synthetic coding sequence
atggcagcccatctcctgccaatttgtgccctgttcctcacccttctggatatggcccagggcttcaggggtccgttgctgccaaaccgcccatttacaaccgtatggaacgccaacactcaatggtgccttgagaggcacggggtggatgtggacgtaagtgtcttcgacgtcgtagcaaatccgggacagacatttcgtggacccgatatgaccatcttttacagttcccagctagggacatacccctactatactcctacaggtgaaccagtgttcgggggtcttcctcagaacgcttccctgatcgcccatttggcaaggacttttcaagacatattggcagcaatacctgctcctgactttagcggactagccgtgatcgattgggaggcttggcgccctcgatgggcatttaactgggataccaaggatatatacaggcaacgttcacgggctctcgtgcaggctcagcacccagactggccagcgcctcaagtcgaagctgtagcacaggatcagtttcagggggcagccagagcatggatggccggaacattgcaattgggtagggcactcaggcctcgtggactctgggggttctatggctttccagattgttacaattacgactttctgagccctaactatactggccagtgtccttctggaatccgcgcacaaaacgaccagctcggttggttgtggggtcagagtagagcactatacccttcgatctacatgccagctgtgctcgagggcacaggtaaaagccagatgtacgtgcagcatcgggtggcagaggcattcagagtcgccgttgccgctggcgaccccaatcttcccgtccttccatatgtacagatcttctacgatactacaaaccattttctgccactcgagagctgccaagctattaaggagtatatggataccacgttgggtccattcattttgaatgtcacaagtggagctctgttgtgtagccaggccctctgtagtggtcacggtcgctgtgtgcgcaggacaagccaccctaaggcactgcttttgctgaatcccgcttccttcagcatccaacttactcctgggggaggcccactgtccctgcggggtgcactgagtctcgaggatcaggcgcagatggccgtcgagtttaagtgcaggtgttatccaggctggcaggccccatggtgcgagcgcaagagcatgtggtag

SEQ ID NO: 226458 - DNA, 1308 bp, Artificial Sequence
  Description of Artificial Sequence: Synthetic coding sequence
atggcggctcacctgcttccaatttgcgctttgtttctgaccttgctggatatggcacagggatttcggggacccctgttgcctaatcgcccattcactacagtgtggaatgctaacacccagtggtgtcttgagaggcatggcgtggacgtagacgtgtctgtgttcgacgtggtcgctaatcccggtcagacattcagaggccctgatatgacaatcttttatagctcccagcttgggacttatccatactacacccccacaggagagccagtattcggaggcctcccccagaatgcatccctcatcgcccacctggcgagaactttccaggatatcctggctgctatccccgcacctgacttcagcgggttggctgttattgactgggaggcctggcgcccaagatgggcctttaattgggacacaaaggatatttatcgacagcggagtcgcgcactggtgcaggcacagcacccagattggcctgcccctcaagtggaggcagtggcccaagaccagtttcaaggggctgcgcgagcctggatggccggtactctccagctgggtcgagcccttcggcctcgtggactgtggggtttctatggattccccgattgctacaattatgatttcctgtcccccaactacactggacagtgcccttcaggtatcagggctcagaatgaccagctgggttggctgtggggacagtctagagcactctacccgtctatttatatgcctgcggtgctcgaaggaacaggaaaaagtcagatgtatgtgcagcaccgggtcgcggaagcctttcgagtggctgttgctgcaggggacccgaacctgccggtgttaccctacgtgcagatcttctacgacacgaccaaccactttctgccgcttgatgaactcgagcattccctgggtgagagcgctgcccagggcgctgccggtgttgttctttgggtgtcgtgggagaatacaaggacaaaggagtcgtgtcaagcaatcaaggaatacatggacaccactctgggaccctttattcttaatgtgactagcggggctctcctgtgtagccaggctctgtgctcgggacatgggcgttgcgtccgcagaacttcccatccaaaggcgctgctcctgctcaacccagccagctttagcattcagctgaccccgggagggggtcccctctccctgagaggtgccctgtccctcgaggaccaggcacagatggcagttgagtttaagtgcagatgttatcccggatggcaggcgccttggtgcgaacggaaaagcatgtggtag

SEQ ID NO: 226459 - DNA, 312 bp, Artificial Sequence
  Description of Artificial Sequence: Synthetic coding sequence
atggctgcccatctgctgcctatctgcgccctttttctgacactcctggacatggcacagggctttagggggccacttctacctaaccgccctttcaccaccgtctggaacgccaacacccagtggtgtctagaacggcacggtgtggatgtggatgtgagcgtctttgatgtagtggctaaccctggccagactttccgagggccagatatgactatcttttactctagtcagctgggaacttacccttactatactcccaccggagagccagtgtttggcggactgccacagaatgctagtctcatatag

SEQ ID NO: 226460 - DNA, 531 bp, Artificial Sequence
  Description of Artificial Sequence: Synthetic coding sequence
atgtatgtccagcaccgcgttgctgaggcctttagggtcgccgtggcggctggagaccctaatttacccgtgctcccttacgtccagattttctacgatacgaccaatcatttcctaccacttgacgagctggagcactccctgggggagagcgcagcgcagggcgcagcgggagtggtgttgtgggtcagttgggagaataccaggaccaaagagtcctgccaagcaattaaagagtatatggacacaaccctggggcctttcattttgaacgtgacatccggcgctctgctatgcagccaggccctgtgcagcggacacgggaggtgtgtgcgacgcactagccaccccaaagccttgctcctcttgaaccccgcatccttttcaatccagctgacgccagggggaggcccattatctcttcgaggagctttgtcactcgaggaccaggcccagatggccgtagagttcaagtgtaggtgctaccccggttggcaggcaccgtggtgcgaaaggaaaagtatgtggtag

SEQ ID NO: 226461 - DNA, 210 bp, Artificial Sequence
  Description of Artificial Sequence: Synthetic coding sequence
atggctgcgcacctcctgccaatttgcgcgctctttcttaccctgctggatatggcgcaaggatttaggggtcccctgcttcccaatagaccatttacaacagtctggaatgccaacactcagtggtgtctagagagacacggggtcgacgtggacgtttccgtcttcgacgtggtcgcaaacccgggtcagacgttcagaggaccctag

SEQ ID NO: 226462 - DNA, 762 bp, Artificial Sequence
  Description of Artificial Sequence: Synthetic coding sequence
atggccggtacattgcaactcggtagagcactgcggccacgcggactgtggggcttttacgggtttcctgactgttacaattatgattttttgagcccaaattataccggacagtgtccttctggcatccgggctcagaacgaccagctggggtggctctggggacagagccgtgccttatacccctctatttatatgccagcagtgctggagggtactggaaaatctcagatgtacgtgcaacatagagtagctgaagcctttcgggttgcagtggctgccggagacccaaatttaccagtgctgccatatgtacagatcttttatgacaccaccaatcacttcctacccctggatgaactggagcattcactcggagaaagcgccgcacagggcgctgccggagtcgttctttgggtatcttgggaaaacacccgcacgaaggaaagctgtcaggccattaaggagtatatggatacgaccctggggccattcatcctaaacgtgacttctggagccttgctttgtagccaggcactgtgtagtggccatggccgatgcgttcgcaggacaagccatcccaaagctttgcttctgcttaacccggcaagtttttccatccagctgacacctggtgggggacctctgtcactgcggggagcgctttccttggaggaccaggcccagatggccgtggagttcaaatgtcgctgttatcccggttggcaggcgccatggtgcgagcggaaaagtatgtggtag

SEQ ID NO: 226463 - DNA, 1422 bp, Artificial Sequence
  Description of Artificial Sequence: Synthetic coding sequence
atgcgcgcaggccctgggcctaccgtgaccctggcattagtgctcgctgtgtcttgggcaatggaactcaaaccaactgctcctcctatcttcaccggtcgaccatttgtcgttgcctgggacgtcccaacccaggattgcggccctcgcctcaaggtccctttggacttaaacgccttcgatgttcaagcgtctccgaacgaaggatttgtcaaccagaacatcacaatcttctatcgagaccgactagggttgtatcctaggtttgatagcgctggaaggagtgtccatggaggagtgcctcagaacgtgagcctgtgggcccataggaaaatgctccagaagagagtcgagcactatatacgtactcaggagtctgccggactcgccgtcatcgactgggaggactggagacctgtctgggtgaggaattggcaggacaaggacgtctatcgccgtctcagtcgtcagcttgttgcctcacgacaccctgattggccacccgacagaatagtcaagcaagctcagtacgagtttgaatttgcagcgcagcaattcatgcttgagaccctcaggtatgtcaaagctgttcggccacgacacctctggggattttaccttttccccgactgctataaccacgactatgtgcaaaattgggagtcctacaccggacgatgcccagatgtggaagtggctcgcaacgatcaactcgcctggctgtgggccgaatcaaccgcgttgttccccagtgtatacctcgacgagactcttgccagcagtcgccatggtagaaatttcgtatcatttagagtgcaggaggccctgcgagttgcaaggacacaccatgccaaccacgcactgcctgtatatgtgtttacacggcctacttactctagacgtcttacaggcctaagcgaaatggatctaataagcacaataggggagtcagccgctctcggagcggcaggcgtcattctttggggcgacgcagggtacaccacttccaccgagacgtgccagtacttgaaggattaccttaccaggctgctggtgccctacgtagtcaatgtgagctgggcgactcagtactgtagtcgtgctcagtgccatggccacggacgttgcgtaaggcggaatccatccgctagcacctttctgcacctgtccacgaatagctttagactggtgccaggccatgcgcctggcgaaccgcaattacggcctgtgggggagttgtcctgggccgacattgaccacctccagacacattttcgatgtcagtgctatctggggtggtccggggaacagtgtcagtgggaccaccggcaggccgctgggggtgcatctgaggcctgggcaggcagtcacttaacaagtcttctggcgttagccgcactcgcattcacctggacgctatag

SEQ ID NO: 226464 - DNA, 1422 bp, Artificial Sequence
  Description of Artificial Sequence: Synthetic coding sequence
atgagggcaggcccaggtcccactgtgactttggccttggtcttggcagtgtcctgggctatggagctcaagcccacagcccctcctatcttcaccggacgtccgtttgtagtggcgtgggatgtccctacccaggattgtggtccccgtctcaaggtccccctggatctaaacgcatttgatgtccaagccagccctaatgaaggattcgttaaccaaaacatcactattttctaccgggacagactagggctgtacccacgcttcgactccgcgggtcggtccgttcacggcggagtacctcagaatgtctccctctgggcccatagaaaaatgctacaaaagagggttgaacactatattagaacgcaggagagcgctgggctggctgtgattgattgggaggattggcggcctgtctgggtacgaaattggcaggacaaagatgtctatcggaggctgtcaaggcagcttgtggcatcaaggcaccccgattggcctccagaccggatcgtcaaacaggcccagtatgagtttgagttcgccgcacagcagtttatgctggagacactccgatacgtgaaagctgtgagacccagacacctgtgggggttctatctttttccagactgctataatcatgactacgtgcagaattgggagagctataccggaaggtgtccagacgtggaggtggcacggaacgaccaattagcgtggttatgggccgaatccacagctctgttcccatcggtttaccttgacgaaacactcgcttcgtctagacatgggcgaaattttgtatccttcagggtgcaggaagccctacgagtggccaggacacaccacgctaaccatgctcttccggtatatgtcttcacccgtccaacatacagtcgcagactgacgggtttaagtgagatggatctgatatccaccataggggagagcgccgcattaggggctgccggtgtcatcctgtggggggacgcaggctacactacatctactgaaacatgccagtacttgaaggactatctgacaaggctgctggttccctacgtcgtgaatgtgagttgggccacccagtattgcagccgagcacagtgccatgggcatggaaggtgcgtgaggagaaatcccagtgcctcaaccttcttgcacctaagcactaacagctttagactggtccctggccatgctcctggcgaaccccagctgagaccggtgggggagctgagttgggcagacattgaccatcttcaaacccacttcagatgccagtgctacctggggtggtccggtgaacagtgtcagtgggaccacaggcaagctgccggaggcgcatctgaggcctgggccggttctcatttaacaagcctgctggctctggccgctctggcctttacctggactctctag

SEQ ID NO: 226465 - DNA, 147 bp, Artificial Sequence
  Description of Artificial Sequence: Synthetic coding sequence
atgcgagccggacccggacctactgtgacgctcgccctggtattggcagtctcatgggctatggaattaaagcctacagcgcctccaattttcaccgggagaccattcgtggtggcctgggacgtcccaacacaggattgcggctag

SEQ ID NO: 226466 - DNA, 354 bp, Artificial Sequence
  Description of Artificial Sequence: Synthetic coding sequence
atgagggccggaccagggccaactgtgaccttagcccttgtgctggctgtctcatgggccatggagctcaaaccaacagcacctccaatttttacggggaggcctttcgtggtggcctgggatgtccccacccaggactgtgggccacggctgaaggtccccctggatctgaatgcttttgatgtacaggcaagccccaacgaaggatttgtgaatcagaacattacaatcttttacagagatcgacttggactttatcctcgattcgactcggcaggtcgatcagtacacggaggagttcctcagaatgtgagcctctgggctcacaggaaaatgctccagaagagggtttag

SEQ ID NO: 226467 - DNA, 246 bp, Artificial Sequence
  Description of Artificial Sequence: Synthetic coding sequence
atgcgcgcaggccctggacccaccgtgaccctggccctggtgctggccgtgtcttgggccatggagctaaaaccgactgccccacctatattcacgggcagaccattcgtcgttgcctgggatgttcctacccaggattgcggccctcgtcttaaggttcctctggacctcaacgcattcgatgtacaggccagtccgaacgagggatttgttaaccagaatataacgatcttctaccgcgattag

SEQ ID NO: 226468 - DNA, 231 bp, Artificial Sequence
  Description of Artificial Sequence: Synthetic coding sequence
atgcgggctggccctgggcctacagtcactctggctctggtgttggccgtcagctgggctatggaattgaagcccaccgcccctcctatcttcaccggccgtccgtttgtagtggcctgggatgtcccgactcaggactgcgggccacggttgaaagtcccactggaccttaacgcattcgacgtccaggcaagcccaaatgaagggttcgtcaaccagaacatcacttag

SEQ ID NO: 226469 - DNA, 1422 bp, Artificial Sequence
  Description of Artificial Sequence: Synthetic coding sequence
atgagagctggcccagggcctaccgtgaccctcgccttagtcttagccgtctcctgggcgatggaactgaagcctaccgcaccccctatttttaccggtagaccctttgtggtggcctgggatgtgcccacacaggattgcggccctcggctcaaagttcccctggatttaaatgctttcgatgtgcaggcgtctcctaacgagggatttgtcaaccaaaatatcaccattttctaccgagatcggctcgggttataccccaggtttgattctgctggccgaagcgtacacgggggagtccctcaaaatgtctccctgtgggctcacagaaaaatgctgcagaagagagtggagcactacatcagaacccaggaatcggccggacttgcagtcatcgattgggaggactggcgaccggtgtgggtgcgtaactggcaagacaaggatgtttaccggagactcagtcggcagctggtcgcgtcaaggcacccagactggccccctgatagaatcgtgaaacaggctcaatacgagttcgagttcgccgcacaacaatttatgttggaaacactgaggtacgttaaggccgtgagaccacgtcatctgtggggtttttatctctttcccgattgctacaatcatgactacgtgcagaattgggaaagctataccggtaggtgtccagatgtggaggtggccaggaacgatcagctggcctggctgtgggctgagtcaaccgccttatttccatcggtttacctcgatgaaaccctagcttcctcgagacacgggcgaaactttgtgtctttccgtgtgcaagaagctctgcgggtggccagaacccatcatgcgaaccacgccttgcccgtgtatgtgttcacccgaccaacctacagtagaagacttaccgggctttctgaaatggatctcattagtactattggcgagagtgctgcactcggcgcagccggtgtaatcttgtggggagacgctggctacacgacaagcactgagacctgccaatatttgaaggactatctaacccggctactcgtgccctacgtggttaatgtctcctgggcaacacaatactgctctcgagctcagtgtcacgggcacggacggtgtgtcagaagaaacccaagcgcatctaccttcctccatttgtcaaccaacagtttcagattagtccctggccacgcccctggggaaccgcagctgcggcctgttggagagctgtcttgggcagatattgaccatctgcaaacacattttaggtgtcagtgctacctcggatggtccggggagcagtgccaatgggaccaccgtcaagccgctggcggtgcgtccgaggcttgggccggatcacatctcacctcactgctggcactggccgctttggctttcacctggaccctgtag

SEQ ID NO: 226470 - DNA, 1422 bp, Artificial Sequence
  Description of Artificial Sequence: Synthetic coding sequence
atgagggctggtccaggtcccaccgtcactctagcacttgtgctcgcggtcagttgggccatggaattgaagccaactgctcctcctatttttacaggccgtccctttgttgtggcatgggacgttccaactcaagattgcggacccaggctcaaggtgcccctcgacttgaacgccttcgatgtccaggcctctccaaacgaaggctttgtgaaccagaacattactatcttttatagagaccgcctgggtctgtacccaagattcgactccgccggtaggtctgtccatggtggagtgcctcaaaatgtgagcctctgggcccaccggaagatgctgcaaaaaagagtggagcactacatacggactcaggagagcgcaggcctcgccgtaattgactgggaggactggcgtcccgtttgggtgagaaactggcaagacaaagatgtttaccggcgtctgagccggcagttagtggcttcacggcatcctgactggccacccgaccgcattgtgaaacaggcgcagtatgagttcgagtttgcagcacagcagtttatgttagaaactctccggtatgtcaaagcagtacggccaagacatctgtggggcttctatctgttccctgactgttacaatcatgactacgtgcaaaactgggaatcatatactggaagatgccccgacgtcgaagtggccaggaatgaccagctcgcctggctttgggctgaatccactgccctgttcccctcagtatacctggatgagacactagcgtcttccagacacggccgaaacttcgtgtccttccgcgtgcaagaagccctgagagtggcgcgtacacatcatgctaatcacgcactgcccgtttacgttttcaccagaccgacatacagccggagattgaccggcctctccgaaatggacctgatcagcacaattggagagtctgccgctctgggtgccgctggcgtgatcttgtggggggatgctgggtacacgacatccaccgaaacttgccagtacttgaaagactatctgaccagactgctggtgccatacgttgtcaacgtgtcatgggccacccaatactgtagcagggctcagtgccacggacacgggcgatgtgtaaggagaaatccaagcgcgtctactttcttgcacctgtccaccaatagctttcggttagttcctggccacgcacctggtgaaccccagctgagacccgtcggggagttaagctgggctgatatcgaccacctgcagacccacttcagatgtcagtgttaccttgggtggtccggagaacagtgtcagtgggatcaccggcaggctgccggtggggcatccgaagcttgggccggttcacatctcacttctctgctcgcgcttgcggcattagcctttacctggactctttag

SEQ ID NO: 226471 - DNA, 366 bp, Artificial Sequence
  Description of Artificial Sequence: Synthetic coding sequence
atgcgggctggcccaggccctaccgtgaccctggccttggtgctcgctgtgagttgggctatggaactcaagcccactgcgcctccaattttcactggacgccctttcgtggtcgcatgggacgttcctacccaggactgcggtcccaggctaaaagtccccttggatctcaatgcttttgacgttcaggcttccccaaacgaaggtttcgtgaatcagaacattaccattttttacagagatagactgggcttatacccgagattcgatagtgcaggaaggagtgtgcacggaggggttccacagaacgtgtctctttgggctcataggaagatgcttcaaaaacgggtcgagcactacatctag

SEQ ID NO: 226472 - DNA, 1254 bp, Artificial Sequence
  Description of Artificial Sequence: Synthetic coding sequence
atgactactcagctggggcctgccctggtcctgggggtggctctgtgcttagggtgtggtcagcctctgccgcaagtgcctgagcgcccattctccgtcttgtggaacgtgccatcagcacattgtgaagctaggtttggtgtgcacttacccctgaatgccttgggaattatagccaacaggggccagcacttccatggacagaatatgaccattttctacaagaaccagctggggctgtacccatatttcggacctcggggaacagcgcacaatggtggtatcccccaggccttaccgctcgatcggcacctcgccttggccgcttatcagatacatcacagcctgaggcctggttttgcgggacccgcagtacttgactgggaggagtggtgtcccctctgggccggaaactggggacgacgaagggcctaccaggcagcttcttgggcatgggcacagcaggtatttcccgacttggacccccaagagcagttgtacaaagcttacactggattcgaacaggcagcacgggcacttatggaggataccttacgagttgctcaggccttgaggccacatggcctgtggggcttttatcattatcctgcgtgtggtaacggatggcactcaatggctagcaactacaccggcaggtgtcacgccgctacactagctcgaaacacacagcttcactggctgtgggcagcatcatctgcgttattcccatccatatacttaccacccaggcttccacctgcacaccaccaggcattcgtgagacaccggctggaggaagccttccgcgttgcactcgtaggacaccgacaccccctgccagtcctggcatatgtcaggctcacacaccgcagaagcggtcgtttcttgtcacaggacgatctggtacaaagtattggagtgtctgcagctcttggcgcagccggagtcgtgctctggggcgacctgtctctgtctagctctgaggaggagtgctggcacctccacgactaccttgtcgacacgcttggtccttatgtaataaacgttacccgggctgctatggcttgttcccaccagcgctgccatggccacgggcgttgtgcacgcagagaccccggacaaatggaggcattcttgcatctgtggcctgacgggtctctcggggactggaaaagcttttcgtgccactgctattggggatgggcaggccctacatgccaggaacctcgccctggtcccaaagaagccgtctag

SEQ ID NO: 226473 - DNA, 1164 bp, Artificial Sequence
  Description of Artificial Sequence: Synthetic coding sequence
atgaccactcaattgggtcccgcactcgtcctcggtgtcgccctgtgtctcggttgtgggcagccacttccacaggttcctgaaagacctttctcagtgctgtggaatgttccaagcgcacattgtgaagctcgctttggcgtccacctgccactgaacgctttaggtatcattgccaatcgcggtcagcacttccatggccagaatatgactatcttctacaagaaccagctggggctttacccttacttcggcccaagaggaacggcccataacgggggtattccacaggccctaccgttggaccgacacttggccctcgctgcataccagatccaccattccctgcggcctgggtttgccggacctgccgttcttgactgggaggaatggtgtcctctctgggcaggaaattggggccgtcgtcgtgcttaccaagcagccagttgggcctgggctcagcaggttttcccagacttggatccccaagaacaactctacaaagcctatactggctttgagcaggccgctagggcactgatggaagacacactcagagtggcgcaggcgttacgccctcacggattatggggcttctatcactatcctgcttgcgggaacggatggcatagcatggcctcaaactacacaggtaggtgccacgccgctaccctggcaagaaacacccagcttcactggctgtgggccgcatccagtgccctgttcccgagtatctacttacccccaaggctccctccagcccatcatcaggccttcgtgagacaccgactcgaggaggcctttcgtgtggctcttgtggggcatcggcaccctctgcctgtgcttgcatatgtgcgcttgacccatcgccgttcgggcaggttcttatcacaggaggagtgctggcatctgcatgactacctcgtggacacactcggaccatatgtgattaacgtgactcgcgcagccatggcctgttcgcatcagaggtgtcacgggcacggaagatgcgccaggcgcgatcccggtcagatggaagcatttctgcatctttggcccgacggatctctgggagattggaaaagtttctcgtgccactgttactggggctgggcaggcccaacctgtcaagagccgagaccaggaccaaaggaggcggtgtag

SEQ ID NO: 226474 - DNA, 507 bp, Artificial Sequence
  Description of Artificial Sequence: Synthetic coding sequence
atgttgcccccagcgcaccatcaagcgtttgtgaggcaccggcttgaagaggccttcagagtggcgctagtaggacatcgccatcctctccctgtgctcgcatacgtaaggttaacccaccgtagatccggccgatttctttcccaggatgatctcgtgcagagcattggggtcagtgcggctctgggtgcggcaggagtcgtactgtggggcgacctgtcgctgtctagctccgaggaagagtgttggcacctacacgattatttggtagataccctgggaccctatgtcatcaacgtgacaagggctgccatggcttgttcacatcaaaggtgccacggccatggacgctgtgcccgacgagacccaggccagatggaggctttcctacacttatggccggatggcagcttaggagattggaagagcttttcctgtcattgttactggggatgggctggcccaacatgccaggagcccaggcctgggccaaaagaagctgtttag

SEQ ID NO: 226475 - DNA, 483 bp, Artificial Sequence
  Description of Artificial Sequence: Synthetic coding sequence
atgacaacccagctgggccctgcactagttctgggtgtagcattgtgtctggggtgcgggcaaccgctcccgcaggtgcctgaaagacctttttccgtgctctggaacgtgccatccgcccattgcgaggctcgcttcggtgtgcatctcccactgaatgccctcggcataatagccaatcgcggtcagcacttccatgggcagaacatgaccattttttacaagaaccagctaggcctgtatccttattttggccctcgcggtactgcccacaacggagggattccgcaggcactgcccttggaccggcatcttgccctagcagcgtaccaaattcaccacagtctgaggcccggtttcgccggacccgctgtacttgattgggaagagtggtgccccctctgggccggaaactggggacgaaggcgagcctatcaggcggcttcatgggcgtgggcccaacaggtctttcccgacctgtag

SEQ ID NO: 226476 - DNA, 1164 bp, Artificial Sequence
  Description of Artificial Sequence: Synthetic coding sequence
atgactactcagctaggccctgctcttgtcctcggagtagccttgtgtctcggctgtggccagccccttccccaggtaccagaacgcccatttagcgtcctgtggaacgtcccgtcagcacattgcgaagcaagattcggcgtgcacctacctctgaatgccctggggattattgctaatagggggcagcactttcatggtcaaaacatgaccatcttttataagaatcaactcggtctgtatccttactttggaccgaggggcactgcgcacaacggaggaatcccccaggcactgccccttgaccggcacttggcactggccgcttatcagattcaccacagcctccgccctggattcgcaggtcctgccgtcttggattgggaagagtggtgtcccttatgggctggcaactggggtcggaggcgcgcataccaggcagccagctgggcgtgggctcagcaagtgttccccgacctggatccccaggagcaactgtacaaggcttacacgggcttcgagcaagcagctcgcgcactaatggaggatactttgcgcgtggcccaagcactacgtccacacggactgtggggcttctaccactatcctgcgtgtggcaacgggtggcattcaatggcttcaaattacacggggaggtgtcatgccgctaccctcgcacgtaacactcagttacattggctttgggcagcaagcagtgcactctttccctccatttatttgcctccacgcctcccacctgctcaccaccaggccttcgtccgccatcgcctggaggaagcgttcagggttgctctggtgggacatcggcatcccctccccgtgttggcatatgtgagactgactcaccgccgatctggacgcttcctatcacaggaggaatgttggcatcttcacgattacctggttgacacactagggccatacgtgatcaacgtgacccgcgctgctatggcttgctcacaccagcgctgccacgggcatggcagatgcgcccgaagggaccccggacagatggaggcttttctccacctgtggcctgatgggtctcttggggattggaaaagtttctcctgccactgttactggggctgggcgggacctacgtgtcaggagccgagacctggaccaaaggaggcagtgtag

SEQ ID NO: 226477 - DNA, 417 bp, Artificial Sequence
  Description of Artificial Sequence: Synthetic coding sequence
atgttacctcctgcccatcatcaggccttcgtcagacaccgacttgaggaggcctttagggtggcactggtgggacacaggcaccctctcccagtccttgcttatgtgcggctgacacacagacggtccgggcgttttctgagccaggaggaatgctggcatctgcacgactaccttgtggataccctgggaccctacgttattaacgtgacaagagccgctatggcctgctcacatcagcggtgccatggccacggaaggtgcgccagaagagatcccggacagatggaagcctttctgcacctgtggcccgacggcagcctcggcgattggaagtcattttcttgccactgctattggggctgggccggacctacgtgccaagagcccaggcccggacccaaagaggcagtatag

SEQ ID NO: 226478 - DNA, 1518 bp, Artificial Sequence
  Description of Artificial Sequence: Synthetic coding sequence
atgagcagcgtgcaacagcagccacccccaccgaggcgagtgacgaacgtgggcagcctgctcctgacgccgcaagagaacgagagtcttttcacatttctcggaaaaaaatgcgtgactatgtctagcgctgtcgtgcagttgtatgcagctgacagaaattgtatgtggtccaaaaagtgctctggcgtcgcttgtctagtaaaagataatccccagcgcagttacttcctgcggatctttgacatcaaagatgggaaactgctgtgggagcaggagctctataataattttgtatataacagcccccgaggctactttcatacatttgctggcgatacttgtcaggtcgccctgaattttgcgaacgaagaagaggctaagaaatttcgcaaggctgttactgatctcctgggcaggagacaaagaaagagcgagaaacggagagatcctcccaatggacctaatcttcctatggctacagtagatatcaagaatcccgagatcaccacgaatcggttctatggaccccaagtcaacaatatatcccacactaaggaaaagaaaaagggcaaggccaagaagaaacggctcacaaaggcagatataggcacaccttccaatttccaacatatcggacatgtgggttgggatcctaacactgggtttgatctcaacaatctggacccggaattaaaaaaccttttcgatatgtgcggtatcagcgaggcacagttaaaagatagggagaccagtaaggtcatctacgactttatagaaaaaactggaggagtcgaggctgtcaaaaatgagctgcgcagacaggcccctccacccccaccgccttctcgtggcggaccgccacccccaccaccgccaccccataacagcggtccgcctcctccccctgcaagaggcaggggtgccccaccgccacctccttcgcgggcaccgaccgccgctcctccacctccccctccatcaagaccatcggtagccgtcccaccacctcctccgaatcgtatgtacccccctccacctcctgccttgcctagctccgctccttccggccctccccctcctccgccttccgtcctgggagtcggaccagttgcaccaccgcctccgccacccccacctccccctcccggaccacctcccccacccggactgcctagcgatggagatcaccaggtccccaccaccgcagggaacaaggcggctctcctcgatcaaatcagggaaggggcacagctcaagaaggtcgaacagaactcaaggccggtctcctgttccggacgagatgccttgctggatcagattcgccagggcatccagctgaaaagtgttgccgacggacaggagtccaccccccctacccccgcacccactagcggcatcgtgggcgcactgatggaggttatgcagaaaagaagcaaggccattcactcatcagacgaagatgaggacgaggacgatgaggaggactttgaggatgatgatgaatgggaggactag

SEQ ID NO: 226479 - DNA, 1446 bp, Artificial Sequence
  Description of Artificial Sequence: Synthetic coding sequence
atgaaggttcttagtgagggccagctgaagctctgtgtcgtacagcctgttcacctaacctcttggctgctcatattctttatcttaaagtccatctcttgcctgaaaccagctcggcttcccatttatcagcgtaaacctttcatcgctgcgtggaacgctcctaccgatcagtgtcttataaaatacaacttgcgccttaacctcaagatgttcccggttataggaagcccactggctaaggccagaggtcagaatgtgaccattttctacgtgaatcgcctcggttactatccgtggtataccagtcagggagtacctatcaatggtggcctccctcagaacatcagcctgcaggttcaccttgaaaaggccgatcaagatattaactactatataccagccgaggacttctcaggcttggcagtcattgactgggaatattggcggcctcagtgggcccgaaactggaactccaaggatgtatatagacagaagagccggaagctcatctccgacatgggaaagaatgtgtccgctactgatatcgaatacctggccaaagtcacattcgaggagtccgctaaggcgttcatgaaggagactattaagctagggattaagtctcggccaaaggggttgtggggctactatctgtatcctgattgccacaactataatgtctatgccccaaactatagcgggagttgtccggaggacgaggtgctaagaaacaacgaactgagctggctgtggaactcaagcgccgctctctacccaagcattggagtgtggaaatctctcggcgattcggagaacattctgagattctcaaagtttcgggtgcacgagtccatgcgtatcagtaccatgacttcccatgattatgcccttcccgtcttcgtgtacactcgcttgggttatcgcgacgaacccctattctttctcagcaagcaggatttggtgtcaaccataggggaaagcgcggcactgggagctgcaggaattgtgatctggggggatatgaacctgactgcctcgaaggctaactgcacaaaggtaaaacagtttgtcagctctgatcttggatcctatatcgcaaatgtaacacgtgctgcagaggtctgctctctccacctgtgccgcaataacggcaggtgcatcaggaagatgtggaatgccccttcctatctgcatctaaatccagccagctaccatattgaggcctcagaggatggcgagttcaccgttaaaggaaaagcttccgacaccgatcttgccgtgatggctgatacattttcctgccactgttatcaggggtacgaaggcgctgattgtcgcgagatcaaaaccgcagatggctgttcaggtgtttctccaagtcccggaagtcttatgacactgtgcttgctgctgttggcatcatataggagcatccagctgtag

SEQ ID NO: 226480 - DNA, 138 bp, Artificial Sequence
  Description of Artificial Sequence: Synthetic coding sequence
atgaaggttctttcagagggacagctgaagctgtgcgtggttcagcctgtacatctgacctcgtggttattgatcttcttcattttgaagtccatttcatgtctcaagcctgcacggctgccgatatatcagagatag

SEQ ID NO: 226481 - DNA, 192 bp, Artificial Sequence
  Description of Artificial Sequence: Synthetic coding sequence
atgaaggttctgtccgaggggcagcttaaactgtgcgtagttcagccagtgcacctcacctcttggctcctgatcttctttatccttaaatcaatcagttgccttaagcccgctcgtcttcccatatatcagaggaagccctttatcgccgcttggaatgcacctaccgatcagtgtctaatcaagtactag

SEQ ID NO: 226482 - DNA, 15366 bp, Artificial Sequence
  Description of Artificial Sequence: Synthetic coding sequence
atgactagtcgtcggctggaggaaagcatgggcgcagttcagatgggtctcgtcaacatgttcaaaggatttcagtccaaggtgttgcccccactgtctcccaaggtggtcacagaagaagaagtgaatcgcatgctgactccaagtgagttcctgaaggagatgagcctgacaaccgaacagagattggccaagacccggctgatgtgcaggccgcagatcatcgaactgttagatatgggagagaccacccatcagaaattcagtggaatcgacctcgaccaggcactgtttcagccattcccctccgagattatcttccaaaactacactccctgtgaagtatacgaagtcccgttgattctgcgcaataacgacaagatcccgagactggtcaaagtggtggaagagtcatccccgtatttcaaagtgattagccccaaagacattggccacaaagtggcccctggtgtgccttctatttttagaatcctatttacaccagaagaaaacaaagactacgctcacaccctcacctgtgtaactgagagagagaaattcattgttcccattaaggctagaggagctagagccatcctcgactttccggacaagcttaacttctctacttgcccagtgaaatattctactcagaagatcttgctggtgcgaaatattggaaataagaacgcagtattccatataaagacctgtagacctttctctatagaacctgccattggcactctcaacgtcggggaaagcatgcaactggaggtggaatttgaaccgcagtccgtgggcgatcatagcggcaggctgatcgtgtgctacgacacaggggagaaggtgtttgtctctttgtatggcgctgctatcgacatgaacatcaggctggataaaaactcactgacaatagagaagacttatatctccctcgcaaatcagcggacaatcaccatccataatagatcaaatatcatagcgcattttctatggaaagtgttcgctacacagcaggaagaggatcgcgaaaagtacagggcctgtgatgacctgattaaagaagagaaggacgaaactgacgagttttttgaggaatgcatcacagacccgctgttgcgagaacacttgtcggtgctaagccgaacttttgccaatcagcgacgcttagtgcagggtgacagcaagcttttcttcaataacgtgtttacggtggaacctctggagggcgatgtatggccaaacagctcagctgaaatcaccgtctacttcaatcccctggaggctaagctctaccagcagacaatctattgcgatatcctgggtcgggagatacgactgcctctgagaattaaaggtgaaggcatggggcctaaaatccattttaatttcgaactcctggatattggcaaagttttcactggatccgcacattgctacgaagccatcctgtacaacaaaggatccatagatgcgctttttaatatgaccccccctacctcagccctgggtgcctgtttcgtgttctctcccaaggaaggcatcattgagcccagcggcgtgcaggctatacagatatcttttagtagcactatcctcgggaatttcgaggaggaatttctggtgaatgtgaatggctccccggagcccgtgaagttaactatccggggttgcgtcatcggccctacattccatttcaacgtccccgctctgcatttcggtgacgtttcttttgggtttcctcatacactgatatgcagtctgaataacacgtccttgataccaatgacatataagctgcgtatacctggcgacggcctgggtcataagtctatcagttattgcgaacagcatgtcgattataaaaggcctagctggaccaaggaggaaatatcgtctatgaagcccaaggagttcacaatttccccagactgcggtaccattagaccccagggattcgccgctatccgggtgacactgtgcagtaacactgtgcagaagtacgagctggccctggtagtagatgtagaaggaattggcgaagaagtcctagccctgcttataaccgctagatgtgttgtccccgcactgcacctagtcaataccgaggtggattttgggcactgctttctgaaatacccttacgagaagactctccaactcgctaatcaggacgacctgcccggattttacgaggttcagccccaggtttgcgaggaggttcccaccgtgcttttctccagcccaactccgtctggggtgatttccccttccagcactatccatatcccattggttttggaaacgcaggtgaccggtgagcatcgttctaccgtttacatctccatctttggatctcaggatccacccttagtgtgtcatcttaagagtgccggtgaaggaccagtgatctacgtgcacccaaatcaagtggatttcgggaatatttacgtgctgaaagactcatcaaggatcctgaacctatgcaaccagtcatttatacccgctttcttccaggcgcacatggcccacaaaaagtctctctggactattgagcccaatgaggggatggttccacccgagaccgatgttcagctggccttgactgccaatttaaacgatacacttaccttcaaggattgcgtcatcctggacatcgagaatagctcgacctaccgcatccccgtccaagcgagcggaacagggtcaactatcgttagcgataagccattcgctcctgagctgaacctgggcgcacatttttctctagacacacactattaccacttcaaactgatcaacaagggtcggaggatacagcagctcttctggatgaacgacagctttcgtcctcaagctaagctttctaaaaaggggagagttaaaaagggacacgcacatgtccagccccagccatctggcagccaggaacccagagacccccagtccccagtttttcacctccacccagctagcatggagctatatccaggacaagctatagatgtgattctggaagggtactctgccacccctcgcatcgtcaaggagaaacttgtatgccatgctatcattggggctcagaagggcaaatcactcgtcatggccgtaaatataacgtgtgaattcgtggcgccactgatccagctgagtacaaagcaattgatctacaggttggaaaagaaacccaattcaattctgaagcccgattatcaaccccttgctataaagaacatttctacccttccagttaaccttctgttgtctacaagtggccctttttttatttgcgagacagacaagtctctgctaccagcaaccccagagccaatcaagctggagattgatgaagagaaaaatttgctgatcaagttcgatccctcttacagaaacgacctcaataactgggtggccgaggagatactggccattaaatatgtggaacatccccagattgattctctggatttgcgtggcgaggtgcattatcctaacctatctttcgaaaccaaggaactggactttggctgcatcctaaacgacacagaactgattcggtatgttacaattacaaattgcagcccgctcgtggtcaagtttcggtggttttttcttgtgaatgatgaggaaaatcagattcgctttgtgaccctgccaaagaagccttactctgccccagtctcacagatggagtcaatcccggctacctctgaagcagcctcaccccctgctatcctagtcacagtcgaaagtccagaaatggacctcaacgacttcgtcaagacggtgctggtcgatgaagatgcccgtccagaagaaaaggagctgagaaagactaaggcaagcagcgtcatcagtgacgagattaagatctcctccacagaaatcgagcgcatatacagttcccagtctcaggtggaagaccaggaaagcctccagacctgtgagcaaaatgagatgctctccattgggattgaggaagttttcgacatcctgcccttgttcggggtgctgcagccgcactccagccatcagatcagctttacattctatgggcacgcgaacatcatcgcccaggcaaaagccttatgtgaagtggaggaaggtccgacctatgagatcaccttgaagggcgaagcctctctcgtcaactactccttcgataccaaagacatccattacggtctgcagctgttcgaccatgtgaccgagcgtgaaatcactcttacaaacatggggaaagtcggcttcgaatttaaggtcctgaccgaccatcagtcctcccctgacaacttgctgcctggggtgcccttaattttacccgtgtctgggtttatttcgtcgcaccaggagcaggtgcttaaggtatattacttacccggagttcccgaggtgttcaagaggtcatttcagattcagatagcacatctcgaccctgagaacattaccctttccggggagggcattttcccgcagatttgtctggacctccctcggaacctcaccgcaaacgagaaatatgaaatgtttctcaatcaggcccgaaaaaacacagacaaagaatacaacaagtgcgagatgctggaccactttgatattataacagaagaggtgcctgaggatgagccagcggaagtaagtgctcacctgcagatggaagtcgaacgcctaatcgtacaatcctacgtgctggaacaccagaaaacaacaactcccgacccaatggatgatccatgcttctcccatcgcagtcgcagaaagctcgccaagatccagctgcccgaatacattctggacttcgggtacatcatcctgggcgaggtccggacacatattatcaaaataatcaacacatcacactttcccgtgtctttccacgccgacaaaagggtcctgcacgaaaccggattcagcacagagcttgacagggtgaaaaatctgcctcactgcgaaacagaaatctttgaagtgagattcgatccccagggagccaatctccccgtgggttcaaaagaggtgatcctcccaattaaggtcgtcggaggacccactgtgcacatctgtctccaggccaaagtaaccatacctactatgacactctctcggggtaaggtggatttcgctacaatacagtgtggccagtgtttagtagaaacaatccaactaagcaaccatctgcaggtcccatgtgagtggttcgtacagagccagaagccggtcgataagcttgagaagcacatgccaaaatatctgaggcaaaaacttcgggcagagttaaagcctaaaactagaattttcgagatacaaccaatctctggagtgctagatccgggagaaaagagcaatgtgcaagtcaaattcatgcctaaagaggaaaagttctatagtcagactctggtgtttcagatcgctcagagcgctcagaagttgacactcctggcgaggggacaggggttggagccacgactggaatttagcccctccgtgctggacttgggtcccctgttgctgtgcgctcccggtgacgaggccgaggtgatcgttaaaaacccttgtaactttcccatagaattctacagccttgaattcgatcagcaatacctcatcgaggagaagatcctgcggaagctgaaagggtacgattcttataataccctcctcctgccccctcgcaacccaggggagaaactgcccccagagctttacgagtatttcaaggagatcaagaaaagcaaggaagaacagatgcgcgcaaagtacctcgaaaacctagcgcaagaaaacgaagaggaggatatcacctccagcgatcaggggacgtctaacagtaccaaaagaacatcactgtcgagaggcatcagtgttacctcaaacttagaggagtggcacgccctgctggtggagtccaagacttacctggaggaggaagaagatgaagagtccctcgaaaagatcattttccaaacagacaagttgcagtcaatagattcccacagcatggaggaggtgggggaggtggagaacaatcctgtctctaaagcgattgccagacatctaggcatcgacatctccgctgagggacgtttggcgaagaaccgcaagggcatagccatcattattcacgggactcctctctccggaaaatccgccaacgcagtgtcagtggccaagtactacaacgccgcttgcctgagcattgattctatcgtgttagaggcagttgcaaatagcaataacatcccgggaatcagagcgagagagctatgtatcagggcagctatagagcagagcgtgaaggaaggcgaggaggccgctcaggaggccgctgtgggacaaaatgttatcggccagggcaggctaagtacggacacactcggcaagctcgcctctgagatgaccctagtggctccagagataaagcccggtaaatcggtccgcggatcagtcgttatcaccaagagcaaggcagactcccacggctccggttcccagaaacagcatcactctcaccagagtgagacaccccaaatttcctcctccccactgcccccaggccctatccataggtggctttctgtgtctcctagcgtcggcggtgagacagggctgatgagttgtgtattgccagatgaactcctagtgcagatactggcggaacgtatccagctgagcgactgctacaggggagtagttttcgacggactggacaccctatttgcccagaatgccgcagctgcactcctgtgcttacttaaggccatcggcagccgtgaacacatttatatcctgaatatggcacaggactatgctgccatgaaggcccaggaaaaggcaaagaaagagcaggaggagaggaagcacaagggcgcactggaaaaggagaaggaaagattgcaaaacatggacgaggaggaatatgacgccctgacggaagaagagaagttaactttcgatagaggaattcagcaggcgctgcgtgaacgaaagaaacgagagcaggagcgactcgcaaaggaaatgcaagaaaaaaagctccaacaggaactggaacggcaaaaagaagaagatgagctcaagaggagggtgaagaaggggaagcagggccctatcaaagaggaacctcccatgaaaaaatcccaggctgctaacaagcaggtccccccactgacgaaggtagatgtgaaaatggaaaccatcgagcgcaaaatcagcgtgcgcgagcagacaatgagcgagaaggaggagcttaataaaaaaaagcgcaacatgggggacgtgagcatgcatggtttgcccttggtgcaggaccaggaggactccgagggggataattctaaggaccccgataagcagcttgccccaaagttcaaaacctatgagcttactctcaaagatgtccagaatatcctgatgtactgggatagaaaacagggggtacagctgccacccgctgggatggaggaagctcctcacgagccagatgaccagagacaggttcctctgggaggtcggcgaggacggaaagatcgtgagagagagagattggagaaagagcgaaccgagaaagaacgcctcgaaagggagaaagcagagcgcgagagacttgagaagctccgggcattagaagaaaggtccgattgggaaggcgaaggggaagaggatcatgaaggtaagaaggagaaagatctgggagtgccctttctggatattcagactcccgactttgaggggctcagctggaagcaagcattagagagcgataaacttcccaagggcgaacaaatcctcgacattctgggcctgggcgcttctggcccacccataccccctccagcactgttctccattgtgtcctatcccgtcaagcggccacctttaactatgactgacgacttagaacattttgtatttgtgatccccccttcagaagatatctctttggatgaaaagaaggagatggagattgagagtgattttctggctacgaccaacactacaaaagcccaggaggagcagacaagtagctctaaggggggtaaacagaagatgaaggaaaaaatcgatcaggtgtttgaaattcaaaaggacaaaaggcacatggcactaaaccgcaaagttctcagcggtgaacccgctggaacaataagccagctgagcgatacagacctggacaacttcaacggccagcattcccaagagaagtttacccggctgaatcacttcaggtggatcgtgccggcaaatggtgaggtgacgttgcaagtgcactttagttccgacgaatttggtaatttcgaccagacattcaatttcgaaatcctgggtacctgctgccaatatcagttgtactgtcggggaatctgtacctacccgtatatttgtcaggatcctaaagtggtgtttcctcaacgaaagatggatatgaaaacaaatgaagtcatatttaagaagtatgtcatgagtactgaaacctactatttcggcccactgctctgcgggaaatcccgcgacaaatacaagagtagtctatttccaggaaacatggagacactgaccatactgaatacctctctgatggttgtggaagcctctttctactttcagaacgacgtgaaagccaacacttattttctggaacccaataccatggtgctcaaacctaatgaaaagcagatcttaaacgtatgggcataccctaccagcgtgggtgtgtttgaggatagcatcgtgtgttgcattaatgataaccctgaacctgctatctttcagctgtcatgccaggggataaggcccgagctggaactggagccgagacaactgcacttcgatcgtctgctgctgcatcggcaggagagcagagttgtgttgcttaggaatgtgaccctgctccctgtcgcctggagaatcacttctctggaacatttgggggacgatttcactgtgagcttgatgcagggcacaatacctccagaggccgagtacggcctacatctgtatttccagccaactaaaccagtcaacatcaagaaagctattcggctggaagtgcttgatgctgaaaaccttctgggggtggtccaaatcgaaaacataatggtgtttgctgaagcatacgacatagctcttgatatcacctttccaaaaggtgctgagggtggactggatttcgggatcgttcgcgtcaccgaggaagctaagcagccacttcaactgaagaatcggggaaagtacgagatcgctttctccttctctgtggattccgtgggcatttccaccccaaacatcaattctatgatcagtgtgcagcccaagaagggctctctaacccctaccgagaagccaaccaatgtgcaggttttcttccacgcgaaaaaggaagttaaaatcgagcaccagccggtgttacggtgtcagatcatcgaaccaaacatctcagagggcggagaaatcatagctagcattccaatcaagttctccgcaaatgccgtgtactctaagtataatattacccccagtagtgtcataaactttggcgctctgatctgcgggaccaggaagtcaaccacctttaccattgagaaccagggtgtgactgatttcaagttcgctctctacaagcttaccggcgaatccccgattcaccagaaaaaggcagcgtcccacgtgcgccacgcacgctctagggagtcagagagtttctataaaacaggcagctcccgggcagctaaattcagtgatacaatccaaaaggaagtgaccacaacaggacaagcgcgttttgcacacgggatgtttaccgtgtatcccggtttcggctctattccttccggcggtcaacaggtcattaatgtcgactgcgtagccgatgctatggggaagtgtgaggaattcattgctatcgacatcagcggtcgcgaccccgcagtccaccccgcaggcatactgtacacactcttagccgaggcatgcttgcctgcgttcgtcacagagaacaatgccctgattttcgaagaacatcagatttgcacaagcgcaaatttgcaccatatcctgcagactatcgagagcgggggattgttcgttgaggatgaaaataaattcattttctgcaacgttctcgtgggccgtcaggccaaggctaggttcaagatttctaatgtggggaaaatcacctgcgacgtaaacatagtggtgaggcctatctccaataaaccgtttgcaaggattgttgacatttttgaggtggaacccagcaaaatgtgcattgcttcccatagccacgcattcgctacagtgtctttcaccccccagattatgcagaactaccagtgcattttcgaagcaacactagacgggcttcccagcactttagcaaagtcacgcggacttgttttcgacattgctggggagggcaacttgcctcgggtgacagtggtcagaccagtgctccataaccagtatggcaatcctctgcttctgttcaagagactgcttttggggcactcagagaagttgcctctcattctcaaaaacaatggcgtgctgcctgcgcagctccatgttgacctccaggacgaattgggtgtgttcagcctcaagggcagacccactacagcctacatttacatcaccgaggagaacaaaccccatgttaaagcgaagaaagctcacacagcttcgctagtggtttcaccaggggacaccgctgaattcgacgtggtgttccactcccaaaaagtcggcaggatgagaggaattatccacctgtccgtcattaacaatcagtacgaggagactagtatccatatggttggggagggctatgaagatgatataacgctggacaacatccacggattggtggctccaacctcacaggaggatatctccatatctgagttcactgagatcattgaagataatgacatggaggacctggttgcagcagcacttgtggatcatattcagttcggagattgtcacatcgggcactcatataacgccagctttacagtcactaaccattcgcaggtgaacctcattcggtttgagtggcctgtgagtgcaacgatagctttcagccctcagatgggccatcttcatcctggctgcgcaaaggatatagttgtaactatgaagtctgatgtcccgattaatttaaagaatatgcggatccggtgtaaactctcccgtattatgtttcagcttcccgctgatcaggtgcccgattgggacgatcggatgcacactgttaaatgggttgacgtcccccgaaacatgccaggcacctttacgaccaagcgaaaggtgattgagactgaccctgagccagctcactcagtcctagaagagaattaccaggaacttcaactccagatttcggcaaatgtggacttcgcgtcataccattgccaggcacgggacgtgcgctttaaagaaactctcgtatatcagacccgtgtgttcgagtttgacgtaataaattccgggagagtgcagctggaattctcgtgggtctccgaagatacctcaaaggcagttagtttcgctaaacccgatcaccaagggtcagcccagaaggatcagctgagccagggtaccatgcacactggatctactctcgactcaacaatggaccattgggccgaagggtccccacaaccctttagcgtggaaccatcatcaggaattgtgccagttgggaaaatccaaaagttcaaggtcaagtttagtcctctcgatattggcgacttcgagtctaatttgttctgtcagatccctaacctcccccctggcgagcaaggacctgttctggttgcaaaaggccgaagtactctccccatatgccatttcgatctgaaggactccgactacatctcagggcaccagagaaacccagaactgcggggaagttctggtggagcactcgacccaaacacacgggttattgagttcacaactgtcggcatcggcggtaagaatctgcgcaccttcaccattttaaaccctaccaattctacctattccttttgttggatctctgaggagatcgaatccctccagaaccccgcagctttcacatgcctcaccgagaaagggttcatccatccagaaaagaaagcagaaatcgtgttccagtttaccccctttcacctgggaattactgaaagctcctggacattccttattccagaacataatataacggtgcccttccttctggtcggtaagaccactgaacccctgatttccttaaacaaatcccaccttaacttctccagcttgctcatcggtagagaggcgcgtgagaccgtgcagataataaacaaagaggaacagggattcgacttctccttccaggataactcacgatatagtgagggcttctctaatagtttgctggtatgtcctatggaaggatggattccccctctcagccggttccctatcgacattttctttacgccgaagcaggagggagacgttaacttcaacttgatttgcaacgtggaaaagaaggtgcaccccgtcacactgaacgttaaggcagaaggctacaccatgaacgtggaaataaagtgcaaagatcgaacaggctccattactttattgactcctaaccagactaacatcataaacttctacgaggtggagttaaatgaatgtgttcagtgtgaatttaatttcatcaatacagggaagtttacttttagcttccaggctcagctgtgtgggtccaagactttgctacagtatctggagttctcccccatcgatagcacagtggacgtggggcaaagtgtgcacgccaccttgagcttccaacccctaaaaaaatgtgttctgacagacctggagctaattatcaaaatctcccacggcccaacctttatgtgtaacatttctggatgcgctgtctcccctgctattcacttttccttcacctcttataacttcggcacctgttttatataccaggccggaatgcctccctacaaacaaactctagtgatcactaataaagaagagacgccaatgagtattgactgcctgtacaccaatacgacacacttggaggtgaacagtagggttgacgtggtgaaacctgggaacactctggagattccaattaccttttatcctcgtgagtcgatcaactaccaggagctcatccccttcgaaattaatggactcagccagcaaactgtcgagattaaaggaaagggcacaaagatgaaaattctggttctcgatccggctaaccgaattgttaaactaggagcggtcctgcccggacaggtcgtaaaaaggactgtgagcattatgaacaattctctcgcccagctgacttttaatcagagcatcctattcactatcccagagctgcaggagcctaaagtgctgactctggccccttttcacaacatcacccttaagccgaaagaggtctgtaaactggaagtgatttttgcgccaaagaaacgtgttccccctttctccgaggaggtgttcatggagtgcatgggtctattacggccactgttcctgctgtcagggtgctgccaagcactggagatatccctggaccaagagcacatcccctttgggccagtggtatatcagacccaggcaacccgcaggatcctgatgatgaatactggtgacgtaggggcacgattcaaatgggatatcaaaaagttcgaaccacacttcagcatttcacccgaagaaggctatattacatcggggatggaagtctcgttcgaggtgacatatcacccgacagaggtgggaaaagagagcctgtgcaagaatattctatgttacatccaaggcggttctcccctgtcactgacactatccggagtatgtgtcggtcccccagcggttaaagaggtggtgaacttcacttgccaagtgaggagcaagcacacgcaaaccatccttctctccaatcgcaccaaccagacctggaacttacaccccatatttgagggagaacactgggaggggcctgaattcattactctggaggcccaccaacaaaataaaccttatgaaataacctatcgaccccgaaccatgaatttggaaaaccgcaaacaccaaggaacactgtttttccccctgccagatgggacaggatggttatacgctctgcatggcacttcggaattgccgaaagccgttgcaaacatctatcgtgaagtgccctgtaagacaccctacacggagctcctgcccattacaaactggctaaataaaccccagcgcttcagggtgatcgttgaaatcctcaagccagagaaacctgatctgtccattaccatgaaaggcctggattatattgatgtgcttagtggcagcaaaaaggattacaagctgaatttcttctcccacaaggaaggcacatatgctgcgaaggtgatcttccgcaatgaagtcacgaatgaattcctatactataatgtcagttttcgggtgataccgtcaggaattattaagactattgagatggtgacacctgtccgtcaagtcgcctctgcctcaatcaagttagagaatcctctgccttacagtgttacgttttcaactgagtgcagaatgccagatattgctctcccttcacagttcgttgtgcctgccaactctgaggggactttcagctttgaatttcaacccctgaaagccggtgagacctttgggaggctcacccttcacaacactgacctggggtactaccagtatgaactatacttaaaagccacacctgctctccctgaaaagcccgtccattttcagacagtcctcggctcttctcagataatccttgtgaaattcatcaactatacacggcaaaggaccgagtactactgtagaacagactgtaccgattttcatgctgagaagctgatcaacgcagcgccaggaggacagggaggcactgaggcatccgtcgaggtgctgtttgaacctagccacttgggggagactaagggcattcttatcttaagtagcttggccggaggagagtacatcattcctctgtttggcatggctctgcctcctaagccacaagggcctttcagtattcgagcgggatattcaatcatcatccccttcaaaaacgtcttttaccatatggtgaccttttctattattgtcgataaccccgcattcacgatcagggcgggagagtctgtgaggccaaaaaagatcaacaacataaccgtatcctttgagggcaatccctctggttccaaaacgcccattacaacaaaactgacagtcagctgcccgcctggcgaaggtagtgagactggggtgaagtgggtgtattatctaaagggaatcactctttaa

SEQ ID NO: 226483 - DNA, 2853 bp, Artificial Sequence
  Description of Artificial Sequence: Synthetic coding sequence
atggagagtgctgggggatttaaactcggaatggaaccactatcaggcggtggggtgtgtgagaaaaaaaaattgctgaaaatgacatctagacggctcgaagagagtatgggtgctgtccagatgggtctcgtcaacatgttcaaggggttccagtctaaggtgttaccgcctttgtctcctaaagtggtgacagaagaggaggtgaataggatgttaactccatcagagttcctcaaagaaatgtctctcaccacagagcagcgattggctaagacccgcctgatgtgccgtccacagattatagagctcttggatatgggagagacaacccaccagaaattctctggcattgatctggatcaggccttgtttcagccttttccttcagagattatctttcagaactacaccccgtgtgaagtgtacgaagtgcccttaatcctgcgaaataatgataaaatccctaggctggtcaaagtggtggaggaatcaagcccgtacttcaaggttatcagccctaaagatatcggccacaaagttgctcctggcgtgccatctatatttcgcatactttttacccccgaagagaacaaggattatgcgcacactctgacctgcgtgacagagagagaaaaatttattgtccctattaaggccagaggcgctcgagccattctcgattttcccgacaaactgaactttagcacatgtccagtgaagtatagcactcagaagatccttctcgtgcggaacatcggaaataagaacgccgtgttccacatcaagacttgcagaccgttttcaatcgagcctgctattggcacactgaacgtcggcgagagcatgcagctggaagttgagtttgaaccccaatcggttggtgaccattccgggcgacttatagtctgctacgacacaggagagaaggtgtttgtttctctgtacggggctgccattgatatgaatatacggcttgacaagaatagcctcactatagaaaagacctacatatcgctcgctaaccaacgcacaattactattcacaatcgttctaatatcattgcgcacttcttgtggaaagtgtttgccactcaacaggaagaagacagggagaaatatagggcctgtgacgatctgataaaggaagagaaggatgaaaccgacgaattcttcgaagaatgtatcacggaccccctcctgcgggagcatctgagcgttcttagtagaacatttgctaatcagagacgattggtgcagggcgactctaagctgttttttaataacgttttcacagttgagccgttggaaggagatgtgtggcccaatagttctgccgaaatcacagtttattttaacccactggaggccaaactgtaccaacaaactatttactgtgacatccttgggagagaaattcgattacccctccgaatcaagggagaaggcatgggacccaagattcacttcaacttcgagcttttagacatcggcaaagtattcacaggctccgcacactgttacgaggctatcctgtacaacaagggatcaattgacgctttgttcaacatgactccacctacatctgcactgggcgcttgctttgttttctctcctaaagagggcattatcgagccctccggcgtacaagcaattcagatctccttcagttcaaccatcctgggcaacttcgaagaagagttcttggtcaacgtcaatgggtcccctgagcctgtgaagcttacaataagagggtgtgtgattggcccaacctttcatttcaacgtgccggcactgcatttcggcgacgttagctttggatttccccacacactcatctgcagcctgaataatacgagcttgatccctatgacctataagctgaggatccccggtgatgggctcggccataaatcaatcagctattgtgagcagcacgtggactataagcggccatcctggaccaaggaagaaatctctagtatgaagccaaaggaattcacaatctcgcctgactgtggtaccatccggccacaggggtttgcagctattagggtcacgttgtgctctaacaccgttcagaaatatgagttggccctcgtcgtggatgtcgagggcatcggcgaagaggtgctggctctgctcattactgccagatgcgtcgtcccggctctacacttggtgaacacggaggtggattttgggcattgcttccttaagtacccatatgaaaagactctgcaacttgccaaccaagatgatctgccaggcttctacgaggtccagccacaggtttgtgaagaggttccaacagtattattctcctcacctacaccatctggcgtcatcagcccgtcaagcaccattcatatcccactggtgctggagacgcaggtcacaggcgaacataggtctactgtctatatctcaatttttggatctcaggacccacccctggtttgccacttaaagagtgccggagaaggacccgttatctacgttcatccgaaccaggtggatttcgggaatatctacgtcctgaaagattcctctcgcatcctgaatctgtgtaatcagagtttcattcccgctttctttcaggcccatatggcccacaaaaagagcctctggactattgagccaaacgaaggtatggttcccccagaaactgacgttcagctagctctcacagcgaacctcaacgacactttaacattcaaggattgtgtgatacttgatattgagaattcctctacatatagaattcctgtgcaggcttccggaacaggctcaacaatcgtcagcgacaaaccctttgccccagaactgaacctcggagcgcattttaggtag

SEQ ID NO: 226484 - DNA, 2823 bp, Artificial Sequence
  Description of Artificial Sequence: Synthetic coding sequence
atggagagcgccggtggtttcaagctgggggagaaaaaaaaactgctcaaaatgaccagcaggcgactggaggaatctatgggtgcagtgcagatgggtctcgtcaatatgtttaaggggtttcaatccaaggtgctgcctccactttcgccaaaagtggtcactgaggaagaagtgaaccggatgttgactccttcagagtttctgaaggaaatgtctttgactaccgagcaaaggctggccaaaacccggctgatgtgccgacctcagattatcgagctgctcgatatgggagagactactcatcagaaatttagcggcatcgacctggatcaggcattatttcagccattcccctctgaaattattttccaaaactacacaccttgtgaggtgtacgaggtgcccttgatcttaaggaacaacgataagattccacggttggtgaaggtggtggaagaatcttccccttattttaaagtaattagccctaaagatataggacacaaagtggccccaggcgttcctagtatcttcagaatcttatttaccccagaagaaaacaaagattacgcgcatacactcacttgtgtcacggagagagagaaattcattgtccctattaaagctaggggtgcgcgagctatccttgatttccctgataaactcaatttcagcacttgcccggtaaaatattctacgcaaaagattctcctggtgcgtaatatagggaataaaaacgccgtctttcacatcaaaacgtgtaggccattctcaatcgaaccagctataggaacgttgaatgttggcgagtccatgcagctggaagtggaattcgagcctcagagtgtgggggaccatagcggcagactgattgtttgttacgataccggcgaaaaagtgtttgtctcgctgtatggagccgcaattgatatgaatattaggttagacaagaatagtttgacaattgaaaagacatacatcagcctcgcaaaccagcggacaattacaatccacaaccgaagcaatattatcgcacatttcctatggaaagtcttcgcaactcagcaagaagaggatcgggagaagtatagagcttgcgacgacctgatcaaagaagaaaaagacgaaacagacgagttcttcgaagagtgcattacagatcccctcttgagagaacatctctctgtgttaagtaggaccttcgccaatcagcggaggctggtgcaaggagattcaaaactgtttttcaacaatgtgtttaccgtcgaacctctggaaggggacgtttggcccaacagctcagctgagatcaccgtttatttcaatcccctcgaggcgaagctgtaccagcagacaatatactgtgatatcctcggcagggagatcagactgcccttgcgtatcaagggagaaggaatggggccaaagattcatttcaatttcgaattgttagatattggcaaagtgttcactggatccgctcactgctacgaggccattctctacaacaaagggtctattgatgccctctttaatatgaccccaccaacgtccgctctgggagcctgtttcgttttttcaccaaaagaggggataatcgaaccttcaggtgttcaagccattcaaatcagctttagcagcaccatacttggaaactttgaagaggagtttctcgttaacgtgaatggttcacccgaacctgttaaactgacaatccgcggttgtgtcattggacccacatttcacttcaacgtaccagcactccactttggagacgtgtcattcgggttcccacatacgttgatctgctctttaaataacacaagcctcattccaatgacatacaagctacgcataccaggcgacggactcggacataagagtatatcctactgtgaacagcacgtcgactataagcgtcctagctggaccaaagaggagatctcctcaatgaagcccaaggagttcacaatctctcccgattgtgggacgatccgccctcagggatttgcagctatccgggtgaccctgtgcagcaacactgtgcagaaatatgagctcgccctggttgtagacgtggaagggattggagaggaggtgttggccctgctgattacggctagatgcgtcgtgcctgcactgcacctggttaacaccgaggtcgactttggtcactgcttcctgaagtatccatatgaaaaaaccctccagctcgctaaccaggacgacctgccgggattctacgaggtccagccccaggtgtgcgaggaggtgccaactgtgctgttctcctctcccacaccaagcggagtaatttccccctcctcaaccatacatatcccccttgtgctggagacccaggtgactggcgaacataggtccaccgtctacatatctatctttgggtcccaggaccctccgttggtgtgtcatcttaaatcagcaggcgaaggtcctgttatatacgttcaccccaaccaggtggattttggtaacatctatgttttaaaagacagcagccggattctgaatctttgcaatcagtcttttatccctgccttcttccaggcccacatggctcataagaagtccctttggaccatcgagccaaacgaaggcatggtgcctccagagaccgatgtgcagctcgcattgactgctaacctgaatgatacactgaccttcaaggattgtgttattctggacattgagaattcgtccacatacaggatccccgttcaagcctcgggtacaggatcaaccattgtgagcgacaaacctttcgcccctgagctgaacttgggcgctcactttagatag

SEQ ID NO: 226485 - DNA, 15363 bp, Artificial Sequence
  Description of Artificial Sequence: Synthetic coding sequence
atgacgtctagaagattggaggagagtatgggcgcagtgcagatggggttagtcaacatgttcaaaggctttcagtcaaaggtcctgcctccactcagtccaaaggttgtgaccgaagaagaagttaaccggatgctgaccccctccgagttcctcaaggagatgtctctgactactgaacagcgattagcaaaaacgagacttatgtgtagaccgcagattattgaattgctggacatgggcgaaacaacccatcagaagttttccggcattgatctcgaccaagcactctttcagccatttccaagcgagatcatctttcaaaactataccccttgcgaagtgtatgaggtgcctctgattcttaggaacaacgacaagatcccccgattggttaaagtcgttgaggagtcctctccatacttcaaagtgataagccctaaagacatcggacataaagtggctcctggcgtgccgtccatcttcaggatactgttcaccccagaggaaaataaggattatgcacacacactaacctgtgttaccgaacgggagaagttcatcgttcctattaaagccagaggcgcaagagccatcctcgatttccccgacaagctcaacttcagtacttgtcccgtgaagtactcaacccaaaagatccttctggtaaggaatattggcaacaaaaacgcggtgttccatattaagacatgccggcctttttcaatagagcctgccataggaactctgaacgttggtgaatctatgcagttggaagttgagtttgagccccagtcagtgggagaccattctgggagactgattgtctgctacgatactggtgagaaggttttcgtgtcactgtatggggctgccatcgacatgaatataagactcgataagaacagcctaaccatcgaaaagacctacatttccttggctaaccagagaaccatcactattcataatcgctccaatatcatagcccacttcctttggaaggtctttgctacacagcaagaagaggatcgggaaaagtaccgtgcgtgtgatgatctgattaaggaggagaaagatgaaaccgatgaatttttcgaggaatgtatcacagaccccctgctccgcgagcatctcagtgtgctttctcgcacctttgccaatcaaagacgcctagtgcagggtgattcaaagcttttctttaacaacgtgttcacagtggagcccttggaaggcgatgtgtggcctaacagctccgccgagattaccgtctacttcaaccctctggaggcgaaactgtatcagcagactatttattgtgatattctcggccgagaaatccgcttgccattaaggataaagggagaaggcatgggcccaaagatccacttcaactttgagttactggatattggcaaagtctttactggttcagcccattgttacgaggcaatactgtataataaaggctcaatagacgccttgttcaatatgaccccccctaccagcgccctgggcgcatgcttcgtgttttctcccaaggagggtatcatcgaaccatcgggtgtccaagcaatacagataagcttctctagcacaattctggggaattttgaagaggaattcttggtgaacgtaaatggttcgccggagcctgtgaaattgacaattcggggttgcgttatcggccctacttttcattttaacgtacccgcactgcacttcggagacgtgagcttcggctttcctcatactcttatctgttccttgaacaacacaagcctcattccaatgacctacaaactcaggataccaggcgacgggctaggccacaagagcatcagctattgcgagcagcacgttgattataaacgcccatcctggactaaagaagagatatcgtctatgaagcctaaggagtttacaatttcccctgactgtggcaccattaggccacaggggttcgctgctatcagggtcactctttgctccaatactgtccaaaaatacgagctcgccctggttgtcgacgttgagggtataggcgaagaggtcctggctctgttgatcactgcccgttgtgtggttcctgccctgcatctagtgaacaccgaggtggacttcggacactgcttcctgaagtacccctacgagaaaactctgcaactcgcaaaccaggacgacctgccaggattttacgaagtccagccacaggtctgcgaggaggtccccacagtcctgttctcgtctccaaccccatcaggggtgatatcaccgagctctacaattcacatccccctggtgctggaaacccaggtgacaggtgaacatcgctccacggtctacatctctatcttcggctctcaagatccacccctggtgtgccatctgaaaagtgcgggagagggtcctgtgatttacgtccaccccaaccaggtggatttcgggaatatttatgtattgaaggatagttcacggatccttaacctgtgtaatcagtcctttatccccgcttttttccaggctcacatggcccacaagaaaagcctctggactatcgagccgaacgaagggatggtacctcccgaaaccgacgtgcaacttgcgttaactgcgaacttaaacgacaccttgaccttcaaagattgcgtgatccttgatattgagaacagctcaacttaccggatcccagtgcaggcttctgggacaggtagtacaattgtgtccgacaaaccatttgcaccagaattaaacctgggcgcacacttctctctcgacacgcactactaccattttaagcttatcaataaaggcaggcgcatccagcaactgttttggatgaatgacagttttcgcccacaggccaaactgtctaagaaaggtcgggttaagaaaggtcatgcacatgtccagccacagccatccggctcccaagagcccagagacccacagtctccggtctttcacttgcaccccgcttcaatggaattgtatcctggccaagccattgatgtcatcctggaaggatactctgctacccccaggatcgtgaaagagaagcttgtatgccatgccataataggtgcccagaagggcaagtcccttgtgatggccgtgaacattacgtgcgaattcgtggcccctctcatacagctttcaactaagcagttgatatacagacttgagaaaaagcctaatagcatactaaaacctgattatcagcccctcgccattaagaatatttccaccctgcctgtcaacctgctattgtccacaagtggtcccttttttatctgcgagaccgacaagtccctcctccctgccactcccgagcccattaaactggagatcgacgaggaaaaaaacttgctaatcaaattcgacccgtcttaccgtaatgacctcaacaactgggtcgccgaagaaatcctggccattaaatatgtggagcacccgcagatcgattcattggacctgcgaggagaggtacactacccaaacctatcattcgagaccaaggagctcgatttcgggtgtatcttaaatgatactgaactcattcggtatgtaaccatcactaattgttcacctttggtggtgaagtttcggtggttttttctggtgaatgacgaggagaaccagatcaggttcgtgaccctgcctaaaaaaccctattccgccccagtgagccagatggagtcaatacccgctacttctgaggccgcttctcctccagctattcttgtaaccgtggagtctcctgaaatggatctcaacgactttgttaagaccgtattggtggatgaggatgctcgcccagaggagaaagaactgcggaagactaaggcctcatccgtgatatccgatgtaagatgtccattccacggagaggagcgcatctactctagtcagagtcaggtggaagaccaggagagccttcaaacctgcgagcagaatgaaatgctgtctatcggaatcgaagaggtatttgatattctcccgctgttcggggttcttcagccccacagtagccaccagatctcttttacattttatggacatgccaatatcatcgctcaggccaaagcattatgcgaggtcgaggaggggcctacttatgagattacccttaaaggcgaggcttcacttgtgaattattccttcgacaccaaggatattcattatggcctacagttattcgatcacgtgacggaacgcgaaatcaccttgacgaatatggggaaagtcggcttcgaattcaaggtgctcactgatcaccagagctcccctgataacctgctcccgggagtgcctctgatcctgcccgtgagcggctttatctcatctcatcaggagcaggttctgaaagtgtactatcttcctggagttcccgaagtctttaagcgatcatttcaaatccagatcgcccacctcgaccccgaaaacataacactctccggtgaagggatctttccccagatctgcctggaccttcctcggaatcttactgccaatgaaaagtacgaaatgttcctgaatcaggctcggaagaacaccgataaagagtataacaagtgcgagatgcttgatcactttgacatcatcacagaagaagttcctgaagacgagcccgctgaagtctccgcacatttgcagatggaggtcgaaagactgatcgtgcagagctatgtcctcgagcaccagaaaaccacaacaccagaccccatggacgatccatgcttctcacacagaagccgccgaaaactggctaagattcagctgcctgagtatattctggactttggctacattatacttggcgaagtccggacccatatcattaagattattaacacctctcatttccccgtcagctttcacgccgacaaaagggttctgcacgaaacaggtttcagcactgaactcgaccgcgtaaagaacctcccccactgcgagaccgagatttttgaagtgagatttgacccccaaggagcaaatctccctgtaggatctaaggaggttatcctgccaattaaggttgtgggaggtccaactgtgcacatctgtctgcaggctaaggttacgatccccactatgaccctctctcgcggtaaggtggattttgctaccatccaatgtggacaatgcctcgtcgagacgatccagctgagcaatcatctgcaagtcccctgcgaatggtttgtccagtctcagaaacctgtggacaaactggagaagcatatgccaaaatacttgagacagaaattgcgcgctgagctgaaacccaagacccggatctttgagatacaacctattagtggggttctggacccaggagagaagtctaatgtgcaggtcaagtttatgcctaaggaagagaagttctatagtcagaccctagtcttccagattgctcagagcgcccagaagttgaccctgttggcccgagggcagggcctcgagccacgtctggaattttctccctcagtgctggatcttggcccactgctcctatgcgcccctggggatgaggctgaggtcatcgtgaagaatccttgtaactttcctatcgagttctatagcctggaattcgatcagcagtacctcatcgaggagaagattctgagaaaacttaagggatacgatagttataacaccctgctgctcccacctaggaatcccggtgagaaacttccccctgaactgtacgagtactttaaagaaattaaaaagtctaaggaggagcagatgcgggctaaatacctggagaacctggcacaggagaacgaggaggaggacatcacatcatccgaccagggcacatccaatagcactaagcggaccagtctgtctagaggaatctccgtgaccagcaacctggaggagtggcacgctctgctggttgagagtaagacatacctggaggaggaagaagacgaggagtcactggagaagatcatcttccagacagataaattgcaatcgattgactctcacagtatggaggaggtaggtgaggtggaaaataacccagtcagtaaagccatagcccgtcatctggggattgacatctccgctgagggtcgcctggcaaaaaatcgcaagggaatagctatcattattcacggaactccactttcaggcaaatctgcaaatgcagtgtccgtggccaagtactacaacgctgcctgtctttctatcgatagcattgtgctagaggccgtggccaactccaacaacattccaggcatcagggcccgtgagctctgcatccgggcagccattgagcagtccgtgaaggagggggaggaagccgctcaggaagccgctgtgggccagaatgttattggccagggcaggttatccacagacactctgggtaagctcgctagtgagatgacccttgtcgcacccgagatcaagcccggaaaatctgtgcggggttctgtcgtgatcacaaagtccaaagctgattctcacggcagtggatcccagaagcagcatcattcgcaccagtcagagacaccgcagattagtagctctcccctgccgccaggtcccattcaccgatggttaagtgttagtcctagtgtgggcggagaaactggacttatgagctgcgttcttcctgatgagttgctcgtgcagattctcgccgaaaggatccagctttctgattgctataggggagtagtgtttgatggtttagatactttgtttgcacaaaacgcagccgctgcacttctctgtctgcttaaagcaattggctcccgggagcacatatacattctgaacatggcccaagattacgccgcaatgaaagcccaggaaaaagcgaaaaaagagcaggaagagagaaagcataagggcgctctggagaaagagaaagagcgcctgcaaaacatggacgaggaagaatatgacgccctaaccgaggaggagaagctgactttcgatcggggaatccagcaggcactgcgggaacgcaaaaaaagagagcaggaacggctggcgaaggaaatgcaggagaaaaagttgcaacaggagttagaaagacagaaggaggaagacgagctgaagagacgggttaaaaaaggcaaacagggcccaatcaaggaagaaccccctatgaagaaatcccaggctgctaacaaacaggtccctcccttgacaaaagttgacgtcaagatggaaacaatcgaacggaaaatatcagtgcgcgagcaaacaatgtcagaaaaagaggagctgaacaagaagaaacggaacatgggggatgtatcaatgcacgggctgcccctggtccaggatcaggaggactcagagggagacaattctaaggatccagataagcaattagctcccaagtttaagacatacgaattgacgctgaaagatgtgcagaacattttaatgtactgggatagaaagcagggggtccagctgccacctgccggtatggaagaagcaccgcatgaacccgacgaccagcgccaggtcccgttaggaggacggagaggcagaaaggatagggagcgcgagaggctggaaaaggaacgtaccgagaaggagcggttggagagagaaaaagccgaaagggaacggcttgagaagctgcgagcactggaggagcgtagcgactgggagggggaaggggaagaggaccacgagggcaagaaggaaaaggatctcggcgtgccctttctagacattcaaacccctgattttgagggcttaagctggaagcaagccctggaatccgataaactgcccaaaggagaacagatactggacattctaggtctgggagcatcaggaccacctatcccaccccctgcactgtttagcattgtctcatacccagtgaagcgccctcccctaaccatgacagacgaccttgaacacttcgtctttgtcatcccgccttctgaagacatttcactggacgagaagaaggaaatggaaatcgagtccgacttcttggccacaaccaatacaacaaaagctcaagaagagcagacctcttccagtaagggaggtaaacagaaaatgaaagaaaagatcgatcaggtgtttgaaattcaaaaagacaagaggcatatggccctgaataggaaagttctgtctggtgagcctgccggaacaatctcacagctgtccgacaccgatcttgacaactttaatgggcagcattcccaggagaagtttactcgcctcaaccacttccggtggatcgttccagcgaacggggaagtaactctgcaagtgcatttcagcagcgacgaattcggaaattttgatcagaccttcaacttcgagatcctcgggacgtgctgccagtaccagctgtattgccggggaatatgcacatacccctacatttgccaggatccgaaggttgtgttcccacagcggaagatggatatgaaaaccaacgaagtaatattcaagaagtatgtgatgagcaccgaaacatactactttggacccctgctctgtggcaagtccagggataaatacaagagttccctgttccccggaaacatggaaactctaacaatccttaacacttctctcatggttgtggaggcgtctttctattttcagaacgacgtcaaagccaatacttacttcctcgagccaaacacaatggtccttaagcctaacgaaaagcagatcctgaacgtctgggcctatcccacttctgttggggtatttgaagatagcattgtctgttgtattaatgataatcctgagcctgcaatttttcagctaagctgccaagggataaggccagagctcgagttggagcctcgacagcttcactttgacaggctgctcctgcatcgtcaggagtctcgggtggtgttgttgagaaatgttactttgctgcccgttgcctggcggatcacttccctggagcatctgggggacgacttcacggtctcacttatgcagggaaccataccccctgaggcagagtatggccttcacctttattttcagcctactaaacctgtgaacatcaaaaaagccatccgacttgaagttcttgacgcagaaaatctgctgggagttgttcaaatcgagaatattatggtctttgcagaggcctacgatattgctctggatatcacctttccaaagggggcagaagggggactggactttggtatagtacgcgttactgaggaagccaagcagccacttcagctgaagaatcgcggaaaatatgaaattgccttctctttctcggtggactcagttggcatcagtacgccaaatatcaatagcatgatctccgtccagcccaaaaaaggctctttaacccctactgagaagcccacaaacgtgcaggtattcttccacgcaaagaaggaggtgaaaatcgagcatcaaccagtactgcggtgccagataatcgagcctaatatcagcgaaggcggagaaatcatcgcttctataccaatcaaattctcagccaacgctgtctattccaagtacaacatcacaccttccagtgttatcaacttcggggcactgatctgcgggacaaggaagtcgacaacttttaccattgagaaccagggagtgaccgatttcaaattcgccctctataagctaactggcgagagccctatccaccaaaagaaggccgcttcccacgtacgccacgcccgttcccgggaatctgagtcattttataagaccgggtctagtcgcgcagctaagtttagcgacactattcagaaggaagtgactactacaggccaggcaagatttgctcacggcatgttcaccgtgtatcccggattcgggagcatccctagcggcggacagcaggttattaatgtcgattgtgtggccgacgcaatgggcaaatgcgaggaatttatagctatcgacatcagcggaagagacccagctgtccatccggcaggcatcctctataccctcctggcagaagcctgtttgccagctttcgtgaccgaaaacaatgcactgatcttcgaggaacaccagatttgcacgagcgcaaatctccatcacatcctacagaccatcgagtctggcggactcttcgtggaggatgaaaataaattcatcttctgcaatgtcctggttgggagacaggcaaaggctcggtttaaaatttccaacgtgggtaagatcacttgcgatgtgaatattgtcgtgaggcccatatccaacaagccatttgccagaatcgtggatatctttgaggtagaaccgtccaaaatgtgcattgcatcacacagccacgcctttgcaactgttagcttcacccctcaaatcatgcaaaattaccagtgtatcttcgaggccactctagatggcctgccctcgaccctggccaagagtaggggcttagtgttcgacattgcaggagaaggcaatttacctagggtcactgtagtccgaccagttctacataaccagtatggaaatccattgttgttatttaagcgcctcctcctcggccactctgaaaaactacccctcatccttaaaaataacggcgtgcttccggctcaattacacgtcgacctacaggatgagctgggagtcttttccctcaagggtcggccaacaactgcgtacatttatataactgaggagaacaaaccacacgtgaaagccaagaaggcccacactgccagtctggtagtttcaccaggtgatacagctgaattcgatgtggtttttcactcccagaaagtgggtcgtatgagggggattatccacctgagtgtcatcaataaccaatacgaggagacgtccatccacatggttggagagggctacgaggacgacattactctcgacaatatccatggccttgtcgcacctacgtctcaggaggatatcagtatctctgagttcacagaaatcattgaggacaacgacatggaggatctggtagctgcggcactcgtggaccacatccagtttggggattgtcatattggccattcctacaatgcctccttcactgtgactaaccactctcaggtcaacctcatcagatttgaatggccagtctccgcgacaattgcattctcacctcaaatgggccaccttcaccccggatgtgccaaagatatagtggtcaccatgaaatcagacgtgccaatcaatttaaaaaacatgcggatccgttgtaagctttctagaatcatgtttcagctgcctgcggaccaggttcctgattgggacgacagaatgcacaccgtaaagtgggtggatgtgccgaggaatatgcccggaacgtttactacaaaaaggaaagtcatcgagacagaccccgaaccagcccactcagttctggaggagaactaccaggaactccagcttcagatcagcgccaacgttgattttgcctcctaccactgccaggcacgtgacgtgagattcaaggagacactggtataccaaactcgcgtattcgagtttgatgttattaacagtggcagagtgcagcttgagttcagctgggtcagtgaggacacaagtaaggcggtgagcttcgcgaagcctgaccaccagggcagtgcgcaaaaagaccagctatcgcagggaactatgcatacaggtagcaccctcgacagcaccatggatcattgggcggaaggctcaccgcagccgttttccgtggagcccagttccggcatagtgccagtggggaagatccaaaagttcaaggtgaagttcagcccgctggatatcggagatttcgagagtaaccttttctgtcagattcccaacctgcctcccggtgagcagggcccagtcctggtcgcgaaggggcgatcaactttgcctatatgccattttgacctgaaggatagcgactatatcagtggccaccagcgcaacccggagctaagaggctcctcgggtggggctctcgatcccaatactcgggtgatagagttcacaacagtcggcattgggggaaagaatctacgaactttcacaattctcaaccccactaatagcacttacagcttttgttggatctctgaagagatcgagtcactgcagaacccggctgccttcacgtgcctgaccgagaaggggttcatccacccggaaaaaaaagcagaaatcgtgttccagtttaccccgttccacctcggaatcactgagagcagctggacctttctgattcctgaacacaatataactgtgccgtttctcctggtgggcaaaactactgagcccctaattagtctgaataagagccatcttaacttcagcagcctcttgattgggagagaagcacgggagaccgtgcagatcatcaacaaggaggagcaaggcttcgacttttcattccaggacaattcccgatactccgagggcttctccaactcattactggtgtgcccaatggaggggtggatccctccattgagcagattccccattgacattttttttactcccaagcaggagggagacgtgaattttaatctgatttgtaatgtcgagaaaaaagtacacccagtaaccctcaatgttaaggctgaaggctacacaatgaacgtcgagatcaaatgcaaggacaggaccggatccataacattgcttacccctaatcagaccaacataatcaacttttatgaagtggagctcaatgaatgtgtacagtgcgaattcaactttattaacacagggaagtttaccttctccttccaggcacagctgtgcggctccaaaacattgctgcaatacctggagttctcaccaatcgatagtactgtcgacgtcggacaaagcgtgcatgccaccctttcattccagcctttgaagaagtgtgtgctgactgaccttgagctcatcatcaaaatcagtcacggtccgacatttatgtgcaacatctccggctgcgccgtttcgccagccatccacttcagtttcacctcgtacaacttcggcacctgttttatctatcaggctgggatgccaccatacaagcagactctggttattaccaacaaggaagaaacacccatgtcaatcgactgcttatatacgaatactacccacctcgaggttaattccagggttgacgttgttaagcccggaaacaccctggaaattcccattactttctatccgagagagtctatcaattatcaggaactgatcccttttgaaatcaatggtctgagccagcaaaccgttgagatcaagggaaaaggcaccaagatgaaaatccttgttctcgacccagccaacaggattgtgaaactgggagcagtgctgccaggacaggttgtgaaacgtacagtttcaatcatgaacaattcgctggctcagcttacctttaatcagtcaatcctgttcaccatcccggaattacaggaacctaaagtgctcactttagctcccttccataacatcactcttaagcctaaggaggtttgcaagctcgaggtcatcttcgccccaaaaaaaagagtcccccctttctctgaggaagtctttatggaatgtatggggttacttaggccactgttccttctgagtggttgttgtcaggcgctggaaatctctctggatcaggagcatatcccttttggtccagtggtctatcagactcaggccaccaggaggatactgatgatgaatacaggggatgtgggtgccagatttaagtgggatattaagaagttcgagcctcatttcagcatcagccctgaggaggggtatatcacttcaggaatggaggtgtcttttgaggtgacttaccacccaacggaggtcggaaaagaaagcttgtgcaaaaatattctgtgttacatccaggggggatcccctttgtcactcaccctaagcggcgtctgcgttggcccaccagccgttaaggaggtggttaactttacatgccaagtacgctctaagcacacacagacaattctcctgagcaacaggacaaaccagacatggaatctgcaccctatattcgagggcgagcattgggagggccctgagttcattactcttgaggcccatcagcagaacaagccatacgaaattacttaccgacctaggaccatgaacctggaaaaccggaagcaccaggggaccttgttcttcccactgccggacggcacaggctggctgtacgcattgcacggcacaagcgagttgcctaaagctgttgctaacatttacagggaggtgccctgtaaaacgccatacacagaactcttacctataactaattggcttaacaagcctcaaaggtttagagtgattgtcgagatactgaaacctgagaaacccgatctctctataacaatgaaagggttagactacatcgacgttttgagtgggagtaagaaggactacaaactcaattttttctcccataaggaagggacttatgcagccaaagtgatttttaggaatgaggtgacaaacgaattcctgtactataatgtttcctttcgagtgatcccatcaggcattattaaaaccatcgaaatggttacacctgtccggcaggtagctagcgcgtcgatcaagctcgagaaccctctgccttactctgtaaccttttccaccgagtgcagaatgcccgatattgctctgccctcccagttcgtggtccccgctaacagtgaggggacctttagtttcgaattccagcctttgaaggctggagaaacctttggacgactgaccctgcataataccgatctgggctactaccagtacgagctctatctgaaagctacaccagcactgcccgaaaaacccgttcatttccaaaccgtactggggtcttcccagattattttggtgaaatttatcaactacacacggcagaggacagaatactattgccgcacggactgtaccgatttccacgcggagaagctaatcaacgccgctcccggtgggcagggaggaaccgaagcgtctgtggaagtcctgttcgaaccaagtcatttgggggagactaagggtatcctcatcttaagttctctggctggcggtgagtatatcatcccgttatttggaatggccctgccaccgaaaccacaagggccattttccattcgagctgggtacagtatcattattccgtttaaaaacgtattctaccatatggtgaccttctctattattgtggacaatccagcattcacaatccgcgcaggagagtctgtgagacctaaaaaaataaacaatataactgtgagcttcgaaggcaacccgtctggatcaaagaccccaatcaccactaaattgaccgtgagctgcccgccaggtgagggttctgaaactggcgtcaagtgggtgtattacctgaagggcataactctgtag

SEQ ID NO: 226486 - DNA, 3054 bp, Artificial Sequence
  Description of Artificial Sequence: Synthetic coding sequence
atgacatcaagacgtctggaggaaagtatgggagccgtgcaaatggggttagtgaatatgttcaagggattccagagcaaggtgttgcccccactgtcgcccaaagtcgtgacggaagaagaagtgaatcgtatgctgaccccctccgagttccttaaggagatgagtctgactacggagcaacgactggccaagacacgcttaatgtgtagaccccaaattatcgagctgcttgacatgggcgaaaccactcaccaaaaattctccggtattgatctcgaccaggctctttttcagccatttccctcagagattatcttccaaaattataccccatgcgaagtctacgaggtgccgctgatcctgcgaaacaatgacaaaatcccacgcctggttaaagtggtggaagagtcctctccttactttaaagtgatctccccaaaggatattgggcataaggtcgcacctggggtgcccagtatcttcaggatcttgttcacccccgaggaaaataaggactacgcccacaccctaacctgcgtgaccgaacgagagaaattcatagtgcctattaaagcacgcggagctagagctatactagactttcctgacaaattgaatttttctacctgccctgtaaagtactccacccagaaaattctgctggttcgcaacatcggcaacaaaaatgctgtcttccacattaagacgtgccgccctttctcaatcgagcccgctatcggcacacttaatgtaggggagtctatgcagctggaagttgaattcgaacctcagtctgtgggggaccattctggacggcttatcgtatgctacgataccggcgaaaaagtgtttgtcagcctgtacggcgcagcgatagacatgaacatcaggttggataaaaatagcttgacaattgagaaaacctacatctccctcgcaaatcagaggacgattaccatacataatcgcagtaatatcatagcacattttctgtggaaggtctttgccacccagcaggaggaggacagggagaaatatagagcatgcgacgacctgattaaagaggaaaaggacgagaccgacgaattcttcgaagaatgcataacagaccctctgctgagggagcatttgtcagtcctgagtcgtacttttgccaatcagcgacgcttagtgcaaggcgattcaaagctcttctttaacaatgtgtttactgtcgagccactggagggtgacgtctggccaaattcttctgcagagattaccgtgtacttcaacccattggaggctaagctctatcagcagactatctattgtgacatcctgggacgggaaattcgtcttccactgcggatcaagggagaggggatggggcctaaaatacacttcaatttcgagcttcttgatatcgggaaagtttttacaggctctgcgcactgctacgaagctatcctgtataataagggatctatcgatgcgctgtttaacatgacccccccaacgtccgccctcggggcatgctttgtgttttcccctaaggaagggatcatcgagccaagcggggtgcaagctattcagatctccttttccagcacgatcctcgggaactttgaggaagagtttcttgttaatgtgaatggctcacccgagccagtgaaactaacaattcgaggttgtgtgattggtcctacattccatttcaacgttcctgctcttcattttggggatgtctccttcggttttccccataccctgatttgcagtctgaacaacacgagtctgatcccgatgacatataaactaagaataccaggggacggattaggccacaaatcaataagttattgtgagcagcacgtggattacaaacggcctagctggaccaaggaggaaatatccagcatgaagcccaaggagtttaccattagccccgattgtggaacgatacggccacaggggttcgccgctattcgagtgactctctgttccaacactgtgcaaaagtacgagcttgcattggtggtggatgtggaagggatcggtgaagaggttttggccctacttataacagccagatgcgttgtcccagcactgcacctagtaaataccgaggttgacttcgggcattgttttttaaaatacccctacgagaagactcttcagctggctaatcaggacgacttgccgggattctatgaagtgcagcctcaggtatgcgaggaagtgccaaccgtcttgttttcttcgccaacgccatccggcgtgatctcgccgtcgagtaccatccacatcccactggtgctcgagacgcaggtcacgggagaacaccgttccacagtgtacatctccattttcgggagccaggatcccccactggtgtgtcacctgaaatctgcaggcgaaggtccagtgatctacgtgcacccaaatcaggtcgatttcggcaacatatatgtcttaaaagactcttcccgaattctgaatctgtgcaaccagtcgtttatacctgctttcttccaggcccacatggcccataagaagagtctttggaccatcgaaccaaatgaaggcatggtacctccagagacagatgtacagcttgcactcactgcgaatctgaatgatacactgacctttaaggattgcgtgattctagacattgaaaattccagtacctaccggatcccagtccaggcaagcggaaccggatcaactatagtctcagataagccttttgctcccgaactgaacctgggtgctcacttcagcctcgacactcattattatcattttaaactgataaacaaggggagaaggattcagcagctgttttggatgaatgacagcttccgccctcaagccaaactgagtaaaaaaggccgtgtgaagaagggccacgctcatgtacagccacagccaagtggcagccaggaacctcgcgatccgcagtcccctgtatttcacctgcatccagcctcaatggagctttacccaggacaggctattgatgtgatcctggagggatacagtgccacaccaagagttagaggctag

SEQ ID NO: 226487 - DNA, 2223 bp, Artificial Sequence
  Description of Artificial Sequence: Synthetic coding sequence
atgacgtcccgccgtctcgaggaatcaatgggggctgtgcagatgggccttgtaaatatgttcaaaggcttccagtctaaggtgcttcctcctctttcacctaaggtggttaccgaggaggaggtaaataggatgctgacccccagcgagttcttaaaggagatgagcctgacaacagagcagcgactcgcaaagacaagactgatgtgccgaccccaaataatcgagctcctcgatatgggggagactacacaccagaaattctccggaatcgacctggaccaggcattattccagcctttcccatctgagattatcttccagaactataccccgtgcgaagtgtatgaagtcccactaatccttcgcaataacgacaagataccacgattagttaaggtggtggaggagagcagcccgtatttcaaggtgatttctccaaaagatattggccataaggtcgctcccggagttccgagcattttccgtattctgttcacccctgaagagaacaaggactatgctcacacattaacttgcgtaaccgaaagagagaaatttatagtgccgataaaagccagaggggctcgggctattttggacttccccgataaactcaacttctccacgtgtcccgtgaagtattcaacccagaaaattctactggtgaggaatattggaaacaaaaatgcagtctttcacatcaagacttgccgacccttttctatcgaacctgccatcggaacattgaatgtcggcgaaagcatgcagctcgaggtggagttcgagccccagtctgtcggagatcattcagggcgactgatagtatgctatgatacgggagagaaggtgttcgtgagtctatatggtgccgctatagatatgaatattaggttggacaagaattcccttacgatcgagaaaacttacatatccttagctaaccagcggacgataacgattcacaaccgatcaaacataattgcccactttctttggaaggtctttgccacgcagcaggaagaggatagggaaaagtatagggcgtgcgatgatttgatcaaagaggagaaggacgaaacggatgaatttttcgaggagtgtattactgacccactcttaagggagcacctgtcagttttgtctcgcacgttcgccaaccaacgacgactggtgcagggcgacagcaagctcttttttaataacgtgttcacagtggagcccctggaaggggatgtgtggccaaattcatctgccgagatcactgtgtactttaaccccctagaagctaagttgtatcaacagactatttattgcgacatccttggcagggagatacgcctccctctgaggattaaaggcgagggtatgggccctaagatacacttcaatttcgaactgctggacatcggaaaagtgtttaccggcagcgcccactgctacgaggccatcctatacaataaaggttctatcgacgccctattcaatatgactccaccaacgagcgctttgggtgcgtgtttcgtgttctcccccaaagaaggcataatcgaaccatccggggtccaggcgatccaaatttccttctcttccaccatcctgggaaacttcgaggaagaattcttggtaaacgtgaacggatctcccgaaccagtaaagctgacaattcgcggatgcgttatcgggcctaccttccattttaacgtccctgcactgcacttcggtgacgtgagcttcgccacacaggagctccgggatccccaggtgctgatacctttccaaaggtttcctcacaccctcatttgcagcctgaataacacttcgcttatcccaatgacgtacaagctgcgcattcccggagacggtctggggcataaaagcatttcctactgcgaacaacacgtggactacaagagaccttcttggacaaaagaagaaatttctagcatgaagcctaaggaatttactatatccccagattgcggtaccatcagaccccagggtttcgccgcaatccgcgttactctctgctcaaacaccgtgcaaaagtatgaactcgccctcgtcgtggatgtcgaggggattggcgaggaggtgctggctctactgattaccgccagtgctcctgaactatgcaaccggaaggtgatgctctctgtgcttcagtggaagatccatagagccaagaggtccctgccgcgagacacagttgccgtcacttag

SEQ ID NO: 226488 - DNA, 3645 bp, Artificial Sequence
  Description of Artificial Sequence: Synthetic coding sequence
atgaccagccgccgactcgaggagtccatgggagccgtgcagatggggctggttaacatgtttaagggttttcagagcaaggtcctgcctcctctgtcacctaaagtagtgactgaagaagaggtcaaccggatgctcacacccagcgagttcttaaaggagatgtccttgacgacagagcagcgcttagccaagacacggctgatgtgtcgccctcagattatcgagcttctggatatgggagaaacaacgcatcagaagttctctggaattgaccttgatcaggcactattccagccatttccttctgaaataatatttcagaactatacgccttgtgaggtgtatgaagtcccgcttattctccgcaataatgataagattccccgattggtgaaagtggttgaggaatccagtccttatttcaaggtaattagtcctaaggacattggacacaaagtcgcacccggagtaccgtccatttttagaatcctgttcactcccgaagagaataaagactatgctcatacacttacctgtgttaccgaacgagagaagttcatcgttcctatcaaggctcgaggcgctcgtgccattttggattttcccgacaagctcaactttagtacttgccctgtgaaatattccacccagaaaatactgttggtgcgcaatatcgggaataagaatgctgtgttccacattaagacgtgtaggccctttagcatcgagcctgcaatcggtactctgaatgtcggagagtccatgcagcttgaggttgagtttgaacctcagagcgtgggcgatcactccgggaggctgatcgtgtgctacgacacaggtgagaaagtcttcgtttccctgtacggcgctgcaattgatatgaacatccgattggacaaaaacagccttaccattgaaaaaacatatatctctttagctaatcagcggacgattaccatccacaaccgaagtaacattattgctcacttcctttggaaagtcttcgccacccagcaggaggaagaccgcgaaaagtatcgggcttgtgatgacctcattaaggaagagaaagacgaaacagatgagttcttcgaagagtgtatcacagatcccttgttaagggagcacctgtctgttctgagccgcacatttgccaaccagagaaggctagttcagggagactctaaactcttttttaataatgtgtttaccgtggagccccttgaaggcgacgtgtggcctaacagttctgccgaaatcacagtctatttcaatccattggaggcaaaactctatcagcagacaatatactgcgatatcctgggtcgggaaataagactgcccctacgcataaaaggcgaaggcatgggtcccaagatccactttaacttcgaattgctcgatattgggaaagtattcacggggtccgctcactgctacgaggctatcctctacaacaaaggatctatcgacgcactgtttaacatgactcccccaacatctgcccttggggcttgtttcgttttttctcccaaggaggggatcatcgagccgtccggcgtgcaggcaatccaaattagctttagctccaccatactaggcaactttgaagaggaatttttggttaatgtgaatggctccccggaacccgttaagttgaccattagggggtgtgtcattggcccaacttttcattttaacgttcccgctctgcatttcggtgacgtatcctttggcttcccacatacactaatctgttctctgaacaacaccagtttgattcctatgacttacaagctgcgcatccccggtgacggacttggccacaagtccatctcttactgcgaacaacacgtggattacaagcggccaagctggacgaaagaggagatttccagtatgaagcctaaggagtttacaatttcacctgattgtggcacaattcgtccccaagggttcgcggctattagagtgactctgtgcagtaataccgttcagaaatacgagctggccttggtcgtcgatgtagagggtattggagaagaagttctagcactcctcattacagcacgctgcgtagtgccggctctccacctggtcaatacggaagtggatttcggacactgctttttgaaatacccctatgagaaaaccctccaactagccaaccaggacgatctgcctggcttctatgaggtgcagccccaggtgtgcgaagaagttccaaccgtcctcttcagcagccctaccccttctggagtgatcagtcctagctccaccatccatataccgctagtgctggaaacgcaggtaaccggagagcataggagtactgtgtacatctctatcttcggctctcaggatcccccactcgtgtgtcatctaaagtcagccggtgagggcccagtgatttatgtccatcccaatcaggtagattttgggaatatatatgttttgaaggatagctctcggatcctcaatctgtgtaaccaaagcttcataccagccttcttccaagcccatatggcccacaaaaaatcactgtggacaattgagcccaatgaggggatggttccacctgagacagatgtccaactcgccctgacagccaacctgaacgacaccctgacattcaaagattgtgtcatcctggacattgaaaattcgagcacataccggattcccgtccaggcatcaggaaccggcagcacaatcgtctccgacaaaccttttgctcctgagctcaaccttggcgcacatttctcgctcgacactcactattaccacttcaaactgatcaacaagggacggaggatccagcaactattttggatgaacgattctttcaggccccaggctaaattgtccaagaagggacgggtcaagaaaggccacgctcatgtgcaacctcagccctccggttcccaagagcctcgtgatcctcagtcccccgttttccatctgcatcccgctagtatggagctttatcctggtcaggccattgatgttattctcgagggctacagcgcgaccccacggaagccaaattccatcctgaaaccagactatcagccccttgccattaagaatatttccactctcccagtgaacctgttactatcaacctcagggccatttttcatctgtgaaactgacaaatcactcctccccgcaacaccagaacctattaaactggagattgatgaagaaaagaacctgctgattaaatttgacccaagctatagaaacgacctgaacaattgggttgctgaggaaattttagcaatcaagtacgtggagcaccctcagattgattcgctggatctcagaggcgaagtccactatcctaacttgtcttttgagactaaagagctcgactttggatgtatccttaacgataccgaactgatccgctacgtgaccatcactaactgcagccctttagtggtcaagtttagatggttcttccttgtaaatgacgaggagaaccagattcgcttcgtcacgctcccaaaaaagccttacagcgctcctgtgtctcagatggagtccatccccgcaacgtccgaagccgcatcacctcctgccattcttgtaaccgtggagagtccagaaatggacctcaatgacttcgtaaagtag

SEQ ID NO: 226489 - DNA, 3054 bp, Artificial Sequence
  Description of Artificial Sequence: Synthetic coding sequence
atgacatccagacgcctggaagaaagtatgggcgctgtgcaaatgggactggttaatatgtttaaggggtttcaatcaaaggtgctgcctccactgtcccctaaggtggttactgaggaagaggtgaatagaatgttgacgccctcagaattcctaaaggagatgtctctcaccacagaacagcgcctggctaagaccaggctcatgtgtaggccacaaattattgagctgttggacatgggcgagacaacacatcagaaattctcgggcattgacctggatcaggccttattccaaccctttccatccgaaattatcttccagaattatacaccctgtgaggtctacgaagtgccactgattttacgtaacaacgataagataccacgcctggtgaaggtggtggaggagtcctcaccctattttaaagtgatcagccccaaagacatcggacacaaggtggccccaggtgtccccagcattttccgtatcctgtttacacctgaggagaacaaggattacgctcacactctcacatgcgtcacagaacgcgagaagttcattgtgcccatcaaggcgaggggagccagagcaatcctcgactttcccgacaaattaaacttttctacgtgcccggtgaaatactccacacagaaaatacttcttgttaggaatattgggaacaaaaatgctgtgtttcatattaagacttgcaggcccttctctatcgagccagccatcggaactcttaatgtgggagagtcaatgcagctggaggtggagtttgaaccacaaagcgtaggagaccatagtggacggttaattgtttgctacgatacaggagaaaaggtctttgtttccctgtacggagccgctattgacatgaacatccgcctcgataaaaactccttaacaatcgaaaagacctatataagccttgcaaaccagagaacaatcaccatccacaaccggtctaacatcatagcccactttctgtggaaagtgtttgcaacccagcaggaggaggacagagagaagtaccgcgcatgcgacgatctgattaaggaagagaaagacgaaactgacgaattcttcgaggaatgtatcaccgaccctctgttgcgggaacacctgtccgtgctgtcacggactttcgccaaccagagaaggctcgtacagggagattctaagctgttttttaacaacgtgttcaccgtagagcccctggagggcgatgtatggcctaactcttcagctgaaatcacagtctacttcaatcctctagaggccaagctgtatcagcagaccatctactgcgacattctcggcagggaaatcaggctcccactgcggattaaaggcgaagggatgggaccgaagatacacttcaatttcgaacttctggacattggcaaggtgttcaccggctcagcccactgttatgaggcaatactgtataacaaaggcagtatcgatgccttattcaacatgactcccccaaccagtgccttaggtgcctgctttgtgttttctcctaaggagggcattatcgagccctcaggggttcaggccatccagatcagcttcagctcaaccattcttgggaacttcgaggaagagtttctggtaaatgtgaacgggtccccagaaccagttaagctgaccatcagagggtgcgtgataggccctacctttcattttaatgttcctgctctgcactttggagatgtgagctttgggtttccacataccctgatatgttcacttaacaatacatcgcttattcccatgacatacaaactacgcattccaggtgatggactggggcataagagcatttcctactgtgagcagcacgtcgattacaaaaggccatcttggacgaaagaagagataagctctatgaaacctaaggagttcaccatcagccctgattgtggaaccatccggcctcagggattcgctgccatccgtgttactctatgctccaacacagtccagaaatatgagctggccctggttgtggatgttgagggaataggcgaagaggttctggcgctgctcatcacagcacgttgtgtggtgcctgcactccatctagtcaatactgaggtggatttcgggcattgcttcctaaaatacccttacgagaagaccctgcagctggcaaaccaggatgatctacctgggttctatgaagttcagccccaagtctgcgaagaagtacctaccgtgctcttttcatctcctaccccgtccggtgtcatctccccttcctcaacaatacatatacccctggtgctcgaaacacaggttaccggagaacaccgctccacggtttatatcagcatcttcggatctcaagatcctcctctggtgtgtcatctgaagagcgccggagagggtccagtgatctacgtgcaccccaaccaggtggactttggaaacatctatgtgcttaaggactctagccgaatcttgaacctttgtaaccagtcgttcatcccagcattttttcaagctcacatggcacacaaaaaaagcctctggacaatcgagcccaatgaggggatggtgccaccagagactgatgttcaactggcactaaccgctaacttgaacgacacactgaccttcaaggattgtgtgatactggatatcgagaatagttctacatatcggattcccgtccaggctagcggaactggaagcactattgtatcggacaaaccttttgcccctgaattaaacctaggtgcccatttttctctggatacccattattaccacttcaagctgattaataaaggtcggagaatccaacagctcttctggatgaatgacagcttcagaccacaggccaaactgtctaagaagggtcgggttaagaaggggcacgctcacgtacagcctcagccctctggtagtcaggagccaagggacccccagagtccggtatttcacctgcacccagcttctatggaactctatccaggtcaggccattgatgtaatcctggaaggatatagcgcgacgccgagggtgcgtggctag

SEQ ID NO: 226490 - DNA, 822 bp, Artificial Sequence
  Description of Artificial Sequence: Synthetic coding sequence
atggcaacctgggacgagaaggccgtgacgcggagagctaaagtggcacccgctgaaaggatgagcaagttcttgcgacactttacggttgttggggacgattaccacgcttggaatattaactacaagaagtgggagaatgaggaggaagaggaggaagaggaacagcctccaccaacacctgtatccggcgaggaaggccgagccgctgctcccgatgttgcccctgcacctggccctgctccgcgagccccattggatttccggggaatgctccgtaagctgttctcatcacacaggttccaggtcatcataatctgcctggttgtactagacgcattgcttgtgctggcggaattgatattagacctgaaaattattcagcccgacaaaaataattatgcagcaatggtgtttcattatatgtcgattacaattctggttttttttatgatggagatcatttttaagctgttcgtgttcaggttagaattctttcatcataagttcgaaattctcgacgccgtcgtagttgtcgtctcctttatccttgatatcgtgctccttttccaggagcaccagtttgaagctctggggttgttgatactcttgcgactttggagggtcgctcgcatcataaacgggatcatcattagtgtgaagaccagatccgagcgtcagctgctcaggctaaaacagatgaacgtgcagctggcagccaaaatccagcatttggaattctcctgctcggaaaaagagcaggagatcgagaggttgaataaactgttgagacaacacggtcttctgggcgaggtaaactag

SEQ ID NO: 226491 - DNA, 822 bp, Artificial Sequence
  Description of Artificial Sequence: Synthetic coding sequence
atggccacttgggatgagaaggccgtaaccagaagagcaaaggtagctcccgctgagagaatgagcaagtttctgaggcactttaccgtggtgggtgatgattaccacgcttggaacatcaactacaagaaatgggagaacgaagaagaagaggaagaagaggagcaacctccacctactccagtgagcggagaggagggacgggctgcagcaccagacgtcgcaccggcaccaggacctgctcctcgtgctccactcgattttcgtggaatgctgcgcaagcttttcagttcgcaccgatttcaggtgatcatcatttgtctcgtcgtccttgacgcgcttcttgtcttggccgagctaatactagatctgaaaatcattcaaccagataagaataattacgctgcaatggtgtttcattatatgtctatcacaatcctcgtattctttatgatggagatcatctttaagttgtttgttttccggctggagttctttcatcacaaattcgagatcctggatgctgtcgttgtggtggtctcatttatcctggatattgtccttctcttccaggagcatcagtttgaggcgttgggcctcctgattctcttgagactttggcgagtggcccgaatcatcaacggcatcatcatttccgtgaaaacacggtccgagcgtcagctcctgagattaaaacaaatgaatgtgcagctggcagcaaaaattcagcaccttgaattctcttgttccgagaaagagcaggagatcgagcggctgaacaagctccttcgccaacacgggcttctcggagaagtaaactag

SEQ ID NO: 226492 - DNA, 237 bp, Artificial Sequence
  Description of Artificial Sequence: Synthetic coding sequence
atggctacctgggatgagaaggcagtgacgcgcagggcaaaggtagctcccgctgaaaggatgtctaagttcctgagacacttcacggtagtaggtgatgactatcatgcgtggaatattaattacaaaaaatgggagaacgaggaagaagaggaagaagaggagcagccaccaccaacacctgtgtccggggaagagggacgagccgctgcacctgacgtagccccagctccgtag

SEQ ID NO: 226493 - DNA, 900 bp, Artificial Sequence
  Description of Artificial Sequence: Synthetic coding sequence
atggaagaactactccctgatggacaaatctgggcaaacatggacccagaggaacggatgcttgctgcggctaccgcattcactcacatctgcgcaggacagggagagggcgacgttagaagagaagcgcagtctatccagtacgacccatactctaaggcttccgtggcacctggaaaacgccctgcgctgcccgttcaactgcagtacccccacgtcgaatcaaacgtgccttccgaaaccgtcagcgaagcctcccagaggttgcgcaagcccgttatgaagcggaaagttctgcggcgaaaacctgacggagaggtgttggtcaccgacgagagtatcattagtgaaagtgaaagcgggacggagaacgaccaggacctgtgggacctacgacaacgactcatgaacgtacagttccaggaggataaggaatcatcttttgatgtttcccagaagtttaacctgccccacgagtaccaggggatctcacaggatcagctcatctgcagcttgcaaagagagggcatgggttcccccgcttatgaacaggacctgatcgtcgcctcgcggcctaaatctttcatcctgcccaagctggatcaactttcacggaatagaggcaagaccgaccgtgtggcaaggtatttcgagtacaagcgcgattgggactcaatccggttgcctggggaagatcaccgcaaagaactcaggtggggagtccgcgaacaaatgttgtgcagagccgagccccagagcaaaccgcagcacatctacgtgcccaacaattatctggtaccaaccgaaaaaaaacgcagcgcactcagatggggtgtccgctgtgatctcgccaatggcgttattccccgaaaactgccttttccgctaagtccctcctag

SEQ ID NO: 226494 - DNA, 900 bp, Artificial Sequence
  Description of Artificial Sequence: Synthetic coding sequence
atggaggagctgcttcctgatgggcaaatctgggcgaatatggatcccgaggaaaggatgctggcagccgctaccgcttttactcacatatgtgccggtcagggagagggggacgttcggagggaggcgcagagcatccagtacgatccctattctaaggcgtctgttgcgccaggcaaaaggcccgctctgccggttcagttacagtatcctcacgtggagtcaaacgttccaagcgagaccgtatctgaagcgtcgcagaggctgcgcaagccagtgatgaaacggaaggtactccgcagaaaacccgacggagaggttttagttactgatgagtcgataattagcgaaagtgaaagcgggactgagaatgaccaggacctctgggaccttaggcaacggcttatgaatgtgcagttccaggaggataaggaatcaagtttcgatgtctcacaaaaatttaacctcccacatgagtatcaaggtatttctcaagatcagctcatttgtagcctgcagagagaggggatgggaagcccagcatacgagcaagacctgatcgttgcctcccgaccaaagtctttcatactgcccaagctggaccagttatcaaggaacagggggaagaccgacagggtggccaggtatttcgagtataagagggattgggactccattcgcctgcccggtgaagaccatagaaaagagcttaggtggggcgttagagaacagatgctgtgccgagcagaacctcagagtaaaccgcagcatatctatgtgcctaataactacctggtgccaactgagaaaaagcgcagcgcactgaggtggggtgtcagatgtgacctcgccaacggcgttatcccacggaagttaccctttccacttagccccagctag

SEQ ID NO: 226495 - DNA, 900 bp, Artificial Sequence
  Description of Artificial Sequence: Synthetic coding sequence
atggaggagctgctccctgatggccagatttgggcaaacatggacccagaggaaaggatgctggccgctgcaactgcattcactcacatttgtgccggtcagggcgagggcgacgttaggagagaggcccaatcgatccagtacgacccgtattctaaggcgtcagttgctcctggtaaacgaccggctctcccggtccaactgcaatacccccatgtagaatcaaacgtgccctctgagactgtgtctgaagcatcccagcggctccgcaagcccgtcatgaaacggaaggtcttacggaggaagcccgatggtgaggtcctcgtaaccgacgagtcgattatcagtgagtcagaaagcggcactgagaacgatcaggatctgtgggatcttcggcagcgactgatgaacgtccagtttcaggaggacaaagagtcgtccttcgatgtgtcacagaagttcaatctgccgcacgagtatcagggtattagccaggatcagttgatctgcagcctgcaaagggagggaatggggagccccgcttacgagcaggatctgattgtggccagcaggcctaagagctttatcctgcctaagctggatcagctgtccaggaatcgcggtaagacggaccgggtcgctaggtactttgaatataagcgagactgggacagtatccgtctcccgggtgaagaccatcgtaaagagctgagatggggggtacgggagcagatgctgtgtcgggctgagccccagagtaagccccagcatatatacgttcctaataattacttggtgcccactgagaaaaagcgaagtgctttacgatggggcgtgagatgtgacctggccaatggggtcatccccaggaagttgccctttcctctgagcccaagctag

SEQ ID NO: 226496 - DNA, 1113 bp, Artificial Sequence
  Description of Artificial Sequence: Synthetic coding sequence
atgctgcccaggctgatctgcattaatgactatgagcagcacgccaagtccgtcctgccgaaaagcatttacgactactaccgctctggcgcaaacgatgaggaaaccctggccgataatattgcagcattctcgaggtggaaactatatcctcggatgttgcggaacgtggccgaaaccgacctctccaccagcgtcttaggacagcgggtaagtatgcccatctgcgtcggtgctaccgctatgcagcggatggcacacgtagacggagagctggcaaccgtcagagcgtgtcagtctctgggcaccggaatgatgctgtcttcctgggcgaccagcagtattgaagaggttgccgaagccggtcccgaagccttacgttggttacagctgtatatctacaaggaccgggaggtgaccaagaagctggtgagacaagcagagaagatgggatataaggcgattttcgtgactgtggatacaccctatctcggcaatcgccttgatgatgtgcgcaaccgatttaaactgccaccacaactcagaatgaagaactttgaaacctcaacactgtcgttctctcccgaagagaacttcggcgacgactccggcctggccgcatacgtcgccaaagctattgacccttcaatttcatgggaggatattaaatggctaaggcgtctcaccagccttcctattgtggccaaaggcattctccggggtgacgacgcgagagaagcagtgaagcatggtctgaacgggatcctcgtttcaaaccacggcgctcgccagctcgacggagtgcctgcaaccatagatgtgctacccgagatcgttgaggctgtggagggcaaagtcgaggtgttcctggatggaggcgtacgtaaaggaacagacgtactgaaagcgctcgctctgggggcaaaagcggtgttcgtcggtcgtccgattgtctgggggctcgcttttcagggggagaaaggggtacaggacgtgcttgaaatcctgaaggaggagttcagactggcaatggctttgtcgggctgccaaaacgtcaaggttattgacaaaactcttgtccgcaaaaacccactggcggtgtcaaaaatctag

SEQ ID NO: 226497 - DNA, 1056 bp, Artificial Sequence
  Description of Artificial Sequence: Synthetic coding sequence
atgtcgctggtatgcttgactgactttcaagcacacgcgcgagagcagctctcaaagtcaactcgagatttcattgagggaggggctgatgactctatcacaagggacgacaacatagccgcattcaaacggatcaggctccggcctcggtatctgagagacgtgtctgaggtagatactcgcacaactatccagggagaggaaatttccgctcctatctgtattgccccaacgggattccattgcctggtgtggcccgacggagagatgtctaccgcaagggcagcacaggcggctgggatctgttacattacttccacattcgcttcctgctcacttgaggatatcgtgattgccgctccagaggggcttagatggttccagctgtacgttcatcccgacctgcagcttaataaacagttgattcagagggtggagtctttaggcttcaaagccctagtcataaccctggatactccagtgtgcggcaatcgtcggcacgatatccggaatcaactccggagaaatctcacgctgactgatctgcagtcgcctaaaaaagggaacgctatcccctattttcagatgacccccatcagcacatccctctgttggaatgacctgtcctggtttcagagtataaccaggctgcctatcatactgaagggtatcctgaccaaggaagacgccgagctggccgtaaagcataacgtccaggggattatcgtcagcaatcatggtgggagacagctggacgaggttttagcttctatcgacgccctcaccgaagtggtcgctgcagtgaagggcaagatcgaagtctatctggatggaggggtgcgcactggcaacgatgttctcaaagccctcgcgcttggtgctaaatgtatttttctgggcagaccaatcctgtggggcctggcctgcaagggtgagcatggcgtcaaggaggtactgaacatactgactaacgaattccacaccagcatggcgctgacgggttgcagatctgtggctgagatcaacagaaacctcgtacaattctcaagattatag

SEQ ID NO: 226498 - DNA, 1095 bp, Artificial Sequence
  Description of Artificial Sequence: Synthetic coding sequence
atggaggacaagatgtggtccgaatgtgaggggcctgagatgagcctggtgtgtctcactgattttcaagcccacgcgagagagcagctgtccaagtctacacgcgacttcattgagggcggagcagacgattccataactcgtgatgacaatatcgctgcattcaagaggatccgactgcgccctaggtacctccgggatgtttccgaggtggatacacgcactacgatccagggcgaggagatctctgcacccatttgcattgcccctacagggtttcactgtcttgtctggcccgatggggagatgtctacggccagggcggcacaagccgctggtatatgctacattactagcacatttgctagctgctctctggaggacatcgtgatcgccgcaccagagggcctccggtggttccagttgtacgttcaccctgaccttcagttgaacaaacagttaatacagagggtcgaatcacttggcttcaaagcacttgtaatcaccctcgacacacccgtgtgcgggaatcgacgtcacgacatcaggaaccagttaaggaggaatttgaccctgactgacctccaatctccaaagaaagggaacgctatcccctattttcagatgacgcctatctccacatctctgtgttggaatgatctcagctggtttcaaagtattacccggctgcctattatcttaaaaggcattctgactaaagaagatgcagaactggccgtcaaacacaatgttcagggtataattgtatcaaaccacggaggtagacaattggatgaggtgctagctagtattgacgcgctgacggaggtggtcgcagccgttaagggaaagatcgaggtgtacctggatgggggagttaggacaggaaacgacgtgctgaaggctctggcacttggcgcaaaatgcatttttctgggaagacccattctgtggggtttagcatgcaaaggagaacatggagtcaaggaggttttaaacatcctcaccaacgagtttcatacctcaatggcgctcacaggatgcaggagcgtggctgaaattaacaggaatctcgtccagttttcgagattgtag

SEQ ID NO: 226499 - DNA, 561 bp, Artificial Sequence
  Description of Artificial Sequence: Synthetic coding sequence
atgtcgttggtatgcctcaccgatttccaagctcacgctagggaacagctgtcaaagagcacccgggatttcatcgagggaggagccgacgattctatcacccgcgacgacaatatagcggcttttaaaagaatcagactgcgccctaggtatctccgcgacgtgtccgaagtcgacactagaacaactattcaaggggaagaaatatccgcaccaatctgcatcgccccaactggctttcattgtttggtctggcccgatggggaaatgagcacggccagagcacctgaaggacttaggtggtttcaattatacgtccacccagatcttcaactgaacaaacagctcatacagcgtgtcgagtccctaggctttaaggctctggtgatcacactcgacacccctgtatgcgggaataggcgccacgacattcgaaatcagttacggcgtaatctgaccctaaccgacctgcagtctcctaagaagggtaacgccattccgtatttccaaatgaccccaatttcgacctcactctgctggaacgacctgtcttggttctag

SEQ ID NO: 226500 - DNA, 2292 bp, Artificial Sequence
  Description of Artificial Sequence: Synthetic coding sequence
atggtggcctgtcgagctatcgggattctgtcccgcttttcagccttccggatccttcggtctaggggctacatttgcaggaacttcacaggtagctccgctctgctcacacgaactcacatcaattatggagttaagggagacgtcgccgtggtccgcatcaatagcccaaattctaaggtgaatactctgagcaaagaactgcattcagagttcagtgaggtgatgaacgagatttgggcctccgaccagatccgcagtgccgtgcttatctctagcaagccaggctgcttcatcgcgggagctgacattaatatgctggccgcttgtaaaacactgcaggaggtcactcagctgtcgcaggaagcccagagaatcgtagaaaagctcgaaaaatctaccaagccgatcgtcgccgctatcaacggatcttgtctagggggagggctcgaggtggcaataagctgtcagtatcgaatagcaactaaggatcggaaaactgtgttgggcactcccgaagttctgctcggagcactccccggagccggaggaacccaaagactgccgaagatggtgggcgttcccgcagctctggatatgatgctgacaggaaggtctattcgggctgaccgtgccaagaaaatgggccttgttgaccagctggtggagccactaggacccggattgaagccccctgaggagaggactattgagtatctggaggaggtggcaatcacgtttgccaaaggcctggctgacaaaaagatatccccaaagcgagataagggacttgtagaaaagttgacagcttacgctatgaccattcccttcgtcagacaacaagtatacaagaaggtggaggagaaagtgcgcaagcagactaaaggcctgtaccccgctcccttgaaaatcatagatgtggtgaaaaccggaatcgaacagggatctgatgccggttatctttgtgagtcccaaaagtttggcgagcttgttatgaccaaagaatccaaggctctcatggggctgtatcacggccaagtgctttgtaagaagaacaaatttggcgcaccccagaaagacgttaagcatttagccatcctgggcgctggcttaatgggcgcagggatcgcccaggtttccgtggacaagggtctgaaaactatattgaaagatgccactctcacggcacttgaccggggacaacagcaggtatttaaggggctgaacgacaaggtgaagaaaaaagctttaaccagcttcgaaagggacagtatattcagcaacctcaccggtcagctggattaccagggatttgagaaggcggacatggtgattgaggccgtcttcgaagatctctcactgaagcacagggtgctgaaggaggtggaggcggtgattccagatcattgcatcttcgcctcaaacaccagtgcgctccccatttccgagattgctgcggtgtccaagagacctgaaaaggtgattggcatgcactacttcagtccagtggataaaatgcaactgttagagattatcacaactgaaaagacgtctaaagataccagcgcctccgccgtggccgtgggtctgaaacagggtaaagtgatcatcgttgtgaaagatgggcctggcttttacacaacgagatgcctcgcccctatgatgtcggaggtgatccggatcctacaggaaggcgtggacccaaagaaattggattccttgacaactagctttgggtttcccgtgggagcagcaacactggtcgatgaagtgggagtggatgtggctaagcatgtggcagaggaccttggcaaggtgttcggtgaacggttcggcggtggcaacccagagttgcttacccagatggtatccaaaggctttttgggcagaaagtcaggaaagggcttttacatttatcaggagggagtcaagaggaaggatttaaactctgacatggacagcatactcgcttctcttaaactccccccaaaaagtgaagtcagtagtgacgaggatattcagtttagattggttactcggttcgtgaacgaggcagttatgtgcctgcaggaaggcattctggctactcccgcagagggtgacattggcgcagtgtttggccttggctttcccccttgcctcgggggtccattcaggttcgttgatctttacggagcccagaagatcgtggaccgcttgaaaaagtacgaagctgcctatggaaagcagttcaccccctgccagttgctggcagatcacgccaacagtcctaataagaaattttaccagtag

SEQ ID NO: 226501 - DNA, 783 bp, Artificial Sequence
  Description of Artificial Sequence: Synthetic coding sequence
atggaatcaaagggcatgtggcagctgttcgaactgactctcccaatccagtcaatgctggccgcttgcaagacactccaggaggtcactcaactctcccaggaagcccagcggatcgttgagaaactggaaaaatccacaaaaccaattgtggccgctatcaacgggtcctgcctcggtggtggcctcgaggtcgctattagttgtcaatatcgaattgccaccaaggaccggaaaactgttctgggtacccctgaagtccttcttggcgctctgccgggagccggaggaacacagcgcttaccgaaaatggtgggggtgcctgccgcactggacatgatgttgaccggaaggtctattcgggcagatagagccaagaaaatgggcctcgtggaccagcttgtcgaacccctgggcccaggtctaaaaccacctgaggaacgaacgattgagtaccttgaggaggtggctattaccttcgctaaagggctggcagataagaagataagtcctaagagagacaagggcctggtggagaagcttactgcgtacgccatgacgatcccatttgttcggcagcaggtgtacaagaaagttgaagaaaaggtccggaagcagacaaaagggctgtatcccgcacccctcaaaatcatcgacgttgttaaaacaggcattgagcagggtagtgatgccggatacttgtgtgagagccaggtgaacctgtttccatttaatgtactgctaagtgtcaagggcaagctcaagatacaaagttccgtctag

SEQ ID NO: 226502 - DNA, 1425 bp, Artificial Sequence
  Description of Artificial Sequence: Synthetic coding sequence
atgaccattctcacctacccattcaagaacttgccgacagcgtctaagtgggccctgagattttccattcgccctctgtcttgttcctcccagcttcgggctgcccctgccgtgcagacaaaaacaaagaaaacactggcgaagccaaatatccgcaatgtcgtggttgtcgacggggtgcgcactcccttcttactaagcggaaccagttataaagacctcatgccccacgatctggctcgggcagcactcaccggcctcttgcaccggacatccgttcccaaggaagtcgtggactatataatttttggaaccgtgattcaggaggtgaagacatctaatgtggcccgagaagcagccctgggagcgggttttagcgacaagacgcccgctcacaccgtgacaatggcctgtatctccgccaaccaagctatgaccaccggcgtgggtcttatcgcctctggccagtgcgatgtgatagtggctggcggagtcgagcttatgtcagacgtgccgatcagacactcacgtaaaatgcggaaactgatgctggacttgaataaagcaaagtcaatgggccagcggctatcattgatttctaaatttcgtttcaattttctggctcccgaattgccagccgtgtccgagtttagcacttccgaaaccatgggccattctgcagaccgccttgcagctgcatttgccgtttcaaggctggaacaggacgaatacgcccttcgttcacatagcctagccaaaaaggctcaggacgaaggcttgttgtccgacgttgtcccatttaaagtacccggtaaggatactgtgacgaaagataatgggatcaggccgtcatccctggagcagatggccaagcttaagcctgcctttatcaagccttacggtactgttactgccgcaaacagctccttcctgaccgatggcgcttcagcaatgttaataatggctgaagagaaagcactggccatgggctataaacctaaggcctatctgcgtgacttcatgtatgtgtcccaggatccaaaagatcagttactgctgggacccacttacgccacacctaaggtgctcgaaaaggctggcctgacaatgaacgacatcgacgccttcgagtttcacgaagctttctctgggcaaatcttggctaacttcaaggctatggactccgattggtttgccgagaattatatggggcgtaaaaccaaagtaggtcttcctccgctggaaaaattcaacaactgggggggatcactgagtttagggcaccccttcggcgctactggatgccgcttggtcatggcagccgctaataggctccgcaaggaggggggacagtatggattggtagctgcgtgcgccgctggaggccagggacacgccatgatcgtggaggcttatcccaaatag

SEQ ID NO: 226503 - DNA, 258 bp, Artificial Sequence
  Description of Artificial Sequence: Synthetic coding sequence
atgacaattctcacttacccctttaaaaacttgccgaccgccagcaaatgggccctgcgattctccatccgtccgctgagctgtagctcacagctgcgtgccgcacccgctgtgcagaccaagacaaaaaagacactcgccaagcctaacattcggaacgttgttgtcgttgacggcgttcgaaccccctttctcctgtccggaacatcctacaaagacctgatgccacatgatcttgctcgagctgctctcacgtag

SEQ ID NO: 226504 - DNA, 531 bp, Artificial Sequence
  Description of Artificial Sequence: Synthetic coding sequence
atgaccatactcacatatccctttaaaaatctgcccacggccagcaaatgggcgctcaggttttccatcagaccactctcatgctcaagccagcttagggcagccccagccgtccaaacaaagactaagaagacgctggccaagcccaatatacgaaatgtggtggtcgtggatggtgtgcgcacgccctttctgctgtccggcactagttataaggacctaatgccccatgatctggcgagggctgctttgactggattactgcatcggacatcagttcccaaggaagtagttgactatatcatctttggaacagtgatacaggaggtgaaaacgtcaaacgtcgccagagaggctgccctgggagccggtttctcggacaagaccccggcacacacagttaccatggcttgcatatccgctaatcaggccatgaccactggagtgggcctgattgcatcaggccaatgtgacgtgattgtcgcagggggagtggagctgatgtcggacgtgcctatccgccattcctag

SEQ ID NO: 226505 - DNA, 453 bp, Artificial Sequence
  Description of Artificial Sequence: Synthetic coding sequence
atgacgatcctcacatacccctttaaaaacttacccactgccagcaaatgggccctccggttcagcattcgccctctcagttgcagttctcagcttagagcagcccctgccgtgcagactaaaaccaaaaaaacactggctaaaccaaacatccggaacgttgtggtagtggacggagtgcggaccccattcctcctaagcggcacatcttacaaagatctgatgccccatgacctcgctcgtgccgctctgacaggtctgctgcatcgaaccagtgtgcccaaagaggtggtggactatatcatattcggcacagtgattcaggaagtgaaaacctccaatgtggcgagggaggccgctttgggggcaggcttttcagataagacgccagcccacacagtgaccatggcttgcatctcagctaatcaggcaatgacaacaggagtcggatag

SEQ ID NO: 226506 - DNA, 1380 bp, Artificial Sequence
  Description of Artificial Sequence: Synthetic coding sequence
atgactatcctgacataccccttcaagaatcttcccactgctagtaaatgggctctccgcttttcaatcaggccgctgtcctgctcctctcagctgagggccgctccagctgttcagacaaagacaaagaaaacactggccaagccaaatattaggaacgtggtggtcgtagacggagtacggaccccattcctattatccggaacaagcgggttgcttcacaggacaagtgtgcctaaggaggttgtcgattacatcatattcggtactgtgattcaagaagtgaaaacttccaacgtggctcgtgaagccgctctcggtgctggcttttcagacaagacccccgctcataccgtgactatggcctgtatttctgctaatcaggcaatgaccaccggcgtgggcctgattgcctctggtcagtgcgatgtaatcgtagcaggcggagttgaactcatgtctgacgtgccaataagacatagccgcaaaatgcgcaaactgatgctggacctcaataaggcaaagtccatgggacagcgactgagtttaatatcaaagttcagatttaatttccttgcaccagaattgcctgcagtgtctgagttctctacaagcgaaaccatggggcactcagcggatagattggcagctgcgtttgctgttagcaggcttgaacaggatgaatatgctctccggtcccactccctggctaagaaggctcaagatgaaggtttgcttagcgacgttgttcctttcaaagttcccggaaaggacactgtcaccaaggacaacggcatccggcctagcagtcttgaacagatggcaaaactgaagccagcttttatcaagccctatggaacagtgacagcagccaattccagcttcctgactgatggcgcttcggccatgctgattatggccgaagagaaggcattagcaatggggtataagcccaaagcttacttgagagacttcatgtacgtcagccaagatcctaaggaccagcttttgttgggccctacatacgcaacccccaaagttctggagaaagccggactcacaatgaacgatatcgatgccttcgagttccatgaagcattttctggccaaattttggctaattttaaagcaatggactctgattggttcgccgagaactacatgggacgtaaaactaaggtgggtctcccaccactggagaagtttaacaactggggaggatctctgtcccttggacatccattcggcgctactggatgccgattagtgatggccgcagctaaccggttgcgaaaagaaggcggacagtatgggctcgtggcagcctgtgcggcaggcggacagggccacgccatgattgtggaagcatatcctaaatag

SEQ ID NO: 226507 - DNA, 1359 bp, Artificial Sequence
  Description of Artificial Sequence: Synthetic coding sequence
atgacccttgtgtccggctggctgctgtatggatggattatcgctgttcaaacgaagacaaaaaaaactctcgccaaaccaaatatccggaatgtggtagtggtggacggtgtaaggacaccatttcttctatcgggcacgtcgtataaagacctaatgccccatgatctcgctcgtgccgctctcacaggtttactgcaccgaacttccgtacctaaagaagtcgtggactacatcatcttcggaactgttatccaggaagtcaagaccagcaatgtggctcgcgaagctgcactaggagccggttttagcgataagacacctgcccacacagttactatggcctgcatcagtgcaaaccaggccatgactactggcgtggggcttattgcttcagggcaatgcgatgtgattgtggcgggaggggtggaactgatgtccgacgtgccaattcggcatagcagaaagatgagaaaattaatgttagacctgaataaagctaagagcatggggcagcggctctctctcatcagcaagttcagattcaatttcctggcccctgagctcccagctgtgtccgaattttcaacatctgagaccatggggcactctgcagatcggctggctgccgcattcgcagtgtctagactcgaacaggacgagtatgccctgcggtctcacagcctggctaagaaggctcaagacgaaggtctattgagtgatgtcgtgccgttcaaagtgcctggcaaagacacggtgactaaggacaacggtatcaggccctcttcattggagcagatggccaaactgaagcccgcattcattaagccctatggcaccgtgaccgctgcaaatagcagcttcttaacggacggggcttccgccatgctaattatggccgaagaaaaggcgcttgccatgggatacaaacccaaggcgtacctacgcgacttcatgtatgtttctcaggaccctaaggatcagttactcttgggccctacctacgccacaccaaaggtgctcgagaaggctggacttaccatgaatgatattgacgcgtttgaattccacgaggccttcagtggtcaaattttagcaaatttcaaggcgatggatagcgactggtttgccgaaaactacatgggaagaaagacaaaggtagggttacctcctctggagaaatttaacaattggggaggaagcctgtccctcggccatcccttcggggcaacagggtgccgactggtcatggctgctgcaaataggcttagaaaggagggaggacagtacggcctggtcgctgcatgtgcggcagggggacagggtcacgcgatgatcgtcgaagcataccctaagtag

SEQ ID NO: 226508 - DNA, 783 bp, Artificial Sequence
  Description of Artificial Sequence: Synthetic coding sequence
atgaaggtagaggtgctgcctgcactcaccgataactacatgtatctcgtgatagatgatgaaactaaagaggctgctattgtcgatccagtgcagccccagaaggtagtggacgcagccagaaaacatggtgtcaagctgactaccgtgttgacaacacatcaccactgggatcatgcaggtggcaatgaaaagctcgtcaagttggagtcaggcttaaaagtgtatgggggagatgataggattggagcactgacacacaagatcacacacctgagtacattacaggtcgggagtctaaacgtcaagtgcctggccaccccctgtcacaccagcggacacatctgctactttgttagcaagcccggaggaagtgaacctcccgctgtcttcactggtgacacgctgtttgtggccggatgcggcaaattctacgaagggacagccgacgagatgtgcaaggctcttttggaagtcctgggcaggctgcctcccgatacccgggtgtactgcggtcatgaatataccatcaataacttaaaattcgctcggcatgtcgaacccggaaacgcggctatcagagagaagttggcttgggcaaaggagaagtactccatcggggaacctactgttccaagtaccctggcggaagaattcacttacaaccccttcatgcgtgtgagagaaaagaccgtgcagcagcatgctggagagacggaccctgtgactacaatgagggccgtgcgcagagaaaaagaccagttcaagatgcctcgcgactag

SEQ ID NO: 226509 - DNA, 927 bp, Artificial Sequence
  Description of Artificial Sequence: Synthetic coding sequence
atggtcgtgggcagaggcctcctcggcaggcgatccctcgccgcactgggagctgcatgtgcaaggcgaggactgggacccgcacttcttggcgttttctgccatactgacttacgaaagaacctgacggtggacgaaggcacgatgaaggtggaggtcctgccagccctcacagacaactatatgtacctcgtcattgacgacgaaaccaaagaggcagctatagtggacccagtccagccccagaaggtggtggatgccgcacgcaaacacggcgtcaagctcactaccgttctgaccacccaccatcactgggaccatgctggcggtaatgagaagctcgtcaagcttgagagcggcctgaaagtatatggcggagacgaccgtattggggcattgacacacaaaatcacacacctgtcaaccttgcaggtgggctctttaaatgtcaaatgtctcgcgacaccctgccacacttctggacatatttgttactttgtgagtaaaccaggagggtccgaacctcccgcagtctttacaggcgacaccctgttcgtcgccggttgtggtaagttttacgaggggacagccgatgagatgtgcaaagctctgcttgaggtgttgggtcgcttgcccccagatacacgggtatattgcggccacgagtacaccatcaacaaccttaagttcgctagacacgtggaacctggaaacgccgcaatccgtgagaagctggcctgggctaaagaaaaatactccatcggcgaacctacagttcctagcacattagctgaagaatttacctataaccccttcatgcgcgtgagggagaaaacggttcagcagcacgccggagaaacagatcctgtaaccaccatgagggctgtgagacgcgaaaaggaccagtttaagatgcccagagattag

SEQ ID NO: 226510 - DNA, 711 bp, Artificial Sequence
  Description of Artificial Sequence: Synthetic coding sequence
atggtggtgggaaggggtttactcggacggagatcgctggctgctctgggcgctgcatgtgccagaaggggtctcgggcctgctctcttgggcgtcttttgtcatacggacttgcgaaaaaatctgaccgttgacgaaggcactatgaaagtggaagtcctccccgctctgactgataattatatgtatctggttatcgacgacgagaccaaagaagcagcaatagtcgaccccgttcagccccagaaagtggttgacgccgcaagaaagcacggagtgaagttaactacagtcctgacaacacaccatcattgggaccacgctggaggtaacgagaagctggtcaaattggagtctggactcaaggtatatggtggggacgataggattggggctttaactcacaagataacccatctctcaactttacaagtgacaccctgtctgtggctggctgctgggtctagtatgaaaggccttcggatgcgatgcgtcaagctgtgctggcgaagctgggctggctcccctcgtacccaggaatcaactgttgccacttccacgccgtctaccacgagctcactgcacgctacctggagccctgcaatgccacctagcgggaggtcatggcctggccctcggagatcaactgccagcggcagcccccagtgccaccctccatggcagcgctcactcccaactacaccctcctag

SEQ ID NO: 226511 - DNA, 1128 bp, Artificial Sequence
  Description of Artificial Sequence: Synthetic coding sequence
atggcaatgacgggttggtcttgtctggtgaccggcgctggcggatttctggggcagagaataattaggctgctggtgaaggagaaggagcttaaggagatcagggtcctagataaagcctttggccctgagctgcgagaggagttctccaaactccagaataagacgaaactcaccgtgctggagggggacatcctcgacgaacctttcctcaagcgggcatgtcaggacgtgtcagtcattatacatactgcttgtatcatcgatgtgtttggcgtcactcatcgtgagtctatcatgaacgtcaacgtaaagggaacccagctcctgctggaagcttgtgtgcaagcaagcgtgcctgtcttcatttacacgagttctatcgaggtagctggccctaatagttataaggagatcattcaaaatggacatgaggaggagcccctggagaatacatggcccgcaccatatcctcactccaagaaactggcagagaaggccgtattggcagcaaatggatggaatctgaaaaatggcggaacactctacacttgcgccttgaggccaatgtatatctacggggagggcagtagattcttgtcggcctccattaatgaagctcttaacaacaacgggattttgagcagcgtcggcaaattttctacggtcaaccccgtgtatgttgggaatgtggcgtgggcacacattcttgccctcagggctttacaagaccccaaaaaagcaccgtcaataagagggcagttttactatatatctgatgacacgccacatcagtcatacgataatctgaattacactctgagtaaagaatttggattgaggttagactctcgctggagctttcctctgtccctgatgtactggatcgggtttctgctcgaaatcgtgtcatttctcctcagacctatctacacctacagaccgcctttcaataggcatatcgtgactttatccaatagtgtgttcacattttcgtataagaaagcacagcgggacctcgcgtacaagccgctgtactcctgggaagaggccaagcagaaaactgtggagtgggttggtagcttagtggaccgccataaagaaaccctgaaatcaaagactcagtag

SEQ ID NO: 226512 - DNA, 1122 bp, Artificial Sequence
  Description of Artificial Sequence: Synthetic coding sequence
atgaccggttggtcatgcctcgtcaccggcgctggcggtttcttagggcagcggataatcagactcctcgtcaaggagaaggagttgaaagagattcgggtcctagacaaagcattcggcccagagctgagagaggagtttagcaaactgcagaacaaaactaagctcacagtacttgagggggatatcctcgacgaaccatttctcaagcgagcctgccaggatgtttccgtgatcattcacacggcttgcatcattgacgtattcggtgtgacacacagggagtctattatgaacgtgaatgtgaaggggacacaactcctcctcgaagcctgcgttcaggcttcagtccctgtgttcatttatacctcttccatcgaagtggccggtcccaatagctacaaagagattatccagaacggtcatgaggaggagccgctggagaatacttggcccgctccctaccctcattctaagaagttggcagagaaagccgtgctcgcagctaacggttggaatctgaaaaacggcggtaccttgtacacttgcgctctgcggccaatgtatatatacggtgaggggagccggttcctcagcgcaagcattaacgaagcgctcaataacaacggcatcctctcctcagtcggcaagttcagcacagtcaatcctgtctacgtgggtaatgtggcctgggcccacatattagcccttagagccctccaggatcccaagaaggcaccttctatccggggacaattttactacatcagcgatgatacccctcatcaatcttacgataatctgaactatactttaagtaaggagtttggcctccgcctcgattctcgatggtctttcccactttctctgatgtattggattggttttcttcttgaaatcgtgtccttcctcctgcgccctatctatacataccgcccaccatttaatcgacacattgtgaccctgtccaactccgtctttaccttctcctacaagaaggcgcagcgagatctggcctataagcccctttatagctgggaggaggcaaaacagaagaccgtcgaatgggtgggcagcctggtcgaccgtcataaggagactttgaagtccaaaacccagtag

SEQ ID NO: 226513 - DNA, 1122 bp, Artificial Sequence
  Description of Artificial Sequence: Synthetic coding sequence
atgaccggatggagctgtctcgtgactggcgcaggcggttttctcgggcagaggattatacgactgcttgtgaaggaaaaagagctgaaagaaatccgcgtgttggataaggcatttgggcctgaactacgcgaggagtttagtaagttacagaacaaaaccaaactcacagtcctagagggggatatacttgatgaaccgtttctgaaaagggcgtgccaggacgtatccgtgatcatccatacagcttgtatcatagatgtgtttggcgttacccaccgggagagtatcatgaatgttaacgttaaggggacacagttattgctggaggcgtgcgtacaagccagcgtgcccgtttttatatatacgagtagcattgaagtcgccggacccaatagctacaaagaaatcatccaaaacgggcatgaggaagaacctcttgagaacacatggccagctccctacccacactcaaagaaactggccgagaaagcggtgctggccgctaatgggtggaatctcaagaatggcggaacactgtacacatgtgccctgcgaccaatgtatatttacggtgagggctctcgcttcctatcagcctctataaatgaggctctgaacaataacggcatactgagctccgttgggaagttcagcacagtgaacccagtgtacgtcggaaatgtggcatgggctcatattctggcactacgcgctctacaggatccaaaaaaagcgccttccatccggggtcaattctattacatctcagatgacacccctcaccagagttacgataaccttaactatacgttaagtaaagagtttgggctccgattggatagcaggtggagcttcccgctctccctcatgtattggatcggatttctattagaaattgtctcattccttctgcggccaatttatacttatcgtcccccttttaaccgtcacatcgttacattgtccaacagtgtgtttacctttagttataaaaaagcacagagggatttggcgtacaagcccttgtactcatgggaagaagcaaagcaaaaaaccgttgaatgggtcggctcactggtggatcggcacaaagaaactctgaagtccaagactcagtag

SEQ ID NO: 226514 - DNA, 249 bp, Artificial Sequence
  Description of Artificial Sequence: Synthetic coding sequence
atgacaggctggtcatgtctggttacaggagccggaggcttcctcggccagagaatcataaggctactcgtgaaagagaaggagctcaaggaaattagagtcctggacaaagcattcggacccgagctgagggaggaattctccaagctccagaataagacgaagctgacagtgctcgagggtgacatactggacgagccctttttaaagcgtgcatgtcaagatgtgtccgtaattatccatacatag

SEQ ID NO: 226515 - DNA, 1119 bp, Artificial Sequence
  Description of Artificial Sequence: Synthetic coding sequence
atggggtggagttgtttggtgaccggcgctggcggacttctgggccaacgcatcgtcagactactcgtggaagaaaaggagctgaaggaaattagggctcttgacaaggcttttcgccctgaacttcgagaagaattcagcaaattgcagaaccgtaccaagcttactgtgttagaaggcgatatcctcgatgagcccttcctgaagcgcgcttgccaggacgttagtgtcgtcatccatacggcctgtataatagatgtttttggcgtgacacacagagagagcatcatgaacgtcaacgtcaaggggacccagttgcttctcgaggcgtgcgtacaagcctcggtccctgtgtttatctatacgagctcaattgaagtagccggaccgaactcctacaaggagatcatccagaatggacacgaggaagaacctctcgagaatacgtggcctaccccctatccttacagcaagaagctggccgagaaggctgttttagccgctaacggatggaaccttaaaaatggggacacgctctacacgtgcgccttgcgaccaacctacatttacggcgagggtgggccttttctgtctgcatcgattaatgaggctctaaataataatggaatcctgagcagcgtagggaagttcagcacagttaatcccgtttacgtgggaaacgtggcctgggcgcatattctggccctaagggcgctacgtgatcccaagaaagcgccatccgtccggggtcagttctactacatcagcgatgataccccgcaccagtcttacgacaacctgaactacatactctctaaggagtttgggctgcgtcttgattcacgatggtcacttccgctcacgctaatgtattggatcggcttcctactcgaagtggtgtcttttctgttgagtccaatctattcctaccagccgccattcaatagacacaccgtgactctatcaaactccgtgtttacattcagctacaagaaggctcagagagatttggcatataagcccttgtatagttgggaagaggccaagcaaaaaactgtggagtgggtgggatctctggtcgatcggcacaaggagactctgaagtctaagacccagtag

SEQ ID NO: 226516 - DNA, 588 bp, Artificial Sequence
  Description of Artificial Sequence: Synthetic coding sequence
atgggatggtcttgtctcgtaactggcgctggaggcctcctgggacagcggatcgtgaggcttttagtcgaggagaaagagttgaaagagatcagggccttagacaaagcctttcgccctgagctgcgtgaagagtttagtaagttgcaaaaccggactaagctgacagtgctcgagggggatatcctagacgagcccttcctgaagagggcatgccaggacgtcagtgtggtcatccacaccgcctgcattatagacgttttcggggtcacccacagagagagcataatgaacgtcaacgtcaaggggacgcaactgctgcttgaggcctgcgttcaggcaagcgtgcccgtgttcatatacacctcttcaattgaggtcgctggacccaattcatacaaggaaatcatacaaaatggtcatgaggaagagcccctggagaatacgtggcccacaccctatccctacagcaagaagctggctgaaaaagctgttttggctgccaacgggtggaacctcaagaatggcgacaccctctacacttgcgccctgaggcctacatacatctatggcgaaggcggaccatag

SEQ ID NO: 226517 - DNA, 1119 bp, Artificial Sequence
  Description of Artificial Sequence: Synthetic coding sequence
atgggatggagctgccttgttactggagccggagggctgctgggacagcgcatcgttcgcctgctagtcgaggagaaggagttaaaggagatacgggctttggacaaggcatttcgcccagagctgcgagaagaattttccaagttgcagaaccgcacgaaactcactgtccttgaaggtgacatcttagacgagcctttcctgaaaagagcatgtcaggatgtcagtgtagtcattcacacagcttgcatcatcgacgtctttggggtgacccaccgagagtcaattatgaacgttaatgtgaaggggacccagctgctcctggaggcatgcgtccaggcttcagttcccgtattcatttacacatcctccatcgaagtcgcaggaccaaatagctataaggaaatcattcaaaatggacacgaggaggagccactggagaatacctggcccacaccttatccttatagtaaaaagctggctgagaaagcagtcttggcagcgaatggctggaacttaaaaaatggggacactttgtacacttgcgcacttcgtcccacttatatatacggggaagggggtccctttctttctgcatccatcaacgaggcccttaataacaacgggattctgtcatccgttgggaaatttagtaccgtaaacccggtctacgtgggcaatgtggcttgggcccacatcttggcactgcgtgctctccgtgatcctaaaaaagcaccatccgtgaggggccagttctactatattagcgatgacactccccaccagtcctatgacaacctgaattacattttgagcaaagaatttggattgagactagactctcgctggtctctaccactgaccctgatgtattggattggatttctgcttgaagttgtgtccttcctgttatcaccaatctacagctatcagcctcctttcaatcgacacaccgtgacgctctcaaatagtgttttcacattcagctacaagaaagcgcaacgggacctggcttataagccactgtacagctgggaagaggcaaaacagaagaccgtggagtgggtagggtcattggtggatagacacaaagagacactgaaatctaagacccagtag

SEQ ID NO: 226518 - DNA, 591 bp, Artificial Sequence
  Description of Artificial Sequence: Synthetic coding sequence
atggccgatagcgctcaggcccagaaactcgtgtacctagtgacgggaggctgtggcttcctcggagagcacgtcgtgagaatgctgctccagcgcgagcccagactgggtgagctgagagtgtttgaccagcatctcggaccatggcttgaggaactgaagaccggccctgttcgggtaaccgccatccagggcgatgtgacacaggcccatgaagttgcagcagcagtggccggagctcacgtggtgattcataccgcgggtctggtcgacgtcttcgggagagcgagtcccaaaactatacacgaagtgaacgttcaggggacgagaaacgtgatcgaggcctgtgtgcagacggggacccgcttcttggtatatacctcatccatggaggtggtgggtccaaacacaaaaggtcatcctttttatcgcggtaacgaagacacaccctacgaggccgtgcaccgacatccttatccttgcagcaaagccctggccgagtggcttgtgctcgaagccaacggcaggaaggccatgctgccaggctgtacatgttggcagccgggtagctggagcagtgggcagccttag

SEQ ID NO: 226519 - DNA, 1110 bp, Artificial Sequence
  Description of Artificial Sequence: Synthetic coding sequence
atggccgatagtgctcaagctcagaagctggtgtacttggttactggaggatgcggatttctgggagaacacgtagttagaatgctactccagcgcgagccccgacttggagagttgagagtattcgaccaacatctcgggccttggctggaagaactgaagactgggccagttcgggtaactgctattcagggggacgtgacccaggcccatgaagttgccgctgccgtggctggcgcacacgtggtcattcataccgccggactcgtggatgtatttggaagagcaagtccaaaaactatccatgaggttaacgtgcagggcacacgaaatgtcatcgaggcctgcgtgcagacgggcactcgatttctcgtgtacacaagctcgatggaggtcgtgggacctaacaccaaggggcatcccttttacagggggaacgaagacactccctacgaagccgtacacaggcacccatacccgtgttctaaagcacttgccgaatggctggttcttgaggctaacggcaggaaagtccgcggtggattgcccctcgtgacttgtgccctgcggcctactggcatctacggggaagggcaccagatcatgcgcgacttctaccgccaagggctccgacttgggggatggctgttccgagcaattcccgcttcggtggagcacggacgtgtttatgtggggaatgttgcctggatgcacgtgctggccgctcgcgaactggaacagagagctacgcttatggggggacaggtttatttttgctatgatggctccccctacagatcatatgaagatttcaacatggagtttttagggccttgtggcctccgcctggtgggcgcacgcccactcctgccatattggctgctggtttttttagcggctcttaacgctctgctgcagtggcttctccgacctctggtgctgtacgcgccacttctaaacccctatactctggctgtggcgaatactaccttcaccgtcagcaccgataaagcccagaggcattttggctatgaacctctattttcctgggaggatagccggacgaggacaatcctgtgggttcaggccgctacaggaagcgctcaatag

SEQ ID NO: 226520 - DNA, 591 bp, Artificial Sequence
  Description of Artificial Sequence: Synthetic coding sequence
atggccgattcagctcaagcacagaagctagtctatctagtcactggtgggtgcgggtttctgggagaacatgtcgtgcgcatgttgcttcagcgcgaacctcgtctcggggaactgcgagttttcgatcaacacttgggaccttggctcgaagagctgaaaacaggccctgttagagtgacggcaattcagggagacgtgacccaggctcacgaggtagccgctgctgtcgcaggagcccacgttgtcatccacaccgcgggtctggtagacgtgttcggcagggccagccccaaaacgatccatgaggtgaatgtccaggggacccggaacgtgattgaggcatgcgtgcagacgggcaccagatttttggtgtatactagttcgatggaggtggtcggaccaaatacaaagggtcacccattttataggggaaacgaagataccccgtatgaagccgtccaccggcatccttacccttgctccaaagcgttagctgagtggctggtgttggaggcaaacggccgaaaggctatgctcccaggatgtacctgttggcaaccgggatcttggtccagcggtcagccgtag

SEQ ID NO: 226521 - DNA, 1086 bp, Artificial Sequence
  Description of Artificial Sequence: Synthetic coding sequence
atgagcggaaacggcaatgccgctgccactgctgaggaaaattctcccaagatgcgggttatccgggtcgggactcgcaagagtcaattagctcggattcagactgacagcgtagtggcaacccttaaggcctcctacccaggacttcagttcgagatcattgccatgtctacaactggcgataaaatcttagacacagccttatcgaagatcggcgaaaagagcctattcacgaaggagcttgagcacgcacttgaaaagaatgaggtggatctggtggtacacagcctgaaggatctgccaacagtcttgcctcctggatttacgattggcgcaatatgtaagcgggaaaatccacacgatgctgttgttttccacccaaagttcgttggtaaaacgctcgagactttgcctgagaagtcagtggtgggaacaagtagcctgcgccgagccgctcagcttcaaaggaagtttccccacttggaattcaggagcatacggggaaacctcaatacacgccttcggaagctggacgagcagcaagaattttctgcaattatacttgctaccgctggcctccagaggatgggctggcacaacagagtcgggcaaatcctgcacccagaggaatgcatgtatgctgtgggacagggagcactgggagtggaggtacgggctaaggatcaggacatcctcgacctcgtgggggtgctgcatgatccggagactctgctcagatgcattgccgagcgggcatttctgagacatctggagggcggttgcagcgtgcccgtggcagtacacactgctatgaaggatggccaactttatctgactggcggtgtttggtctcttgacggatcagattctattcaagaaactatgcaagcaactatacacgtgcccgctcagcacgaggacgggccagaggacgaccctcagctcgtcggaataacagctcgtaacatcccacggggaccacagctggcagcacagaacctgggaatcagcctggccaatctgctgctgagtaaaggtgctaagaacatcctggatgtagccaggcagttgaatgatgctcactag

SEQ ID NO: 226522 - DNA, 1035 bp, Artificial Sequence
  Description of Artificial Sequence: Synthetic coding sequence
atgcgcgtgatccgcgttggcacccggaaatctcagctcgctcggatacagacagactctgttgtggcaacgttgaaagcttcctaccctgggttacagttcgagatcatcgcgatgtccacgaccggtgacaagatcctcgacactgcgctctccaagattggggaaaaatccctgttcacaaaagagctggagcacgctcttgagaaaaatgaagtggatctagtggtgcacagcctcaaggatttacccacggttctgcctccagggttcaccatcggtgccatctgcaaaagagagaatccgcacgacgccgtggtgttccatcccaagttcgtcggtaagaccctggagaccctgcccgagaagtccgtcgtgggaacgtcatcactgcgccgagcagctcagttacaacgtaagttcccccacttggaatttcgaagcattagaggcaatctcaataccagactgagaaaactggatgaacagcaggaatttagtgcaataattctagctaccgctggactgcaaagaatgggctggcacaaccgggttggtcagatcctccatccggaggaatgcatgtacgcagtagggcaaggtgcacttggtgtcgaagtgcgtgccaaggaccaagatatcctggatctggtaggcgttctccacgacccagagacgttgttgcggtgcattgccgagcgagcctttcttcgccatttggaaggtggctgctccgtccccgtggctgtccacacagcaatgaaagatggacagctttacctcactggaggcgtctggtccttagatggatcagactccattcaggagaccatgcaagcaacaatccatgtgccagcacaacatgaagatgggcctgaagacgatccccagctggtggggattactgcccgaaatatcccaagaggcccacagctggccgcacagaacctggggatcagtcttgctaatctcctgttgtcaaagggtgcaaagaacattcttgacgtcgcgagacagttgaacgacgcccactag

SEQ ID NO: 226523 - DNA, 1035 bp, Artificial Sequence
  Description of Artificial Sequence: Synthetic coding sequence
atgagagttatccgggttggaacccggaagtcccagcttgcccgtatccaaaccgacagcgttgtcgccactttaaaagcaagctaccccggtctgcagttcgagattattgcaatgtctaccacaggagacaaaattctggacactgccctgtcgaagatcggggagaaaagccttttcacaaaagagctggagcacgctctggaaaagaatgaggtggacctggtggtgcattcattaaaagacctccctacagtactgcctccagggttcacaatcggcgctatttgtaagcgggagaatcctcacgacgcggtggtatttcatccaaagttcgtgggcaagaccctcgagaccctccctgagaaaagtgtggttggcacttcttccctgcggagggccgctcagctgcaacggaagtttcctcacctcgagttccgttcaatacgtgggaacctgaacacacgcctgagaaagcttgatgagcaacaggaattctcagcaattatacttgcaaccgcgggactgcagcgcatggggtggcataatagggttgggcaaattctccacccagaggagtgtatgtatgctgtggggcaaggggcactgggtgtggaagttagagctaaagaccaggacatccttgatttggtaggcgtgcttcacgatccagagaccctgctcagatgtatcgctgagagggcatttctgaggcatttagagggtgggtgttccgtcccagttgctgtccacaccgcaatgaaagatggccagttgtaccttaccggcggtgtatggtctctggacggtagcgattcaatccaggagacaatgcaagccactatccacgtccctgcccagcatgaagacggccctgaagacgatccgcaactcgtcggaatcaccgctaggaacatacctcggggtcctcagctggctgcccagaacctcggaattagtctggcgaatctgctcctatcaaagggtgctaaaaatattctagacgtggccaggcaactgaatgatgcacactag

SEQ ID NO: 226524 - DNA, 564 bp, Artificial Sequence
  Description of Artificial Sequence: Synthetic coding sequence
atgagagttatccgagttgggacacggaagagccagctggccagaatccagacggattctgtcgtggctacccttaaagcaagctacccaggtctccaatttgaaattattgccatgtccaccacaggagataagatcctggataccgcccttagcaaaatcggcgaaaagtctctctttacaaaggaactggagcacgcactggagaaaaatgaagtggacttggtggtacactccttgaaagatctgccaaccgttctgcccccaggctttacaatcggtgctatttgcaaacgagagaatccacacgatgctgtagtgtttcaccctaaattcgtggggaaaactctcgaaactttacccgaaaaaagtgtcgtagggacttcttcgctccggagggctgcccagctccagcgaaaattccctcaccttgagttccgaagtatccgaggtaatctgaacacacgcctgcgcaagctggatgagcaacaagagtttagtgccattatcctggccactgctggactgcaacgaatggggtggcataatagggtggggcagtag

SEQ ID NO: 226525 - DNA, 1035 bp, Artificial Sequence
  Description of Artificial Sequence: Synthetic coding sequence
atgagggttatcagagtggggacaaggaaatcacagcttgctcgcatacagacagactctgttgtcgctacgttgaaggccagctatccaggtcttcaattcgaaatcattgctatgtcaaccacaggcgataaaatcctcgatactgccctcagcaagattggggaaaagtcgctctttacaaaggagttggagcacgctctggagaagaacgaagttgacttggttgtccactcactgaaagaccttccgaccgtgctgcccccagggtttaccatcggcgctatctgcaagagagagaacccacatgatgccgtcgtgtttcaccccaagtttgtcgggaaaaccctggaaactctgcccgagaaatccgtcgttgggacaagcagtctccgcagggcagcccagctccagcgcaagttccctcacttagaattccggtctatacggggtaatctaaatactcgtctcagaaaacttgatgagcaacaggaattttctgccatcatccttgccactgcaggtcttcagcggatgggttggcacaatcgcgtgggccagatactgcatcctgaagagtgcatgtacgctgtaggtcaaggtgctctgggcgttgaggtgagagctaaggatcaagatatcctcgacctcgtgggagtccttcacgatccagagaccttactgcgttgcattgctgaaagggccttcctcagacatctggaggggggatgcagcgtgcccgttgcagtccacacagctatgaaggacggacagctgtacctgacggggggagtctggagcttagacgggtccgactccatccaagagaccatgcaggctacaatccatgtccccgctcaacacgaagacggtccggaagacgacccacagctagtgggaatcactgctcgcaatataccgcgtggtccccaacttgcagcacagaatttggggatctctctggccaatctgctccttagcaagggcgcaaaaaatatcctcgatgtcgcacgacagctgaatgacgcccactag

SEQ ID NO: 226526 - DNA, 564 bp, Artificial Sequence
  Description of Artificial Sequence: Synthetic coding sequence
atgcgagtcataagggttgggacgcggaagagccagctggcaagaatccagaccgacagcgtagttgctaccttgaaagcttcttatccaggtctgcaatttgaaatcatcgctatgtctaccacgggcgataagatactggacacagccctgagcaagattggcgagaagtcgctgttcactaaggaacttgaacacgccctggaaaagaatgaggtagacttggtcgtgcactcgctgaaagacctacccacagtactgccccctggcttcacaatcggggctatttgcaagcgcgagaaccctcacgacgcagtggtcttccatccgaagtttgtgggcaagacacttgagacgctcccggagaagagcgttgtcggtacatctagtctgaggagggcagcccagctacagcgcaagttcccccacttggagttccgcagtattaggggcaaccttaataccaggctgcgcaagttggatgaacagcaggagttctctgcaattatcctcgcaaccgcaggcttgcagcggatgggatggcataacagagtaggacagtag

SEQ ID NO: 226527 - DNA, 915 bp, Artificial Sequence
  Description of Artificial Sequence: Synthetic coding sequence
atgagggtcatcagagtgggcacaaggaagagtcagctcgctagaatccagactgactcagttgtggctaccctaaaagcaagttaccccggtctgcaattcgagatcatcgctatgtccacaacgggcgataagatcctggacacagcccttagtaaaataggtgagaagagtcttttcacaaaagagttagagcacgcactggagaaaaacgaagtggatctcgtcgtgcactcgcttaaggacctgccaaccgttcttccaccgggtttcacaatcggggctatctgcaagagagaaaatccccacgacgccgtggtttttcaccccaagttcgtcggcaagactttagaaacgctacctgagaaatccgtagtcggaacgtcctccctccgccgagccgctcagctacagcgtaagttcccccacctcgaatttaggagtattcgcggtaacctgaacacacggcttcgaaaactcgatgaacagcaggaatttagcgcgataatcctcgccaccgctggactgcagagaatgggatggcacaatagagtggggcagatcttacaccccgaagaatgcatgtacgcagttggccaggaggggggatgttccgtccctgtcgccgtccacaccgccatgaaggatgggcagctgtatttgaccggaggcgtgtggtccctggatggttcagattcaattcaagaaaccatgcaggctacaattcacgttcccgcacagcacgaagatggtccggaggatgaccctcagctggttggaataactgctagaaatattccaagaggccctcaactggccgctcagaatctcggcatcagcttggcgaacctactgctctcaaagggagccaaaaacatcctggatgtcgccagacagctgaacgacgcccactag

SEQ ID NO: 226528 - DNA, 966 bp, Artificial Sequence
  Description of Artificial Sequence: Synthetic coding sequence
atgagcggcaacggtaatgcagctgccaccgcagaggaaaacagccctaagatgagagtcatcagagtcggcacgaggaagagtcagctagccagaatccagacggactccgtcgtggctacactgaaggcttcttatccaggcctacagtttgaaattatcgccatgtccaccactggagataagatcctcgatacagccctgtcaaagatcggggagaagagcctatttacgaaagaactagagcatgctctcgagaagaatgaggtagacttggtcgtccattccctcaaggacttgcccaccgtgctgccacctggatttacaatcggcgcaatctgcaagagggaaaaccctcacgatgccgtggtattccaccctaagttcgtgggcaagacacttgagacccttcctgagaagagtgtggtcggaacaagctcactgcggagagccgcacagctgcagcgcaagtttccgcacttggagttcaggtccatcaggggaaacctgaatacgcggcttaggaagttggacgaacagcaggagttttccgccattattttagctacggccggactgcaaaggatggggtggcacaacagggtgggacagattctccatccagaggagtgcatgtatgctgtcggccaggagggcggatgcagtgtccctgttgccgtacatacagccatgaaggatggtcagctgtacttaacaggaggagtatggtcactggacggaagcgactctatccaggaaacaatgcaggcgacgatccacgtgcctgcacagcatgaagacggtcccgaagacgatccccagttagtggggattactgcacggaatattccacgagggcctcagcttgccgctcagaacctgggcattagcctagcgaacttgcttctatccaagggggctaagaatatcctggatgtggccaggcaactgaatgacgcacattag

SEQ ID NO: 226529 - DNA, 879 bp, Artificial Sequence
  Description of Artificial Sequence: Synthetic coding sequence
atggcctttatgaaaaaatatctgctcccgattctaggcctgttcatggcctactattactacagcgctaacgaagaatttaggccagagatgcttcagggcaagaaagtcattgtgacgggggctagcaagggtatcgggagagagatggcatatcacctggcaaagatgggcgcacatgtggttgtgaccgctagatccaaggagacattgcaaaaggtcgtttcacactgcttggagctaggtgctgctagtgcccactacatagctggcaccatggaagacatgaccttcgccgagcagttcgtggctcaggcgggaaagctgatgggaggattagatatgctgatccttaaccatataaccaacacatcactgaatctttttcacgacgatatacaccacgtccgaaaatccatggaagttaacttccttagctatgttgtacttacggtcgctgctctccctatgcttaagcagagtaacggatccatagtcgtggtttcttcactggctggaaaagtcgcctacccgatggtggccgcatatagcgctagtaaattcgccctggacggctttttcagcagcattcgcaaggagtacagtgtaagtcgggtcaacgtgtccatcaccctgtgcgtcctcggactgatcgacactgaaacggccatgaaagccgtatcaggcatcgtgcatatgcaggctgcacctaaggaagaatgcgctctcgagattattaagggcggtgcactgcgacaagaggaagtctactatgactcctcattgtggacgaccctgctcattagaaacccctgtagaaagattctggagttcctgtattccacctcttacaacatggatagatttatcaacaagtag

SEQ ID NO: 226530 - DNA, 879 bp, Artificial Sequence
  Description of Artificial Sequence: Synthetic coding sequence
atggccttcatgaagaagtacttacttccaatacttggtctcttcatggcgtactactattacagcgccaacgaggaatttcggccagaaatgctgcaggggaaaaaagtgattgtgacaggcgcaagcaaaggcattggaagagaaatggcttaccacttggccaagatgggagcacacgtggtcgtgacagcgagatcgaaggagactttgcaaaaggtcgtgagccactgtctggagctgggtgccgcttccgcacactatattgctgggacaatggaagacatgacttttgccgaacagttcgtagctcaggccggtaaactgatggggggactggacatgctcattctaaaccacattaccaacaccagcctgaatctcttccacgatgatatccatcacgtgcgcaagagcatggaagtgaattttctgagttatgtggtcctaaccgtcgccgcactgcccatgctgaagcaatctaatgggtccatagtcgtggtttccagcctggccggaaaagtagcctaccctatggtggcagcgtactctgctagcaaattcgccctcgacggcttcttctcctctattagaaaagaatacagcgtgtctcgagtgaacgtaagcatcacactatgtgtgctgggcttaattgacacagagactgcaatgaaggccgttagcgggattgtacatatgcaggcagccccaaaagaggagtgtgcactggaaatcattaaggggggagcattacgacaggaggaggtatactacgactcttccctgtggactactctactaattcgcaacccttgccgcaagatcttggagtttctttactccacctcctataacatggaccgatttataaacaagtag

SEQ ID NO: 226531 - DNA, 879 bp, Artificial Sequence
  Description of Artificial Sequence: Synthetic coding sequence
atggccttcatgaagaagtatttgctgcccatactgggtctgtttatggcctattactattacagtgctaacgaagaatttcgaccagaaatgctccaaggcaagaaggtgatcgtcaccggggctagcaagggaattggaagagagatggcttaccatcttgccaagatgggcgctcatgtggtcgtgaccgctcggagtaaggagacacttcagaaggttgtctcccactgcctggagctgggcgcagcgagtgctcactatatcgctggaaccatggaagatatgacattcgccgagcagtttgtcgcccaggcgggaaaacttatgggaggtttggatatgctcatccttaaccacataactaatacgagcttgaatttgttccatgacgacatccatcatgtgcggaaatctatggaggtcaacttcctctcctatgtcgtgctgaccgtggccgcactgcccatgctgaagcagtcaaatggaagcatcgtggtcgtttcatcacttgctgggaaagtggcgtacccaatggtggcggcatactccgcctccaagttcgccctggacggcttctttagttccataagaaaagagtattcagtgtctagggttaacgtctctataaccctgtgcgtgttaggcttgattgataccgaaactgctatgaaagcagtgtccgggattgttcatatgcaggccgcacccaaagaggagtgtgccctggaaataatcaagggtggggcacttcggcaggaggaggtgtactatgactcatccctctggacaacactgcttatacggaacccctgccgcaagatcctggagtttttgtatagcaccagttataacatggaccgatttattaataaatag

SEQ ID NO: 226532 - DNA, 1218 bp, Artificial Sequence
  Description of Artificial Sequence: Synthetic coding sequence
atggagcggtggccttggccttcaggcggtgcttggttgcttgtggcagcgcgtgcactgctacagctacttaggagcgatctacggttgggtagacccttattagcggctctcgccctgttggcagcactagactggttgtgtcaacgccttcttccgcctcctgccgcactagccgtgctagctgcagcagggtggattgcattatcacggctagctagaccacagaggcttcctgtcgccactcgagccgtgctcatcacggggtgcgactccgggttcggtaaagaaacagctaagaagctggattctatgggttttaccgtgctcgcgacagttctggagttaaattctcctggcgcaatagagctgcgcacttgctgcagccctagattgcgactcctccagatggacctgactaaacccggagacattagccgcgtcctagagtttactaaggcccatactactagtaccggcctttggggcctggtaaataatgctggccacaatgaggtggtcgcggatgcggaactgtctccggtggcaacgttccgatcatgcatggaggtgaatttttttggcgcactggagcttaccaagggcctcttaccactgctgcggtctagtcggggacgcatagtcaccgtaggaagtcccgctggtgacatgccttatccctgcctgggcgcttacgggacgagtaaggccgcagtggcattattgatggatactttttcttgcgagctcctcccgtggggagtgaaagtcagcatcatccagcccggttgcttcaagacagaatccgtgcgcaatgtggggcagtgggagaagagaaagcaactgcttctggcaaatctccctcaagaactcctgcaggcatacggaaaggactatatagaacaccttcacggccagtttctgcacagtcttcgccttgccatgtccgacctcacccccgtggtggacgcgattaccgacgcactccttgccgctcggcctcgcaggaggtactaccccggtcagggtctgggcctgatgtattttattcactactatcttcccgagggcctcagaagacgctttctccaagcgtttttcatttcccactgtctgcctcgcgctctccagccaggccagcctggaactaccccccctcaggatgccgctcaggaccctaatctgtctcccggtccaagccccgctgtcgcgagatag

SEQ ID NO: 226533 - DNA, 2232 bp, Artificial Sequence
  Description of Artificial Sequence: Synthetic coding sequence
atggaagccgtggccgtggccgctgctgtgggggttttactcctggctggcgcaggcggagcagcaggggacgaagcacgcgaggctgctgcagtgcgtgcactcgtggctcgcctgttaggccctgggcctgccgctgactttagcgtgagcgtggaacgcgcattggctgccaagcctggactggacacctattctttaggtgggggaggggctgcaagagttagagttcgcggtagcactggcgttgcagctgcagccggacttcacagatacctccgagacttctgcggatgccacgtggcttggtccggctcccagctgcggctgccacggcctctgccagctgtgccgggagagttgactgaggctacgcccaatcgctaccgctattatcaaaacgtttgtacacagtcttattccttcgtgtggtgggattgggctagatgggagcgagagatagactggatggccttaaacgggattaatctggcgctcgcgtggtcaggccaggaggccatttggcagcgcgtttacctggccctcggcttgactcaggccgagatcaacgagttcttcacaggcccagcgttcctggcctggggccgaatgggcaacctccatacctgggatggtcctctgcctccatcgtggcatattaagcaactctaccttcagcacagagttctagaccagatgaggagcttcggcatgacgcctgttctccccgcatttgcaggacacgtgcctgaagccgtgacccgtgtgtttccacaggtgaatgtcacaaagatgggatcctggggtcactttaattgcagttacagctgtagtttcttattagctcccgaggatccgatctttcccattattggatccctctttttacgagaactgatcaaagagttcgggactgaccacatttacggggctgacacctttaatgagatgcagcctccatcatccgagcccagttatctggccgctgcaacgactgcagtgtatgaggccatgacagctgtagacacagaggctgtatggctgctgcaaggctggctctttcagcaccagccacaattctggggacctgctcagatcagagctgttctgggggcagtccccagagggcgtctactcgtgctcgatctgtttgccgagtcccagcctgtgtatactcgtactgcttccttccagggccaacccttcatctggtgcatgttacacaatttcggcggtaatcatggactgttcggagcccttgaagccgtgaatggtggccctgaggcagctaggctctttcctaattctaccatggtaggaactggcatggctcccgaaggtatttcccagaatgaggtcgtgtattccctcatggccgagttggggtggagaaaagatccagttcctgatctcgccgcatgggtaaccagctttgccgcacggaggtatggtgtctcacaccccgacgcaggagccgcttggcggctgcttctgcgttccgtgtataattgttctggcgaggcctgtaggggccacaacagatccccattggtaagacgccctagcctgcagatgaatacttccatatggtacaacagaagcgacgtgttcgaggcctggcggctacttctcacatcagcccctagcctcgctaccagccccgctttcaggtatgacctgctcgatctgacccgacaggcagtgcaagagctggtttcgctatactacgaggaggcacggagtgcttacctgtctaaggagctcgcctcattgctcagggctggaggggttctagcttacgagcttttgcctgccttagatgaggtgttagcttcagatagccgattccttctggggtcttggttagaacaggctagagcagctgccgtatctgaggccgaggctgatttttacgagcagaacagtcgctaccaactgacactttggggccctgaaggaaatattctagattacgccaataagcagcttgctggccttgtcgcaaattactacactcctagatggcgtctatttctggaggccttggtggacagcgtggctcaggggatcccctttcaacagcatcaatttgataaaaatgttttccaattggagcaggccttcgtgctatctaagcagcgctaccctagccagccgagaggtgataccgtcgacctcgcaaaaaagatctttcttaagtactatcctcggtgggttgccggatcctggtag

SEQ ID NO: 226534 - DNA, 450 bp, Artificial Sequence
  Description of Artificial Sequence: Synthetic coding sequence
atggcaagaacagtcgtcctgattacgggttgttcatctggaatcggactccacctggctgtgagattggcctcggaccctagccagagctttaaagtgtacgcgacattaagggacctaaaaacccagggccgactgtgggaggccgctcgggcactcgcttgcccacctggctcccttgaaacgttacagttggatgtgcgtgactctaagtcggtggcggctgctcgcgagagggtgacggagggacgagtcgacgttctggtatgcaacgctggcttgggactgctcggtccactagaggccctcggcgaggatgcagtggcctccgtgttggacgtgaacgttgtgggcaccgtcaggatgttgcaggctttcctcccagacatgaaacgtcgaggctccggaagagtgctggtgactggctctgtgggcggacttatggcttag

SEQ ID NO: 226535 - DNA, 987 bp, Artificial Sequence
  Description of Artificial Sequence: Synthetic coding sequence
atggccagaactgtggtattaattactggatgttcttccggcatcggcctacatctggcagtccgtctcgctagcgatccaagtcagtcattcaaagtatacgctactttgagggacctgaaaacacaggggcgtctgtgggaagcagcgcgagctttagcctgtcctccagggagcctggagacattgcagctggacgtgcgggactctaagagcgtcgccgctgcaagggagcgcgtgacagaagggagggtagacgttctggtgtgtaatgccggtctcggcctgctcggccctctcgaggccttgggagaggacgccgtggcttctgtgctggatgttaacgtggttgggactgtcagaatgctccaagctttcctgccagatatgaaacggagaggtagcgggagagtgctggtgacaggaagcgtggggggtctcatgggcctaccttttaacgatgtttactgcgcatctaagtttgcactggaggggctgtgcgagagtctggctgttctcctgttacctttcggagtgcacttgagcctcatagaatgtggaccagtgcacaccgcttttatggaaaaggttttggggtccccagaagaggttctagatagaactgacatccatacgtttcatcgcttctatcagtatctcgcacacagcaagcaagtgttccgggaggccgctcagaatcccgaggaggtagcagaagtcttcctaacagcactacgggcacccaagccaaccctgcggtactttacaactgagcgttttctgcctctgctgcgaatgcgtctggacgatcctagtggctccaactatgtaacagccatgcaccgggaggtttttggcgacgtgcccgctaaggccgaggcaggtgccgaggcgggaggtggggcaggccctggagctgaagatgaggccggtcgcggtgcggtgggcgatcctgagttaggagatccacccgcagcaccacaatag

SEQ ID NO: 226536 - DNA, 447 bp, Artificial Sequence
  Description of Artificial Sequence: Synthetic coding sequence
atggcatgcactgtggtgctgattacaggatgttcatccggaatcggacttcacttggctatacacttagccctcgacccaagtcaatcattcaaggtgtatgcgaccttaagggacctgaaaacgcagggtagactttgggaggctgctcgcgctcttgcctgccctcagggaagcctggagcggctgcagttggatgtaagaaattcctcatctctggccgctgctcgggagcgagttactgagggtagggttgatgtgctagtctgcgacactggcttgggcctgctgggaccattaggtgaggatgctgttgcatcagttttggacgtaaacgtcgtgggcacggtccgcgtgctgcaggatttcttgccggacatgaagcgccctggcagcggtcgggttctggtgacaggatccatgggaggtctgatgggtgagtggtag

SEQ ID NO: 226537 - DNA, 786 bp, Artificial Sequence
  Description of Artificial Sequence: Synthetic coding sequence
atggcagcagcgtgtcgcagcgtcaaggggctagttgccgtgattacggggggagcctccggactgggactcgctacagccgagcgcttggtcggtcaaggagcctctgcagtgcttctagatctgccgaatagtggcggagaagcccaggccaagaagctgggtaacaactgcgtcttcgctcccgcagatgtcacctcggagaaagatgttcaaacagctctcgcgctcgccaaaggaaagttcgggagagtggacgtggccgtgaactgcgctggcatagccgtggcctccaaaacgtataatctcaaaaaaggacagacacacactctagaagattttcagcgagttctggatgttaacctgatggggacattcaacgttataagactggtggccggtgagatgggccagaatgagcccgatcagggaggtcagagaggggtgattataaataccgcctccgtggccgcttttgagggacaagtgggccaagccgcttactcagcctccaaaggaggcattgtaggtatgaccctcccaatagcccgtgatttagcacctatcggcattcgtgtaatgactatcgcccctggactcttcgggacacccttactgacatccctccctgaaaaagtatgtaattttctcgcatctcaggttccgtttccatccaggttgggagaccctgcagagtatgcccacctggtgcaggccatcattgaaaatccattcctgaacggcgaagtgattaggttggacggggctatcagaatgcagccatag

SEQ ID NO: 226538 - DNA, 510 bp, Artificial Sequence
  Description of Artificial Sequence: Synthetic coding sequence
atggcagccgcatgcagaagcgtgaaaggactggtcgctgtcataactggtggtgcttccggcctcggactcgccaccgcagagcggcttgtcggccaaggggcatccgctgtgctgctagatctccctaacagtgggggtgaagcacaggctaaaaaattgggcaacaattgtgtgttcgccccagccgacgtgaccagcgaaaaagacgtgcaaactgccctggcattagccaaagggaaatttggccgagtggacgtcgccgtaaattgtgcagggatagccgtcgcttcaaaaacttataatttgaaaaaagggcaaacgcacacattggaagactttcagcgggtcctggacgtaaacctgatgggaacattcaacgtgatcagactggtggcgggagagatgggccagaacgaacctgaccaagggggtcagcgtggcgtgatcataaatactgcctccgtggccgcatttgaaggacaggtgtgtctagccccacattgctag

SEQ ID NO: 226539 - DNA, 759 bp, Artificial Sequence
  Description of Artificial Sequence: Synthetic coding sequence
atggccgcagcatgtaggagcgtcaagggcttagtggctgtgatcaccgggggagcgtcaggcttgggattggcaactgctgagagactcgtgggccagggcgcttcggccgtgctgctagatcttccaaacagcggaggcgaagctcaagctaaaaaactagggaacaattgtgtcttcgctcctgccgacgtgacctcagaaaaggatgtgcaaaccgccctggccttagcaaagggtaagtttggcagggttgacgtcgccgtgaattgcgctggaatcgccgtggctagtaaaacttacaacctgaaaaagggccagactcacacactcgaggacttccagcgggtactagatgttaacctcatggggacttttaacgtgatccgattggtggcgggagaaatgggccaaaatgagcccgatcagggagggcagcggggtgtgataatcaatacagcatctgtagctgcgtttgaaggccaggtggggcaagcagcatatagtgcctcaaaggggggaatcgtgggaatgactttgcctattgcccgtgatctggctccaatcggacttttcgggacacctctgctaacgtcccttcctgaaaaggtgtgcaattttctggctagccaagtaccttttcccagccggctgggcgacccggcagagtacgcacacctggtgcaggccataatagagaatccctttctgaatggtgaggtcattaggctggacggtgctattaggatgcagccctag

SEQ ID NO: 226540 - DNA, 903 bp, Artificial Sequence
  Description of Artificial Sequence: Synthetic coding sequence
atgaagttcctgttggacatcctccttctattgcctcttttaatagtgtgctctctggagtcttttgttaaactgtttatcccgaagcggcgaaaatccgtgaccggggagatcgtgctgatcacaggagctggccacggaattgggaggcttaccgcttatgagttcgctaaattgaaatctaagttagtgctctgggatataaacaaacatggccttgaggaaaccgccgcaaaatgcaaggggctaggcgctaaagtgcatacgttcgtagttgactgcagcaacagggaggatatctactcctcagctaagaaggttaaggcggagattggagacgtaagtatcctggtgaacaacgccggagttgtctatacctctgacctgttcgccacccaggacccacagatcgagaagacctttgaagtgaacgtccttgcccacttttggacgaccaaggccttcttacctgccatgacaaagaataatcatggccacatcgtgactgtagccagcgcggcaggacatgtctcagtgcccttccttctggcttactgtagcagcaagttcgctgcggtcgggttccataaaaccctgaccgacgagctcgctgcccttcagatcacaggggtaaagacgacatgtctgtgtcctaactttgtaaatacaggttttatcaaaaacccctctacctctctgggtcccactctagaacctgaggaagtggtgaaccggctcatgcatggaattttaacggagcagaagatgatcttcatccctagctcgatcgcatttctgaccactctagaaagaattctgccggagcgctttctagctgtcctcaagcagaagatcagtgtcaagttcgacgcagtcattggatacaagatgaaagctcagtag

SEQ ID NO: 226541 - DNA, 795 bp, Artificial Sequence
  Description of Artificial Sequence: Synthetic coding sequence
atgaacattatcctcgagatattgctcctactgattactatcatctactcctatctcgagagcctagtgaaatttttcattccacaaaggagaaagtcagtggcaggggagatcgttctgattactggagcaggacatggtattgggcgacagaccacctacgagttcgctaaacgacaatccatccttgtactttgggatatcaacaaggtaaagaaagaagttggggatgtgactattgtcgtgaataacgccggtacagtctaccccgcagacctcctttccaccaaagatgaggaaatcaccaagacctttgaggttaacattctgggtcatttctggattacaaaggctttactgccctcaatgatggagaggaaccatggtcacatcgtcacggtcgcttctgtctgtgggcatgaaggcatcccatatttgattccatactgtagtagcaaattcgccgctgtagggtttcatagagggctgacctccgagctccaggctcttggaaaaacagggattaaaacttcctgtctctgtccggtgtttgtgaacaccgggttcaccaagaatccctctacccgtctttggccagtgctggaaaccgatgaggtggtcagatcccttatagatggcatactcacaaacaaaaagatgatttttgtcccatcctacatcaatatctttctgcggttgcagaagtttttgcctgagagggcttccgctatcctgaatcgtatgcagaacattcaattcgaagccgtggtgggtcataaaatcaagatgaagtag

SEQ ID NO: 226542 - DNA, 903 bp, Artificial Sequence
  Description of Artificial Sequence: Synthetic coding sequence
atgaacattatcctagagatcttactgctgctgatcaccatcatctactcctatctagagagcttggtgaagttctttatcccgcagcggagaaaatctgtggctggcgaaatcgtcctcatcaccggggcaggccatggcattggtcgccagaccacatatgagtttgcaaaaaggcagagcatcctcgtgctgtgggatattaacaagaggggggtagaggagacggccgcagaatgcaggaaactcggagtgactgcccacgcctatgtggttgattgctctaacagggaggaaatatatcggtcgcttaatcaggtaaaaaaagaggtgggggatgttacaatagtggtaaacaatgctggcacagtgtatcctgcggaccttctgtcaactaaagatgaggaaataacaaagacctttgaggtgaacattctgggacatttctggataaccaaagctttgctcccatctatgatggagaggaaccacggacacatcgtgacagttgcttctgtgtgcggacacgagggaattccttacctgatcccgtattgctcatccaagttcgctgctgtggggtttcacaggggcctgacctccgaactacaagcactgggaaagacaggcataaagaccagctgcctctgtccagtattcgtgaacacggggtttacaaagaatcccagcaccagattgtggccagtgctggagaccgacgaagtggtgcggtccctgatagatggaatcttgactaataaaaagatgatcttcgttccatcttatatcaacattttcctgagactacaaaagtttctgccagaaagggccagtgcgattttgaaccggatgcagaacattcagtttgaggctgtggtggggcataagattaagatgaagtag

SEQ ID NO: 226543 - DNA, 813 bp, Artificial Sequence
  Description of Artificial Sequence: Synthetic coding sequence
atggctacaggaacacgctacgccggtaaggtggtagtggtgacgggcggaggacggggaatcggggctggtatcgtgcgcgctttcgtgaatagcggagctcgcgttgtcatttgtgacaaagacgagtcaggcggaagggccctcgaacaggagcttcctggtgcagtcttcatattgtgtgacgtaacacaggaggatgatgtaaaaactctcgtgagcgaaacgatccgcagattcggtcgtctcgactgcgtggtgaataacgctggccaccacccgccacctcagcggccagaagagacctccgcacaggggttccggcagttattagagctcaacctgctggggacctatacgctcaccaaactagccctgccatatctcagaaagtcacagggcaacgtgattaacatttcaagtctcgtaggggcaatcggccaagctcaggctgttccatatgtggccacaaagggtgcggtcaccgctatgacaaaagccctggccctcgatgagtccccttatggggtgcgggtgaattgtattagcccgggaaatatctggacccccctgtgggaggagctggctgccctaatgcctgacccacgtgccacaattagagagggtatgcttgcccagcccctgggtcggatgggccagcccgctgaagtgggtgcagctgctgtgttccttgcttccgaggccaatttttgcaccgggattgagctcctcgtgaccgggggtgcagaactagggtacggttgcaaagcgtcacgctctacccccgtagacgcccctgacattccttcttag

SEQ ID NO: 226544 - DNA, 1164 bp, Artificial Sequence
  Description of Artificial Sequence: Synthetic coding sequence
atgagtacctttttctcagacaccgcttggatctgtctcgctgtgccaacagtcctgtgcgggacagtgttctgcaaatacaaaaagtcatccggccagttatggagttggatggtttgcctcgccggactctgcgccgtttgcctgttgattttgtctcccttctggggtctgatccttttttctgtgagctgcttccttatgtacacatatttgtccgggcaggagttgctgcccgtggaccagaaagccgtactcgtgacaggcggtgattgcggtttgggacatgccctgtgtaagtacctagatgagctcgggtttacggtgtttgccggagtgctgaacgaaaatggccctggagctgaagagctgagaaggacatgctcaccacgactgtccgtcctccaaatggatatcacaaaacctgtccagatcaaggacgcctatagcaaagtggctgctatgcttcaggatcggggtctgtgggccgtgataaacaatgccggtgttctgggcttccctaccgacggagagcttctcctgatgaccgactacaagcaatgcatggcagtcaacttttttggtaccgtcgaggtgactaagacttttttacctcttcttagaaagtccaaaggcagattggtcaatgtgtcttccatgggcggtggggcacccatggaacgattggcttcctatggtagtagcaaagccgctgtgaccatgttcagcagtgtcatgaggttggagctctcaaagtggggaatcaaggtggcttccattcaacccggagggttcctgacaaacattgcgggaacatctgacaaatgggaaaagctcgagaaagacatactcgatcacctacctgcagaggtgcaggaagactacggacaggactacatactcgctcagcgtaacttcttactgctgatcaattcgttggcatcaaaagacttctccccagtgttgcgagatatccagcacgctatcttagctaaatcacctttcgcctactacacaccaggaaaaggcgcatacctttggatttgcctagcccactatctcccaattgggatttacgactacttcgctaagcgccacttcgggcaagacaagccgatgccgagagctttgcgaatgcctaattacaaaaagaaagccacatag

SEQ ID NO: 226545 - DNA, 783 bp, Artificial Sequence
  Description of Artificial Sequence: Synthetic coding sequence
atgggggacgtgctcgagcagttttttattttaactgggctgttggtgtgcctggcttgtcttgccaagtgcgtgagattcagtaggtgtgtactgttgaactactggaaggtgcttccaaaaagcttcctgcgatctatgggacaatgggcagttattaccggggcaggcgacggcattgggaaggcctactctttcgaactggctaagcgagggctcaatgtcgtgcttatttcccgcacgctggagaagcttgaagccatagccactgagatcgagcgcacaacaggaaggtcggttaagatcatacaggctgacttcacgaaggatgatatttacgagcacataaaggagaagcttgctggccttgagatcgggattttagtgaacaacgtcgggatgctgccgaatctgctgccaagccattttttgaacgcacctgacgagatccagtctcttatccattgtaacattaccagcgtagttaaaatgactcagctgattctcaagcatatggagtcacggcagaaaggtctgatcctcaatatctcttcagggatcgctctgttcccctggcccctttacagtatgtatagcgcttctaaggctttcgtatgtgctttttccaaagccctgcaggaggaatataaggctaaggaagtgataattcaagccggatttctgtccctgatacccgcttgggcgttctacagcggtgcctttcagagacttcttttgacgcactatgtggcctatctgaagctcaacaccaaggtgaggtag

SEQ ID NO: 226546 - DNA, 933 bp, Artificial Sequence
  Description of Artificial Sequence: Synthetic coding sequence
atgggcgatgtgctggaacagtttttcattcttacaggattgctcgtctgcctagcttgcctagctaagtgcgtccgattctcacgctgcgtcctcctgaactactggaaggtattgccaaagtcattcctgaggagcatggggcaatgggcagtgatcacaggtgccggagatggaatcggcaaggcctactctttcgaacttgcaaagagaggactgaatgtggtcttgatctccaggacgttggagaaactcgaagcaattgcaacagagattgagaggacaaccggcagaagcgtcaagattattcaggccgacttcacaaaggacgacatctatgagcatatcaaggagaaattagcgggactggagatcgggattctggtcaacaatgtgggtatgctccccaacctcctgccatcacactttcttaacgccccagatgagatccagtcactgatccattgtaacatcaccagcgtcgtgaagatgacgcagctgatcctgaagcacatggaaagtcgccaaaaggggcttattttaaatatatcctcaggcatagcgctgttcccgtggcccctctactctatgtactctgcaagcaaggccttcgtgtgcgcctttagtaaagccttacaggaagagtacaaggccaaagaggttatcatacaagtgcttactccctacgcggtgtccacagctatgaccaagtacctaaacaccaatgtgatcacaaaaacagcggatgaatttgtgaaggaatctttgaattacgtgacaatcggcggtgagacgtgcggatgcctggctcatgaaatccttgctggctttctaagtctcattccagcctgggccttctactctggggctttccaacgcctgctgctgactcactacgtcgcctatctgaagctcaacaccaaagtaaggtag

SEQ ID NO: 226547 - DNA, 2211 bp, Artificial Sequence
  Description of Artificial Sequence: Synthetic coding sequence
atgggatcaccattgaggtttgatggcagagtggtcctcgtgacaggggctggggcaggcctggggagagcgtatgccttggcttttgctgagagaggagccttggtggttgtcaacgacctggggggtgacttcaaaggggtggggaaaggtagcctcgccgctgataaggtggtggaagagattcgccgtcgaggaggaaaggccgtcgctaattatgatagcgttgaggagggcgaaaaggtcgtaaagactgctctggatgccttcggacgtattgatgtggtggtgaataatgccggtatcctgcgagacagaagttttgctaggatttccgacgaagactgggatattatccatcgggtccatctgcgtgggtcatttcaagtgactagagctgcctgggagcacatgaaaaaacagaaatatggcaggataatcatgacaagctccgccagcggcatttacggcaattttggccaagcaaattactcagctgcaaagctgggattgttaggcctggctaactctctggccatcgaggggaggaaatccaatattcactgcaacacaatcgcccctaacgctggcagtcggatgacccagactgttatgcctgaggatctggtggaggcactgaagccggagtacgtagctcccctcgtcctatggctctgccacgaatcatgcgaggaaaatggtggcctgtttgaggtcggagccggatggatcgggaaattgcgttgggaaaggacgttgggagctatcgttagacaaaagaaccaccccatgacgccggaggctgtaaaggccaactggaaaaagatttgcgatttcgaaaatgcttcaaagcctcaaagtattcaggaaagcacaggcagtattatcgaagtcctgagtaaaatcgattctgaagggggtgtgtcagcaaaccacaccagcagggcaacttctacggcaacctctggctttgcaggagctatcgggcaaaagctgccgccattctcctacgcctatacagaactcgaggccatcatgtacgcactcggagtcggggctagtatcaaggaccccaaggatctgaaatttatatatgaaggtagctctgacttctcgtgtctgcccacctttggtgttataatcggacagaagtccatgatgggaggcggactcgccgagattcccggactctcaattaatttcgcgaaggtcctccatggagaacaatacctggagctttataaacctttgcccagggcaggcaaactgaagtgcgaggcagtggtggcggacgtcctggataaagggtcgggcgtcgtgattatcatggacgtgtattcatactccgagaaggaactgatctgccataatcaatttagtctttttctggtggggagcgggggatttgggggtaagcgcacatccgacaaagtgaaagtcgcagttgctattcccaatcgcccaccagatgccgttctcaccgacacaacctcactgaaccaggctgcgctgtaccggctgtccggggactggaacccactgcacatcgatccaaattttgcctcgttggccggtttcgataagccaatcttgcacgggttgtgcactttcggattctctgccaggagagtcctccagcagtttgcagacaatgatgtgagtcgattcaaagccatcaaagcccgatttgcaaaacccgtgtatccaggccagactctacagaccgaaatgtggaaagaagggaacagaatacattttcagacaaaagtgcaagaaactggggacatcgtgatcagtaacgcttatgtagatcttgcaccaacgagtgggactagcgccaagacaccgtctgaggggggtaagctacagtcaaccttcgtattcgaggaaataggacgacgactaaaggatatcggcccagaggtggtgaaaaaggtgaatgctgtgtttgagtggcacattaccaagggcggaaatatcggggctaaatggaccattgacttgaagtctggatccgggaaggtgtaccaggggccagccaagggcgctgctgataccacaattatcctgtctgatgaggattttatggaggttgtgctgggaaagttagacccccagaaagcatttttttctggacggctcaaggctagaggcaatatcatgctgagtcaaaagttgcaaatgatactgaaggattatgcaaaactatag

SEQ ID NO: 226548 - DNA, 2286 bp, Artificial Sequence
  Description of Artificial Sequence: Synthetic coding sequence
atggtgattttagaagcgcctcacctccttcgcagaaaagagccagaaacaccaggcctgtcaagtcgaatcggtccaagcctgtgccctgggttttgccgcaagcggagcgtgtcctgctgttttcagaacctctgtaacaatccaatggaaaagattatcagccaatgtcggttttttgtgtccatgaacgacctggggggtgattttaagggagtggggaagggctcccttgcagcggataaggtcgtggaggagatcaggcgtcggggaggaaaagcagttgcaaattacgacagtgttgaggagggcgaaaaagtggtcaaaacagctctcgatgcctttggccgaattgacgtggtggtaaacaatgctggaatcctgagagatcgaagtttcgccagaatcagcgatgaagattgggatatcatccaccgggtgcatctgagagggtcttttcaggtgaccagagccgcttgggaacacatgaagaaacaaaaatatggaaggataattatgaccagctccgcttccggcatttatggcaatttcgggcaggcaaactacagcgcagccaaactgggattgctgggcctagctaactccttggcgatcgaaggcaggaagagcaacatccattgcaacacaatcgcccctaatgctggctcaaggatgacacagactgtgatgccagaagatttagtggaggccctgaagccggaatacgtggctcccctcgtcctctggctgtgccatgagtcctgcgaagagaatggaggactcttcgaggtgggagcaggctggattgggaagctccgctgggagcgaaccctgggggcaatagttcggcagaagaaccaccctatgacacccgaggcagtcaaggcaaactggaaaaaaatttgcgactttgagaatgcttccaaaccccagtccatacaggagagtaccggaagtattatagaagtcctatccaagatagattccgaaggaggcgtgtccgccaatcacacctctcgagccacatctaccgcgacttccggattcgctggtgccatcggccagaaacttcctccattctcatacgcatataccgaactggaggccatcatgtatgcacttggggtgggcgcatcaatcaaagaccctaaagacttgaagtttatctatgaggggagttcagacttctcctgcttacccacatttggggtgattatagggcagaaatctatgatggggggaggcctggcggagatcccgggactctcgatcaattttgccaaggtcctgcatggagagcagtatctggagctctataagccactgccccgtgcaggtaaattgaagtgcgaggctgtcgtcgctgacgtactcgacaagggctcgggggttgtgatcatcatggatgtctattcctatagtgaaaaggagctgatttgtcacaatcaattcagcctatttctggttggatccggcggattcggaggcaagcggacatcggacaaagtaaaagtggcggtagcgatccccaataggcccccagacgcagtgctcacagacaccacgagtctgaaccaagctgcattatatcgcctctcgggggattggaatccactccacatagacccaaacttcgcctcattggctgggttcgacaagcccattttgcatggactgtgcacattcggcttctctgcaagacgggtgctccagcagttcgctgacaacgatgtgtctagattcaaagcaattaaggcccgttttgctaagcctgtataccccggacagactctgcagaccgaaatgtggaaagagggtaatcgcattcacttccaaacaaaagttcaagagactggagatatcgtaattagcaatgcatacgtagaccttgctccaactagtggcacaagtgcgaaaactccatccgaggggggaaaactccagagtaccttcgtgttcgaggagatcggcaggagactgaaggatataggccctgaggtggttaaaaaagtgaatgctgttttcgagtggcatatcacaaaaggcggaaacatcggcgctaagtggactatcgaccttaaatctgggtcaggaaaggtttatcaggggcctgccaagggcgctgccgacaccacaattatcctgtccgatgaggacttcatggaggtcgtcctggggaagctggacccacagaaggccttcttcagcggaaggctgaaggcccgaggcaatattatgcttagtcagaagctgcagatgatcctgaaggattatgcaaagttatag

SEQ ID NO: 226549 - DNA, 2139 bp, Artificial Sequence
  Description of Artificial Sequence: Synthetic coding sequence
atggaaaagatcatttcccaatgcagattctttgtctcaatgaacgacttggggggtgactttaagggcgtgggtaagggaagccttgctgctgataaagtggtggaggagattcgcaggaggggaggaaaggctgttgcaaactacgacagtgtcgaggagggcgaaaaggtcgtcaagaccgcccttgacgcattcggacgcattgacgttgtggtcaataatgccggtatcctgcgtgatcggagctttgcacgtatcagcgacgaggactgggatatcatccatcgcgtccacctccgtgggtccttccaggtcacaagagcggcttgggagcacatgaagaagcaaaagtacggccgaattataatgacttcttcagcctctggcatctatggaaactttgggcaggctaattacagtgctgctaaactgggcctccttggcctagctaacagcctggcaattgaaggcaggaaaagcaacatccactgcaacaccatcgctcccaacgctggtagccgcatgacgcagacagtgatgcccgaagacttagttgaggccttaaaacccgagtatgtcgcccctctggtcctgtggctttgtcacgagtcatgcgaggaaaatggcggactgttcgaggtcggagcaggctggattgggaagctccggtgggagcgaacactcggggctattgtgagacagaagaatcatcctatgactcctgaggccgttaaggcgaattggaaaaagatctgtgacttcgaaaacgcatcaaagccccagagcattcaggagtcaactgggtcaatcatagaagtgttgtctaagatcgacagtgaaggaggcgtgtctgctaatcacacgtctcgcgctacctccacagccacgtcaggcttcgccggagccattgggcagaaactacccccttttagctatgcttacacagagttagaggcgattatgtatgcacttggggtgggtgcttcaattaaggatcctaaggacctcaagttcatttatgagggttctagcgactttagctgcttgccaacttttggcgtcattatcggacagaagtctatgatggggggtggcttagcggaaatcccaggcctgtctatcaatttcgctaaggtgctccacggcgagcagtatcttgagctctacaaaccacttcccagagccggaaaactgaaatgtgaggccgtagtggcagatgtacttgataagggatctggagtcgtgatcatcatggatgtttactcctattcagagaaggagctgatttgccacaaccagttctccctattcctggtgggctccggaggattcggtggcaagagaaccagcgataaagtgaaggtggctgtcgccatacctaatcgcccacctgatgccgtcctgacagacacgacctcactcaatcaagcggctctgtataggctgagtggcgattggaaccccctgcatattgacccaaattttgcctcactcgcgggatttgataaaccgattctccacggcctgtgcacctttggatttagcgcacgccgagtcttgcaacagtttgctgacaatgacgtttctcgatttaaggctatcaaagctcggttcgccaaacccgtgtatcccggacaaactctgcagactgaaatgtggaaggagggaaatcgcatccactttcaaactaaggttcaggagactggcgatatagtcataagcaacgcttatgtggatcttgctcccacatccgggacctcggcgaagactcccagcgagggaggaaaattgcagtccaccttcgtctttgaagaaataggccgaagactgaaggacatcgggccagaggtcgtgaagaaggtcaatgccgtattcgagtggcacatcaccaagggcggtaacatcggtgctaagtggacgatcgacctcaaatcggggtccggaaaggtataccagggcccagctaagggggctgctgataccactatcatcttatcagatgaggacttcatggaagtggtgctaggaaagctcgaccctcagaaagcctttttttccggcagactaaaggcaagaggtaatatcatgctcagccagaaactgcagatgatcttaaaggattacgccaagctgtag

SEQ ID NO: 226550 - DNA, 1800 bp, Artificial Sequence
  Description of Artificial Sequence: Synthetic coding sequence
atgaaaaaacagaagtatggcaggatcatcatgacgtctagcgcctccggcatctacggtaattttggacaagctaactatagcgccgcaaaactgggcctgcttggtttagcgaactctctcgcaatagaaggacgcaagagcaatatccattgtaacacaattgccccaaacgcgggatcacgcatgacccaaaccgtaatgccggaagatctggtggaagcattgaaacccgagtacgttgctcccctggtgttgtggctgtgtcatgagagttgcgaagagaacggcggattgtttgaagttggggcaggatggataggcaaattacgttgggaaaggacgctaggcgcaatcgtaaggcagaaaaatcatcctatgacacctgaggccgtgaaggccaactggaaaaaaatttgtgacttcgagaatgcttcaaaacctcagagcatccaggagtcaacagggagcatcatcgaggtgttgtctaaaatagattcagagggaggggtgagtgccaatcatacgagtagagcaacttccactgctacttctggttttgcaggggcaatcgggcagaagctcccaccttttagttatgcctatacagaattggaggcaattatgtacgcactgggtgtcggcgcttccattaaagacccgaaagacttgaagttcatctatgagggcagctctgatttctcttgtcttcccacatttggtgtgattatcggccaaaaatctatgatgggcggtgggctggccgagatccctggccttagtatcaattttgcgaaggtgctgcacggggaacaataccttgagctttacaaaccactccctcgcgctggaaaattgaagtgcgaagccgtggttgcagacgtgttggacaaaggctcgggagtggtcatcataatggatgtgtactcatactctgaaaaagagctcatttgccacaaccagtttagcttatttctagttggtagtgggggatttgggggaaagagaacctctgataaggtaaaagttgctgtcgctattcccaaccggccacccgacgccgtgttgaccgacactaccagtttgaatcaagctgcactataccggctaagcggagactggaatcctttgcacatcgaccctaattttgccagcctggcaggttttgacaaacctatactgcatggcctttgcacctttgggttttcagcacggagagtcctgcagcagttcgccgataatgatgtgagtagattcaaggctatcaaagcacgtttcgccaagcctgtctatcctggtcaaaccctccagaccgagatgtggaaggaaggaaatcggatccacttccaaacgaaagtccaggagactggcgacatcgttatttccaatgcttacgtggatctagccccaactagcggcacgtctgccaaaacaccttctgaaggaggtaagttgcagtctacattcgtatttgaggaaatcgggaggcgccttaaggacatcggacccgaggtcgtaaagaaagtcaacgctgtgttcgaatggcacattacaaagggcggtaatatcggagcaaaatggaccattgacctgaagagtggctccggcaaagtgtaccaaggcccagccaaaggagcagccgataccacaataatcctgagcgacgaagactttatggaggttgttctgggcaagcttgatccacagaaggcttttttttctgggaggctcaaagcccgaggcaacatcatgctctcacaaaaactgcaaatgatccttaaagattacgctaaactctag

SEQ ID NO: 226551 - DNA, 2157 bp, Artificial Sequence
  Description of Artificial Sequence: Synthetic coding sequence
atgggatccccactgcgtttcgacgggagagtagtgcttgtgacaggagctggagccgttaatgacctggggggtgatttcaaaggcgtcggcaaaggcagcctggctgccgataaagtggtagaggagattcggcgaagaggaggtaaagctgtggctaactacgacagtgtggaggagggcgaaaaagtcgtcaaaacagcgttagatgcatttggaagaattgacgtagttgttaacaacgccggtatcctcagggaccgatccttcgcacggatctccgacgaggattgggatataatacacagagtgcacctgcgcggttcatttcaggtcactcgcgctgcttgggaacacatgaagaagcagaagtatggcaggatcatcatgacatcctccgcctcggggatctatgggaacttcgggcaggccaactactcagccgctaaactggggctgctcggtttggcgaacagcttggccatagaaggcaggaagagcaacatacattgtaacaccattgcaccaaatgctggaagccgtatgacacagacagtgatgcccgaggatctcgtagaggcccttaaaccagagtatgttgcaccccttgtgctgtggctgtgccacgaaagttgtgaggagaacggcggactcttcgaggtgggcgctgggtggattgggaaactcaggtgggaaagaaccctgggagccatcgtccgtcaaaagaaccatccaatgactccggaggctgtcaaagcaaattggaaaaagatttgtgattttgagaacgctagtaagccacaatcaatccaggaatctactggctctataattgaggtgttgtccaaaattgactccgagggcggagtgagcgccaaccacacctcaagagccacttccacagcaacgtcgggtttcgccggtgcaattggtcaaaagttgccgcctttctcgtacgcatatacagagcttgaggcaatcatgtacgcacttggcgtgggtgcctctatcaaagatcctaaagatctgaagtttatttatgagggaagctctgacttctcctgccttcccaccttcggggtcattatcggacagaaaagcatgatggggggaggtctagccgagattcctgggctgtccatcaacttcgccaaagtgctccatggagagcaatatcttgagctctataagcctttgcccagggccggaaaactgaaatgtgaagctgtagtggccgatgttcttgacaagggcagtggagtggtgatcataatggatgtgtacagttacagtgaaaaagagctgatatgtcacaatcaattctcactgttcctggtagggtctggaggctttggcggtaagaggaccagtgacaaggtgaaagtagctgtggcaataccgaaccggccaccagatgcagtcctgacggacacaacctctttgaatcaggctgcactctatcgccttagtggcgattggaaccctctgcacatcgatccaaatttcgcctcactcgctggttttgataaaccgattcttcatgggctctgcacatttggcttttccgcacggagggtcctgcagcagttcgctgacaacgacgtctcgcgatttaaagcgatcaaggccagattcgcaaagcccgtgtaccctggtcagaccctgcaaactgaaatgtggaaggaggggaaccggatccattttcagactaaagtgcaagaaactggggacatcgtcatcagcaacgcgtacgtggaccttgcccctacctccgggaccagcgctaaaacaccgtctgaaggaggtaagctccagtctacctttgtgtttgaggaaataggacgtcgcctcaaagacattgggccagaggtcgtcaaaaaagtgaacgctgtattcgaatggcacattaccaagggtggcaatattggagctaagtggaccattgatttaaaaagcggctctggtaaggtatatcagggcccagctaaaggggcagccgatactacgattatcctgtcagatgaagacttcatggaggtggtgctggggaagctggatccacagaaggcctttttcagcggcagattaaaagcccgagggaacatcatgctcagccagaaactccaaatgatcctgaaggactacgccaagctgtag

SEQ ID NO: 226552 - DNA, 1026 bp, Artificial Sequence
  Description of Artificial Sequence: Synthetic coding sequence
atgcgcaaagtagttctaattacaggcgcttcctctggaatcggtctggcactgtgcaagaggctgcttgccgaagatgacgagttgcatttatgccttgcttgccgcaacatgtcaaaagctgaagctgtgtgtgcagcactgctcgcttcgcacccaaccgccgaggtgactatcgtgcaggttgacgtgtccaaccttcagtctgtgttccgcgcttctaaggagcttaaacagagattccagagactagactgcatctacctgaatgctgggattatgccaaacccacagttgaatatcaaggcactcttttttggcttgttttctagaaaagtgatccacatgttctccaccgcagaagggctcttgacccaaggagataagattaccgctgacggtctccaggaggtattcgagaccaacgtgttcgggcactttattctcatccgggagctggaacctctcttatgccacagcgacaacccttcacagctgatctggacatcctctcgcagtgccagaaagagcaatttttctctcgaagacttccagcattctaagggtaaagagccctattcatcttccaaatacgcaacagacctgctctccgttgccctgaatcggaacttcaatcaacagggtctttattccaacgtagcttgccccggaaccgcactcacaaacttgacctatggaatcctcccacccttcatctggactttgctcatgcccgcaatcctgctcctgcgtttttttgccaatgcgtttacactgacgccctataacggcacagaggcgctcgtctggttgttccatcaaaagcccgaaagtctgaatccgctgataaaatatctctctgcaactaccgggtttggaaggaattacattatgacccagaagatggacctagatgaagacactgccgagaagttctatcagaagctgcttgaattggagaaacatatcagggttaccatccagaaaaccgacaaccaggcccgattaagcggctcctgtttgtag

SEQ ID NO: 226553 - DNA, 336 bp, Artificial Sequence
  Description of Artificial Sequence: Synthetic coding sequence
atgcgcaaggtggtgttaatcactggtgcttccagcggcataggcctggccctgtgcaaacgtctgcttgcagaggacgacgagctacacctgtgtctggcttgccgcaatatgagtaaggccgaggccgtctgtgctgcactgctagccagtcatcccactgcggaagttacaattgtgcaggttgacgtaagtaatctgcaatcagtgttcagggcgtcgaaggagttgaaacagagatttcaacgattggactgcatctacctgaatgcgggaatcatgccaaacccccagctgaatattaaagccctctttttcggcctgttctcaagctag

SEQ ID NO: 226554 - DNA, 255 bp, Artificial Sequence
  Description of Artificial Sequence: Synthetic coding sequence
atgaggaaggtggtcctgatcacaggtgcctcttccggaattggactagcactgtgtaagcgcctcctggcagaagacgacgagcttcatttatgcttagcctgtaggaatatgtctaaggccgaagccgtatgcgcagccctgctggcttctcacccaaccgcagaagtgactatcgttcaggtcgatgtgtccaacctgcagagcgttttcagggccagtaaagagctgaagcagaggtacattagctgctag

SEQ ID NO: 226555 - DNA, 921 bp, Artificial Sequence
  Description of Artificial Sequence: Synthetic coding sequence
atgagaaaggtagtacttataacaggggcttctagcggaatcggcctggcgttgtgtaaacgcttgctcgcagaggacgacgagctgcacctgtgtctggcatgccgaaacatgagcaaggcggaagccgtatgtgccgcactgctagcaagtcaccccaccgctgaagtgacgatcgtacaggtagatgtctcaaatctacaatcagtgttccgcgcttcaaaggaactcaaacagcggtttcaacgcctggactgcatttacctcaatgcgggaattatgcctaatccacaacttaatataaaggccctgtttttcgggctcttctcccgaaaggtgatccacatgttcagcaccgccgaaggcctcctgacccagggtgataagattaccgcggacggcctccaggaggtctttgaaacgaacgtttttggccatttcattttgatcagggaactggagcccctgctgtgtcacagtgacaacccaagccagctgatctggacctcctctcggagtgcaaggaagagtaatttctccctcgaagacttccagcattctaaaggaaaggagccctatagctcctctaaatacgctactgatctgttaagcgtggctctcaacagaaattttaaccagcagctccggtttttcgctaacgcgttcacacttacaccgtataatggcacggaggccctggtatggttatttcaccagaagccagagagcctcaatccactcattaaatacctgagtgctacaaccggctttgggaggaattacattatgacacagaagatggaccttgatgaagatactgctgaaaagttttatcagaaactgctagagctggaaaagcacattagagtgactatccagaagactgacaatcaagctcgattgtccggctcgtgcctgtag

SEQ ID NO: 226556 - DNA, 360 bp, Artificial Sequence
  Description of Artificial Sequence: Synthetic coding sequence
gtcgttattagggagttagagcctctcttatgtcatagtgataaccccagtcagcttatatggacctctagtagaagcgccagaaagagtaatttcagcctagaggattttcagcactcaaagggtaaggaaccatactctagctctaagtatgcaactgacctgctgagtgtggccctcaatcgaaactttaatcaacagttacggtttttcgcgaatgcttttacacttacaccatacaatggaactgaggcgttggtttggctgtttcatcaaaaacctgagtcgctgaatccactgatcaagtacttgagcgccacaacaggcttcggtaggaactatattatgacccagaaatag

SEQ ID NO: 226557 - DNA, 966 bp, Artificial Sequence
  Description of Artificial Sequence: Synthetic coding sequence
atggaacggaaaaatcagacagctataaccgagttcattatccttggattcagcaatctcaatgagtggcaattcttactgttcaccatattctttctcacctacttttgcaccctcggcggaaacattctcatcatcttgacaaccgttactgacccacatttgcatacccccatgtattatttcctggggaacctggcatttattgatatatgctataccacctctaacgtgccacagatgatggtacacttgctgtccaaaaagaagagcatcagttacgtcggctgtgttgtgcagctgtttgcgtttgtgttttttgtcggctccgagtgcctcctgttggcagccatggcctacgaccgttatatcgctatctgtaatccgctccgctactccgtcattctgtctaaggtcctgtgcaaccagctggcagccagctgttgggctgccggttttctaaatagtgtggtgcacaccgttcttaccttctgtctacccttttgcggcaataaccagatcaattattttttctgtgacatcccgcctctcctgattctaagctgcggtaacacttctgtgaatgagctcgccttgttgtcaacaggcgtgtttattggatggacacccttcctttgtatcgtgctaagctatatctgcatcatttcgaccattctcaggattcagtcatcggagggcaggcggaaggcttttagcacctgtgctagccacctggcaattgtgtttctgttttatgggtccgcaatctttacctatgtgaggcctattagtacctatagcctgaagaaggacaggctggtgagcgtcctctattcagttgtgacacccatgctgaatcccatcatctacacgctccgtaataaggatatcaaggaggccgtgaagaccatcggaagcaagtggcagcctccaatctccagtctcgatagcaaactaacttactag

SEQ ID NO: 226558 - DNA, 786 bp, Artificial Sequence
  Description of Artificial Sequence: Synthetic coding sequence
atggccagccaactgcagaacagattgcgcagcgctttggcattagtcacgggggcagggtcgggaataggacgcgctgtcagcgttagattagctggggaaggagctaccgtcgcagcctgtgatcttgatagggcagctgctcaagagaccgtgaggctcctgggtggtcccggaagcaaagaaggacccccacgaggcaaccacgcagcttttcaggccgatgtctctgaggcccgagccgctagatgcctgctggagcaggtgcaagcctgcttcagccggcctccaagtgtggtggtgagctgtgctgggatcacacaagacgaatttctgctgcatatgagcgaggacgattgggataaggtgatcgccgttaacttgaagggcacctttcttgtgacgcaggccgctgcccaggccttggtttccaacggctgtaggggttctataatcaatattagcagcatagtcggcaaggtcgggaacgtaggccagacaaactatgctgcctccaaagctggtgtgatcggcttgacccagaccgcagctcgggagcttgggcgtcacggaattcggtgcaatagcgtcctccccggtttcatcgcaactccgatgactcagaaagttccacagaaggtagtggacaagataaccgaaatgatccctatggggcatctgggggaccctgaagatgttgctgacgtcgtggcctttttagcaagcgaagattccggatacatcacaggaacaagcgtagaggttacaggcggattgttcatgtag

SEQ ID NO: 226559 - DNA, 786 bp, Artificial Sequence
  Description of Artificial Sequence: Synthetic coding sequence
atggcatctcaattacagaataggcttcgctctgccttggccttggttaccggagcaggatctggcatcgggagagccgtttcagttaggcttgcgggtgagggagctactgtcgccgcatgcgatctggaccgagccgctgcccaggaaaccgtcaggctcctaggtgggccagggtccaaggaggggccaccaagaggtaatcatgccgcttttcaggcagacgtttcagaggcccgtgcggcaaggtgtcttttagaacaggtgcaggcctgtttttcccgacctccatcggtggtggtctcttgcgcgggtatcactcaggatgaatttctgctgcatatgagtgaagacgattgggacaaagtcattgccgtgaacctgaagggcaccttccttgtgactcaggcagccgcacaggcactcgtctcaaatggatgccggggaagcattataaatatttcaagcattgtggggaaggtgggcaacgtaggccagacgaattacgccgcaagcaaagctggcgtgatcggcctcacccagactgccgctcgggagctgggcaggcatggtatccggtgcaattccgtactgcctggcttcattgccacccctatgacccaaaaagtgccacaaaaggttgttgataaaattaccgaaatgatcccaatgggacatttgggcgacccagaagacgtggctgacgtggtggcctttttagcctcggaggactccggttacatcaccggaaccagtgtcgaggtcactggtggattgttcatgtag

SEQ ID NO: 226560 - DNA, 786 bp, Artificial Sequence
  Description of Artificial Sequence: Synthetic coding sequence
atggcgagtcagctgcaaaaccgccttaggagtgccctggcattggttacaggagccggaagtggaattgggcgtgcagtttccgtccgcctggccggagaaggtgccactgttgctgcctgcgacctcgatagagcagctgcacaggagacggtccggttgctcggcggtcccggttctaaagagggcccacctcggggaaaccatgccgctttccaggcagacgtgtcggaagcacgggctgcccgatgccttctggagcaagtacaggcatgctttagtcggccaccctccgtggtggtaagctgtgcgggtattacacaggacgagtttctcctgcatatgagcgaggacgactgggacaaagtcatcgccgtcaatctaaagggcacttttttagttacgcaggccgcagcccaggctctggtgtctaacggctgtaggggttccattatcaacattagctctatcgtaggcaaggtgggcaacgtcgggcagaccaattacgccgcttccaaggcaggtgtcattggcctcacgcagacagcagctcgtgagctcggtcgccatgggatccgatgcaacagcgttctacccggattcattgccacaccaatgacccaaaaagtgcctcagaaggtagtggacaaaattacagaaatgatccctatgggtcacttgggggatccagaggacgtggcggatgtcgttgccttcctcgcctcagaggactccggatacataactggtaccagcgtggaggtgaccggcggactctttatgtag

SEQ ID NO: 226561 - DNA, 786 bp, Artificial Sequence
  Description of Artificial Sequence: Synthetic coding sequence
atggcctcacagctgcagaatcgcctaaggagcgctctcgccttggtcaccggagcaggcagcgggatcggtagagctgtgtccgtgcggctcgccggtgagggcgctacagtggccgcttgtgacctagacagggccgcagctcaggagaccgtgcgcttattaggaggtccaggttctaaggagggacctcctaggggtaatcatgctgcctttcaggccgacgtttctgaggctcgggctgccagatgcctacttgagcaagtgcaggcttgtttctcgagaccgcctagtgtcgtagtgagctgcgccggaattacccaggatgagtttctgttgcatatgtcagaagacgactgggacaaggtgattgctgtgaatctgaagggtacttttctggtgacgcaggccgctgcccaagccctggtgtctaacgggtgcagaggcagcattataaacatctcttctatcgtcggcaaagtcggaaacgttgggcagactaattatgctgcttccaaggccggagttatcggcctgacccagactgctgcaagagaactgggcaggcacgggatccgctgcaatagcgtcctacccggattcatagcaactccgatgacacagaaagtgccccagaaggtcgttgacaagataaccgaaatgattccgatgggccatctgggcgatcccgaagatgtggccgacgttgtcgcatttctggcctcagaagatagcggatatatcaccggcacgagcgtggaagttaccggtggtcttttcatgtag

SEQ ID NO: 226562 - DNA, 786 bp, Artificial Sequence
  Description of Artificial Sequence: Synthetic coding sequence
atggccagtcaacttcaaaaccggcttcgatccgctctcgcccttgtgacaggagcaggttcaggcattggtcgggcagtaagtgtgagattggccggagaaggtgccaccgtggccgcttgcgatcttgatagagcggctgcacaagagacggtccgactcctcggaggtccaggttccaaggagggtccccctcgtggaaatcatgctgcgtttcaggcagatgtttccgaggctagagccgctaggtgtttactggagcaagttcaggcatgcttcagtaggcccccatctgtggttgtaagttgtgctggcatcacacaagacgagttcctgttacacatgtccgaagacgattgggacaaggtgattgccgtcaacttgaaggggacattcctagttacacaagctgccgcacaggccctggtctctaatggctgcaggggttctattatcaacatcagctccatcgttggaaaggttggcaatgtaggccagacaaactatgccgctagcaaggcgggtgtgattggtctgacccagacagcggcaagggagctgggacggcacggcatccgctgcaatagtgtactcccagggttcattgcaactcctatgacacagaaggtcccccaaaaagtcgtggacaagattaccgagatgatcccaatgggccaccttggggaccccgaagatgtcgccgacgtcgtcgcctttctcgccagtgaagattcaggttacatcacgggaacctccgtggaagtgacaggcggactttttatgtag

SEQ ID NO: 226563 - DNA, 1848 bp, Artificial Sequence
  Description of Artificial Sequence: Synthetic coding sequence
atggtgtcaggtccactagcacttcggtggtgtgcctgggcaggcaggggcgatatggggccagatatggagctgcctagccacagcaagcagcttctcctgcaactgaatcagcaaagaacgaaaggtttcctctgtgatgtaattattatggttgaaaatagcatttttcgggcacacaaaaacgtgctggcggcatcatcaatctactttaagtcattggtgctgcatgacaacctgatcaatctggatacagacatggtgtcttcaaccgtcttccagcaaatattggattttatctatacgggtaagctgctcccttccgatcagcctgctgagcccaatttctccacactgttgacagctgcaagttaccttcagctccccgagcttgcagccctgtgtcgaaggaaactcaagcgcgcagggaaaccttttggctctggaagagccggatcaaccggaatgggcaggccccctcggagccaaagactgtcgactgccagcgtgattcaggccaggtaccagggccttgtggatgggcgtaagggcgcacatgccccacaggaactcccccaggctaaagggtccgatgacgagctctttctcgggggtagcaaccaggatagcgtgcaaggccttgggagagccgtctgccctgctgggggagaagctggattgggagggtgcagcagctctactaatgggtcctctgggggatgcgagcaggaactgggactggacctctctaaaaagtccccaccactgcctccagcaaccccagggcctcacttgacacctgacgatgctgcccagctgagcgattctcagcatggatcgccacccgcagctagcgcgccacctgtcgccaatagcgcaagctacagcgagctgggcggtaccccagacgagcccatggatcttgagggggcagaggacaatcatctgagcctcctggaagcgcctggtggtcagcccagaaaatccctccgccacagcacccgcaaaaaagagtgggggaagaaagaacctgtcgccggaagcccattcgagagacgcgaagccggacccaagggaccatgtcctggagaggaaggagaaggagttggagatcgggtgcccaacggaatcctggctagcggcgctggcccatcaggcccttacggcgaacccccttatccctgtaaggaagaggaggagaacgggaaggacgccagcgaggacagcgcccagtcagggagcgagggcggtagtggccatgcctccgcacattacatgtaccggcaggaggggtacgaaacagtatcttatggggataatctgtacgtgtgcatcccatgtgcaaaaggcttcccctcgtcagagcaattaaatgctcatgtggaaacccacactgaggaggagctgttcatcaaggaggaaggagcttatgagaccggctcagggggagcagaagaggaggccgaggacctctcagctcctagcgctgcttacacagctgaacccaggcccttcaagtgtagcgtttgcgaaaagacctacaaagaccctgcgacgctccggcagcacgaaaaaacccactggctgactcggccattcccgtgcaatatttgcggaaagatgttcacgcagagaggcacgatgaccagacacatgaggagccatttgggcttaaaacccttcgcatgtgatgagtgcggtatgaggttcaccagacagtaccgacttaccgaacatatgcgggtccatagcggggagaagccctatgagtgccagctttgtggcggtaagtttacccagcagcgaaatcttatatcacatctgaggatgcacacctctccttcttag

SEQ ID NO: 226564 - DNA, 1848 bp, Artificial Sequence
  Description of Artificial Sequence: Synthetic coding sequence
atggtatccggtcccctcgctttgcggtggtgtgcctgggccggaagaggtgacatgggaccagacatggagctgcctagccactctaagcagctgctgcttcagttgaatcagcagcggaccaaggggtttctttgtgacgtcatcatcatggttgagaactccatcttcagggcccataagaacgtgcttgccgcttcttccatttacttcaaatccctcgtgttgcatgacaatttgattaaccttgacaccgatatggtgagcagcacagtcttccagcagatcctggatttcatctataccggcaagcttctcccaagtgaccagccagccgagccaaatttctctactctgttaacagccgcttcttacctgcagctaccagagctcgctgcactgtgcaggcggaaactgaagcgagccggaaagcccttcggaagcggaagagccggaagtactgggatggggcgacctcccaggtcccagaggctaagcaccgcgagcgtcatccaggctaggtatcagggtctggttgatgggagaaagggagctcatgcccctcaggaactgcctcaggcaaaaggctcagacgacgaactttttctgggcggtagcaatcaggacagcgtgcaaggtctgggacgcgctgtgtgtcctgctgggggagaggccggactgggaggctgcagctcttcaaccaacgggagctctggagggtgtgaacaggagttggggctcgatctgtcaaagaaatcacctcccctgccacctgctactccaggtccccacttgaccccagacgatgccgctcaactcagcgatagtcagcatggatcccccccagccgcttcagcccctccagttgctaatagcgcttcttatagcgaactgggtggcacaccagatgagcctatggatcttgaaggggcagaagacaaccacctctctcttcttgaggccccaggcggtcagccacgtaagagtttgcgtcattccacaaggaagaaggagtggggcaagaaagaaccggttgccggttccccttttgagcgcagagaggcaggccctaagggcccatgcccaggggaggagggagaaggggtaggtgaccgcgtccctaatggaatcttagcgagcggggctggacctagcggtccttatggggagcctccctacccctgcaaagaagaggaggagaatggcaaggacgcttcagaggatagtgctcagagtggcagtgaggggggatctgggcatgcaagcgcccactacatgtataggcaggagggctatgagaccgtcagctacggggacaatctttatgtctgcatcccctgtgcgaaaggcttcccgtcatctgaacagttgaatgcacacgtggagacccatacagaagaagagctgttcatcaaggaagagggagcctatgagaccgggagcggtggcgctgaggaggaggctgaggatctgtccgccccttccgccgcatacactgcagagcctaggcccttcaagtgttcagtttgtgaaaagacatacaaggatcctgcgactctgagacaacacgaaaagacgcattggttaacccggcctttcccctgcaacatttgtgggaaaatgttcacccaacgtgggacaatgactcggcacatgcgcagccacctggggctgaagccctttgcttgcgatgaatgcggtatgcggtttaccaggcagtaccggcttacagaacacatgagggtccactccggggagaagccctatgagtgccagctctgcggtggtaaattcacccaacagcggaatctaatttcccacttgcgaatgcacactagcccgtcttag

SEQ ID NO: 226565 - DNA, 1848 bp, Artificial Sequence
  Description of Artificial Sequence: Synthetic coding sequence
atggtgagtggcccattggccctgagatggtgtgcatgggccggtaggggcgacatgggacctgacatggagctcccctcccacagcaagcagctgcttctccagctgaatcagcagcggacaaaggggttcctttgtgatgttatcatcatggtcgaaaatagcattttccgtgcccataaaaatgtgctggcagcttctagcatctattttaaatccctcgtgctgcacgacaacttgatcaacctggacactgatatggtctcatcaactgtgtttcagcagatactggactttatctataccggaaaactcctgccttcagaccagcctgccgagcccaacttctcaacccttctcactgctgcatcttacctccagcttcctgagctcgctgctttatgcagaaggaagctaaagagagcgggtaaaccatttggcagcggcagagccggtagcaccgggatgggtcgccctcccaggtcccagcggctctccaccgcttctgtgatacaggctcgataccaaggcttagtcgacgggaggaagggggctcatgctccacaggagctgccccaggctaaagggagtgatgatgagctgttccttgggggatcaaatcaagacagcgtccagggcttagggagggctgtatgtccagccggaggtgaagccggtctgggcggatgttcttccagtaccaacggtagctcagggggatgtgagcaggaattagggctggatctgagtaagaagtcccctccactgcccccagctactcccggacctcacctgacccctgatgacgccgctcagctgtcagattcccagcatgggtcccctcctgctgcctctgctccccctgttgctaattccgcttcttacagcgaactggggggaacacccgatgaaccaatggatctggaaggggcagaagataaccatctttcactcctcgaggctccaggaggtcagcctagaaagtctctccgccatagtactaggaagaaagaatggggcaagaaggagccggtggccggatcgccctttgagagacgcgaagcaggcccaaaagggccatgcccgggagaggaaggggagggggttggcgatcgcgttcctaacgggatcctggcctcaggtgctgggccttccggcccatatggagagccaccctatccttgtaaagaggaggaggagaatggcaaggatgcctcagaggactcggcccagtcaggtagcgaggggggttcagggcatgcgtcagcacactacatgtatcggcaggaggggtacgagactgtatcttacggagacaatttgtacgtctgcattccctgtgctaaagggttcccctcctctgagcagctgaacgcccacgtggaaacacacacagaagaagagctgtttattaaagaagagggtgcttacgagacaggctcaggcggtgcagaagaggaggctgaagatctctctgcccctagcgctgcctacaccgccgagccacgaccttttaagtgcagcgtctgtgagaaaacatataaggacccggctactctccggcagcatgagaagactcactggctcacaagaccttttccatgcaatatctgcgggaaaatgttcacccagaggggaaccatgaccagacacatgagaagtcaccttggcttaaagcccttcgcatgtgatgagtgtggcatgagatttacaagacagtaccggctgacagagcacatgagggtccactccggagagaaaccatacgaatgtcaattatgcggagggaaatttacacaacagcgcaatctaattagccacctcagaatgcacacatcacccagctag

SEQ ID NO: 226566 - DNA, 2670 bp, Artificial Sequence
  Description of Artificial Sequence: Synthetic coding sequence
atggacgcccgaggaggcggaggaagacctggtgagtccccaggcgctaccccggcacccggtccaccaccaccacctccaccagctcccccacagcagcagcctccccctccacctcctcccgcacccccacccggtccgggtcctgccccaccacagcaccctccaagagcagaggctcttcctccggaggccgctgatgagggtggccctaggggcagactgaggagcagggacagttcatgcggcagaccgggaactcccggtgcggcaagcacagccaaagggtcacccaacggggagtgcggcagaggagagccacaatgctcacctgccggtcctgaaggacccgctagaggtcctaaagtgtccttctcttgtagaggggctgctagcgggccagcacccggtcctggaccagcggaagaggcgggaagcgaagaggccggacccgcaggcgagcccaggggcagtcaagctagcttcatgcaacgtcagtttggcgctctacttcaaccgggtgtcaataagtttagtcttagaatgtttgggtcgcagaaggctgtagaaagagaacaggaacgagtgaagtcagcgggtgcatggatcattcatccctacagcgatttccgcttttattgggacttcacgatgttactgttcatggtgggtaacctgattattatcccagttggcatcactttcttcaaggacgaaaccacggccccttggatcgtctttaacgtggtcagcgacacctttttcctaatggacctcgtactgaacttccggacaggcatcgtgattgaggacaacacagagatcattctagatcctgaaaagatcaaaaagaaatacctcaggacatggtttgtcgtggactttgtttcttcaatccctgtcgattacatctttctgattgtggaaaaaggtatagatagtgaagtctacaaaaccgcaagggccctgagaatcgtccggttcactaaaatcctgtcgctgctcagactgttgcgcctgtctagattgatacgctacatccatcagtgggaagagatctttcatatgacctatgatctggcgtctgccgtcatgcgaatttgtaacctgatctccatgatgctgctcctctgtcactgggacggatgtctgcagttcctggtgcctatgctgcaagactttccccgtaattgttgggtcagcatcaacggaatggtgaaccatagctggtcagagctgtacagttttgcccttttcaaggctatgtcccacatgctgtgtatcggatacggacggcaggctcccgaatcaatgactgacatctggttaaccatgctctcaatgattgttggagctacctgttacgcgatgtttattggacacgcgaccgcactcatccaaagccttgacagctcccgacgacagtaccaagagaagtacaagcaagtggagcagtacatgagtttccataaactgcccgctgactttcgccagaagatccatgattattacgaacatcgctaccagggaaaaatgtttgatgaggactccattctcggcgagctgaacgggccactgcgagaagagattgtcaactttaattgtcggaaactggtagcaagcatgcctctgttcgcaaacgctgatcccaatttcgtcaccgccatgctgacaaagcttaagttcgaggttttccagccgggtgactacattatccgcgagggaacaatcggcaagaagatgtactttatccagcacggagtcgtgagcgtgctgaccaagggaaacaaggagatgaaattgtcagacggaagctatttcggcgagatttgtctattaacccggggacggaggacagctagtgtgagagccgatacttactgtcgtctctactctctgagcgtggacaacttcaatgaggttttggaggagtacccaatgatgcgacgtgcctttgagacggtagcgatcgatcggctcgacaggatcggcaagaagaattccatcctgctgcacaaagtgcagcatgacctgaattctggggttttcaacaaccaagagaacgcaatcatccaggagatcgtcaagtacgatcgcgagatggtccagcaagctgagctcggtcaacgggtggggctctttccacctcctccccctcctccccaagtgacttccgccattgctacgctccagcaggcagccgctatgtccttttgtccccaggtggcccgtcccctcgttgggcctttagccttgggcagccctcgactcgtaagacgaccaccccctgggcctgctcctgcggcagcatctcccggacctccccctccggcttcgccacccggagcccctgccagccctagggcaccaagaactagcccctacggcggtctgccggctgccccactcgcagggccagctcttcctgccaggcgcctgtcacgggctagtcgtccattaagcgccagccagccttcactgccacatggcgctccgggaccagccgcaagcacacgccctgcttccagctcaacaccacgactcggaccaacccccgcagcacgagccgctgctccctctcccgatagacgtgattcagcatcaccaggcgctgcagggggactggatccccaagattctgcccgttcacgcctcagcagcaatctgtag

SEQ ID NO: 226567 - DNA, 2325 bp, Artificial Sequence
  Description of Artificial Sequence: Synthetic coding sequence
atggaagcagagcaacggccagcagctggagcttcggagggagccaccccgggtttggaggccgttcctccagtcgccccaccacccgctactgccgcatcgggccctattccaaaatctgggccagaacccaaacgcagacacttggggactctgctacagcctactgttaataagttttcgctgcgggtgttcggcagccataaggcggtggagattgagcaggagcgcgtaaagtctgctggggcttggatcatccacccgtattccgattttcgtttctactgggatctgatcatgctgctcctgatggtcggaaatcttattgttttgcccgtcgggataacctttttcaaagaagaaaactcccccccttggatcgtcttcaatgtacttagcgataccttctttctcctcgaccttgtgttaaatttccgcactggaatcgtagtggaggagggcgcagagattctcctggccccacgagccattagaaccagatacttgaggacttggtttctcgtggacctcatttcatctatccccgtagactatattttcctcgtggtcgagctggaacctcggctggatgcggaggtttataaaaccgccagggccctgcgcatcgtacggttcactaagatcttgtctctgctgaggctgctaagactctcaagactcattcggtacatccatcaatgggaggagatatttcatatgacatacgatctcgcttcagcagtggtcaggatcttcaatctgatcgggatgatgcttttattgtgccactgggatggctgcttgcagttcctggtacctatgttgcaagatttcccgcctgactgttgggtgagcatcaatcatatggtcaatcactcttgggggagacagtacagtcatgctctatttaaagccatgtcgcacatgctttgcattgggtacggacagcaggccccagtgggtatgccagatgtctggcttaccatgctgtctatgattgtgggcgcaacatgctacgccatgtttattggacatgcaactgccttgattcagtcactcgacagttctaggcggcagtaccaggaaaagtacaagcaagttgagcagtacatgtctttccacaaattaccagcagacactaggcagaggatacacgaatactacgaacaccgataccaaggaaagatgttcgatgaagaatcaattttaggagagctctcggaaccgctacgagaggaaatcattaatttcacctgccgcggtctggtggcccatatgcctctattcgcgcacgctgatcctagctttgtgaccgcagtgctgacaaaactccggttcgaggtgtttcagcctggcgatttggtggtgcgggaagggagtgttggcaggaaaatgtactttattcagcacggcctgcttagcgtccttgccagaggcgcacgggacacccggttgaccgacggatcttacttcggagagatctgtctgctcactcggggacggaggacagcatccgtcagggctgacacttactgtagattgtatagtctgagtgtggaccatttcaacgcagtgctggaggaattccccatgatgcggagagcctttgagacggtggctatggacagactgctgcgcataggtaaaaagaactctatcctgcagagaaagcgatctgaacctagcccagggtcctcagggggaattatggaacagcatctggtgcagcacgatcgcgacatggctaggggcgtcaggggacgggctcctagcaccggcgctcaactgagcggcaaaccagtgctctgggagcctttggttcatgcaccgttgcaggctgctgccgtcactagcaacgtagcaattgccctaactcatcagcggggtcccctcccgctttcaccagacagcccagctacactcttagccaggagcgcctggagaagcgcaggttctccagcctctccactggtccccgtgcgagccggaccatgggcaagcaccagtcgtcttccagcccctcctgcgcgaacccttcacgcatccctgagtagagctgggcgatcccaagtgtccttgctgggcccacctcccggtgggggaggacggaggctaggccctcgcggacgtcccctttccgcctcccaaccatctctgccgcagcgagccacaggcgacgggtcgccgggacgtaaagggtcagggtccgagagactgcctccaagtgggctgcttgccaagccacctaggacagcccagccccctagacctcctgttccggaacctgctactccccgaggtctgcaactgagtgctaatatgtag

SEQ ID NO: 226568 - DNA, 3612 bp, Artificial Sequence
  Description of Artificial Sequence: Synthetic coding sequence
atggataaactgccaccctctatgcgcaagcgcctctatagtttgccccagcaagtgggagccaaagcatggataatggatgaagaggaagatgcggaagaggaaggcgctggcggaagacaggatccttcccggcgttcaatcagactgagacctctgccaagtccctctccttccgccgcagcaggcggtacagagtccagatcttccgctctgggcgctgctgactcggagggtccagccagaggtgctggcaagtcaagcacaaatggcgactgtcgtaggttccggggtagtctcgctagtctgggctccaggggagggggttcaggtgggacaggcagcggctccagccacggacatcttcacgatagcgcagaggaacgcagattgatcgccgaaggcgatgcctctcctggtgaagataggactccacctggtctagccgctgaaccagagcgtccaggcgctagcgcacagcctgcagcttcaccacctccgccacagcagcctccccaaccagccagtgcctcctgcgaacaaccctcagtggacaccgccatcaaggtggaagggggagctgccgcaggggatcagattttacctgaggccgaagtaagacttggacaggctggttttatgcaaaggcagtttggggctatgctgcaacccggtgtcaataaattttcccttcgcatgttcggatcccaaaaggccgtggagcgcgaacaggagcgcgtaaaatctgcaggtttctggattattcacccctacagtgattttcgcttttattgggacctcactatgctacttctgatggtcggcaacctcatcatcattccagtgggtatcacattcttcaaggatgagaacacaactccatggattgtctttaatgtggtgagcgacaccttctttctcattgacctcgttctaaattttcggaccggcatcgtagtagaggacaataccgagatcattctggacccccagcggatcaagatgaagtatctcaaatcgtggttcatggtggacttcatttcgagcatccctgttgactacatatttttgatcgtcgagacccgcattgattcagaagtgtataagactgctcgcgcactgagaatagtgagatttaccaagattctttctctcttgcgcttgttaagactgtcgagattaattcggtatattcaccagtgggaagagatcttccatatgacctatgatctggccagcgcagtcgtaaggatagtgaacctgatcgggatgatgctgctcctgtgccactgggacggttgtttgcagttcctcgtgcccatgctccaagatttccccgacgattgctgggtatctatcaacaatatggtgaacaattcctggggtaagcagtacagctacgctctcttcaaggccatgagtcacatgttgtgcattggctatggacgccaagcccctgtgggtatgtcagatgtctggcttacgatgctgtcaatgatcgttggagctacttgttacgccatgttcataggtcatgcaaccgccctgatacagtcacttgattcctctcgtagacaatatcaagaaaaatacaaacaggttgagcaatacatgagttttcacaaactcccacccgatactcgacagagaatccacgactattacgagcatcgctaccaggggaaaatgtttgatgaagaaagtatcctaggtgagctgagcgagcccctgcgggaagagattatcaattttaactgtcgcaaactggtggcttctatgccactattcgccaatgccgacccaaatttcgtgacctccatgctgacaaaactgcggtttgaggtatttcagcctggggactatataatcagggagggaaccatcggaaaaaaaatgtattttatccagcatggtgtcgtgtcagtcctgactaaaggcaataaggaaaccaaactcgcggatggatcatactttggcgaaatctgtctcctcacgcggggtcgcagaacagcctccgtgcgggcagacacgtactgtcggctttactctctgtccgtggataactttaacgaagtgttggaggaataccccatgatgagaagggcatttgagactgtagcgctggacaggcttgacaggattgggaaaaaaaactccatacttctccacaaagtgcagcatgatctgaactcaggtgtgtttaactatcaggagaatgaaataatacagcagattgtgcagcatgaccgtgaaatggcacattgtgcccatagagtgcaggccgcagctagtgccacacctacccccactcccgtgatttggaccccacttattcaagcccctctgcaggctgcagctgctactacctccgtggccattgctcttacccatcaccccaggcttcctgccgctatttttcgcccacctcccggaagcggcttgggtaatctgggggctggccagacaccgcgacacttaaagcggttgcagtcccttatcccatcagcgctggggtctgccagccctgcaagtagcccatctcaggtggacacaccatcttcctctagctttcatatccagcaacttgccggtttttcagcccctgctggtttaagcccactcctccccagctcctccagttcccccccacccggagcatgcggcagccccagcgctccgacgccttctgccggagtcgccgcaactactatcgctggtttcggccactttcataaagccttaggcggaagtctatcctccagcgacagcccccttctcacccccttacagcccggagccaggtcccctcaggcggctcagcctagtcccgcacctcccggagcacggggtgggctgggacttcctgaacattttctacccccaccccctagcagcagatcaccatccagtagccccggtcagctgggtcagcctcctggagagctgtccctgggacttgctacagggccattatccacgccggagaccccaccaagacagccagaacctccatcactggtagcaggcgcatccgggggtgcgagtcctgtgggctttacccccaggggtggtctcagtccgccagggcactctccagggccaccacgcaccttcccatccgcccctcctcgggcaagtggcagccatggctctttattgctgccaccagcttcttcgccaccaccaccccaggtaccacagcgcagaggcacccctcctctgactcctgggagattgacccaagatctaaaactgatatctgcatcacagcccgctctgccgcaggatggcgctcaaaccctgagacgggcatccccacactctagcggggagtcaatggcagcatttcccctcttccctcgcgctggtgggggttcagggggaagtgggtcctcagggggactgggccctcctgggaggccatacggtgccatccccggacagcacgtaacgctcccgaggaaaacatcttccggaagcctgccaccacccttgagtctctttggggctcgagcgactagttcaggagggcctccattgaccgccggaccccagcgagagcccggagccagacccgaacctgttcgatcaaaacttccctccaacttgtag

SEQ ID NO: 226569 - DNA, 396 bp, Artificial Sequence
  Description of Artificial Sequence: Synthetic coding sequence
atgaatctgccatcgaccaaggtgtcatgggctgcagtcaccctgctgctgcttctgctgctcctgccaccagctctgctttcctctggagctgctgctcagccgcttccagactgttgccgccaaaagacttgctcttgccgtctgtatgagttactccatggcgctgggaatcacgcagccggaatcctgactctgggaaagcggaggagcggaccccctggactgcaggggcgactccaacgacttttacaggcatcaggcaaccacgcggcaggcattcttaccatgggcaggcgggcaggtgctgagcctgcgcctagaccctgcctgggcaggcgctgtagcgcaccagccgcagctagtgtggccccaggtggccagtccggcatttag

SEQ ID NO: 226570 - DNA, 1050 bp, Artificial Sequence
  Description of Artificial Sequence: Synthetic coding sequence
atggctgcgacagcagcagaagctgtggcaagcggttccggagaaccaagagaagaagccggagctcttggcccagcctgggatgaaagccagcttagaagttatagctttcctacccgcccaatccctagattgtctcaatccgacccaagagccgaagagttaatcgagaacgaggaacccgtggtgctgactgacaccaatctggtgtacccagccttgaagtgggacctggagtatctgcaggagaatattgggaacggcgacttttccgtttatagcgcctcaacacacaagttcctctactatgatgagaaaaaaatggcaaactttcaaaattttaagccccgatcgaacagagaagagatgaaattccatgagttcgtcgagaagctccaggatatccaacagaggggaggggaagagagactctatctgcaacagaccctaaacgacacagttggtcggaaaatcgtgatggactttctcgggttcaattggaactggattaacaagcagcagggtaaaagaggttggggtcaacttactagcaaccttcttctgattggtatggagggaaacgtgacacctgcccactatgatgagcagcagaactttttcgctcagatcaaaggatacaaaaggtgtatcctatttcctccggatcagtttgagtgcctgtatccctacccagtacaccatccctgcgaccggcagagtcaggtggactttgacaatcctgactacgaacggttccccaacttccagaatgtcgtgggatacgagacagtggtgggccctggtgacgttctgtatatcccaatgtactggtggcaccacatcgagtcgctgctaaatggagggattacgattaccgtgaatttttggtataagggtgcacccacaccgaagcgcatagagtacccacttaaggcgcatcaaaaggtagctattatgcggaatatcgaaaagatgttaggagaggcgctggggaacccacaagaagtgggccctctattaaatactatgatcaagggtcgatataattag

SEQ ID NO: 226571 - DNA, 1149 bp, Artificial Sequence
  Description of Artificial Sequence: Synthetic coding sequence
atggtttccgttgggtgcgtggtttttctgtttttctttttcggcgtccgaaataggaggagctttcggttccgatgggggccatctctggcagcggaaatggcagctactgctgccgaagccgtcgcgtccggaagcggggagccacgagaggaggcgggagccctaggcccagcatgggatgaatctcagctccggtcctactcctttcccacccggcctatcccacgtctcagtcagagcgacccacgagccgaggagctgattgaaaacgaggaacctgttgtactgacagataccaacctggtgtacccggcacttaagtgggatcttgagtatttgcaggagaatattgggaacggagactttagcgtctatagcgcctcgactcataagttcctgtattatgacgaaaaaaagatggcgaattttcagaactttaaaccaagatctaacagagaggaaatgaagttccatgagtttgtggaaaaattgcaagatatacagcagcgtggcggtgaagagagattgtacctgcaacagacccttaacgataccgtcggacgcaagatagtgatggatttcttgggcttcaactggaactggataaacaagcaacagggtaagcgcggatggggtcaactaacaagcaatctccttctcattggtatggagggaaacgttacccctgcacactatgatgagcagcagaattttttcgcgcaaataaaaggctacaaacgctgcatactcttcccaccagatcagttcgagtgtctgtacccttatcccgtgcaccacccgtgcgacagacagtcacaggtggacttcgacaatccagattatgaacggtttccaaacttccagaatgtcgtcgggtatgaaaccgtggttggtcccggtgacgtgctgtatataccaatgtattggtggcaccacatcgagagcctgttgaatggtggcataactatcaccgtgaacttttggtataagggggcacccaccccaaaacggatcgagtatccactgaaggctcatcagaaagtcgctatcatgcgcaatattgagaagatgttgggcgaagctcttgggaatccacaggaggtaggtcctctgctgaatactatgattaagggtcgctataattag

SEQ ID NO: 226572 - DNA, 579 bp, Artificial Sequence
  Description of Artificial Sequence: Synthetic coding sequence
atggctaactttcagaactttaagccccgaagtaaccgcgaagaaatgaaatttcatgaattcgtcgaaaaactccaagatattcaacaaagagggggagaggagcgcctctacctgcagcagaccttgaatgacactgtcggaagaaaaatagtcatggacttcctgggttttaactggaactggatcaacaagcagcaaggtaagagggggtggggccaactgaccagcaatctgctcctcataggaatggagggcaacgtgacacccgctcattacgacgaacagcagaattttttcgcccagatcaagggttataagagatgtatcttattcccgccagaccagtttgaatgtttgtatccctaccctgtccatcacccctgcgaccgacagtcccaggtggacttcgacaatcccgactacgaacggttcccaaatttccagaatgtagtggggtacgaaaccgttgtgggtccaggcgacgtgctttacatccccatgtactggtggcatcacatagagtcacttttgaatggaggcatcactattactgttaatttctggtacaaagggtag

SEQ ID NO: 226573 - DNA, 1803 bp, Artificial Sequence
  Description of Artificial Sequence: Synthetic coding sequence
atgagaccagctgccggagcagcccgacgtcctaggtgctgtacctcatggctcacccgctgtccaagtcctgctgcaagcgctccgacctggactcggcctcttagctgtgctagtccaagtgccacctgtgcctgcacagcatctgccccacaactcgaacttatcggccactcaatctttgatttcatccacccttgcgatcaggaagagttgcaggacgcgctgacgcctcagcagacattatcaagaaggaaggttgaggcccctacagagcggtgcttctccctgcgaatgaagtcaacactgacttctcggggtcgcaccctaaacttgaaggctgccacctggaaagtgcttaattgctcgggccacatgcgcgcttacaaacctcccgctcagacttctccagctggaagccctgactctgaaccccctcttcagtgcttggtgctcatatgcgaagccatcccccatccaggatctctggagcccccactcggacgcggtgccttcctcagtcggcatagccttgatatgaagtttacttattgcgatgacaggatcgccgaagtggcaggctactcgccagatgatttgatagggtgctcggcctacgaatatatccatgcattggactccgacgcagtttccaagagtatccatacactgctgtccaagggtcaggccgtgactggtcaataccgcttcttggctcggtcaggaggttatctctggacacaaacccaggccaccgtggtctccgggggtcgcggaccccagtcagaatctatcgtgtgcgtgcacttcctgatatctcaagttgaagagacaggcgttgtgctgagtctggaacagaccgaacagcatagtcggaggcccattcaacgcggtgctccctcccaaaaggatactcctaatccaggcgattcgttagacacaccaggtcctaggatattggcctttctgcatcccccttccctgtctgaagcggctcttgccgctgatcctcggaggttctgcagtcctgacctgaggaggctcctgggacctattctggacggcgcaagcgtggccgcaacaccctctacccctcttgccacaaggcatccccaatcccccctatcagccgatttgcctgatgagcttcctgtcggaacagaaaatgtacatcgactgtttacatctggaaaggacacagaggcagttgaaacggacctggacatcgcccaagacgcagacgccctggacctcgagatgctggccccatatatttcaatggacgacgatttccagctgaacgcgtcagaacagttaccgagagcataccacagacctttgggagccgtccccaggccccgagctagaagctttcatgggctgtcaccaccagcccttgagccctcccttctgccccgttgggggtcggaccctcggctgtcctgcagcagccccagccgtggagacccttccgcaagcagccccatggcaggggcacgtaagcgaacgcttgcccagtcaagtgaggatgaggatgaaggtgtggagttactcggtgttcggcctcccaagagatcaccatcgcccgaacatgaaaacttcctcctgttccccctgtctctgagcttcctcttaactggtggccctgccccaggaagtctccaggacccctcgacccccctgttaaacctgaacgaacccctagggttaggcccttccctgctgtctccttattctgacgaagacaccacgcagccaggtggacccttccaaccgagggcaggctccgcccaggccgactag

SEQ ID NO: 226574 - DNA, 1353 bp, Artificial Sequence
  Description of Artificial Sequence: Synthetic coding sequence
atgaggcctgccgcaggcgctgcccgacggcctagatgctgcacttcttggctcactaggtgtccttcaccggctgcctccgcccctacttggactcggcctctgtcttgcgcttctccgagcgcaacatgcgcctgcactgcgagcgctccacagctggaactcattggtcactcaatctttgatttcattcacccctgtgaccaggaggagctgcaggatgccctgacccctcagcagaccctgtctcgcaggaaggtggaggcccctactgagcggtgtttctctctgcggatgaagtcaacgctcacctctcggggtcgcacactgaatctgaaggcagctacatggaaggtgctcaattgcagtggccatatgagagcttataagccacctgctcagaccagccctgccggttcgccggattccgaaccaccactgcaatgcctggtgctgatttgtgaagctatacctcaccctggctctctggaaccaccgctgggcagaggggcttttctgtcacgccactccttggatatgaaattcacatactgcgacgataggatcgctgaggtggcgggatactctccagacgacttaatagggtgctcagcctatgagtacatccacgctctcgattcagatgccgttagtaagtctattcacactctgctgtccaagggccaggccgtgacagggcagtacagatttcttgcacgatcagggggttatctgtggacacaaactcaggcaaccgtggtttccggcggacgcggacctcaatcagagtccattgtttgcgttcacttcctcatttctcaggtggaagagactggggtcgttctttcactagagcagactgaacagcattctcggagaccgattcaacgcggtgccccaagtcagaaggatacacctaacccaggagacagtctggatacccctggaccccgtattctggcattcttacacccaccttccttgagcgaagccgctttggctgctgatccgagacgattttgctcgcccgacctacgtcgcctgttagggccaatccttgacggagcatcagtggcagcaacaccctccactccactggccaccagacacccgcagagtcctctgagcgccgatttgcccgacgaactgccagttggaacagagaacgtgcatcgactgttcacctcaggaaaggatacagaagcagtggagactgatctggacattgcccaagacccaagtacccccctcttgaacctcaatgaacccctcggcttccattttgtgacgcaaagtggcgtgcagtggcacaagcacagttctccgcagcctcgccctcctggattaaaatag

SEQ ID NO: 226575 - DNA, 1899 bp, Artificial Sequence
  Description of Artificial Sequence: Synthetic coding sequence
atggccctggggcttcaacgcgctcggtctaccacagagctgcggaaagagaagagtagggatgccgctagatcaagacgttcccaagaaaccgaggttctgtaccaactggcgcatacactgcctttcgcacgaggagttagtgcccatctggacaaagcctcaattatgcgcctcactatttcgtaccttcgcatgcataggctgtgtgctgcaggggaatggaaccaagtcggtgcaggcggagaacccctcgacgcctgttacctgaaagcactggaggggtttgtgatggttctcaccgccgagggtgatatggcctatctgagtgagaacgtttctaaacatctggggctgagtcagttggagctgatcggacatagcattttcgacttcattcacccctgcgatcaggaggagctgcaggacgcattgactccccaacagactctgtcgagaaggaaagtggaagcaccgactgagcgctgcttttcactgcggatgaagtctactctgacatcaaggggtcggaccctgaacctgaaggccgctacctggaaagtcctgaactgctccgggcatatgcgcgcatataagcctcctgctcagaccagtccagcaggcagtcccgattctgaaccccctctgcaatgcctggtccttatttgcgaagcaattccacatcctgggagcttagagcccccactgggccgtggtgcatttttgtccagacactctctggacatgaaatttacctattgcgatgatcgaatcgctgaggtggctggatattcacccgatgacttaatcggctgtagtgcttatgaatatattcatgctctggacagcgatgccgtttcaaagtccatccacacactcctttcgaaaggtcaggctgtcacaggccaatatcggttcttagccaggagcgggggatacttgtggactcaaacacaggccaccgtggtgagcgggggtcgaggtcctcagagtgagtccatcgtatgtgtccatttcctgatatcccaggtggaggagactggagtagtgctgagccttgaacaaaccgaacagcacagcaggaggcctatccagagaggagctccctcccagaaggacacaccaaatcccggtgactcattagacacaccaggacccaggatcctggcgttccttcatccgccaagtctgtccgaggccgctttggcggctgatccccgtcggttttgttctcccgaccttagaagattgctcggccctattttggatggggcatcagtcgcagcgacgccctccaccccactcgcaaccagacaccctcaaagcccgttgagcgccgatcttcccgatgagctgcctgtaggcactgaaaacgtacatcgcctgtttacctccggtaaagatacagaggcagtagagactgatttagatatcgcccaggacgcagacgccctggatctcgaaatgctcgctccctacatctcaatggatgacgattttcaactgaatgcctcagaacaacttccgagagcttaccaccggccactaggggcagttccaaggcccagagccagatcttttcacggtctgagtcctccagccctagagccaagtctgctgccccgatgggggtccgatccaagactgtcttgttcaagccccagccgaggagacccgagcgcttccagtccaatggctggtgcccgaaagaggaccctcgcacagagctccgaggacgaggatgaaggtgtggagctgcttggcgtgcgcccaccgaagcggagtccatcccctgagcacgaaaatttcctgctctttccgttgtctttggtgtgctggggcatcaatggaatcctttggcccagtctccccagctggctgaaacctacagtgctctag

SEQ ID NO: 226576 - DNA, 1731 bp, Artificial Sequence
  Description of Artificial Sequence: Synthetic coding sequence
atgcggctcaccatctcctacctgagaatgcacaggctgtgcgcagctggggaatggaaccaggttggagctgggggtgagccactcgatgcatgttacctaaaggccctagaaggatttgttatggtactcacggcagaaggtgatatggcctacctcagcgagaacgtgagcaaacatctgggcttgtcccagctggagctgattggtcacagtattttcgactttattcacccctgtgaccaggaagagctgcaagatgccctgacaccgcagcaaaccttaagcaggcgaaaggtcgaggccccaaccgagcgctgtttttctctgcgaatgaagtcgacactcacctcgaggggacgcactctgaatctgaaggccgctacttggaaagtgctcaattgctcaggccatatgcgcgcttacaaaccacccgcacagacgagccccgctggctcacccgattccgaacctcccctccagtgccttgtgttgatatgtgaggcaattcctcatcccggttccctcgaaccccctttgggcaggggggctttcctgtcacgccacagcctggatatgaagtttacatattgcgacgatcggatagctgaggtggctggttatagtcccgatgatttgatcggctgtagcgcttatgagtacatacacgcactggactccgatgcggtgtctaaaagtattcatacgttgctgtctaaaggacaggctgtgaccggccagtaccgtttccttgcaagatctgggggatacctgtggacacaaacccaggccacagtcgtatccggagggagggggcctcagagcgagtcaatcgtatgcgtgcacttcctcatatcccaggtggaggaaactggagtagtgctaagcctggaacagaccgagcagcattctcggaggcccattcagaggggtgctccatcccaaaaagatacccccaacccgggagactccctcgatacaccagggcctcgcatccttgcgtttttacatccacccagtttatcagaggccgcactggcagccgatccaagacggttttgtagtcctgatttaaggcgtctgctgggcccaattctggacggcgcatcagtcgcggctacgccttctacgccattggcaacccgtcacccacagagtcccctcagcgctgatctccctgacgaattgccagtgggtactgagaacgttcatagactattcacatctggcaaggataccgaagccgtggaaactgaccttgatatcgcccaggatgcagacgcattagatctggagatgctggcaccttacatctctatggacgacgatttccagcttaatgcatcggagcagctgccaagggcctatcatcggccactcggagccgtgcctcgacccagagccaggtccttccatgggctctcaccccctgccctagagccgagtttgctgccacggtggggttcagacccacgcttgagctgtagctccccttctagaggagatcctagcgcctccagtcctatggctggggctagaaaacggaccctggctcaatcatcagaagacgaggatgaaggtgtcgaattgctcggagttaggccaccaaaaagatcccccagccccgagcatgagaactttctgctctttccactttcattggtctgctggggcatcaatggcatactgtggccttctctacctagctggctgaagcctactgtcctctag

SEQ ID NO: 226577 - DNA, 2004 bp, Artificial Sequence
  Description of Artificial Sequence: Synthetic coding sequence
atggattggcaggaccaccggagtaccactgagttgaggaaggaaaagtcacgcgacgcagccaggtcccgcagatcccaagaaacagaggtgctctatcagctcgcacatactttgccttttgcccgtggcgtgtccgcacatctagataaagcttccatcatgagactgactatctcatacctgagaatgcacaggttgtgcgcagcaggtgagtggaatcaggtgggagccggtggcgagccactggacgcatgttacctgaaagcattagagggcttcgtcatggtgctgaccgctgagggggatatggcgtatttgtcagaaaacgtgtctaaacaccttggtctgtcccagcttgagttgatcggacattccatattcgactttatccatccttgcgaccaggaggagctgcaggacgcgcttaccccccagcagacgttaagcaggagaaaggttgaggcccctacagaaaggtgctttagtctgagaatgaagagcaccctgacgagtcgcggacggactctgaacctgaaggcagccacttggaaagtgctaaattgcagcggacacatgagagcatataaacctccggcacagacgagcccagccggatccccagactccgaaccccctctgcaatgcctggtgttgatctgcgaggcaattcctcaccccggatctctggaacctcctttggggagaggcgcttttctgagcaggcacagtctcgatatgaaatttacgtattgtgatgaccgtatcgctgaagtggctggatacagccccgatgatctaattggttgttccgcctatgagtatatccacgcacttgattcagatgcagtctctaagtccatccatacactgctctcaaaagggcaggctgtcacagggcagtaccgctttttagctaggtcggggggatatctctggacgcaaacacaggcaaccgtggttagtggcggtagaggccctcagtcagagagtatagtatgcgtgcattttttaatatcccaagtcgaggagacaggcgtggtgctgtcgctggaacagaccgagcaacacagcagacggcctatccagcgtggcgcaccttcccaaaaggacacccccaatccgggagactccctggacacccctggcccaaggatactggcctttctgcatcccccatctctgtcagaggccgcacttgctgctgatcccaggcggttctgtagcccagacctgcgccgactcttgggacccatcctagacggtgctagcgtggctgcgactccatccactccattggctacccgccatcctcagtcgcccctgagcgcagatctgcctgacgaactccccgtgggaacagaaaacgtgcaccgcctttttacttcaggaaaagacaccgaagccgtggaaactgacctggacattgcccaagatgcagatgccctggacttggagatgctggcaccgtatatatcaatggacgacgacttccagctcaacgccagtgaacagttaccacgggcatatcataggccactcggtgctgtacccaggcctagggccaggagctttcatggcctcagccctcccgcactcgaaccctcccttttgcccagatggggatcagatccacggttgagctgcagctcgccttccaggggagatcctagcgcctcaagccctatggcgggagcccgtaaacggacccttgcccagagcagtgaagatgaagacgaaggtgtcgaattgttgggtgtgagacctccaaagcgctctccctcccccgagcatgagaacttcctgctcttccccctgagcctgtcatttctgctgactggagggcctgcgcctggatcgctgcaagacccaagtacacctttgctcaacctaaatgaaccactgggactgggaccctctctcctgagtccatatagcgatgaagataccacccagcccggaggcccattccagccgcgagccggtagcgcccaggccgattag

SEQ ID NO: 226578 - DNA, 1842 bp, Artificial Sequence
  Description of Artificial Sequence: Synthetic coding sequence
atgagactaactattagttacttacgaatgcatagactttgtgcagcaggcgagtggaatcaggtcggggctggaggcgagccactggatgcgtgttatctcaaggcactagagggcttcgttatggtgttaacagccgagggcgacatggcttacctttctgagaatgtgtcaaaacacctcggtctttctcagctcgaacttattgggcatagcatcttcgatttcatccacccctgtgatcaggaggaacttcaagacgctctgacaccacaacaaaccttgtctcggcgaaaggttgaggctccgaccgagaggtgcttctctctaagaatgaaatctacgctgaccagtagaggacgtacattgaatctaaaagcagccacctggaaggtcctgaactgcagcggtcatatgcgcgcttacaagccgccagcccagactagcccagctgggagtccagactctgaaccccctttgcagtgtctcgtgttgatctgcgaagctattcctcaccccggaagtctggaacccccacttggcagaggtgcttttcttagtagacattcactagacatgaaattcacctactgcgatgaccgaattgcggaggtggcaggttactcccccgatgacttgatcggctgttccgcctatgagtatatccatgctcttgactccgacgcggtgtcaaaatccattcatacactcctcagcaagggccaagctgttaccggccagtacaggtttctggccagatccggtggttacctttggactcagacacaggccaccgttgtgtccggtggtagaggccctcaaagcgagtcaatcgtctgtgttcatttcttaatctcccaagtggaagaaaccggcgtcgtcttgagcctggagcagacggagcaacactcacgtaggccaatccagcgcggtgcgcctagtcagaaggatacacccaacccgggtgactccttggatacaccaggtccacgcatcttggccttccttcatccacccagtctgtccgaagctgcgttagcagcagatcctcggagattctgctcccccgacctgcgcagacttctaggcccaattctggacggagcttcagtggcagctaccccctccactccactcgctacaagacatcctcagagcccgctctcagccgacttaccggatgagctgccagtgggcacggaaaatgtacacagactgttcacgtctggaaaggatacagaagcagtggaaaccgacctagacatcgcccaagatgccgacgcacttgaccttgagatgttagccccttatatttccatggatgacgactttcagctgaacgccagcgagcagctgcctagagcctaccaccgcccactcggtgcggtgcctcgccctcgagcgagatcatttcacggcctcagcccccctgcactagaaccctccctgcttccaaggtgggggagtgatccaaggctttcatgttcatcaccttccaggggagacccatccgcatctagccctatggcgggagctcgcaagcgaaccctcgcccaaagtagtgaagacgaggatgaaggggtcgagctgctcggggtgaggcccccaaaaagatctccgtctcccgagcacgagaattttctactgtttccactgtctctctcgttcctactgactggaggaccagcccctgggtccttgcaagacccgtccacgccactgctgaacctcaatgagccattaggactggggcctagcttgctttctccgtactccgatgaagatacgactcaacctggcggaccatttcagcctcgcgcaggttcagcgcaagcagattag

SEQ ID NO: 226579 - DNA, 2010 bp, Artificial Sequence
  Description of Artificial Sequence: Synthetic coding sequence
atggcgctgggtctgcagcgggcaaggtccacgactgagctccggaaagaaaagtcgagggacgcagccagatctaggaggtcccaggaaaccgaggtactttaccagttggcacacaccctccctttcgcccgtggggtgtctgcccacctagacaaagctagtataatgaggctgaccatttcttatctcaggatgcaccggctatgtgccgctggagaatggaaccaggtaggcgcaggaggggagcccttggacgcttgttatctcaaagccctcgagggattcgtgatggttctcacagcagaaggtgacatggcgtacttgagtgagaatgtatctaagcatttgggtctttcgcaactggagctcatagggcacagcatctttgatttcattcacccctgtgaccaggaggagcttcaggatgccctaaccccccagcaaacattgtcaaggagaaaagtcgaggcaccaacagagcgttgtttcagtctcagaatgaagtctaccctcacaagcagaggtcggacactgaatctgaaagctgcaacgtggaaggtcttgaattgctcaggccatatgcgcgcttataaacctcctgcacagacatcccccgcaggatcccccgactctgagcccccactgcaatgtctggttctcatctgtgaggccataccccatccaggctcacttgaacccccacttggcaggggcgctttcctgtcccgacacagtttggatatgaaattcacctactgcgacgatcggatcgcagaggtcgcaggctacagtccagatgatttaattggctgttctgcttacgaatatatccacgccctggatagcgacgctgtgtcgaaaagcattcacacactcttgtctaaagggcaggccgtgaccggacagtaccgctttttggcccgaagcgggggatacctctggacgcaaacgcaggcaactgttgtcagtggtggaagagggccacagtcagaatccattgtgtgtgtccactttcttatttctcaggttgaggaaactggtgtggtgttatctctggagcagaccgagcagcacagtagacgcccaattcagagaggggctccatcccaaaaggacacgccaaatccaggggatagcctggacactcctggaccgaggatccttgcattcttgcaccctccttcactatccgaggctgctctggctgccgatccaaggcgattctgttcaccagatctgcggagattgctagggccaatacttgacggggcatccgtagccgctacaccttccaccccacttgctacaagacatccacagagcccactgagcgctgacctgcctgatgaactgcctgtgggaacagagaacgtacaccggctttttacttccggcaaagacaccgaagccgttgaaacagatctcgatatcgctcaggacgcggatgccttggacctggaaatgctggcgccttatatctcaatggacgatgattttcagctcaatgcgtccgaacaactgcctcgtgcttatcacaggcccctgggtgccgtcccccgtccaagggcgagatctttccatggactgagtccacccgctctcgaaccgagcctcctgcctcggtggggttccgatccaaggttgagttgctccagcccatcccgaggcgaccccagcgcatcctctcctatggcaggggctagaaaacgtacgctcgcccagagcagcgaagatgaggacgaaggggttgaactgctcggtgtgagaccacccaaaagatcgccaagtcctgagcatgagaactttctgctgtttcctctttccttgagcttcctgctgacggggggacctgcaccgggatccctgcaggacccctccacacccctgctcaacctcaacgaaccccttggactgggcccatcacttctcagtccttatagcgacgaggacacaacccagccagggggtccgttccagcctcgggcaggatctgcgcaagctgactag

SEQ ID NO: 226580 - DNA, 1092 bp, Artificial Sequence
  Description of Artificial Sequence: Synthetic coding sequence
atggctctcggtctgcaaagggctcgatctactactgaactgcggaaggaaaagtctagggacgcggcaaggtcacgcaggtcccaggaaactgaggttttgtaccagctcgcccataccctccctttcgctagaggggtcagtgcccacctcgacaaggctagcattatgcgtctgaccataagctatttgcgaatgcataggttatgtgctgccggagagtggaatcaggtaggtgcaggaggggagcctctcgatgcttgttacttgaaagcgctggaaggcttcgtgatggttctgactgctgaaggcgacatggcatatctgtccgagaatgtgtcaaaacatctcgggctctcccagctcgaactgatcggtcattccatctttgactttattcatccatgcgatcaggaggaactccaggatgccttgacaccacagcagaccctgagcagacggaaggtggaagcccctactgaaagatgcttctcgctgaggatgaagtcgactctcacgtctcgtgggagaacactgaatctcaaagcggcaacttggaaagtgctgaactgctcaggacatatgagagcctataaaccacccgctcagaccagtcctgcaggttcgcctgatagtgagcctcctctgcaatgcttggtcctgatctgtgaggccatccctcaccccggttctctggagcctccattgggaaggggggctttcctttctcggcattccttggacatgaaattcacttattgcgacgataggatagcagaagtggccggatacagccccgatgacctaatcgggtgtagcgcctatgagtacattcatgcactggattccgatgcggtcagtaagtccatccacacctgtatgtatcccatttcaccaggcgcaaaaccggcagctacatggcctcctgctgatacccgaacaccccagttgcccataccacaggatgctctcccaccccatttgaacacatcctcgctcctgcctaagccccaaggtaccgtttctttcctggccccatcgtatcctgtgcccaggtacttttctccacacctgcctccatggtggccatag

SEQ ID NO: 226581 - DNA, 1839 bp, Artificial Sequence
  Description of Artificial Sequence: Synthetic coding sequence
atgctgccaatgccctcaggcagacccaggagttgcgccagaaagtcacccggaatgcgcccagcagccggagcagccaggaggccacggtgctgcacttcatggctgaccaggtgtccttcacctgccgcttccgccccaacctggacaaggcccttaagctgcgccagcccgtctgcaacttgcgcctgtactgcttccgcaccgcagctggagctgatcggtcatagtatcttcgactttattcacccgtgtgaccaggaagagctccaggacgcccttaccccgcagcagacactcagccgaaggaaagtggaagcccctactgagaggtgcttttcgctccgcatgaaaagcacacttactagccgcggacgaacactgaatctgaaagccgcaacctggaaggttcttaattgtagcggacacatgcgcgcatacaagccccctgcacagacttcaccagctggaagccccgattccgaaccacccctgcagtgcctggtgctgatctgcgaggccattccacaccccggttccctagagcccccactgggaaggggggcatttttgagcaggcacagtctggacatgaaatttacatactgcgacgatcggattgctgaagtcgccggatacagccccgacgacctaattggctgctcggcctacgaatatattcacgcactggactcagacgcggtgtccaaaagcatccatacgctactgtcaaaaggacaagccgttacaggtcagtatcgttttctggcccgtagcggcggatacctatggacgcaaacccaggctacggtggtttcggggggtagagggcctcagagcgaatccattgtttgcgtccacttcctcatatcccaggtggaggaaaccggcgtggtgctgtcgctcgagcagactgagcagcacagtcggcgtccaatccagaggggagcgccaagccagaaagacacccccaatccgggtgacagtcttgatacccccggacctcggatcttggcatttctccaccctcctagcctgtctgaggccgctttagcggctgacccacggagattctgcagtccagacctgcgtaggcttctgggccctattctggacggtgcttccgtcgcagcgacacccagtacaccactggcaaccagacacccacagagccctctgtctgccgaccttcccgatgagttacccgtagggactgaaaatgtgcataggttattcaccagcgggaaagacactgaagctgtggaaactgacctagacatcgcccaggatgccgatgccctggatctcgaaatgcttgccccatacatcagcatggatgatgatttccagctgaacgcttctgaacagcttcccagggcctaccatagacccctcggcgctgtgccgaggccacgagctcgctcctttcatggcctctcgcccccagccctcgagccaagtttgctgccaaggtgggggtctgatcccagactgagctgtagttctccaagtcgcggtgaccctagtgcttcctcccccatggctggagctcgcaaacggacactggcacagtcctctgaagatgaagatgaaggtgtggagcttctgggggtgcgacctccgaaacggtcaccttcaccagagcacgagaactttctgcttttcccattgtcgctgagtttcctgcttacgggtggcccagcgccaggctccctccaagatccatcaaccccccttctcaatctcaacgagccgctgggatttcactttgtgacccagtccggggtgcagtggcataagcattcatccccccagcctcgtcccccaggccttaagtag

SEQ ID NO: 226582 - DNA, 600 bp, Artificial Sequence
  Description of Artificial Sequence: Synthetic coding sequence
atgagacctgcagccggtgccgcacggcgaccaagatgctgcacgagttggcttacacggtgcccttcacccgcagcatctgcccctacctggactagacctctgtcttgtgcgtctccctctgctacttgtgcgtgtacagcttccgccccacaactggaactcatcgggcacagcatctttgactttatccatccctgtgaccaggaagaacttcaggacgctttaaccccgcagcagacgctgagtaggcgaaaagttgaggctcccaccgaacggtgcttcagcctgcgcatgaagtcaaccctgacatcacggggaaggaccctgaatctgaaggcagctacctggaaggtgctgaattgcagcggccacatgagggcttataagccccctgctcagacatcccctgccggaagccctgactctgagccgcctttacagtgcctggttctgatttgcgaagccatcccgcatcccggttctctggagccaccattgggtagaggagctttcctgagccggcatagtttagatatgaaatttacttactgcgacgacaggatcgccgaggtagccggatacagtcccatgacatag

SEQ ID NO: 226583 - DNA, 714 bp, Artificial Sequence
  Description of Artificial Sequence: Synthetic coding sequence
atgcgacccgctgccggtgcagcaaggcggcctagatgttgtacaagctggctgacgcgctgtccctctccagcggcttctgccccaacatggacccgccctctaagctgcgcttcgccatccgccacttgtgcctgcacagcgtccgcccctcaagaggaacttcaggatgctttgaccccccagcagaccctgagccgcagaaaggtggaggcacctactgagcgatgcttctccctcagaatgaaaagcaccctgaccagcagggggagaacacttaatctgaaggcagctacatggaaagtgctaaattgttccggccacatgcgggcatataagcccccagcgcaaacatcgccagctggatcaccagatagcgagcctcctctccagtgcctcgtactgatctgcgaggctattcctcatccgggaagtctcgagagattcgtcccggttagttctgcagcgaccagtctctgtctgccatccctgtcaccttccaaagtggcgggttactctcctgacgatctgattggatgttcagcctacgaatacatacatgcgctggacagcgatgcaccacaggatgcactcccaccccacctgaatacctctagcctgctcccaaagccccagggcacggtgtcatttctggctccgtcctaccccgtgcctcgctacttcagcccccacttgcctccgtggtggccttag

SEQ ID NO: 226584 - DNA, 1092 bp, Artificial Sequence
  Description of Artificial Sequence: Synthetic coding sequence
atggctctgggacttcagagggctagatccacaaccgagttacggaaggaaaagtctagagatgcggctaggagtaggagaagccaggaaacggaggtgctatatcagctggcccatacgctgccctttgctcggggagtctctgcacatttggacaaagcatctattatgaggctgaccatcagctatctccggatgcacaggctctgtgcagccggagagtggaaccaggtgggcgcagggggagagcccctggacgcctgctacctaaaggcgctggagggttttgtgatggtgctaaccgcagaaggagatatggcctacctgagtgaaaacgtatcaaaacatctgggcctctcacagctcgagctcattggtcactctatttttgattttatccatccttgtgaccaggaggagctccaggacgctctgactccccagcagactctctctaggcggaaggtagaggctcccaccgagcgctgtttcagtctacggatgaagtcaactctgactagccggggtcgcacactcaatctgaaagccgcaacatggaaggtgttgaactgcagcggacacatgcgagcctataagccaccggcacagacttctccggctggcagcccagacagcgaaccacccctccagtgtctggtgcttatctgtgaagcaattccgcaccccggtagcctcgaaccacccttgggaagaggagcttttctgtcaagacatagcctcgatatgaaatttacatactgtgacgaccgtatcgcagaggtggctggttatagccctgacgacctgattgggtgtagcgcttacgaatacatccacgctctggattcagatgccgtctctaagtcaatccatacctgtatgtaccccataagtcccggtgctaaaccagcagctacctggccacctgccgacacccggacaccccagctccctattccccaagacgctctgccacctcatctgaatactagcagcctcctcccaaagccgcaaggaaccgtaagctttcttgccccaagctatccggtacctcgttattttagccctcatctgcctccgtggtggccttag

SEQ ID NO: 226585 - DNA, 2976 bp, Artificial Sequence
  Description of Artificial Sequence: Synthetic coding sequence
atggccgataaggtcaggagacagcgtccgagaaggcgtgtgtgctgggcactggtggccgtgttgctcgccgacctgctggcacttagtgataccctggccgtgatgtcagtggacctcgggagtgagtcaatgaaggtggccatcgtgttgaataaagagtcccgtagaaagacgccggtcattgtcactctaaaggagaatgagcggttttttggcgactccgcagccagcatggctatcaagaacccaaaagctacactgcgctacttccagcatctcttaggtaagcaggccgataatccccatgtggctttatatcaggccaggttcccagagcacgaactgacctttgaccctcaaaggcagaccgttcacttccagatctcaagccagctgcagttctctccagaagaagtcctgggtatggttctcaattattctcggagtctcgctgaggactttgcagagcagccaatcaaggatgctgtgatcaccgttcctgtgttttttaaccaggccgaaagacgggctgtgctgcaggcagccagaatggctggcttaaaggttctacaactgattaacgataatacagcgaccgctttgagctacggcgtgtttcggaggaaggatatcaacaccacagcacagaacattatgttctacgatatggggtcggggtccactgtctgtactatcgtaacttaccagatggtgaagacgaaagaggcagggatgcaacctcagttacaaatcagaggggtggggttcgacagaacactgggcggattggaaatggagctacgcctacgcgaacgactggccggactatttaatgagcagaggaaaggccagcgcgctaaagacgtccgggaaaatcctcgggctatggccaaactgttaagagaagccaataggttgaaaaccgttctgagcgccaatgcggaccacatggcacaaatcgaaggtctgatggacgacgttgacttcaaagctaaagtcactcgcgtggaattcgaagaactatgtgctgatctttttgaacgcgtgcctggtccagtccagcaggccttgcagagcgctgagatgtccctagatgagatcgagcaagtaatcttagtggggggtgcaaccagagtccctcgagtgcaggaggtgctcctgaaggctgtaggtaaagaagagctggggaaaaacatcaacgcggacgaagccgcagccatgggcgcagtgtaccaagccgctgccctgagtaaggcgttcaaggtaaagccatttgttgtccgggacgccgtggtgtatcccatcctggtggagttcaccagagaggtagaggaagagccaggtattcactcacttaagcacaacaaacgagttcttttcagtagaatgggcccttacccgcagcgtaaggtgatcactttcaatcgctacagtcatgactttaattttcacattaactatggagacttgggtttcctcgggccagaagacctgcgggtgttcggcagtcagaaccttaccacagtgaaattaaagggggtaggcgacagctttaaaaaatacccagactatgagtccaagggtatcaaagcacactttaacttagacgagagtggcgtattatcactagaccgcgtggaatcagtgttcgagacactcgtagaagactccgccgaggaagagagcaccttgactaagctgggcaataccatctctagtttgttcggcggaggtacaacacctgatgccaaggagaacgggactgatactgtccaagaggaagaagagtcacccgctgaggggagtaaagatgaacccggagaacaggtagaattgaaagaggaggccgaggcccctgttgaggatggtagccagcctccaccgccagagcccaagggtgatgcgactcccgagggggaaaaagcaacagagaaagaaaatggcgataaatcagaggcacagaagccgtcagagaaagcagaggcgggacccgaaggtgtggcacctgccccagagggcgaaaaaaaacaaaagcctgcacgcaagagaaggatggttgaagagattggtgtggaattagtggtcctggacctgcctgatcttcccgaagacaagctcgcccaatccgtgcagaagctgcaagatctgactctgcgggatctcgagaagcaggaacgagaaaaggccgcaaattccttggaggcgtttatattcgaaacccaagataagctctatcagccggagtatcaggaggtaagcacagaagagcagcgagaggagatctccggcaagctgtccgctgcctctacatggcttgaggatgagggagtaggagccacgactgtgatgcttaaagaaaagctagcagaactgcggaaactctgccagggtcttttcttccgcgtggaggaaaggaaaaagtggccagaacggctctcagcacttgataatctgctgaaccactcttctatgtttctaaagggggcaaggctcataccagagatggaccagatttttacagaggtagagatgaccacactcgagaaggtgatcaatgaaacatgggcctggaagaatgccacattagcagaacaggctaaactgcccgctaccgagaagccagtgctgctgtcaaaagacattgaagctaagatgatggccttggaccgggaggttcagtatttgctgaataaagccaaattcactaaaccacgtcctagaccgaaagataaaaatggtacgagagccgaacccccactgaacgcctccgcatctgaccagggcgaaaaagttatccctccagcagggcagaccgaggacgccgagccaatttcagaacctgagaaggtggagacggctggtagcgagcccggagatacagagccgctggaattgggcggtcctggcgcagagcctgagcagaaagaacagtctaccggacagaagcggcctctgaagaacgacgagttgtag

SEQ ID NO: 226586 - DNA, 3000 bp, Artificial Sequence
  Description of Artificial Sequence: Synthetic coding sequence
atggctgacaaggtgcggagacaacggccacgcaggcgggtatgttgggcgcttgtggccgtcttgcttgcggaccttctggctctcagcgacacactggccgtcatgtccgttgatcttggatccgagagtatgaaggtagcgatagtaaagcctggagtgcctatggagatagtgttaaataaggaatctcggaggaaaacccccgttatcgtcaccctgaaagagaatgaaagattcttcggcgacagcgctgcctcaatggcaataaaaaatccgaaagccaccctgagatacttccagcatctgctgggcaagcaggccgataaccctcacgtcgcattgtatcaggccaggttccccgagcacgagcttaccttcgatccgcagaggcaaactgttcactttcagatctcttcacaattacagttcagtccggaagaggtactggggatggtgttaaactactcccggtctctcgctgaagatttcgctgagcaacctatcaaggacgcggtgatcaccgtgccagtgttctttaaccaggctgaacgacgggcagtactacaggccgctcggatggctggactgaaagttctgcagttaattaacgacaacacagccaccgctctgtcctatggtgtatttaggcgcaaagatataaatacaactgctcagaacattatgttctatgacatgggcagcgggagcaccgtatgcacgattgtgacttaccagatggtcaagaccaaggaagcaggcatgcagccccagcttcagatccgcggagtgggatttgatcgtacgctggggggactggagatggagctgaggttgcgtgagaggctggccggactgttcaatgagcaacggaagggccaaagagccaaggatgttcgagagaacccgagagctatggccaaacttctgcgagaggccaaccgactcaaaaccgttctgtccgctaacgctgatcacatggcccagattgaggggttgatggacgacgtcgacttcaaagctaaagttacacgggtcgaatttgaagagctgtgtgctgatttgtttgaaagggtgcccggacccgttcagcaggcccttcagtcagccgaaatgtctttggacgaaattgaacaggtgattttagttgggggagccacacgagtccccagagtccaggaagtgcttcttaaagccgtcggcaaagaagagctcgggaaaaatatcaacgccgatgaggccgcagctatgggggcagtgtaccaggccgcagccctgtctaaagcctttaaagttaaacccttcgttgtaagggatgcggtggtataccctatactcgtagagttcaccagagaggttgaagaggaacccggaatccatagcctgaagcacaataagcgggtcctgttctcgcggatgggcccttatcctcagaggaaagtgattactttcaaccgctacagccacgacttcaatttccatatcaactacggcgatcttggcttcctgggcccagaggacctcagagtgtttggaagccagaatcttacaaccgttaagcttaaaggcgtgggggattccttcaagaaataccctgattatgaatccaagggcattaaggctcatttcaacctcgacgagtcaggagttctcagcctcgatagggttgaaagcgtattcgagaccttagtcgaggatagcgctgaagaagaaagcactttaactaagttgggaaatactatatcatcactcttcgggggtggcaccaccccagatgccaaggagaatggaactgatacggtgcaagaagaggaggagtcacccgctgaaggctccaaggacgaaccaggggaacaggtcgagctgaaagaggaggcagaggcacccgtagaggatggatcacagcccccacccccagagccaaaaggcgatgcaacccccgaaggcgaaaaagccacagagaaggagaacggagataaaagcgaggcacagaaaccttcagagaaagctgaagcaggcccagagggcgtggccccagccccagaaggagagaaaaagcagaagcccgctaggaagaggcgcatggtggaggaaatcggcgtcgaactggtagttttggacctgcccgacctccccgaggacaagcttgcccagtctgtccagaagctgcaggacctgacactgcgggatctggagaaacaagagcgcgagaaggctgccaattctcttgaagcattcatctttgaaacacaggacaaactgtaccaacccgagtaccaggaagtgtccacggaagagcaacgcgaggagatctccggcaagctttctgctgctagcacttggctggaggacgagggagttggagccactacagttatgctgaaggaaaagctggccgaactcaggaagctctgccaggggctgtttttccgagtggaggagagaaaaaagtggccggaacggctctctgcccttgataatctcttgaaccattcatctatgtttctaaaaggcgctagattgatacccgaaatggatcagatcttcaccgaggtagaaatgacgactctcgagaaggtgattaacgaaacttgggcctggaagaacgcaacactggccgaacaggctaaactgccggcaaccgaaaagccggtgttgctgtcgaaggatattgaggcaaagatgatggccctcgaccgggaggtgcagtatctgcttaacaaggccaagtttaccaagccgagaccaagacccaaagacaagaacgggacacgtgccgaacccccactcaacgcatcagcttctgaccagggggaaaaagtgataccacccgcaggtcagacggaggacgccgagcccatttcagagcccgaaaaagttgaaaccgggtctgaaccaggggatactgaacctcttgagctaggcggtcctggcgctgagcctgaacagaaggaacagagtaccggtcaaaagaggcccctgaagaacgacgagttgtag

SEQ ID NO: 226587 - DNA, 2547 bp, Artificial Sequence
  Description of Artificial Sequence: Synthetic coding sequence
atggtgctaaactattcgagaagtttggctgaggacttcgcagaacagccaatcaaggacgctgttatcacagttcccgtgtttttcaaccaggccgagcgcagggccgtgcttcaggcagccaggatggccggactcaaagttctgcagttgatcaacgataatacagcaactgccctgtcttacggtgtttttcgccgtaaggatatcaatactaccgcccagaacatcatgttctacgacatgggaagcggaagtaccgtgtgcactatcgtgacctaccagatggtgaagactaaggaggcgggtatgcagcctcagctccaaattagaggcgtgggctttgacagaacgctcgggggtctggaaatggaattaagattacgggaacgcctggccggactattcaacgagcaacgcaaggggcagagggctaaggacgtgcgcgaaaacccaagagcaatggcgaagctgctcagagaagctaatagattgaagactgtactgtctgcaaatgccgaccatatggcccagatcgaaggactgatggacgacgtggacttcaaagccaaggttaccagagtggagtttgaggagctctgcgccgacctgtttgagcgggtgcccggtccagtccagcaggccctgcagtccgcagaaatgtcactcgatgagatcgaacaggttatcctggttggaggggctacccgagtgccacgtgtgcaggaggttctgctgaaggccgtcgggaaagaagagctaggaaagaacataaatgcggatgaggccgctgccatgggggcagtgtaccaggcagcagctctctcaaaagccttcaaagttaagccttttgtagtgcgtgacgccgtagtctaccccattcttgtggagtttacccgagaagtggaggaggaacccggtatacacagcctcaaacacaataaacgggtgctgttcagtaggatggggccttacccccagagaaaggtcatcacttttaatcgctatagccatgatttcaactttcatattaactatggcgacttgggcttcttggggccagaagacctgagggtgttcggctctcagaatttgacaacagtgaagttaaaaggagttggcgattcctttaaaaagtatcctgattatgaaagcaagggtattaaggcccactttaacctggacgagtcgggcgttctttccttagaccgtgtcgaatcagttttcgagactctcgttgaagattctgctgaagaggaatctacactgactaaactggggaacactatcagtagcctcttcgggggaggcaccacccctgatgctaaagagaatggaaccgacacagtgcaggaagaggaagagagcccagcagagggcagtaaagacgagccaggagagcaggttgaactcaaggaggaggctgaggcccctgtggaagacggaagccagccgcctccacctgaaccgaagggggacgctactcctgaaggggagaaggcaaccgaaaaggaaaacggcgacaaatcagaagcacagaaaccatccgaaaaggcagaggccggtcccgaaggagttgccccagctcctgaaggtgaaaagaagcagaaacctgctaggaaacggagaatggtggaagaaatcggcgtagagctggtcgtccttgacttgccagatctccccgaagataagttggcccagagtgtgcagaaactccaggatttgacacttagagatcttgagaagcaggagcgggaaaaagcagcaaactctctggaagcatttatctttgagacacaggacaagttgtaccagcctgaataccaggaagtgtctacagaggagcagcgggaggaaatcagcggtaagttgtcagcggcttcaacctggttggaggacgaaggcgtgggggctaccactgtgatgttaaaagaaaaattagctgagctcaggaaactttgccaggggctgttctttagggtggaggagcggaagaaatggcctgaacggttaagcgccctcgacaatttgctgaatcactcaagtatgtttctcaaaggggcacgacttattccagagatggaccagatcttcactgaagtagagatgacgactctagagaaagtgattaatgaaacttgggcctggaagaacgccacactggctgaacaagcaaaattgccagcgactgagaagcccgtcctgctgagtaaggacatcgaagccaagatgatggcactggacagagaagtccaatacttgctcaacaaagctaagtttacgaaaccgagacctcgccctaaggacaagaatggcacccgggcagagcccccactcaacgcatctgcctccgaccaaggggaaaaggttatcccacccgctggacaaaccgaagatgctgagccaatctcggagccagagaaggttgaaactggttccgaacctggcgacacagaacccctagagttgggaggccctggcgctgaacccgagcagaaagagcagtcaacaggccaaaagaggcctctcaaaaatgatgagctctag

SEQ ID NO: 226588 - DNA, 2040 bp, Artificial Sequence
  Description of Artificial Sequence: Synthetic coding sequence
atggccgacaaggttagaagacagcgaccaaggaggcgagtgtgttgggcattagtggccgtgctcctcgcagatttattggctctgagcgataccctagccgtgatgagcgtcgacctgggtagcgagagtatgaaagttgccatagtaaaacccggtgtgcccatggagatagtactgaacaaggaatccagaagaaaaactcctgtgatagtcacactgaaggaaaatgagagattcttcggagacagcgccgcatccatggccatcaagaaccctaaagccacacttagatattttcagcatctgcttggaaagcaggcagataatccacatgtggcgctgtatcaggcacgctttccagaacatgagctgacatttgatccccagaggcagaccgtgcactttcaaatatcaagccagcttcagttctcacctgaggaggtgctcggaatggtgttgaattactcacggtccctcgcagaggacttcgccgagcaacccattaaagatgcagtaattaccgtgccggtgttttttaatcaggccgagcgacgggctgttctccaggccgcaaggatggctgggcttaaggtgctccagcttatcaatgataacaccgccacggcgctttcatacggcgtgtttcggaggaaggacatcaatactaccgcccagaacattatgttctacgatatggggtcagggagcactgtgtgcaccatcgtaacttatcaaatggtgaagacaaaggaagcaggaatgcaacctcagctgcagattagaggagtgggattcgataggaccctgggaggcctggagatggagcttcgcctgcgggagaggctggcagggctcttcaatgaacagcgcaagggtcagagagccaaggacgtgcgcgagaatccacgggcaatggccaaactgttgagggaagcaaataggctgaagactgtcctgagcgcaaacgctgaccacatggcacagatcgagggactgatggatgatgtcgattttaaggccaaggtcacccgagtggagttcgaggaattgtgcgctgatctgttcgagagagttcctggacctgtgcagcaagctcttcagtctgctgaaatgagcctggacgagattgagcaggtgattttggttggaggggcaaccagagttcccagggtccaggaagtgcttttaaaggcagtgggcaaagaagagctcggcaaaaatattaatgccgacgaagcagccgcaatgggagcagtatatcaggctgctgccctttcgaaggcattcaaggtcaaacccttcgttgtgcgggatgcagtggtgtatccaatcttggtggaattcactagagaggtggaggaggaacccggtattcatagtctgaagcacaacaaacgagtgctgtttagcaggatgggcccatatcctcagcgcaaggttataacttttaatcgctactcacatgactttaactttcacatcaattacggagacctgggctttctggggccagaagatttgcgagtttttggctcccaaaatctgacaacggtcaaactcaagggagtcggcgactcgtttaaaaagtatccggactacgaatcgaagggaatcaaagcccacttcaatctggatgagtcaggcgtgctctctctcgacagggtggagtctgtgttcgaaactctggttgaggatagcgcagaagaggaatctacgctgacaaagttaggtaataccatctcttctctgttcgggggaggaactactccagatgcaaaagagaatgggaccgacacagtgcaggaggaagaagagagcccagctgaagggtctaaagacgagccaggcgaacaggttgagctgaaggaagaggcagaggcacccgtcgaagacgggagccagccacctccgccagagccaaagggggacgccacccctgagggggaaaaagccactgaaaaagagaatggtgacaagtcagaggcgcaaaaacctaccagcgtttgccgtgcttctgttacacgctttggcttttag

SEQ ID NO: 226589 - DNA, 444 bp, Artificial Sequence
  Description of Artificial Sequence: Synthetic coding sequence
atggcagacaaggtgagaagacagcgtcccagacgacgggtctgctgggctctggttgcagtgctcctagccgacctgctggccttgagtgacacgctggctgtgatgagcgtggacctgggcagcgaaagcatgaaggtggcaatagtgaagcctggggtgcccatggagattgttttgaataaggagtctaggagaaagactccagtgatagtaacactgaaggagaacgagaggttctttggcgatagcgccgcatcaatggctatcaaaaatccgaaagccacgctgaggtactttcagcatctgctggggaaacaggcagataatccgcacgttgctctttaccaggcccgtttcccagagcacgaactgacattcgatcctcagagacaaaccgtgcactttcagatttcatcacagctgcaatttagccccctgtag

SEQ ID NO: 226590 - DNA, 1680 bp, Artificial Sequence
  Description of Artificial Sequence: Synthetic coding sequence
atggcaatcaaaaacccaaaagcaaccctgcgctactttcaacaccttctcggtaagcaggccgacaatccccatgtggcattgtatcaggctaggtttcctgagcacgagctgacttttgatccccagaggcagaccgttcactttcagatttccagtcagttacaattctcccctgaagaggttctgggcatggtactgaactattcccgttcgcttgccgaggatttcgctgagcagcctatcaaagatgccgttattacagtccccgtattcttcaatcaggcagagcgacgggcagttctgcaggccgcacgtatggcaggcctgaaggtgttacagctgattaatgataataccgcaaccgccctctcctacggggtgtttaggcgtaaggacatcaacaccacagcccaaaacattatgttctacgacatgggctccggaagcacagtctgtacaatcgtgacctatcaaatggtgaaaacaaaagaggccggaatgcagccacaattacagatacgtggcgttggtttcgaccgcacgctgggcggtctggagatggaattgagactgagggagaggttggccggattgtttaatgagcaacgcaaaggtcagcgcgctaaagacgtaagggagaaccctcgagctatggctaagctgttgcgtgaagccaatcgactcaagaccgtgctgagcgccaacgccgaccacatggcccagatcgagggcctgatggacgacgttgactttaaagcaaaggttacacgggtggagttcgaggagctgtgtgcagacctctttgagcgcgtaccgggacctgtacagcaggccctgcagagcgctgagatgtccctggatgagattgaacaggtgatcctggtgggaggggcaaccagagtgccgcgagtccaggaggtgctgctgaaagctgtgggcaaggaagaactaggcaagaatatcaacgctgatgaagctgccgcaatgggagctgtttaccaggccgcagctctgtctaaggcctttaaggtcaaaccctttgtggtgagggacgccgttgtgtacccaatcctggttgagtttacaagagaggtggaagaggaaccaggcattcacagcctcaagcacaacaaaagggtcctcttttctagaatgggcccttatccccaaagaaaggtgattacattcaacagatacagccacgattttaacttccacataaactatggggacctcggatttttgggtcccgaagacctgcgcgtcttcggctctcagaacctaacaaccgtgaaactaaagggagtgggagattccttcaagaaatacccggattatgagtccaaaggtataaaagcccactttaatctggatgagtccggagtgctctcactcgatcgggtggagagcgtcttcgaaactctcgtggaggattccgcagaggaagaatcgacactaacaaagctggggaacactatctcctccctctttggagggggaaccaccccagatgctaaagagaacggtacagacacagtacagatgctttttctgtgtccagctcgcctgcctcagtccaaacaggccatcgatcgctttcatacagctgttacatgtatggaacctccttggggcagacgctgtcgcgctagaccagcctggaggctctgctcttag

SEQ ID NO: 226591 - DNA, 2943 bp, Artificial Sequence
  Description of Artificial Sequence: Synthetic coding sequence
atgtggcaaagtcgtgggcctatgctgtttcaccttgggctgtgtgtcggagccgctggcatgatcagagaatggttcgtgcctattcggagggagaaagggagcagattgatctgtccaggcggaactatggccgacaaggtacgtcggcagcgcccacgtcggcgtgtgtgctgggccctggttgccgtcctcctggccgacctgctcgcactgtctgatacactggccgtcatgagcgtggacctgggcagcgaatccatgaaggttgctattgtgaagcctggggttcccatggaaatcgtcttgaataaagaatctaggaggaaaacaccggtcatagtaacgcttaaggagaacgagagatttttcggggactctgccgcaagcatggcaataaagaaccccaaggctactctgcggtatttccagcacctgctcggtaagcaagccgataatcctcacgtcgctctttaccaggccagattccctgagcacgagctcacattcgaccctcaacgacagaccgtccatttccaaatctcgtcacagctgcagtttagtcctgaggaggtgttgggtatggtgctgaattacagccgtagtctggctgaagactttgccgaacagcccatcaaagatgcagtcattaccgtgccagtgttctttaaccaagccgaacgcagagccgtgctgcaggcggcacggatggcaggtctcaaggtccttcagctcatcaacgataacactgcgaccgcattgtcctacggagtgttcagacggaaggacataaacactacagcccagaacatcatgttctacgacatgggttctgggtccacagtctgtactattgtgacgtatcagatggtgaagacaaaggaggcaggtatgcagcctcagctgcagattagaggcgttggcttcgacagaaccttaggcggactcgagatggagctccgcctgcgagagagattagccggactattcaacgaacagaggaagggccagagggcaaaggacgtgcgtgaaaatccgcgagcaatggcgaaactactgagagaggctaataggttgaagaccgttctctctgcaaatgcagatcacatggcacagattgaaggactgatggacgatgttgacttcaaggccaaggtgacacgggtggagttcgaggagctctgcgcggatctgttcgagcgggtaccagggcctgtgcagcaagcccttcagagcgccgaaatgtcactagacgagatcgaacaggtaatcttggtgggcggagccacacgcgtcccgagggttcaggaggtgctgctaaaagccgtggggaaggaggagctgggcaaaaatatcaatgccgacgaggctgccgcaatgggcgcagtgtaccaagctgcggctctgtctaaagcgttcaaggtaaagcctttcgtggtgcgtgacgcagtggtctaccctatcttggttgagttcacccgcgaagttgaggaggaacccggaatccatagtctgaagcataacaaacgtgtgcttttctcccgtatgggcccatatccccagcgaaaagttatcacttttaaccgctacagccatgactttaattttcacattaattacggggacctgggctttctcggccctgaagatctgcgggtttttgggtctcagaatctgacgactgttaagctgaagggcgtgggcgacagctttaaaaaataccccgactatgaaagcaaggggatcaaggcccacttcaacttggacgagtcaggagtcctgagcctggatcgcgtggagagcgtcttcgaaacacttgttgaagattcggctgaggaggaaagtaccctgacaaaactgggcaatactattagttcactctttggaggagggacaaccccagacgctaaagagaacggaactgatacagtccagaagccctccgagaaggcggaggctgggccagagggcgtcgcccctgccccagagggcgagaaaaaacagaaacccgctagaaagcggaggatggtggaggagatcggggttgagttagtggttttagatttacccgacctgcctgaagacaagctcgcccagtccgtgcagaagctgcaggacctcacactccgagatctagagaaacaggaaagagaaaaggccgcaaattcactggaggcatttatctttgaaactcaggacaaactgtaccaacccgaataccaagaggtctccacggaggagcaaagggaggaaatctcaggcaaactttcagccgcaagcacatggttagaagacgagggggttggggcaactaccgttatgttgaaggaaaagctggcggaactcagaaaactgtgccagggactgttctttagagtggaggaacgaaagaaatggcccgaacgcctcagcgctttggacaacctgcttaatcattcctcaatgtttctcaaaggggcacgcctgattcctgaaatggatcagatcttcacggaggtggagatgacgactctcgagaaggtgattaatgagacgtgggcctggaagaatgcgaccctggctgaacaggctaaactcccagctactgaaaaacctgtgttgctgtctaaagacattgaagcaaagatgatggcattagacagggaggttcagtacttgctgaacaaggccaagtttaccaagcccagacccagacccaaggacaaaaacggcacccgcgctgagccccctctgaacgcgtcagcaagtgatcagggggaaaaagtgatccctcctgccggacagacagaagacgctgaaccaatatccgagcccgaaaaagtcgagaccggctctgagccaggtgacactgaaccgttggaacttggcggacccggagctgaaccagaacagaaagaacagtctaccggtcaaaagaggccccttaagaatgacgagttgtag

SEQ ID NO: 226592 - DNA, 333 bp, Artificial Sequence
  Description of Artificial Sequence: Synthetic coding sequence
atggctccacgaggctgtatcgtggctgtgttcgccattttctgtatcagccgactcctatgctcccacggtgcgcctgtggcccctatgactccctatcttatgctctgtcaacctcataaaagatgtggggataaattctatgaccctcttcaacactgctgttatgatgacgcggtcgtgccacttgctcgaacccagacctgtgggaattgtaccttccgagtatgtttcgaacagtgctgcccatggactttcatggtgaaattgatcaatcagaattgcgattccgcacgtaccagtgacgacaggttgtgccgtagcgtgtcttag

SEQ ID NO: 226593 - DNA, 360 bp, Artificial Sequence
  Description of Artificial Sequence: Synthetic coding sequence
atggtgcctcgaatcttcgcacctgcctatgtgagcgtgtgcctccttctgctgtgccccagggaagttattgcacctgcgggttctgaaccgtggctgtgccagccagccccaaggtgtggagataaaatctataaccctcttgagcagtgttgctacaacgacgctattgtttccctgagcgagactcgacagtgcggacccccttgcactttctggccttgttttgaattatgctgcctagattcttttggtctgaccaatgactttgtggttaagcttaaggtccagggggtgaacagccagtgccactcatcaccaatcagttctaagtgcgagtcccgccgacggttcccatag

SEQ ID NO: 226594 - DNA, 393 bp, Artificial Sequence
  Description of Artificial Sequence: Synthetic coding sequence
atgagatttagcgtgtccggaatgcggaccgactatccccgaagcgtgcttgcacctgcctatgtcagcgtctgtcttttactcctgtgccccagggaagtcatagccccagcaggatctgagccctggctgtgccaaccggcaccacggtgtggggacaaaatctacaacccactggagcagtgttgctataacgacgccattgtcagcctgtctgaaacccggcagtgcggccctccctgcacgttttggccctgctttgaactctgttgtctggattcgtttggtctcacaaacgactttgtggtgaagttgaaggtccaaggcgttaacagtcagtgtcattcgagccctatctcctcaaaatgtgagagcagacggcgttttccttag

SEQ ID NO: 226595 - DNA, 378 bp, Artificial Sequence
  Description of Artificial Sequence: Synthetic coding sequence
atgaggcccagatgctgtattttagctttggtttgttggatcacggtatttcttctccagtgtagcaaaggcaccaccgatgcacctgtaggcagtggactgtggttatgccagcccacacctcgttgcggaaacaaaatttacaatccatccgagcagtgttgttatgacgacgctattctgagcctgaaagagacccgtcggtgcggcagcacctgcacgttctggccctgttttgaactgtgctgcccagaaagctttggaccacagcaaaaatttctcgtgaagcttcgagtgctggggatgaagagtcagtgtcacctttcccccatcagtcgctcatgtaccaggaaccggaggcacgtactgtatccctag

SEQ ID NO: 226596 - DNA, 375 bp, Artificial Sequence
  Description of Artificial Sequence: Synthetic coding sequence
atggtccctagaatctcagctgccatcttcattttcgagcttctagggtctaattccgagggtgtgactgatctgcgcttgtggttgtgtcagcccgcacctcggtgcggggaatggacctacaacccactggaacagtgctgtgatgatggtgtgatcctggacctgaaccaaactaggttatgcggttcctcatgcacgttctggccctgttttcagcactgctgccttgagagtctgggctcacagaaccagaccgtggtgcgcttcaaagtgccaggtatgaagcctgactgcaagtctagccccatcactcgcatttgtgcccaggaataccatcccaagagtcccgtcagcagatcagacctgatctag

SEQ ID NO: 226597 - DNA, 1068 bp, Artificial Sequence
  Description of Artificial Sequence: Synthetic coding sequence
atgggaccagggcgatgcctgctgacagcactgctgctactagcgctggcccctcccccagaagcctcccagtactgtgggaggctagaatattggaatcctgacaacaaatgttgctctagttgcctacagagatttggccctccaccctgtccagactacgaatttcgcgaaaattgcggcctcaatgatcatggggatttcgtgacaccgccttttaggaaatgttcatccggtcaatgtaacccagacggagcagaattgtgttccccctgtggcggaggcgctgtgacgcctacccccgctgccggagggggacgaaccccctggcggtgccgtgagcgacctgtgccggctaagggacactgtcccttgactcctggcaacccaggcgcaccctcgtctcaggagcggagcagccctgccagcagtatcgcatggaggacaccagagccggtcccccagcaagcctggccaaacttcctgcctttggtggttctcgttctgctccttactttggcagtaatagccattcttctgttcattctcttatggcatttgtgctggccgaaggaaaaggccgacccttatccgtatccaggtctggtgtgcggcgtccccaatacacacactcctagctcttctcacctctccagcccaggcgcacttgaaacaggggacacatggaaggaagctagcttgctcccccttctctcacgcgagctgagctcactcgcttctcaaccgttgagcagactgctggatgagctagaggtcctggaagagctaatagttttgctcgaccctgaaccagggcctggaggaggcatggcccatggaactacccggcacttggccgcacggtatggcctcccggctgcttggagcacctttgcctatagtctgcggccttcaaggtctccgcttagggcgcttatcgaaatggtcgttgctagagagccctccgcgtcactgggacagctgggaacacatttagctcagctgggaagagccgacgcactccgggtactctcaaagcttggcagctccggcgtgtgttgggcctag

SEQ ID NO: 226598 - DNA, 504 bp, Artificial Sequence
  Description of Artificial Sequence: Synthetic coding sequence
atgggcccaggtaggtgcctgctgacggcactgcttctgctggccttggctcccccacctgaggctagccagtattgcggacgcctggagtactggaacccggataacaagtgctgctcttcctgcctccagagatttggtccccctccatgtcccgagctcagctcccttgcctctcaacctttatcccgcctgctggatgagttagaggtgctggaggaactcatcgtcctgctcgaccctgagccaggcccaggtggcggaatggcacacggaacaactcggcacttagccgcacgctacggcctacccgctgcctggtcgaccttcgcctactcactgagaccctctcggtcccctctgcgcgcactcattgagatggtcgtggcacgagaacccagcgcttccttaggccaactgggaactcacctggctcaactgggcagggctgacgcactgcgggtgctgtctaagttgggatcatctggggtgtgttgggcgtag

SEQ ID NO: 226599 - DNA, 723 bp, Artificial Sequence
  Description of Artificial Sequence: Synthetic coding sequence
atgccagagagagatagtgagccattttcaaaccctctcgcccctgatgggcatgacgtggacgacccgcactccttccaccagtccaagctgactaacgaggacttccggaaactgttgatgactcctagagcggctccgacctcggccccacctagcaaatctcggcaccacgaaatgccccgtgaatacaatgaagatgaggatccagctgctcggaggcgcaaaaaaaagagctattacgccaagttgaggcaacaagaaatcgagcgggaaagagagctcgctgaaaagtatcgagatcgggctaaggaacgtcgggatggtgtaaataaggactacgaggagactgagctgattagcacaaccgcaaactaccgcgctgtgggtccaactgccgaggccgataagtctgccgcagagaaacgacgccaactgatccaagagagcaagtttctggggggtgatatggaacacacccacctggtaaaaggtcttgatttcgccctactgcagaaggtccgtgccgaaatcgctagtaaggaaaaggaggaagaagaactgatggaaaagcctcagaaagaaacaaaaaaggatgaagatcccgagaataagattgagttcaagacaaggctgggtcgtaatgtctaccgcatgctgtttaaatccaaagcttacgagcgtaacgagctatttcttcctggccgaatggctatgtggtag

SEQ ID NO: 226600 - DNA, 1674 bp, Artificial Sequence
  Description of Artificial Sequence: Synthetic coding sequence
atgccagagcgggatagtgagcctttcagcaaccctcttgcccctgatggccatgacgtggacgatcctcactctttccaccagtccaagctgaccaatgaggacttccgcaaactcctgatgactccccgagcagctcctacaagcgcacctccaagcaagtctagacaccatgaaatgccccgagaatacaacgaggacgaagatccagcagccagaaggcggaaaaaaaaatcttactatgccaagctgaggcagcaggagattgaaagagagagggagctggctgaaaaataccgagatcgcgcaaaggagcgacgcgacggcgttaacaaggactacgaggaaactgagcttatctccactaccgccaactacagagctgtaggcccaacagcagaggccgacaaatccgctgctgagaagcgcagacagctgatacaggaatcgaaattcctggggggtgatatggagcacactcatctggttaagggccttgacttcgctttactccagaaggttcgagcggagattgcaagcaaagagaaagaagaggaagagctgatggagaagcctcagaaagagaccaaaaaagacgaggaccccgagaacaaaatagagtttaaaactcggctgggaaggaatgtgtaccggatgctgtttaaatctaaggcttacgagaggaacgagttgtttctccctggaagaatggcctacgttgtggaccttgacgatgagtatgctgatactgatattccaactacactaatccgcagcaaggctgattgtcctactatggaagcgcagaccacccttaccactaacgacatcgtgataagcaagttgacacagatccttagctacctgcgacaaggcacgaggaataaaaaactcaagaagaaggataaggggaaactggaggaaaagaagcctccggaggcagacatgaatattttcgaagatatcggcgattatgttccctccactaccaagactccacgcgacaaggaaagggaaaggtatagggaacgagagagggaccgcgagagggatagagatcgggaccgcgaaagagagcgcgaacgagatcgtgagcgcgaacgcgaaagagacagggaacgggaggaggagaagaaacgccactcctacttcgagaagcccaaagtggatgatgagccaatggacgttgacaagggcccaggatcaacaaaggaactcatcaagtcgatcaatgagaagttcgccggtagcgccggttgggaaggtacagagagcctgaagaaacctgaggataagaagcagctgggtgattttttcggaatgagcaactcatacgctgaatgctacccagccactatggacgatatggcagtcgattctgacgaagaagttgactattcaaagatggatcaggggaacaagaaaggacctctcggcagatgggatttcgatacgcaggaagagtattccgagtatatgaataataaggaggctctgcccaaagccgcatttcagtatggcatcaaaatgtcagaaggaagaaaaacgaggaggtttaaggagaccaacgacaaagctgagctggacaggcagtggaaaaaaatcagcgccatcatcgagaaacgcaagaagatggaggccgatggcgttgaggtgaaacggcctaagtactag

SEQ ID NO: 226601 - DNA, 1560 bp, Artificial Sequence
  Description of Artificial Sequence: Synthetic coding sequence
atggatgctgatgagggtcaggatatgagtcaggtcagcggcaaggaaagcccaccagtctccgatacgccagatgaaggagacgagccaatgcctattcctgaagatctttccaccacaagcggcggacaacagtcttcgaaatctgatcgagtggtggcctcaaacgtcaaagtcgaaactcagtcagacgaagagaatggtcgcgcttgtgagatgaacggcgaggaatgtgccgaagatctgcgcatgctcgacgcatctggtgaaaaaatgaatgggagccacagagatcagggctcttccgcactctccggcgtcggtgggattaggctccctaacggaaagctgaaatgcgacatctgcggcatcatctgtatcgggccaaatgttctgatggttcataagcgttctcacaccggagagagacctttccagtgtaaccaatgcggcgcatccttcactcagaaagggaatcttctgcggcacatcaagctgcatagcggcgagaagccgttcaagtgtcatctgtgcaattacgcctgtcgcagacgggacgccctgaccggtcacctccggacgcatagcgtcggtaagcctcacaagtgcggttactgtgggcgtagctacaaacagcggtcaagcctagaagagcacaaagagcgatgccataattacctcgagtccatgggtttgccagggacactttacccagtcattaaggaggaaactaatcacagcgaaatggccgaggatctgtgcaagatcggttccgagagatctctcgtcctggatcgactcgctagtaacgttgctaaaaggaagtcctcaatgccccagaagttcctgggagataagggcctctctgatacaccttacgattcttctgctagctacgagaaggagaatgagatgatgaaatctcatgtaatggatcaggccataaacaacgccatcaattatctcggcgctgaaagtctgcggccactggtgcagaccccaccgggagggagcgaagttgtcccagtgatttctccaatgtaccaattacacaagcctctagccgaagggacacccagatctaatcactctgcccaagacagcgccgtggagaatttattattgctgtccaaggctaagttggttccctcggagcgggaggcatctccttcaaactcatgccaggattcgaccgacaccgaatccaataatgaggaacagcgcagtgggctcatctacctgactaaccacatcgcgcctcatgctagaaacggactgtctctgaaggaagagcaccgtgcttacgatctcttgagggccgctagcgagaattcacaggatgcccttcgggtagtgagtacatcaggagaacagatgaaggtctacaaatgtgaacactgcagggtgctgttcttagatcatgttatgtacaccatccacatgggctgtcacggctttcgggatccttttgagtgcaacatgtgtgggtaccatagccaggatcgctacgaattcagtagtcacatcacccgaggtgaacatcgatttcatatgtcatag

SEQ ID NO: 226602 - DNA, 1299 bp, Artificial Sequence
  Description of Artificial Sequence: Synthetic coding sequence
atggatgccgatgaggggcaagatatgtcccaggtgagcggaaaggagagcccccctgtgagtgatacacccgacgaaggcgacgagccaatgcccattcccgaggacctctcaactactagcggcggacagcagtcttccaagagcgatagagttgtcggcgagcggccattccagtgcaaccaatgcggagcctcattcacgcaaaaggggaacctgctgcgccacattaagttgcacagcggagaaaagccttttaaatgtcacctgtgcaactatgcgtgtcgtagacgggacgcgttaacagggcatctacgtacccattcggtgggaaagccacacaaatgtggctactgcggaagaagctacaagcagaggtcatctctcgaagagcataaggagaggtgtcacaattatctggagagtatgggcttgcctggaactctttatcccgttatcaaggaagagactaaccactccgaaatggcagaagatctgtgcaagattggctccgaacgctctctggttctggataggctggctagtaatgttgccaaacgtaagtctagtatgccccagaagtttctgggagataaaggcctttccgacactccttatgactccagcgcctcatacgagaaggaaaatgagatgatgaagtctcatgtgatggaccaagctatcaacaacgccatcaactaccttggtgccgagtctctccgacctttagtccagactccaccaggcggttctgaagtggtgcctgttatctccccaatgtatcaactccataaaccattagccgagggcacgccaagatccaatcattctgcccaagattccgccgtggaaaacctactgctcctgtccaaagccaaactggtgccctccgagagggaggcctcccccagcaatagttgtcaggattccacagatactgaaagcaacaatgaagaacagcggagcgggttaatctacctcacaaatcacatcgccccacacgctcgaaacggtctctctctgaaggaagagcaccgtgcgtatgatctgctgcgagctgcttctgagaactcccaggacgctttgcgcgtggtgtccacttcgggagagcaaatgaaagtgtacaaatgcgagcattgcagagtgctgtttctcgatcatgttatgtacactattcacatgggctgtcatggttttagggacccatttgaatgcaacatgtgcggctatcactcccaagatagatatgagttttcttcccacatcacccgaggcgagcacagatttcatatgtcatag

SEQ ID NO: 226603 - DNA, 870 bp, Artificial Sequence
  Description of Artificial Sequence: Synthetic coding sequence
atggatgccgacgaagggcaagatatgagccaggtcagtgggaaagagtcccctcctgtatctgacacccccgatgagggtgatgagcctatgcctattcctgaggacctatcaactacctctgggggtcagcagtcttctaagagcgatcgcgtcgtgggggataagggactcagcgatacaccatacgactcctccgcgtcatatgagaaggagaacgagatgatgaagagccatgtcatggaccaggcaatcaataacgctattaactatctgggggcagaatccctgcggcctcttgtacagacacctccgggaggtagcgaagtcgttccagtcatctcacctatgtatcaacttcacaagcctctagccgaggggactccccgatcaaatcactcagctcaggactcagctgtggagaatctcctactgctgtcaaaagcaaagctcgtaccgtctgagagagaagctagtccgagcaattcttgccaagactcaaccgataccgagtcaaacaacgaagaacagaggtctggcttaatttatctcacgaatcacatcgctccccatgcccgaaacggactgagtctcaaggaggagcaccgagcatacgacctcctgcgggcagcgtctgagaactcccaggacgccttgcgcgtcgtgagcacgagtggcgagcaaatgaaggtttataagtgcgaacactgcagggtgctgttcctggaccatgtaatgtatactatccacatgggatgtcacggctttcgggacccattcgagtgtaacatgtgcggctaccactcacaagaccggtatgaattctcgagccatataacgaggggcgagcacaggtttcacatgtcatag

SEQ ID NO: 226604 - DNA, 1131 bp, Artificial Sequence
  Description of Artificial Sequence: Synthetic coding sequence
atggatgctgacgaaggtcaagacatgagtcaggtgagtggcaaggaatctcccccagtaagcgacacacctgacgagggcgatgagccaatgcccatccctgaagatctatccaccacatctggtggccagcagtcaagtaagtccgatagggtggttgccagcaatgttaaggtcgaaacccagtctgacgaggaaaatggaagggcatgcgaaatgaatggcgaagaatgtgctgaagacctgcggatgctggatgcttctggtgagaagatgaatggctcccatcgagaccaggggtcctctgctctgtccggcgttggaggcattcggctgcccaacggtaagctgaaatgcgatatctgcgggatcatctgcataggaccaaatgtgctgatggtgcacaaaagatcccacaccggtgacaaggggctatctgacacgccatacgactcctccgcgtcctacgaaaaagaaaacgaaatgatgaaatcccacgtgatggaccaagccatcaacaacgcgataaactatttaggagccgagtcgctgcggccacttgtgcaaacccctcctggcggatcagaagtggtcccggtgatcagtcctatgtatcagcttcataaacctctggcggaagggacaccacggagcaaccactccgcccaggactctgccgtcgaaaatcttctcctgttgagcaaagccaagcttgtgccttcagagcgggaagctagcccctccaatagttgtcaggactctaccgacaccgagtctaacaatgaggaacagcgctcaggcctcatctatttgactaatcacattgcacctcacgcccgtaatggactgtcgctgaaggaggagcatagagcctatgatctcctgcgagcagcctctgaaaatagtcaagatgcgctgcgcgttgtgtctacctctggcgagcagatgaaggtgtataaatgcgagcattgccgggtgctgttcctcgaccacgttatgtataccatccacatggggtgtcacgggttccgcgatccgttcgaatgcaacatgtgcggctaccatagccaggaccgttacgagttctcaagccacattacacggggtgagcaccgtttccatatgagctag

SEQ ID NO: 226605 - DNA, 1299 bp, Artificial Sequence
  Description of Artificial Sequence: Synthetic coding sequence
atggatgctgacgaagggcaggacatgagccaggtctctgggaaggaatctcctcccgtgtccgataccccagacgaaggagacgaacccatgcccataccagaagacctgtctactacatccgggggtcagcagagcagcaagtccgaccgcgttgtggcaagtaatgttaaagtcgaaacccagtctgacgaagagaacggaagagcctgtgaaatgaacggcgaggaatgcgcggaagatctgaggatgctggatgcttccggcgaaaagatgaacgggagccaccgcgatcaggggtccagtgctctgtcaggggtgggcggtatccgattacccaatggcaagctgaaatgcgacatctgtggaataatctgtatcgggccaaacgtcctcatggtgcacaagcgttcgcacaccggggagcgtccgttccagtgtaaccagtgtggagccagctttacgcagaaaggcaatctgctgagacatatcaagttacactcaggcgagaaacctttcaagtgccatctctgtaactatgcatgccgccgtcgcgacgcattaaccggacacctgcgcacccattctggggacaagggcctgtctgataccccttacgactcgtcagctagctacgagaaggaaaatgagatgatgaaaagccacgtgatggaccaggctattaacaacgcgatcaattatttaggtgcggagagcctgagaccgctcgtgcagacccccccagggggaagcgaggtggtccctgtcatctctcccatgtatcagctgcataagccccttgccgagggaactcctcgtagtaaccacagcgcacaggattcagcagtggagaacctgctgctgctaagcaaggctaagctggtcccttccgagcgcgaggcaagccctagcaactcttgccaagactctaccgatacagaatcaaacaacgaggagcaacgaagtggtttgatatacctgaccaaccacattgctccccatgccaggaacggactgtcacttaaagaggaacaccgggcatacgatctgctacgagctgcctcagagaattctcaggatgccctcagagtggtgtctacttccggagaacagatgaaggtgtataagtgtgagcactgccgcgtgttgttcttggatcatgtgatgtacacgattcatatgggctgtcacggatttcgggatccctttgagtgtaatatgtgcggctatcattctcaagatcgatatgagttctcatcccacatcacaaggggcgaacatagattccatatgagctag

SEQ ID NO: 226606 - DNA, 1434 bp, Artificial Sequence
  Description of Artificial Sequence: Synthetic coding sequence
atggatgcagacgaaggccaggatatgagccaggtgtccggcaaagaatcccctcctgtgtcagacacgcccgacgagggagacgaacctatgcccatccctgaggatctgagcactaccagcggcggacagcaatcctctaagagtgaccgggtcgtcgcctcaaacgtgaaggtggagactcagtctgacgaggaaaatgggagggcttgcgaaatgaacggagaggaatgcgccgaagaccttagaatgttggacgcttcaggcgaaaaaatgaacgggagccaccgtgatcaaggctcctccgccttatctggtgtggggggaatccgcctcccaaacggaaaactgaaatgcgacatatgcggtatcatttgtatcgggccaaacgtgctgatggtgcataaaagatcacataccggcgaaaggcctttccagtgtaaccaatgtggggcatcctttacgcaaaagggcaatttactgaggcacatcaagctccatagcggggagaagccattcaagtgccatctgtgtaattatgcatgtaggaggagggacgcactgactggccacctgcggacccactctgtcattaaagaagaaaccaaccactcagaaatggctgaggacctgtgcaagattggtagtgagagatcgctcgtgttggaccgcttggcgtccaacgtggcgaagagaaaatcaagcatgcctcagaaattcctcggagacaagggtctctctgatactccctacgattcatccgcctcctacgaaaaggagaacgagatgatgaagagtcatgttatggaccaggctattaacaatgcgatcaattacctgggagcggagtcactgaggcccttggtccagacaccacctgggggttctgaggtggtgccggtcatcagccccatgtatcaattgcataaaccactggccgaggggacccctcggagtaaccacagcgcccaggactcagcagtggagaatctgctgttgctttctaaggctaagctggtccccagtgaacgtgaggcaagtcctagtaactcctgtcaggactccaccgatacagaatctaataatgaagagcagcgctcaggcctgatttacctcactaatcacattgcgccacacgccagaaacggcctctccttaaaagaggagcacagagcatatgatctcctgcgcgctgcctctgagaactctcaggatgccctgcgggttgtgtccacatccggagaacagatgaaggtttataagtgcgagcattgcagagtcctatttctggaccatgtgatgtacacaatccacatgggatgtcacggattccgtgatccatttgaatgcaatatgtgtggatatcactctcaagaccgctacgaattctcttcacacataacgcggggtgagcacagattccacatgagctag

SEQ ID NO: 226607 - DNA, 1299 bp, Artificial Sequence
  Description of Artificial Sequence: Synthetic coding sequence
atggacgccgatgagggccaggatatgtcacaggtgagtgggaaggagagcccaccggtgtccgatacgcccgatgaaggagacgagccaatgcctatcccagaggatttgtcaactactagtggcggtcaacagtcatctaaatccgacagggtagtcggcgagaggcctttccagtgcaaccagtgtggcgcttcctttacgcagaagggcaacttgctgagacatattaagttacatagcggcgagaaaccattcaaatgtcacctgtgcaactatgcctgtcgccgaagagacgccttgaccggacacttacgaacccactcagtcggaaaaccacacaaatgcgggtattgtggacggagttacaaacagaggtcaagcctggaggagcacaaggagcgatgtcataattatttggaatctatgggattacccggaaccctgtatcccgtcataaaagaagagacaaaccatagcgaaatggccgaagatctctgtaagatagggagcgagcgaagcctcgtgctcgatcgactggcgtcgaacgtcgcaaagaggaagagctccatgccccaaaaatttttgggtgataagggactgtccgacacaccttacgacagtagcgcctcttatgagaaggaaaacgaaatgatgaaaagccatgtgatggaccaggccataaacaacgccattaactatctgggagcagaaagcctacggccattggttcagacacctccaggcggttctgaggtggttccagtaatctctccaatgtaccagctccacaagccactggctgagggcacccccagaagcaatcacagcgcccaggactctgccgtagagaacctcctgctcctgtcaaaagccaagctggtgccatcagaaagggaggcgagcccaagtaacagctgtcaggatagcacagatacagaatctaacaacgaggagcagagaagtggactgatctacctaacgaatcacattgcaccccacgccaggaatgggctttcactcaaggaggagcatagagcatacgatctcctccgggcagccagtgagaactcccaagacgccctgagggtagtgagcacgtcaggagagcaaatgaaggtatataagtgcgaacattgtcgagtgctgttcttagaccacgtgatgtacacaattcacatgggatgccacggcttccgagacccgttcgagtgtaatatgtgtggctatcattcacaagatcgctatgaattttccagccatatcactcgcggtgaacaccgcttccatatgtcctag

SEQ ID NO: 226608 - DNA, 1434 bp, Artificial Sequence
  Description of Artificial Sequence: Synthetic coding sequence
atggacgccgacgaggggcaagatatgtcccaggtgtccggtaaagaatccccacccgttagcgacaccccggacgaaggagacgaacccatgccaattccagaggacctgagcaccacctcaggcggtcagcagagttctaaaagcgaccgagtggtggcaagcaatgtaaaggtggagacccagagcgacgaagaaaatggaagagcttgtgaaatgaacggagaggagtgcgcagaggatctaagaatgctcgacgctagtggcgagaagatgaatggtagccatcgcgaccagggaagcagcgcactgagtggagttggtggaatccgtctgccaaatggtaagcttaagtgcgatatctgtggaattatctgcataggaccgaatgtgctgatggtgcataagagatcccacacaggggagaggccattccagtgcaaccagtgcggcgcttccttcacgcagaagggtaatttgctgaggcacatcaagctgcactcgggggaaaaaccatttaagtgtcatttgtgcaactatgcttgccgaagacgcgatgctctcactggacacctgcgcactcatagtgtaattaaggaagagaccaatcacagtgagatggccgaggacctttgcaaaatcggatcagaacggagtctcgtgcttgatcgtttggcatccaatgtagccaagcggaagtctagtatgccacagaagtttttgggagacaaaggactcagcgatacaccatacgactcatctgccagctacgagaaagaaaacgagatgatgaagagccacgtgatggatcaggctatcaataacgccatcaattacctgggagcagagtccctgcgacccctggtccagacacccccaggcggttccgaggtggttcccgtgatttcgcccatgtaccagctgcacaaaccgctcgcagagggaactcctaggtccaaccactctgcccaagatagcgcagtggaaaatctgctcctcctgtcgaaggctaagctggttccctccgagagggaggccagcccctcaaactcctgtcaggattcgacagataccgaatccaacaacgaggagcagagatccggcttgatttacctcaccaaccacatcgcccctcacgccagaaacggactgtcactgaaggaggagcacagagcctacgatctcctgcgagctgcctctgagaacagtcaggacgcgcttcgagtggtgtccacctccggcgagcagatgaaagtttacaagtgcgagcactgtagagtgctcttcttagatcatgtcatgtacacaatccacatgggttgccatgggttcagggatcccttcgaatgcaatatgtgcgggtaccacagtcaggatcgatatgaattttcatcccatatcactagaggggagcatcgtttccatatgtcctag

SEQ ID NO: 226609 - DNA, 681 bp, Artificial Sequence
  Description of Artificial Sequence: Synthetic coding sequence
atggatgccgacgaggggcaggacatgtcacaggtgtctggcaaggaatcccctcctgtcagtgacacgcctgatgagggagacgagccaatgcctatccccgaagatcttagcacaacaagcggtggccagcagtctagtaaatccgatcgagtggtggcgtccaatgttaaagtggagacacagtccgacgaggagaatggacgggcatgcgaaatgaatggggaagagtgtgctgaggatctgagaatgctagacgctagtggcgaaaaaatgaatggctcccatcgggaccaaggaagcagcgctctgagcggggtggggggtatcaggttgcccaatggcaagctcaaatgtgatatttgcgggattatctgtatcgggcctaatgtgctcatggtgcataagcgaagtcacaccggggagaggccttttcaatgtaatcagtgcggcgcttccttcactcaaaaaggaaatcttctacgtcacattaagctccacagcggagagaaaccgttcaaatgccacttgtgcaattacgcttgcagaaggcgcgacgcccttaccggtcacctccgcacgcattctgtgatcaaggaggagacaaatcattccgagatggcagaggacctctgcaagatcggcagcgaaatcagccgggctggccaaacttccaaatag

SEQ ID NO: 226610 - DNA, 1758 bp, Artificial Sequence
  Description of Artificial Sequence: Synthetic coding sequence
atgcataccccaccagcgctgcccaggcggttccaaggaggaggcagagtgcgaacacccggatctcataggcagggcaaggataatttagagcgtgacccatctggaggctgtgtgcccgacttcttaccacaggcacaggattccaaccattttattatggagtccttattctgtgaatcttccggggactcatccctggagaaggaattcctcggagccccagtaggcccaagtgtttccactcccaattctcagcactccagcccatcccgctctttgtccgccaatagcatcaaagtagaaatgtactcggatgaagaaagcagtagacttctgggtccagacgagagactgttagagaaagacgactccgtgatcgtggaagattctctgtcggagcctctgggatattgtgatggcagcgggccagagccccatagccccggaggaattcgtctccccaatgggaagctgaagtgtgatgtttgtggcatggtgtgtataggccctaatgtgctgatggttcataagcgatcacataccggtgagagaccattccactgcaaccaatgcggtgcctcctttactcaaaagggaaatttgttgaggcatataaagctgcattccggcgagaagccattcaaatgtcctttctgcaattatgcctgccgcagacgagacgctcttacaggccatttgcgcacacactctgtgtcatcccctactgtgggcaagccttataagtgcaactactgtgggagatcatacaaacaacagtccaccttggaagagcacaaggagaggtgccacaactaccttcagtctctgtcaactgaggcccaagctctggctgggcagcccggagatgaaattcgtgatctcgagatggttcctgacagcatgctgcactcgtcatccgaacgcccaactttcatagaccgactggctaattctctgacgaaacgtaaacggagcacacctcagaagtttgtgggggagaagcaaatgagattttctctatccgatctcccatacgacgttaactctggcggatacgagaaggatgttgagcttgtcgcacaccatagtctggagccgggattcggaagctccctcgccttcgttggggctgagcacctcaggcccctaaggctgcctcctacgaactgcatcagcgagctcacacctgtgatatcatcagtgtatactcaaatgcaacccttacccggtagattagagttacccggaagcagggaagcgggtgagggcccagaggatttggccgacggtggccctctactgtacaggcccaggggccctctgacagatcctggggcaagccccagcaatggttgccaagactcgactgatacagagagcaaccacgaagaccgggtagcaggggtcgttagtctgcctcagggccctccccctcagccgccaccaactatagtggtggggagacacagccccgcatacgccaaggaggacccgaagccacaggagggtctgttgcgtggcaccccaggaccgagcaaagaggtccttagagtggtgggcgagagtggagaaccagtgaaagctttcaagtgcgagcactgcagaatcctctttctggaccacgtgatgttcacaatacacatggggtgccatggcttcagagaccctttcgaatgtaatatctgtggctaccatagtcaagaccggtacgagttctcctcacacatcgtgagaggcgagcacaaagtcggttag

SEQ ID NO: 226611 - DNA, 1452 bp, Artificial Sequence
  Description of Artificial Sequence: Synthetic coding sequence
atgtattccgatgaagaatcttcaagactcttggggcctgacgagagactgctggagaaggacgattctgtcattgtggaagactctctgagcgaacctctgggctactgcgacgggagtggtcctgaaccccactctcccggtggcattcgacttccaaacggtaaactcaagtgtgacgtgtgtggcatggtatgtatcggcccaaacgttctcatggtccacaagcggagccacacgggggagcgcccttttcactgcaaccagtgcggcgcatcgttcacacaaaaaggtaatttgctgcgtcatatcaagctccactcaggcgagaaacctttcaagtgtcccttttgcaattacgcctgcaggcgacgggatgctcttaccggccacctgagaacccattctgtgagctcgcctaccgtgggaaaaccctacaaatgtaactattgcggcagaagctacaagcagcagtccacccttgaggaacataaggagagatgtcacaactatctccagagcttgagcacagaggcacaggcgttagcaggtcagccaggcgacgagatcagggatctggaaatggtccctgattctatgttacatagcagtagtgaacgcccaacttttatcgaccggttagctaacagcctgactaaaaggaagcgctctactccccagaagttcgttggagaaaagcagatgaggttctctctctcagatttaccctacgatgtgaactcaggtggatacgaaaaggacgtggagctcgtggcacaccattctcttgagccaggcttcgggtcctctctggcctttgtcggggctgaacacctgcgacctctgcgcctgcccccaacgaactgtatctcagagcttacgcctgtcatctcgtctgtgtatacgcagatgcaacctctgccaggccgtttagaactacctggctcaagagaagccggagaaggcccagaagatttggccgatggaggcccactgttgtacaggcccagaggaccactcacggacccaggagccagcccctcaaacggctgtcaggacagtaccgacacagaaagtaatcatgaggaccgcgttgccggagttgtgtctttgccgcagggtcctccaccccagcccccaccaactatagtcgtagggagacactcgcctgcgtacgctaaggaggatcctaaaccgcaggaaggacttctcagaggtactcccggacctagcaaagaggttctccgagtcgttggggaatccggtgaacccgtgaaagcctttaaatgtgagcactgtaggattttgtttttggaccatgtcatgttcacaatccatatgggatgccacggatttcgggatcccttcgagtgcaatatttgcggctaccacagtcaggacagatacgagttctctagccatatcgtaagaggggaacataaagtcggctag

SEQ ID NO: 226612 - DNA, 1758 bp, Artificial Sequence
  Description of Artificial Sequence: Synthetic coding sequence
atgcacacaccgccagctttgccaagacggtttcaaggcggtggtagagtcagaacgccgggatcgcacagacagggaaaggataatttagaaagagacccaagcggtggctgtgtccccgatttccttccccaggctcaggatagtaaccatttcattatggagtctctattttgcgagtcgtccggcgatagctctttggagaaagagtttttaggcgctcccgtggggccttctgtaagtactccaaatagccaacacagttcccccagcagaagcctgagtgccaactctatcaaggtggaaatgtacagcgacgaggaatccagccgtctgctcggcccagatgaaaggttattggaaaaggacgacagcgtgatagtggaggatagcttatcagagcctctgggatattgtgatggcagcgggcctgagcctcattcaccaggcggaatccgcttacctaatgggaaactaaagtgtgatgtatgtggcatggtttgcatagggccaaacgtcctgatggtgcataaacggtcacatactggggagagaccattccactgtaatcagtgcggggcatcatttacccaaaaaggcaatttgcttaggcatataaagttgcatagcggtgagaagccattcaaatgcccattctgcaattacgcatgcagacggagggacgctttgaccggccatcttcgtacacatagtgtaagctcacctaccgtaggcaaaccatataagtgcaactactgtggccgtagttataagcagcagagcacgttagaagaacataaggagagatgtcacaactatctccaaagccttagcaccgaagcgcaggccttagccggacaacccggtgacgagatccgcgatctggagatggtccccgactccatgctacactcctcttccgaaagaccaacattcatcgatcggctcgccaattctctaaccaaacgcaagagatcaacaccccaaaagttcgttggtgagaaacaaatgcgcttcagtctgtcagatttgccctatgatgttaatagtggcggttacgagaaagacgtggaacttgttgcccaccattcccttgaaccagggtttggatcatccctcgctttcgtgggagccgagcatctcaggccgctgcgcctcccaccaaccaactgcatctcagaactgacgcctgtgatcagctccgtgtatacgcagatgcaacccctgccgggacgactggagctgcctggcagcagagaggctggagaaggccctgaggatttggctgacggcggaccactgctgtatcgacctaggggtcccctgaccgatccgggtgcctctccttctaacgggtgtcaggattccactgacacagagtctaaccatgaggatagagttgcaggcgtggtgtctcttccccagggcccaccaccacagccaccacctaccattgtcgtggggcgacacagccccgcttatgccaaggaggatcccaagccccaggaggggttgttgagaggcaccccgggaccttcaaaagaggtgctccgcgtggtgggagagagcggagaacccgtgaaagcctttaagtgcgagcactgtaggatcctcttccttgatcacgttatgtttacgattcatatggggtgtcacgggtttagggacccgttcgaatgcaacatctgtgggtatcatagccaggaccggtacgagtttagctcacatattgtccggggagaacacaaggtggggtag

SEQ ID NO: 226613 - DNA, 33 bp, Artificial Sequence
  Description of Artificial Sequence: Synthetic coding sequence
atgcacacacctcctgcgctaccacggagatag

SEQ ID NO: 226614 - DNA, 1863 bp, Artificial Sequence
  Description of Artificial Sequence: Synthetic coding sequence
atgaacaactttattttgcttgaagagcagctcatcaaaaagagtcaacagaagaggcgaacaagcccaagtaattttaaggtgagattcttcgtgctcactaaggctagcctcgcctactttgaagacagacatgggaaaaaacgcactctcaaggggtccatcgaactcagccggataaaatgtgtcgagatcgtcaagagtgatataagcattccctgtcactacaagtaccctttccaggtggtccacgataattacttgctatatgtcttcgctcctgatagggagtctcggcagcgctgggttctggcgctgaaagaggaaaccaggaacaataactccttggttcccaagtatcacccgaatttctggatggacgggaaatggcgctgttgctctcaacttgagaaactagcgaccggttgcgctcaatatgatcccaccaaaaacgcctcgaaaaagcccctcccacccacaccagaggataatcgccgacccttgtgggaacctgaggagacagtggtcattgcactatatgattatcagacaaacgacccgcaagagctggcccttagacgaaacgaagagtactgtttgctggattccagcgaaattcattggtggagagttcaggatcgaaacggacatgagggctatgtaccttccagctatctcgtggaaaaaagccctaataatcttgagacctacgagtggtataataagagcattagcagggataaggctgagaagctgctcctggatacaggaaaggagggcgctttcatggtacgagatagcaggaccgcgggaacctatactgtcagtgtctttaccaaggccgttgtgtccgagaacaatccttgcataaaacattaccacatcaaggagactaatgataacccgaaacgctattacgtcgctgaaaagtacgtctttgatagcattccgctcctgatcaactatcatcagcacaacggtggcggactcgtcacacgacttaggtatccagtgtgcttcggcagacagaaggctccggtgacagccggactcaggtacggtaaatgggtcatagacccgagtgagctcactttcgttcaggagattggcagtggccagtttggcctggtgcacctcggatattggctgaacaaggataaagtggctattaaaaccattcgtgagggcgctatgtccgaggaagacttcatcgaggaagccgaggtgatgatgaagcttagccatccaaaacttgtccaattatacggcgtctgcctcgagcaggctcccatctgcttagtttttgaattcatggagcacgggtgcctatcagattatctgcgtactcagaggggcctgtttgccgcagagacactactgggaatgtgtctagatgtgtgcgaaggcatggcatacttggaggaggcctgcgtgatccatcgagaccttgctgcacgaaactgtctcgtaggggagaaccaggtgataaaggtgtcggacttcggtatgactcgcttcgtgttggatgatcagtacacaagttccaccggcacaaagtttccggtgaaatgggcatcgcccgaggtgttcagcttctcaagatattcatcaaagagtgacgtgtggtcattcggcgtcttgatgtgggaagtcttctccgagggtaagatcccttacgaaaataggagcaattctgaggtggtggaagacatttctacaggctttcggttatataagcccagactggcaagcacccacgtgtaccagattatgaatcactgctggaaggagcggcctgaggaccggccagcgttctcaagactgctgcgacagctggccgaaattgcagaatctggattgtag

SEQ ID NO: 226615 - DNA, 1899 bp, Artificial Sequence
  Description of Artificial Sequence: Synthetic coding sequence
atggagaccccagccgctgccgctccagctggcagcctcttcccttcattcctacttctcgcctgtggaaccctcgttgctgccctcttgggggcagcccacaggctcgggttgttttatcagttgctccacaaagtggataaggcttccgttagacacggaggggaaaatgttgcggctgtgctgagagcacacggagtgaggttcatttttactttggttggcggacacatatcccctctgctggtggcttgtgagaagctcggaatccgagttgtcgacactaggcacgaagtgactgccgtgttcgccgctgatgcgatggcacgattgagcggaaccgtgggtgtggctgcggtcaccgccggtccagggctgaccaacacggtgacagcagtgaaaaacgcccagatggcacaaagtcccattctgctgctagggggagcagctagcacgctgctgcagaaccgcggagcactgcaggccgttgatcaactgtcactgttccgccctctgtgtaaattttgcgtcagcgtgagacgcgttcgtgacattgtccccaccttgcgggcagctatggcagctgcccaaagtggcactcccggaccggtgtttgttgagctgccagtggatgtgctgtacccatatttcatggtccagaaagaaatggtccctgcgaagcctcccaagggtctggtggggagggtggtgagttggtatctggagaattacttagccaacctgttcgccggagcgtgggaaccgcagcccgagggcccattgccactcgatatacctcaggcttcaccccaacaggttcaaagatgcgtcgagatcctatcccgcgcaaaacggccactcatggtgctcggctcacaagctctgctcactccaacttctgcagacaagttgcgggctgccgtagagacacttggggtaccctgttttctaggcggtatggcaagaggtctgctcggtcggaaccatcccctgcacatacgcgagaatcgctcagcagcgctcaagaaagcagatgtaatcgtcctcgcagggacggtgtgtgattttcggctctcatatggaagagtgctctcgcacagttctaagattattatcgttaaccgcaatagagaagaaatgctgctgaattccgatatcttttggaaaccacaggaagccgttcagggtgatgtggggtcctttgtactcaagctcgtggagggactgcaagggcagacatgggcgcctgattgggtcgaggaactcagggaagctgatagacaaaaagaacagacgtttcgtgagaaggcagcgatgcctgtcgctcaacacctgaatccggtacaggtgcttcagctggtcgaagagaccctccctgacaactccattctggttgtggacggaggcgacttcgtcggcaccgccgcacatctggtgcagccccgtggtccgttaagatggctagaccccggagcctttggcactttaggggtgggcgcaggctttgcccttggagcgaaactttgccgtcctgacgcggaggtctggtgtctctttggcgatggagccttcgggtacagcctgatcgaatttgatacttttgtgcggcataagatccctgttatggccttggtcgggaatgacgccggatggacacaaatttcccgcgaacaggtgccttcattaggtagtaacgttgcatgtggactggcgtacactgattaccataaggctgccatgggtctcggagccagaggcctcctcctcagccgggaaaacgaggatcaggttgtcaaagtcctccacgatgcccagcaacagtgccgggacggccatcccgtggtggtcaacattcttattgggagaacagattttcgtgatggctccattgcagtgtag

SEQ ID NO: 226616 - DNA, 678 bp, Artificial Sequence
  Description of Artificial Sequence: Synthetic coding sequence
atggagactcccgctgccgcagcccctgctggttcactttttccaagttttctcttgctcgcatgtggaacccttgtcgccgcattgctaggggctgctcaccggcttggattgttctaccagctgctgcataaggtggataaggcctctgtccgtcacggcggagaaaacgtggccgcagtgctccgtgcccatggagttcgctttattttcaccctggtgggaggtcatatctcccccttacttgttgcttgtgagaaactgggaattagagtcgtagatacgcgacacgaagtgactgccgttttcgcagccgacgctatggctcgcttgtctggtacggttggcgtggctgctgtaaccgcaggacctgggcttactaacacagtgacagcggtcaaaaatgcccagatggctcagagccctatccttttgttgggaggggcagcatcgacattgctgcagaaccgaggggctctgcaggccgtagatcaactctctctcttccgtccaccccctgggtgcggacagcacccccactgggaagatgggctgcctcggtggctgcactgttgcattggaccttgcggatccggcaggctggccgcattcctgcccctggactgtgtgcaattagtgtggtctctgatcatcgcctgccctggaccgattccctag

SEQ ID NO: 226617 - DNA, 789 bp, Artificial Sequence
  Description of Artificial Sequence: Synthetic coding sequence
atggagacaccagctgcggctgctcccgcaggatctctgtttccatcttttttactgctggcttgcggtactcttgtcgccgctctgttgggtgcagctcatcggctcggccttttctatcagctcctgcataaagtggacaaagccagcgttcgccacggcggagaaaatgtcgccgctgtcctgcgcgctcacggagtccgatttatcttcacgcttgtgggcggacacataagcccactgcttgttgcttgcgagaaacttggcatcagagtggtggacacacgacacgaggtgacagctgtgttcgccgctgacgcaatggcaagactgtctggaaccgtgggggtggcggctgtgacagctggacccggactgacgaacacggtgactgccgtaaaaaacgcccagatggcacagtcccccattctgctcttgggtggcgctgcatctacactcctgcagaaccgaggcgcactccaggctgttgatcaactgtcccttttccgcccactgtgcaagttttgtgtgagcgtaaggcgtgtgagggacattgtgcctactcttcgcgctgcaatggccgctgcacaatccggcacccctggccctgtcttcgtcgaactgcctgtagatgtgctgtacccatatttcatggtgcagaaggagatggtgcccgctaaacctccaaagggcctcgttggcagagttgtcagctggtatctagagaactatctcgcaaatctgtttgccggagcctgggagccccagccagaagggccactcccttag

SEQ ID NO: 226618 - DNA, 501 bp, Artificial Sequence
  Description of Artificial Sequence: Synthetic coding sequence
atggagacgcccgcagccgctgcacccgcagggagcttgttccctagctttctgctgctagcctgcgggacgctcgttgcagctctgctcggcgctgcacataggctggggttgttttaccagctgctgcataaagtcgataaagctagtgtccggcacgggggagaaaatgtggccgcagtgcttagggcgcatggcgttcggttcatctttacgctggtaggaggacatatctcccccctgctggtggcttgcgagaaactgggcatcagagtggttgacacgaggcacgaggtgaccgccgtctttgcggcagatgccatggcccgtctttccggaactgtcggcgtggcggcagtgacagctggccctggattaactaacaccgtgacagcagttaagaacgcccagatggcgcagtcccccatactcctcctaggcggagctgcttccaccctgcttcagaaccgaggcgctctacaggctgtggaccagctttag

SEQ ID NO: 226619 - DNA, 621 bp, Artificial Sequence
  Description of Artificial Sequence: Synthetic coding sequence
atggccgcaactagatgtttgaggtggggtctgagtagagcaggtgtgtggctgctacctcctccagcaaggtgcccccgaagagccttacacaagcagaaggacgggacagagtttaaatccatttattctctcgataagctttaccccgaaagtcaggggtccgatacagcctggcgcgtgccaaatggagccaagcaggctgactcggatatcccactggaccgccttaccatctcatattgtagatcatccgggccaggaggacaaaacgtcaataaagtgaattctaaggccgaggttagatttcacctggccaccgccgagtggatcgctgagcccgttcgccagaagatagctattactcacaagaataagatcaatcgactcggtgagctcatcctgacctcagaatcttcacggtaccagtttaggaatttggccgattgtttgcagaaaatcagagacatgattactgaagcctctcagacccccaaagagccaacaaaagaggatgtgaaactacatagaattcgcattgaaaatatgaatagggagcgcttacgccagaagcgcatccactctgcggtgaagactagccggagagttgacatggactag

SEQ ID NO: 226620 - DNA, 471 bp, Artificial Sequence
  Description of Artificial Sequence: Synthetic coding sequence
atgtgccattcacgcagctgtcatcccactatgaccattctgcaggcacctacccctgcacctagtacgatccccggacccagacgtggctcgggacctgaaatcttcacctttgatcctctgcccgagcccgctgcggctcctgctggccgaccatccgcaagccggggtcaccgcaagcgtagcagaagggtgctttatcctcgagtagtccggagacagttgcctgtcgaagagcctaatcccgctaagagactgctgtttctgctgctaacaatcgtgttctgccagattctcatggctgaagagggagtgcctgcaccgttgccaccagaagacgctcctaatgccgcttccttagcccctacaccagtctctgcggtcttggagccgtttaacttgaccagcgagcctagtgattacgcactggacctcagcacttttttgcagcaacatccggcagctttctag

SEQ ID NO: 226621 - DNA, 417 bp, Artificial Sequence
  Description of Artificial Sequence: Synthetic coding sequence
atgtgtcattctcggtcttgtcaccctacaatgacgattctgcaagcacccacccccgcacctagcactataccaggccctcgcaggggttcaggaccagagatcttcaccttcgacccccttcctgagcctgcagccgcacccgctggtaggcccagcgccagccgtgggcatcggaaaaggtctaggcgcgttttataccctagggtggtgagtattgcggaagtgggcattcgtggcgtccgatgtccgggagttactggcgaacggcctgactcacggggtctggacctgacctgcttactgttctgtttgcccctggggcctgcaccagctgcttctagaggtaccgagccctctcagaaagcatccctttccgccgctcaccaccgcttgctgccagacccggatggctag

SEQ ID NO: 226622 - DNA, 579 bp, Artificial Sequence
  Description of Artificial Sequence: Synthetic coding sequence
atgtgtcattccaggagttgtcacccgaccatgactattctccaggcaccgactcctgccccatcaactattcctgggccacggagaggctcagggcctgagattttcacgtttgaccccttgccggaacctgcagccgcaccagcgggacgccctagtgccagccgcggtcatcgaaagaggtcccgccgtgtgttaccgtcgagcggagagtaccgacgctcagggcacagtaggggcgctctgccgtggagccattgggggaccacacgtctgcaggggcttgacctgacatgtctgttgttctgcctccccctggtgcggagacagttgcctgtagaggagcctaatcccgcaaagaggttgctgttcttactgttgaccatcgttttctgccaaattctcatggctgaagagggcgtgcccgcacccctcccacctgaggatgccccaaatgctgctagtctcgcacccaccccagtgagcgccgtgttggaaccgttcaacctcacaagcgagccgagcgactacgccctcgacctgagcacatttctgcagcaacaccctgccgctttctag

SEQ ID NO: 226623 - DNA, 471 bp, Artificial Sequence
  Description of Artificial Sequence: Synthetic coding sequence
atgtgtcattcacgaagctgccatccaaccatgactattctgcaggcacctactcccgctccttccacaattcctggacctcgccgaggctcgggccctgagattttcactttcgatccactcccggagcccgcagctgcccctgctggtaggcccagtgccagcagggggcaccgcaaacggagtcgcagagtgttatatcctcgcgtggtaagacgccaacttcccgttgaggagccaaatcctgccaagagattgctcttcctgctacttacaatcgtcttctgccagattctgatggctgaagagggagtgcccgctccgctgcctccagaggacgcccctaacgcagcctccctcgcacccaccccagtcagccctgttctggagccctttaatttgaccagtgagccttctgattacgccttggatttgtcaacttttctgcagcaacaccccgcagctttttag

SEQ ID NO: 226624 - DNA, 417 bp, Artificial Sequence
  Description of Artificial Sequence: Synthetic coding sequence
atgtgccactcgagatcttgccacccgaccatgacgatcctgcaggcacctacccccgctccctctacaattcctgggccaagacgaggtagcggcccagaaatattcacctttgatcccctgcctgaacctgccgcagctcccgcaggcaggccttccgcttctcgcggtcacagaaagaggagccgccgagtgttataccctcgggtggtgtcaatagctgaggttggaatcagaggtgtgcggtgccccggtgttaccggggagaggcccgacagccggggactggacctgacctgcctgctgttttgccttcctctcggccctgctcccgctgcatccagagggaccgagccatcccagaaagcttccttgtccgcagcgcaccaccggttactgccagatcccgatggatag

SEQ ID NO: 226625 - DNA, 417 bp, Artificial Sequence
  Description of Artificial Sequence: Synthetic coding sequence
atgtgccatagtcgctcttgccatcctacaatgacaatattgcaggctcccacccctgctccttcaacgatcccagggccaaggaggggcagtgggccagaaatctttacctttgaccctttgccggaacctgccgctgcgcctgctggcagaccaagcgcgagtcgagggcataggaagcgctcgcggagggttctctacccacgagtggtgtcgatcgccgaggttggcatcagaggcgtacggtgtcctggagttacaggggagcggccagatagtagagggctggacctgacttgcctgctgttttgtctccccttgggccctgctccagccgcatctcgcggaaccgaaccctcccagaaagcgtctctcagcgcggcacatcataggcttctgcctgacccagacggctag

SEQ ID NO: 226626 - DNA, 471 bp, Artificial Sequence
  Description of Artificial Sequence: Synthetic coding sequence
atgtgtcatagcaggtcttgtcatcctacgatgaccatcttgcaagcccctacccctgccccatcgactattccagggcctcggcgtggaagcggccctgaaatattcactttcgaccctttgccagaaccggctgccgcacctgctgggcgtccctcagccagccgcggtcatagaaagcgatcccggagagtgctctatccaagggttgtgcggcgacaactgcctgtagaagagccgaatcctgccaagagattgctgtttcttctcctgactatcgtgttttgtcagattctaatggctgaggaaggggtcccagcacccttacccccagaggatgcacccaacgcagcgtccctggcacctacccccgtgtctcccgtgctcgagccgttcaatttaaccagtgaaccctcagattatgccctggaccttagcaccttccttcagcagcaccccgcagcgttctag

SEQ ID NO: 226627 - DNA, 417 bp, Artificial Sequence
  Description of Artificial Sequence: Synthetic coding sequence
atgtgccactctagaagttgtcatccaaccatgactattttacaggctcctactcccgctcccagtacaatacccggacctcgccgtggtagcgggcctgaaatctttacattcgatccgttgcccgaacccgctgccgcacctgccggtcggcctagcgcctcgagaggccataggaaaagatctaggagagtcctgtacccacgggtggtttctattgccgaagtgggaattaggggtgttcgctgtcccggagtcaccggagagcgcccagactccaggggactagacctgacatgtttactcttttgtctgcctctcggtccagctcccgcagcaagccgcggtaccgagccatctcagaaagcatcactgtctgctgcccaccaccgcctcctcccggaccctgatgggtag

SEQ ID NO: 226628 - DNA, 471 bp, Artificial Sequence
  Description of Artificial Sequence: Synthetic coding sequence
atgtgccatagcaggagctgtcacccgactatgaccatcctccaggctccaactcccgcaccaagcacgatccctggaccccgaagggggtccggccctgagattttcacttttgacccgctacctgagcctgccgcagctcccgctggtcgaccgagcgcctcgaggggccacagaaagcgcagtcggagagttttgtatccacgggtggtgcgccgtcaactgcccgtggaggagccaaaccctgccaagaggctgctatttcttctcttgaccattgtgttttgccagatcctcatggcggaagagggagtacccgctcctcttccaccagaggacgcccctaatgctgctagcttagctccgaccccagtgtcacctgtgctggagcctttcaacctaacgagcgagccaagtgattatgctctggatctcagcaccttcctgcagcagcatcctgccgctttttag

SEQ ID NO: 226629 - DNA, 417 bp, Artificial Sequence
  Description of Artificial Sequence: Synthetic coding sequence
atgtgccatagcagatcctgccatcccaccatgacgattctgcaagcccctactccagcacctagcacaatcccaggcccaagaagaggctccggcccagaaatttttactttcgaccctttgccagaacctgcagccgcacccgcagggagacccagtgccagccgcggacacagaaagcggagtcggagggtgctctatccaagagttgtgtctatagccgaggttggcatcagaggagtaaggtgcccaggagttacaggtgagagaccagacagccgcggtctggacctgacctgtctgcttttttgtttgcctctcggcccagcccctgctgcttctcgcggtaccgaaccttcccagaaagcctctctgtctgctgcccatcatcggctgttgccagacccagacggatag

SEQ ID NO: 226630 - DNA, 471 bp, Artificial Sequence
  Description of Artificial Sequence: Synthetic coding sequence
atgtgccatagccgatcttgccacccaaccatgaccattctgcaggcccctactcctgcacctagtaccatcccgggaccccgtcgaggctccggaccagagatcttcacatttgacccacttcctgaaccagccgctgccccagccggaagaccctcagcaagccgtggtcatcgaaaaaggtccagaagggtgttatatccgagggtggtccggagacaacttcctgtggaggagccaaatccagccaaaagactactgtttctgctgctgacaatagttttctgtcagattcttatggccgaagagggcgtgcctgccccactgccccctgaggacgcccctaacgcggcaagtctcgcgccaactcccgtctccccggtacttgagccgtttaatctcacgagcgaaccaagcgactacgctctggacctcagtaccttccttcaacagcacccagccgctttctag

SEQ ID NO: 226631 - DNA, 417 bp, Artificial Sequence
  Description of Artificial Sequence: Synthetic coding sequence
atgtgtcacagcagaagctgtcatcccaccatgactatactacaagccccaactccagcaccatcgaccattccaggtccccgaaggggttcagggcctgagatatttactttcgatcctctgcctgagcccgctgcagcccctgccggaagacccagtgcatcccgcggacacaggaagaggagccggcgagttctctacccacgcgtggtgtccattgcagaggtcgggatccggggagttcgctgtcctggggtgaccggggagcgcccagatagccgaggtctagatctcacatgtctgcttttctgcctcccactgggtcctgctccggcagcctcacgtggcacagagccatcacagaaggcctctctgtcggctgcccaccaccgtcttctccctgatccagacgggtag

SEQ ID NO: 226632 - DNA, 471 bp, Artificial Sequence
  Description of Artificial Sequence: Synthetic coding sequence
atgtgtcactctcgctcatgtcatccgaccatgacgattctccaagctcctactcccgcaccttcaactatccccggaccccgacgaggaagcgggcctgagatcttcacattcgatccactgcccgaacctgccgcagcccctgctggcagaccatccgcctctcgaggtcacaggaaacggtcaaggagggtactatatccaagggttgttaggcggcagctgcccgtggaagagcctaacccagctaagagactactcttccttctcttgaccattgtcttctgccagatcctgatggctgaggagggggtacccgctcctctacctcctgaggatgcgcctaatgccgcttcactggctccaacccccgtcagtcctgtgctcgagccttttaatctgacgagcgagccctctgactatgctctggatctgtccacttttctgcagcaacaccctgccgctttctag

SEQ ID NO: 226633 - DNA, 249 bp, Artificial Sequence
  Description of Artificial Sequence: Synthetic coding sequence
atggcgttcaccttatatagcctcctgcaggcagcactcctgtgtgtgaacgcaatcgcggttctgcacgaggaacgctttttaaagaacattggctggggaaccgaccaaggtattggcggattcggcgaagaaccaggaattaagtcccagcttatgaacttgatccggagcgtccgcactgtcatgcgtgttcctttgataatcgtcaatagcatagctattgtactgcttcttttgttcggctag

SEQ ID NO: 226634 - DNA, 984 bp, Artificial Sequence
  Description of Artificial Sequence: Synthetic coding sequence
atggagtttaaattggaggctcataggattgtatccatctcattaggaaaaatatacaactcaagagtgcagcgaggtggaatcaaactgcacaagaatctgctggtctctctcgttctgagatcggcgaggcaagtgtacctttcagacccatgtcccggtctgtacctggctggccctgctggcacgcctgctcccccaccgcagcagcagcccggtgaacctgctgccggtcccccagctgggtggggggaaccgcctcctcctgccgctagagcaagctggccagaaaccgagccccaacctgaaagatcttctgtatcagatgctccacgggtgggcgacgaagtgccagttgctaccgtgaccggagtaggtgacgttttccagggtggcgaggccgacgcgaccgaggcggcttggtccagagtggaggggccacgacaggccgcagctagggaggcagagggaactgccggagggtggggtgtgttccccgaggtgtcaagagcagcgcgaaggccttgtggctgccctctggggggtgaggacccccctggaaccccggctgccacgccacgagcggcttgctgttgtgccccacagcccgctgaggacgagccgcctgcccctccagccgtttgccccaggaagcggtgtgcagccggtgtgggtgggggacctgcgggatgccctgctccaggctctaccccattgaaaaagccccgacgaaatctggagcagcccccatccggcggtgaagacgatgatgcggaggagatggagactggcaatgtggccaatcttatcagcatttttggtagcagttttagtggtctgctccggaagtcccctggcggaggtagggaggaggaggagggcgaggagtccggcccagaagccgctgagcccggtcagatctgctgtgataagcctgtgctcagggacatgaatccctggagcactgccatcgtggctttttag

SEQ ID NO: 226635 - DNA, 420 bp, Artificial Sequence
  Description of Artificial Sequence: Synthetic coding sequence
atggaattcaagttggaagcccataggatagtctcaatttcactgggcaagatatataattccagagtgcagaggggagggatcaagctgcacaaaaatctgcttgtgagtttagtgttacggtctgcaaggcaggtctatctgagcgatccttgtccgggtctatatcttgcagggcctgcaggtacacctgccccacctccccagcaacaaccgggagagcccgctgctgggccacccgcaggctggggtgaaccgcctccgccagcagcccgtgcttcgtggcccgaaaccgagccacaaccggagaggagcagcgtgtctgatgcccctcgcgttggcgacgaggtccccgtggctactgtcactggagtgggggacgtcttccagggtcgatctgctgccattagtagatgttag

SEQ ID NO: 226636 - DNA, 546 bp, Artificial Sequence
  Description of Artificial Sequence: Synthetic coding sequence
atggaggccatgaacgtggaaaaggcctccgcggatggtaatctccccgaagtcatcagtaacatcaaggagaccctgaagattgtgtctcggacgcccgtaaacattacaatggcaggggactccggcaatgggatgtcgaccttcatatccgctctcagaaacaccggccatgaaggcaaggccagcccaccgacagagctggtgaaggccactcagaggtgtgcctcctactttagcagccactttagcaacgtggtgctttgggaccttccaggcaccgggtccgcaaccactacacttgagaactaccttatggagatgcagttcaacagatatgattttatcatggtcgcttccgcacaattctcaatgaatcatgtgatgctggcaaagaccgctgaggacatgggcaagaaattttatatcgtgtggacaaaattggatatggatctgtccactggtgctctccctgaggtgcaactgttgcagattcgtgaaaacgtgctggagaacctgcagaaagagagagtgtgtgagtattag

SEQ ID NO: 226637 - DNA, 1020 bp, Artificial Sequence
  Description of Artificial Sequence: Synthetic coding sequence
atggccgctgaagatgagttgcagctgcccagattaccagaattattcgagaccggtagacagcttctggatgaagtcgaggtggccactgagcccgcaggctcacgtatcgtgcaggaaaaagttttcaaaggactggatttactggagaaggccgcagagatgctgtcccagctcgatttgttctcacgcaacgaagatctcgaagaaatagcatctactgaccttaagtatttgctggtgccagcattccagggggctctgactatgaagcaagtgaatccctcgaagcgactggaccatttacagagggcccgagagcattttatcaactatttaacccagtgccattgctatcacgtcgccgagtttgagctgccgaaaaccatgaataacagtgctgagaatcatacagccaatagttctatggcatacccctctctggttgcaatggcgtctcagcgccaggccaagatacagagatacaagcagaagaaagaactggaacaccggcttagtgcgatgaagtcagctgtggaaagcggccaagccgacgatgagagagtgagggagtattacttactccatctgcagcgatggatagacattagcctggaggagattgaaagcattgaccaggagatcaaaatcctgagggaaagagattcttcccgggaggcctccacctcaaacagttcaagacaggaaagaccaccagtcaagccctttatcttgaccaggaacatggcacaggctaaggtgtttggagctggctatcctagtttacccaccatgacagtgtctgattggtatgaacaacaccggaaatatggcgctctgcctgaccagggaatcgccaaggcggctcctgaggagttcaggaaggcagcgcaacaacaggaggagcaggaagagaaggaagaggaagacgatgaacagacattacacagagcccgtgagtgggatgattggaaggacacacatcctcgcggttacgggaaccgccaaaatatggggtag

SEQ ID NO: 226638 - DNA, 1020 bp, Artificial Sequence
  Description of Artificial Sequence: Synthetic coding sequence
atggccgcagaagacgagcttcagcttccaagactgccagagctgttcgagaccgggaggcagctgctggacgaggtggaggtcgccactgagccggctggctcgcgcatcgtgcaggaaaaggtgttcaagggcctggacctgcttgaaaaagcagccgagatgctatcgcagctggacttattcagtaggaatgaggacctggaggagatcgcctccactgatctgaagtacctgttagtaccagcctttcagggagccctaaccatgaaacaggtgaatccatcgaaaagactggatcatttgcagagagcacgcgagcatttcatcaactatctcacacagtgccactgttatcatgtggccgagttcgaactacctaagaccatgaacaactctgccgagaaccacaccgctaactccagtatggcttatccttcccttgtggccatggcttctcagaggcaggctaagattcagaggtataagcagaaaaaggaactagagcaccggctgtccgccatgaagagcgcagtggagtccgggcaggccgacgatgagcgtgttagagaatactacctgctgcacttgcaacggtggatcgacatttcgcttgaggagattgagtctatagatcaagagatcaagatcctgcgggaacgagacagtagcagggaggccagtacttccaactcttcaagacaagaacgaccacctgtcaaaccatttatcctaaccaggaacatggctcaggccaaggtgtttggggctggctatccgagcctgccgacaatgactgtgtccgactggtacgagcagcaccgcaaatacggcgctttacctgaccaaggcatcgctaaagccgctccggaagagtttcggaaggccgcacagcagcaagaagaacaggaagaaaaggaggaggaggatgatgaacagacactacatcgggctagggaatgggacgattggaaggacacgcacccaaggggctatggaaataggcagaatatgggctag

SEQ ID NO: 226639 - DNA, 480 bp, Artificial Sequence
  Description of Artificial Sequence: Synthetic coding sequence
atgaaaaatcatcttcttttctggggcgtgttagctgtcttcataaaggctgttcacgtgaaggcgcaggaggacgaacgaattgtcctagtcgataataaatgcaagtgtgctagaattaccagtagaatcatccgaagttctgaagatcccaatgaggacattgtcgaaagaaatataaggattatcgtgccgctcaataacagggaaaatattagtgaccctacaagcccgctgaggacacggttcgtgtaccatctgagtgacctctgcaagaaatgtgacccaacagaagtggagttggacaatcaaattgttaccgccactcagtccaatatctgcgacgaagattccgctaccgagacctgctacacttatgatcgcaataaatgttacaccgccgtggttccactggtgtacgggggtgaaacaaagatggtagagactgctcttaccccagatgcgtgctaccctgactag

SEQ ID NO: 226640 - DNA, 213 bp, Artificial Sequence
  Description of Artificial Sequence: Synthetic coding sequence
atgaaaaaccacctcctcttttggggcgtcctggcagtctttattaaagccgtgcatgttaaagcacaggaggacgaacgtattgttttagttgataataaatgcaagtgtgccagaattactagcagaatcatacgttcttctgaggatccaaacgaggatatcgtggaaaggaacattcggattattgtgcctctcaacaaccgcgagtag

SEQ ID NO: 226641 - DNA, 480 bp, Artificial Sequence
  Description of Artificial Sequence: Synthetic coding sequence
atgaagaatcatttgctgttttggggcgtgctcgccgtgtttataaaagctgtccacgttaaggcccaggaggatgaaagaattgtgctggttgataataagtgcaagtgtgccagaatcacaagccgcataatccggtcatcagaggaccccaacgaagacatagttgagcgaaacattcgaattatcgttcccctgaacaacagggaaaatatttctgatcccacctcgccactgagaacacgcttcgtgtatcacttgtccgacctgtgtaagaagtgcgatcccacagaggtggaactggataaccaaattgtgacggctacacagagtaacatatgcgatgaagactcagcgactgaaacctgctatacttatgacaggaacaaatgttatactgcagtggttccacttgtatatgggggagagaccaagatggtggaaaccgcgcttaccccagacgcctgctaccccgattag

SEQ ID NO: 226642 - DNA, 528 bp, Artificial Sequence
  Description of Artificial Sequence: Synthetic coding sequence
atgaaaaaccatctgctgttctggggcgttctggctgtgtttattaaggccgtccatgtgaagggcagccgtgattcctccgcgtccgcttctcgagtggctggtataacggctcaagaggacgaacggatcgtgcttgtcgataacaagtgtaagtgtgcgaggataacatcaaggatcatccgctcttccgaggacccaaacgaagatatcgtggaacggaacatcagaatcattgttcctctcaacaaccgggagaacatctctgatccaacctcaccactgagaacccgcttcgtttaccacttgtccgatttgtgtaagaaatgcgatccgaccgaagtggagctcgataaccagatcgttactgccactcaatccaatatctgtgacgaggactccgcgacagaaacctgttacacatatgacaggaacaaatgctacacagcagtggtgccgttagtttatggtggggagactaagatggttgagaccgctctcacacccgatgcttgctaccccgactag

SEQ ID NO: 226643 - DNA, 642 bp, Artificial Sequence
  Description of Artificial Sequence: Synthetic coding sequence
atgcgtcctggaaccgggcagggtggccttgaggcccctggagaacccggaccgaatctcaggcagcgttggccccttttattactggggctggccgtggttacccacggtctgctacggccaaccgccgcatcccagtctagggccctgggcccaggagctcccggaggcagctctcgaagctcactacgaagtaggtggggtaggttcctgttacagcgcggatcctggaccggtcccaggtgctggccccgtggattccagtctaaacataattctgtgacgcatgtgttcggatctggcacccagttgactgtgctttcacagccaaaggccacaccatccgtcactctatttccaccatcctcagaagagcttcaggctaataaggccaccctcgtgtgcctgatgaatgacttttatcccggtatactgactgtcacctggaaagcagacggcacgcctatcacccagggggtggagatgaccaccccttcaaaacaatcgaacaacaagtatgccgcttcatcttacctctccttgactcccgaacagtggcgttctcgtaggtcctactcatgccaggtgatgcatgaggggagcacggtggaaaaaacagtcgcgcctgctgagtgctcctag

SEQ ID NO: 226644 - DNA, 255 bp, Artificial Sequence
  Description of Artificial Sequence: Synthetic coding sequence
atgaggcctggcaccgggcaggggggacttgaagccccaggagaacctggccctaatctcagacagcggtggccactcctgttgttagggctggccgtcgtcactcatggactgttgcggcctacagctgccagccagagccgcgctttggggccaggcgctcccggaggatcttcacgctccagtcttcgatctagatggggtaggtcagctcagggacacccattgggacattccgtgccagctgttctgtag

SEQ ID NO: 226645 - DNA, 2982 bp, Artificial Sequence
  Description of Artificial Sequence: Synthetic coding sequence
atggcgtcagctgctgtggagtcttttgtgaccaagcagcttgatttgctggaactcgaacgcgatgcggaggtcgaagagcggagatcttggcaggagaatatcagtctgaaggaacttcagagccgaggcgtctgtttgctgaagctccaggtaagttcccagagaactggactctatggcaggcttcttgtgaccttcgaacccagacgatacggatccgctgccgctctgcctagcaactcctttacctcaggagacatcgtgggtttgtacgacgctgcaaatgagggctcacagctggccactggcattctgacccgcgtcacccagaagtctgtcacagtggcctttgacgagtcccacgatttccaattgtcattggaccgtgagaatagctaccgactcttaaagttggctaacgacgtcacatatcggaggctgaaaaaagctctgatcgccctgaagaagtatcacagcggcccagcctcaagcttgatcgaggtgttgtttggcagaagtgccccatcacccgcaagcgagatacatccactcacatttttcaacacttgtctggatacaagccagaaggaagctgttctcttcgctttgagccagaaggaattggccatcatccacgggcctcccggaaccgggaaaaccacaacagtggtggagattattctgcaggctgtgaaacagggcctcaaggttttatgttgtgctcccagcaatatcgccgttgataacctggtggagcgtctggcgctatgcaaacagagaattctgaggctcggccatcctgccagactcctcgaatctatccagcagcactccctcgacgctgttctggccaggagtgactctgcccagattgtcgccgacatccggaaagatatagatcaggtgttcgttaaaaacaaaaaaactcaggataagcgggagaagtctaactttcggaatgagatcaaactcctccgcaaggagctcaaagaacgagaggaggccgcaatgcttgaaagtctgacttctgctaacgtagtgctagctactaacactggggcatcagcagatggacctctgaagctcctgcctgagtcctacttcgatgtggtggtcattgatgagtgtgcccaagcactggaagccagctgctggattcctctccttaaagctcgcaagtgcatccttgcaggagatcacaaacagctgcccccaactacggtcagccacaaagctgccttggccggactttcactgagtctgatggagagactggcagaggagtacggggcacgcgtggtgaggactctcaccgtgcagtataggatgcaccaggccatcatgagatgggcctccgacacaatgtacctgggacaactgacggcccactcaagtgtggcgcgtcatcttctccgggatctccccggagtagcggcaacagaggagactggggtcccactgttgctagtggacaccgccggatgcgggctgttcgagctggaggaggaggacgagcagtcaaagggcaatccaggggaagttcgactggtgtcgttgcacattcaggctcttgtcgatgccggagtgcctgcacgggacattgcagtggtcagtccatacaacttacaggttgatctcctccgccaaagccttgtgcaccggcacccagagctggaaatcaaatcagtcgacggcttccagggacgggaaaaagaggcggttatactcagttttgtgaggagcaatcgcaaaggagaggtgggcttcttagcggaagataggcgaatcaatgtggccgtgacaagggcaaggcgacacgtggctgttatttgcgatagcagaaccgtaaacaaccatgctttcctgaagacattggtggaatacttcacacagcacggggaggttcgtaccgcatttgagtacctagatgacatcgtccctgagaactatagtcatgagaattcccagggatcatcccacgccgcaactaagccgcagggcccagctacctccacccggacgggaagccaacgccaagagggcggacaggaagctgctgctccggctcggcaagggaggaagaagcccgcaggaaaatctcttgcttcagaggcgccatcgcaaccaagtctcaacgggggtagccctgaaggcgtcgaatcacaggatggtgtcgatcattttagggcaatgatcgttgagtttatggcctctaaaaagatgcagctcgaattcccgccttcactgaactcccacgaccggctacgtgtgcaccagatcgctgaagaacacgggcttaggcatgatagtagtggggagggtaagcgacgcttcattacagtatctaaaagggcacccaggcctcgcgctgctctgggaccgcctgcaggaaccgggggtcccgctccccttcagcctgtgccccctaccccagctcagacagaacagccacccagagaacaacgtggccctgaccagccagatctgcgcacactgcatctcgagcgcctgcagcgagtaagatctgcccagggtcagccagctagcaaggagcagcaggcttctgggcagcagaagctgccagagaaaaaaaaaaaaaaggctaagggtcatcctgccactgatcttcctaccgaggaagattttgaggcactggtctcagcagcagtgaaggctgacaacacctgcgggttcgcaaagtgcaccgctggggtgaccaccctaggacagttttgccagctttgcagtcgtaggtattgcctgtcccaccacttgccagaaattcacggttgtggcgagagggcgagagcccatgccagacagcgcatctcccgcgaaggtgttctttatgccggatcagggacaaaaaatggctcactcgaccccgctaaacgggcacagctgcaacggagactcgacaaaaaactctctgaattgagcaaccaacgaacttctagacggaaggagaggggaacttag

SEQ ID NO: 226646 - DNA, 1287 bp, Artificial Sequence
  Description of Artificial Sequence: Synthetic coding sequence
atgcaggagttgcacctcctctggtgggccctgcttctggggctcgcccaggcttgtcctgaaccatgcgactgtggggagaagtacgggtttcaaatagcagattgcgcctaccgcgacctcgaaagcgtgccgccagggttccccgcaaatgtgacaactctctcattgtctgcgaaccggctgccaggactgccagagggggcatttcgagaagtaccgctgctccagtcactctggcttgctcataatgagatccggactgtggctgctggtgccttggcaagtctttctcatttgaaatctctggatctgtcccacaacctcatctcagatttcgcgtggagcgacctgcataatttgtcggctttgcagctcctgaagatggactccaacgaactgacgtttatccctagagacgccttccgctccttgagggccctccggagtctacagttgaaccacaatcgactccacactctcgccgaaggaacatttaccccactcaccgcattgtcccacctgcagatcaatgagaaccctttcgactgcacttgtgggatcgtgtggctgaagacctgggccctaactactgctgtttctatccccgagcaggacaatatcgcctgcacatccccgcatgtgctgaagggaactcccctctcaaggttgcctccactgccatgcagcgctccctcagtgcaattaagctaccaaccctctcaggatggggcagaacttcgccctggttttgtcctggctctacattgcgacgtggatgggcagccagcccctcagctacattggcacattcagatcccttctggaatcgttgagatcacaagtcctaatgttggtacagacggaagggcgctgccgggtactcctgtggcttccagtcaacctcggtttcaggcctttgccaatggttctttactgattcccgacttcggaaaactcgaggaggggacatatagctgtctggctactaacgaactcgggagcgcagagagcagcgttgacgttgcgctggcgacccctggggaagggggagaagatacccttgggaggaggttccatggtaaggccgtggagggaaaaggctgctacacagtcgataatgaggtgcaacctagtgggccagaggacaacgtagtgataatctatctgtcacgggctgggaatccagaagctgccgtggccgagggtgtgcctggccagcttccccctgggctgctcctactgggacaaagcctgctgcttttttttttcttgacgagcttctag

SEQ ID NO: 226647 - DNA, 1287 bp, Artificial Sequence
  Description of Artificial Sequence: Synthetic coding sequence
atgcaggagctgcatttgctgtggtgggccctgctgttaggcctcgcccaagcttgcccagagccatgtgactgcggcgagaaatacggattccaaattgcggattgcgcctaccgggatttagaatcagtcccccctggctttcctgcgaatgtcacaacactgtccctttccgccaacagactgccagggctgcccgagggtgcattccgagaagtgcctctcctgcagtcattgtggttggctcacaacgagatccgaaccgtggccgcaggagcgcttgcatccctttcacacttgaaatcccttgacctgagtcataatcttatctcagattttgcttggagtgaccttcacaatcttagcgccttacagctcttgaagatggactctaacgaactgacattcatcccaagagatgcgttccggtcactaagggcactcaggagtttgcagctcaatcataacagactgcacacgcttgccgagggtacattcactccgttaacggcgctgagtcacttgcagatcaacgaaaatccctttgactgcacatgtggcatcgtgtggctgaagacctgggccttgaccacggccgtgtcaattccggagcaggataacatcgcctgcacttctccccacgttttgaaaggcacaccgttatcccgattgcctcccctcccttgtagcgcccctagcgtgcagctgagttatcagccaagccaggatggggcagaattgaggccaggtttcgtactggcgctgcactgtgatgtggacggccagcccgctcctcaactccattggcacatccagattcccagcggcatcgttgagattacaagccccaacgttggcaccgacgggagggctctccccggaaccccagtggcgagcagtcagcctcggtttcaagcctttgccaacgggtcactactaatcccggacttcggcaagctggaagagggtacatacagctgccttgccactaacgagctaggctcagccgaatctagcgtggatgtggccctggcaacccctggggagggcggagaggacacacttggtcgacgcttccatggcaaagcagtcgaggggaaaggctgctacaccgttgacaatgaggtacagccatcaggtcctgaagacaatgtcgtgatcatctatctatccagagccggtaacccagaagccgcagtggccgaaggcgtccctggccagctccccccaggcttgctcctgctgggccagtcattacttttattcttttttctcactagcttttag

SEQ ID NO: 226648 - DNA, 444 bp, Artificial Sequence
  Description of Artificial Sequence: Synthetic coding sequence
atgcaggaacttcatctgttatggtgggctctgctgcttgggctggctcaggcatgtcctgagccttgtgattgtggggaaaagtatggcttccagatcgccgactgcgcctatagggatctcgagtctgtccccccaggcttccctgcgaacgttacaaccctgtctttaagcgcaaatagactgcccggtctacctgaaggcgcttttagagaagtacccctcctacagtctttgtggcttgcccacaacgagatccggaccgtggcagcaggagctctggctagcctgagccatttaaagagcctggacctgtcgcacaaccttatatctgattttgcctggtccgaccttcacaacctttctgccctgcagctgctcaaaatggactccaatgaactgacgtttatcccacgtgacgcgttcaggagcctgcgcgcttag

SEQ ID NO: 226649 - DNA, 552 bp, Artificial Sequence
  Description of Artificial Sequence: Synthetic coding sequence
atgcaggagctgcacctgttatggtgggctctgctgctgggcctcgcacaagcctgccccgagccttgcgattgtggcgaaaagtacggattccagattgcagattgcgcctatcgagatcttgagtctgtcccaccaggcttccccgctaatgttaccaccctgtccctttccgccaatagactgcctggtctgcctgaaggcgcattccgcgaagttcccctgcttcagtctctttggctcgcgcataatgaaattcggacagtggccgctggggcactggcctccctcagccacctgaaaagtttggacctgtctcacaatttgatcagcgatttcgcctggtccgacttacacaatctttctgctctgcagttgttgaagatggactccaacgagctcacatttattcccagggacgccttccggagtttgcgcgctcttcggtcactgcagctgaatcacaaccgacttcacactctagccgaaggcacgttcacacctcttactgccctaagccaccttcaaatcaatgagaatccttttgactag

SEQ ID NO: 226650 - DNA, 2238 bp, Artificial Sequence
  Description of Artificial Sequence: Synthetic coding sequence
atgttccctttgagagccctctggctggtttgggccctgctgggcgtggccggtagctgccccgagccttgtgcttgcgtggataaatatgcacaccagtttgccgattgcgcatataaagagttaagggaagtacccgagggcctgccggcaaacgtgacaactctgtcattgagtgctaataaaattacagtgctcagaaggggggcttttgccgatgtgacgcaggttacgtctctatggcttgcccacaatgaagtgcgaacggtcgagccaggcgcattggctgtgctgtcccagttgaaaaacctcgacctatcccacaattttattagctcgtttccatggagcgatctgcgaaatcttagcgcactgcagctgcttaagatgaatcataatagacttggaagcctccctagagacgctctgggcgcactcccggatctgcggtctctgaggattaataataatagacttagaacactggcgcctggcacattcgacgccctgtcagctctctcccatctacaactgtaccacaatccttttcattgcggatgcggtctagtatggctgcaggcctgggctgcatcgacacgggtgtcccttcccgagcccgatagcatcgcttgtgcaagcccacctgccctccagggcgtcccagtttacagacttcctgcactcccctgcgccccacctagcgtgcacttgtctgccgagccaccccttgaagccccaggaaccccgctgagagccggtttggcgttcgttctccactgcatcgccgacgggcatccaactccgagactgcaatggcaactacagattcctggcggtactgttgttctggaacccccagtgctgagtggcgaagacgatggcgtgggcgcagaagagggggagggagagggggatggggatctgctgacccaaacacaggcccagacccccactcccgctcctgcatggcctgcacctcctgcgactccccgtttcctcgcacttgccaacggatctttgttagtgccgcttctctccgccaaggaagctggggtatatacctgtagagcacacaacgagttgggcgcaaatagcacttcgataagagtagcagttgcagcaaccgggcctcccaaacatgcccctggtgccggaggcgaaccagatggacaggcccctacctccgagcggaaatcgacggctaagggtagaggaaacagcgttctgccctcaaaacctgagggcaagatcaaagggcagggtttggccaaagttagcattctgggggagaccgaaacagaaccagaagaggacacgtcagaaggagaggaagcagaagaccaaattcttgccgaccccgcagaggaacaaagatgtggaaacggagacccaagccgctatgtgagcaatcacgccttcaaccagagtgctgagctgaagcctcacgtgttcgagctcggcgttatcgctcttgatgtcgctgagagggaagccagggtgcaactgacaccacttgctgccagatggggccctggaccaggcggagccggtggggctccacgacctgggagacgcccactgaggctcctgtacttgtgtcccgcaggcggaggagccgctgtccagtggtccagggtcgaggagggagttaatgcatattggtttcgcggattgaggccaggaaccaattacagcgtctgtcttgctctggccggtgaggcttgtcatgtgcaagtggtctttagtacaaagaaggagctgcctagcctgctcgtcatcgtggcagtgagcgtgtttctgcttgttctagccaccgttcccctgcttggagcagcctgctgtcacctgctagccaaacatccagggaaaccataccggctaattttaaggccacaggcacctgatcctatggagaaaaggatcgccgcagactttgaccccagggcatcttatctcgaatccgaaaaatcttatccagctggtggtgaggccggtggggaagaacccgaagatgtgcagggcgaaggcctggatgaggacgccgaacagggcgatccctctggggatcttcagcgggaggagagcctcgcagcatgtagtcttgtagaatcccagtcaaaggcaaatcaagaggaattcgaggccggatccgagtactcggacagattacctctaggggcagaggccgtcaatattgcgcaggaaattaatggaaattaccggcaaacggctggatag

SEQ ID NO: 226651 - DNA, 1005 bp, Artificial Sequence
  Description of Artificial Sequence: Synthetic coding sequence
atgtttcccctgcgagcgctttggttagtatgggcgctgctgggggtagctggctcctgcccagagccatgcgcttgtgtcgataaatatgctcatcagttcgcagactgcgcctacaaggagctgcgggaagttcctgagggcctgccagccaatgtaacaactttaagcctctccgccaataagattacagtcctgaggaggggcgcatttgccgacgttacccaggtgaccagcttgtggcttgcccacaacgaggtgcgcaccgtggaacccggagccttagcggttttaagccagctgaagaatcttgatcttagtcataatttcatctccagtttcccctggtccgacctcaggaacctgtccgcattgcaactactgaaaatgaaccacaatcgattgggatcgctccccagggacgcactgggcgctctgcctgacctgcggagcctgcggattaacaataatcgcctcgccggagaggcttgtcatgtccaggtggtttttagtaccaaaaaagaactgcccagtctgctggtaattgtggcggtaagcgtgttcttacttgtgctagctaccgtgccacttctaggagccgcttgttgccatctgctcgcaaaacacccaggcaaaccataccgcctgattctgcgcccacaagcgcctgacccaatggagaagagaatcgcggcagacttcgatccacgtgcatcttatctcgaaagtgagaagtcctacccggctggcggtgaagccggaggcgaagaacctgaagacgtgcagggggagggccttgatgaagacgccgaacagggtgatcctagcggagaccttcagagggaggagagccttgcagcctgctcccttgtggagagtcagagtaaggcaaaccaggaggagttcgaagccggatctgaatactccgatcggctgcctctaggagccgaagcagtaaatatcgcacaggaaattaatggaaattatagacagacggccggttag

SEQ ID NO: 226652 - DNA, 2238 bp, Artificial Sequence
  Description of Artificial Sequence: Synthetic coding sequence
atgtttccgttgcgggcactgtggctggtgtgggctctcttaggagttgccggaagttgcccagaaccttgcgcctgtgtggataaatatgcgcaccagttcgccgactgcgcatacaaggaattaagagaagtgcctgagggactccctgccaacgtgacaacactctcccttagcgctaacaaaatcactgtgttgcggaggggggctttcgccgacgtaacacaggtgactagcctgtggctggcccacaatgaagtccggacggtagaacctggtgccctagccgtgctctcacagcttaaaaatttggatctgagtcataacttcatttcatcattcccctggtccgatctgaggaatttgagcgcacttcagctgctgaaaatgaaccacaacaggcttgggtctctgcctcgggatgcgctaggcgctctgcccgacctccgaagccttcggatcaacaacaaccgattgcggaccctcgccccaggcaccttcgatgctttgtcggctttgtctcacttgcagctgtaccacaatccttttcactgtggctgcgggctggtctggcttcaggcctgggcagcttccactcgcgtttccctgcccgaacccgactctatagcctgcgcttccccccctgcattgcagggtgtgcccgtgtaccgcttgccagcccttccatgcgcacctccttccgtacacctctccgccgaaccaccactggaggccccaggaacccctctgcgggctggcctggctttcgtgctgcactgcatagctgatggccacccaactcccaggctgcagtggcagttgcagatccccggtggcacagtcgtcctcgagcctccggtcttgagcggcgaagacgatggcgtgggggcagaggagggtgagggtgaaggcgacggggacctgctgacccagacacaggcgcagaccccaacacccgctcctgcctggcctgccccaccagccacacctagatttctggcactggcaaacggatccttgttggtacccctgctcagcgctaaggaggccggtgtctacacttgccgcgctcacaatgagctcggggcaaactcaacatctattagggtggcagtcgcagccactggcccaccaaaacacgctccaggcgcaggcggtgaacctgatgggcaggccccaacctcagagaggaagagcaccgctaaggggcgtgggaatagcgtgctccctagtaaaccagaggggaagatcaaagggcagggcctggccaaggtgagtattttaggcgagactgaaacggagccagaggaagatactagcgagggcgaggaagccgaagatcaaatcctggcagaccccgcagaggaacaacggtgtggaaatggggacccttcaaggtacgtgtccaaccatgcatttaaccagagcgctgaacttaagccccacgtgtttgaactcggcgttattgccctggacgttgcagagagagaagctcgcgttcagctcaccccgctcgccgcacggtggggcccaggtccgggaggggctgggggtgctccaaggcctgggagacgccctctgcggctgctctatttgtgcccagccggtgggggagccgcagtgcaatggtctagagtcgaggagggcgtcaatgcttactggttccgcggtctgagacctggcacaaattactctgtctgcctggccctcgctggagaggcctgtcatgtccaagtagtgttttccacaaaaaaggaattacccagcttgctggtgatcgtcgctgttagcgtgttcctcctagtgctggccaccgttcccttgctgggggcagcctgctgccatctgctggcaaagcaccctgggaagccataccgtctgatcctgcgaccgcaggccccagatccaatggagaagcggattgctgctgactttgatccacgggcatcataccttgaatccgaaaaatcgtaccctgctggcggagaggcgggtggtgaggagcccgaggatgtgcagggtgaagggctcgacgaggacgctgagcagggtgatccaagcggcgacctacagcgagaagagagtcttgctgcctgcagcttggttgagagtcagtctaaggctaatcaggaggaatttgaggcaggtagcgagtattctgaccgacttcccctcggggcagaagccgttaacattgctcaggagatcaatgggaactatcgtcagactgctggctag

SEQ ID NO: 226653 - DNA, 2238 bp, Artificial Sequence
  Description of Artificial Sequence: Synthetic coding sequence
atgtttcctctcagagccctctggcttgtctgggctttgctcggagtggctgggtcctgcccagaaccttgtgcttgtgtggacaaatacgcccaccagtttgcagattgcgcttataaagagctgagagaggtgccagaaggacttcccgctaacgtgacaacactctccctctccgcaaataagattactgttctaaggagaggagcctttgctgatgtcacacaggttacatcactgtggctggcccataatgaggtgcgaacagtggagccgggagctctggctgtgctctcccagttgaagaacctggatttgtcacacaacttcatctcctctttcccttggagtgatctgagaaatctcagcgcccttcagttgcttaagatgaatcacaataggctcggcagcctgcctagagatgcactgggagccttgcccgaccttcgatccctgagaatcaacaataaccgactaaggaccctggcgcctggcacattcgatgccttgtccgcactgtcccatctgcagctgtatcataacccttttcactgtggctgcggcctggtctggttgcaggcctgggcagcgagtactcgggtcagcttaccagaaccggattctatcgcatgcgcatcaccgccagcacttcagggggtccccgtatacagattacctgcgctcccctgtgcccctcccagcgtgcacctgtccgctgaaccgcctctggaggcgccagggactcctctcagggccggtctggcattcgtgctgcactgcatcgccgatgggcatcccactccacggctccagtggcagctgcagatacctggaggaactgtagttctggagccacctgtcctgtcgggggaagatgatggcgttggcgctgaggaaggggagggggagggggatggcgacctgctgacccagacacaggcccaaactcctaccccagctcccgcatggcctgcccctccagccaccccaagatttttggcactggcaaacggcagcctccttgtccctctcctgagcgccaaggaagccggagtgtatacgtgcagggcacacaacgaactcggagccaattccacatcaatccgcgtagcagtggccgctacgggaccaccaaagcacgcacccggagcagggggagaacccgacggccaggctccgacatcagaaagaaaaagtactgccaagggacgtggcaactccgtgctgccatctaaacccgagggcaaaatcaagggccaaggtttagcaaaagtctcaatcctcggagagaccgagacagaaccagaagaagatacatccgaaggcgaggaagccgaagatcagattcttgcggaccctgcagaggagcagaggtgtggaaacggcgatccgagtagatatgtctcaaaccacgcttttaaccagtccgctgaactgaagccacacgtttttgagctgggagtaatcgcactggatgtggccgaaagagaagcccgagtccagctcactccactggccgcacggtggggacccggacccggaggagctggaggcgctcctcgacccggtcggaggccgctcaggttgctgtatctatgtcccgctggtggaggggctgccgtgcagtggtccagagtggaagaaggagttaacgcctactggtttcggggactccgccctggcaccaactattccgtttgcttggccctcgccggagaggcatgccacgtgcaggttgtgttttcaaccaagaaggagctccctagcctgctggtgatagttgctgttagcgtgttcctgttggtactggccacggtgccattactgggggcagcttgttgccacctcctcgccaaacatcctggaaagccatatagattgatcctcagaccgcaggccccagaccctatggagaagagaatagccgcagacttcgaccccagagctagctacttagagagcgagaagtcatatcctgcaggcggagaagccggtggagaggaacccgaggatgtgcagggggaaggccttgatgaagacgctgagcagggtgaccctagcggggaccttcagagagaggagagtttggccgcttgctccttggtcgagtctcagtccaaggccaaccaggaggagtttgaagcgggttccgagtatagcgacagactgcccctgggggcagaggcagtgaacatcgcgcaggagatcaatgggaactatcgacagaccgccggatag

SEQ ID NO: 226654 - DNA, 2238 bp, Artificial Sequence
  Description of Artificial Sequence: Synthetic coding sequence
atgtttcctctgcgagccttatggttagtatgggcccttctcggcgtggccggatcctgcccggagccatgtgcatgcgtggataagtatgcccatcaatttgccgattgcgcatataaagaactacgggaggtgcctgaaggcctccctgccaatgtgactaccctgagtctttctgccaataaaatcaccgtcctccgcagaggggcatttgccgatgtaacccaggttacctccctctggttagcccacaatgaggtgcgtacagtagaacccggtgccctggccgtccttagccagcttaaaaatcttgacctcagtcataattttatctctagcttcccttggtctgatctccgcaacctcagcgcgctccagttgcttaagatgaatcacaacagactgggcagcctccctagggacgccctgggggctctccctgatttgcgttcactgcggattaataataatcgcctcaggaccttggctccaggcacattcgatgctctctctgccctgtcacacctgcaactgtatcataatccatttcactgtgggtgtggccttgtttggctacaggcctgggccgctagcacacgtgtctcgctgccagagccggatagtatcgcttgcgcttccccacctgccctgcagggggttccagtctatcggctcccggcactgccatgtgccccaccaagcgtgcacctgagcgccgagccacccctggaggctccaggcacccccctcagggctgggctggcgtttgtcttgcactgtatcgcagacgggcacccaactcctcggctgcagtggcagctccagatacccggtgggaccgtggtcctcgaaccccctgtgctgagcggcgaggacgatggagtgggagctgaagagggcgagggggagggagatggagatctgctaacacagactcaagcccagactccgaccccagcacccgcatggccagcccctccagccacccctcgctttcttgccttggccaatgggagcctgctggtaccattgctgtccgcaaaagaggctggcgtgtatacctgtcgagctcacaacgaattaggagcaaacagcaccagtatacgggtggccgttgcggcaacagggcctcctaaacacgccccaggcgcaggaggggaaccggacgggcaggctcccacgtctgaacgcaagtccaccgccaaggggagaggaaactctgtcctgcccagcaagcccgaaggaaaaatcaaaggccagggtcttgccaaggtgtccattctaggcgagaccgagacggagccagaagaagatacgtctgagggggaggaggccgaggatcaaattctcgcagacccggctgaggagcagcgctgcggtaatggagatccgtcaagatacgtcagcaatcacgcctttaatcagagcgccgaacttaaacctcacgtgttcgaactcggtgtgatcgccctggacgtcgccgagagagaagcacgggtgcaattgacccctctcgcggcacgatggggacccggaccaggaggcgctgggggagctccacgccctggcagacgtccattaaggctgttgtacctttgtccggcaggtggtggcgcagctgtgcagtggtcccgcgtagaagagggagtcaatgcctattggttccgcggacttaggccgggtactaactattccgtttgcttagccctggcaggtgaggcctgccatgtgcaggtggtattctcaaccaagaaggaattgccatccctgttagtgatcgtagctgttagcgttttcctgctcgttttagctacagttccactgctgggtgcagcctgctgtcatctgctggctaagcatccaggaaagccctatagactgattctgagaccgcaggccccagatcctatggagaagagaattgcagcagactttgatccacgcgcatcctacctggagtcagaaaagagttaccccgcaggtggagaagctgggggtgaggaacccgaggacgtgcagggagaaggcctcgatgaagatgccgaacagggggatccctccggcgatttgcaaagagaagagtcccttgccgcttgtagtcttgtggaaagccagagtaaggcgaatcaggaagagtttgaggctggtagtgagtacagtgacaggctcccgctgggagccgaagctgtcaacattgctcaggaaatcaatgggaactataggcagacagcagggtag

SEQ ID NO: 226655 - DNA, 2238 bp, Artificial Sequence
  Description of Artificial Sequence: Synthetic coding sequence
atgtttcccctcagagcgctgtggctggtgtgggccttgctaggcgtcgcagggagctgtccggagccgtgcgcctgcgtggataagtatgctcaccagttcgccgattgtgcctacaaggagctgcgcgaggttcccgaaggacttcctgccaacgtcactacgctctcgttatcagctaataaaataaccgttttacggaggggagctttcgcagatgtcacccaggtgacatccctgtggttagctcacaacgaggtccggaccgtcgaacctggcgctttagcagttttaagccagttgaaaaatctggacctcagccacaacttcatctcttcatttccttggagtgatctgcgtaatcttagtgccctgcagctcttgaaaatgaaccataatcggctgggatccttacccagggacgcccttggggcattgccagatctgagatcgctccgcatcaataacaatagactgcggaccctggcgcctgggacattcgacgctctctccgccctgagccacctccagctgtaccataatccattccactgcggttgtggcctcgtgtggctgcaagcctgggctgccagcacacgcgtgtctctgcctgagccagattctattgcctgcgctagcccccctgcattgcagggcgttccagtctaccggttgccagcactcccatgtgccccaccttcggtgcacctgagtgccgagcctcctcttgaagcccctggtacccccctccgcgctggactagccttcgtgctgcactgtatcgcagatgggcacccgactccccgtctgcagtggcagctgcagatccctggcggtacagtggttcttgaacctcctgttctaagtggggaggacgatggggtgggggctgaggagggagagggagagggggatggagatctcctcacacagacccaagctcagacccctactccagctccagcatggccggcacctcccgctactccaaggttcctcgccttagccaacggatcactgttggtaccactcttatccgccaaggaggctggcgtgtatacctgcagagcccacaatgaactaggcgcaaacagtacaagtattcgggtagcagtggcggcaactggcccaccgaaacacgcacccggagcagggggagagcctgacggacaggccccaacctctgagcgtaagtcaaccgccaagggaaggggcaactcagtactgccgtccaagcctgaggggaaaattaagggccagggtttagcgaaggttagtatacttggagagactgagacagaaccggaggaggacacatccgaaggtgaagaagctgaggatcagattttggccgatcctgccgaggagcaacgatgcggcaatggcgacccttctcggtacgtgtcaaatcacgcgtttaaccagtccgcggagctgaagccccatgtgtttgaactcggcgttatcgctctcgatgtcgctgaacgggaggctcgtgttcaactcaccccgctggccgcacgttgggggccaggccctggcggtgctgggggagcccctcggcctggaagaaggcctctgagattgctctatttgtgccccgcaggaggaggagctgcagtgcagtggtctagagtggaggaaggagtgaacgcctattggttcagagggctcaggcctggaacgaactatagcgtgtgtcttgccctggctggtgaggcctgtcacgtacaggttgtcttctcaaccaagaaagagctgcctagcctgcttgtgatcgtagccgtaagcgtgttcctgctggttttggccactgtgcccctgcttggtgctgcctgctgccatctgttagccaagcacccagggaaaccctatagactcatcctgagacctcaggcccctgaccccatggagaagcgcattgcggcagatttcgaccctagagcgtcatacctggaatccgagaaaagctaccccgctggaggtgaggccggaggcgaggaacctgaggacgtccagggagaggggctggacgaggacgccgagcaaggcgacccttcaggtgacctccaaagggaggagagtctggccgcttgttcgctcgtagaatctcagagtaaggccaaccaagaagagttcgaggcaggcagtgagtatagtgacaggcttccattaggagccgaggccgtcaatatcgcccaagaaatcaatgggaactatcgccagaccgcagggtag

SEQ ID NO: 226656 - DNA, 4011 bp, Artificial Sequence
  Description of Artificial Sequence: Synthetic coding sequence
atgaccctggaccgccctggcgagggtgccaccatgctgaagaccttcactgtgttgctgttttgtatccggatgtcactgggcatgacatccattgtgatggatccccaacccgagctgtggatagaatcgaattaccctcaggccccttgggaaaatattaccttatggtgccgaagtcccagcaggatcagttccaagtttttgcttcttaaagataaaactcaaatgacctggatccggccatcccacaaaacatttcaagtttcatttctgattggagctttgaccgagagtaacgccggtctctaccggtgttgttactggaaggagactggctggagcaaaccttccaaggtcttggaattggaggcccctggacagcttccaaagcccatcttttggatccaggcggaaacaccagctttgcccggttgcaacgtcaacattctgtgtcatggctggctgcaggacctcgtttttatgttgtttaaggaagggtacgccgagcccgtagactatcaggtcccaaccggcactatggctatcttctctatcgataatctgacacccgaagatgagggtgtatacatatgtaggacccacatccagatgctgcctacactgtggtcagaacctagtaacccgttgaagctcgttgtggccggactgtacccaaaacctacactaacagcacaccctggtcctattatggctccaggcgaaagtcttaacttgcggtgccaggggcctatatacggaatgacattcgccttaatgcgggttgaagacctcgagaaatctttttaccacaaaaagactatcaaaaacgaggccaatttcttttttcagtctctgaagattcaggatacgggccattatctgtgcttctactacgacgcaagctataggggctcactgctcagcgatgtgctgaagatatgggtgaccgatacattcccaaagacctggttgcttgccagacctagcgcggtcgttcaaatggggcagaatgtctctttgcgttgcagaggaccagttgacggggtgggactggcgctgtataaaaaaggagaggacaaacccctccaatttctcgacgcaacgtccattgatgataacacaagtttcttcttgaacaacgtgacttattcagatactgggatttattcgtgtcactatcttctcacttggaaaacctcaataaggatgcctagtcataacacggtggagctgatggtcgtggacaagccacccaagccctcgctgagtgcctggccctccacagtgtttaagctcggtaaggcgatcaccctgcagtgcagggtgagccatcccgttctcgaattctccttagaatgggaggagagggaaacgttccaaaaattcagtgtgaacggcgatttcattatctcaaatgtcgatggaaaggggaccggaacctatagctgctcttatcgggtggagacccatcccaacatctggagccatcgctccgagccgttgaaattaatgggcccagctggctacctcacgtggaactacgtcctaaatgaagcgatcagactgtccctgattatgcagctggtggccctgctgctagttgtgctgtggatacgctggaagtgtcggagacttagaatcagggaggcttggctgttgggcacggcacagggagtgactatgctattcatcgttactgcactcctctgctgtggcctatgtaatggtgtccttattgaggagacagaaatcgtcatgccaacacctaaacccgaactgtgggccgaaacaaatttcccgttggcgccatggaagaacttaacattgtggtgtcggtcaccatctggctctaccaaagaattcgtcttgctgaaagatgggaccggttggattgccacccggccagcatccgaacaagtgagggctgcttttcctctgggcgctctgactcagtctcacaccgggtcctatcactgtcatagctgggaggaaatggccgtgtcggaaccatccgaagccctggaactcgtcggcacagatattctgcccaagccagtgatatctgcatccccaactattcggggtcaagagctccagctccggtgcaagggatggctggccggaatgggttttgcactgtataaggagggcgagcaggagccagtccagcaactgggggcagtgggacgggaggccttttttaccatccagaggatggaggacaaggacgaaggtaactacagctgtcgaacacacactgagaagcgaccattcaaatggtctgagccatccgaacccctggaattggtaatcaaggagatgtaccccaaaccgtttttcaagacctgggccagtcccgttgtcacccctggagccagggtcactttcaactgttctaccccgcaccagcatatgtcctttatactgtacaaggacggtagcgagatcgcatcttccgatcgaagctgggctagtcctggcgcatctgcggctcacttcctcattatttcggtgggcatcggagatggcggaaattactcttgtcggtattatgatttctcgatctggagcgaaccctctgatcccgttgagttggtggttaccgaattctaccccaagccgacattgctggcccaacctggtccagttgtcttccctggcaagagtgtcattctacgttgccaggggacgtttcagggcatgcgttttgcattactgcaggaaggagcgcacgtgcccctccagttccgctccgtgagtggcaactccgccgactttcttcttcatacggtgggggcagaagactctggaaattatagctgtatctattacgaaaccaccatgagtaaccgcggaagttacctgtccatgcctctcatgatctgggtgacagataccttccctaagccttggttgtttgcagagccaagcagcgtcgtgcccatgggccaaaacgtgaccctgtggtgtcggggtcctgtgcacggggtggggtacattctgcacaaggaaggtgaagctacatcaatgcagctttgggggtccacaagtaatgacggcgctttccccataaccaatatttctggcacctccatggggagatacagctgctgttatcaccccgactggacctcctcaatcaaaatccaacctagcaatactctggagttgctggtaacaggcctcttgcccaagccatccctgctggctcaacccggaccgatggtcgctcccggagagaacatgacactgcagtgccagggagagttacccgactctacattcgttctgttgaaagagggcgcacaagaaccactggaacagcagaggcccagtggataccgcgcagacttttggatgcccgctgtacgaggagaggacagcggtatttactcttgcgtttattacctcgactccacgccctttgcagcatcgaatcactccgactctctggaaatctgggtgaccgacaaaccacctaaaccatcattgagtgcttggccatctaccatgtttaaactggggaaggacatcacactacagtgcagggggcctctgcctggcgtggaattcgtgctggagcacgacggtgaggaggcgccacagcagttctcagaagatggggacttcgtgattaataacgttgaaggcaaggggatcggaaactacagctgcagctacagacttcaggcctaccccgacatctggtcagagccctcagacccactagagctcgtgggtgcggcaggacccgtcgcgcaggaatgtactgtgggcaatatcgtgaggagttcactcatcgtggtggttgtcgtggctctgggagttgtgctggctattgaatggaagaagtggcccaggctcagaaccagaggctcggaaactgacgggagagatcagaccattgcgctcgaggagtgcaaccaggaaggcgagccaggaacacccgctaacagtccttctagcacatcacagcgtatatcagtggagctgcccgtgccgatatag

SEQ ID NO: 226657 - DNA, 729 bp, Artificial Sequence
  Description of Artificial Sequence: Synthetic coding sequence
atgaccctggacaggcccggtgagggcgctaccatgctcaagacatttacagtgcttctgttttgtatcagaatgtcgctgggcatgacctctatcgtgatggatccacagccggaattatggattgaatctaactatcctcaggctccctgggagaacattaccctctggtgccgttccccctcccgaatctcgtcgaagtttctgttgctcaaggacaagactcagatgacatggatccggccaagtcacaaaacatttcaggtgtccttcctaatcggagctctcaccgagtcaaacgcaggcctgtaccggtgctgctattggaaggaaacaggttggtccaagcctagcaaggttttagaactggaagctcccggtcagttgccaaagcctatcttttggattcaggcagagaccccggcattacctggctgcaacgtaaatatcctttgccacggatggctgcaggacctggtgtttatgctgtttaaggagggctacgccgagcccgttgactaccaggtgcccactgggaccatggccatcttctccattgacaacttgaccccagaggacgagggcgtgtacatctgccggactcacatccagatgttgccaacactctggagcgaacctagcaatccgctgaaattagtggttgcagggggatgcggctatggctgttggcacctggccattgtggtccccggaataatggccggatag

SEQ ID NO: 226658 - DNA, 729 bp, Artificial Sequence
  Description of Artificial Sequence: Synthetic coding sequence
atgacactcgatcgacctggggagggggctaccatgctcaagacctttaccgtcctgctcttttgtataagaatgtcgctgggaatgacttcaattgttatggatccacaacccgaactgtggatcgagtccaactatcctcaggccccttgggagaatattacactgtggtgcagatcaccgagtcgaatcagtagcaagtttctgctgctgaaagacaaaactcaaatgacatggattcgccctagccataagactttccaggtgagttttctgatcggagccctgactgagtccaacgctggcctttacagatgctgttattggaaagaaacggggtggtccaaaccttctaaggttttagaactcgaggccccaggtcagctgccaaagcctatcttctggattcaagcagagacccccgcactgccaggttgcaacgtgaacatactgtgccatggctggctgcaggacctggtgttcatgctgttcaaagaggggtatgccgaacctgtggactaccaggtgcccaccgggactatggccattttcagcattgacaatctcacccctgaagacgagggcgtttacatatgcagaactcatatccaaatgctccccacgctgtggagcgagccatccaatccactaaaactggtagtggctggaggctgcgggtacgggtgctggcacctggccatcgtagttccgggaattatggctggatag

SEQ ID NO: 226659 - DNA, 4026 bp, Artificial Sequence
  Description of Artificial Sequence: Synthetic coding sequence
atgaccctggatagacctggcgaaggcgcaacaatgctcaaaactttcacagtgcttttgttttgcatccggatgtctctcggcatgacctccatcgtgatggacccgcagccggaactatggatcgagagtaattacccacaggcgccttgggagaatattactctgtggtgccggtcaccgtccagaatatccagcaagtttctgttgcttaaggacaagacacagatgacttggatccgcccttctcataagacctttcaggtcagcttcctgattggtgcccttacagagtccaatgccggattgtaccgatgctgttactggaaggagactggatggtctaaaccaagcaaggtgctagagttggaggccccagggcagctccctaaacccattttctggatccaggctgagactcccgcattacccggatgcaatgttaatatcctgtgccacggatggctgcaggatttggtgttcatgctcttcaaagaggggtacgcagaaccagtggattatcaggttccgaccgggaccatggcaattttctccatcgataatttgaccccagaggacgagggcgtttatatctgcaggacccatatacagatgctgcccaccttgtggtccgaacccagcaatccactgaagctggttgtggccggactgtacccaaaacccactttaacggcacatcccggacccattatggcacccggagagagcctcaatctacggtgccagggcccaatatatgggatgactttcgccttgatgagagtagaggacctggagaaaagtttttatcacaagaagacgatcaagaatgaagccaatttttttttccagagcctgaaaatacaagataccggacattatctttgtttctactatgacgcctcctaccgcggatccctgctgagtgatgtgttgaagatctgggtgacagatacctttcccaaaacctggctgttggctcgtcctagcgcggtcgtccagatgggacagaacgtttctttgaggtgtcgtggacctgttgacggcgtaggactagccttatataaaaaaggcgaggacaaacccctgcaatttcttgacgccacatcaatcgacgataatacctccttcttcctgaacaacgtcacctacagcgatacagggatctatagttgccactatctcctgacgtggaagactagcattcgcatgcccagccacaacaccgttgagctgatggtggtagacaagccacctaagccctcactcagcgcttggccttccacagtatttaaattgggcaaggctattactttgcagtgtcgggtctcccacccggtgctggaattttccctcgagtgggaggaacgagagacctttcagaaatttagcgttaacggcgattttattatctccaacgtggacggcaaaggcacaggaacctatagttgttcttacagggtggagacccacccaaacatctggagtcaccgaagcgagcctcttaaactgatgggaccggctggctatctgacatggaactacgttctgaacgaggccataaggctgtccctaatcatgcaactagtcgctcttctgttggtggtattgtggatcaggtggaaatgcaggagactccgaattcgggaggcatggttattgggcaccgcgcagggggtcaccatgctgtttattgtgacggcactactttgctgtgccatcagctttgctggactgtgcaacggagttcttatcgaagaaaccgagatcgtgatgcccacacccaaacccgagctctgggcagaaacaaattttcctctggctccatggaagaatctgacactctggtgcaggtcgccatcaggatccaccaaggagttcgtcctactgaaggacgggacaggatggatagcaacaaggccagcatcagaacaggtgcgcgcagccttcccattaggggcattgacgcagagccataccggctcataccactgtcacagttgggaagaaatggcagtgagtgaaccatcagaggccctggaactggtgggtacagatatcctccccaaacctgttattagtgcctctccaactatcagaggacaggaactgcagctgcgatgcaaggggtggctggcaggaatggggttcgcactgtacaaggaaggcgaacaggagccagtccagcagctgggagcagtcggcagagaggcatttttcacaatccagagaatggaggataaggacgaaggaaactattcatgtcgaacgcacaccgagaaacgccctttcaagtggtcggagcctagcgagcccctggagctcgtgatcaaggagatgtatcctaaacccttttttaagacttgggccagccctgttgtcactcctggggctagggtaacctttaactgcagcactccccaccaacatatgtcattcattttgtacaaggatggaagcgagatagcatcctcagaccgtagttgggcctcacctggggctagcgcagcccacttcttaattataagtgtgggtattggcgacggtggcaattatagttgccgctactatgactttagcatctggagcgagcccagtgatccggttgagttggtcgtcaccgagttttacccaaagcctacccttcttgctcagcctggccctgtggtttttccaggcaagtcagtgatcctacgctgtcaaggtaccttccaggggatgagattcgctttgttacaggagggcgctcacgtgcccctccaatttcgaagcgtcagcggcaactcagccgactttctgctgcacacagttggagcagaggactctggaaactatagttgtatttactacgagaccacaatgtccaacaggggttcttacttgagtatgcccctcatgatatgggtgaccgacacttttccaaaaccgtggctgtttgcggaaccatcgagcgtagtgcccatgggtcagaatgtgacgctttggtgtaggggccctgtccacggcgtcggatacatcctgcacaaggagggcgaggcaactagtatgcagctgtggggctccacctcgaacgatggcgcttttcctataactaacatctctggcactagcatgggcaggtactcctgctgttaccaccccgactggacctcatcaatcaagatacaaccctccaatacactcgaactcctggtgacaggcttactgccaaaaccatccctgctggctcagcctgggcctatggtggcgcctggagagaatatgacactccagtgccaaggggaactgcccgacagtacgttcgtgcttttaaaagagggggctcaggagccattggagcaacaacgtccgtccggctatcgagccgacttctggatgccagctgtgcgcggtgaggactctgggatctactcctgcgtttattaccttgactccaccccattcgctgcgtcaaaccatagcgactcgcttgagatttgggtcacggacaaacccccaaaaccatctttaagcgcgtggccatccactatgtttaagctgggaaaggatataactctgcagtgtcggggacctcttcctggtgttgagttcgtcttggaacatgatggtgaggaggctccacaacagttctccgaagatggagactttgtaataaacaatgtggagggcaagggcatcgggaattattcatgctcctatcggttacaggcatacccagacatctggtcggaaccatctgaccctctggaactggttggggctgccggtcccgtcgcgcaggaatgtactgtcggcaacatagtgcgatcttcgttgattgtggtggtagtggtagcgctgggggtggtcttggctattgagtggaaaaagtggcccagattgagaacacggggatccgagaccgatggcagagaccagactatcgccctggaggagtgcaatcaggaaggagaaccaggcacccctgccaatagcccctcttccacaagccagagaatcagcgttgagttaccagtacccatatag

SEQ ID NO: 226660 - DNA, 3984 bp, Artificial Sequence
  Description of Artificial Sequence: Synthetic coding sequence
atgaccctggatagacccggagaaggggcaaccatgttgaagacctttactgtactcctgttttgtatactgatggatccacagcccgaactatggattgaatccaattacccgcaggctccatgggaaaatataacattatggtgccggagcccgagcagaattagtagtaaatttctgttgctcaaagacaaaacccagatgacatggattagaccaagtcacaaaacctttcaagtaagcttcttaatcggagcacttaccgagagtaacgccggtctttaccgctgctgctactggaaggagaccggatggtctaagccttctaaggtgctggagctcgaagcgcctggtcaattgcccaagcctatcttctggatccaggcagagaccccggctctgccagggtgcaacgttaatatactctgccacgggtggctgcaggacttggtgttcatgcttttcaaggaagggtacgcagagcctgttgactaccaggtgccgaccggtaccatggctatattcagcattgataacctgactcccgaggacgaaggtgtctacatttgccggacccacatccagatgctccctactctttggagcgaaccgtctaacccgctgaagctggtggttgccggactgtacccaaagcctacactgaccgcacaccctggccctataatggccccaggtgaatccctgaatctgcgctgccagggaccaatctatggaatgacattcgctttaatgcgggtcgaagacttagaaaagtctttctatcacaagaagacaatcaaaaatgaagccaacttcttctttcaaagtctgaagatccaggacactgggcattatctttgcttctactacgacgccagctatcgcggatctctgctgtcagacgttcttaagatttgggtcacagatacctttcccaagacatggttgctcgcgaggccgtcggcagttgtgcagatgggccagaatgttagtctgcgttgcagggggccagtcgacggggtgggattagccttgtacaagaagggtgaagataaaccactccaattcctcgacgcaacctccatcgatgataatacatcttttttcttgaacaatgtgacttattctgatacaggaatctactcctgccactacctactgacttggaagaccagcattagaatgccttctcataacacagtcgaactgatggtggtcgacaagcccccaaagccgagcctcagcgcatggccgtctacagtgtttaaactcggcaaggccattactctccagtgcagagtgtcccacccagtgctggagttttcactagaatgggaggagcgggaaaccttccagaagtttagcgtgaacggagatttcataatcagcaatgtggatgggaaagggactgggacctacagctgctcataccgcgtagaaacacaccctaacatctggtctcacagatctgagcccctgaaattaatgggacctgccggatacttgacctggaattacgtgcttaatgaagccatccgcctatctctgattatgcagctggtggccctcctcctggtagtgctgtggatcagatggaagtgcagacgacttcgaattcgggaagcttggcttctggggacagcccagggcgtcacaatgctcttcattgtcactgccctgctgtgctgcgggctctgcaacggcgttttgattgaggaaactgaaattgtgatgcccacacccaagcccgagttgtgggctgaaacaaatttcccgttggcaccgtggaagaaccttactctgtggtgtcgaagtccctctgggtctacaaaggagtttgtcctgctaaaagatgggactggctggatagcaacaaggccagccagtgagcaggtcagggccgcattcccgctgggggcactgacccagagccatacagggtcgtaccactgtcattcctgggaggaaatggcagttagcgagccctcagaagcgctggagctggtcggcacagatatcctgccaaaaccagttatcagtgcttctccgaccatccgcggtcaggaactacaattgcgctgtaaggggtggctagctggaatgggcttcgctctttataaggaaggcgagcaggagccagtacagcagctgggggcagtggggcgtgaggcatttttcactatccaacggatggaggataaggacgaagggaactactcttgcaggacccacacagagaaacgaccattcaagtggtctgaacctagcgagcctctcgaactggtcattaaggagatgtatccgaagcctttcttcaaaacatgggcatcccctgtggtcacccccggtgcccgagtcacttttaactgcagcacccctcatcagcatatgtctttcattttgtacaaagatggttctgaaatcgctagttcagaccgctcatgggcctctccaggggcaagtgctgctcattttctgataatctcagtagggatcggtgacggcggaaactactcctgtcggtactacgatttcagtatatggagcgaaccatccgatcccgtcgaattggttgtcaccgagttctatccaaagcccacccttctggcacagcccggacctgtagtgttcccgggaaagtcagtgatcttgagatgccaaggaactttccaggggatgagattcgccttattacaggagggggcacacgtaccgcttcaatttcgtagcgtgtctggtaatagcgctgatttcctcctccataccgtgggagctgaggattctggaaattactcatgtatatattatgagaccacaatgtccaacaggggctcttacctttcaatgcctctcatgatctgggtgacagatacctttcccaaaccttggctgttcgccgagccatctagcgtcgtgcccatggggcagaatgtgactttgtggtgcagagggcctgtccatggcgtagggtacatcctgcataaagagggtgaggctacatccatgcagctgtggggctccacaagcaatgacggcgcatttccgattacgaacatttccgggaccagcatgggtaggtattcctgctgctaccaccctgactggacttcaagtattaaaatccagccaagcaatactctcgagctgctcgtgactggactgctgccaaagccgtccttactggctcagccaggaccaatggtagcacctggagagaatatgacactgcaatgtcaaggtgagctccccgattcaaccttcgtactgctcaaagaaggcgcacaggaaccgttagaacagcaacgccctagcggctatcgggcagatttctggatgcctgccgtgcgcggagaggactctggaatctatagctgcgtgtattacttggattctactccgtttgccgcttctaatcactcggacagtctggaaatttgggtgaccgataaaccacctaagccatcgttgtccgcctggcctagtaccatgttcaaactggggaaagacattaccctccagtgcaggggacccttaccaggagtagaattcgtcctggagcatgacggcgaagaagccccacagcaattttctgaagatggggacttcgtgattaataatgtggagggaaaaggtatcgggaactatagttgcagttatcgactgcaggcctaccccgatatttggagtgagccatctgatcccctggagttggtcggggctgccggtcccgtggcccaagagtgtactgttgggaatatcgtacgtagctccttgatcgtggttgttgtggttgcccttggggttgtgctggccatagaatggaagaaatggcctcgactcaggacccggggttcagagacagatggcagggaccaaaccatcgctctggaagaatgtaaccaggagggcgaacccggaacgccagcaaacagcccctcatctacctctcaacggattagcgttgagttgcccgttcccatctag

SEQ ID NO: 226661 - DNA, 3984 bp, Artificial Sequence
  Description of Artificial Sequence: Synthetic coding sequence
atgacactcgaccgccctggcgaaggggctacaatgctgaaaaccttcaccgtgctgctgttctgcatcctgatggatccccaacccgagttatggattgagtctaactatccacaggcaccatgggaaaatattacactttggtgtaggtcccctagtcgtatttctagcaagtttttgctgcttaaagacaaaacccagatgacctggatcaggccatcgcacaagacttttcaggtgagtttcttgattggcgctctgacagagtccaatgcgggactgtaccgctgctgctattggaaagaaactggttggagcaagccaagcaaggtgctggaactcgaagctcccggtcagttgcccaagccgattttttggattcaggcggagacccccgcactgcctggctgcaacgtaaacatactgtgccatggctggctacaggatctagtgttcatgctgttcaaggaaggttatgcggaacctgtcgactaccaggtccccacgggcactatggcaattttttctatagacaatttgactcccgaagacgaaggcgtgtatatctgcagaacgcacattcagatgctgccgacactgtggtctgagccgtctaaccctcttaaattggtcgtggcaggcctgtaccctaaaccaactttaacagcccatccaggcccaatcatggcccctggagaaagtctgaatcttcggtgtcaagggcctatttacgggatgacatttgccctgatgcgggtggaggatctggaaaaatcattctaccacaaaaagacaattaaaaatgaggcaaacttctttttccagtctctcaaaattcaggatacgggccactacctttgtttctactacgatgcatcataccgcggtagcctcctgtcagatgttcttaagatatgggttacggataccttcccaaagacctggctgctggccaggccatccgccgttgtgcagatgggccagaacgtcagcctgagatgtagagggccagttgacggagttggattggctctatataaaaagggtgaagataagcctctgcaattcttggacgcgacaagcatcgacgataatacctcttttttcctgaataacgtgacgtacagcgataccggcatttacagctgccactatctgctcacctggaaaacatctatcagaatgccgtcacacaacacagtagaactgatggtcgttgacaagccgcctaagccaagcctgtcagcctggcccagcaccgtgttcaagctgggaaaagcgattaccctgcaatgtcgggtctctcacccagttttagagttcagtctagaatgggaagaacgcgagacgtttcaaaagttctctgtaaacggtgactttataatttcaaacgttgacggcaaggggaccggcacctacagctgttcgtacagagtggagacacatcccaacatctggtcccatagatccgagcccctgaaactgatgggccctgccggttacctcacctggaattatgtcctaaatgaggcaattcgtctgagcctgatcatgcagctcgttgctttgctcctcgtggtactatggatcagatggaaatgccgacgtctccgtattcgagaggcttggctcttggggacagcccagggtgtgaccatgctatttatcgtcaccgccctcctgtgttgcggactttgcaatggggtgttgatagaggaaactgagatcgtgatgcccacaccaaagcccgagctgtgggctgaaaccaactttcctttagcaccttggaaaaatctgaccctttggtgtagatctccgagcgggtccactaaggagttcgttttactcaaagacggtacaggatggattgctactaggcccgcaagcgaacaggtgcgggctgccttccccctgggcgctttgacccagtctcataccgggtcctaccactgccacagctgggaggaaatggcagttagtgagcccagcgaagccctggagctcgtgggaactgacatcttgcccaagcctgtgataagtgcatccccaacaattagaggccaggaactgcagctgagatgcaagggctggttagctggcatgggttttgccttgtacaaagaaggcgaacaggagcccgtacagcagctcggagcagtgggcagggaggccttctttaccatccagagaatggaggacaaagacgagggcaattacagctgtcggacccacaccgagaaaaggccgttcaagtggtccgagccctctgaaccacttgagcttgtcatcaaggaaatgtatcccaagccattcttcaagacctgggcctcccctgttgtgacccctggagccagagttacgttcaattgcagcactccgcatcagcacatgagtttcatcttgtacaaagacgggagcgagatcgcctcctctgaccgaagctgggccagtcctggtgcatcagctgcacactttttgatcatctccgttggaatcggggatggagggaactactcatgccgctactacgacttttccatctggagtgaaccttctgacccagtggaactggtagtgacagagttctatcccaagccaacgctcctcgcacagcctggtccagtggtgttcccgggaaagtccgtcatactgaggtgtcaaggaacattccagggtatgcggtttgcactcctgcaagaaggtgcccacgtgcctttacagtttcgctcggtcagcggcaattcggcagactttctcctgcatacggtgggagccgaggatagcggcaattattcatgcatatactatgaaacaaccatgagcaatcgcggtagttacttgtctatgcccctcatgatctgggtcactgatacgttccctaagccttggctctttgccgagccaagctctgtggtcccgatgggccaaaacgttactctgtggtgtagaggcccagtacatggtgtgggatacattcttcataaggaaggtgaagctacctctatgcagctgtggggaagcacctccaacgacggcgctttccccatcacaaatatctctggcacaagcatggggcgatactcctgttgttaccaccccgattggacctcttctatcaaaatacagccaagcaataccctcgaactcttagtgaccgggctacttccgaaaccatccctgttagctcagcctggccctatggtggccccaggcgagaacatgaccctgcagtgccagggtgaacttcccgatagcacctttgtccttctgaaggagggggctcaggagcctctggagcaacagcgaccatccggatatcgcgcagatttctggatgccagctgtgaggggagaggactcaggcatttacagctgcgtgtactatcttgactctaccccgttcgccgcatccaaccacagcgactcccttgagatctgggtcaccgacaagccaccaaagcctagcttgagtgcctggccgtctacaatgtttaagctggggaaagatataactttgcagtgccggggtccactgcccggtgttgaatttgtcctggaacacgacggcgaggaggcccctcaacagttttcagaggacggggactttgtaattaacaatgttgagggcaaggggatcgggaattatagttgtagctatcgcctacaagcttaccctgacatttggtctgaaccttcagatcctcttgagctagttggggctgctggccctgtggcccaggaatgtacggtcggcaatattgtgcgatcctctctcatagtggtggtagtggtagctctgggtgtggttctggctatagagtggaagaaatggcccaggctgagaacgcgcggatccgagaccgacggccgagaccagacaatagcactggaggagtgtaaccaagaaggggagcctgggactcccgctaacagtccatcctctacgtcacagcggatcagcgtcgagctgcctgtgccaatctag

SEQ ID NO: 226662 - DNA, 3645 bp, Artificial Sequence
  Description of Artificial Sequence: Synthetic coding sequence
atgaagtgtttttttcccgtgctctcttgccttgctgtgctcggtgtcgtgtcagcccagcgtcaggtcacggtgcaggaaggccctctttataggactgaggggtcacacatcactatctggtgcaacgtgtcgggctatcaaggacctagtgagcagaacttccagtggagcatatacctgccttcttcccctgaacgcgaagtgcagattgttagtacaatggactcctccttcccgtatgcaatatacacacaaagagtgcgcggtgggaagatcttcatagagcgggtacaaggaaattctacactgttacacataactgacctccaggccagggacgctggcgaatatgagtgccatacaccaagtaccgataaacagtatttcggatcttattccgcaaaaatgaatctggtggttataccagactccctgcagacgacagcaatgccacagaccctccatcgggtcgagcaggacccgctggaactcacctgtgaggttgcctctgagaccattcagcacagccacttgtccgttgcctggttacgacaaaaggtcggtgagaagccagttgaagtgatctccctctcacgggacttcatgcttcacagctctagcgagtacgctcaaaggcagtcgttgggagaggttcgcctggataagcttggtagaactacctttagattgacaattttccatctgcaaccatcagaccagggggagttttactgcgaagccgctgagtggatacaggatcctgatggttcctggtatgccatgacccggaagaggagtgaaggtgccgtcgttaatgtccagccgaccgacaaggagtttaccgtcagactggagactgagaagcgcctccacacggttggagagcccgtggaatttaggtgcatcctcgaggcgcaaaacgtgccagaccgctatttcgccgtctcgtgggcattcaattcttctctgatagctacgatgggacctaatgccgtgcccgtgctgaactccgagtttgctcaccgggaggccagaggccaactgaaagtggcaaaagaaagtgattctgttttcgttttaaaaatatatcatctgcggcaggaggacagtggcaagtataattgccgggtgacagagcgagagaagacagtcaccggtgagtttattgacaaggaatccaagaggccaaaaaatattccaatcattgtactccccttaacagataactgggttgttaaggttcctcagcatcaccagctcctgtcacagggacatctggagagcagtatatccgtggaggtggcgtcaaatgccagtgtcattctagaaggtgaagatttaagattctcttgttctgtgcgaacagcgggacgacctcaaggacggttctccgtgatctggcagctggtggatcgacagaaccggagatctaacataatgtggcttgatagagatggtacagttcagccaggctcctcctattgggaacgttcctctttcggcggagtgcagatggagcaggttcagcccaattccttctcacttggaatctttaactcccgaaaagaagatgaagggcagtacgaatgtcacgttacagagtgggttcgggctgtggatggagagtggcagatcgtcggcgaaagaagagcaagtacaccaataagtataaccgcccttgaaatggggtttgccgttaccgccattagtcgtactcccggagtgacctatagcgatagtttcgacctacagtgtatcatcaagcctcattatccagcctgggtgccagtttcagtgacatggaggtttcagcccgttggaaccgtggaattccatgacctagtgacattcacccgagacggaggggttcagtggggagatcgctcttctagctttcgaaccaggactgctattgagaaagccgaaagcagcaataatgttaggctgagcatctcacgggcttccgatactgaggcagggaaatatcaatgtgttgcggagctgtggaggaaaaattacaacaacacctggacaaggctggctgagcgcacctccaatctcctcgagattagggtactgcagcctgtgaccaagcttcaggtctccaaatctaagcggactctcaccttagtcgagaacaaacccatccaacttaattgtagcgtgaaaagccagacgtctcagaattcccatttcgcagtcttgtggtacgtgcacaagccctccgacgccgacggcaagctcattctcaaaacaacccacaactccgcatttgaatacgggacatatgccgaagaggaagggctaagagctcggctccaatttgaacgccatgttagtggcggactgtttagccttaccgttcagagggccgaagtctctgattctggcagttactattgtcacgtggaagagtggctcctgagccctaattatgcgtggtacaagctcgctgaggaagtatccgggaggaccgaggtgacggttaagcagccggattcccgtctgaggctgagtcaggcccaagggaatttaagcgttctcgagacccgacaggttcagctcgaatgtgtggttttgaatcggacgtctatcacgagtcagctcatggtagaatggttcgtatggaaaccaaatcatcccgagcgcgagaccgtggccagactgtcacgggatgctaccttccactacggggaacaggccgctaagaacaatctgaaggggaggctccacctagagagcccaagcccgggagtgtatcgactgtttattcagaacgtggcagtccaggactctggcacctattcctgtcacgttgaagagtggcttccttccccatctgggatgtggtataaaagagccgaggacaccgcagggcagaccgccctcactgtcatgaggcccgacgctagcctgcaggtcgacacagttgtgcccaatgcaaccgtttccgagaaagccgcatttcaacttgactgttctattgttagtaggtctagccaggactcaaggttcgcagttgcttggtactccctaaggacaaaagctggcggtaagcgttcttcccctggtctcgaagaacaggaagaagagcgcgaggaagaggaagaagaggacgacgacgacgatgacgatccgactgaaaggacagcccttctgtctgtcggtccggacgccgtcttcggccctgaaggttcaccttgggagggcaggctccgtttccaacgcctgagtcctgttctgtatagactaacagtactgcaggctagccctcaagataccggaaactactcttgccacgttgaggagtggttaccgtccccacagaaggagtggtacaggttaacggaggaggaatccgccccaatcggaataagggtgctggatacctcaccaactctacagtcaattatatgttcgaacgatgccctgttctacttcgtcttcttttatcctttccctatcttcggaattcttattattactattcttttggtgcgctttaagtcacggaactcctccaaaaacagcgatggcaaaaatggggtgcctctgctgtggattaaagagccccacctaaactatagccccacatgcctggaacctcccgtgctttctattcaccccggagcgatagattag

SEQ ID NO: 226663 - DNA, 3645 bp, Artificial Sequence
  Description of Artificial Sequence: Synthetic coding sequence
atgaaatgtttctttccggtgctgtcatgtcttgcggtgctaggagttgttagcgctcaaagacaggtaacggtgcaggagggcccactttacagaactgagggcagtcatatcactatctggtgcaacgtgtccggctaccagggaccctctgaacagaattttcagtggtccatttacttacccagttcccccgagcgcgaagtgcaaattgtaagtacaatggattcctccttcccatacgccatttatacccagagggttagaggaggtaagatattcatcgaacgggtgcaaggcaactcgacattgctgcacatcaccgacctccaggccagagacgccggagaatacgaatgtcacactccatccacagataagcagtacttcggatcctacagtgccaaaatgaacttggtcgttatccctgactctcttcagacaaccgctatgccccagaccttgcatcgggtggagcaggacccactggagctgacatgcgaggtggcgtccgagaccattcagcactcccacctgtccgtggcctggctgagacagaaagtcggtgaaaaacccgtggaagtaatatcactgagccgcgattttatgctgcacagctcttctgagtacgcccaacggcagtctctcggcgaggtaaggctggacaaactgggacggacgacattccgcctgacgattttccatctccaacccagtgaccagggcgagttttattgcgaggccgcagaatggatccaggatcccgatggctcatggtacgccatgacaaggaaacgatccgaaggcgctgttgtcaatgtccagcctactgacaaggagtttacagttcggctcgagactgagaagcgccttcataccgttggagaacctgtagaattccggtgcattttggaagcccagaatgtacccgacaggtattttgctgtttcctgggcattcaactcatctctgatcgcaactatgggcccaaatgctgtgccggttctgaactcggaattcgcccatagagaggcaagaggccagctaaaggtcgccaaagagtcagacagtgtcttcgtgctcaagatttatcatcttcgacaggaagattcaggtaagtacaattgcagagttacagagcgagagaagaccgtgactggagagttcatcgataaagaaagcaagaggcctaaaaacattcctatcattgtcctgccactgacagataactgggtggttaaggtacctcagcaccaccaactgttgtctcaaggccacctggagagtagcatcagcgtggaagttgcatctaatgcatccgtcatactcgagggagaggaccttcgcttctcatgctcggtgcggactgccggtcggccacagggcagattctctgtgatttggcagctcgtcgaccggcagaacagaaggtccaatatcatgtggctcgatcgcgatggcaccgtgcagcccggttcatcttactgggaaagatctagttttggcggtgtgcagatggagcaggttcagcccaattctttctctctgggcatctttaattctcgaaaggaggacgagggacagtacgagtgtcacgtgactgaatgggtgagagcagtcgatggcgagtggcagatcgttggggagagacgagcatctacgccaatttccatcaccgcacttgagatgggttttgccgtcactgccatctcaaggacacccggagtcacttatagtgattctttcgatctccaatgcattatcaagccccactacccagcgtgggtgcccgtctctgtgacttggcgctttcagccagttgggactgtggaattccatgatcttgtaacattcacccgcgatggtggcgttcagtggggggacagatctagttcatttcggacgcggaccgccatagaaaaggcggagtcctcaaataacgtaaggttgtctatctcccgtgcctctgacactgaagctgggaagtatcagtgcgttgctgaactttggaggaagaattataacaatacctggactcggctcgctgagagaaccagtaatctgttggagatccgagtcctccaacccgtgactaagctgcaggtgtccaagtccaaaaggactctgactctggtggagaataagccaattcagctgaattgctcagtgaagtcacagacatctcagaacagccattttgcagtcttatggtatgttcataagcccagcgatgctgacggaaaacttattctcaagacaactcacaattctgcctttgaatacggaacttatgctgaagaagaagggctcagagcacggctccagtttgagcgtcacgtgtcgggcggtttgtttagcttgacagtccagcgcgcagaggtgagcgactctgggtcctactactgccacgtcgaagagtggctcttgtctcccaattacgcttggtacaagcttgccgaagaagtctccggccgaactgaggttacagtcaaacagcctgattcacgcttacgtttgagccaggcccagggtaatttgagtgttctagagactcggcaggttcagctggagtgcgtcgtcctgaaccggaccagtatcacgtcacagctgatggtggaatggttcgtttggaaacctaaccatcctgagcgagagactgttgccaggctgtcccgggatgctacatttcattacggcgagcaagcagccaaaaacaatctgaagggccgtctgcacctcgagagcccctcccctggggtgtaccgtctgtttatccagaacgtcgctgtccaggatagtggcacatactcttgccacgtggaagaatggctcccctcaccctccgggatgtggtataagagagctgaagacaccgctggtcagacagccctcacagtgatgcgccctgacgcctctctgcaggtcgatacggttgtgcccaatgccaccgtctcagaaaaggcagctttccaactggattgctctatcgtctcaaggtcatcacaggatagccgatttgcagtcgcctggtactccctgaggaccaaagccggaggtaagagatcctcacccggacttgaggagcaggaggaggagagggaggaggaggaggaggaagatgatgacgatgacgatgatcccacagagcgaacggcgttgctctcagtggggccagacgcagtgttcggacctgaggggtcaccatgggaaggaagactacgcttccaaagactatctcctgtcctttaccgtctgacagttctacaggcctccccacaggatacaggaaactattcctgccatgttgaggagtggctaccctctcctcagaaagagtggtataggctgaccgaagaggagtcagcgccaatcggaatacgtgtgctggatacctctcccacgttacaaagcataatctgttccaatgatgccctgttttactttgtgtttttctacccatttcccatttttggaatcttaatcatcacaatactcttggtgagattcaagtcacgcaactcgtcaaaaaactccgacgggaaaaacggtgttccactcctctggattaaggagcctcatctcaactactctccgacctgtttggaacccccagtattgtccattcacccaggtgcaatcgattag

SEQ ID NO: 226664 - DNA, 3585 bp, Artificial Sequence
  Description of Artificial Sequence: Synthetic coding sequence
atgaaatgctttttccccgtgctgtcttgcctggccgtgctcggtgtcgtgagcgcccagcggcaggtaactgttcaggaggggcctctgtatcggacagaaggtagtcacataacaatatggtgtaacgtgtccggctaccaggggccatcagagcaaaacttccaatggagtatctatctgccatctagcccagaacgggaggtgcagatcgtgagtacaatggattcctcctttccgtatgccatctatacacagcgtgttagagggggtaagattttcatcgagcgcgtacaaggcaattctacacttctgcatatcaccgacctccaggccagagacgccggtgaatatgaatgtcacacccctagcactgataaacagtattttgggagttatagcgcaaaaatgaacttggtggtgatcccagactcactccagactaccgcgatgccccaaactctgcaccgcgttgagcaggaccctttagaactaacatgtgaagtggcatcggaaaccattcaacatagccacctgtctgtggcctggctgagacagaaggtcggagagaagcctgtcgaggttatcagcttgtctcgggattttatgctgcattctagtagcgagtacgcccagcgccagtcattgggggaagtccgcctagacaagctggggcgaaccacatttagactgaccatctttcatttgcagccgagtgatcagggcgagttttattgcgaggctgcagaatggatccaggacccagatggctcgtggtacgctatgaccaggaagcgttctgaaggcgctgtagtcaacgtgcaaccgacagacaaagaatttacagtccgactggaaactgaaaagcggctccacactgtgggggagcccgtggaatttcgctgtattcttgaggcccagaatgtgcccgatagatatttcgcggttagctgggccttcaacagctctctgatcgctaccatggggccaaatgccgtccctgtgcttaactcagaatttgcacacagggaggccaggggccagctcaaggtggccaaagagtctgactccgtttttgtactgaaaatctatcacctaaggcaagaagacagcgggaagtacaactgccgtgtgaccgaacgagagaaaaccgtcacgggagaatttatcgacaaggagtccaagaggcccaagaatatccctatcatagtgctccccctgaagagcagcatctccgtggaggtggctagcaatgcgtccgtcatactagaaggcgaggatctccgcttttcttgttccgtgcgcaccgcagggcgacctcagggtcggttctccgtgatttggcagctcgtagataggcaaaacagacgctctaacatcatgtggcttgacagggacgggaccgtacagccagggagctcttactgggagcggtccagtttcgggggagtgcagatggagcaggtgcagcccaatagtttctccctggggatcttcaactcccggaaggaagacgaaggccagtacgagtgtcacgtcactgaatgggtgcgcgcagtggatggagagtggcaaattgtgggcgaacgccgtgccagtacgccaataagcattaccgctctggagatgggattcgcggttacagctatctctcggacgcccggtgtaacatattcagacagtttcgacttgcagtgcataattaagccccactaccccgcatgggtccccgtctctgtaacctggcggtttcaacccgtcggcaccgtcgaattccacgatctggtcacttttaccagagatgggggtgtgcagtggggggatcgcagctctagcttccgaactaggacagctattgagaaagccgagtcctccaataacgttcggttgtcaattagcagagctagcgacaccgaggcaggcaagtatcaatgtgttgcagaattgtggcgtaagaattacaataatacttggacccgcctagcagaacgtaccagcaacctgctggaaatccgggtgctccagcccgtgacaaaactgcaagtgtcaaaatctaaacggacactcaccctggttgaaaacaaacccattcagctcaattgcagcgtgaagtcacagacctctcagaactcacactttgctgttctctggtacgtgcataaaccatctgatgccgacggaaagctcatcttgaagaccacacataactcggcattcgagtatggtacctacgcagaggaggagggtctgagggcaagactccagttcgagcggcacgttagcggcggattatttagcctcactgtacagcgcgctgaagtgagcgactctggttcctattactgtcacgttgaggagtggctcctgtcccccaactacgcgtggtacaagcttgccgaggaagtctccggccgtactgaagttacagtgaagcagcccgactcacggctccgacttagccaggcccagggaaacctgtctgtgctggagacccggcaggtgcagctggagtgcgtcgtattgaaccgcacaagtattacttcccagctgatggtcgagtggttcgtatggaagcccaatcatccagaacgcgagactgtggccagattaagcagagacgccacctttcactacggggagcaggctgccaagaacaacttgaagggacggttacacctggagtccccaagccccggtgtctacagactcttcatccaaaacgtggctgtccaggatagcgggacctactcatgccacgtagaggaatggctgccttctcccagcggtatgtggtacaagcgggcagaagatacagcgggacagactgctctgacggtgatgaggcccgacgcctccctacaggtcgacacagttgtgccaaacgctacggtgtccgaaaaggcggcattccaactcgactgctctatcgtgtcccgaagtagccaagatagtaggttcgccgttgcctggtattctctcaggaccaaggctgggggaaagcgctcctccccaggactagaagaacaggaggaggaaagagaggaggaggaagaagaggatgatgacgatgacgacgacccaactgagagaaccgccctgctatcagtgggtccagatgcggtctttggcccagaagggtccccctgggagggtcgcctcagatttcagcgactgtccccagtgctgtaccggctcaccgtgctacaggcctccccacaagacacagggaattatagttgtcacgtggaggaatggctgccgtcccctcagaaagagtggtataggctgaccgaagaagaaagtgccccaatcggaatccgggtgctcgacaccagccccaccctgcagagcatcatctgttctaacgacgccttattttatttcgtgttcttctaccccttccccatctttgggatcctgattattaccatcttgctggtcaggttcaaatcccgtaatagctccaaaaattccgatggcaagaacggcgtgccactcctgtggatcaaagaacctcacttgaattactcccccacctgtcttgagccacctgtgttgtctatccaccccggtgctattgactag

SEQ ID NO: 226665 - DNA, 726 bp, Artificial Sequence
  Description of Artificial Sequence: Synthetic coding sequence
atgggaacagcctcacggtcaaatatagcacgccatttgcaaaccaacctgatcctgttctgcgtgggcgctgtgggggcttgtacgctaagtgtcactcaaccttggtatctagaggtcgattacacccatgaagccgttaccatcaagtgtactttctctgctacagggtgccctagcgagcaaccgacctgcctgtggtttcgctacggcgctcatcagcccgagaatctgtgtttggatggctgcaaatccgaggcagacaagttcacggtgcgtgaggccttaaaggaaaatcaagtgagcctgaccgtaaacagagtgacttctaacgattctgccatctacatctgtggcattgctttccccagcgtgcctgaagctcgagctaaacagacgggcggtggcaccacactcgtggttagggaaattaaactcctgtccaaagaattgagatcctttctgactgcactggtttcactgctgtcggtatatgtaacaggggtttgtgtcgcttttatccttctgagtaagtctaaatcaaatcctttacgtaacaaagaaataaaggaggattcccagaaaaagaagtccgcccgaaggatcttccaagagatcgcacaggagctctatcataaaaggcacgtcgagacaaaccaacagagtgagaaagacaacaacacgtatgagaaccgccgtgtacttagcaactacgaaagaccctag

SEQ ID NO: 226666 - DNA, 1842 bp, Artificial Sequence
  Description of Artificial Sequence: Synthetic coding sequence
atgggcgctcttaggcctaccctgttacctcccagcctcccattgctgctcctcctgatgcttgggatgggctgttgggctcgcgaagttctggtaccagaggggcctctgtaccgcgttgcaggaaccgcagtctctatttcttgcaatgtgaccggttatgaggggcctgctcagcagaacttcgagtggttcctgtaccgtccagaggctcccgacacggccctcggtattgtgagcaccaaggacacccagttcagctatgcagtgtttaaatccagggtcgttgctggtgaggttcaagtgcagcgcctacagggtgatgcagttgtgctgaagattgccaggctgcaggctcaagatgcaggaatttacgagtgtcacacccccagcactgatacgcgttatctcgggagctattccggaaaggtcgaactgagggtcctaccagacgtgctacaagtgtcagccgctccacccggaccaagagggagacaggcccctacctcacctccaaggatgacggtccacgaaggtcaggagctggccctaggttgtctcgcaaggacatcaactcaaaagcatactcatcttgctgttagcttcggcagaagcgtccctgaagcccctgtgggacgatccaccttacaggaagtagttggaattcgatcggacctggccgttgaggcgggtgccccatatgccgaaagactggccgcaggggagctgaggcttggcaaggaaggaaccgacaggtatcgtatggtggtggggggagctcaggccggtgatgcgggaacttaccattgtaccgcagccgagtggatccaggacccagatgggtcgtgggctcagatagcggagaagcgtgcagtgctggcccacgttgatgtccagacactgagtagccagttagccgtgacggtcggcccaggcgagcgtcggatcggcccaggagagccgctggaactactatgtaacgtgtccggggctctccctcccgcaggaaggcacgcagcatactctgtcggctgggaaatggcacctgcaggcgcaccaggccctggtaggcttgtggcacagctggatacagagggcgtgggaagcttgggcccagggtatgagggtcggcatatagccatggaaaaggtggcctctcgtacgtatcgactgagactggaagccgctcggccaggggacgctggcacttacaggtgcctggccaaagcttatgtgaggggttcgggcacacgtctgcgcgaggcagcttctgcgagaagccgtcccctgcccgtgcatgtgcgcgaggagggtgtcgtactcgaggccgtcgcttggctcgccggagggactgtctatcgcggtgaaacagcctctttactttgtaacataagcgtgcggggtggacctcctggtctgcggcttgccgcaagctggtgggtcgaacggcctgaagacggagaactatcatctgtgcccgcacaactcgtgggcggtgtagggcaagacggagtggctgagctcggggtccgccctggcggtggaccagtttcggtggagcttgtgggcccacggagccaccggttaagactgcatagtctaggcccagaagacgagggcgtctatcattgtgccccaagcgcctgggtccagcatgcggattattcttggtaccaggctggctccgcccgaagcggaccagtcaccgtgtatccctatatgcacgcgttggatactctgtttgtgccgctccttgtcggaaccggagtcgccctcgtaaccggtgccaccgtgctgggcactatcacctgctgttttatgaagaggctgagaaaacgctag

SEQ ID NO: 226667 - DNA, 1581 bp, Artificial Sequence
  Description of Artificial Sequence: Synthetic coding sequence
atgggagcactgcgtccgacgttactgccaccgagtctgccactcctgctacttctcatgttgggaatgggctgttgggcacgagaggtcctggtcccagaaggccctctttaccgggtggctggaaccgcagtgtcgattagttgcaacgtgacgggatatgagggcccagcccagcagaactttgaatggtttctttataggcccgaggcccctgacactgccctcgggattgttagcactaaggacactcaattctcctatgcggtgttcaaatcgcgagtggtagccggagaggtccaggttcagagacttcaaggggatgctgtcgtgctgaagatcgccagacttcaggcccaggacgcagggatttatgagtgccatactccatctaccgacacaaggtatctgggctcttacagcggcaaggttgaattgcgtgtactccctgatgtgctgcaggtgtccgcggcaccacctggcccaagaggccgtcaggctcctacatctccaccccgaatgaccgtgcacgaggggcaggaactggccctgggttgcctggcaagaacctctactcagaagcacacacaccttgcggtctcttttggacggtctgtgcctgaggccccagtgggacggtccacactgcaggaagtggtgggcattagatcggacctagcagtggaagctggcgcaccatatgctgagagactggctgctggagaactcaggctgggtaaagaaggtacagataggtatagaatggtggtaggtggtgcacaggctggagacgccggaacttaccactgtacggctgccgaatggatacaggacccagatggtagttgggcgcaaatcgctgagaagcgtgcggtcctggcccacgttgacgtccagaccctctcaagccagctcgctgtgacagtcggcccaggggagcggaggatagggcctggagaacccctggaactactttgtaatgtgagcggagcactgcccccagcagggagacatgcggcttactctgtgggttgggaaatggctcctgcgggagccccaggacccggtcgacttgtggcacaactggatactgagggggtcggaagcctagggcctggttacgagggacggcacatcgcgatggaaaaggtggccagtcgcacttaccggttgaggctcgaggctgcaagacccggtgatgcaggaacatatcggtgtcttgccaaggcctacgttcggggatctggaacacgactaagggaggcagctagtgctcgatcccgccctctacccgtgcacgtccgagaagagggcgtggtcttagaggccgttgcctggctggcaggcggaacagtttataggggcgaaactgcaagcttactctgtaacatttctgtgcggggaggccctccagggctcaggagtgctcggtctgggcctgttactgtatacccttacatgcacgctctggacacgctattcgtcccgctgctagtcggtacaggcgtagcacttgtcaccggtgctaccgttctgggaacaataacctgttgtttcatgaagcgtttgcgcaagaggtag

SEQ ID NO: 226668 - DNA, 1842 bp, Artificial Sequence
  Description of Artificial Sequence: Synthetic coding sequence
atgggtgctctcaggcccacccttttaccacctagcttgccacttctgcttctgctgatgctgggcatgggctgttgggcccgtgaagtgctggtccccgaggggccactgtaccgtgtcgccggaacggccgtctcaatcagctgtaatgtcacaggatacgaggggccagcccagcagaatttcgagtggttcctttatcgcccagaggcaccggacacagccctgggcattgtaagcacaaaagacacacagttttcctatgcggtttttaagtcacgggtcgtggcgggtgaggtgcaggtgcagaggctgcaaggggatgcagtggtcttgaaaattgctcggcttcaggcgcaggatgccggaatatatgagtgccatacaccatcaacagatacacggtatctcggctcatattctggaaaagtcgagctgagagtcctccctgatgtactgcaggttagcgctgcacccccaggtcccaggggacggcaagccccaacctccccccctaggatgacagtgcacgaaggacaggagctcgccctgggctgcttagccagaacatcaacccagaaacacactcatctggccgtcagttttggacggtcggttccagaagcacctgtcggtcggagcactttgcaggaggtggtgggcatccgctcggatctggctgtggaagcaggtgccccttatgctgaaaggcttgcagccggagaactaagactcggcaaagagggcacagacagataccgcatggtggtgggaggagctcaggcgggagatgccggtacctaccattgcactgccgctgaatggatacaagatccagatggctcatgggcgcaaattgcagagaagagagccgtgctggctcatgttgacgtgcagaccttgagtagccagctggctgttaccgtgggaccgggagaaaggagaatcggcccaggcgaacccctcgaacttctgtgtaacgtgtcaggcgcactccccccagctggaagacacgcagcttactccgtaggctgggaaatggctcctgccggtgcccctggcccagggcgactggtggcccaattggatacagaaggagtaggcagccttggacctggctacgagggcaggcacatcgccatggaaaaagtggcttctagaacttacaggttacgcctggaggctgcaaggccaggggatgcagggacttacaggtgcctggccaaggcttacgtgcggggatccggcacccgcttaagggaggcagcgtccgctcgctccaggcctcttccagtgcacgttagagaggagggggtggtactggaggccgtcgcatggctagctggagggactgtgtaccgcggagagaccgcatcactcttgtgcaacattagtgtgcgtggtggcccacccggtctccggcttgcggctagttggtgggttgagcgcccagaagatggcgaacttagttccgtcccggcacaattggttggcggagtcggccaggacggggtcgctgagctgggtgtcagacccggagggggtccggtaagcgttgaactggtcggccctcggagtcacaggctacgactacactcccttggccctgaagacgagggtgtttaccattgtgccccttccgcttgggtccagcatgccgactactcctggtaccaggccggtagtgccagaagcggacccgtcacagtctatccctacatgcacgccctggataccctgttcgtgcctttgctggtgggcacaggcgtggcccttgtaaccggggcaaccgttcttgggaccatcacttgttgcttcatgaagcggctgaggaagaggtag

SEQ ID NO: 226669 - DNA, 906 bp, Artificial Sequence
  Description of Artificial Sequence: Synthetic coding sequence
atgggagctctgagaccaacacttctcccaccaagtctacctctcctgctgctacttatgctggggatggggtgctgggccagagaagtcctggttccagagggtcccctctaccgggtggccggaaccgcagtctctatatcttgtaacgtaaccggctacgaaggaccggcacagcaaaactttgaatggttcctttaccggcctgaagcacccgatacggccttagggatcgtctctacaaaggacacccagttcagttatgctgtgtttaaaagcagagtagttgctggtgaagtgcaagttcaacgattgcagggcgacgccgttgtgctgaagatcgctcggctccaggctcaggacgctggtatttacgagtgccatacaccaagcactgatacacgctatcttgggagctattccgggaaggtggaactccgggtactaccagatgtgctgcaagttagcgccgctcccccaggcccacgtggccgtcaggctccaacttcacctcctagaatgactgtacacgagggccaggaactggccctcggctgtctggcccgtacttcgacacaaaagcatacccaccttgccgtatccttcgggagatctgtcccagaagccccagtgggcagatccaccctccaggaagttgtgggcatcagatctgaccttgcagtggaggccggagctccttatgccgagcggctcgcagccggtgaactcaggcttggtaaggaggggacagaccggtacaggatggtggttggcggagcccaggctggtgacgctggcacctatcactgcaccgcagccgagtggatccaggatcccgacggctcctgggcccagatcgccgagaagcgtgctgttcttgcccatgtcgacgttcagacactctag

SEQ ID NO: 226670 - DNA, 2154 bp, Artificial Sequence
  Description of Artificial Sequence: Synthetic coding sequence
atggtgtggtgcctggggcttgctgtgctcagtctcgtaataagccaaggggctgatggcagaggtaagcctgaagtggtgagcgttgtcgggcgtgccggtgaatcagtggtgttaggctgcgatctacttccacctgcagggaggccaccacttcacgtgattgagtggttgcgctttggattcctgctgcctatctttatccaattcggcctttacagcccacggattgaccccgactacgtcggcagagtgagactccagaagggcgcttcactgcagatagaggggcttcgagtggaggaccagggctggtatgagtgtcgcgtcttcttcctggaccagcacattcccgaggatgactttgctaatggtagctgggtccatttgacagtgaattcccctccccagttccaggaaacgccacccgctgttctggaggtgcaagaactggaaccagttacactgaggtgcgtggctaggggaagtccgctccctcatgtgacctggaaattacgaggaaaggacttgggacaggggcaggggcaggtacaagtacagaacggcaccctaagaatcagaagagtcgagcgcggtagcagcggcgtgtatacttgtcaggcttccagtacagagggatccgccacgcacgcaactcagctcttggtcctgggccctcctgtgatagttgtgccccctaaaaattccaccgtaaatgcttcacaggatgtcagcttggcatgtcacgcagaggcttacccagctaacctgacatattcttggtttcaggataacataaacgtgttccacatttccagattgcagcccagagtgcgcatccttgtagacgggtcactccgattgctcgccacacagccagacgacgccggatgctatacatgtgtgccctctaatggcctactccaccccccttcagcttctgcatacctgactgtgctttaccctgcccaggtgactgccatgcccccagagacaccactgcccattgggatgcccggagtcattcggtgccccgtgagagcaaacccgccactgctgtttgtgtcctggaccaaagatggtaaagcgcttcagttggacaaatttcctggttggagccagggaactgaaggctccttaatcattgctctgggaaatgaggacgccctgggtgagtactcttgcactccgtacaactctctgggaactgctggacctagccccgttacccgtgtgcttctgaaggctcccccagccttcattgaaaggcccaaagaagagtattttcaagaggtggggcgagagctgctgattccttgcagtgcgcagggggacccccctcccgctgcccctccgtcacccctccctggcccaggccctctgctgcagtatctgtcactgccttttttccgggaaatgaacgttgatggtgactggccacctcttgaggaaccgagccctgcagccccacccgactacatggacacacgtcggtgccctaccagttccttcctgcggtcacccgagaccccaccagtgtcgccgagggagtctctgcctggcgcagtggtgggggctggagctacggcagagccaccatacaccgctctggctgactggactttgagagagcgcctcctgcccggactgctgccagccgctccacgcggatctctcacctcacaatcttctggcagaggatctgcttctttcctaaggccaccttccaccgcacctagcgccggtggatcctatctgtcaccagcacctggggatacatctagctgggccagcgggccagaaaggtggcccagacgggaacacgttgtaaccgtgagcaagcgcagaaatacatctgtagacgaaaattatgagtgggattccgaatttccaggtgacatggagctgctagaaaccctacatctcggcctggccagcagcaggctgaggcccgaggctgaacctgagctgggcgtgaagactccagaggagggctgcctgctcaatactgcacatgtgactggcccagaagccaggtgcgctgctctgcgcgaagaatttcttgcctttcggagaaggcgcgatgccacacgtgcccgtctacccgcttaccggcagcccgtgccccatcccgaacaggcgactctgctttag

SEQ ID NO: 226671 - DNA, 3492 bp, Artificial Sequence
  Description of Artificial Sequence: Synthetic coding sequence
atggtctggtgtctggggttggccgtgctcagcttggtgatatctcagggcgcagacggacggggaaagccagaagttgtatccgtggttggacgggctggtgaatctgtggtgttagggtgtgacctactcccgcctgccggaaggcctcctctacacgtgatcgagtggctgagattcggttttctgctgcccatctttattcagtttggtctttattctccccgtattgacccagactatgtcggacgggtgcgactgcagaagggcgcttctctccagatcgagggtttgcgggttgaggaccaaggctggtacgaatgcagggtctttttcctggaccagcatatccctgaagatgacttcgcaaatggatcgtgggtccatctcaccgtgaactccccaccccaattccaggagaccccccctgctgtcctcgaagtccaagaactggaacccgtcactctgaggtgtgtcgccagaggttcgccccttccacacgtgacttggaaacttcgcggaaaggatctgggacagggccagggccaggtccaagttcagaacggcacactgcgcatccggcgtgtcgaacgtggctcatccggtgtttatacctgccaggccagtagtaccgagggaagtgcaacccacgccacacaactgttggtactgggacctcccgtcatcgtagtgccccctaaaaactctaccgtgaacgcgagccaagatgtctcactagcatgtcatgctgaagcatacccagccaacctgacttactcctggttccaggataatattaatgtcttccatataagccgattacagcccagggtacgcatattggtcgacggctctctcagactgctagccacgcaacctgatgacgcaggatgttatacatgtgtgcccagtaatggactgctccaccccccaagcgcgagcgcctacctcaccgttctgtgtatgcctggagtcatccgctgcccggtccgcgcaaatccaccgctcctgttcgtttcttggactaaagacggaaaggcactgcagctcgataagtttcctggttggtcccagggcaccgagggtagccttatcatcgccctcgggaatgaagacgccctcggtgagtattcgtgcactccttataacagcctgggcaccgccggtccctcccccgtgacccgggtgctcctgaaggcaccacctgctttcatcgagcgaccgaaggaggaatacttccaggaggtcgggagagaattgctgattccctgttctgcccagggcgacccccctcccgtggtgagctggacaaaggtgggtcgaggccttcagggccaagcgcaggtggacagtaacagttcactcatcctccgcccactcaccaaagaggctcatggccactgggaatgctctgctagtaatgctgtcgctagagtggctacttcgaccaatgtatacgtgttgggcacctccccacatgtcgtcactaacgtcagtgtcgtggccctccctaaaggagccaacgtctcctgggagcctgggtttgatgggggatatctccagcgttttagcgtttggtacactcccttggcgaaacggcctgataggatgcaccacgattgggtgagcctggctgtgcctgtaggcgctgctcatctcctagtgcccggactgcaaccgcatactcagtatcagttttccgtcctagctcagaacaagctaggttcaggtccatttagcgagatagttttaagtgcgccagagggcctacctactactcccgctgcccctggcttgcccccaacagagatacctccaccattaagccctccacggggtcttgtggcagtcagaactcccaggggagtgctgctgcattgggaccccccagagctggtacctaagcgcctggacggctatgtcttagaggggcgtcagggatcacaggggtgggaagtcctggatcctgcggttgccggaactgagaccgagttgcttgtgccaggcctgatcaaggatgttctctacgagttccgcctggtagcattcgccggttccttcgtgtctgacccctccaacacagcaaacgtgagcacaagcggccttgaggtttacccgagtcgaactcagcttcctggcctgctgccccagcctgtgctcgctggagtggttgggggagtatgttttttaggagtagctgtgctcgtgagcatcttggctggctgcttattgaaccggcgacgggctgcacggcgacggcgtaaacgtttgagacaggatccccctcttattttctccccgacaggcaaatcagcagccccttctgccctgggctcggggtctcccgattccgtagccaaacttaagttgcaggggtcgcccgtgcctagtttacggcagagcctgctgtggggggatccagccggaactccctctcctcatcccgaccccccttcatctcgcggtccactcccactggaaccaatctgccggggacccgatggacgcttcgttatgggaccaaccgtcgcggcaccacaggagagaagtggtcgcgagcaggcagaaccgcgtacacccgcacagaggctggcgcgatcttttgactgctctagttcaagcccatcaggcgctcctcagcctttgtgtatcgaggacatctccccagtggccccacctcctgctgctcctccctcacctttgcctgggcctggtcctcttctgcaatatctctcactcccctttttccgggagatgaatgttgacggcgattggccacccctggaggaaccatcacccgcagcgcctcccgactacatggatactcgtcgctgtcctactagctcttttctcaggtcacccgagaccccaccggtaagtcccagggagtctcttcccggtgctgtcgtgggcgctggcgctacagccgagcccccttacaccgcactcgctgactggacactgagggaacgattactgcccggactactcccagcagctcctcggggatcgcttacatcccagagctctgggagaggttcagcatcgtttctgcgcccaccctctaccgcaccctcggccggaggcagttacctgagtccagctcccggagataccagcagctgggcctccgggcctgagcggtggccacgccgagaacacgtcgttactgtgagtaaacgtagaaatacttccgtagatgagaattacgaatgggattcagaatttcccggagacatggagctgctggagacattgcatctcggacttgcctcctctagattacgccctgaggccgagccggaactgggggtgaaaacgccagaggagggttgcctgctaaacacagcacacgtaacgggacccgaagccaggtgtgcagccctgagagaagaatttctggcttttcgccgtagacgggatgcaacccgcgctcgactcccagcctacaggcaacccgtccctcaccccgaacaggccacattgctttag

SEQ ID NO: 226672 - DNA, 3540 bp, Artificial Sequence
  Description of Artificial Sequence: Synthetic coding sequence
atggtttggtgccttgggcttgcagtgcttagcctggtgatttcacagggagccgatggcaggggcaagcccgaggtcgtgagcgtagtgggaagagcaggcgaatcagttgtcctcggttgtgatctgctccctccagcaggtcggccaccgctccatgtgatcgagtggttacgtttcggtttccttctcccaatttttattcaattcggattgtactcaccacggatcgatcctgattatgtcggcagggttcgcttgcagaagggggcaagtctgcagatcgagggactgagagtggaggatcagggctggtatgaatgcagagtattttttttagaccaacacattcccgaagatgatttcgccaacggaagttgggtccatctcacagtcaacagcccacctcaatttcaggagaccccaccggcagtgctcgaggtccaggaactggaaccagtgacactgcgatgtgtcgcacgagggtctcctttgcctcacgtcacctggaagctgcgcggtaaggatctggggcagggacaaggtcaggttcaggttcagaacggtacattgaggatcaggcgcgtcgagaggggatcctccggtgtgtacacttgccaagcatcatccactgaaggcagcgctactcatgcaacccagctgctggtgctggggcctccagttatcgttgtaccccctaagaattccactgtgaacgctagtcaagacgtctcactggcatgccatgccgaagcataccctgccaatctgacgtattcatggtttcaagataacatcaacgtctttcatatcagccgactgcagcctagagtaagaattctcgtggacggaagcctgagacttctggctacacagccggatgatgcagggtgctacacttgcgtgcctagcaacggtctcttgcacccaccatccgctagtgcgtatcttaccgtcctctaccccgctcaagtcacagctatgccccctgagactcctctccccattggaatgcccggtgtcatacggtgcccagtgagagccaatccaccgctcctctttgtcagctggaccaaggatgggaaagcattacagctggacaagtttcctgggtggtcccagggaactgaaggatcactgataattgcattaggcaacgaggatgccctaggtgaatacagctgcaccccatacaacagcctgggcaccgctggcccttcccccgtcacaagggtcctattgaaggctcccccagcatttattgagagacccaaggaagaatactttcaggaagtcgggagggagttactgataccctgctccgctcaaggagatccccctccagtggtttcttggactaaagtaggcagggggttgcaggggcaagctcaggtggattctaacagcagcttaatcctcagacccctgacaaaggaggcacatgggcattgggaatgttctgcatccaacgccgtcgctcgggtggcgacgtccaccaacgtgtacgtgctgggaacctccccgcacgtagtgactaatgtctctgtggtcgccctacctaagggagccaacgtgtcttgggaaccgggattcgatggcggttacctccagcggttctccgtttggtacacccctcttgcgaagagaccagaccgcatgcaccacgattgggtgtccctcgctgttcccgtcggagctgcccacctgctggttcctggccttcagccgcacacccaataccaattctccgtcctggctcaaaacaagctcgggtctggtcccttctccgagatcgtcctgtccgcgcctgagggattaccaactactccagcggctcccggactaccacctacggaaatcccaccaccactcagtccaccccgtggtctggttgctgtgagaactccaagaggcgtactgctccactgggaccccccagagctggtccctaagagactggatgggtatgtgctggagggccgtcaggggagccagggctgggaggtgctggacccagcagttgctggaacagagaccgaactacttgttccaggtctgatcaaggacgtcttatacgaattccggttagtggcctttgccggatcattcgtgtccgatccttccaacacagctaacgtttccaccagcggtctggaggtataccccagcagaacacaactgcccggactactgcctcagccggtgctcgcgggagtcgttggcggagtttgctttttaggagtggcagtgctggtgtccatcctggcaggctgtctgttgaaccgtcgtagggctgcccgtcgtaggagaaagcgattaaggcaggacccaccgctcatctttagtcccactggcaaatcggccgctccctcagctcttggatccggaagccctgacagcgtggcaaagcttaagctgcaaggctctcccgtcccgtccctcagacagagtttgctgtggggagaccccgcagggactccatccccgcaccccgatccacctagctcacgcggacccctgcctctcgagcccatttgccgtggacctgacggcagattcgttatgggcccaacggtggctgctccccaagaaaggtccggaagagaacaagcagagccaaggactccggctcagagactggcgagatctttcgattgctcttccagtagcccaagcggtgcaccacagccactttgcatcgaagatatctcccctgtggcgccaccgcctgccgcaccaccctctcccttgcctgggcctgggcctctccttcagtacctcagtctgccgttcttccgggagatgaacgttgatggagattggcctcctctcgaagaaccaagccccgctgcccctccagactacatggacacaaggcggtgccccactagcagcttcctgcgttctcccgagacaccaccagtgtcccctcgcgagtctctcccgggtgccgtggttggagctggagcaacggctgaaccaccttatactgccctcgccgattggaccctccgcgaaaggctgcttccaggcctactgcctgccgcacccagaggtagcctgacctcccagagcagtggtcggggaagtgccagtttcctccggccacctagtaccgccccaagtgccggaggcagttacctctctcctgcgcctggagatacatccagctgggctagcggtccagagaggtggcctcggcgagagcacgtggtgactgtatcaaaaaggaggaacacatcagtggatgaaaattacgagtgggactccgagttccctggagacatggagctgttggagaccttacacttaggacttgcatcctcgagactgagacccgaagctgaacctgagctaggagtgaagacgcccgaggaagggtgtctgcttaataccgcccacgttactggacctgaggctcgatgtgcggcacttcgcgaagaattcctggcgtttcgacgaaggagggatgcaacgcgagcacgcttgcctgcttatagacagcctgtcccacatccggaacaagccaccctcttgtag

SEQ ID NO: 226673 - DNA, 4050 bp, Artificial Sequence
  Description of Artificial Sequence: Synthetic coding sequence
atgatctggtacgtggcaacttttatcgcttccgtcattggaacaagggggctggctgcagagggcgctcacggactgagggaggagcctgagtttgtgacagcccgagcaggagaatcagtggtcctgagatgtgacgtgattcacccagtgacgggtcaaccgccaccatacgtggtggaatggtttaaattcggggtgcctatcccaattttcatcaaattcggttattacccgccacacgtggatccggaatacgctggccgtgcctctcttcacgataaggccagcctccgccttgagcaagttcgcagcgaggatcagggctggtatgagtgcaaggtgcttatgctcgaccaacaatatgacacttttcacaatgggtcctgggtgcacctgacgattaatgcaccacccacattcacggagacacccccacagtacatcgaagcaaaagagggcggttcaattacaatgacctgtaccgcctttggcaatccaaagcccatcgttacctggcttaaggagggcacgctgttgggagcctccggcaagtaccaggtctctgatgggtccctaacagtcacatcggtctctagagaggatcgcggagcttacacatgccgagcttactcaattcaaggagaggccgttcacactacccatctgcttgtgcagggccctccattcatagtatcgccacccgaaaatataactgtgaacatttcgcaggacgctttactgacatgcagagccgaggcctaccccggtaacctcacatacacatggtactggcaggatgagaatgtttatttccagaatgacctgaagctacgcgtaagaatcctcattgacggcactcttatcatcttccgggtgaagccggaggatagcggtaagtacacctgtgtcccctctaactcactcgggagaagcccgtccgcctctgcctatctcactgtgcagtatccagctcgggttctgaacatgccaccagtcatatacgtgccagtgggaatccatggttacattcgctgtcctgtggacgcggaaccccctgccactgtggtgaagtggaacaaggatggtcggccactgcaggtcgagaaaaatctaggctggactctgatggaagatggcagtattagaatcgaggaggccacggaagaggcactcggtacctatacttgtgtgccatataataccctgggcaccatgggacagtcagccccagctaggctggttttaaaggaccccccttattttaccgtgcttccaggctgggaatatcggcaggaagccggacgggagctgctcataccgtgtgcggctgccggagatccgttccctgtcattacctggcgaaaggtgggtaagcctagtaggtccaagcatagcgcgctgccttccgggtctctccagtttcgagccctgtcaaaagaggaccatggagagtgggaatgtgtcgctaccaatgtagtaacgtctatcacagcctccacccacttgacagtgattggcacgagccctcatgcacctggctccgtgcgcgtccaggtgtctatgacaacggctaacgtgagctgggaacccggatatgatggcggatatgagcagacctttagtgtgtggatgaagcgagcccagttcgggcctcacgactggctgtccctgcccgtcccaccgggtccctcctggctgttagttgacacactggagcctgagaccgcgtatcagtttagcgtcctggcccaaaacaagcttggcacctcggcgtttagtgaggtggtgactgtgaacaccctcgccttccccatcaccacaccagaacccctcgtgctcgtgacgccgcctcgctgcttgattgcaaatagaacacagcaaggagtattgctgtcatggctgcccccagctaatcattcctttcccatcgatcggtacatcatggagttcagggtggcagagcgctgggaacttttagatgatggtatacctgggaccgaaggtgaattctttgcaaaagatctgtctcaggatacctggtatgagtttcgagtcctcgccgtgatgcaggatctgatttccgagccatctaacatcgcaggtgtgagctctacggatatcttcccccagcccgatctcactgaggatgggctcgccaggcctgtactagcaggcatcgtcgcaactatatgcttcctggccgctgcaattctcttcagtacactcgccgcttgcttcgtgaacaaacagcgaaagcgcaaactgaaacggaaaaaagaccctccgctgtctattacacactgtaggaaatctttagagtctccacttagttcaggtaaagtgagcccagaatccatcaggacgttacgggctccgtccgagagctcagatgatcaagggcaacctgccgctaaaagaatgctgtcacccacgcgggaaaaagaactgtcactgtataaaaaaacaaagagagcgatatcttctaagaaatactccgttgcaaaggccgaagctgaagcagaagctacaacccccatcgaattaatcagccggggaccggatgggcgttttgtgatggacccggcagaaatggagccttccctgaagtctagaaggattgaaggatttcccttcgctgaggagactgatatgtatcctgaattcaggcaaagcgacgaagagaacgaagatcctttagtccccacctccgtcgctgcgctaaagagccagctcactccattgagttccagccaggagagctaccttcctcctcccgcatattcacctaggttccagcccaggggattggaggggcctggcggactcgagggcagactacaagctacggggcaagcgcgaccaccagctcccagacctttccatcacggccagtactacgggtatttaagctcctcttcccctggggaagtcgagcctccccctttttatgtacccgaggtcggatcacccctgtctagtgtgatgtcctctccacccctgcccaccgagggcccatttgggcaccctacaattcccgaagagaacggcgagaacgccagcaactcgactctgcctctgacacagaccccgactggaggcaggtctcccgagccttggggcaggcccgagttccctttcggtgggctagaaactcctgcgatgatgttcccccatcaactccctccttgtgacgtcccagagtccctgcagccaaaagccggactgccacggggtctgcctccaacctctttacaagtgccagctgcataccccggaatcctgagcctggaagcacctaagggctgggccggtaaaagcccaggaagggggccagtaccagctcctcccgctgcaaagtggcaggatcggcctatgcagcccctggtctcgcagggacaattgagacacacctcacagggcatggggatccccgtgctaccctatccagaacctgccgaacccggtgcacacggcggtccttctacattcggtttggatacaagatggtacgagccccagccacggcctcgcccatcccctagacaggctcgacgtgccgaacccagcctccatcaggttgttctgcagcccagtcgcctgagtccactgactcaaagccccctctctagccgcacaggctctccagagctggcggctagagccaggcccagacccggacttctacagcaggcggagatgtcagaaattactctgcagcccccagcagcagtctctttctctcgcaagtcaactccgagcaccggatcaccatcccagtccagcaggtctgggagcccatcgtatagacccgcaatgggcttcacgaccctggccactgggtatccctcaccgccaccaggtccagctccagctggcccaggagactctctggatgtgtttgggcaaacaccctctcctcgcagaactggggaggagctgttgcgaccagagacgcccccacccaccctgcccacatcgggtaagttgcagagggaccggccagcaccggcaacatcaccacccgagcgcgcattgagcaaattgtag

SEQ ID NO: 226674 - DNA, 1509 bp, Artificial Sequence
  Description of Artificial Sequence: Synthetic coding sequence
atggcttggccaaagctgcctgccccttggctgctgctttgcacgtggctgcccgctggctgcctgtcacttttggtgactgtccagcatactgaaaggtacgtgactttattcgcctctatcatcttgaagtgtgattatacaacctctgcccaattacaggacgtggtggtgacatggaggttcaagagtttttgcaaggacccgattttcgactactactccgcctcgtatcaagccgctttatctctgggacaagatccttccaacgattgcaatgataaccagagggaagtacggatagttgcccagcggcgaggacagaatgagcctgtgctgggtgtcgactaccgacagcgaaaaatcactatccagaatagggctgatctggtgattaacgaggtgatgtggtgggaccatggggtgtactactgcactatcgaggccccaggagacactagtggggatccagataaggaggttaaactcatcgtgctacattggttgacagtaatattcattatcttgggagccctgcttctcttgcttctcattggcgtgtgttggtgtcagtgctgcccacagtattgctgctgctacattaggtgtccgtgctgccctgcacactgttgctgtcctgaggaggatcttagcctcccttccagccttccccagatgccaatgacgcaaacaacaaaccagccccctatagcgaacggcgttctcgaatacctcgagaaggaattgagaaatctcaacctggcccagcccctgcctcccgatcttaaagggagattcggccatccctgttcaatgctcagctcacttggcagcgaagtagtggagcgcagaattatccacctgccgcctcttatccgggacctgtccagttctcggcgtacaagcgactccctccaccagcagtggctgaccccaattccttccagaccctgggatctgagagaggggagatctcaccaccactaccctgactttcaccaggaattgcaggatcggggaccaaagagttgggccttagagagacgggagctggacccttcctggtccggcagacaccgatccagtcgcctaaacgggtcgcctatccattggagcgatcgagatagtttgagcgacgtgccttcatcctccgaagctcgatggagacccagtcaccccccatttcggagtaggtgccaggaaaggcctcggaggccatcaccacgggagagtacccagaggcacggacggcgacggcgtcacaggtcatatagtcccccacttccctcggggcttagttcctggtcctccgaggaagataaagagaggcagccacagtcatggcgggcacacaggcgcggtagccacagtccccactggcctgaggagaagccaccaagctaccgatccctagatattaccccaggcaaaaatagcagaaagaagggctcagtggaaaggcggagtgaaaaggacagttctcattcgggaaggtccgtcgtgatatag

SEQ ID NO: 226675 - DNA, 1641 bp, Artificial Sequence
  Description of Artificial Sequence: Synthetic coding sequence
atggcctggccaaagcttcccgcaccttggcttctgctgtgtacctggcttcctgctggttgcttgtccctgttagtcaccgtacagcacaccgagcgctacgtgaccctgttcgcctcaataatacttaaatgtgactacactacatcagcacagctccaagatgtggtagtgacgtggaggtttaaaagcttttgcaaggatcctatctttgactactacagcgccagttaccaggcagctctgagcctgggtcaggatccttccaacgactgtaacgacaatcagcgtgaggttcgaatcgtcgcgcagcgaaggggccagaacgaacccgtcttgggcgtcgactatagacagcggaagatcacaatccagaaccgggcagacctcgttataaatgaggttatgtggtgggaccatggggtctactactgtaccatagaagcccctggagacacttcgggcgacccagacaaagaggtaaaactgattgtgctgcattggttaacggtgatcttcatcatcttgggagcactgctgctgcttctgttaatcggagtttgctggtgtcagtgctgcccccagtactgttgctgttacatcagatgcccttgctgccctgctcactgctgctgtcccgaggaagccctcgcaagacatcggtacatgaaacaagcacaggctctgggacctcaaatgatgggcaaacccctgtattggggagcggatcggtcttctcaggtatccagctatcctatgcaccccctccttcagcgcgatctgagcttaccctcaagtctgccgcagatgcccatgactcagaccaccaatcagcccccaatcgccaatggggtgttggagtacctggagaaagaactgcggaatctgaatctcgcacagcccctacctccagacctgaaagggcgttttggccacccttgctccatgttgtcatccctcggatctgaagttgtcgaacgccgaattatccatctcccaccgttgatacgcgacctgtctagctcaagaaggacgtcagactcattgcatcagcagtggcttacacctataccgtcaaggccttgggatcttagagaagggcgttcacaccaccattaccctgatttccaccaagagctccaggatagagggccaaaaagttgggctctggagcggagggagctggaccccagctggagtgggagacacagatcatcccgcctgaacggctctcctatccattggagtgacagagactccttgtccgacgtaccttccagcagtgaggccagatggaggccatcccaccccccatttcgaagccgctgtcaagagcgcccaaggcggccttcaccgcgagagtctacccagcgacatggaagacgtaggagacaccgatcatacagtcccccactccctagcggcttgagctcttggagctccgaggaggataaagaacgccaaccacagagttggagagcacacaggagaggaagccattccccacactggcctgaagagaaacccccaagctaccgctcgctagatattacacccggtaaaaactctcggaaaaaaggttcggtggagaggcggtccgaaaaagactcaagtcattctggacggtcagtcgtgatctag

SEQ ID NO: 226676 - DNA, 639 bp, Artificial Sequence
  Description of Artificial Sequence: Synthetic coding sequence
atggcctggccaaaactgccagctccgtggctgcttttatgtacctggctgcctgctggctgtctgtcacttctggtaaccgtccagcatacagaacggtatgtgacactttttgccagcatcatattgaaatgtgactatacgaccagtgcccagctgcaggatgtcgttgtgacgtggcgcttcaagtccttttgcaaagaccccatcttcgactattacagtgccagttatcaagctgcactgagtctaggccaagatcctagcaacgactgttgctgttgtccagaagaggctctggccagacatcgctatatgaagcaggcccaggccctaggaccgcaaatgatgggtaaaccgctgtactggggtgccgaccgtagctcgcaggtgtctagctatccaatgcatcctcttttacagagagacttgagcctcccaagttccctaccccaaatgccaatgactcagactaccaaccagccaccgatcgcaaacggagtgctggagtacctggagaaggagctgaggaacctcaacctagctcagcctttgccacctgacctgaagggcagatttggccatccttgctcaatgcttagctccctgggtagcgaaaaccagatcgaggagttctag

SEQ ID NO: 226677 - DNA, 1374 bp, Artificial Sequence
  Description of Artificial Sequence: Synthetic coding sequence
atggcctggcctaagttacctgccccttggctcctcctgtgcacttggctgcctgccggatgcctttcattactggtaactgtgcagcacaccgaaaggtacgtcaccctgtttgcttccatcatcttgaagtgcgactataccacctctgcacagcttcaggacgtggtcgtgacatggcgatttaagtcattctgtaaggatcccatatttgattattattccgctagctatcaggcagctctatctctggggcaggatcccagcaacgattgcaatgacaatcagagagaagtaaggatagttgctcagaggcggggacagaacgagccagttctgggcgtggattacaggcagagaaaaattaccatccaaaacccacttgctcgccaccgctacatgaagcaggcccaagccttaggaccgcagatgatggggaagcccctttactggggtgcagacagaagcagtcaggtgtcgtcatacccaatgcatcccttgctgcagcgcgatctgtccttgccttctagtctacctcagatgcctatgacacagaccaccaatcagccacccatcgcaaatggagtcttagaatacctcgaaaaggaactgcggaatctgaaccttgctcagcccctgccacccgatcttaaaggcagatttgggcatccctgctccatgctgtcgagcttgggctctgaagtggtagagagacgaataatccatcttcccccactaatacgggacctctcaagtagccgtcgcacaagcgacagccttcatcagcaatggctcaccccaattccatcgagaccctgggatctcagagaaggaaggagccatcaccactatcccgatttccaccaagagctgcaggatcggggtccgaagagctgggcgctggagaggagagaattggaccctagctggtccgggaggcaccggtcttcacggctgaacgggagccccatccattggagcgacagagattcattgtccgatgtgccaagcagttccgaagctcggtggagacccagtcatcctcctttccggtcaaggtgccaagaaagacccaggcgtcctagtcccagggaatctacccagcgtcacggcagaagacggcgacataggagttattccccaccgttgccgagcggactgtcatcatggagcagtgaagaagataaggagcggcagccccaaagttggcgggcacacagacgtggttctcatagtcctcattggcccgaggagaagccgccatcgtataggagcctagatatcacgccaggcaaaaatagtagaaaaaaaggttctgttgagagaaggagtgagaaggattcctctcactcgggacgatcagttgtgatctag

SEQ ID NO: 226678 - DNA, 1545 bp, Artificial Sequence
  Description of Artificial Sequence: Synthetic coding sequence
atggctggcaacatcttctgcccttttgctctgttttttctgccgatgagtagagttggccacctgcagcattttctgttgctgttggcgctggggtgtttaagcctgctggtaaccgtgcagcatactgaaagatatgtcacgctgtttgcatctattattctcaagtgcgattataccacaagcgcccagctgcaagacgtggttgttacctggcgctttaaaagtttttgcaaggaccccatttttgactattattctgcaagctaccaggctgcactaagcttaggacaggatccgtctaacgactgcaatgacaatcagcgcgaagtgagaattgtggcacagcgtcgaggccagaacgaaccagtgctgggggtcgactaccggcagcgcaaaattacaattcagaaccgcgcagatttagtgatcaacgaggtgatgtggtgggaccacggtgtgtactattgcaccattgaggcaccgggagacacgtcaggcgatcccgacaaggaggtgaagctgatcgtgcttcactggttaaccgtgatatttattattcttggagccttgctgttgctcttgctcatcggggtttgctggtgtcagtgctgccctcagtattgttgttgttatatccggtgcccgtgctgccccgctcactgttgctgtccagaggaagatctgtctctgcccagctctctgcctcaaatgcctatgactcagacaacaaatcaacctcctatcgcaaatggcgtactggagtaccttgagaaggagttaaggaatctcaacctcgcccagccacttcccccagatctgaaaggccgattcggccatccttgctccatgctgtcctccctggggtctgaggtcgttgagcgtaggatcattcacctgccccctcttatccgtgacctgtcttcttcaaggagaacgagcgacagcctacaccagcagtggctgacccccataccaagtagaccctgggacttgcgcgaggggcgatcccatcatcactatcctgattttcaccaggagctgcaagaccgcggaccgaagtcatgggcactggagcggagggagctggaccccagctggtccggccgtcaccgcagtagtcgcctgaatggttctcccatccattggtcagaccgagattccctgtcggatgtgccatccagctcagaggcaaggtggcgtccaagtcacccgccatttcgctccaggtgccaggaaagacccaggcgcccttcaccacgagaatccactcaacgccatggacgtaggcggagacaccgatcttatagcccccctcttccttcaggactgtcatcatggtcaagtgaagaggacaaagagcggcagcctcaaagctggcgggctcaccggaggggcagtcactcgcctcattggcccgaagagaagcccccttcctataggagcttagatatcacaccaggcaagaacagtcggaagaaagggtctgtggagcgaaggagtgagaaagacagcagtcactcaggtcggtccgtcgtgatttag

SEQ ID NO: 226679 - DNA, 1800 bp, Artificial Sequence
  Description of Artificial Sequence: Synthetic coding sequence
atggaggggcctctgacgcctccgccactccagggtggtggcgcagctgccgtccccgaacccggtgccaggcaacacccaggtcatgaaactgcagcccagcgctatagcgcgaggcttctccaggccggatatgagccagaatcccccagactcgaccttgcaacccacccgaccactccaaggtctgaactgagctctgtggttctgctggctggcgtgggcgtacagatggacaggctgcgtcgcgcttccatggctgattatctgattagcggcggtaccggatacgtgccagaggatggcctgaccgcccagcagctgtttgcctctgcagatggcttaacctataatgattttctgatcctgcctgggtttattgattttatcgcggatgaggtcgatctaacaagtgctctgacaaggaagattactctgaaaaccccattgatctcctcccccatggacaccgtgactgaagccgacatggcaatcgccatggctctgatgggagggatcggttttatccaccataattgtacccctgagtttcaagctaacgaagtgcggaaggttaagaagtttgagcaggggttcataactgatcctgtggtactgtctccatcgcacaccgtgggtgacgttcttgaggccaaaatgagacacggcttttcagggattccaatcacagagacaggaactatgggctcaaagttagtgggcatcgtgacctctagagacattgactttctcgctgagaaggatcacactacactgctgagcgaggtgatgacacctagaattgaacttgtggtggccccagccggagtcaccctgaaagaggcgaatgaaattttacagcggtcgaagaaaggcaaactgcccattgtgaatgattgtgatgaactagtggccattattgcccgaactgacctaaaaaaaaatcgggactatccactggcctccaaggattcacagaaacagctgttatgcggcgcagctgtgggtaccagggaagatgacaaataccggctcgacctcttaacgcaagccggagtagacgtgattgtcctcgatagttcacagggaaatagtgtgtaccagattgccatggtgcactacatcaagcagaaatacccccatctccaggtgatcgggggaaacgtggtcaccgccgcacaggcaaagaatctgatagatgctggggtggatggactcagggtcggaatgggatgcggatccatctgtatcacccaagaggtgatggcatgtggccgtccgcaaggcaccgccgtgtacaaagtcgccgagtacgcaagaaggtttggcgtcccaataatagccgatggcggtatacagaccgtgggtcacgttgtgaaagctctagcccttggagcctctacagtaatgatgggatctctgcttgcagccaccactgaggcacccggagaatatttctttagtgatggggtgagactgaagaagtaccgcggtatgggcagtctggacgcgatggaaaagtctagcagctcccagaaaaggtatttctcagagggggataaggttaagatcgcccagggcgtctccggaagtatccaggacaagggatcgatccagaagttcgtcccttacctgattgcaggcattcaacatggttgtcaggacattggcgctcgctccctgagcgtcttgcgttcaatgatgtacagcggagagctgaaatttgagaagaggactatgtctgctcaaatcgaggggggagtgcacggcctgcattcttatgaaaaacggctatactag

SEQ ID NO: 226680 - DNA, 1470 bp, Artificial Sequence
  Description of Artificial Sequence: Synthetic coding sequence
atggccgactacctaattagtggcggaactggatacgtaccagaagatggtcttacagcccaacaacttttcgcaagcgccgatggccttacatataacgacttcctgattctgcccggattcatcgactttatagctgatgaggtggacctcaccagtgcactgacacgaaagatcacactaaagacccctcttatctctagccccatggacacagtgacagaggctgatatggcgattgctatggcaaaattcgagcaaggcttcattacagatccagtcgtgctatctcccagccacactgtcggggacgtgctggaggccaagatgagacacggcttctcaggcatccctataacagagacgggaaccatggggagcaagctggtgggtatcgtaacttctcgtgatattgatttcctggcagagaaagatcacaccacacttctttccgaggttatgactcccaggattgagttggtcgtcgctcccgctggcgttactctgaaggaagctaacgaaatcctgcagcgaagcaagaaggggaaactgcccattgttaatgactgtgacgagctggtggcgatcatagcccgtaccgatctgaaaaagaaccgagattacccactggcatccaaagactcacagaaacaactgctgtgcggggcagcggtgggaaccagggaggatgacaaatataggctcgaccttctaacccaggccggagtggatgtgatcgttctcgattcgagtcaaggaaactcagtatatcaaatcgctatggtgcactacattaaacagaagtacccgcaccttcaggtgattggaggcaacgtcgttactgcagcgcaagcaaaaaacttaatcgatgccggtgtggacggattgcgggtggggatgggttgtgggtcaatttgtatcacacaggaggtaatggcatgtggtcggccacaagggactgcagtttacaaagtcgccgaatacgcccgtagatttggagtacccatcatagccgacgggggaatccagacagtaggtcatgtggtcaaggctttggcccttggagccagtaccgtcatgatgggctcccttcttgctgcaacaactgaggctcccggtgagtatttcttttccgatggggttcgactaaaaaaatacaggggcatgggctctctggacgccatggagaagagctccagctctcagaagcggtacttctccgaaggcgacaaagtgaagattgcccagggagtctctggatccattcaagacaaaggaagcatccaaaaattcgtgccctatctgatcgccggaatccagcatgggtgtcaagatatcggtgcgcgatcgctctcagttttgcggtctatgatgtattccggagaactgaaatttgaaaaaagaacgatgtcagcacaaatcgaaggcggtgtgcatggtctgcattcttacgaaaaaaggctttactag

SEQ ID NO: 226681 - DNA, 1692 bp, Artificial Sequence
  Description of Artificial Sequence: Synthetic coding sequence
atggaggggcctctgacaccacccccattgcaaggtggtggggcagccgctgtgccagaaccgggtgctcgccagcacccgggacatgaaactgcagcacagagatacagtgctcggctgctccaggccggatacgagccagaaagcatggccgattacctgatcagcggtggcaccggctatgtgcctgaagatggccttaccgcgcaacagctgtttgcaagtgcagacgggctaacatataacgactttcttatcctcccaggattcatagacttcattgctgacgaagtggatctgacctccgccctcacgcgcaaaattacacttaaaacacccctgattagctcaccaatggacactgttacagaggccgatatggctatagccatggccctcatggggggtataggatttatacatcacaactgcactccagaattccaggccaatgaggttcgcaaggtcaaaaagttcgagcagggtttcattactgatccggtggtgctgtctccttctcatacagtcggggatgttctggaggctaagatgaggcatgggttttcaggcatcccaataaccgaaacaggcactatgggctcaaaactcgtaggaattgtgacatctcgggatatagatttcctggccgaaaaggatcacaccacactgttgtctgaagtgatgacaccacgaattgaacttgtggtagcgcctgccggagttacactaaaggaggccaatgagatactgcaacggtcaaagaaaggcaaacttccaattgtgaatgactgtgatgagctggttgcgattatcgctcggacagatctgaagaagaatagagattaccccctggccagcaaggactcccagaagcagctcctgtgcggcgcagctgtgggaacacgggaggatgacaaatatcgcctggacttactaacccaggcgggagtggacgtgatcgtgctggactcatctcagggaaattccgtgtatcagattgccatggttcattatattaagcagaaatacccacacttacaggtcattggtggtaacgtagtcactgcagcccaggcgaaaaatctcatcgatgcgggagtcgacgggctaagagtgggaatggggtgtggaagcatatgcatcacccaggaagtgatggcatgcgggcgacctcagggaacagcagtttataaggtggcagagtatgctagacggttcggcgtgcccattatcgcagacggcggaattcagaccgtcggccacgtagtcaaggccctggccctcggcgcatctacagtgatgatgggcagcctgctggcagcaactacagaggcaccaggtgaatacttctttagcgatggcgtgcgactcaagaagtatcgcggtatgggaagcttagatgccatggagaagagcagcagctcacagaaacggtatttctcggaaggagataaggtaaaaatcgcacagggcgtaagtggctcaattcaagataagggctcaattcagaaatttgtgccatatctgattgctggcatccaacacggctgccaggacatcggggctcggtcgctatccgtgctgagaagtatgatgtactctggcgagctgaagtttgagaaacggaccatgtcagctcagattgaggggggtgtgcacggtctgcactcttatgagaagaggttgtactag

SEQ ID NO: 226682 - DNA, 1770 bp, Artificial Sequence
  Description of Artificial Sequence: Synthetic coding sequence
atggagggcccactgaccccacccccactgcaagggggaggagccgcagcggtgcccgagccaggtgcgagacaacacccaggccacgagaccgcagcccagaggtactccgcacgcctgcttcaagctggttatgagccagagtcttgttttctcctggagttgtcttctgtcgtactcctggcaggcgtaggcgttcaaatggatcgcctcaggcgtgcgtctatggctgattatttgatctccggcggaacaggctatgtgcccgaggacggactgacagcacagcagctctttgcaagcgccgatggcctgacatacaacgacttcctgattctgccagggttcattgactttattgcagacgaagtggatctgacatccgctctgacacggaagataacacttaagactccgctgatttcatctcccatggatactgtcaccgaggcggatatggcaatcgccatggccctgatggggggtatcggcttcatccaccataattgcactcctgaatttcaggcgaatgaggttcgcaaggtcaagaaatttgagcaaggttttattacagatcccgtggtcctgtcaccaagccacacagtaggtgacgtcctggaagctaaaatgcgtcacggcttttctggcatcccgatcaccgagaccggaactatgggaagtaagctcgtgggcatcgtcacctcgcgtgacatcgattttcttgctgagaaggatcatacaacactgttatccgaggttatgactcctcgtattgagctcgtagtggcgcctgccggagtaaccctcaaagaggctaacgaaatcctgcagagaagtaaaaaagggaaactcccaatagtaaatgattgtgatgaattagtcgcaataattgcccgaaccgacctgaagaagaatcgggattatcccctcgcctcaaaagattcccagaagcagttgctgtgtggggctgccgtcgggacgagggaggatgacaaatacagactggacctgctgacacaggctggagttgacgtgatcgtcctcgatagtagtcagggcaatagcgtctatcagatcgcaatggtgcactacatcaagcagaagtacccacacctgcaagttatcggaggcaacgtggtgaccgccgcacaggcaaaaaacctgattgacgcaggtgtcgacggacttcgcgtggggatgggctgtgggagcatttgtataacgcaggaggtgatggcctgcgggagaccacaaggcacagcagtgtacaaggttgcagagtatgccaggcgctttggcgtgcctatcatcgcagatggaggtattcagaccgtcgggcatgttgtaaaggccctcgccctgggcgcttctactgttatgatggggagtctactggctgccacaacagaggcccctggtgagtacttctttagcgacggtgtcagactgaaaaagtatcgcggaatgggtagtctggatgcaatggaaaagagtagcagctctcagaagcggtacttttctgaaggggataaagtaaagatcgctcagggagtctctgggagtatccaggataagggatccatccagaagttcgtaccatacttaattgctggcattcaacatgggtgccaggacattggagccaggagcctgtctgtgcttagatctatgatgtatagtggggagttgaagttcgaaaagcgcaccatgagtgcgcagatagagggcggagtgcacggtctgcactcttacgaaaagaggctctactag

SEQ ID NO: 226683 - DNA, 1593 bp, Artificial Sequence
  Description of Artificial Sequence: Synthetic coding sequence
atggagggacccctgaccccgcctccgttgcaagggggaggcgcagctgcagtgcctgagcccggtgccagacaacacccaggtcacgaaacagcagcacagcggtatagcgctaggctcctgcaggccggatacgagcccgaaagtgacttccttatcttgcctggcttcatagactttatcgccgacgaagtagatctgacatccgccctgacaagaaagatcaccctgaagactcccctgatctcttcacccatggataccgtaaccgaggctgacatggccattgcgatggccctgatgggcggtatcggcttcatccaccacaattgcacaccagagtttcaggccaacgaagtacgaaaggtcaagaagttcgaacagggcttcatcacggatcctgtggtgctgagtccttcccacaccgttggggacgtgcttgaggccaaaatgcggcatggcttcagcgggattccaattacggagacagggacgatgggttcgaagctggtcggcatcgtgactagccgagacatcgatttcctggccgaaaaggatcacaccacactgttgtcggaggttatgacacccagaattgagttggtcgtggcccctgccggtgtgactctcaaggaagctaatgagattctgcagagatcaaagaaaggcaaacttcccatagtcaacgactgtgacgaactggtcgctatcatagcgcgtaccgacctgaaaaaaaatagggactaccccctcgcttctaaggattcacaaaagcagttgctgtgcggagcggcagtgggaacccgggaggacgataaatatagacttgacctcttgacccaggctggagtagatgtgatcgttttggattcctcgcaaggcaattccgtgtatcagattgccatggtgcactacattaagcaaaagtacccacatcttcaggtcatcggcggaaacgtagtaactgcagcccaagccaaaaacctgatcgacgccggagtcgatggactgagggttgggatgggctgcggctcaatttgcataactcaggaggttatggcctgcggtcggcctcagggcaccgctgtttacaaagtggctgagtatgcacgacgattcggggtgcccatcatcgctgacggtggcatacaaacagtgggacatgtggttaaggccctcgccttaggcgcttctacagtgatgatgggctccctcctggccgcaacaactgaggcccctggggagtatttcttttccgacggcgttcgattgaagaaatatagaggcatggggtcattggatgcgatggaaaagtctagctcctcacagaagaggtacttcagtgagggcgacaaggtgaagatcgcacagggtgttagcggaagtatccaggataagggttccatacagaaatttgtcccttacctgatcgcgggaatccaacacggttgccaggacatcggggcacgttctctctcagtcctccgaagcatgatgtattcaggagaactgaagtttgagaaaagaacaatgtctgcgcaaatagagggtggagtacacggtctgcatagctacgagaagcgcctctattag

SEQ ID NO: 226684 - DNA, 1701 bp, Artificial Sequence
  Description of Artificial Sequence: Synthetic coding sequence
atggaagggcctcttaccccacccccactgcaaggcggtggtgcagctgccgttccagaaccaggagcgaggcagcaccccggacacgagactgcggcacagcggtactcggcacgactgcttcaggcgggttacgaacctgagtcccccagactagacctggcaactcatcctacaacacctagatccgagcttagttctgtagtgttgctggccggagtgggagtacagatggaccgcttgaggcgtgcctctgactttctcatcctgccaggttttattgatttcattgctgacgaggttgatctgacatcagcacttacaaggaagatcactctcaaaactccactaatctcctcccctatggatactgttacagaagctgacatggcaatcgctatggctctcatggggggtatcgggttcatacaccataactgtacccccgaattccaggcaaacgaggtgagaaaagtcaaaaagttcgagcaaggattcataactgatcctgttgtgttatccccgagccatacagtgggggacgtgctggaagctaaaatgcggcatggttttagtggcatccctatcaccgagactggaaccatggggtcaaagctggtgggcatcgtgacttctcgtgatatcgactttttagcagagaaagatcataccacgctgctgtctgaggttatgacccctaggatcgagctagttgtggctccagccggagttactctcaaggaggccaacgaaatcctccagaggtccaaaaaaggtaagctgcctatcgtgaatgactgcgacgaactggttgcaattattgcccgtaccgatctcaaaaaaaaccgagactacccacttgcgtccaaggactctcagaagcagctgctctgcggcgcagcagttggaacaagagaggatgataagtaccgtttagacctgctcacacaggcaggtgtggatgtaatcgtgcttgattcttctcagggcaatagtgtgtatcagattgccatggtgcattatatcaagcagaagtatccccatcttcaggtgatcggcggaaatgtagtgacagctgcgcaggcaaagaatttgattgacgcaggcgttgatggtctccgcgtcggcatggggtgtgggtctatttgcataacccaggaggtcatggcctgcgggagaccccagggtaccgcagtgtataaggtggccgaatatgctaggagattcggtgttcctatcattgctgacggcggtatccagactgtgggccacgttgtgaaggcattggcccttggggcttctacggtaatgatggggtcgttactcgcagccactacggaggcaccaggagagtactttttttcagacggcgtcaggctcaagaaataccggggtatgggctctctcgacgccatggaaaagtcatcgagttctcagaagaggtacttttctgagggggataaggtgaaaatagcccagggggtatcaggatccatacaggataaaggttctatacagaagtttgtgccatacttgatcgctggcattcaacacggatgccaggatatcggcgcaagatcacttagtgtgctaaggtccatgatgtacagcggagagctcaaatttgagaaaaggaccatgtccgctcagattgagggtggcgtccatggcctgcattcctatgagaaaaggctctactag

SEQ ID NO: 226685 - DNA, 1530 bp, Artificial Sequence
  Description of Artificial Sequence: Synthetic coding sequence
atggccgattatctgatcagtgggggaacagggtatgtccccgaagacggactcaccgcacagcagctgttcgcctccgccgatggactcacttacaatgacttcctcatcttgcctggattcatagacttcatcgccgacgaggtagatctgacttcagcactgacccgaaagattacactgaagactcccctaatcagcagccctatggacacagtcacggaggccgatatggccatagcgatggctttaatgggtgggatagggttcatacaccacaattgcacccccgagtttcaggccaacgagaagtttgaacaaggattcataaccgatcctgttgtgctctctccctctcatacagtcggcgacgtgttggaggctaagatgcggcacggcttctcaggcatccccatcaccgaaaccgggactatggggtccaagctcgtcggcattgttacctcacgggacatagacttcctggctgagaaggatcacaccacgctactctcagaggtgatgacccccagaatcgagttggtggtggcccctgcaggggtaaccctgaaagaggccaatgagatattacagcgctctaagaaaggcaaactacctatcgtgaatgactgtgacgagttggttgctattattgcacggactgatctgaagaaaaatagagactacccgttagcaagcaaagactcccagaagcagttgctctgtggagccgcagtaggaacccgagaggatgataaataccgcctagacctcctaactcaggctggggttgatgttattgtactggattcatcacaaggcaactcggtttaccagatcgcaatggtacactacatcaaacagaaatatcctcatctgcaagtgattggaggcaacgtcgtcactgcagcgcaggctaagaacctgattgatgccggtgtcgacggactgagagttggaatggggtgtggaagcatttgcatcacacaggaagtgatggcttgcggcaggccgcaaggcacagccgtgtataaagtcgctgagtacgcgcgacgcttcggagtgccaattattgccgatgggggaattcaaactgtcgggcacgtggtgaaagcgctggccttgggagcaagcactgttatgatgggtagtttgctggcagcaaccacagaagcccctggcgaatattttttttccgacggtgtacgcctcaaaaagtatcggggtatgggcagccttgatgccatggaaaaatcttcctcctcacagaaacggtatttctctgagggggacaaagttaaaatcgcgcagggcgtgagcggctcaattcaggataaaggatcaatacaaaagttcgtcccttacctgattgcagggatacagcacgggtgccaggacatcggcgctagatccctctcagtgctgcgctccatgatgtactccggagagttaaagtttgagaagcgaaccatgagcgcacagatagaaggcggtgtccatggactgcattcctatgaaaagaggctgtattag

SEQ ID NO: 226686 - DNA, 1470 bp, Artificial Sequence
  Description of Artificial Sequence: Synthetic coding sequence
atggcagattatctgatttctggaggcaccgggtacgtgccagaagatggtcttactgcccagcagctttttgcttcggcggatggattaacctacaacgattttttgatcctgcccggattcatagattttatcgcagacgaggtcgacttaacctccgcattgaccaggaaaattacactaaagacccctctgatttcttcccctatggataccgtgacggaggctgacatggcaatcgcgatggctaagttcgagcaggggtttattaccgaccccgtcgtcctcagtccctcacatactgtgggcgacgttctggaggccaaaatgcgccatgggtttagcggtattcccattacagagacgggaacaatgggctccaaactggtgggaattgtgacgagtcgggatattgactttctcgcagagaaggaccataccaccctcttgtccgaagtcatgacacccaggatcgagctggtagtcgctccagcgggagttaccctgaaggaggccaatgagatcctgcaacgctccaagaagggaaaactgccgattgtgaacgactgtgatgaactggttgctattatcgccagaaccgatttgaagaagaatcgggattaccccctcgcaagcaaggacagccagaagcagctgctatgtggggctgctgtaggcacacgcgaggacgataagtaccggctggacttattgactcaagcaggcgtggatgtgattgttcttgacagctcgcagggcaattctgtctatcagattgccatggtgcactacattaagcaaaaatacccacacctccaagtaatcggcggaaatgtggtgactgccgctcaggccaagaatttgatcgatgcaggcgtcgacggcctgcgagtgggtatgggttgtggaagtatctgtatcacacaagaggtgatggcctgcggcagaccccaggggacagcagtgtataaggtagcggagtatgctcgccgttttggggtgccaataatcgccgatggtggcattcagaccgttggacatgttgtgaaagcccttgccctaggtgcaagtacagttatgatgggaagtcttctcgctgccactacagaggcccctggggaatattttttcagcgatggtgtccgtctcaagaaataccggggtatgggaagtctggatgcgatggaaaaatcaagctcatcacagaagagatactttagtgaaggcgataaagttaagatcgcacagggtgtaagcgggagcattcaggataaggggagcatccagaagtttgtgccatatctgatagctgggattcagcatggctgccaggacattggcgctagaagcttgtccgtgctgcggtcgatgatgtactcaggagaactgaagttcgaaaaaaggactatgtccgcccagatagagggaggtgtgcatggacttcacagttatgaaaagaggctctactag

SEQ ID NO: 226687 - DNA, 1545 bp, Artificial Sequence
  Description of Artificial Sequence: Synthetic coding sequence
atggccgattatctaatctctggaggaacctcctacgttcccgacgacggactcacggcacagcagctgttcaactgcggagacggcctcacgtataatgacttcctgattctgcctggatacattgactttaccgcagatcaagtggaccttaccagcgcgcttaccaaaaagattactctgaaaacgcctctggtcagtagccccatggacactgttactgaggctggcatggcgattgcgatggccctgaccggaggcatcggatttattcaccataactgcacgcccgagttccaagccaacgaagtccggaaggtaaaaaagtacgaacagggcttcatcacagatcccgtggtgctcagccctaaggaccgcgtgcgggatgtgttcgaagccaaggctcggcatggattctgtggtattcccattaccgataccgggcgtatgggctctcggctcgtgggtattatctcatcccgggatatcgactttctcaaggaggaggagcatgattgcttccttgaggagataatgaccaagagggaggatctagtggttgcacctgctggtatcacactcaaggaggcaaatgaaattctgcagcgaagcaagaaaggaaaacttccgattgttaatgaggatgacgagcttgtggccatcattgccaggaccgatctgaaaaaaaaccgcgactacccacttgcatctaaggacgctaaaaaacagctgctctgtggcgcagcgattggtacccacgaggatgacaaatacagactcgatctgctggctcaggccggagtggatgtcgtggttctagacagctcccaggggaattcgatatttcagattaatatgataaagtatatcaaggacaaatatcccaatctccaggtgatcggaggtaatgttgtaaccgcagcacaggctaagaatctgattgatgcgggagtcgacgcgctgagggtgggcatgggatccgggtcaatttgcatcacacaggaggttctcgcatgtggccgtccacaggctactgccgtctataaagtgtcagagtacgcaagaaggtttggggtccccgtaatcgcagacggcggaatacagaacgttggccacattgctaaagcgctagctctcggggcttccaccgtaatgatgggaagtctcctggctgctacgaccgaagcccctggggagtactttttctccgatggcattagactgaagaaatatagaggaatgggctccctggatgcgatggacaagcatctgtccagtcagaatcgctacttctctgaagccgacaaaattaaagtagctcagggcgtttccggtgccgtgcaggacaaaggttcaatccacaagtttgtgccatatctcatagcaggcatacagcattcttgccaggacatcggcgcaaagagtctcactcaagttcgtgccatgatgtactctggcgagctgaaatttgagaaaagaacttcctccgctcaggtggagggaggcgtgcatagccttcactcttacgagaaacgcctgttttag

SEQ ID NO: 226688 - DNA, 1074 bp, Artificial Sequence
  Description of Artificial Sequence: Synthetic coding sequence
atggctgattatttaatttctgggggaaccagctacgtgccggacgatggtctgacagcacaacagttgttcaactgcggcgatgggctgacatacaacgacttccttattctaccgggatacatcgattttaccgccgatcaggtggacctaacctctgctctgacaaaaaaaatcacattgaagactcccctggtttcgagccccatggacactgtgaccgaggccggtatggccattgctatggcactgacaggaggcattggattcattcaccacaattgcactccggagttccaagctaacgaagtgcgaaaggtcaaaaaatacgaacaggggttcattaccgaccctgtggtgctctcaccaaaggatagggttcgagatgtttttgaagccaaagctcggcatggcttttgcggcatcccaattactgatacaggacgcatgggaagtagattagtggggatcatttcttctagagacatagattttctgaaggaagaagaacacgattgcttccttgaagagattatgactaaacgcgaggacctcgtggtagcaccggcaggaatcacactgaaggaggcgaacgaaatccttcagcggtcgaagaagggcaagcttcccatcgtgaatgaagacgatgagctggtggctattatcgctcggactgacttgaagaaaaacagagactaccccctggcctctaaggatgctaaaaaacagttgctgtgtggtgccgctatcgggacgcatgaggacgacaaatatcgactggatctactcgctcaagccggagtagatgtagtcgtgctggactcatctcaagggaattctatatttcagatcaacatgattaagtacattaaggataaataccccaatctgcaagtaattgggggaaacgtcgtgaccgctgcccaagcgaaaaacctgattgacgctggtgtcgatgcactgcgggtcggcatgggcagcggttctatttgcatcactcaggaagtgctggcctgtggccgtccacaggccacagctgtttgtactcagaagcaacacccacactttcagtag

SEQ ID NO: 226689 - DNA, 501 bp, Artificial Sequence
  Description of Artificial Sequence: Synthetic coding sequence
atgcttagaggggtcttaggtaaaacgtttagactcgtcggctataccatacaatacggctgtatcgcacactgcgcattcgagtatgtgggtggagttgtgatgtgctccggaccttctatggagccaactattcagaacagcgatatcgtgttcgcggaaaatctgtctagacacttttacgggatacagcggggagatatcgtaatcgccaagtcgccctcagaccctaagagcaacatctgtaagagggtgattggactggagggagacaaaatactgactacctctccaagtgacttcttcaagagtcattcttacgtgcctatgggtcatgtttggctggagggtgataatctgcagaatagcactgactcgagatgttacggcccaatcccttacggtttaattagaggtcgaatcttttttaaaatttggcccctgagcgattttggttttctaagagcaagccccaatggacaccgcttctctgatgattag

SEQ ID NO: 226690 - DNA, 324 bp, Artificial Sequence
  Description of Artificial Sequence: Synthetic coding sequence
atgctccgaggcgtactcgggaaaacttttcggctggtggggtatacaattcagtatggctgtatcgctcactgcgcatttgagtatgtgggcggtgtggttatgtgttctggtccctctatggaacccacaattcagaatagcgacatcgtctttgccgagaatttatcaaggcacttttacgggattcagaggggcgacatcgtgatcgctaaatcaccctcagaccccaaatccaatatctgcaaacgggttatcggactagagggtgataagatcctcacaacctctccctcagattttttcaagtcccactcctattag

SEQ ID NO: 226691 - DNA, 291 bp, Artificial Sequence
  Description of Artificial Sequence: Synthetic coding sequence
atgctgcggggtgtcttggggaagacatttcgactggtcggctacactattcaatatgggtgtattgcccactgtgccttcgagtatgtcgggggagtcgtgatgtgtagcggcccatctatggagccaaccatccagaatagtgacatagtgttcgccgaaaatctttctcggcacttttacggtattcagcgcggtgacattgtcatcgcaaagtctccgtctgacccaaagagcaatatttgcaaacgagtgatcggcctggagggcgacaaaattttaacaacctag

SEQ ID NO: 226692 - DNA, 501 bp, Artificial Sequence
  Description of Artificial Sequence: Synthetic coding sequence
atgttaaggggtgtgttgggtaaaacatttaggctcgtcggctataccatacagtatggctgcatcgctcactgtgcatttgagtacgtaggcggagtagtcatgtgcagcgggccatcaatggaaccgaccatccagaactctgatattgtcttcgcagaaaacctgtctaggcatttctacggaattcagagaggggatattgtgatagccaaatcccccagtgatcctaagtcaaacatctgtaagagggtgattggtctcgagggcgataaaatcctgaccacgagcccctctgatttcttcaagtcgcatagttacgtccccatgggacacgtgtggctcgagggcgacaatctgcagaatagtactgattctcggtgctatggccctattccttacggcctgatcagggggagaatcttcttcaagatatggcctctttctgatttcggatttctccgagctagccctaacggccacaggttcagtgatgattag

SEQ ID NO: 226693 - DNA, 528 bp, Artificial Sequence
  Description of Artificial Sequence: Synthetic coding sequence
atggcccagtcgcagggttgggtcaagcgctacatcaaggctttttgcaaggggttctttgttgcggtcccggtggctgtgacctttctggatagggttgcctgcgtggccagggtggagggggcaagtatgcagccctccctgaatccaggtggatcccagagctctgacgtcgtgctacttaaccattggaaggtccgtaacttcgaagtgcataggggggacattgtgtccctggtatctcccaaaaatccggaacagaagattattaagcgggtgatcgcgttggagggcgatatagtacgcacaatcgggcataaaaacagatatgtgaaagtcccccgaggccatatctgggtggagggagaccatcacggtcactcgttcgattccaacagttttggccctgtgagtcttgggttactgcatgcacatgccacccacatcctttggcccccagagcgatggcaaaaacttgaaagcgtcctacctcctgagcggttaccagtccagcgcgaggaggaatag

SEQ ID NO: 226694 - DNA, 528 bp, Artificial Sequence
  Description of Artificial Sequence: Synthetic coding sequence
atggctcagtcccagggctgggttaaacggtacattaaggccttctgcaaagggttcttcgttgctgtgcctgtggcagtgacattcctggatagggtagcgtgtgtggccagggtcgaaggtgctagcatgcagccctccctgaaccccggaggctctcaaagttctgatgtggtcttgttgaatcactggaaggtcagaaattttgaggtccaccgaggggacatcgtgagccttgtaagccctaaaaaccccgagcaaaagattatcaagagagtcattgccctggaaggcgatattgtccggacaattgggcacaaaaatcgttacgttaaggttccacgcggacatatttgggtggagggggaccaccatggacattcctttgacagcaactctttcggtcccgtgtctctagggctgctccatgctcacgcgactcatatcctgtggcctcccgaaagatggcaaaagctggagtccgtgctgcccccagagcgcttacctgtacagagggaggaagagtag

SEQ ID NO: 226695 - DNA, 528 bp, Artificial Sequence
  Description of Artificial Sequence: Synthetic coding sequence
atggcccaaagccaaggatgggtcaaaaggtacattaaggccttctgtaagggctttttcgtggcggtgccagtggcagtgacattccttgatagagtggcctgcgtcgccagggttgagggcgcatcaatgcagccctccctgaatccaggtggatctcaaagttccgacgtcgtactcctcaatcactggaaggtccgtaattttgaggtgcatcggggtgacatcgtctctctggtgagtcctaagaatcctgagcagaaaataataaaacgggtgattgccttggagggagacatcgttcggacaatcgggcacaaaaacagatatgtcaaagtgccgcgtgggcacatatgggtcgagggagaccaccacggccacagttttgacagcaactccttcggtcccgtatctctgggcctgcttcatgcccatgctacccatattctatggccacccgagcggtggcagaagctagaatctgtcttgccccctgaacgccttccagtgcagagggaggaagaatag

SEQ ID NO: 226696 - DNA, 333 bp, Artificial Sequence
  Description of Artificial Sequence: Synthetic coding sequence
atggcccagagccaaggctgggtgaaacgttacatcaaggcgttctgcaaagggttcttcgtcgcggttccagtggccgtcacatttctcgatagggtcgcctgtgtggcaagggttgagggtgcctccatgcagccctccttgaacccaggcggttcgcagagcagcgacgtagtgctgttgaatcattggaaggtgaggaattttgaagtgcatcgaggagacatcgtgagtctggtttcacccaagaatcctgaacagaagatcatcaagcgcgtcatcgcccttgagggcgatatcgtgagagacggtaggaaactgaagaggatctag

SEQ ID NO: 226697 - DNA, 240 bp, Artificial Sequence
  Description of Artificial Sequence: Synthetic coding sequence
atggctcagtcacaaggctgggtgaaacgatatataaaggccttctgcaaaggcttttttgtcgctgtgcccgttgccgtaacctttctcgatcgagttgcctgtgttgctagagtagaaggcgcttccatgcagccgagcttgaaccctggcggaagccaaagctcagacgtggtcctcctaaaccattggaaggtgcgcaatttcgaggtccatcgcggagatattgtctccctctag

SEQ ID NO: 226698 - DNA, 528 bp, Artificial Sequence
  Description of Artificial Sequence: Synthetic coding sequence
atggctcagagccaaggctgggtcaaaagatatattaaagccttctgtaaaggcttctttgtggcagtccccgtggccgtcaccttccttgaccgagttgcctgtgttgcaagggttgagggcgcttccatgcagccttcactgaacccagggggaagccagagttccgacgtcgttctgcttaatcactggaaggtgcgtaatttcgaggtccatcgaggtgacatcgtatccctggtcagccctaaaaatcctgaacagaagatcattaaaagggtgattgctctggaaggtgacattgtgcggacaatcgggcacaaaaacagatacgtgaaggtccccaggggacatatctgggtggagggcgaccaccacggccactcctttgattcaaactccttcggtcctgtttctttagggctcctccacgcccatgctacccacatcttatggccgccagagagatggcaaaagctggaatcggtactgccccctgaacgcctacctgtgcagagggaagaagagtag

SEQ ID NO: 226699 - DNA, 555 bp, Artificial Sequence
  Description of Artificial Sequence: Synthetic coding sequence
atggtccgcaaactcaagtttcatgagcaaaaattgttgaaacaagttgacttcttgaactgggaggttacagatcataatctgcacgagctgagggtccttcggagatatagactgcagcggagagaagactacactcgctacaaccagctgagtcgtgctgtcagagagttagcacgtcgcctccgcgatctccccgagcgcgaccagttccgagttagggcaagcgcagctctcttggacaagctttatgctctcggtctcgtgccaacacgaggctctttggagctatgcgactttgtcactgccagtagcttctgccgcagaagactacctactgtgttgctcaaactgagaatggcacagcacctgcaagctgcggtggcatttgtagaacaggggcacgtgcgtgtcggccctgacgtggtgaccgatcctgctttcctggtgactagatctatggaagatttcgtgacgtgggtagactcttcaaagattaagaggcacgtgctcgagtacaacgaagaaagagacgattttgatcttgaggcttag

SEQ ID NO: 226700 - DNA, 555 bp, Artificial Sequence
  Description of Artificial Sequence: Synthetic coding sequence
atggtgagaaagctcaagttccacgagcaaaagctactgaaacaggtcgatttcctcaactgggaggtaacagaccacaacctccatgagctcagagtcctcagacgctatcggctgcagaggcgtgaagactatactcgctacaatcagctgagccgggctgtccgagaactcgctaggagactccgggatctgccagagagagatcagttccgggtcagagcttcagctgcattgctggacaagctgtacgctttagggctcgtcccaacaaggggcagcttggagctttgcgacttcgtgacagcgtcttctttctgcagacggagactgccaacagtgctactgaagctcaggatggctcagcatcttcaagccgcagtagcttttgttgagcaaggacatgtaagagtgggcccagacgtcgttactgatccggcttttctagtgacccgtagcatggaggacttcgtgacatgggtggatagttccaagatcaagagacacgttctggaatacaacgaagagcgcgatgacttcgatctggaagcatag

SEQ ID NO: 226701 - DNA, 96 bp, Artificial Sequence
  Description of Artificial Sequence: Synthetic coding sequence
atggaagatttcgtgacttgggttgattcgtctaagataaagaggcatgttctcgagtataatgaagaaagggatgactttgatcttgaagcatag

SEQ ID NO: 226702 - DNA, 876 bp, Artificial Sequence
  Description of Artificial Sequence: Synthetic coding sequence
atgctcaggcgggaagctcggttaagaagggagtacctctatagaaaagccagggaggaggctcagcggagcgctcaggagaggaaggagagattgagaagagccttggaagaaaatagactgattcctaccgaactgaggagggaagctctggcactccaggggagtctggagtttgatgacgccggtggcgagggtgtgacttcccacgtcgacgacgagtatagatgggctggcgtcgaagacccaaaggtgatgatcactacctcaagagatccatcatctcgcctcaaaatgtttgctaaagaactcaaactcgtgtttcctggggctcagcgcatgaaccgaggcagacatgaagttggggctctagtgagagcgtgcaaagcaaacggtgttaccgacctgttggttgtgcacgagcataggggtacacccgtcggcttaatcgtatctcacctcccattcggcccaaccgcttactttactctgtgtaatgttgtcatgagacacgacataccagatctcggaacaatgtccgaagcaaagccacatttaattacccacgggttctcctctcgactgggcaaacgtgtttcggacatcctgagatacttgttcccagtcccgaaagatgatagccaccgtgtgattacatttgccaaccaggacgattatatcagtttcagacatcacgtgtataaaaaaaccgatcataggaacgttgagctcaccgaggttggtccccgattcgagctgaaactgtatatgatcagactgggcacccttgaacaggaagcaactgctgacgtcgaatggagatggcatccttatacaaacactgccagaaagcgggtgttcctgtctacagagtag

SEQ ID NO: 226703 - DNA, 2928 bp, Artificial Sequence
  Description of Artificial Sequence: Synthetic coding sequence
atggatctaaactcagccagtacagtggtgcttcaagttctgacccaggcaacctctcaagacacagccgtgctcaagccagcagaggagcaactgaagcagtgggaaacacagcctggtttttattccgtcctgttgaatatctttacaaatcacaccctggatatcaacgtacggtggctcgctgtcctatactttaagcacggaattgaccggtattggcggcgtgttgcgccacatgcactctcggaggaggagaagacaactctgcgcgcaggtttgattacgaacttcaatgagcccattaatcaaatcgccacgcagattgccgtgctgatagcgaaggtcgcaaggctggattgccctagacaatggcccgagcttattcctactctaatcgaatcagtcaaagtacaggacgacctccggcagcatcgcgcactgttgacattctaccatgtgactaagaccctagctagcaaaagactggcggctgacaggaagttgttttacgatttagccagcgggatctacaacttcgcctgttcgctgtggaaccaccatactgacacttttctgcaggaggtgagcagcgggaatgaggcagccatactgtctagtctcgagcgtacactacttagcttgaaagtgcttagaaagctcacggtcaatggatttgtggaaccgcataaaaacatggaagtaatgggtttcctgcatggtatttttgagcgcctgaagcaattccttgaatgcagtcggtcaattggcaccgataatgtgtgtcgcgatcggctcgaaaagaccattatccttttcaccaaagtgctgctggatttccttgaccagcacccattcagcttcacccccctaattcaaaggagcttagaattttctgtttcttacgtctttaccgaggtgggcgagggcgtcacgttcgaacgttttatcgtgcagtgcatgaatctcattaaaatgattgtcaagaactacgcctacaaacccagtaaaaattttgaagactcctcccccgaaacactggaggcacacaagatcaaaatggcctttttcacatacccaaccttgaccgagatctgtcgcagactcgtgagccactattttctcttaaccgaggaagaactgaccatgtgggaagaggacccagaaggctttacggtcgaagagaccgggggagactcatggaagtactcactgaggccatgtaccgaggtcctgttcattgatatctttcacgaatacaatcaaactctgacccccgtgctcctggaaatgatgcagacactgcaaggaccgaccaacgtcgaagatatgaacgctctgctcatcaaagacgcagtatataacgctgtgggcctggccgcatacgagctctttgatagcgtggacttcgaccaatggttcaagaatcaactgctgccagagcttcaagtcatccacaacagatataaacctctgcggcgacgggtcatttggcttattggacaatggatctccgtgaagttcaaaagcgatctgaggccaatgctctacgaggcaatctgcaatctgctacaggaccaggatttggtggtgaggatcgagactgcaacaactctgaagctgactgtagatgacttcgagttccggaccgatcaattcttaccatacttggagacaatgttcacactgctcttccagctgttgcagcaggtgacagagtgcgataccaagatgcatgtcctgcatgtcctatcttgcgttatcgaaagagtgaatatgcaaatacgcccttatgtagggtgcctagtccagtacctgccattactttggaagcagtcagaagagcataacatgcttagatgcgccattctcaccaccctgattcacctggtgcagggcctgggggcagattcaaaaaatttgtacccctttttactacccgtcatccagttatccacggacgtcagtcaacctcctcacgtgtatcttctggaagatgggctcgagctgtggttagtaacactcgagaacagtccttgtatcaccccagagctcctgcgcatatttcagaacatgagtcccctgctggaacttagctcagagaacctccggacctgtttcaagataatcaacggttacatcttcctcagttccacggagttcctacaaacgtacgctgtgggcctctgccagtccttctgtgaactcttgaaagaaattacaaccgaaggacaagtccaggtgctcaaagtcgtggagaatgccctcaaggtaaatcctatacttggccctcaaatgttccagcccattctaccgtatgtcttcaagggcatcattgagggcgagaggtaccctgtggttatgtcaacttatctgggggtgatggggcgagtactgcttcaaaacaccagtttcttttcctctctcctgaatgaaatggcgcacaaattcaaccaagagatggatcagttgctgggaaatatgatcgagatgtgggtggacagaatggataatataacccagcccgaacgtaggaagctatcagccttggcattgctctcactactgccttcagataacagcgtgatccaagacaagttttgtggtatcatcaatatcagcgtcgagggactgcacgatgtgatgaccgaggatcctgaaacaggcacttacaaagactgcatgttgatgagccacctggaggaaccgaaggtaaccgaagatgaagaaccgcctaccgaacaagataagcggaaaaaaatgctggccctgaaggatcccgtgcacaccgtgagtctccaacaatttatatacgaaaagctcaaggcccagcaggagatgctgggggaacagggattccaaagcttgatggagacggtagacactgagatagtgacccaacttcaagaatttctgcagggcttctag

SEQ ID NO: 226704 - DNA, 3048 bp, Artificial Sequence
  Description of Artificial Sequence: Synthetic coding sequence
atggtgcagcctatcattcatcttggctacgttgtctactctcttctatacttgggctacaagccggttcagcatgtcaccgctctcaacacggtgtcctcatgccacaagatggtttccatggatttgaactctgcctcaactgtggtgttgcaggttctgactcaggctacctcccaggacactgcagttctcaagcccgctgaggagcagttgaaacagtgggaaactcagcccggattctattccgtgcttctgaacatattcactaaccacactttagatatcaatgtccgctggttggccgtcctctacttcaagcacggaatagatagatactggagacgggtggcccctcacgctttgtcagaggaggaaaagaccactctgcgtgccggtttaatcactaacttcaatgagcctataaatcagattgccacacaaattgccgtgcttatcgccaaagtggcccgattagattgcccgagacaatggcccgagctgatcccaactctcatcgagagcgtgaaagtacaggatgatctgcgccagcacagggcacttcttactttctaccatgtcaccaaaacgctggctagtaaacgtcttgccgctgaccgaaagctgttttatgacctggccagcgggatctacaacttcgcatgttccctgtggaatcaccacacagacacattcttgcaggaggtatcgtctggtaacgaggcggctatcctgagcagtttggaacggactctgctaagcttgaaagtactgaggaaattaacagtgaacggcttcgtggagccgcacaagaatatggaagtgatggggtttctccacggcatttttgagagactgaaacagttcctggagtgctcccgaagcataggcacggataatgtatgtcgcgaccgtttagagaaaacaatcatcctgttcacaaaggtgttgttggatttccttgatcagcatcctttctcttttactcccctcatacagcggagtcttgaattcagtgtgagctacgtattcactgaagtgggcgagggagtcacattcgagcgttttattgtacagtgcatgaacttaataaaaatgatcgttaagaattacgcctataagcctagcaagaatttcgaggatagttccccagagacgctcgaggctcataagataaaaatggcatttttcacctatccaacattgacagaaatctgccgcagactagtatcacattactttttactgacagaggaagagcttaccatgtgggaagaagatccggaaggattcactgtcgaggagacgggcggagactcctggaaatattctctgcggccttgcacggaagtgcttttcattgatatctttcacgaatataaccagactcttactcccgtgctgttggagatgatgcaaaccctccagggccctacaaatgtggaggatatgaacgctttactcataaaagacgccgtgtataacgcggtcgggctggctgcttacgagctattcgatagcgtagactttgatcaatggttcaagaatcaattactccccgagctccaggtgatccacaaccggtataaaccactgcgccgaagagttatatggctaataggacagtggatctcagtcaagttcaaaagcgacctgcgaccaatgttatacgaagcaatctgcaacctgctgcaagaccaagacttagtagttagaatcgagacagctaccacgctgaagctgacagtggacgatttcgaattccgaaccgatcagtttctcccctatctcgaaacaatgttcacattgctctttcagctccttcaacaagtgacagagtgcgacactaagatgcacgttcttcatgtgctctcgtgcgtcatagaaagagtgaacatgcagattcgcccttatgtaggttgtcttgtccagtatttgccactcctgtggaaacagagcgaggaacataacatgctgaggtgtgccatcttgaccaccctgatccacttagttcagggtctcggagcagattccaagaatctgtacccttttctgctcccggtcatacagctctcaactgatgttagccagcctcctcatgtgtatctgctggaggatgggcttgagctctggctcgtgaccttagagaatagcccctgcatcacacctgaactgttgagaatcttccaaaatatgtctccgttgctggaactcagttcggaaaatttgcgcacctgcttcaagattatcaacgggtatatattcttatcatccaccgagttcctgcagacatacgcagtgggcctgtgccagagcttctgcgaattgctgaaggagataaccactgagggccaagttcaggtccttaaagtggttgagaacgctctcaaagttaatccgatcctgggaccccagatgttccaacctattctgccctacgtcttcaaaggcattatagagggggagcgctaccctgtcgtaatgagcacatatctgggagttatggggagggttttattacagaatacctccttttttagcagcctgcttaatgaaatggctcacaagttcaaccaggagatggatcagctgctgggcaatatgattgaaatgtgggttgaccgcatggacaacattactcagccggaacggcgaaagctcagcgccttggccttgttgtcactgctgccttctgacaactccgtcattcaggacaagttctgtggcattatcaacatttcagtggagggactgcatgacgttatgactgaagatccagaaactggaacgtacaaagactgcatgctcatgagccacctggaggaaccaaaagtgacggaggacgaggaaccacctaccgagcaggacaagagaaagaagatgttggcccttaaggacccagtccataccgtgagcctccagcagttcatctacgagaaactcaaggcccagcaagaaatgctgggcgaacagggcttccagtctttaatggagaccgtcgacactgagattgtgacccagttgcaggagtttctgcaagggttttag

SEQ ID NO: 226705 - DNA, 195 bp, Artificial Sequence
  Description of Artificial Sequence: Synthetic coding sequence
atggacctcaactctgcttcaactgtggtgctgcaagtgctaacccaggccacctctcaggacacagctgttctgaaacccgcagaagagcagctgaaacagtgggagacccagcccggattttacagtgtgctgcttaatatctttaccaatcatacccttgatattaatgttcgctggcttgctgtgttatag

SEQ ID NO: 226706 - DNA, 489 bp, Artificial Sequence
  Description of Artificial Sequence: Synthetic coding sequence
atggacctgaactcagccagcaccgtagtgctgcaggtactaacacaagccactagtcaggacacagccgtgctcaagcctgcggaggaacagcttaaacagtgggagactcagcccggattctacagtgtgctgctgaatatttttacaaatcacactctcgacatcaatgtgagatggctggcagtgctctactttaaacatgggattgatagatactggcgcagggtggcgcctcacgctctgtcagaagaagagaagaccactttacgggctggtctgattacgaattttaatgagccaattaatcagatcgcaacccagattgcagtgctcatcgccaaggtggcgagattggattgtccaagacagtggcctgaacttatacccacccttattgagtccgtgaaggtgcaggacgacttgcgccagcatcgagcactgctgacgttttaccacgtcactaagactctagcaagtaaacgctag

SEQ ID NO: 226707 - DNA, 450 bp, Artificial Sequence
  Description of Artificial Sequence: Synthetic coding sequence
atggacctcaatagcgcttctactgtggtattgcaggtgcttacacaggctacctcacaggacacagcagtgttaaagcccgctgaagaacagctcaaacagtgggaaacacaacccggtttttatagcgtgttattgaacatctttactaaccatacattggacataaacgttcgatggctggccgtcttgtacttcaagcacgggatcgatcgatattggagacgcgtggcgccacatgccctgagtgaggaggaaaaaaccaccttgagagcaggcctaattactaatttcaatgaacccatcaatcaaatagccacacagatcgcagtcttaattgcgaaagttgctcgattggattgccccagacagtggcccgagttgatacccacgttaattgaatcagtgaaggttcaggatgacttgcggcagcatcgtgccctgctctag

SEQ ID NO: 226708 - DNA, 1425 bp, Artificial Sequence
  Description of Artificial Sequence: Synthetic coding sequence
atgatgcagacactgcaagggcctaccaatgtagaggacatgaacgccctgctgataaaggacgcggtgtataatgcagttggccttgctgcctacgagctatttgactctgtcgacttcgaccaatggtttaagaaccagctgctgcccgagctgcaggttatccataatcggtataaacctctgaggcggcgtgtgatttggttgattgggcagtggatttccgttaagtttaaaagcgacctgaggccaatgctatatgaagccatctgtaacttactgcaggaccaagatctagtggtccggatcgagacagcaaccactttaaagcttacagttgatgacttcgaattccgcacagatcaatttctcccttacctcgaaaccatgtttacactgctgttccagctgttacaacaggtgaccgaatgcgacacaaagatgcacgtcttacatgtgctctcctgtgtgatcgaacgagtcaatatgcagatccgcccttatgtagggtgcttggtgcagtacctgcccctgttgtggaagcaaagcgaagaacataatatgttgaggtgtgccatcctgactaccctaatccacctcgtgcagggcctgggagcagattcaaagaacttgtacccattcctgcttccagtaatccagctatctactgatgtgtcacaaccaccccacgtctacctcctggaggatggcctcgagctctggctggtcacccttgagaactcaccctgcattactcctgagctcttaaggatctttcagaacatgagcccactcttggaactgagcagtgagaacctccgaacctgcttcaagatcatcaacggctacatcttcttgtctagtactgaattcttgcagacctatgccgtgggcttgtgtcaaagcttttgtgagttactgaaggagatcactacagaggggcaggtgcaggtgcttaaagtcgttgagaacgcgctgaaagtcaatcctattttgggccctcagatgtttcaacccatcctgccgtatgtgtttaaaggcatcatcgaaggcgagcggtacccagtggtgatgtccacctacctgggcgtgatgggacgggttctgctgcagaatactagtttctttagcagtctactcaatgagatggcacataaattcaaccaagagatggaccagctcttaggcaatatgatcgagatgtgggtagaccgaatggataatatcacccagccagagagacgcaagctaagcgccctggctcttttaagccttctgcccagcgacaatagcgtgattcaggataaattctgtgggatcatcaatatctccgtcgagggcctacacgacgtgatgacagaggaccccgagaccggcacatacaaggattgtatgcttatgtcccacctcgaggaacctaagtag

SEQ ID NO: 226709 - DNA, 3117 bp, Artificial Sequence
  Description of Artificial Sequence: Synthetic coding sequence
atggatccgaatactattattgaggccctgcgtggaacaatggaccccgcactgcgtgaagccgctgagcgtcagctgaacgaggcccataagtctctcaacttcgttagcactctgctacagatcacgatgtctgagcagctggatctgcccgtgcgacaggccggagtgatatatctgaaaaacatgatcacgcaatactggccagatagagagaccgccccaggggacatttcgccatatactattccagaagaagaccgtcattgtatacgagaaaacattgtggaggctataatacactctccagaacttatccgcgtgcagttaaccacttgtatacaccacattatcaaacacgactacccctctaggtggactgcaatcgtggataagatcggattctatctgcagagcgataactctgcttgttggctggggattctgctgtgcctatatcagcttgtgaagaactatgaatataagaagcccgaggagagatctcccctggtagctgcaatgcagcattttctcccagtcctgaaagatcggttcatccagttattgtctgatcagagtgatcaaagtgtgttgatccagaagcagatttttaaaattttttacgccctggtccaatacaccttacctttagagttgatcaatcagcaaaatctgaccgagtggatcgagattttgaagaccgtggtaaaccgagatgtgccaaacgaaaccctgcaagtggaggaggacgatcggcctgagttaccctggtggaaatgcaagaagtgggctctgcacatattggcccgtctttttgagagatacggaagtcccggaaacgtctccaaggaatacaacgagttcgccgaggtgttccttaaagcgtttgcagtaggggttcagcaggttcttctgaaggtgttgtaccagtacaaggaaaagcaatatatggcacctcgcgtgctgcagcagaccctgaactacatcaaccagggggttagtcacgcactcacctggaagaatctcaaaccccacattcagggaatcattcaggacgtaatttttcccttgatgtgctatacggacgcagacgaggagctctggcaagaggatccatatgaatacattaggatgaaattcgacgtattcgaagattttatatcccccaccaccgccgctcaaaccctcctgttcacagcctgttctaagcgtaaggaggtgctgcagaaaactatgggcttttgttaccaaattcttaccgagccaaatgcagaccccagaaaaaaagacggagccttacacatgatcggctccctggctgagatactccttaagaaaaaaatttataaggatcagatggagtacatgctgcagaaccacgtctttcccctgtttagtagcgagctgggctacatgcgagcacgtgcctgctgggtgctgcattatttttgtgaagtaaaattcaagtctgatcagaacctgcagactgccctagaactcaccaggcgttgcctcattgacgatagggaaatgcccgtgaaggtggaggccgcaattgctctgcaggttttgattagcaatcaggagaaggccaaggaatatataacccccttcattagaccagtaatgcaggctctgctccacattatcagagaaacagaaaatgatgatctgacaaacgtgattcaaaagatgatttgcgagtacagcgaagaagtaacacctatagcagtcgagatgactcagcacctggctatgacgtttaaccaagttattcagacagggcctgacgaggagggaagtgatgataaagcagtgacggcaatgggcatcctgaatactatcgataccctgctgagcgttgtggaggaccacaaggagatcacacagcagcttgagggtatctgtcttcaagtgattggaacagtgttgcagcagcatgtcctcgagttctacgaagagattttctcattggcgcacagcctcacttgccagcaggttagccctcaaatgtggcagttgctacctctggtgttcgaagtgttccaacaggatggtttcgactatttcacagatatgatgcctctgctgcataactacgtgactgtggataccgacaccctgctgagcgatacgaaatatcttgagatgatatactctatgtgcaagaaagttttgaccggggtcgcaggagaagacgcagaatgccacgcagctaaacttctcgaagtcatcatcctccagtgtaaggggaggggcatagatcagtgtatccctttgttcgtagaagcagctctcgagagactgaccagggaggtgaaaacgtctgaactgagaactatgtgtcttcaggtcgccatagcggctctctattacaacccacacctcctgctgaatactctggagaacctacgctttcccaataacgtggagcccgtcaccaatcacttcatcacacagtggctgaacgacgtggactgttttctaggacttcacgatcgcaagatgtgcgtactcgggctgtgcgcattgattgacatggaacaaatccctcaggtcctcaatcaggtgtcaggccagattttgccagccttcattcttctgttcaatgggttgaaaagggcctatgcatgccacgctgagcatgagaacgatagcgacgacgatgacgaagccgaggacgatgacgaaacagaagagctgggatctgacgaagatgacattgatgaagacggccaggagtaccttgaaatcctggccaagcaggccggagaggatggagacgatgaggactgggaagaggatgatgcagaagaaaccgccctggagggatacagcacaatcattgatgatgaggataacccggttgacgaatatcagatctttaaagctatttttcagacgatccaaaatcgcaaccccgtgtggtaccaggccctgactcatggtctcaacgaggaacagcgcaagcagttgcaagacattgcgacgctggctgaccagcgcagggccgctcacgaaagcaagatgatcgaaaagcacggaggatataaattcagtgcgcctgtggtgccaagcagctttaattttggaggccctgctcccggaatgaactag

SEQ ID NO: 226710 - DNA, 3114 bp, Artificial Sequence
  Description of Artificial Sequence: Synthetic coding sequence
atggatcttaatcggattatacaagcgttaaagggaaccatcgatcccaagctaaggatagcagctgaaaatgaactgaaccagagctataaaatcataaactttgcgccatcattgctgcgcatcatcgtctcggaccatgtggagtttccagttcgccaggctgcagctatttatttaaagaatatggtgacccagtactggccggatcgtgaaccaccccctggcgaagcgatattccccttcaatatccatgaaaatgatagacagcagatacgcgacaacattgtggagggcattattcgctcccccgatctggtaagggtgcaactgaccatgtgtcttcgcgctattattaagcacgacttcccaggccactggcccggagtagtggacaaaatagattactatttgcagtctcagtccagcgcctcatggctggggtctctgctgtgcctgtatcagctggtcaagacctacgagtacaaaaaggcagaggagagggaaccccttataatagcgatgcagatctttttgccgagaatccaacagcaaatagtccagttgctgccggacagcagttactatagtgtgctgctccagaagcagattctcaaaatattttacgctcttgtacagtatgcactccccttgcagttggtcaacaaccaaacgatgaccacgtggatggaaatctttaggacaatcatcgaccgaaccgtaccacccgagacactgcatattgacgaggacgacagacccgagcttgtttggtggaaatgcaagaaatgggccctgcacattgttgcaagattgtttgaacgatacggttccccgggaaacgttaccaaagaatattttgaattttccgagtttttcttaaagacttatgcagtgggtatccaacaggtgttactcaagatcctggaccaataccggcagaaggagtacgttgcccctagagtgcttcaacaggcttttaactacctgaatcagggcgttgtgcactcaattacctggaagcagatgaaaccccacatacagaacatctccgaagatgtgatcttcagcgtgatgtgttacaaggacgaggatgaggagctgtggcaggaggacccgtacgagtacatcagaatgaagttcgacatattcgaggactacgcatctcctacgaccgccgcacagaccttactgtatacggccgctaagaagcgcaaggaagtcctgcccaaaatgatggctttttgttaccagattctcacagacccaaattttgaccctcgcaagaaagatggcgcattacacgttattgggtcgctcgcagaaatactgctgaaaaagtccttgttcaaagaccaaatggagctgttccttcagaaccacgtattccccttattgctgtccaatttagggtatctaagggctcgcagctgttgggttctgcacgcattttcctcactcaagttccacaacgagctcaatttgcgcaatgcagtggaactagctaaaaaatccctcattgaggataaggagatgccagtcaaggttgaagctgccctagccctgcagagcttaatttctaatcagatccaggctaaagaatatatgaaaccccacgtgaggcccatcatgcaagaactgctccatattgtcagggaaactgagaacgacgatgtgacgaacgtgattcaaaagatgatctgtgaatattctcaagaggtggcatcaattgccgtggacatgacgcagcacctggcagagattttcggaaaggtgctgcagagtgacgagtacgaggaagtcgaggacaaaacagttatggccatgggaatcctgcacacaatcgatactattctcactgtcgtggaagaccacaaagagatcacccagcagctggagaacatctgcctgcggatcatagaccttgtgctccagaagcacgtgattgaattctatgaggaaattctctctctggcttatagcctaacatgccatagtatttctccacagatgtggcagctgttaggcattctgtacgaggtgttccaacaggactgtttcgagtatttcactgacatgatgccactgctgcacaactacgtgacaattgatacagataccctcctgagcaacgccaagcatttggaaattttgttcacaatgtgccgtaaagtcctttgcggagatgccggagaggacgcggagtgccacgccgctaagctactggaggtcataattctccagtgcaagggaagaggaatcgaccagtgcattcctctcttcgtccagctcgttctggaaaggctgacaagaggagtcaagacaagtgaactgagaacaatgtgcctacaggtggctatcgctgcactgtactacaaccccgatctgcttctgcataccctggagcgaatacagttaccacacaaccctgggcctatcaccgtgcagttcatcaatcaatggatgaatgacactgactgttttctgggacaccacgacaggaagatgtgcattattggtctttcgattcttttggaactgcagaaccgcccaccagcagtcgatgccgtcgtagggcagatagtcccaagcattctttttcttttcttaggactcaagcaggtgtgcgctacccgccagctggtgaatcgtgaagataggtcaaaggcagagaaggccgacatggaggagaacgaggagatttcctcagatgaggaggaaactaacgtaaccgcccaggcgatgcaatcaaacaacggccgaggggaagacgaggaggaggaggatgatgattgggatgaagaagtcttagaggagacagcgcttgagggcttttcaacacctctggacctggacaacagcgtggacgaataccaattcttcacacaggctttgattaccgtccaaagtcgcgatgccgcttggtaccagctgctgatggcccctctgagcgaggaccagcgaactgcactccaagaggtgtacaccctcgcagaacaccgacgcaccgtcgcggaggccaaaaagaagatcgaacagcaggggggtttcacgtttgaaaataaaggcgtgctatcagcctttaactttggtactgtgccatccaataattag

SEQ ID NO: 226711 - DNA, 2499 bp, Artificial Sequence
  Description of Artificial Sequence: Synthetic coding sequence
atggagtcccttacccttaagggctatgctcttccgttgcagctggttaacaatcaaactatgaccacctggatggagatttttcgcactattatcgaccggacagtgccaccggagactctccatatcgacgaagatgatcgacccgaattagtgtggtggaaatgcaagaagtgggcccttcacattgttgccagactgttcgaacgctacggaagccccggaaacgtcaccaaagaatactttgagttttcggagttcttcctaaagacctacgccgtagggattcagcaggttttgttaaagatcctggaccagtaccggcagaaagagtatgtcgcaccgagggtgctgcagcaggccttcaattacctgaatcagggggtggtgcattcaattacatggaaacagatgaagcctcacattcagaacatctcggaggatgtgatcttttcagtgatgtgctataaggatgaagacgaggaactgtggcaggaggacccttatgagtacattagaatgaaatttgatatcttcgaagactacgcttccccaaccactgctgcccaaaccctgttgtacactgctgccaaaaagaggaaagaagtgctgccaaagatgatggctttctgttatcagattctgacagacccaaactttgaccccagaaaaaaggatggagctctgcatgttattggatctctggcagagatactcctgaaaaagtccctgttcaaggaccaaatggaactctttttgcaaaatcatgtgtttcctctgctgttaagcaatctggggtacttgcgagctaggtcctgctgggtcctccacgccttctcgagtctgaagtttcacaacgagctgaatctacgtaatgctgttgaactggcgaagaagtcattgattgaggataaggaaatgcccgttaaagtggaagctgcactggctttacaaagtctgattagtaaccagatccaagcaaaggagtacatgaaacctcatgtgcgccctattatgcaggagcttctgcacatcgtacgcgagacagaaaatgacgacgttaccaatgtgatccagaagatgatctgtgagtattctcaggaagtagcctccattgccgttgatatgacacagcacctcgcagaaatcttcggaaaggtccttcagtctgatgagtacgaggaggtggaagacaaaaccgtcatggccatgggcatactgcacaccatagatactatacttactgtcgtggaggaccacaaagaaattacacagcagctcgagaacatatgcctgcgcatcatagatttggttctgcaaaagcacgttatcgagttctatgaagagatcttgtccctggcatacagcctgacctgtcacagcatctcaccccagatgtggcagttattaggcatactatatgaggttttccagcaagattgttttgaatacttcacggatatgatgccgctgttgcacaattatgtgaccatagacacggacacacttctgtctaacgcgaaacatctcgaaatacttttcacaatgtgccgtaaggtcctgtgcggggatgcaggcgaggacgcagagtgccatgctgccaaactgcttgaagtgatcatcttacagtgcaagggtaggggaattgaccagtgcatacccctgttcgtccaattagttcttgagagattgactcgaggagtcaaaacaagtgagctgcggaccatgtgcctgcaagtcgccattgctgctttgtattataatcccgatctccttctccacaccctggaacgaatccagctgcctcacaatcctgggcctataaccgtccagttcattaaccaatggatgaacgatactgattgtttcttgggacatcatgatagaaagatgtgtatcataggattatccatcctgctggagcttcagaatcgcccaccggctgtcgacgccgtggtgggccagatagtgcccagcattttgttcctgttcctgggactaaagcaggtgtgcgcaacccgccagctggtcaaccgcgaagacagatcgaaggccgagaaagctgacatggaggaaaatgaggaaatctccagcgacgaggaggaaaccaacgttaccgcacaggctatgcaaagcaataatggtcgcggagaagatgaagaagaagaagatgatgactgggatgaagaggttctggaggaaacggctcttgagggcttctctactcctttggatcttgacaattccgtagatgaatatcagtttttcactcaggctctgatcacagtgcagtcacgtgacgctgcgtggtaccagcttctgatggcccctttgagcgaggatcagagaacagcgctccaggaggtgtatactctcgcggaacatcgacggaccgttgccgaagcaaagaagaaaatagagcaacaaggaggattcacatttgaaaacaagggcgttctgagcgcgtttaactttggaacagttccttccaataactag

SEQ ID NO: 226712 - DNA, 1542 bp, Artificial Sequence
  Description of Artificial Sequence: Synthetic coding sequence
ctatccagtggacacgaactggctaaggaatatatgaagccacatgtcagacctatcatgcaggagctcctccacattgtgagggaaactgagaatgacgatgtgactaacgttatccagaaaatgatttgcgaatacagtcaggaggtagccagtatcgctgtggatatgacccagcacctcgctgagatttttggaaaggtgttacagtccgatgaatacgaggaggtcgaggataagaccgttatggccatgggcatcctgcatacaattgatacaatcctgacggtcgttgaggatcataaggagataacacaacagttggaaaatatctgcctgcgcataatcgatctcgtacttcagaaacacgttatcgagttctacgaagagattctgtcactagcctattcactgacttgccactccatttctccccagatgtggcagttgctagggattctgtatgaagtgttccagcaagattgtttcgaatacttcaccgacatgatgccactgctgcacaattatgtgactatcgatacagacaccctcctctcaaacgcgaaacacctcgaaatactttttacgatgtgtaggaaggtgctgtgcggcgacgcaggtgaagacgctgagtgccacgccgcaaagctgcttgaggtgataattttacaatgtaaaggtcggggaatcgatcagtgtattccactcttcgtccaattagttcttgagcggcttacccgaggggtgaaaacttctgagcttaggactatgtgcctgcaggtagccattgcagctctctattataaccctgacttgctcctgcacacactcgaacggattcaacttccacacaatcccggtcccatcaccgtgcagttcattaaccagtggatgaatgatacggattgttttctgggacaccacgatcggaagatgtgcattataggactctccatcctgctggaactgcagaatcggcctcctgcagtggacgccgtggttggccagattgtcccctccattctcttcttattcctggggctgaagcaagtgtgtgccactcgccagctggtcaaccgcgaagatcgttccaaagccgagaaggctgatatggaggaaaacgaggagataagctctgatgaggaggagaccaatgtcacggcccaggctatgcagagtaataacggacgcggtgaagacgaagaggaggaggatgacgattgggacgaggaggtgctcgaggaaacagcactggagggctttagtacccctctggacctcgataactccgtggatgagtaccagttcttcacgcaagccctgattaccgtgcagtctcgagacgccgcatggtatcagctactgatggctcctttgtctgaggaccaacgtaccgccctgcaggaagtgtatacccttgcagagcacaggcggacagtggctgaagctaagaagaaaatcgaacagcaaggtggattcacttttgaaaataagggagtgctgagcgcttttaactttgggacagtaccttccaataactag

SEQ ID NO: 226713 - DNA, 3546 bp, Artificial Sequence
  Description of Artificial Sequence: Synthetic coding sequence
atgccggagaatcctgctacggataaactgcaggtgctgcaggtattggaccggctcaagatgaagctccaggagaaaggggacacctcccaaaacgagaaactctccatgttctacgagactctgaagtcacccctgtttaatcagatccttacactgcagcaaagcattaagcagctgaaggggcagttgaatcacataccgtcggactgcagcgctaactttgatttctcgaggaaggggcttttggtcttcacagacgggagtattactaacggaaatgttcatcgcccttcaaacaactctactgtcagtggactgtttccatggacccccaaacttggaaatgaagactttaatagcgtgattcagcagatggcccaaggtaggcagattgagtatatagatattgagagacctagcactgggggtctgggtttctccgtggtagccctgaggtcacagaatttgggcaaagttgacatatttgtgaaggacgtgcagcctgggagcgtagcagaccgggaccagagactaaaagagaacgatcaaatcctagcgataaaccacacgccattggatcagaacatcagccaccagcaggccattgccctgctccaacaaaccaccggttcattacgcctcattgtcgctcgggaacctgtgcacaccaaatcttcaacttcttctagccttaatgataccacactgcccgaaactgtctgttggggacacgtcgaggaagtcgagctcattaatgatgggagcggcctcggcttcggcatagtgggcggaaaaacctcgggcgttgtggtgcggaccattgttcccggtggactggctgatagggacggaaggctgcaaacaggggaccacatacttaagatcggaggcaccaacgttcagggcatgacatctgaacaagtcgcccaagtacttcgtaattgtggcaattctgtgagaatgcttgtggcccgagaccccgctggcgatatctccgtgaccccccctgctccagcagccttacctgtcgccctccccactgtggcgagtaaggggccagggagtgattcctctctctttgagacttataatgtagaattggtgcgcaaggacggacagagcctcggcatacgtattgttggatacgtgggaacctcccatacaggagaagcgtccgggatctatgttaagtcgatcatccctggttctgcggcataccacaatggacatattcaagtgaatgataagatcgtggctgtcgacggagtgaacattcagggctttgcaaaccacgatgtagtggaggtgctcagaaacgctggtcaggtggtccaccttaccctcgtcagacgcaagactagctcctccacttctccccttgaaccaccatcagatcggggaacagtagtggagcctctgaagccacctgctctctttctgaccggcgcagtcgaaactgaaacaaatgtggacggtgaagatgaggagatcaaggaaagaatcgacacactcaagaatgataatatccaggcgctggagaagttggagaaggtgccagattcacccgaaaatgagctcaaatcgcggtgggaaaatctgctggggcctgactatgaggtgatggtggccactctcgacacccaaattgcagatgacgccgagctgcagaaatacagtaagctactccccatccatacactaagactgggcgtagaggtggattcatttgacggccatcattatatctcatcaatcgtaagcggtggccctgtcgataccctcggcttgctacagcctgaggatgaattgctcgaggtgaatggcatgcaactgtatggaaagtctcgccgagaagccgtcagctttctgaaggaggtaccaccacccttcacactggtgtgttgcaggcgcctgttcgacgacgaggcatctgtcgacgagccccgtcgcacagagaccagcctgcccgaaaccgaggtggatcataatatggatgttaacactgaggaggatgatgacggagagttagccctgtggagcccagaagtgaagatcgttgaactcgtgaaggattgcaagggtctgggattctccattctcgattatcaggatcctctggacccaacacgttctgtgatcgtgatccggtcgctggtagccgacggagtcgctgagcgatccggcggtctgctacccggtgatagactagtctcagtgaacgagtactgtctggataatacgagcctcgctgaggctgtggagatcctgaaggcggtgccccctgggctagtccacctgggcatctgtaaaccactcgtcgaagataacgaggaggagtcctgctacatactgcattcgtcctccaatgaggacaaaacagaattctctggcaccatccacgatatcaactcaagtctcatcctcgaagccccaaagggcttccgcgatgaaccgtacttcaaggaggagttagtggacgagccctttttagacctcggcaaaagcttccacagccagcagaaggagatagaacagagcaaagaggcctgggaaatgcacgagtttctcacccctagactgcaggaaatggatgaagagagggaaatcttggtggacgaagaatacgagctgtatcaggacccatcaccttccatggagctctacccattgagccacattcaggaggcaactcccgtgcctagtgtcaatgaattacacttcggcacccagtggctgcacgacaacgagccctccgagagccaggaggcacgaacaggcaggaccgtgtactcccaggaggcgcagccgtatggatactgccctgagaacgtgatgaaagaaaacttcgttatggagtcgctgccgtctgttcccagtaccgaaggcaattctcagcaaggccgattcgatgatcttgagaatctgaatagcctcgccaagacttctctcgatctgggtatgataccaaacgatgtgcagggaccatctctgctgattgatttgcctgtggtcgcccagcggagggaacaggaggacctccccttgtaccagcaccaggcaactcgagttattagcaaagctagtgcgtacacagggatgctttccagcaggtacgccactgatacatgtgaactgcccgaaagggaagagggtgaaggagaggagacaccgaacttttcccattgggggcctccccgtatagtggaaatattccgcgagccaaatgtcagccttggaatctcaatcgtaggaggtcagactgtcatcaaaagactgaagaatggagaggaactgaagggcattttcattaagcaggttctggaggacagtcccgcaggaaagaccaatgccctaaagacaggagacaagatcttggaggtgtcaggggtcgacctacagaacgcctcgcactccgaagccgtagaggccataaagaacgccggtaatcctgtagttttcatagtgcagtctctgagtagtacaccagcttgggtgactgagcaggactcggtgtcgaaaaaaaagaaaaaccatgaggggtag

SEQ ID NO: 226714 - DNA, 600 bp, Artificial Sequence
  Description of Artificial Sequence: Synthetic coding sequence
atggtgcaaggcggttttcccgaaaagatccggcagagatatgccgacctgcccggagagcttcatattatcgagctagagaaggacaagaatggcctcggcctgagtttggccggtaacaaagatcggtcacgcatgagcatcttcgtggtgggtatcaaccccgaaggacccgctgcggcagatggtagaatgagaataggagacgagctactggagatcaacaaccagatcctttacgggaggtcccaccagaatgccagcgctatcatcaagactgctccttcaaaggtgaagctggtctttatcagaaacgaagacgctgtcaatcagatggccgtgacccccttccccgtgccttcaagttccccttcctccatcgaggatcagagcggcactgagcctatctcttcagaggaggatggctcagtcgaggtgggcatcaaacagttaccagaatccgagtcctttaaattggccgtgagccagatgaaacaacaaaaatatccgaccaaggtgtccttttcaagtcaggaaattcctctggcacccgcatcctcctaccacagtacagatgcagacttcactggctacggttag

SEQ ID NO: 226715 - DNA, 4745 bp, Artificial Sequence
  Description of Artificial Sequence: Synthetic coding sequence
atgccagaaaaccctgcaacggacaagctacaggttcttcaggttctggataggctgaagatgaagcttcaggaaaagggagatacaagccagaatgagaagctgtcaatgttctacgagactttaaaaagccccctcttcaaccagatccttacccttcagcagtctattaaacaacttaaagggcagctgaatcacattccctccgattgttccgctaatttcgacttttcccgaaaaggtctgttagtgtttactgacggcagcatcacaaatggaaatgtgcatcgcccaagcaacaactcaacagtgtccgggctatttccctggacccctaagctcggcaatgaagatttcaattccgtgatccagcagatggcccagggacgccaaattgagtacattgatattgaaagacccagtaccggtggactaggtttcagtgtcgtcgctctcagatcgcaaaacctgggtaaggtggacatcttcgtcaaggatgtacagccaggctctgttgctgatcgggatcaaaggcttaaagagaatgatcagattttggccattaaccacacccctctggatcagaatatcagccaccagcaggccatcgccttgctccaacagactaccggatccctgaggctgatagtggctagggagccagtacataccaagagcagcacatcttcctctctgaatgacacaactctccccgaaacagtctgctggggtcacgtggaagaggtcgaattgatcaatgatggctccggcctaggatttgggatcgtcggtggcaaaaccagtggtgtggtggtccggaccatcgtgcccggtggcttggcggacagagatggtcgattgcagaccggggatcatatcttaaaaataggaggcaccaacgtgcaggggatgaccagtgaacaagtggcccaagtgttaagaaactgcggcaatagcgtgagaatgctggtcgcaagggaccctgctggggatatctctgtgacaccaccagcacctgcagccctgcccgtagcactgccaacagtggcttctaaaggacccggtagcgattctagcttgttcgagacttacaacgttgagcttgtgcggaaggatggccagtctctcgggatcaggattgttggatacgtgggaactagtcatacaggtgaagcatccggtatatatgtaaagagcatcattccgggatccgccgcttaccacaacggacacatccaagtgaatgataagatcgtggccgtggacggggtgaatattcagggttttgccaatcacgatgttgtcgaggttctgagaaatgccggacaggtggtccacctaacactagtgcggcgaaagacctcatctagtacatcacctctggagcctccatccgatcggggaacagtcgtagaacccctgaaaccccctgcgctttttcttacaggtgccgtggaaactgagaccaatgtcgacggtgaggacgaagaaattaaggagcgtattgacacactgaaaaacgataatatacaggccctcgagaagctggagaaggtgccggattcccccgaaaatgaacttaagtcaagatgggagaacctgctcggccctgactacgaggtcatggtggcaacactggacacccaaattgcagatgatgctgaactgcaaaaatactcaaagcttctacccattcacactctgagactgggggttgaggtagattcttttgatggacaccactacatctcatctatcgttagcgggggacctgttgatacactcggcctgttacaacccgaagatgaactgctcgaagtgaacggtatgcagctatacgggaaatctcgtcgggaggccgtgtctttccttaaggaagtaccgcctccatttaccctggtctgctgtcggagactgttcgatgacgaagcctctgtcgatgagcctcgacggacggagacgtccctccccgagactgaagtggatcacaacatggatgtcaacacagaggaagacgatgatggtgaattagcactctggtcacccgaggtcaaaatcgtggagctcgtcaaagattgtaaggggctgggtttctcgattctggactaccaggacccgctagatcccacgcggagtgttatcgtgattcgatctctggttgcagacggagtagctgaacggtccggagggctgctgccaggcgacaggcttgtctcggtgaacgagtattgtctggataacacaagtctggccgaagccgtggagatccttaaggctgtccctccaggccttgtgcacctcggtatctgtaaaccacttgtggaagataacgaggaggaatcatgctacatcctccacagctcttcaaatgaggataaaacagaattttcaggcacgatacacgatattaattcctcccttattttagaagctccgaaggggtttagagacgaaccatacttcaaggaagagttggtggatgagccctttctggatctgggtaagagcttccactcccagcaaaaagaaatagagcagagcaaggaagcttgggagatgcacgaattcctgaccccaagactccaggaaatggacgaggagcgcgaaattttagtagacgaagagtacgagctctaccaggatccatccccttctatggaactgtatccgctgtcacatattcaagaagccacccctgttccaagtgtgaacgagctccacttcggaactcagtggctgcatgataatgagccatctgagtcccaggaggcaaggacaggcagaacagtgtattcccaagaagctcagccttacggttattgcccggagaacgtgatgaaggagaacttcgtcatggaaagcctcccgagcgtcccatccacggagggcaacagccaacagggtagattcgacgacttggagaacctgaactctttagccaaaacaagcctggatttaggcatgattcctaacgacgtgcaagggcctagcctcctgatcgatttacccgtagttgcacaaaggcgcgaacaggaggatcttcctttatatcagcaccaagcaacccgggtgataagcaaggcatctgcatacacaggaatgctaagcagccgatatgccacggacacctgcgagcttccagaacgggaggaaggagagggtgaggagacccctaatttctcacactggggcccaccgagaattgtcgagatctttagggagccaaatgtgtcactcggcatttcgatagttggtggacagaccgtgatcaagcgcctcaagaacggagaagaacttaaaggcatcttcatcaagcaggtccttgaagattctcccgcaggaaagaccaacgccctcaaaacaggcgataaaattctcgaggtcagcggggtcgacctacagaacgcaagtcacagtgaggcggtggaggcgatcaaaaacgcgggaaatcccgtggtttttattgtccagtctctgtcatccacaccacgcgttatcccaaacgtccacaacaaagctaataaaattacaggcaaccagaaccaggacacacaggaaaaaaaagagaagcggcaaggaacagctccgcctcctatgaagctacctcctccatataaagcccttacagacgatagcgacgagaacgaggaagaggacgcattcacagatcagaaaatcagacaaagatacgccgacttgccaggagagctacacatcatcgagctggagaaagacaagaacggcttgggcctctcactggcaggaaataaagaccgcagcagaatgagcatctttgtagtgggcattaatcccgagggaccagcagccgctgacgggagaatgaggataggcgacgagttgctcgagattaataaccaaatcctgtacggaagatcccaccagaatgcatccgccattataaagaccgcaccaagtaaggtaaagctggtgttcatccgtaatgaagatgcggtaaatcaaatggcagttacaccctttccggtccccagctcaagcccgagttccattgaggatcagtccggcaccgagcccatctcctccgaagaggacggcagtgtggaggtgggtattaagcaactgcctgagtccgagagttttaagctggccgtttcacagatgaagcagcagaagtaccctaccaaggtttcattttcttcccaggaaattcccctggctcccgcatctagttatcacagtaccgacgccgactttaccggctacggcggatttcaggccccactcagcgtcgaccctgctacttgtcccatagtgccgggacaggagatgatcatagaaatcagtaaggggcgttccggactgggtctcagcatcgtgggaggtaaggatactccactgttttggcggctcggctctccaagagcgtggtctcaacacctcgtgcgggcattcatgctgcatcatcccgtcactgaggtagaaggccaaaatgcaattgtgatccatgaggtctatgaggagggcgcagctgccagagatggacgtttatgggccggtgatcagatcctggaggtgaatggggtcgacctacgcaacagttcccatgaagaggctattactgccctgaggcagactccacagaaagtcaggcttgtggtgtacagagacgaggcccactaccgcgatgaggagaatctcgagattttcccagttgacctccagaaaaaggctggcagaggcctgggcctcagtattgtgggtaaata

SEQ ID NO: 226716 - DNA, 5405 bp, Artificial Sequence
  Description of Artificial Sequence: Synthetic coding sequence
atgcctgaaaacccagctacagacaagctgcaggtgctccaggtactcgatcgtctcaagatgaagctgcaggaaaaaggcgatactagtcagaacgagaagctgtctatgttctatgaaaccctgaagtctcccctattcaaccagattttgacgctccagcagagtataaaacagctcaaagggcaactgaatcatatcccctcagattgcagcgccaattttgacttcagtagaaagggactcctggtgttcaccgacggctccattactaatggcaacgtgcacaggcccagcaacaatagcaccgtatcgggcttgttcccatggacacccaaattgggtaacgaggatttcaactctgttatccagcagatggcccagggcagacagattgagtatattgacatcgaacgacctagtacaggaggactgggttttagcgtggtcgcattgcgctcacagaacctgggaaaggtcgatattttcgttaaagatgtccagccgggatccgtggccgacagggaccaaagattgaaagagaacgatcaaattttagcgattaaccatacccctctggaccagaacataagtcatcagcaggcgattgctttgctgcagcaaacaacagggtccctgcggttgatcgtagcccgagagccagtacatactaaaagtagcacatcttccagcctcaatgacacaaccttgcctgaaactgtttgttgggggcacgtcgaggaggttgagctgattaatgacggatccggcctcgggttcggtattgtcgggggaaagacatccggtgtcgtcgtgagaaccatcgttccgggaggcttggccgaccgcgacggacggctgcagaccggagatcacatattaaagattggtggaacgaatgtgcaggggatgaccagcgaacaggtagctcaagtcctgcgtaattgcggaaactccgtgaggatgttggtcgctcgggacccagctggcgatattagtgtgacaccaccggctccagcagccctgcccgtcgcactgccaaccgtcgcaagtaagggtccagggtcagactcgtccctgttcgagacttacaatgtggagttggtgaggaaggacggccagtccctgggaatcagaatcgtaggttatgtgggcaccagccacactggcgaagctagcggcatttatgttaagtctatcatccctggaagcgctgcataccacaatggtcacattcaggtgaacgacaaaatcgtcgcagtggatggcgtgaacatccagggttttgctaatcacgacgtggtggaagtgttgagaaatgccggacaggtagtacacctgacattagtcagacggaaaacgtcaagcagtacctcacctttggaacctccgagcgatagaggtacagttgtggagccactgaagccccctgctctgtttctgaccggcgcagttgaaacagaaactaacgtagacggagaggacgaagagattaaggaacgaattgatacacttaaaaacgacaatatccaggctctcgaaaagctggagaaggttcccgatagcccggagaacgaacttaagtctcgatgggagaatctgctgggaccagactatgaggtcatggtggcaaccctcgacactcaaatcgcggatgacgccgagctgcagaagtattccaagctgctgccaatccatactctacgattaggagtagaggtagattctttcgacggacaccactatatcagttctattgtctccgggggacccgttgacaccctcgggcttctgcagcctgaggacgaattgctcgaggtgaatggaatgcagctttacggcaaatcgcgccgagaggcagtgtccttcctgaaggaagtgccaccgcctttcacgcttgtttgttgcagacggctctttgacgatgaagcatccgtggacgagcctcgcagaaccgagaccagcctgccggagacagaggtcgaccacaacatggacgtcaacaccgaggaggatgatgacggggagttggcactttggtcaccagaagtgaagatagtggagcttgtgaaagattgtaaggggctgggtttctctatactggattatcaggaccctcttgatccaacaaggagcgtgattgtgattagatctctcgtagccgatggagtggcggagagaagtggaggattactacctggagatcggctagttagcgtgaacgagtactgcctggataacacttcactggccgaagcagtggagatactgaaggctgttccgccagggctcgttcatctgggaatttgtaagccattggtggaggacaatgaggaagaatcgtgttatattcttcacagctcctccaatgaagataagaccgagttttcaggcaccatccatgacataaactcatccctgattctggaagcaccaaagggcttcagggacgaaccctacttcaaagaagaattggttgacgaacctttcctggatctggggaagtcctttcattcccagcagaaggaaatcgagcagagtaaggaggcgtgggaaatgcacgaattcctgacaccacggctgcaggagatggatgaagagagagaaattctcgtcgatgaggagtacgaactgtatcaggatccttcaccctctatggaattatacccactctctcacattcaggaagccaccccggtgccctccgttaacgaactccacttcggaacacagtggctgcacgacaatgaaccaagcgaatctcaagaggctcgaaccggcagaactgtgtactcccaggaggcccagccttatggctactgccccgagaatgtaatgaaggaaaacttcgtgatggagtccttgccaagtgtcccatctacggagggaaatagtcaacaggggaggttcgacgatcttgaaaacctcaattccctcgcaaaaacatctctggatttaggtatgataccaaatgatgtccaggggccttcacttcttatagatcttcccgtcgtagcccagcgacgagagcaggaggatctgccgctctatcaacaccaggctactcgggtcataagtaaagcctcggcttacacggggatgttgtcatcccgctacgctacagacacttgtgagctgccagaacgagaggagggagagggcgaggagacacctaacttctcccactggggcccacccaggattgtcgagatcttccgagaacccaacgtgagcctgggaataagcattgtcgggggacaaactgtcatcaagcgactcaaaaatggtgaagagctgaaaggtatctttatcaagcaggtacttgaggattctccagctggtaaaacaaacgctctgaaaacgggcgacaagatcctggaagtaagcggagtggatctccagaacgccagccacagtgaggctgtggaagcaattaaaaatgcaggaaaccccgtggtgttcatcgttcagagccttagctccacgcctcgggtgattcctaacgtgcataataaggctaataaaattactgggaatcagaatcaggacacacaggaaaaaaaggagaaacgccaagggacagcaccaccacctatgaagctgcctccaccctacaaagcgttaaccgacgattctgatgagaatgaggaagaagacgcattcaccgaccaaaaaatcaggcagagatacgcggacctgccaggagaacttcacatcatcgagctggagaaagacaagaacggacttgggctgtctctggccggaaataaagaccgctcacgcatgagtatcttcgtggtcggaattaatccagaagggccagccgcagcagacggcaggatgagaattggcgatgagttgctggaaattaataatcagatcctgtatggacggtctcatcagaacgccagcgccatcattaagacagcaccttctaaagttaaactggtgttcatccgaaatgaggatgctgttaatcaaatggcagttactcctttcccggtcccatcctcaagtccgtcaagcattgaagatcagtcaggcactgagcccatctcatcggaggaggatggctccgtcgaagtaggcattaaacagctgcctgaatcagagagctttaaactcgccgttagccagatgaaacagcagaagtacccaaccaaggtcagctttagctcacaggagatcccgctggctcccgcttccagttaccacagtacggatgcggactttactggctacggtggcttccaggccccacttagcgttgaccctgctacctgtcctattgttcctggacaagaaatgataatagagatcagcaagggtaggtcaggcctgggtctctccatcgtaggaggtaaagacacacccttgaatgcaattgtgatccacgaagtgtacgaggaaggagccgcagctcgagatggacggctgtgggctggggaccaaattctcgaggtcaacggggtcgaccttcggaactcatcccacgaggaggccattactgcgctgcgacagaccccccagaaggtgaggctggtggtgtatcgtgacgaagcccactacagagacgaggaaaatctggagatttttcccgtagatctgcagaaaaaggccggaagagggttgggactgtccattgttggcaagcgcaatggttctggtgtgtttattagtgacatagtgaagggaggcgctgccgacctggacggccgtctcattcagggggaccagattttgtcggtaaacggagaagacatgagaaacgcgtctcaggaaaccgtggccacaattctaaaatgtgcgcagggccttgtgcagctggagataggacggttgagggccggaagttggacctcagcccgtacaacctctcagaactcccaaggcagccagcagagcgctcacagctcttgtcatcccagtttcgctcccgtgataactggtctgcaaaacttggttggaaccaagagggtgtcagatcctagtcagaagaactccggcaccgatatggagccacgcactgttgaaatcaatagagagcttagcgatgccctggggatctcgatcgcagggggtcggggatcgcctctgggcgacatcccggtgtttattgcgatgatccaggcatctggagttgcagcccgaacccagaaactcaaagtgggggatcgaatagtgagtatcaacggccagccactggatggactttctcacgctgacgtggtgaatctgctgaaaaacgcctacggacgcattatactgcaggtggtcgccgataccaatatcagtgcaattgctgctcaattggagaatatgtccaccggataccacctcggctcacccactgctgaacaccaccctgaagacaccgaagagcagctccagatgacagccgacta

SEQ ID NO: 226717 - DNA, 4571 bp, Artificial Sequence
  Description of Artificial Sequence: Synthetic coding sequence
atgcctgaaaatcccgctacagacaagctacaagtcctgcaagtgctcgaccgtttaaagatgaagctccaagagaaaggtgacacgtctcagaatgagaaactgagcatgttttatgagaccctgaagtctcccctgttcaatcagatcctgacactgcagcagtctattaagcaattgaaagggcagctcaaccacatcccctcagattgttctgcaaatttcgatttcagccgcaagggactgcttgtcttcacggacggatcgattaccaacggaaacgtccatcgcccatctaacaactctaccgtgtctgggctgtttccttggacacccaagctgggcaacgaggattttaacagtgttatccaacagatggcccaagggaggcaaattgaatacattgacatagagcgcccatccactggcggtttgggcttctccgtggtcgccttaaggtcacagaatctgggcaaggtcgacatttttgttaaggacgtgcaacctgggagcgtggcagacagagaccaacgtctgaaggagaatgatcagatcctggcgatcaatcatacaccactcgatcaaaatatctcgcatcagcaggcgattgccctcttgcagcagaccacgggttccctgaggttgattgtagcccgtgagccggtccacaccaaatcttcgacgtctagcagcctgaatgacactaccctgcccgagacggtgtgctgggggcacgtggaagaggtggagctgataaacgatgggagtggcctgggcttcggaatagtcggcggaaaaacctctggagtggtggtacggactatcgtcccaggaggcttggccgatagagatgggcgtctccagaccggtgaccacatcttaaaaattggcggaaccaacgtccagggaatgaccagcgagcaagttgcccaggtgctgagaaactgcggaaacagtgtgcggatgctagtcgccagagaccccgctggagatatctcagtaacacctccagccccagccgctctgcccgtggcactgcccaccgtagcatcgaagggcccaggctccgattcatccctgttcgagacttataatgtggagctggtgcgaaaagatgggcagtcactgggcattcgcattgtgggctacgttgggacaagccatacaggtgaggcatccggaatatacgttaagtcgataattcccggatcggcagcttaccacaacggccatatccaggtgaatgataagatagtggcagtggacggcgtgaacatacaaggattcgctaaccatgacgtggttgaagtgctgcgcaatgcaggccaggtggtgcatctaactctggttaggagaaaaacaagctcttcgacatctccattggagcctccttccgacaggggaacagtggtcgaaccactgaagccaccagctctgttccttacaggcgcagtagaaacagaaacgaacgttgatggcgaagacgaggaaatcaaggagcgaatcgatacacttaagaacgataatattcaggcactcgaaaagctcgagaaggttcctgattcccctgaaaacgagctaaagtccagatgggagaatttgctggggccagactatgaagtaatggtcgccactttggacacccaaatcgctgacgatgcagaattacagaaatatagcaaactgttgcctatccacactctgcgcctgggtgtcgaagtcgactcattcgacggacatcactacatcagttcgatcgtgtccggaggccctgtggataccctcggattgctgcaacctgaggacgaattgctcgaggtgaacggaatgcagctttacgggaaaagtaggcgtgaagccgtgtcttttcttaaagaagtcccgccaccctttaccctggtgtgttgtaggcggctctttgatgacgaagcttcagtggacgagcccagacgcaccgagaccagcctgccggaaacagaggtggaccataacatggacgtgaatacagaagaagatgatgacggtgaactggcactctggtcacctgaggtcaaaatcgtagagctggtgaaagattgtaagggcctgggatttagcattctggattatcaggatcctctggacccaaccagatcggtgatcgtaatcagatcgctggtggccgatggagttgccgagcgaagcggagggttgttgcctggagaccggctcgtgtcggtcaatgagtactgtttagataatacttccctggctgaagctgttgagatactaaaggctgtgcctcctggccttgtgcatctgggtatctgcaaacctctggtggaggacaacgaagaagagagttgctacatcttacattcttctagtaatgaagacaagaccgagttttccggcacaatccacgacatcaattcgagtctgattctcgaagccccaaaagggttccgcgacgagccctacttcaaagaagaactagtcgacgagcccttcctcgacctgggcaagagtttccacagccagcagaaagagattgagcagtcaaaggaggcttgggaaatgcacgagttcttgaccccacggttgcaggagatggacgaggaacgggaaattctcgttgacgaagaatacgagctctatcaggatccatctccatccatggagctgtaccccctctctcacatacaagaagcgactccggtgccaagcgtgaacgagttacacttcgggacacagtggctgcatgacaacgaaccctctgaaagtcaggaagccaggacaggccgtacggtgtactcacaggaggcgcaaccctatgggtactgcccagagaacgttatgaaggaaaactttgttatggaaagtctcccctctgtcccatctaccgaggggaactcccagcagggcagattcgatgatctcgagaacctgaactcgctagccaagacctccctagacctgggaatgataccaaatgacgtgcaggggcctagcctgctcattgatctccccgtggttgcccagcggagagagcaggaggacctgccgctctaccagcaccaggccacgcgtgtaataagcaaagcgtcagcctataccggcatgcttagctctcgctacgctacagatacctgcgaactacccgaaagagaagagggagaaggtgaggaaacccccaattttagccattggggaccaccaagaattgtcgagatttttagagaacctaacgtgtctttgggcattagcattgtgggagggcagaccgtcattaagagactgaagaatggcgaggagctgaaagggattttcattaagcaggttctggaagacagccccgcaggtaagaccaacgcactgaaaaccggcgataagatcttggaagtatcgggtgttgatctacagaatgccagccactcagaggccgtggaggccataaagaacgcaggtaaccccgtcgtcttcattgttcaatctctgagcagcacaccacgcgtgatccccaatgtccacaataaggctaataaaattacaggtaaccagaatcaggatactcaggagaaaaaggagaaaaggcaaggcacagctcctccacccatgaagctgccccctccctacaaagcacttacggatgacagtgatgagaatgaagaggaagacgccttcaccgaccagaaaattcgtcagcgctatgcagatctcccaggcgaattacatataattgaactcgagaaggataaaaatggtctgggactgtcgctggccggtaacaaggacaggtcaagaatgtccatcttcgtcgtaggtattaacccagaggggcctgctgccgctgatggtaggatgcggatcggggatgagttgctggagattaataaccagatattgtacggcagatcacaccaaaacgcttctgccatcatcaagaccgcccctagtaaagtaaagctcgtgttcatccgcaatgaagacgctgtcaaccagatggctgtgaccccttttcctgtcccctcgtctagcccaagctccatcgaagaccagtcaggtaccgagccgatctcttctgaggaagatggaagcgtcgaggttggaatcaagcaactccccgagagtgagagctttaagctggcagtttcccagatgaaacagcagaaataccctacgaaggtgtctttttcctctcaggagatccccctcgcgcctgccagtagttatcactccacagatgccgattttactggctacggaggcttccaggctcccctgtcagtcgatcccgctacctgtccgatcgttcccggacaggagatgattattgaaatcagcaagggtagatcaggtctcggtctctcaatcgtcggcggaaaagatactcctcttgttaacggagtggatctacgcaatagttctcacgaggaagccatcactgctttgaggcagaccccccagaaagtaaggctggtcgtgtacagagacgaggcacactaccgtgacgaggagaatctagaaattttccccgtagacctccaaaaaaaagctgggagagggcttggcctgtccattgttggtaaata

SEQ ID NO: 226718 - DNA, 1359 bp, Artificial Sequence
  Description of Artificial Sequence: Synthetic coding sequence
atggttcagggcggtttccccgaaaagatccgacaacggtatgctgatctccccggagagttgcacataatagaactggaaaaagacaaaaacggtctcggtttgagcctcgctggcaacaaagacagatctcgcatgtccatctttgtggtggggattaatccagaggggcctgcggctgcggatggtaggatgcggattggagacgagctgctggagattaataaccagattttgtatggccgatcacaccaaaatgcgagcgccattattaagaccgcccctagcaaagtcaaattagtctttatccggaatgaagacgcagtgaatcaaatggccgtcacacctttcccggttccaagctctagtccgtccagcatcgaagatcaatcaggtacagaaccaatcagtagcgaggaggacggctccgtggaggtcgggatcaaacagttacctgagagcgaatctttcaagctggctgtgtctcagatgaagcagcaaaagtacccaacaaaagtgtcattctcctcacaggaaatacccctggcgccagccagctcctatcactcgacagatgccgactttacaggctacggaggctttcaggcacctctgagcgttgaccccgctacctgcccgatcgttcccggtcaagagatgatcatcgagatttccaagggacggtcgggcctgggacttagtatcgttggcggaaaagatactccgctgttctggcggttgggtagcccaagggcgtggagccagcacctggtccgggcattcatgcttcatcatcctgtcacggaggtcgaagggcagaatgcaatcgtaatccacgaagtctatgaagaaggcgcagccgcacgggacgggaggctctgggctggcgatcagattctcgaagttaatggagtggatttgcgcaacagctcgcacgaagaggccatcacagcactgcgacagacacctcaaaaagtcagactggtggtgtaccgagatgaggcccactacagggacgaagagaacctggaaattttccctgttgatttgcagaagaaggcaggccgaggtctgggtttgtctattgtcgggaagagaaacggttctggtgtgtttatatctgacatcgtcaagggcggtgctgctgacctggacggtcgccttattcaaggcgatcaaatcctgtctgtaaacggcgaagatatgcggaatgcatcccaggaaacagtggccacaatcctgaagtgtgcccaagggttggttcagcttgaaatcggtcgcctgcgagctggctcctggaccagtgcccgaacaacatcccagaattcccaggtagtggatggattctcgtccgactag

SEQ ID NO: 226719 - DNA, 594 bp, Artificial Sequence
  Description of Artificial Sequence: Synthetic coding sequence
atggccgtaactccctttcccgtgccttctagctctccaagtagcatcgaagaccagtctggaaccgagcctatttccagtgaagaggacgggtctgttgaggtaggaatcaaacagttacccgagagcgagtcattcaaactcgccgtcagccaaatgaagcagcagaaatatccgaccaaggtcagtttctcttctcaggagataccacttgccccagcaagttcctaccactcaacagacgccgacttcaccggatacggcggtttccaggcgcctctgtcggttgacccggctacttgtcccatcgtgcctggacaggagatgattattgagattagcaaaggcagatccggcctgggcctgtccattgtgggcggaaaagacacaccactcgtcaatggcgtcgaccttaggaatagctcacacgaggaggccattactgcactcagacagaccccacagaaggtgaggctggttgtctaccgcgacgaggcacattacagagatgaagagaacctggagatttttccagtcgaccttcagaaaaaggctggcaggggactgggactgagtattgtaggaaagagatag

SEQ ID NO: 226720 - DNA, 1236 bp, Artificial Sequence
  Description of Artificial Sequence: Synthetic coding sequence
atgagccccgcacggttgagacctcggttgcacttttgtctcgtgctcttgcttcttcttgttgtgccagctgcctggggatgcggacccggacgggtcgtgggctctaggagacgcccacctcggaaacttgttccgctagcttacaaacagtttagcccgaacgtaccagagaaaacactgggagcctcgggcaggtatgaggggaaaatagcccgtagtagcgagcgcttcaaagagctcacccctaactacaatcccgacattattttcaaagatgaggaaaatactggagcggacaggctgatgacacagaggtgtaaagaccgcctcaactcccttgccataagcgtaatgaatcagtggccaggcgtgaagctgagggtcaccgaagggtgggatgaagatggtcaccattccgaagagagcctacattacgaaggcagagcagtcgacattactacctctgaccgcgacaggaacaaatatggactgttggccaggctggccgtcgaggccggattcgattgggtgtactacgaaagcaaggctcacgtgcattgtagtgtgaaaagtgagcattctgccgcagcaaaaacagggggatgcttccccgcaggcgctcaggtgcgcctggagtccggtgcacgagttgctctttctgctgttcgacctggcgacagagtgttagccatgggcgaagatggaagcccgaccttctcagatgttctgatcttcttggaccgggaaccccacagactgcgagcctttcaggttatcgaaacacaggacccccctaggcggctggctctgacgcccgctcacctattattcactgccgataaccatactgaaccggcagcacgttttcgcgcaaccttcgccagccacgtccagccaggacagtatgtgctggtagcaggagttcctggcctgcaaccggctcgggtggcggctgtgtccacacacgtggctctcggcgcttacgcacccctaaccaaacacggcaccctggttgtagaagacgttgtggcttcctgtttcgctgccgtagccgaccatcacttagcccagctcgcattttggcccttgagattgttccattcgttggcatgggggtcttggaccccgggtgagggggttcactggtacccacaactgctctatagacttgggaggcttcttctggaggagggctcattccatcccctcggcatgagcggcgctgggtcttag

SEQ ID NO: 226721 - DNA, 1212 bp, Artificial Sequence
  Description of Artificial Sequence: Synthetic coding sequence
atggctcacgccatggaaaacagctggacaatcagtaaggaataccacattgacgaggaagttggattcgccctcccgaacccacaagaaaatctgcctgacttctataacgactggatgttcatcgccaagcatcttcccgatttaatcgagagtggacaattgcgcgaacgcgtggaaaaactgaacatgctgtcgatagaccacttgactgaccacaagtcccagcgcttggcccgattggtgttgggttgcatcaccatggcgtatgtgtggggaaaaggacacggggacgtcaggaaggtcctccctagaaacattgccgttccctactgccaactgagcaaaaaattggagcttccacccatccttgtgtacgcagactgcgtgcttgctaactggaagaagaaggaccccaataaacccttgacctacgagaacatggatgtcttgttcagcttcagagatggtgactgtagcaagggcttttttcttgtgtccctacttgtagagatagctgcagcgtcagcaatcaaagttatccccacagtatttaaagccatgcaaatgcaagagcgggacaccctcctgaaggcactcttggaaattgccagctgcttggaaaaagctctgcaagtcttccaccaaattcatgaccatgttaacccaaaggccttctttagtgtgcttcggatctatttgagtggctggaagggaaatccccagttgtccgatggcctagtctacgaaggcttttgggaagatcctaaggagtttgccggagggtcagccggacagtccagcgtcttccagtgctttgacgtactgctgggcatccagcagaccgctgggggaggacacgctgctcagtttctccaggacatgaggaggtatatgccccctgcccacagaaatttcctgtgttctctggaatccaatccctcagtacgggagttcgtcctctccaaaggtgacgccggtctcagagaggcatacgacgcgtgtgtgaaagctcttgtctcactccgcagctaccacctgcagatagttaccaagtatatactgatacccgctagtcagcaaccgaaggaaaataagacatccgaagacccatccaagctggaggctaagggcactggaggcactgacctcatgaactttctgaaaacagtcagatctactactgaaaaatccctgctgaaagaaggttag

SEQ ID NO: 226722 - DNA, 237 bp, Artificial Sequence
  Description of Artificial Sequence: Synthetic coding sequence
atggcgcacgcgatggaaaactcttggactatttcgaaggaataccatatcgatgaggaagtgggtttcgcactgcccaatccacaggaaaaccttcccgatttctataatgattggatgtttatagctaagcacctccccgatctgatcgaaagcggccagttaagggaacgcgtggaaaaactgaatatgctgtctatagaccacttaactgaccacaagtcacagcggctttag

SEQ ID NO: 226723 - DNA, 543 bp, Artificial Sequence
  Description of Artificial Sequence: Synthetic coding sequence
atggcacacgcgatggagaatagttggaccataagcaaggaatatcatatagacgaggaagtggggttcgccctccccaatcctcaggagaatctgcctgacttttataatgattggatgttcatagccaaacacctcccggaccttatagagagtgggcagttgagagagcgggtcgaaaaactgaacatgctctccatcgatcatctcacggaccacaaaagccagcgcttggccagactagtgctggggtgtatcacaatggcatacgtgtggggaaaggggcatggggacgtgcggaaggtcctcccacgtaatatcgctgttccctattgtcagctcagcaagaagctcgaactccctccgattctggtgtacgccgattgtgtcctggctaattggaaaaagaaggacccgaacaagccactcacttatgagaacatggacgtcctcttcagtttccgtgacggagattgttccaagggcttttttcttgtctcattgttagtggaaattgctgccgcttcagctattaaggtctag

SEQ ID NO: 226724 - DNA, 1212 bp, Artificial Sequence
  Description of Artificial Sequence: Synthetic coding sequence
atggcccatgccatggaaaattcctggacgatttcaaaagaatatcacattgacgaggaggttggatttgccctacccaacccccaggaaaatcttcccgacttctataacgactggatgtttatcgccaaacacctaccagatctgattgaatcaggccagctccgggaacgggtcgaaaagctgaatatgctttctatcgaccacctcactgatcacaaaagccagcgccttgctcggctagtccttggatgcataactatggcttatgtgtggggaaagggacatggagatgtccgcaaagtactgccccgaaatatagcagtaccttactgtcaattgtccaagaaactcgagctgccacctatcctggtgtatgcggactgtgtgttagccaactggaagaagaaagaccccaacaagcccctcacgtacgagaacatggatgttctgttcagctttagagatggtgattgttctaaagggttttttttggtgagccttcttgtggagatcgccgcagccagcgcaatcaaggtgatacccacagtgtttaaggcaatgcaaatgcaagaaagggatacgctcttaaaggccttgctcgagattgcttcatgcctcgagaaggcactccaggttttccatcagatccatgatcacgttaaccctaaagcgtttttctctgtcctgcgcatctacctgtcagggtggaaaggcaaccctcagttatctgacgggctggtttacgaggggttctgggaggacccgaaggagtttgccggaggatccgccggacagtcatctgtgttccagtgttttgacgtactgctgggtattcagcaaactgccggtgggggacacgccgcacagtttctgcaggacatgcggagatatatgcccccagcccacagaaactttctgtgttcactggagagtaacccatcagtccgtgagttcgtgttaagcaagggggatgccggactgagggaggcctacgacgcctgcgttaaagcgttggtaagcttgcgctcgtatcacctacagattgttaccaagtacatcctgattcctgcctcacagcagccaaaggagaacaagacctcagaagatccaagcaaactcgaagcaaagggcaccggcggaacagaccttatgaattttcttaaaacagtcagatcaactacagaaaaaagcctcttaaaagagggctag

SEQ ID NO: 226725 - DNA, 144 bp, Artificial Sequence
  Description of Artificial Sequence: Synthetic coding sequence
atggcccacgctatggaaaactcatggaccatctcaaaagaatatcacatagatgaggaggtcggctttgctctccccaatcctcaagagaatctgccagatttttataacgactggatgtttattgcaaaacacctgccatag

SEQ ID NO: 226726 - DNA, 1224 bp, Artificial Sequence
  Description of Artificial Sequence: Synthetic coding sequence
atggaaccacatcggccaaacgtgaagacagcggtaccgctctccctcgagtcataccacatttctgaggagtacggatttctgttgccggattcactgaaagaacttcctgaccactacaggccctggatggagatcgctaacaaactgccccaactgatagacgcccaccagctacaggcccacgtggacaaaatgccacttttatcgtgccaatttctgaagggtcatagagagcaacgcttagctcatctggttctgtcgtttctcaccatggggtacgtgtggcaggagggggaggcccagcccgctgaggtgttgccccgaaatttagctttgcccttcgtggaggtgtcccgcaatctgggcctgccacccatcctggtgcatagcgatttagttctaaccaactggaccaagaaagatccagacggcttcttagagattgggaacttggagacgattatctccttccccggaggagagtctctccacgggtttattcttgtgacggccctcgtggagaaagaggcggtccccggaatcaaggcgctggtgcaggcaaccaatgctatactgcagcctaaccaagaagccttgctgcaggccctccagaggctgcgactgtccattcaagacatcaccaagacactaggacagatgcacgactacgtggacccggatattttttatgccggaatccgcatctttctgtccgggtggaaggacaacccggctatgcccgcaggtctgatgtacgagggagttagccaagaacctttgaagtacagcggtggatccgctgcacagagcaccgtgttgcatgcttttgacgaatttctcggaatccgccacagcaaagaatccggagacttcctctaccggatgagggactacatgccaccctctcacaaggcttttatcgaggatatccactctgcgccaagcctcagagactatatcctgtcctctgggcaggatcatctgttaacagcatataatcagtgcgttcaggccctcgcagagctgcgttcatatcacatcaccatggtcacaaaatatctgattacagcggctgctaaagccaaacatgggaagcctaaccaccttcccggaccgcctcaggcgttaaaagaccgaggaaccggaggcacagctgtcatgtcattcttgaagtcggtgagagataagacccttgagagtatcctgcatccgcgtggttag

SEQ ID NO: 226727 - DNA, 1263 bp, Artificial Sequence
  Description of Artificial Sequence: Synthetic coding sequence
atgcttcacttccactactacgacacaagtaacaaaatcatggagcctcaccggccaaacgtcaagacagcggtgccacttagtttggaatcatatcatattagcgaggaatacgggtttttgttgccagacagcctcaaagaactcccagatcactataggccttggatggaaatcgcgaataaactgccccagctgattgacgcccatcagctgcaggcccacgttgacaagatgccactactgtcatgccagttccttaagggtcatcgggagcagcgactagctcatttggtgctttcatttctgacaatgggctacgtgtggcaggagggagaagcacagcctgctgaggtgctgccacggaacctggcattaccctttgtcgaggtttcacgtaatttggggctgccccctattctggtgcactctgacctggtgctgacgaattggactaaaaaggaccccgatgggttcttggagatcgggaacctggaaaccattataagcttccctgggggagagtctcttcatggtttcattctcgtgaccgcacttgtggagaaagaagccgtaccagggatcaaggcacttgtccaagcaactaacgcgatattgcagccaaaccaggaggccttactgcaggcgctgcagcgattgagattgagcattcaagatattacaaaaactctgggccagatgcatgactacgtggatcccgacattttttacgccggaataaggattttcttgtctggctggaaagacaatcctgccatgcccgcagggctgatgtatgagggtgtgagtcaggaaccccttaaatacagcggaggatctgcagctcagtctaccgtcctgcatgcctttgacgaattcttaggcatcagacattccaaagagtcaggagatttcttgtaccgcatgcgcgattatatgcccccttctcataaggctttcattgaggatatccactctgctccctctctccgggattatattctctcctctggccaagaccaccttcttacagcttacaatcagtgcgtgcaggctctcgcagagttacgctcctaccacattacaatggtgacgaagtacctcatcactgccgcagctaaggctaagcacgggaaaccaaatcacctaccaggtcctccacaggcactgaaagataggggtactggaggcactgccgtcatgtctttcctcaagtcggttagagataagaccctcgagtcgattttgcaccctcggggttag

SEQ ID NO: 226728 - DNA, 792 bp, Artificial Sequence
  Description of Artificial Sequence: Synthetic coding sequence
atgaaaggcggattcacaggcggagatgagtaccagaagcatttcctaccacgggactacctggctacttactattctttcgatggctccccatctcccgaggctgaaatgctcaagtttaatctggagtgtctgcacaagacattcgggcctggcggattgcagggtgatactttaattgatatcggctccggtccaaccatctatcaggtgctcgctgcatgcgactccttccaagacattaccttgagtgattttactgatcggaatagggaggaactggagaaatggctaaagaaagagcccggtgcctacgactggacgccggctgtgaaatttgcctgcgaacttgaagggaacagcgggcgatgggaggaaaaggaagagaagctccgagccgctgtcaagagagtgctcaagtgtgacgtgcacctgggcaatcctctggcaccggcagtcttgcctcttgctgactgcgtcctgactctgttggcaatggagtgtgcctgttgcagcctggacgcctaccgagccgctttgtgtaacctcgcctcattgttaaagccgggaggccacctggttacaactgtgaccctacggttaccatcctacatggtggggaaaagagaattcagctgcgtggctctggagaaagaagaggtggagcaagctgtgctggacgccggatttgacatcgaacagttgcttcactcaccccagagttattccgtcactaacgctgccaataacggagtgtgcttcattgtagcccgtaaaaagcctggcccttag

SEQ ID NO: 226729 - DNA, 789 bp, Artificial Sequence
  Description of Artificial Sequence: Synthetic coding sequence
atgaagggtggatttacaggaggtgatgaatatcagaaacactttttgcctagggactatctcgccacctactattcttttgatgggtctcccagccccgaggccgagatgctgaagttcaatctcgaatgtctgcataagacctttggtcctggcctgcagggagacacactgatagatatcggcagcgggcctaccatatatcaagttctggccgcttgcgatagctttcaggacattaccctgtcagacttcaccgaccgcaaccgggaggaattggaaaaatggctgaagaaagagcccggagcttatgactggactcccgcagtaaaatttgcatgcgagttagaggggaactccggccgttgggaagagaaagaagagaagctgcgtgccgcagtgaagcgagtattaaagtgcgacgtccatttaggcaatcccttagcacccgctgtgctgcctctagccgattgcgtgcttactctgttggctatggaatgcgcttgctgtagcctggatgcatatcgagcagctctgtgtaacttggcgtcacttttgaaaccaggaggccacctcgtaacaacggtcactctgagacttcccagctacatggtggggaagcgggaattttcatgtgtagctctggaaaaggaagaggtcgagcaggcagtcctggacgcagggtttgacatcgagcagttactccactccccccaatcttattcagttaccaatgctgccaacaatggtgtctgcttcattgtcgcgagaaaaaagccaggcccatag

SEQ ID NO: 226730 - DNA, 600 bp, Artificial Sequence
  Description of Artificial Sequence: Synthetic coding sequence
atgaagagcggactgtggtactttttcctattctgcctcagaatcaaggtcctgaccggggagatcaacggatcagctaattacgaaatgttcatctttcacaatggcggagtccagatcttatgcaaataccctgatatcgtgcaacagttcaaaatgcagttgttgaaggggggacagatcctctgcgacttaactaaaactaagggatctggcaatactgtgtcaatcaagagtcttaagttttgtcactctcaacttagcaacaacagtgtctcctttttcttgtataatttagaccactctcacgccaattattatttctgcaacctgagtatctttgatccccctccatttaaggtgacattgacagggggttaccttcacatatacgagtcccaattgtgctgccagctgaagttctggttaccgattggatgtgccgcttttgtggtcgtttgtattcttgggtgcatcttgatctgctggttgacaaagaaaaaatacagtagcagcgtgcacgacccgaacggggaatacatgttcatgcgcgcagtgaataccgccaaaaaatcccggttgaccgatgtgactctgtag

SEQ ID NO: 226731 - DNA, 507 bp, Artificial Sequence
  Description of Artificial Sequence: Synthetic coding sequence
atgaaaagtgggctgtggtatttcttcctgttttgtctcaggattaaagtgctcaccggggagatcaacggatccgccaactacgagatgttcatttttcataacggaggggtgcagatcctgtgtaaatatccagatattgtgcaacagttcaagatgcagctactgaaagggggacagatcctctgcgatctgacgaagaccaagggcagcggaaatacagtgtccatcaaatccttaaagttttgtcatagccagctctctaataactcagtcagtttttttctctataatctggaccatagccacgctaactattatttttgcaacctaagcatattcgacccccctccattcaaggttacactaaccggaggatacctgcatatttacgagtcgcagctttgctgccagttgaaattctggctccccattggatgcgctgcctttgtggtggtctgtatcctcggatgtatcctgatttgctggctaactaaaaaaatgtag

SEQ ID NO: 226732 - DNA, 930 bp, Artificial Sequence
  Description of Artificial Sequence: Synthetic coding sequence
atgcgtctgggctcccctggcctactgttcttgctgtttagttcccttcgagcagacacacaggaaaaggaggtgagagctatggtcggctcagacgttgaattatcatgtgcgtgcccggaagggagcaggtttgacctcaatgatgtatatgtgtactggcagacttctgaaagtaaaactgtggtgacataccatataccacaaaacagtagcctggagaatgtggactcacggtatagaaatcgggcacttatgtccccagctggcatgctgcggggagatttttctctgaggctctttaatgtgacacctcaggatgaacagaagtttcattgcttggtcctgtcccagtccctgggctttcaggaagtgctgtccgtggaagtgactttgcatgtcgcggcaaatttctccgtccccgtagtaagcgcaccccattcaccctctcaggacgagttgacattcacatgtacaagtataaatgggtaccccagacccaatgtgtattggattaataagactgataactccctactcgaccaagccctccaaaatgataccgtgtttctcaatatgcgtggcctatacgatgtggtttccgtgctgcgtatcgcacgcacgccgtccgtgaatattgggtgctgtatagagaatgtgcttctacaacagaacctcacggtgggttcccagaccggcaacgatataggcgaacgggataaaatcactgagaatcccgtgtcaacaggggagaagaacgctgctacatggtccatcctggctgtgctgtgcttgctggtcgtagtggcagtggctattggctgggtgtgccgggatcgatgcctccagcatagctacgctggggcttgggctgtgagtcccgagacagagctgactgaaagctggaacttgcttctgctgctgtcttag

SEQ ID NO: 226733 - DNA, 558 bp, Artificial Sequence
  Description of Artificial Sequence: Synthetic coding sequence
atgaggctcggcagtccgggactgttgtttcttctgttttcatcactaagggccgctaactttagcgtgcctgttgtttccgcgcctcactctccgagtcaggacgaactgacttttacctgcacaagcattaatggttatccccgaccaaacgtctactggattaataaaaccgacaattctctgctggatcaggctttacaaaatgataccgtgtttctaaacatgaggggactgtatgatgtcgtctctgtgctgcgaattgcacgtacacctagcgtcaatatcggctgctgcatcgagaatgtgctgctgcagcaaaacttgactgtgggctcacagacagggaacgatattggcgagcgcgataaaattactgaaaacccagtgtcaacgggggagaaaaatgccgctacttggagcattctggcagtgctatgtctgctggtggttgtggccgtcgctataggatgggtctgccgtgacaggtgtttgcagcattcctacgcaggggcatgggctgtgagcccggaaacggagctcactggacatgtgtag

SEQ ID NO: 226734 - DNA, 909 bp, Artificial Sequence
  Description of Artificial Sequence: Synthetic coding sequence
atgcgcctggggtcacccggtctgttgttcttgttattttcaagtctccgcgctgatacgcaggagaaagaggtgcgcgcaatggtgggcagtgatgtcgagctctcttgcgcttgccccgaaggtagcaggttcgatcttaacgacgtgtacgtgtactggcagacaagtgaatctaagactgtggtgacataccacatccctcaaaacagcagtttagagaacgttgactcccgttaccggaacagggccctgatgagccccgcaggcatgctgcgcggagacttttccctgagattgtttaacgttacaccacaggatgaacagaagttccactgcctggtgctgagccaatcactgggattccaagaagttctcagtgtggaagtcactctccacgtggcggcaaacttctccgtgcccgtcgttagcgcaccacactctcccagccaggatgaattgaccttcacctgtacatctataaatggctatccacgccctaatgtctattggatcaataagacagacaactccctactggaccaggcacttcagaacgatacggtcttcttgaacatgaggggcttgtatgatgttgtgtcagttctccgcatagcaagaacaccttccgtaaacatcggctgctgcatcgagaacgtgctgctccagcagaatctcaccgtgggtagccagactgggaacgacataggcgagcgcgataagattacggagaatccggtgtccacaggcgaaaagaacgctgctacctggagcatacttgccgtgttatgcctcttggtcgtagtggctgtggctatcggctgggtgtgtagagatcggtgtctgcagcacagttatgcaggcgcttgggcagtgtccccagagactgaactgaccggacatgtgtag

SEQ ID NO: 226735 - DNA, 1101 bp, Artificial Sequence
  Description of Artificial Sequence: Synthetic coding sequence
atggtcctacacctcttgctgtttcttctcctcacgcctcagggcggtcactcctgtcagggcctggagctcgccagggagctggttctggccaaggtgcgcgcattgttcctagacgcccttggacccccagcagtcacccgagaaggtggtgacccgggtgttcgcagacttccaaggagacacgccctgggcggtttcactcataggggctccgaaccggaggaagaggaggacgtgtctcaggctatcctctttccggctacggacgctagctgtgaagataagagcgcggctaggggactggcccaagaggccgaggagggtctcttcagatacatgttccgccctagccagcacaccaggtctaggcaggttacatccgcgcagttatggttccatactgggctggataggcaaggcaccgccgctagcaactcctctgaaccccttcttggcctacttgccctcagccccggaggacccgtcgctgtgcctatgtcacttggtcacgccccaccacactgggccgtcttgcatctagccacatccgccctctctcttctgacccatcccgtgctggtgttgctgcttaggtgtcctttatgtacttgttcagccagacccgaggcaacaccattcctggttgcccatacccgtacacggcctcctagtggaggtgagcgggctagaagatccacccccctgatgtcttggccgtggtcccccagcgccctccgattgctgcagaggccgcctgaggagcccgctgcacacgcgaactgtcaccgtgtcgccttgaacatcagtttccaggaactcggatgggagagatggatcgtttacccaccttcctttatttttcactactgccatggcggttgcgggctccacattcctcctaacttaagtcttccggtgcctggtgctcctcccactccggcacagccctacagtttgcttccgggagcgcaaccctgctgcgcggcactccccggtaccatgcggcctttgcacgtccggacaacatccgacggcggttactcattcaaatatgagactgtgccaaatcttctcactcagcactgtgcttgtatatag

SEQ ID NO: 226736 - DNA, 1281 bp, Artificial Sequence
  Description of Artificial Sequence: Synthetic coding sequence
atgcccctactatggcttcgaggcttcttacttgcctcttgttggataatcgtgcgcagttcccctaccccgggttctgaagggcactccgccgctcccgactgccccagctgtgccctggccgctttgccgaaggatgtgcctaattcccaacctgaaatggtggaagccgttaagaaacatatcctgaacatgcttcacttaaagaagcgccctgacgtcacacaaccagtgccgaaggcagcattgctcaacgcaattagaaagctgcacgtcggcaaggtgggcgagaatggctacgtcgagatcgaggacgatatcggtcggagagcggaaatgaatgagctgatggaacagaccagcgaaatcattaccttcgctgaaagcggtacagctcggaaaaccctgcattttgagatctccaaggaggggtccgacctgagcgttgttgaacgagccgaggtatggctgtttcttaaagtacccaaggcaaacaggacgagaacgaaggtgacgattcgcttattccagcagcagaagcaccctcagggctcgcttgacacaggagaagaggctgaagaagtgggcctgaagggggaacgttcagagcttcttctttccgaaaaagtcgtcgacgcgaggaaaagtacctggcatgtgttcccggtctccagttccatacaaaggcttctcgaccagggtaagtcttccttagatgtaagaattgcttgtgaacaatgtcaggagtctggtgccagtttagtcctcctcgggaaaaaaaaaaaaaaagaagaggagggggaaggaaagaaaaagggagggggagaggggggtgcaggggctgacgaagagaaggagcagagccatcgcccattcctcatgctgcaggctaggcagtccgaggatcacccccacaggcgtagaagacgaggcctagaatgcgatgggaaagtaaacatctgctgtaaaaagcaattctttgtctctttcaaggatatcggctggaatgactggattattgctcccagcggctatcacgctaattactgtgagggcgaatgcccctcacacatcgccggaacctccggtagtagccttagtttccactcaaccgtgatcaatcactacagaatgcggggtcatagcccattcgccaaccttaagtcgtgttgtgtaccaaccaagctccgacctatgagtatgctgtattacgatgatggacagaatataattaaaaaagatattcagaacatgatagtcgaagagtgcggatgctcttag

SEQ ID NO: 226737 - DNA, 1281 bp, Artificial Sequence
  Description of Artificial Sequence: Synthetic coding sequence
atgcctctgctgtggctaagaggattcctcctcgccagctgctggataatcgtcaggtctagtccaacccccggtagcgaagggcacagtgccgctcctgattgtccgtcctgcgccctcgccgctctgcccaaagacgtccccaattctcagcctgaaatggtggaagctgtaaagaagcatattctgaatatgcttcacttaaagaaaaggcctgatgtgactcagccggtacctaaggccgcactgctgaacgccatccgcaagctccacgtgggtaaggtcggtgaaaacggctatgttgagattgaggatgatattggaaggagagcggagatgaatgagctcatggagcagacaagcgaaatcattaccttcgctgaatctggaacggctcggaagacgttacacttcgagatttccaaggagggatccgacctcagtgtagtcgagcgcgcagaagtttggctattcctgaaggtacccaaagccaaccggacacgcactaaagtcacgatcaggctgttccagcagcaaaagcacccacaaggatcactcgatactggagaggaagcggaagaagttgggttaaagggagaacgctctgaattacttctgtccgagaaagtggtggacgctcgcaaatcgacctggcacgtctttccggtgtcctctagcatacaaaggttactggatcaaggtaaaagctcccttgatgttcggattgcttgcgaacagtgccaagaatccggggcatccctggtgctgttgggcaaaaagaagaaaaaggaagaggaaggcgagggcaaaaagaagggcggtggtgagggaggggcaggcgctgatgaggaaaaggaacagtcccaccgtccattcctcatgctgcaggcacgccagagtgaggatcacccacacagacggcgaaggaggggcctggagtgtgacggaaaggtgaatatttgttgtaaaaagcagttcttcgtgagctttaaagatatcggatggaacgactggatcatcgcgcctagtggttaccacgccaactattgtgaaggcgaatgccctagccacattgctgggaccagtggctcaagtctgagtttccacagcaccgtgatcaaccactaccggatgcgaggtcactcacctttcgccaacctgaaatcttgctgcgtccccacaaaactgcggccaatgagcatgctctactatgatgatgggcaaaacataattaagaaagacatacagaatatgatcgttgaagagtgcggctgttcatag

SEQ ID NO: 226738 - DNA, 1224 bp, Artificial Sequence
  Description of Artificial Sequence: Synthetic coding sequence
atggatggactgccaggcagggcactcggggcagcctgcttactgctcctggccgcaggatggctggggcctgaggcatggggcagcccaactccacctccaacgcctgcagcaccgccaccgccacccccacctggaagccctggaggtagccaggacacatgcaccagctgcggtgggttccgcaggccagaggagctaggtcgagtggatggggacttcttagaggcagtgaaacgacacatactgagtagactgcaaatgcgcggacgccctaatatcacacacgctgtccctaaagctgccatggtcacggcactccgtaaactgcacgccggtaaagtaagagaggatggtagggtcgaaattccacacctagacggtcacgctagtcccggtgcggacggtcaggagcgggtatccgagattatctctttcgccgaaacagatggccttgccagttccagagtgcgcctgtatttctttatcagtaatgaaggaaaccagaatcttttcgttgttcaggcttctctgtggctgtatttaaagctgttgccctatgtgctcgagaaaggcagccgaagaaaggtgagagtgaaggtctatttccaggaacagggacacggcgatcgctggaacatggtggaaaaacgcgtcgacttaaaacgcagcggctggcatacattccctttgaccgaagccattcaagcgcttttcgagcgaggcgagcgtaggcttaatctcgatgtgcagtgtgactcatgccaagaactcgccgtggttcctgtttttgtcgaccccggtgaggaatctcacaggcccttcgtcgttgtgcaagccaggctgggcgattccagacacagaatacgtaagagggggttggaatgtgacggacgtactaacctttgttgccgccagcagttcttcatcgacttccgacttattggctggaacgattggatcatagccccaactggttactacggcaactactgtgaggggagctgtcccgcatacctcgctggcgttcctgggagtgcctcctccttccatacagctgtggtcaaccagtatcggatgaggggtctgaacccaggaaccgtcaacagttgttgtattccaactaagttgtccacaatgagtatgctatactttgatgatgaatacaacatcgtcaaacgggacgttcccaacatgatagtggaggagtgcggatgtgcttag

SEQ ID NO: 226739 - DNA, 1059 bp, Artificial Sequence
  Description of Artificial Sequence: Synthetic coding sequence
atgacctcttctctgttactcgctttccttcttttagctcctactaccgtggccacgccaagggccggaggccagtgccccgcttgtggcggacctacgctcgaactggagagccagcgagaactgttgctcgatctggctaaaagatccatcttagataaactacacctcacacaacgaccgacgctaaaccgccctgtctctcgggctgcactgcggactgccctccagcatctgcacggagtgccacagggcgcattattggaggacaaccgggaacaggaatgcgaaattataagctttgcagaaaccgggctttccaccattaatcagacacggctcgacttccacttttcaagcgatcggaccgctggcgacagagaagttcagcaagcatcccttatgttttttgtgcaattacccagtaacactacctggactctgaaggtgcgcgtgctggtgctgggacctcataataccaaccttacattagcaacacaatatctactggaggtggatgcatcaggctggcaccagctaccacttggtccagaggcccaggctgcatgtagtcaggggcacctgacattggaactggtccttgaaggccaggtggcccaatctagtgtgattctgggcggagcggctcatcgaccattcgtcgcagcgcgagtcagggtgggtggaaagcaccagatccacaggcgcggaatagactgtcaaggcggatcaagaatgtgttgccgccaagaatttttcgtcgattttcgggagattggttggcatgattggatcattcagccggaaggttacgcgatgaacttctgtatcggccagtgtcctttgcacatcgccggaatgcccggaatcgcagcctccttccacacagccgtgttaaacctgttgaaggctaacactgcagccggaacaacagggggagggtcctgttgtgttcccacagccaggagaccactatctctcctgtactacgaccgtgactctaacatcgtgaagacagacatacccgacatggttgtggaggcatgtggatgttcctag

SEQ ID NO: 226740 - DNA, 1053 bp, Artificial Sequence
  Description of Artificial Sequence: Synthetic coding sequence
atgaggctgcctgacgtgcagctatggcttgttttgctatgggctctggtcagggcacagggtacaggttcagtctgcccctcctgtggtgggtccaaactcgcgcctcaggccgagagagcattggtcttggagcttgctaagcagcagatactcgacggtctccatctaacatcccggcctagaatcacacaccccccacctcaggcagctttaacccgggctctgagaagattgcagcccggtagcgtggcccctgggaatggcgaagaggttattagctttgccaccgtgaccgatagcacatctgcatattcttctctgttaacctttcaccttagcacacccagaagccaccacctgtaccatgctcgtctctggctgcacgtgctcccaacactgccgggtactttgtgcttgcgaatctttaggtggggcccacgccgtaggcgtcaaggttctcgcacccttctcgccgagcaccacatcaccaacctgggctggcatactctcaccctgccatcttctgggttgcggggagaaaagtctggagtgttgaagcttcagctcgattgccgtcctttggagggaaactccacggttactggccagccaaggaggcttctggacaccgccggacatcagcaaccctttttggaacttaagatccgcgcaaacgaacctggggctggcagggctagaagacgaacaccaacctgtgaacctgccacgcccttatgctgcagacgggaccattatgtagacttccaggaactcggctggagagattggatcctccaacccgagggatatcagcttaactactgctccggccagtgcccaccccacctcgctggcagtccaggtattgcagcctccttccatagcgctgtcttttcattgctcaaggcaaataacccctggcctgcctcgacgagttgttgtgttccgacagcgaggagacccctctcccttctgtacttggatcataacggcaatgtggtcaaaaccgatgtacccgacatggtggtggaagcctgtgggtgctcttag

SEQ ID NO: 226741 - DNA, 4062 bp, Artificial Sequence
  Description of Artificial Sequence: Synthetic coding sequence
atgtcctcacccatgcccgattgtactagcaagtgccggtccctgaagcacgctctagacgtgctgtctgttgtgacaaaaggctctgaaaatcagattaaagcgttcttgtcctcgcactgttataacgccgcaactatcaaggatgtgttcggcaggaatgctctgcatctagtgagtagctgcggaaagaagggggtgcttgactggctcattcaaaagggcgtggacctgctcgtaaaggacaaggaatccggctggaccgcccttcataggagcatcttttatgggcacattgactgcgtttggagtctgctgaaacatggagtgagtctctacatacaagataaagaggggctgtctgccctggatttagtgatgaaggaccggccaacacatgtggtctttaagaacacggacccaacggacgtttacacgtggggggacaacaccaatttcaccttagggcatgggtcacagaatagcaagcaccaccctgaacttgtggacctgttttctcgaagcggaatttatatcaaacaagttgttctgtgcaaatttcactctgtcttcctctcccagaagggccaggtgtacacatgcggtcatggaccgggaggtaggctgggacatggcgacgagcagacctgcctggtgcccagactagtggagggcctgaacgggcataattgttcccaggtcgccgcagccaaggaccacactgtggtgcttaccgaggatggttgtgtctacacgttcggactcaatatcttccaccaacttggcataatccccccaccttccagctgcaatgtccctagacaaattcaggctaagtacctgaagggcagaactatcataggtgtcgccgctggacggtttcacaccgtgctgtggactcgcgaagctgtgtacaccatgggtctaaatgggggacaactgggatgcctactcgatcctaatggggaaaagtgtgttacggcgcctagacaggtgtctgcacttcaccataaagatatcgccttaagtctggtcgctgcctccgatggcgcaaccgtgtgcgtcaccaccagaggcgacatctacctgctggccgattatcagtgcaagaaaatggcctctaagcagctcaatttaaaaaaggtcctggtgagtggagggcacatggagtataaggtcgaccctgagcacctcaaggagaacggaggccaaaaaatctgcattctcgcaatggacggggctggccgagtcttctgctggcgcagcgttaatagtagcctgaagcaatgcaggtgggcctatcccagacaggtcttcatttcagacattgccctgaatagaaacgagatactttttgtgactcaagacggggaggggttcaggggtaggtggttcgaagaaaagcgaaaatccagcgagaagaaagaaatcttgtctaacctgcataattcgtcatccgacgtctcctacgtgtcagatatcaactccgtgtacgagcgtatccgactcgagaaactgactttcgcacatagagcagtgtcagtgtctactgacccaagcgggtgtaattttgcaatcttacaatctgatccaaaaacatccttgtacgagattcccgcagtgtcctcctcctcctttttcgaagagtttggaaaactcctccgcgaggccgacgaaatggattcaattcacgacgtcacatttcaggtaggaaaccgactctttcctgcccacaagtatatcctggccgttcactccgatttctttcagaaattgttccttagcgacggtaatacgtccgaatttaccgatatataccaaaaggacgaagatagtgctggctgccaccttttcgttgttgagaaggtgcatccagatatgtttgagtatctcctgcaattcatctacacagatacctgtgactttttgacccacggcttcaagccgaggatccacttaaataagaatcctgaagaatatcagggcactttgaattcccatctgaataaggtgaactttcacgaggatgacaatcagaaatccgccttcgaggtgtataaatccaaccaggcacagacagtcagcgaacggcagaaaagcaaaccaaagtcatgtaagaagggcaaaaatatacgcgaagacgacccagttcggatgttgcagaccgtggctaaaaagtttgacttttccaacctgagcagtagactggacggcgtcagatttgaaaacgaaaaaatcaatgtgatagcgaaaaatactggtaacaagttgaagctttctcagaagaaatgcagtttcctgtgtgatgttaccatgaagtcagttgatggaaaggaattcccctgccataagtgtgtgctctgtgcacggctggaatactttcactcaatgctgagcagctcctggatagaggcctcttcatgcgcagctctggagatgcccatacacagcgacatcttaaaagttatcttagactatctgtacacggatgaagcagtcgtgatcaaggaaagccagaacgttgactttatttgcagcgtgttagtggtagcagatcaattactcatcacaagattaaaagagatctgcgaggtggcccttaccgagaaactgactctgaagaacgccgctatgctgctggagtttgcggctatgtattcggccaagcagctgaaactgagctgcttacaattcatcggtctcaacatggcagctctattggaagccagatctctggatgtattatctgacggagtgctcaaggacctctccgagttctaccggaagatgattccggcaatggaccggagagttattaccccataccaggacgggcctgatattagctacctcgaagtagaagacggggatatttttctgaaggaagaaatcaacatggaacagaaccactccgagactatgttcaagaaagcgaaaaccaaggccaaaaaaaaacccagaaaacgatctgactcatcgggaggctataacctcagtgatatcatacagtcgccgtccagtacagggctgctcaaatcaggaaaaaccaattccgtggagagcctgccagaacttctgacatccgattcagagggctcctacgccggtgtgggcagcccccgagacttacagtcccccgattttacgactggattccattccgataagatcgaagcgaaggtgaagccatatgtcaacggcacgagcccagtctacagccgcgaggatctgaagccctgggaaaagagtcccatcctcaaaatcagtgcaccccagcctatccctagcaaccgcatcgacaccacatccagtgcttcctgggtcgcgggttctttctcacccgtgtccccccctgtagtcgatctgagaaccatcatggagatcgaggagtctcggcagaaatgcggagcaacccccaaaagccatctcgggaagacagttagtcacggagtgaaactttcccaaaagcagagaaaaatgattgctcttactactaaggaaaataattccggcatgaactccatggagacagtgctgttcactccatctaaggctcctaaacccgttaatgcatgggcgtcatccctacactctgtttcctccaagtccttccgcgacttcctcttggaagagaaaaaatccgttacttcccacagtagcggtgaccatgtgaagaaggtgagtttcaaaggtatcgagaattctcaggcaccaaagattgtccggtgcagtactcacggaactcctggacccgagggcaaccacattagcgatctgccactgctcgacagtccaaatccctggctttctagtagcgtgacggcccctagcatggtagcaccagtgacgttcgcatcgatcgtagaggaagagttgcagcaagaggcggcactcataagatcaagggagaagccactggcattaatccagatcgaggagcatgctatccaggacttattagtgttttatgaagcgtttggcaatccagaggagttcgttatcgtcgagcgcacgccccagggaccactcgctgtgccgatgtggaacaaacatggctgctag

SEQ ID NO: 226742 - DNA, 1386 bp, Artificial Sequence
  Description of Artificial Sequence: Synthetic coding sequence
atgtggcagttaacttcacttctgttgttcgtcgcaacctggggcatcagtggaacaccggctccacttgatagtgttttctcaagctccgaacgtgctcatcaggtgcttcggatccggaaaagggctaacagtttcctggaggagctgcgccattcgtcattggagagagaatgcattgaggaaatctgtgatttcgaggaggccaaagaaatcttccagaatgtggacgatacactcgctttctggagcaagcatgtcgacggagaccaatgcctggtgcttccccttgaacacccttgtgccagtctgtgttgtgggcacggtacgtgcatagacggcattggttcattctcctgtgactgtcgcagcgggtgggaaggacggttctgtcagcgggaggtaagcttcctcaattgcagcctcgacaacggtgggtgtacccactattgcctcgaggaggtcgggtggagaagatgtagttgcgcacccggatataagcttggggacgaccttctccagtgccatcctgctgtgaagttcccttgcgggaggccttggaagcgcatggaaaagaaacggagtcacctcaagcgggacacagaagaccaggaggatcaagtcgaccctcggcttatcgatggaaaaatgacccgtcggggtgattctccctggcaggtcgtactgttggactcaaaaaaaaagttagcctgcggagctgtgctgatccacccatcttgggtgcttactgcggcacactgcatggatgagagcaaaaaacttctcgtcaggctgggggagtatgatctgcgccgttgggaaaaatgggaactggatctggatataaaggaggtgtttgtgcatcctaactactcaaaatctacaaccgacaacgacattgcgctgctgcacctggcgcagcccgctactctctcccagaccatcgtgccaatttgtttgccagattccggacttgccgaacgtgagctgaaccaggccggacaggaaacattggtgaccggatggggctatcactcctccagagagaaggaggctaagcgaaataggaccttcgtgctaaattttatcaagattcctgtggtgccccataatgagtgtagcgaagttatgtccaatatggtctcagaaaacatgctctgtgctgggattcttggcgatcgccaggacgcctgtgaaggcgacagcggtggcccaatggtggcatcttttcacggtacatggttcttagtgggcctggttagttggggtgaagggtgcggtttacttcacaattatggcgtgtacactaaagtgtcacgttatttggactggatccacggccatataagagacaaggaggctcctcagaaatcgtgggccccatag

SEQ ID NO: 226743 - DNA, 405 bp, Artificial Sequence
  Description of Artificial Sequence: Synthetic coding sequence
atgaaggcttttagccctgtgcggtccgtccggaaaaacagtttgagcgaccactcactgggcatttcaaggtctaaaactcctgtcgacgatccaatgagtctcctatacaatatgaatgattgttactcaaaactcaaagagctggtgccgagcatccctcagaacaagaaggtttcaaaaatggagattctccagcacgtaatcgactacattctcgacctgcagatcgccctggactcccacccgaccattgtgagtcttcatcatcagaggcccggacaaaaccaggcgagccgcactcctctgaccactctcaacaccgacatctccatcctctccctccaggcctcagagtttccctctgaactgatgtcaaatgatagcaaggccctctgtggctag

SEQ ID NO: 226744 - DNA, 405 bp, Artificial Sequence
  Description of Artificial Sequence: Synthetic coding sequence
atgaaggcctttagcccggttcgcagtgtgagaaagaattcgctgagcgaccattctttaggaattagtaggagcaaaacgccagttgacgacccaatgtccttgctctacaacatgaatgactgctattcgaagctcaaggagctggtgcctagcattccccaaaacaaaaaagtctccaagatggaaatattacagcatgtgatcgactatattctcgatctgcaaatcgccctggatagtcacccgaccattgtgagccttcatcatcaacggccaggtcaaaatcaggcatccagaacgccattaaccactctgaatactgatatttctattcttagcctacaagctagcgagtttccaagcgagctaatgtctaatgatagtaaggctctatgtggctag

SEQ ID NO: 226745 - DNA, 360 bp, Artificial Sequence
  Description of Artificial Sequence: Synthetic coding sequence
atgaaggccctcagcccagtgcgtggttgctacgaagcagtgtgctgtctgtccgagcgatctctggccatcgcccgaggcagagggaaggggcctgctgccgaggaacctctatctctgctggatgacatgaaccactgctattctagacttcgggagctcgtgccaggcgttccacgcggaacacaactgagccaggtggagatacttcaaagggtgatcgattacatcctagacttgcaggtcgtgctcgccgaacctgctcccggacctcccgatggcccacatctgccaatccagaccgctgagctcacaccagagctggtgatttctaacgacaaaaggtctttctgccactag

SEQ ID NO: 226746 - DNA, 486 bp, Artificial Sequence
  Description of Artificial Sequence: Synthetic coding sequence
atgaaagcagtaagcccagtcaggccatccggaaggaaagctccgtctggctgcggtggcggagaactggccctgcggtgtctagcagaacacggtcacagccttggcggttcggccgcagccgcagccgctgccgcagccgctcgctgtaaggcagccgaggctgctgccgatgagcctgccctgtgtctccaatgtgacatgaacgactgttatagcaggctgagacgcctcgtgccaaccattcccccaaataagaaggtctccaaagtggaaatcttacagcatgtcatcgactacatcctggatctgcaactggctcttgaaacccacccagccctcctccggcagcccccacccccagcccctcctcatcacccggcaggaacctgtcctgcggcacctccacggacccccctgacagccttgaacactgatcccgctggggcagttaacaaacagggagattccattctctgcaggtag

SEQ ID NO: 226747 - DNA, 843 bp, Artificial Sequence
  Description of Artificial Sequence: Synthetic coding sequence
atgctcggtcagcagcaacaacagctctactcttccgccgctctgttaaccggggaaagatccaggctgctgacatgttatgtgcaggactatctggaatgcgttgaaagtctgcctcacgatatgcagcggaacgtaagcgtgctaagggaactcgacaacaagtaccaggagaccctgaaagagatcgatgacgtttacgagaagtataaaaaggaggatgaccttaaccaaaaaaagcggctgcagcaattactgcagcgggcactgataaactcccaagaacttggtgacgagaaaattcaaattgtgacccaaatgttagagctcgttgagaatagagccaggcagatggaactccattctcagtgtttccaggatcctgccgaatctgaacgggcatcagacaaggccaaaatggactcatctcagcccgagaggtcttccagacgacctcgtcgacaaaggacctccgaatcaagagacttgtgtcatatggccaatgggatcgaagattgcgacgaccagcctcctaaggaaaagaagtccaaatcggcaaagaagaagaaacgaagcaaagccaagcaagaacgggaagcctcacctgtcgagttcgccatcgaccccaatgagccaacttactgtctgtgtaatcaggtctcttacggagagatgattggatgtgataatgagcagtgtcccatagagtggtttcacttttcatgtgtgtccctaacttacaaaccgaaaggaaagtggtattgtcccaagtgtcggggtgataacgagaagacgatggacaagagcaccgagaaaacaaagaaagacagacgctctcggtag

SEQ ID NO: 226748 - DNA, 723 bp, Artificial Sequence
  Description of Artificial Sequence: Synthetic coding sequence
atggatcaggatggagatcagcaactggggccttctaggatcctggccccacagacgctcaaggagatcgacgacgtgtatgagaagtacaaaaaagaagacgacttaaaccagaaaaagagacttcagcaactcctccagagggctttgattaactcacaggagttgggcgacgagaagatccagatcgtaacacagatgcttgaactggtggagaatagggcaaggcagatggagcttcatagtcagtgctttcaagaccccgcagagtctgagcgcgcatccgataaggccaagatggactcaagtcagccagaacggagctctcgtcgaccaagaaggcaaaggacctccgaatcacgcgatctctgtcatatggctaatgggatcgaggattgcgatgatcagcccccaaaggaaaaaaagagcaaatccgcaaagaagaagaagcggtcaaaggctaagcaggaaagagaagctagtcccgtggagttcgccattgatccgaatgagccaacctactgcttgtgcaatcaggtaagttatggcgagatgataggctgtgataatgaacagtgtcctatcgaatggtttcacttttcctgtgtgagtctgacgtataagcccaaaggaaaatggtattgtcctaagtgtagaggtgataacgaaaagacaatggacaagagcaccgaaaagacaaagaaggataggagatctcggtag

SEQ ID NO: 226749 - DNA, 1257 bp, Artificial Sequence
  Description of Artificial Sequence: Synthetic coding sequence
atgctctatcttgaagattatctcgagatgatcgagcaactgcctatggatcttcgcgacaggtttactgagatgcgagaaatggacttgcaagtccagaacgccatggatcagctggaacaaagagtcagtgagttttttatgaacgcaaagaaaaataaaccagaatggagggaagagcaaatggccagcatcaagaaggattactacaaagcgttggaagatgcggacgaaaaagtgcaactggctaaccagatttatgatctggtggaccgtcatctccgcaagctggaccaggagctggctaaatttaagatggaattggaggcggacaacgcaggcattacagagattctcgagaggcggagcctcgagctcgacacgccctcacagccagtgaacaatcatcacgctcactctcatacccccgtagagaaacgtaagtataacccaacaagccaccatacgaccacagatcacatccctgagaaaaaatttaaatctgaagcacttctgagcactctgacctcagatgcatctaaagagaatacgctcggctgccggaataacaatagtactgcgagctcaaataacgcctacaacgtaaatagctcacaaccactaggctcatacaatattggttcattgtccagcgggacaggcgctggcgcaattactatggccgcagctcaggcggtccaggccactgcccaaatgaaagaaggacgcagaacatcctccctcaaggcctcctatgaagcctttaagaacaatgacttccaactgggtaaagagttcagtatggctagagagacggtaggatatagcagctccagcgcgctcatgaccacactaacacagaatgccagcagctctgccgctgacagcaggagtgggcgaaagtccaagaacaataacaaaagcagcagccagcagtcctcgtcctcttcgtcttcatccagcctgtcaagctgttcctcatcgtccactgtggttcaggaaatatctcagcagacgactgtggtcccagagtccgattccaattcccaggtggactggacctacgacccaaacgagcccaggtactgcatttgtaatcaggtgagctatggcgagatggttggatgtgataatcaggactgccctatcgagtggtttcattacggctgcgtcggcctgaccgaagcacccaagggcaagtggtactgtcctcagtgtactgccgctatgaagcggaggggatcacgacataaatag

SEQ ID NO: 226750 - DNA, 279 bp, Artificial Sequence
  Description of Artificial Sequence: Synthetic coding sequence
atgctgtaccttgaggattacctcgagatgatagaacagcttcccatggatctgcgggacaggttcactgagatgagagaaatggatttgcaagttcaaaacgccatggatcagctcgagcagcgtgtcagcgagttctttatgaatgctaaaaagaataagcccgagtggagggaggagcagatggcttctattaagaaagattactacaaggccttggaagacgcagatgagaaagtccagctcgctaaccaaatctacgatctgcaacacttctag

SEQ ID NO: 226751 - DNA, 723 bp, Artificial Sequence
  Description of Artificial Sequence: Synthetic coding sequence
atggccaccgccatgtaccttgagcattaccttgattccattgagaatctgccatgtgaattgcagagaaattttcagctcatgcgggaactggatcagcgaacggaggataagaaagccgagattgacattctggctgcagagtatattagtacagtaaagacgctgtctccggaccaacgggtggaaagactccagaaaatccagaatgcctatagcaagtgcaaagagtacagcgatgacaaggtgcagttagctatgcagacctatgagatggttgacaaacatattaggcgattagacgctgacctcgccaggttcgaagccgatctgaaagacaagatggaaggcagtgacttcgagagttcagggggaaggggcctgaaaaagggaagggggcagaaagaaaagcgaggcagtcggggaagaggacgcaggacttctgaggaggacacacctaagaagaaaaagcacaagggaggaagcgagtttaccgataccattctgagcgtccacccttcagacgtgctggacatgcccgtggatccaaatgagcccacctattgcctatgccatcaagtgtcctatggggaaatgattgggtgcgacaatcccgattgtcctatcgaatggttccacttcgcttgtgtcgacctcaccactaagcctaaaggcaaatggttctgccccagatgtgtgcaagaaaaaaggaagaagaaatag

SEQ ID NO: 226752 - DNA, 681 bp, Artificial Sequence
  Description of Artificial Sequence: Synthetic coding sequence
atggccactgccatgtacttggagcactacctagattccattgaaaacctgccttgtgagcttcagcgaaacttccagctgatgagagagctggatcaacggaccgaggataagaaagcagagattgacattctggctgcagaatacatctccaccgtgaagactttgtcacctgatcagagagtggagaggctgcagaaaattcagaatgcttactccaaatgtaaagaatattccgatgacaaggttcagctggctatgcagacttacgagatggtcgacaagcacattagacgactcgacgcagatctggccagattcgaggccgaccttaaggacaaaatggaaggaagcgatttcgagtcgtctgggggacgtggactgaagaagggaagaggccagaaggaaaagagaggctcaagagggaggggcagaagaacctctgaggaggatacccctaagaaaaagaagcacaagggcggatcggaattcactgatacgatactgtcagtgcatccttcagatgttttagacatgcctgtggaccctaacgaaccgacttactgtctatgccaccaagtttcctatggggagatgattggctgcgataacccggactgtcctattgagtggtttcactttgcttgcgtggatctgacaacaaaacccaagggcaaatag

SEQ ID NO: 226753 - DNA, 2265 bp, Artificial Sequence
  Description of Artificial Sequence: Synthetic coding sequence
atgtttagcggcggatgccatagccccggattcgggcgtccgtcacccgctttccccgcacctggaagcccgcctcccgcaccacgaccatgcaggcaagaaacgggagaacaaattgcaatcaaacagtgccgacaagaactctccccaaggaacagggagagatggtgtcttgagattcagatcatgcgacgcttaacccatccaaatgtggtggctgctcgggacgtgcctgagggaatgcagaatctagccccaaacgacttaccgctgcttgccatggagtactgccaaggcggtgacttgcggaagtatctcaatcagttcgagaattgttgtggcctgcgcgaaggagcaattctgacccttttgagtgacattgcttctgctctcaggtatcttcatgagaaccgcatcattcacagagacctgaaacccgaaaacatcgtgctgcaacagggggagcagaggcttatccataagattatcgaccttggttacgcaaaggaactggaccagggctccctctgtacctccttcgtcggaacgctgcaatacctggcaccagagctgctggagcagcagaaatacacggtcactgtagattattggagtttcggtactctcgcttttgaatgcataaccgggtttagaccctttctccccaattggcagcccgtgcagtggcacagtaaagtcagacagaagagcgaagtggacattgtggtttccgaggatctgaacggtaccgtaaagttttcatccagtctgccctacccaaacaacctcaatagcgtcctcgcagaacgtttggaaaaatggctgcagctcatgctcatgtggcatccacgacaaaggggtactgaccccacatacggtcccaatggctgctttaaggctctggatgacatcctgaacttaaaactggttcatatcctgaacatggtaactggaacaattcatacataccccgtaactgaagatgagtccttacagagcctgaaagcacgtatccagcaggacaccgggatcccggaagaagaccaggagctattgcaggaggcaggcctcgccctgattccggacaagcccgcaacccaatgcatcagcgacggaaaacttaacgagggccatactctcgatatggatcttgtgtttctgttcgacaattcaaagatcacctatgagacgcagatctcccccaggccccagcctgagagcgtgagttgtatcctccaggagcccaagcgcaatctcgcattcttccagctgagaaaagtatggggccaggtctggcactccattcagaccctcaaggaggactgtaatagactgcaacaaggacagagggcggcaatgatgaacctactccgcaataattcttgtctgtctaagatgaagaattctatggcctccatgagccaacagctgaaggcaaagcttgattttttcaagacctccatccagattgatctggagaaatattctgagcagacggaatttgggattacaagcgataaattgctgctggcatggcgcgaaatggagcaggccgtcgagctgtgtgggagagagaacgaggttaagctgttggttgagagaatgatggccctacagaccgatatcgtagacttgcaaagatccccaatgggacggaagcagggcggaacactggatgacttggaagagcaagctcgcgagctttacagaaggctaagagagaaacccagagatcagagaacggagggagattctcaggaaatggtgaggttactcttgcaggctattcaaagctttgaaaaaaaggttcgggtaatttatacgcaactgagtaagacagttgtgtgcaagcagaaggctctggaactgctaccgaaggtggaggaggttgtgagccttatgaatgaggacgaaaagactgtcgtgaggcttcaggaaaaaaggcaaaaagaactttggaatttactcaagattgcttgcagcaaggttcggggaccagtctcaggcagtcctgattccatgaacgcctctaggctttcccagccgggacagctcatgtcgcagccatccaccgcatctaactcactgcccgaacctgctaagaagagtgaagaactggttgcagaagcccataatctgtgcacactgctggagaacgccattcaggacacagtgcgagaacaggatcaatcgttcacggcactggactggtcttggttgcaaactgaggaagaagagcactcttgcctcgagcaagcctcttag

SEQ ID NO: 226754 - DNA, 963 bp, Artificial Sequence
  Description of Artificial Sequence: Synthetic coding sequence
atgaacaggcacttgtggaaatcacagctgtgtgagatggtgcaacctagcggtgggcctgccgcagaccaagacgtacttggcgaagaaagtccattgggaaaacccgcaatgctgcatctgccaagcgagcagggtgcgcctgaaaccctccagcgatgtttggaagagaaccaggaactgcgggacgcaatcagacaatcaaatcagattttgagggagcgttgcgaggaattgctgcacttccaggccagccagcgcgaggagaaagaatttctgatgtgcaagtttcaggaggcacggaagttggttgaacgactgggcctggagaagctcgatctcaaacgacagaaagagcaggccctccgcgaagtggaacacctgaagagatgtcagcagcagatggccgaggacaaggcctccgtcaaagcccaggtgaccagtttgctaggtgagctgcaggaatcccagagcagactcgaggctgccacaaaggagtgccaggctctggaggggcgtaggaaattggcacagctgcaggtcgcctaccatcagttgtttcaagaatatgataatcacatcaaatcttctgttgtgggttcagagcggaagagagcggatatctacaaggctgatttccaggctgaacgacaggctcgagagaaactggcagaaaaaaaggagctcttacaagaacagcttgagcagctacaacgcgagtactcaaagctgaaggcatcttgccaagagtctgccagaattgaggatatgagaaagcgacacgtggaagtgtcacaagctcctctgcctccggctccagcctatctgagtagcccactggctttgccttcccaaaggagatcaccgccagaggagccacccgacttctgttgtcccaagtgtcaataccaggctcccgatatggacaccctccagatccatgtgatggagtgtattgaatag

SEQ ID NO: 226755 - DNA, 1602 bp, Artificial Sequence
  Description of Artificial Sequence: Synthetic coding sequence
atgtcgtccgacgggaccatccgccactccaaggtaagacagaagtcggaggtggatattgtcgtctccgaagacctcaatggcacagtgaagttcagctcatcgttgccttaccccaacaatttaaacagcgtgttggccgaacggcttgaaaaatggctacagctgatgcttatgtggcaccctcgtcagcgcggtactgatcccacgtacggacctaacggctgttttaaggcccttgatgacattctgaacttgaaacttgtgcacattttgaatatggtgactggtaccatccatacctatccggtaactgaggatgagagtctgcagagccttaaggcacggatccagcaggatacaggcattccagaggaggatcaggagctcctgcaggaagcaggactggccctcataccggataaaccagcgacgcagtgcatcagtgatggaaaacttaatgaagggcataccctcgatatggacctggtgttcctgtttgacaattccaaaattacctacgaaacgcagatcagtcccagaccccagcctgagtctgtgtcatgtatcctacaggagcccaaacgtaacctggccttctttcaactgcgtaaggtttggggacaagtctggcactcaatacagacccttaaggaagattgtaataggttgcagcagggacagagagcagctatgatgaatttacttcgcaataactcgtgcctgtctaaaatgaaaaactctatggctagcatgtcccagcagctcaaagctaaactggatttcttcaagacatccatccagatagatttggagaagtactcagaacagacagaattcggaataacatcggacaagctattattagcgtggcgcgaaatggagcaagcagttgagttgtgtgggcgagagaacgaggtaaagctgctggtcgagaggatgatggccttgcaaactgacattgtcgatctgcagcgcagtcctatgggcagaaaacagggagggacgctggacgacctcgaagagcaggcaagggaactgtatagaaggctgagggaaaagcccagagaccaaaggaccgaaggcgattctcaggagatggtccgactgcttctgcaagcgattcagtcattcgaaaaaaaggtgagagtgatctacactcagctatccaagactgtggtgtgtaagcagaaggctctggaactgctgcccaaggtcgaagaggtcgttagcttgatgaatgaagacgagaagactgtggtgcgacttcaggaaaagagacagaaagagctgtggaatctccttaagatcgcatgttcaaaggtacgcggacccgtcagtggctcacctgatagcatgaatgccagccggctgagccagcccggacagttgatgagtcagccatcgaccgcgtccaatagtctgcccgaacctgctaagaagagtgaagaattggtggccgaggcccataacttatgtacactgcttgagaacgccatacaagatactgttcgagagcaagaccaaagctttacagcgctagactggtcatggctgcagacagaggaggaggagcacagctgtctcgaacaggcctcatag

SEQ ID NO: 226756 - DNA, 2094 bp, Artificial Sequence
  Description of Artificial Sequence: Synthetic coding sequence
atgagttcggacggtaccattcgactgacacatcccaacgttgttgcagccagagacgtaccagaaggtatgcagaatctcgctcctaatgacttgcctttactcgcaatggagtactgtcagggcggagacctcaggaagtatctcaaccagtttgaaaactgctgtggccttagggagggcgctatattaacgttactgagtgatatcgcgtctgccctcaggtacttgcacgagaatcgcatcatccaccgcgacctgaagcccgaaaatatagttctgcaacagggtgaacagcgcttaattcacaagatcattgatctgggctacgccaaggaacttgaccaaggcagcttgtgtacctctttcgttggaactctgcagtatctggcacctgaactcctggagcagcagaagtacacggttaccgtggattattggagtttcgggacactcgccttcgaatgtatcacgggctttcggccatttttgccaaattggcagccagtccaatggcactccaaagtgaggcagaagagcgaggtggacattgtcgtgtccgaggatctgaatggaacagtcaagttttcctcttccctgccttaccccaacaatctgaacagtgttttggccgagcggctggagaaatggttgcaactcatgctcatgtggcaccccaggcaacggggaacagaccctacctatgggcctaatggctgcttcaaagccctcgatgacatcttaaacctgaaacttgtccatattttgaatatggtaaccggaactattcatacttaccccgtgacagaagacgaatctttgcagagcctcaaggctcggatccagcaggacaccgggattccagaggaggaccaagagctgctgcaggaagcgggattggccctaatccccgacaaacccgcaactcagtgtataagtgacggcaaactcaatgagggccataccctggatatggacctggtttttctgttcgacaactccaagattacttacgagacgcaaatttcacccaggcctcagccagagtccgtatcctgcattctgcaagagcccaagcggaacctggctttttttcagctgagaaaggtttgggggcaggtctggcatagcatccaaactctgaaagaagattgtaaccgactgcaacaaggacagagggctgcaatgatgaatctactgaggaataactcttgcctgtctaaaatgaaaaatagcatggcatcgatgagccagcaactgaaagctaagttggatttcttcaaaacatccatccaaatcgacctcgagaagtactccgagcagaccgagtttggaataacaagtgacaaactactgctggcctggcgcgagatggaacaggcagttgagctgtgcggaagagagaatgaggtcaagctgctggtcgagcgcatgatggctttgcagaccgacattgtggacctgcagcgctctcctatgggaaggaagcaaggtggcaccctcgacgatcttgaggagcaggcccgtgaattatatcgccgacttagagaaaaacctagggaccagagaactgagggcgatagtcaagaaatggttagactcctccttcaggccattcagagcttcgaaaagaaagtaagggtgatttacactcagttatccaagacagtcgtctgtaaacagaaggcactggaactactccctaaagtggaagaggtggtctctctgatgaatgaagacgaaaagacggtggtccgccttcaggagaagagacagaaggagctatggaatctcctgaaaatcgcatgttccaaggtgagaggccctgtgagtggctctcctgattccatgaacgcttctcgtctcagtcagcccggtcagttaatgtcacagccctccaccgcctctaactctctccccgaaccggctaaaaaaagtgaggaattagtcgcagaggctcataatctgtgtacccttctcgagaacgccatccaagatacggtaagggagcaggaccagtcatttacggctctcgattggagctggctccagacagaggaggaagagcatagctgtcttgagcaagcctcatag

SEQ ID NO: 226757 - DNA, 2271 bp, Artificial Sequence
  Description of Artificial Sequence: Synthetic coding sequence
atgagctggtcccccagtttgaccacccaaacttgcggagcgtgggaaatgaaggaacggctcggtacgggcggattcggtaacgtgatacgttggcacaatcaggagaccggcgagcagattgctattaagcagtgtagacaggaacttagtcctcgaaaccgcgaaaggtggtgcctggagattcagattatgcgcaggctaactcacccaaatgtagtggccgctcgggatgtccccgaaggaatgcagaatctggccccaaacgatttacccctattggcaatggaatattgccagggaggcgaccttagaaaatacctgaatcagttcgaaaactgctgcggattgagagagggggctatcctgactttactctcagatattgctagtgctctgaggtatctccatgaaaatagaatcatccacagggacctgaagccagagaacattgtactgcagcagggcgaacaaaggctcatccacaagatcatcgacctggggtacgcaaaagaacttgaccagggatctctgtgcacaagcttcgtgggcaccctgcaatacctagccccagaactgttagagcagcaaaagtacactgttactgttgactattggtctttcggcaccttggcatttgaatgcattacgggatttcgtccattcttgccaaactggcaaccagtgcaatggcattcaaaggttcgccaaaagagtgaggtggacatcgtggtgtccgaggacctgaacggaaccgtcaaatttagtagctcattgccctaccccaacaacctgaacagcgtcttggccgaacgcctggagaagtggttgcaactgatgctgatgtggcatcccagacaacgtggaactgaccccacgtacggccctaacggctgtttcaaggctctcgacgacattttgaatcttaaattggtgcatatcttgaatatggtgacagggaccatccatacttatcctgtcaccgaggacgaaagcctgcagtctctcaaggcccgaatacagcaggacaccgggataccagaagaagaccaggagctgttgcaggaggccggtctggctctgataccagataagcccgctacacagtgtattagtgatggaaaactgaacgaggggcacaccctggatatggaccttgtgtttctttttgataattcaaaaattacctatgagacccagatttcaccacgcccacaacctgagtcagttagctgtatactgcaggagcccaaacggaacctggctttctttcaactgcgaaaggtatggggacaggtatggcactccatccagaccttgaaagaagactgcaatcgactccaacagggccagcgagccgcaatgatgaacctgttgcgtaacaactcctgcctgagcaagatgaaaaactcgatggcctctatgtcccagcagctgaaagcaaaactggactttttcaagactagcatccagatcgacctggagaaatactccgaacaaaccgagttcggtataacatctgataaattgctattagcttggagagaaatggagcaagccgtggagctgtgcggcagggaaaacgaggtgaagcttctagtggagcggatgatggcgcttcagactgatatcgtggatctccagaggtcacccatgggaagaaagcagggaggcacacttgacgatttggaggagcaggctcgagaactgtatcggagattgagggagaagccaagggaccaacgcaccgagggcgactcacaagaaatggtgaggctactgctccaggctattcagagtttcgagaagaaggtgagggtcatctatactcagttgtcaaagacggtggtgtgtaagcagaaagccttggagctactgcccaaagtcgaggaggtggtgagccttatgaatgaggatgaaaaaacagtggtacgtctacaggaaaaacgccaaaaggaactgtggaacctgcttaagatcgcctgtagcaaagtccgcggaccggtttctggctcgccggattctatgaatgcttcccgcctcagtcagcccggtcagttaatgagtcagccgtcaaccgcatccaacagtttgccggaaccagctaagaagtcagaggaactcgtggcggaggcacataatctgtgtaccctgctggagaatgccatacaggacaccgtcagggagcaggatcagagcttcaccgctctagactggagctggttgcaaactgaggaagaggagcactcttgccttgagcaggcaagttag

SEQ ID NO: 226758 - DNA, 3999 bp, Artificial Sequence
  Description of Artificial Sequence: Synthetic coding sequence
atgcggaacctaaaactgttccgtaccctggaattccgggatatacaaggtccaggcaaccctcagtgtttcagcctccgcactgagcagggcactgtgctgattggcagcgagcacggtttgatcgaggtggaccccgtatcaagggaggtgaagaatgaggttagcctggtagctgaagggtttctgcccgaagatggctcaggcagaatcgtcggggtgcaggatctgctagaccaagaaagtgtttgtgttgccacagcttctggggatgttatcctgtgtagtctgagcactcagcagctggagtgtgtagggagcgtggcaagtgggatttctgttatgtcctggagcccggatcaggagctggtgctgctcgctaccggccagcagacattgattatgatgacaaaagacttcgagcccatcctcgagcagcaaattcaccaagacgatttcggcgagtctaagttcatcacggttggatgggggcgtaaggagacccaattccatggaagtgaggggagacaggcggctttccagatgcagatgcatgaatcagccctcccttgggatgaccacagaccgcaagtgacctggaggggggatggacagtttttcgctgtgtctgtcgtgtgcccagagaccggcgcaaggaaggtacgcgtttggaatcgagagtttgcactccagagcacatctgaaccggttgctggactgggacctgctctcgcgtggaagccaagcgggtccctgattgcctctacacaggacaaacctaaccaacaggacatcgtgtttttcgaaaagaacggtctgctccacggccatttcaccctcccgttcctgaaggatgaggtgaaggtgaacgacctgctgtggaatgctgattctagcgtgttggccgtctggttggaggatctgcagagagaggagagcagcattcccaagacatgcgtgcagctgtggacagttggcaattatcactggtacctgaaacagtctctgtcctttagcacctgtggcaagagtaaaatagtatcactgatgtgggaccctgtgacaccatatcgcttacatgtcctttgccagggatggcactatcttgcctatgattggcattggactacagaccggtctgtgggagacaatagttctgacttgtcaaacgtggccgtcattgacgggaatagagtcctggttacagttttccggcagacagtcgtgccaccccctatgtgcacttatcaactgttgttcccacatccggtgaatcaggtaactttcttggctcatccccaaaaaagtaatgatctggcagtcctcgatgccagcaaccagattagtgtgtataagtgcggcgattgtccgagcgctgatccaactgttaaactgggtgctgtcggaggcagtgggttcaaagtctgtctgcggacgccgcaccttgaaaaaaggtacaaaatacaatttgagaacaacgaggaccaggacgtcaaccctcttaagcttggcctacttacttggattgaagaggatgtgttcttggcagtgtctcattccgaattttcccccaggtctgtgattcaccacctgaccgcagcctccagtgagatggacgaagaacacgggcagttaaacgtctcttcctcggctgccgtggacggcgtaataatctcactgtgttgtaatagcaaaactaagtccgtggtcctgcagttggccgacggacagatcttcaaatacttgtgggagtctccgtctctggctatcaagccctggaagaactctggcggattccctgttagatttccttatccgtgcacacagaccgagctggcaatgatcggtgaagaggaatgtgtcctgggcctgactgataggtgtagattctttattaacgacatcgaggtcgctagcaatattactagcttcgccgtgtacgatgagttcttgctgctgaccacgcacagccacacctgtcagtgtttttgccttcgggatgcatcttttaaaaccctgcaggccggactcagcagcaaccatgtgagccacggtgaggtcttgcggaaagtggaacgtggctcccgcattgtgacggtggtgcctcaggatacaaaacttgtacttcagatgccccgaggtaatctcgaagttgttcatcatcgggctctagtcttagcacagatcaggaaatggctagataaactgatgtttaaggaggcattcgagtgcatgaggaagctgcggatcaatctgaatcttatctacgaccacaatcctaaggtgttcctgggaaatgtggagacttttattaaacaaatcgactcagttaaccatattaacctattctttactgagttaaaggaggaggatgtgaccaagaccatgtaccctgccccagtgacaagctctgtttacttaagtcgggatcctgatggaaacaaaatcgatctggtgtgtgatgccatgagagccgtaatggaatctattaatccacataagtactgtctgtcgatcttaacaagtcacgttaagaagaccactcccgagttggagatagtgctgcagaaggtacacgaacttcagggcaacgctccgtcggaccctgacgcggtctctgccgaggaggctctcaaatatctgctgcacctggtggacgtgaacgagctgtatgatcacagcctaggcacctacgactttgatctggtgttgatggtggccgagaagagtcagaaggatcccaaagaatacctgccattccttaacactctgaagaaaatggagaccaactaccagaggtttaccatcgacaagtatctcaagagatatgaaaaagcaattggccacctttccaaatgtggacctgagtactttcctgagtgcctgaaccttatcaaagataagaacctgtacaacgaagcgttgaaactctacagtccctcgtctcaacagtatcaggacatatcaatcgcatacggcgagcatttaatgcaagagcacatgtacgagcctgcaggtctgatgtttgccaggtgtggagcacacgaaaaagctctgtcagcttttctcacatgtggaaactggaagcaggcactctgcgtggcggctcaactgaacttcaccaaggaccaattggttgggcttggtaggaccctggctggcaaactggtcgaacagcgaaagcacatcgacgctgcgatggtgctcgaagaatgcgctcaagattacgaagaggccgtgctccttttgcttgagggcgctgcttgggaagaagcgctgcgactggtgtacaaatacaaccgtctggatatcatcgaaacgaacgtgaagccctccattcttgaggctcagaaaaactatatggccttcttggattcccagaccgctacattcagcagacacaagaagcggctgctggtagtgcgcgagctgaaagaacaagcgcagcaagctggtctggatgacgaggtgccacatggccaggagtccgatctgttcagcgagacctctagtgttgtctcaggctccgaaatgagcggtaagtactcacactctaacagtagaatctctgcgaggtccagcaaaaaccggcgtaaggcagagaggaagaaacattcccttaaggagggatccccactggaggatttagccctgttagaagcgctgtcagaggtggtgcagaatacagaaaatcttaaagacgaggtctaccacattttgaaggtgctgtttctcttcgagtttgacgagcagggtagggaactgcagaaggcttttgaggacaccctgcagctgatggaacggtctctacctgagatctggactctcacataccagcagaatagcgccactcccgttctggggcctaatagcacagccaactcaattatggcaagttatcagcagcagaagacatctgtgcccgtgctcgacgctgagttgttcattccacccaaaatcaacaggagaacacagtggaaactgtcactactcgattag

SEQ ID NO: 226759 - DNA, 2952 bp, Artificial Sequence
  Description of Artificial Sequence: Synthetic coding sequence
atgtgggatccagtgaccccttaccgtctgcacgtattatgtcagggctggcactaccttgcttatgactggcattggacgaccgaccggtcagttggagataacagctctgatctgagcaacgtggccgtgattgacggcaacagagtgcttgtgacggtattccgccagactgtggtgcctcccccaatgtgcacctaccaactgctgttcccccaccctgtgaaccaagtaacatttctcgcccatccccagaaaagcaacgacctggcagtactggacgcctccaaccaaattagtgtgtacaagtgcggggactgtcctagtgcagatcccaccgtgaaattgggtgcagtcgggggttctgggtttaaggtgtgccttcgcacaccccacctcgagaaaagatacaagattcagtttgagaacaatgaggatcaggacgtgaatccacttaagctgggcctgctcacgtggatcgaagaggacgtgttcctggctgtttctcacagcgagttctccccccgatctgtgatacatcatctgacagctgcctctagcgaaatggacgaggagcacggccagctgaatgtgtcaagctcagccgctgttgatggcgtaatcatttcactgtgctgtaactccaagaccaaatctgtggtcctccagctcgcggatggacagatctttaaatacctctgggaatccccatccctggccatcaaaccctggaagaactccgggggatttcctgtaaggtttccatacccttgtacacagacagaactcgctatgattggggaagaggaatgcgtcctgggactgactgatcgatgccgtttctttatcaatgatattgaagtggcttccaatattacatcttttgcagtgtacgatgaatttctgctgctgactacacactctcacacctgccagtgtttctgcctgcgggatgcctccttcaaaaccctccaggcaggtctaagttctaaccacgtctctcacggagaggtgttgcgaaaggttgagcgcggtagtcgcatagttaccgttgtgccgcaagacactaaactggtcctccagatgccccgtggcaacctggaagttgttcaccatagggccttggtgctggcccaaatccgcaagtggctcgacaagcttatgtttaaagaagcctttgaatgtatgaggaagctgagaattaatctgaaccttatctatgaccacaacccgaaggtattcctcggaaatgtggagacattcataaaacagatcgactcagttaatcacattaatttgttcttcactgaactgaaggaggaggacgtgaccaaaacaatgtaccccgcaccagtgaccagctcggtgtacctttctcgcgacccagacggcaacaagattgacttggtctgcgatgccatgcgcgcagtcatggagagtataaacccacataagtactgcctttctatcctgacttctcatgtgaagaagaccaccccggaactggagatagtgttgcagaaggttcacgagctgcagggtaatgccccaagtgacccagatgcagtaagcgccgaggaggctctgaagtacctgcttcacctagtggatgtcaacgagttgtacgaccactcgcttggcacctatgacttcgacctggtcctgatggtggctgagaaaagtcagaaagaccccaaagagtacctgccattcttgaataccctgaaaaagatggaaaccaactaccagcggtttactatcgacaaatatctgaagagatatgagaaggcaattggacatttaagcaagtgtggacctgaatattttccagagtgtctcaatctgatcaaggataagaacctgtataacgaagctctgaagctctatagtcctagctcacagcagtatcaggacattagtatagcttacggggaacacctgatgcaggaacatatgtatgagcctgccggactcatgttcgcacggtgtggcgctcatgaaaaggccttgagtgcctttttgacctgtgggaactggaagcaagccctttgcgtggctgcacagttgaactttaccaaagatcagttggtgggactgggccgtactctggcaggcaaactggttgaacagcgaaaacacatagatgcggcaatggtcctggaggagtgcgcccaagattatgaggaagccgtgctcttacttctcgaaggggctgcttgggaggaagccttaaggctcgtttataagtataatcgcttggatattatcgagacgaatgtgaagccgagtatactggaggctcagaagaattacatggccttcctggactctcagaccgccaccttcagcagacacaagaagcgtcttcttgtcgtgagagaactaaaagaacaagcccagcaggccggactggacgatgaggtacctcacggtcaggagtcagacctgttttcagagacctcttcagtcgtctctgggtccgagatgagtggcaagtactctcacagtaatagccgcataagcgcgaggtccagtaagaataggcgtaaggccgagagaaagaagcactcgctgaaggaaggatcacctctcgaggatcttgcactgctcgaagccctcagtgaggttgtgcagaacactgaaaatcttaaagatgaggtttaccacatactgaaggtgctgtttctgtttgagtttgatgagcagggccgtgaactgcagaaggcctttgaggatactctgcagctcatggaaagatcattaccagagatatggacccttacgtatcagcagaactctgcaacgccagtgctgggtccgaattcaactgcaaactctattatggcctcttaccagcaacagaagacaagcgtacctgtgctggacgccgagctgttcattcccccaaagatcaatagaagaactcagtggaagcttagtcttctggactag

SEQ ID NO: 226760 - DNA, 2151 bp, Artificial Sequence
  Description of Artificial Sequence: Synthetic coding sequence
atgcagtcaactgccaattacctctggcataccgatgacttgcttggacagggggcaaccgcgagcgtatacaaggcacgtaataagaagtctggcgagctggtggctgtcaaggtgttcaacaccacgagttacctacgaccacgtgaagtacaagtcagggagttcgaggtcctccggaaactgaaccaccagaacatcgtgaaattatttgccgtggaagaaacaggcggatccagacagaaggtgctggtgatggaatactgcagctctgggagccttctgtccgtgctcgagagcccagagaatgcatttggacttcccgaggacgagtttctggtggtattaaggtgcgttgtcgctgggatgaaccatctgagggaaaacggtatcgtccacagagacatcaaacccggaaatatcatgcggttggtcggggaggagggtcaatcgatatataaattaacagactttggagctgccagagagctcgatgatgacgagaaattcgtgtcagtgtatggcacggaggagtatttacatccagacatgtacgaaagagcagtgttgcggaagccccaacaaaaggccttcggggttaccgttgacctgtggagtattggggtgacgttatatcatgctgccactggcagcctcccttttattcctttcggcggtcctcggaggaacaaggaaatcatgtaccgcattaccaccgagaaaccagctggggcaatcgcaggggctcagcgtcgggagaatgggccactcgagtggtcctacactctgccaattacatgtcaattaagcctgggactccaatctcagctagttcctatacttgccaatatcctggaagtggaacaggccaagtgttggggttttgatcagttttttgctgagacctcggacatcctacaacgggtggtggtgcacgttttttcccttagtcaggcagtcctgcatcatatctatatccatgcacataacacgattgccatttttcaggaggcagttcacaaacagacctctgtggctcctcggcaccaagaatacctgttcgaggggcacctgtgcgttctcgagccgtctgtctccgctcaacatattgcccacactacagctagctcaccactcacattgttttcaactgccattccaaaggggttggcatttcgagacccagcgctggatgttcctaaattcgtgcccaaggtagacctacaggcagattacaatacggcgaagggagtcctgggggcaggctaccaggctctgcgattggctagagccctgctggacggacaggagctgatgttcagaggtctgcattgggttatggaggtgctgcaggcaacctgcaggcgcactctggaggtggcccgtacaagcttgttgtatctgagcagttcccttggaaccgagagattctcatcagtggccggaacgccggagattcaggaacttaaagctgcggctgagttaaggagtcggttgcgaacactggccgaggttctgtccaggtgtagccagaacatcacagagacccaggagtccctgtcttcccttaaccgggaattggtgaaaagcagagaccaggtgcatgaggacaggtctatccagcagattcagtgctgtttggacaaaatgaacttcatctacaaacagtttaaaaaaagccgaatgcggccaggtctgggctacaacgaagagcagattcacaagctggacaaggtgaatttcagccaccttgcgaagagactgctgcaagtgttccaggaagaatgcgttcagaaatatcaggccagcctcgttacccacgggaaacgaatgcgcgtcgtgcacgaaaccaggaaccacctaagactggtaggctgctcagttgctgcctgcaacacagaagcccaaggcgttcaggagtccctatctaagctgctggaagaactgtcacatcagcttcttcaagatcgcgcaaagggtgcacaagcctcccctccacccatcgcaccatacccctctcctactaggaaagacctcttattacatatgcaggaactgtgtgagggaatgaagctgctggcctctgacctactcgataataacaggatcatcgaacgactgaatcgggtaccagcccctccagacgtctag

SEQ ID NO: 226761 - DNA, 1896 bp, Artificial Sequence
  Description of Artificial Sequence: Synthetic coding sequence
atggagtactgtagtagtggatcccttctgtcagtactggaatcccctgagaacgccttcgggctcccagaagatgaattcctggtagtgttaagatgtgtggtagccggaatgaatcatctgcgcgaaaacggtattgtgcacagggacatcaaaccaggaaacataatgagattagttggagaagaagggcaatctatctataagctgacagacttcggagctgcccgtgagctcgatgatgatgagaaattcgtgtctgtctatggaaccgaagagtacttgcatccggacatgtacgagagagctgttctgcgaaagccacagcaaaaggctttcggggtcactgtggatctatggtcaatcggggtgacactttatcacgccgctacggggagcctaccctttatcccgtttggcggacctcgcagaaataaggaaattatgtaccggattacaacagaaaaaccagcaggcgcaattgccggagcacaacgcagagaaaacggacccctagagtggagttacacgttacctattacctgtcagttatccctgggactacaaagccaactggttcctattctggcgaacattctggaggttgaacaagccaagtgttggggattcgaccaattcttcgcagaaacatctgatattctgcagagagtcgtggtccacgttttcagtctttctcaggctgtactccatcatatctatattcacgctcacaataccattgccatatttcaagaggcagtgcacaaacagacatctgtggctcctcgccaccaggagtacctgttcgaaggccacctgtgtgtgctcgaaccttccgtttccgcccaacacatagcacacacaaccgcatctagtcccctgactttgttttccaccgcaattccaaaaggtctagcctttagagaccctgccttggatgtccccaaatttgtgcccaaagttgatctccaggctgattacaacaccgctaaaggcgttctcggcgctggttatcaggctctgcggctcgctagggccttattggacggccaggaactaatgtttagaggcctgcattgggttatggaggtgttgcaagccacatgccggcgtactttagaggtggccaggacctctctactgtatctgagctctagcctggggacggagagatttagctctgtcgctggcactccagagattcaggagctaaaggccgctgcagagttgcggagcaggctgcgcacccttgccgaagtgctgtcaagatgctctcagaacattaccgaaacccaggagagcctctctagccttaacagggagctggtgaagtctcgtgatcaagtgcacgaggatcgcagcatccagcagatccagtgttgccttgacaagatgaatttcatctacaaacagttcaagaaaagtagaatgcgcccagggctcggctataacgaggagcagatccacaaactggacaaagttaatttcagccacctcgcgaaacggttgcttcaggtgtttcaagaagaatgtgtccagaaatatcaggctagcctggttactcatggaaagcgtatgcgcgtcgtccacgagaccaggaaccatctccgattagtcggatgcagcgtcgctgcttgtaacactgaggctcaaggggtacaggagagcttgtcaaagttgttggaagaactgagccatcaattgttacaggaccgcgcaaaaggtgcgcaggcgtccccgccacccattgccccatacccctctcccactcgcaaggatctgctgctgcacatgcaagagttgtgtgaggggatgaaattgttggcgtccgacctcttagacaataaccgcattattgaaaggctgaatagggtacccgcacccccagatgtctag

SEQ ID NO: 226762 - DNA, 1107 bp, Artificial Sequence
  Description of Artificial Sequence: Synthetic coding sequence
atgaaccggcacttgtggaaaagtcagctatgcgaaatggtgcagccctctggcggaccagccgctgaccaggatgtgctgggggaggagagcccgctcgggaagcccgcaatgctccatctcccttcagaacaaggagccccagagacattacaacgttgcttggaggaaaaccaggagctgcgcgacgccatcagacagagcaatcagatcttacgggagcggtgcgaggaacttcttcattttcaggcatctcagagggaagagaaagagttccttatgtgtaagttccaagaagctaggaaactggtggagagattagggttagagaaactggatctgaagcggcagaaggaacaggcgctgagagaggttgaacacctgaagcggtgccagcagcagatggctgaggacaaggcatccgttaaggctcaagtcaccagcctgctgggggagctacaggaaagccagagcagactggaagctgccaccaaagagtgtcaggcgctggaaggaagacggaagttggctcagttacaagtggcttatcatcagctgttccaagagtatgataaccatataaagtccagcgttgtggggtctgaaaggaagagaggcatgcaactggaggatttgaaacagcagctgcagcaggccgaagaagccctcgttgcgaagcaggaggtcattgacaagctgaaagaagaagctgagcagcataaaatcgttatggagacggtgccagttttgaaagcccaggccgacatctacaaggcagactttcaagcggagcgccaggcccgagaaaagctggcggaaaagaaggaactccttcaggagcagctagaacagttgcaacgcgaatatagtaaactgaaagcaagttgtcaagagtccgccaggattgaagacatgcgcaaaagacacgtggaggtgtcccaggctccattacctccagcccctgcatacctgagcagccctttagcattgcctagccaaagacgatcgccacccgaggagccacctgacttttgctgtccgaagtgtcaatatcaggcccctgacatggataccctgcaaatacatgtgatggaatgcatcgagtag

SEQ ID NO: 226763 - DNA, 1260 bp, Artificial Sequence
  Description of Artificial Sequence: Synthetic coding sequence
atgaatcgccacttatggaaaagtcaactgtgtgagatggtccagccaagcggaggaccagctgctgaccaggacgtgctgggtgaggagtccccgcttggcaaacccgcaatgctgcaccttccatcggaacagggggctcccgagacgctgcagcggtgcctcgaagagaaccaagagcttcgcgacgccatcagacaaagcaaccagatactgcgggagaggtgcgaggaattattacatttccaggcgtctcagagagaggagaaggagttccttatgtgcaaattccaggaggcaagaaaacttgtagagagattgggcctggagaagctggatctgaagcggcagaaagagcaggccttacgagaggtggaacatctcaaaagatgccagcagcagatggcggaggataaagcctcggtgaaggcccaagtgactagtcttctcggtgaacttcaggagtcacagtccagactggaggctgctaccaaggaatgccaggcgctggaggggagggcacgagccgcaagcgagcaggctagacagttagagtctgagcgcgaggcacttcagcagcaacatagcgtccaggttgaccagcttcgaatgcagggtcagagtgtggaggcggctcttagaatggaaagacaggccgcttcagaggagaaacggaagttggcccaactccaggtggcgtaccatcaactgtttcaagaatatgacaatcatatcaaaagtagcgtggtcggatcagaaagaaagaggggcatgcagcttgaggatctgaaacagcagttacagcaagctgaggaagcccttgtggctaagcaggaagtaattgataaactgaaggaggaggccgagcagcacaaaattgttatggagacggtgccagtcctgaaagcccaggccgacatctataaggccgatttccaggctgaaaggcaggcccgtgaaaaattagccgaaaaaaaggaactcctgcaggaacagctggagcaactgcagagagagtatagcaaattgaaggcctcctgtcaggaaagtgccagaatagaggatatgaggaagcgacatgtagaagtcagccaggcaccgctgccaccagctcccgcatacctaagtagccccctagccctcccttcgcagcgcagatcaccccctgaggagccccctgacttttgctgccccaagtgtcagtaccaggcccctgacatggatacattacaaattcatgtgatggaatgtatcgagtag

SEQ ID NO: 226764 - DNA, 1260 bp, Artificial Sequence
  Description of Artificial Sequence: Synthetic coding sequence
atgaatcggcacctatggaaatcacagctgtgtgaaatggtacaacctagtggcggtcctgcagcggaccaagacgtgctgggagaggaatctccactgggcaaacccgctatgctgcatctgccttccgagcagggagcccctgaaacgctgcagaggtgtttggaagagaatcaagagttacgcgatgccattcgccagagtaaccagattcttagagaaagatgtgaggagttgctgcactttcaggccagccagcgggaagaaaaagaattcctgatgtgcaaattccaagaagcccgaaaattagtggagcgcctgggactcgagaagttggatcttaagcggcaaaaggaacaggccctcagagaggtcgagcatctgaagagatgccagcagcaaatggctgaagataaggcctccgtaaaagcccaagtcaccagcctgcttggggagctgcaagagtctcagtcgcgactagaggccgcaacgaaggagtgccaggctctcgagggaagagccagagctgcctccgaacaggcccgtcagttggaatcagagcgcgaagccctacagcagcagcattccgtccaggtggatcagcttaggatgcagggacagtcagtggaagctgccctcaggatggagaggcaggctgcttctgaggaaaaacgtaaactcgctcaactgcaggtggcctatcatcaactatttcaggaatacgacaatcatataaagagtagcgtcgtcggatccgagaggaagagaggcatgcaactggaggacctgaaacagcagctgcagcaggccgaagaggccctggtagccaaacaggaggttatagacaaattaaaagaggaagctgaacagcataagatcgtgatggaaactgtgccggtactgaaggcccaggctgacatttataaggcagattttcaggcagaacgtcaggctagggagaagctcgcagagaagaaggagctgctgcaggaacagttggagcagcttcagagagaatattcgaagctgaaggcctcttgtcaggagtctgctcgtatcgaggacatgcgcaagcgacacgttgaagtgagtcaggccccattaccaccagctcccgcatatctttcctcccctttggcactgccgtctcaacggcgaagccctccagaagagcctccagacttctgttgtcccaaatgtcagtatcaggcccctgacatggatacgctgcagatacatgtgatggaatgtattgagtag

SEQ ID NO: 226765 - DNA, 1260 bp, Artificial Sequence
  Description of Artificial Sequence: Synthetic coding sequence
atgaaccgccacctgtggaagtcccagctgtgcgaaatggtgcagcccagtggaggacccgctgctgaccaggacgttctaggcgaagagtccccgttgggcaaaccagctatgctgcacctcccaagtgagcaaggtgccccagagactctccagcgctgcctggaggagaatcaagagttgagagacgcaatcaggcagagcaaccaaatcttaagagaaagatgcgaggagcttctgcatttccaagcctctcagagagaagaaaaagagtttctgatgtgtaagtttcaagaggcccgaaagctcgtggaaagactgggcctcgagaagctggacctgaagcgacagaaagaacaggcactcagagaagtagagcatctgaagagatgtcaacaacaaatggctgaagataaggcctcagttaaagctcaggttaccagtctcctcggggaactccaggaatcccagtctagattggaggccgctacgaaggagtgtcaggccctcgagggcagggctcgggctgcaagcgagcaggcccgacagcttgaatccgaaagggaagctctgcagcagcagcactctgtgcaagtggaccagctccgcatgcagggacagagcgtcgaggctgcactgagaatggaacgccaggctgcgtctgaagagaaacgaaagttggcccagctgcaggtggcctatcatcagttgtttcaggagtatgataatcatatcaaatcttctgtggtgggttctgaacgaaagcgtgggatgcagttggaggatctgaagcaacagctccaacaggccgaagaggccctcgtggctaagcaggaagttatcgataagctgaaggaagaggcagagcagcataaaattgtaatggaaactgtgcccgtgttgaaggcccaggcagatatttacaaggccgacttccaagcagagcgccaggctagagagaagctggccgagaaaaaagaactgctccaggagcaactggagcagcttcagagggaatattcaaagctgaaggccagctgtcaggagtcagcacgtattgaggacatgaggaaaaggcacgtagaggtgtcacaggctcccctgccccctgctccggcatacctgtcgagcccactagctcttccttcacagcgcaggtccccaccagaggagccacctgatttttgctgcccaaaatgtcaataccaggcgccagatatggatacactgcagattcatgtgatggaatgtatcgaatag

SEQ ID NO: 226766 - DNA, 1464 bp, Artificial Sequence
  Description of Artificial Sequence: Synthetic coding sequence
atggcgctggttattcaggttggaaagcttcggccaagagaggttagaactcctcaaaccattaacccttcgctgttcccatctcttcccgttaaactcagcagcatcattgaggtcccctccgggggagaaagatgctgtagccgcagaacgctagtttataaggcccgagcattttggaaaggagcgccactgccgtgctggatgaataggcatctgtggaaatctcagctctgtgagatggttcaaccaagtggagggccagccgcagatcaggatgtccttggcgaggagtctccactaggaaagcccgctatgctccatctgcccagcgaacaaggcgctccagagacgctgcagcgctgcctggaggagaaccaggagctccgagacgctatccgacaatctaaccagatactgcgggagagatgcgaggaactactgcactttcaggcttcccaacgagaggaaaaggaatttcttatgtgtaaatttcaggaagctcggaagctcgttgagcggctgggactggaaaaactggacctgaagaggcagaaggaacaggcattgcgagaagtggaacacctgaagagatgtcagcagcagatggccgaggataaggcgtcggtgaaagcccaggtaacctccttgctgggtgagctccaggaaagtcaaagccgcctcgaagctgctactaaggaatgtcaggccctcgaaggaagagcacgggcagctagcgagcaagcacgacagttagagtcagagcgggaggccctccagcaacagcactccgttcaggttgatcaactcaggatgcagggccagtccgtggaagcagccctccgcatggagcgacaggccgcaagcgaggagaaacgaaaattagcccagctgcaagtggcttatcatcagcttttccaagagtatgacaatcatatcaaatccagtgtggtaggaagtgagaggaagagagggatgcaactcgaagatctgaaacagcagctccagcaagctgaagaggcactcgtggctaaacaggaggtaatcgataagctgaaggaggaggctgagcagcataagattgttatggaaaccgttccagttctcaaggcgcaggctgatatatacaaggccgatttccaagccgaacgacaagccagggaaaagcttgcggaaaaaaaagaactgttgcaagagcagctcgagcagcttcagcgggagtactctaaattgaaagctagctgccaggaatctgcacggattgaggatatgcgtaagagacacgttgaggttagtcaagctcctcttcccccagctcctgcctacctgtcctctccgctggcattgccctctcagagacggtccccaccagaggagcctccggacttttgttgtccgaagtgccaataccaggccccagatatggacactctgcagattcatgtcatggagtgcatcgagtag

SEQ ID NO: 226767 - DNA, 621 bp, Artificial Sequence
  Description of Artificial Sequence: Synthetic coding sequence
atgaatcgtcacctatggaaaagtcagctatgcgaaatggtccaacctagcgggggacccgcagcagaccaggatgtgttaggcgaggagagtcctcttggtaagccagctatgctacacctgccctcggaacaaggcgcacccgagacccttcagcgctgcctcgaagagaatcaggaactcagggacgcaatccggcaatcgaatcagatactgcgtgaaaggtgcgaagaactcttacacttccaggccagccaacgggaagaaaaagaatttctcatgtgcaaattccaggaggccagaaagcttgttgaacggcttggcctagaaaagctggatctaaagaggcagaaagaacaggcgctccgagaggtcgagcatcttaaacggtgccagcagcagatggcagaagataaggcttcagtgaaagcccaggtcacatcactgctgggtgagctccaggagtcccaatcccggctggaggccgctacaaaggagtgtcaggcactggagggccgagcccgagcagcctcagaacaagctaggcagctggaatcagaacgggaggcccttcagcaacaacacagcgtgcaggtggatcagttgcgcatgcagggctag

SEQ ID NO: 226768 - DNA, 756 bp, Artificial Sequence
  Description of Artificial Sequence: Synthetic coding sequence
atgaacagacatctttggaagtcacagctctgcgaaatggtgcagccatctggaggccctgccgctgaccaggacgttttgggtgaagaaagtccccttgggaaaccagccatgcttcatctgccttctgaacagggggctccagagacactgcagaggtgtctcgaggaaaaccaggaactcagggacgctatccgtcaatccaatcagatattgagggagaggtgcgaggagcttctgcacttccaggcttcccagcgagaagaaaaggagttcctgatgtgcaaattccaggaggctaggaaactcgttgaaagactgggacttgaaaagctagacttgaaacggcagaaggagcaggctctgcgggaggtcgaacacttgaaacgctgccagcagcagatggcagaggacaaagccagtgtaaaggcgcaggttacctcattgctgggcgagctccaggagagccagtccaggctggaggccgctaccaaggagtgccaggccctagaaggcagagctcgggctgcctcagagcaggctcggcagcttgaaagtgaacgggaagctctccagcagcagcattccgttcaggtggatcagctacgaatgcagggacagtccgttgaagccgctttgcgcatggagagacaagcagcttctgaagaaaaaagaaagctggcgcagcttcaagttgcctaccatcagttattccaggagtatgataaccatattaaatcctcagtcgtgggttag

SEQ ID NO: 226769 - DNA, 417 bp, Artificial Sequence
  Description of Artificial Sequence: Synthetic coding sequence
atgaatagacatctttggaagtcccaactttgtgagatggtgcagccctcggggggacctgcggcagaccaggacgttctgggagaagaaagtcccctgggcaaacccgctatgctgcacttgcctagtgaacagggggcacccgaaactttgcagagatgtctggaagaaaaccaggagctgcgggacgccatcaggcaatccaaccagatcctgcgggaacggtgtgaagagctcctgcatttccaagcttcccagagggaggagaaggaatttctcatgtgcaagttccaggaggcgcgtaaactagtggagaggctgggtctggagaagctagatctgaagaggcagaaagagcaagcactgcgagaagtggagcatctgaagaggtgccagcaacaaatggcagaagactag

SEQ ID NO: 226770 - DNA, 1257 bp, Artificial Sequence
  Description of Artificial Sequence: Synthetic coding sequence
atgaaccgacatttgtggaaaagccaactgtgtgagatggtacagccgagcggcggtccggctgccgatcaggacgtgttgggggaggagtctcctctcggaaaacccgctatgttgcacctgccatccgaacagggagcccctgagaccctgcaaagatgcctcgaagaaaatcaggaactacgagacgccatccggcagtcgaatcaaattctgcgggaacggtgcgaggagctgttgcacttccaggcctctcagagagaggaaaaggagttcttgatgtgcaaattccaggaggctaggaagctcgtggagagactcggactggagaagctcgacctgaagcgccagaaagagcaggctctgcgcgaagtggagcatttgaagaggtgtcaacagatggccgaggacaaggcatccgtgaaagctcaggtgactagcctgttgggggagcttcaggagtctcagagtcgactcgaggccgcaaccaaagaatgtcaggctttggagggcagggctagggctgcatcggagcaggcccgtcagctggaatcagagcgggaggccctgcagcagcagcattccgtccaagtggatcagctgagaatgcaaggccagtccgtcgaagctgccctccggatggagcgccaggccgcatctgaagaaaagagaaagcttgcccagctccaggtcgcgtatcaccagctgttccaggagtacgacaatcacatcaagagcagtgtcgttggctccgagaggaagcgtggaatgcagctcgaggatcttaagcaacaactccagcaggctgaagaggccttggtggccaagcaggaggtcatagacaagctgaaagaggaagccgagcagcacaagatagttatggagacggtcccagtgctcaaggcacaggctgatatttacaaggccgacttccaggcagaacgtcaggccagggaaaagctcgcagagaagaaggaacttttacaagagcagttggaacaattgcagcgagagtactccaagctaaaagcatcttgtcaggaaagcgcacgcattgaagatatgcgcaagaggcatgtggaggttagccaagctccacttccgcctgcccctgcgtaccttagttctccacttgcgttgccctctcagcgccgatccccaccagaggaacctcccgacttctgttgcccaaaatgtcaataccaggctccagacatggacactcttcagattcacgtgatggagtgtattgaatag

SEQ ID NO: 226771 - DNA, 2181 bp, Artificial Sequence
  Description of Artificial Sequence: Synthetic coding sequence
atgctgcgggcatgccagttaagcggcgtaactgccgcagcccagagctgtttgtgtggcaagttcgtccttagaccactgaggccatgccgtcgctattctacttcagggtcttctggtctgaccaccggcaagattgcaggcgcaggtctgctgtttgttggaggcggaattggaggcaccattctctacgcaaaatgggacagccacttccgcgagagtgtcgaaaagacaattccatactctgacaagctgttcgagatggtcctgggcccagcggcatacaatgttcctctgcccaagaagtctattcaaagcgggcctctcaaaatatcctccgtcagcgaagtgatgaaggagtctaaacagccagcatcacagctgcagaaacagaagggtgacacacccgcatcagcgactgcgccaaccgaagcagcacagatcatttcagctgctggtgacacattgtcagttcccgctcccgcagtgcaacccgaggaaagtctgaagaccgaccatccagaaatcggagagggaaaacccacacccgcattaagcgctctggctaagtccttagaggatgccctgcgccagaccgcgagtgttacactgcaggccattgcagcgcagaacgctgccgtgcaggcagtcaacgcccacagcaatatcctcaaggctgccatggataactctgaaattgccggtgagaagaaatccgctcagtggcgcacagtcgagggtgccctgaaagagcgaagaaaagctgttgatgaggcagcagatgctctgcttaaggcaaaggaagaactggagaagatgaaatccgtcatagaaaacgccaaaaaaaaagaggtcgccggtgctaagccacacattaccgctgccgaaggaaaacttcacaatatgatcgttgacctggacaacgtggtcaaaaaggtacaggccgctcagtcagaggcgaaagtcgtctcacagtatcacgaattggtcgtgcaggccagagacgatttcaaacgggaactggacagcatcacccctgaagtattgcccggttggaaaggcatgtccgaatataatctggctgataaattaagcacagacgacctaaatagtctcatcgcccacgctcaccgtcgaatcgaccagttgaaccgtgagctggcagaacaaaaggccacagaaaagcaacacattacattagcccttgagaagcaaaaacttgaagaaaagagggccttcgatagtgctgtggccaaggccttggagcatcaccggagcgagattcaagccgagcaagatcgaaagattgaagaggtcagggacgccatggagaacgaaatgagaacacagcttagaagacaggctgccgctcacactgatcaccttcgggatgtgctgcgagtgcaggagcaggaactgaagagtgagttcgaacaaaacttatctgagaagctgtccgagcaggagttgcaatttaggcggctgagtcaggagcaggtcgacaactttaccttagacatcaataccgcctatgctcgactgcgcggtatagagcaggccgtacagtcccatgctgtggcagaggaggaagcgaggaaagctcaccagctgtggctcagcgtcgaggctcttaagtatagtatgaagacgagcagcgccgaaacgcccacgatcccattaggctctgcagtcgaggccataaaggccaattgctccgataatgaatttacgcaggcgttgacagctgccatccccccagaaagtcttacccggggagtttattccgaggaaacacttcgagcgaggttttatgctgtgcagaaacttgcccgtagagtggcaatgattgatgagacccgtaactcactgtaccaatactttctatcatatctgcaatccttactgctgtttccacctcagcaattaaaacctcccccagaactgtgtcctgaagatataaatacttttaaactcttatcttatgcttcatactgcattgagcatggggacttagagctcgccgctaagttcgttaaccaactgaagggcgaaagcaggagggtcgcgcaggattggttaaaagaggccaggatgacacttgagactaaacagatcgtggagatcctgaccgcgtacgcctccgcagtgggcatcggaaccacgcaggtgcagcccgagtag

SEQ ID NO: 226772 - DNA, 1119 bp, Artificial Sequence
  Description of Artificial Sequence: Synthetic coding sequence
atgctacgtgcatgccagttgtccggggtgactgctgccgcacaatcctgcctgtgcggaaagttcgtcctacgaccccttagaccctgccgacggtattccaccagcgggtcaagtggattgacaacggggaaaatcgccggtgctggactcttatttgtcggcggtggaatcggtggcacaatattatacgctaagtgggattctcattttcgcgagtctgtggagaagacaattccctattctgataaactgtttgaaatggtcttgggcccagctgcctataatgtgccactgccaaaaaaaagcatacaaagcggtccattgaagatttcatctgtgagtgaggtaatgaaggaatctaaacaaccagccagccagctgcaaaagcagaaaggggacaccccggcatctgccaccgccggagatacattgagcgtgcctgcaccagcggtgcagccagaagaaagcctgaaaactgaccatccagagattggggaaggaaaacccacaccagccctgtcagaggcttcgtcctcaagtatcagggaaaggcctccagaagaggtcgccgctagactggctcaacaggaaaaacaggagcaagtgaagatcgagtctctggcaaaatcccttgaggacgcacttcggcagacagctagcgtaaccctgcaagccatcgctgcgatacccccagaaagtcttactaggggcgtgtactcggaagagacactgcgagcaagattctacgctgtccaaaagctagcgagaagggtagcaatgatagatgagacccgaaacagcctgtaccagtacttcctttcctatttgcaaagtctgctgctttttcccccacagcagttaaagccacctccggagttgtgtcctgaagatatcaatacttttaagctgctgtcatatgcatcatattgcattgagcacggagatctggaactcgccgcaaagttcgttaatcagctgaagggggaaagtcgaagagtcgcacaggactggttgaaagaagctcgcatgaccctcgaaactaaacagatcgtagagattctcaccgcctatgcctccgctgtgggcattgggaccacccaggtccagcccgaatag

SEQ ID NO: 226773 - DNA, 1980 bp, Artificial Sequence
  Description of Artificial Sequence: Synthetic coding sequence
atgctgcgagcttgccagctatccggcgtgacggctgccgcacaatcatgcctgtgcggcaagtttgtgctgcgccctctccgcccatgccgacgttactctaccagcggctcctctggcttaaccaccggaaagatagccggtgctggtttgctttttgtggggggaggtattggtggaaccattctgtatgcaaaatgggatagccatttccgggaatcagtcgagaaaacgatcccctacagcgacaaactgtttgaaatggtccttggcccagcagcatacaacgtgcctttgcccaaaaagtctattcagtcaggtcctctcaagataagtagtgtttctgaggttatgaaagagagcaagcagcctgctagccagctccaaaaacaaaagggggacacccccgcatccgccacggctctcgctaaaagtttggaagatgcccttagacagactgctagtgttaccttgcaggctatcgccgcacagaatgcggcagtgcaagccgtgaacgctcacagcaacatcctgaaagctgctatggataacagcgagattgccggtgaaaaaaaatctgcacaatggcgtacggtcgaaggagccttgaaggagcgccgaaaggccgtcgatgaggctgccgatgcgctgctcaaggcaaaggaagaactggagaagatgaagagcgtcattgagaacgctaaaaagaaagaggtcgccggagcaaagccgcacataaccgccgctgaaggtaagctccacaacatgatagtggatctcgataacgtggtgcaggccagagatgactttaaacgcgagctggacagtatcacccctgaggtgctgcccggatggaaaggcatgagtgtgtctgacctggccgacaagttgtctacggatgacctaaattcgctgatagcgcacgcccacaggcgaatcgaccagcttaaccgagagttggccgaacagaaggcaactgagaagcaacacatcacattagcactcgaaaaacagaaattggaagaaaaacgagcctttgactctgccgtcgcaaaagccctggagcaccaccggtcagagattcaggcagaacaggaccgcaaaattgaggaagtgagggacgcgatggagaatgagatgcggacacagctgagacggcaagccgctgcgcatacggaccatctgagggacgtgctgagggtgcaggagcaggagctcaaaagtgagttcgagcagaacctgtctgagaaactgtctgagcaggagctccagttccggagattgagccaggagcaggttgacaacttcaccctcgacattaatactgcctacgcaagactgcgaggcatcgaacaggccgtccagtctcacgccgttgccgaggaagaagcacgtaaggcacatcaattgtggctgtccgtggaagccctcaaatattccatgaagacttcatccgccgaaacacctaccattccattgggatccgcagtggaagctattaaagcaaactgcagcgataacgaatttacccaagctctgaccgccgcaatcccaccggagtccctgactcgtggggtatacagcgaggagacactgagagctcgcttctacgctgtgcaaaagctcgcacggagggtggcaatgatcgatgagacacgaaacagcctgtatcagtatttcctgtcttaccttcagagcctgctgctgtttcctccgcagcagttaaagccaccaccagagctgtgccccgaagacatcaatactttcaagcttctgtcatacgcgtcgtattgcattgaacatggggatcttgagctggcagcgaagttcgttaaccagctcaagggagagtcgaggagggtggcccaggattggctcaaagaggctagaatgacacttgagactaagcaaatagtcgaaatcctgacagcctatgcgtccgctgtaggtataggaaccacccaggtgcagcccgagtag

SEQ ID NO: 226774 - DNA, 2277 bp, Artificial Sequence
  Description of Artificial Sequence: Synthetic coding sequence
atgctcagggcttgtcagctgagcggtgttaccgcagcagcgcaatcctgcctttgcgggaaattcgtgcttagaccactacgaccttgcaggagatactcgaccagcgggtcaagcggactgaccaccgggaaaattgctggagctggcttgctttttgtcggtgggggtattggcggaacaattctgtatgccaaatgggacagccatttccgggagtcagtggagaagacaatcccctactccgacaaacttttcgagatggtgctcggtcctgccgcttacaatgtccccctcccaaaaaagtcaatccagagtgggcctctgaagattagctccgttagcgaagtgatgaaggagtcaaagcagccggcatctcaactgcagaagcagaagggtgacactcctgccagcgcaaccgcgccaaccgaggcggctcagattatctccgccgcaggagataccctgagtgtcccagcacccgcagtgcagccggaggaatcccttaagaccgatcaccccgaaatcggagagggtaagccgacaccagccctgtccgaggaggcaagcagcagctcgatacgggaacgccctcccgaagaagtggctgctcggctagcccagcaggagaagcaggaacaagttaagatcgaatccctcgccaagtccctggaagatgccttgaggcagacagcatcagtgacgctccaggcaattgcagcgcagaacgccgctgtgcaggctgtgaacgcgcactccaacattttaaaagcagccatggataattccgaaatcgcaggcgagaaaaagagcgcccaatggaggaccgtggagggtgctttgaaggagcgtcgcaaagccgtggatgaggccgctgacgctctcttgaaggccaaggaagagttggagaagatgaagagcgttattgaaaatgcgaagaagaaggaggtggcgggagcgaaaccacacattacggcagcagaagggaaactccataatatgatcgtcgacctggacaacgtggtaaagaaggtgcaggcagctcagtccgaggccaaagtggtgagccagtatcacgagcttgtggtccaagccagagatgacttcaaacgggaattggactcaattacccccgaggtgctccccggatggaagggaatgagcgtcagcgatcttgctgataaactgtcaacggacgacctcaatagcttgatcgcacacgcccatcgccgaattgatcaactaaacagggaacttgccgaacagaaagctactgaaaagcaacacataacccttgcgctggaaaaacagaaattggaagagaagagggcgttcgatagtgcagtagccaaagccctcgaacatcatcgctccgagatccaagccgaacaggatcggaaaatagaggaggtgcgcgatgcgatggaaaacgaaatgaggacacagttacggcgacaagccgctgcccatacagaccatcttcgggacgtgctgcgtgttcaggagcaggaactgaaaagcgagtttgagcaaaatctgtcagagaagctgtcggagcaagagttgcagtttcgacgtctgagtcaagaacaggtggataactttactcttgatatcaatacagcatacgccaggctgcgcggtattgagcaggctgttcaaagccacgcagttgccgaggaagaggctcgcaaagcacatcagctgtggctgagcgtcgaagccctgaaatatagcatgaaaacctctagcgccgagacaccaaccatccccctcggcagtgccgtggaggctatcaaagcaaattgttccgataacgagttcacccaggccctcaccgctgcgattcctccagaaagtctcacgaggggcgtctattcagaggagactctgcgagccagattttacgctgtacagaagctggcacgcagagtggccatgatagacgagacaagaaatagtctgtatcagtactttctttcatacttacagagcctccttctgttccctccccagcagttaaagcctcctcctgagctgtgccccgaagacatcaacacatttaagctcctttcctatgctagttactgtattgaacatggggacctcgagctggcagccaaattcgttaaccagctgaagggagagtcccggagggtggctcaggactggttgaaggaggcacgaatgaccctggagacaaagcagattgtcgagatactgaccgcctatgcaagcgctgtgggaatcggcacaacacaagtccagcctgaatag

SEQ ID NO: 226775 - DNA, 2274 bp, Artificial Sequence
  Description of Artificial Sequence: Synthetic coding sequence
atgctgcgggcttgccagctgtcaggtgttacagcggcagcgcagagctgcctatgtggaaaatttgtcctgaggcctcttaggccatgccgacgctacagcacctcaggctccagtggcctgactacaggcaagatcgccggagcaggcctgttattcgtcggaggcggtataggcggtacaattctttacgcgaagtgggactctcactttcgcgaatctgtggagaagaccataccatactcagataagctgtttgagatggtcctgggcccagccgcttataatgtgccacttcctaagaaatcaatccagtctggccctctcaagattagctctgtgtctgaggtgatgaaggaaagcaagcagccggcttcccagctgcagaagcagaagggagacactcctgccagcgctactgctccaacagaggccgctcagatcatctctgctgctggagataccctgtctgtacccgcacccgcagttcagcccgaggaatcccttaaaacggatcatccagagattggagagggaaagcccacgcccgctctgtccgaagcctccagctcttcgataagagaaagaccccctgaagaggtggccgcacggctggcccagcaagaaaagcaggagcaagtgaagatcgagagccttgcgaagtccctagaagatgcattgagacagaccgcctccgtgactttacaagccattgcggcacagaatgcggctgttcaggccgtcaacgcccatagcaatatcctgaaggcagctatggataactcagagattgccggagaaaagaagagcgcccagtggaggacagtggaaggcgcattaaaagagcgccgtaaagcagttgacgaggcagcagacgctttactgaaggccaaagaggagttagagaagatgaagtccgtcatagagaatgctaaaaaaaaagaggtggcaggtgccaagccgcacatcaccgccgctgagggaaaacttcacaacatgatagtcgaccttgacaacgtggtaaaaaaggtgcaagccgctcagtcagaggctaaagtggtctctcagtaccacgaactggttgtgcaagcgagagacgacttcaaacgtgaattggactccatcactcccgaagttctgcccggttggaagggtatgagcgttagtgacttggcggataaactgtcgactgacgaccttaattcccttattgctcacgcccaccggagaatcgaccagttgaatcgggagctagcagaacaaaaagcgactgagaagcagcacatcactctggcccttgaaaaacaaaaactggaagagaagagggcttttgacagcgccgtggcgaaagcactggagcaccacaggtctgagattcaagcagagcaggataggaaaatcgaggaggtgcgcgatgcaatggaaaatgaaatgcggacacagctccgcaggcaggccgctgctcacaccgatcatttacgagacgtgctgcgtgttcaggagcaggagttgaaatccgagttcgagcagaatctgtccgaaaagctgagcgagcaggagctacagtttaggagactcagccaggaacaggtagataacttcacactggacatcaacacagcttatgctaggctcagaggaatcgaacaggcagtacagtcacacgcggtcgcagaggaggaagcaaggaaagcccaccagctgtggttaagcgtcgaggcactgaagtatagcatgaaaacatcttcagccgaaacccctactattccgcttgggtccgcggtggaggctatcaaagccaattgctcagacaacgaatttactcaggcactcactgctgccatcccacccgagagtctgacccgcggagtctatagtgaggagaccttgagggcacgcttttacgccgtccaaaagcttgcgagaagggtggccatgatagacgaaactcgcaatagtttatatcagtactttctttcctatcttcagtcactgttgttgtttccgccacagcaactgaaaccacctccagagctgtgcccggaagacatcaacacattcaaattacttagctacgccagttattgtattgagcacggtgatctcgagcttgctgcaaagttcgtgaatcagcttaaaggcgagtcccggagggttgcccaggactggctgaaagaggccagaatgacgctggagaccaaacagatagtggagatcctgacagcctatgcctcagccgtggggattgggacaactcaggtacagcctgaatag

SEQ ID NO: 226776 - DNA, 2244 bp, Artificial Sequence
  Description of Artificial Sequence: Synthetic coding sequence
atgcttagggcatgtcagctgtctggagtcaccgcagcggctcagtcttgcttgtgtggaaaatttgtgctgaggcccctacgaccttgtagacgatactccacatccggtagttccgggttgacaaccggcaagatcgctggcgcaggcttgctgttcgtggggggtggaattggaggtaccatactgtacgctaaatgggactcacattttagggaaagtgtcgagaagactatcccctacagcgacaagttgttcgaaatggtgttggggccagcagcgtataatgtgccattgccaaaaaagtctattcagtccggtccgcttaagatctcctcagtctcagaagtgatgaaggaaagcaagcaacccgctagtcagcttcaaaagcagaagggggatacccccgctagtgcaaccgctggagacacgctctccgttccggcaccggcagtgcagcccgaggagtcattaaagacagatcacccagaaataggagaggggaaaccaacgccggctctgagtgaagaagcctcttcttctagcatacgagagcgccctccagaagaggtggcagcaaggctcgctcagcaggagaaacaggagcaggtcaagattgaatctctcgcaaaatcactggaggatgccctacgtcaaacggccagcgtaactctccaggccatcgccgctcagaatgcagccgttcaggccgtaaacgctcacagcaacattttaaaagccgcaatggataacagcgagatcgccggtgagaagaagagtgctcaatggcgtaccgtagaaggcgctctgaaggaacggcgtaaggccgttgatgaagccgctgacgccctactgaaagccaaggaggagctggaaaagatgaagtcagtgattgaaaacgccaaaaagaaagaagtggctggcgcaaaacctcatattaccgccgcagaaggaaagctgcacaatatgatcgttgacctggataacgtggtgaagaaagtgcaggccgctcaaagcgaggcaaaggtcgtcagtcagtaccacgaactcgtcgtgcaggcccgagacgatttcaagcgggagctggattcgatcactcccgaagtgctgccagggtggaagggcatgtccgtctctgacctggctgacaaactgagcacagatgacctgaattctctcattgcgcacgcccacagacgcatcgatcagttgaatagagaactggctgaacaaaaagccactgagaagcagcacatcaccctcgcactcgagaagcagaagctcgaggagaaacgcgcattcgacagcgcagttgccaaagctttggagcaccatcgttcagaaatacaggccgagcaggacaggaagatcgaagaggtacgagatgctatggagaatgagatgcgtacccagctgaggagacaagcggcagcacacacggatcacctgcgggatgtcctaagggtgcaggaacaggagctgaaatcagaatttgagcaaaacctttcagaaaagctgtctgaacaagagctgcagtttaggagattatcccaggagcaggtcgataactttactttagatatcaacacagcatacgccagactcagaggcatcgagcaggcggtgcagagccacgcggtggctgaggaggaggccaggaaggcccatcaattatggctgtcagtcgaggctttgaagtactccatgaagacatcctcagcagaaactcctactattcccctggggagcgcggtcgaagctattaaggcaaattgttctgataacgaatttacccaggctctgactgccgcaataccacccgagtctctgactcgaggtgtatattccgaggagacactccgcgctcgtttctacgctgtgcagaaactggcgagacgagtcgccatgatagatgagactcgtaattctctttaccagtacttcctaagctatttgcagtcactgttgctgtttcctcctcagcaattaaagcctccgcctgagctctgtcccgaggacatcaacacatttaagctactgagttacgcgagctattgtatcgagcacggggatttggagctcgctgcgaaattcgttaaccagctcaagggggagagccgcagagtggcccaggattggctaaaggaagctcgaatgactttagagactaagcagatcgtcgaaattctcacagcatacgcctctgccgtggggattggaacaacccaggtgcaacccgagtag

SEQ ID NO: 226777 - DNA, 2244 bp, Artificial Sequence
  Description of Artificial Sequence: Synthetic coding sequence
atgctgcgagcctgtcagctctctggcgttaccgccgctgcacaaagctgtctgtgtggtaagttcgttctgaggccactgcggccatgtagacgatacagtacctccggcagctccgggttgacaaccggcaagattgccggtgcgggtctgctttttgtgggcggaggtattggtggcacaatcctctacgctaagtgggacagccattttcgcgagtctgttgaaaaaacaataccttactcggacaagctcttcgaaatggtacttgggccagccgcttacaatgtacccttgcccaagaagagtatacagagcggacccctcaagatatcctcggtctcagaggtaatgaaagagagcaaacaacctgcgtctcaattgcaaaaacaaaagggcgataccccggctagtgctactgccggagatactctttccgtacccgctcctgcagtccagccagaagagagtctgaaaactgatcatcctgagattggcgaagggaagcctacaccagccctttctgaggaggcgagttcttccagcattagggagcgccctcccgaggaggtcgccgctagacttgcccagcaggagaaacaggagcaggtgaaaatagaatcgctcgccaagtcccttgaggatgcactgcggcaaaccgcctcggtgactctgcaggcaatcgctgcccaaaacgccgcagtccaggctgttaatgcccactctaacattctgaaagccgctatggataacagtgagatagcaggagaaaaaaagtccgcccagtggcggaccgtagagggcgctcttaaggagcgcaggaaagcagtcgacgaggccgcagatgcccttcttaaagcaaaggaggaactggaaaagatgaagagtgtcatagagaacgccaagaagaaggaagttgctggcgcaaagccccatatcacggccgctgaagggaagctgcataacatgattgtggatctagataacgttgtcaaaaaggtccaagccgcacagagtgaggccaaagtggtctctcaataccacgaacttgtggtacaagcccgagatgactttaaacgggaactggattctattaccccagaggtgttaccgggttggaagggcatgtctgaatataacctcgctgacaagttatctactgatgacttgaacagcctcattgctcatgcacaccgtcgcatcgaccagctcaaccgagagctcgccgagcagaaggccacagaaaagcagcacatcacactcgctctggagaagcagaaactggaggagaagcgagcatttgactccgccgtggctaaggcactcgaacaccacaggtcagaaattcaggcagagcaagaccgaaagatagaagaggttcgtgatgctatggagaacgagatgaggacccagctccgaaggcaagctgcagctcatacagatcacctgagggatgtcctgagagtccaagaacaagagctgaaatcagaatttgaacagaatctgagcgagaaactctccgagcaagaattgcagtttcgtaggttatctcaggaacaggtggacaattttacactggatattaacactgcatatgcgagactaagaggtatcgagcaggcggttcagagccatgccgtcgcagaagaggaggctaggaaggcccaccagctgtggctgtccgtggaagccctgaagtacagcatgaagacctcttccgccgaaacaccgacaatcccgctggggtctgccgttgaggccataaaggccaattgcagcgacaatgaatttactcaggcgcttaccgcagccattccacctgagagcctcaccaggggtgtgtacagcgaagagactttacgggcacgtttctacgcagttcaaaagctcgccagaagggtggcgatgattgatgaaacacgaaattctctgtaccagtatttccttagctaccttcagtccctgctgctgttcccacctcagcagctaaagcccccacctgagttgtgcccagaagacattaataccttcaaattactcagctacgcctcttactgcatcgagcacggcgacttggagctggctgctaaatttgttaaccagctcaaaggagagtcgaggagggtcgcccaagattggctgaaagaggcccgtatgaccctggaaaccaagcagatagtcgagatactcacagcttatgctagcgcggttgggatcggcactactcaagtgcagccggagtag

SEQ ID NO: 226778 - DNA, 579 bp, Artificial Sequence
  Description of Artificial Sequence: Synthetic coding sequence
atggaccgagcccaccgccttggacaaacaaaacaagtaactgtctaccggctcatatgcaagggcacaatcgaggaacgcatcctgcagcgggcaaaagagaaaagtgagattcaacgtatggtcatttctggcggtaattttaaacccgacacactgaagccaaaagaggtcgtgtctttgctgttggacgatgaggaacttgagaagaaacttcgcctgaggcaggaagaaaagcgccaacaagaggaaacaaaccgagtcaaggagcggaagaggaagagagaaaaatatgcagagaaaaagaagaaagaggatgagctggacgggaagcggagaaaggaaggagtcaacctcgtgatccctttcgtgccgagcgctgataattccaacctctcggctgatggggacgactcctttatttctgtggatagcgcaatgccctctccattcagtgaaattagcatctccagcgagctccatacaggttccatccccctggacgaatccagtagcttagcccctgattcgctggtccggaagcaggggaagggtactaatcccagcggcggtaggtag

SEQ ID NO: 226779 - DNA, 4671 bp, Artificial Sequence
  Description of Artificial Sequence: Synthetic coding sequence
atggcatccgagctaggtgccagggacgatgggggatgcactgagctcgctaagcccctctatctgcaatacctagaacgcgctcttcggctcgaccatttcctccggcagaccagcgcaatttttaatcgcaacattagttcagatgacagtgaagacggacttgacgacagcaaccctttgcttcctcagtcgggcgatccccttatccaagtgaaagaagaaccacctaactctctgctaggggagaccagcggcgcagggtctagcgggatgctcaatacatacagtctgaacggagttcttcagagcgagagcaaatgtgacaagggcaatctgtacaatttctcgaaactgaagaaatcgagaaagtggctcaagtcaatactgttgtccgacgagtcctcagaagcagattcccagagcgaggacgacgatgaggaggagttgaatttgtcccgggaagagctccacaacatgctgcgcctgcataagtacaagaaactgcatcagaataagtatagcaaggataaggaattgcagcagtaccagtactactctgcagggctgctgtccacatacgacccattctacgaacagcagagacaccttttgggtccaaagaaaaagaaattcaaagaagagaaaaagctgaaggccaagctgaaaaaggtgaaaaaaaaaaggcggagggatgaggagcttagtagcgaagagtccccacggaggcatcatcaccagactaaggtgttcgccaaattttcacatgatgccccacctcccggtacaaaaaagaaacacctttccattgagcagctgaatgcaaggcgtcgaaaggtttggctatcgattgtgaagaaggaactgcccaaggcaaacaagcagaaggccagtgctcggaacctgttcctcaccaatagccggaaactggcccatcagtgcatgaaggaggtgagaagggccgctctccaggctcaaaaaaattgcaaggagacccttccaagagctcgacgcctgacaaaggagatgttgctgtattggaaaaaatatgaaaaagtcgagaaggaacatcgaaagcgggctgagaaggaggctctcgagcagcggaaattagatgaagagatgcgcgaggctaaacgacagcagagaaagttgaatttcctgatcacccaaacagagctctatgcacactttatgagcaggaaacgggatatggggcacgatggtattcaggaagagatcctaaggaagcttgaggactcctcaacacagagacagatcgacataggcggaggtgttgtggtgaacatcacccaggaggattatgatagcaaccacttcaaggcacaggccctgaagaatgccgagaacgcttaccacattcaccaggctcgcacccggagttttgacgaggatgccaaagaaagcagggccgcagctctgagggctgccaacaaaagcggaactggattcggtgagagttactctctcgccaatccaagtattagagctggagaggatattccccagcctactatctttaacgggaagctgaaaggctaccagctgaagggaatgaactggttagctaacctgtacgagcaaggaatcaatggaattcttgccgacgagatggggttggggaagaccgtgcaatccatcgccctcctggcccatttggctgaacgcgagaatatctggggcccattcctcattatctctcccgcttctactctaaacaattggcatcaggaattcacccgattcgtgccgaagtttaaagtgcttccttattgggggaacccccacgatcgaaaagtgatcaggcgcttctggagccagaagactctgtacacccaggacgccccatttcatgtggttatcaccagctatcagctggtcgtacaagatgtaaaatattttcagcgcgtcaaatggcagtacatggttctagatgaggcacaagccctcaaatcttcaagcagcgtgaggtggaagatcctactgcagttccagtgcaggaacagactgcttctgacaggtactcctatccagaacaccatggccgagctgtgggcccttctgcatttcatcatgccaaccctgttcgattcccacgaagagtttaacgaatggtttagtaaggacattgaaagccatgctgagaataaaagcgcaatagatgagaatcagctatctcgactgcatatgatcctgaaacccttcatgctccggaggatcaagaaagacgtggagaatgagttatctgacaaaattgagattctcatgtactgccagctgacatcacggcagaagctattgtaccaggctctgaagaacaagatcagtatcgaggatctgttgcaatcaagcatggggagcacccagcaagctcagaacacaacttccagtctgatgaatctggttatgcagttccgtaaggtttgtaaccatcctgaactcttcgagaggcaggagacttggagcccctttcacatttcacttaaaccatatcacatctctaagtttatctaccgccatggacagattagagtcttcaatcattctagggaccgctggctcagggttctatccccgtttgccccagactacattcagcggtcgctgtttcatcggaaaggaattaatgaggagtcatgtttttctttcctgaggtttatcgacatatctcccgctgagatggctaacctgatgttgcaagggctcctcgcccgatggctcgccctgtttctctctctgaaagccagctacagattgcaccaactacgatcatggggtgctcccgaaggcgaatcccaccagcggtatctgcgaaataaggactttctcctcggtgtcaatttcccccttagctttccgaacctgtgcagctgcccactcttaaagtcactcgtgttcagcagtcactgtaaggcggttagcggctacagcgaccaggtagtccaccagaggagatctgccacctcttctctgagacgatgcctcctgaccgagctgccttctttcttatgcgtggcatccccaagggtcaccgccgttccactggactcttattgcaacgacaggagcgctgaatacgaaagacgggtgctgaaggaaggaggaagcctagcagctaagcagtgccttctgaacggcgcacccgagctggccgcagattggctgaatagaaggtcccagttctttcccgaacccgcaggcggtctctggagcatcaggccgcagaatggttggtccttcatcagaatcccaggaaaagagagccttatcacggatagtggcaaactctatgcgcttgacgtattgctcacacggctaaagtcccagggacatcgggtgcttatctattctcaaatgacccgtatgatagacctgttagaggaatatatggtataccgaaaacacacgtatatgaggttggatggctccagcaagatttcagagcgcagagatatggtcgctgactttcagaacaggaacgacattttcgtctttctgctgagcacccgcgctggcggactcggcataaatcttaccgccgctgacactgttattttttacgactccgactggaacccaacggtggatcagcaagcaatggatcgggcacatagactgggccagaccaagcaagttacagtctatcgactgatctgcaaaggcaccatcgaagaacggattctccaacgcgctaaggagaaaagcgaaattcaacgcatggtgatttcaggcggtaacttcaaaccggacaccttgaaacctaaggaggtggtcagtctgcttttggatgatgaagagcttgagaaaaagctaaggctgcggcaagaggaaaaacggcagcaggaagagactaatcgggtcaaggaaaggaagaggaagcgcgaaaaatacgccgaaaaaaaaaaaaaggaggatgagctggacggcaaaagacgcaaagaaggcgttaacctggtgattccctttgtgccctcagctgacaactctaatcttagcgccgacggagacgatagcttcatcagcgtggattctgccatgccgtctcccttcagtgagattagtatctcttcagagctgcataccgggtcaattcccctggatgaatcctcctccgacatgctcgtgattgtcgacgaccctgctagctccgctcctcagtcgcgcgcaactaattctcccgcatccatcaccggctctgtatccgatacagtcaacggcatctctatccaggagatgcctgccgcaggcagggggcactcagcccgttcccggggacgccctaagggcagtggtagcactgccaaaggtgccggaaagggaaggtcgcggaaaagcaccgccggaagcgccgcagcgatggctggcgctaaggcaggggctgctgcggcttccgctgcggcatacgctgcctatggctataacgtgtctaagggtataagcgctagcagtcccctgcagactagcctcgtgcggcctgcaggccttgctgacttcggcccatcaagcgccagctcacccctctcctcacctctaagcaaaggaaataatgtgcctggcaatcccaaaaacctgcacatgacctcttccctggcacctgactctctcgtgcgaaagcagggcaaggggacaaatccaagcgggggtcgatag

SEQ ID NO: 226780 - DNA, 4671 bp, Artificial Sequence
  Description of Artificial Sequence: Synthetic coding sequence
atggcctctgagcttggcgctcgtgatgatggcggatgcacggagttggcaaaacccctgtacctgcagtaccttgaacgtgccttgcggcttgaccattttcttcgccagacatcagctatctttaatcggaacatctcttctgatgacagcgaagacggactggatgacagtaaccctcttctgcctcagtcaggagatcccctgattcaggttaaagaggaaccaccaaatagccttttgggtgagactagcggggctgggtcctccggaatgcttaatacatacagcctaaatggagtgctccaaagcgagtcaaagtgcgataaggggaacctgtataactttagtaagcttaagaagagtcgaaaatggctaaaatccatcctcctgtctgacgagagttcggaggccgattcacagagcgaagacgatgatgaggaagaactgaatttgagcagggaagagctgcataatatgctgaggctgcataagtacaaaaaattgcaccagaacaagtactcaaaagataaggaactccagcagtatcagtactattccgctggacttctgtcaacctatgaccctttctacgaacagcaaaggcatctgttggggcctaagaagaaaaaatttaaggaggagaagaagctgaaggctaagctgaaaaaggtaaagaaaaaaagaagaagggacgaggaactgagctccgaggaatcccctcggaggcatcaccaccagacaaaggtctttgctaagttcagtcacgacgccccacctccagggacaaagaaaaagcatctgtccatcgagcagctgaatgctaggcgtcgcaaggtatggctgtcaatcgtaaagaaagagctgccgaaggctaacaagcagaaggctagcgcccgaaacctgtttctcacaaattcacgcaagctggcccatcaatgcatgaaggaagttcggagagctgccctgcaggcacagaaaaattgcaaggagacactgccccgagcccgtagactgacgaaagaaatgctcctgtactggaaaaagtacgagaaagtggaaaaggagcatcgtaagcgcgctgaaaaggaagctctggagcaacgtaaactggatgaagagatgcgagaagcaaagaggcaacaacgtaaactcaatttcctcatcacccagacagagctctatgctcatttcatgagcagaaagcgggatatggggcatgatggcatccaagaggaaatcctgcggaagctggaggactctagtactcaacggcagattgatattggagggggagttgtagttaatatcacacaggaagattacgattcaaatcacttcaaagcccaggcactcaaaaacgctgagaatgcctaccacattcatcaagcgcgtaccagaagtttcgacgaagatgccaaggaatcccgagccgctgccctccgggcagcaaacaagagtggcaccggatttggagagtcctattcccttgcaaacccttcaatccgggcaggcgaggatatacctcaaccaacaatatttaacggcaagttgaagggctaccagttaaaggggatgaattggttggcaaacctctatgagcaagggatcaacggaatcctggctgacgaaatgggtctgggaaaaaccgttcagagtatcgccctattagcccacctcgcagaacgcgaaaatatctgggggccattcctgattatatccccagcatctaccttgaataactggcaccaggaattcaccagatttgtccccaaattcaaagttctgccatattggggtaatccacacgataggaaagtgatccggcgattctggagccagaagaccttgtacacccaagacgccccatttcacgttgttattacttcctatcaactcgtggtccaggacgtaaagtacttccaacgtgttaagtggcagtatatggtcttggacgaggcccaggcgctgaagtcatccagttcagttcggtggaaaatacttctgcaattccagtgccgcaatcggttgctcttaaccggcacccccatccagaacaccatggccgaactgtgggcattgttgcatttcataatgccaactctgtttgacagccatgaagagttcaatgaatggttttcaaaagatatcgagtcgcacgccgagaacaaaagcgcaatcgacgagaaccagcttagcagacttcacatgatcctgaagccctttatgctaagacgaattaagaaagacgttgaaaacgagctttctgataagatcgaaatattgatgtattgtcagttgacctcccgccagaagctcctataccaggcgctgaagaataaaatctccatcgaggatttactgcaatcctccatgggcagtacccagcaggctcagaacacaacaagctccctaatgaacctggtaatgcagtttcgcaaagtgtgtaaccatcccgagctcttcgagagacaggagacctggagccccttccacattagccttaaaccatatcacatctcaaaattcatctatagacacgggcagattcgggttttcaaccattctcgggaccgctggttgcgggtgcttagtccgttcgccccagattacatacagcgctcactattccatcgcaaaggcattaacgaggagagctgcttcagctttttgaggttcatcgatatctcccccgcagagatggctaacctgatgctgcagggtttgctggctcgctggctggccctgtttctcagtctgaaggcttcttataggctccaccagctgcgcagctggggcgcacctgagggcgaaagccaccaaaggtatctgaggaataaagatttcctgcttggtgttaatttccctctgtctttcccaaatctctgctcctgtccgctgttgaagagtctcgtcttcagttcgcactgtaaagccgtgagcggatactccgaccaggtggtgcaccaaaggaggtctgccacttcgtccttacggaggtgcttactaacagagcttcctagcttcctttgtgtggcaagcccacgggtcactgctgtacctcttgactcctactgtaatgatagatctgcggagtacgagaggcgggtactgaaagagggcggatccttagccgctaagcagtgcctgttaaacggtgctcctgagttggccgcagactggctgaacaggaggagccagttttttccagaacctgctgggggactctggtctataaggcctcagaatggctggagctttattagaattcctggtaaggaatcactgataacggacagcggcaagctatacgccctggatgtactgctgacaagactcaagtcccaagggcatcgcgtgctcatttatagccagatgacaagaatgatcgatctcctggaggaatatatggtctatagaaagcacacgtatatgcgactggatggatccagtaaaatcagcgaacgcagggatatggtcgccgattttcagaatcgcaacgatatttttgtgtttctgctgagcacccgagcaggtgggctggggattaacctgacagccgcagataccgttattttttatgacagcgactggaatcctacagttgaccagcaggccatggatagagcacaccgacttggccagaccaagcaggtgacagtttaccggctgatctgtaaggggacaattgaggaacgtatcctgcagagggcgaaggagaagtcagaaattcagcgtatggttatcagcggtggcaatttcaagccagatactctgaagcccaaggaggtcgtgagcctgctgcttgatgacgaggagctggagaagaaactgcgactgcgtcaagaggaaaagcgacaacaggaagagaccaaccgcgtaaaggagagaaagagaaagcgcgaaaagtacgccgagaagaaaaaaaaagaggatgaactggatgggaaaaggcgaaaggaaggcgtgaaccttgtgattccatttgtaccttctgcggataacagcaacctgtcggcagatggcgacgactcgttcatttccgtagatagcgccatgccaagcccgttcagcgagattagcatctcatcagaactacacactgggagcattccccttgatgagtcctcatctgatatgttggtaatcgtcgacgatcctgcatcgtccgcgccacagagtagggctaccaattcaccggcttcaatcacaggcagcgtttctgatactgtgaatgggatatcgatacaggaaatgcccgctgcagggagaggccacagcgcacgatctcgaggcaggcctaagggttctggatccacggccaaaggagcaggcaaggggcgatccagaaagtccaccgctggcagcgccgctgctatggctggagctaaggcgggagctgccgcagcctctgctgccgcatacgctgcctatggatacaatgtctccaaaggaatcagtgctagtagcccacttcaaacctctctggtcagaccggcaggtctagccgattttggaccttcgagcgccagctctcccctgagtagtccccttagcaagggtaacaatgtgcctggaaaccccaaaaacctgcatatgacctcttcactcgctcctgatagtctggtgcggaaacaagggaaaggcacaaacccgtccgggggtcgctag

SEQ ID NO: 226781 - DNA, 585 bp, Artificial Sequence
  Description of Artificial Sequence: Synthetic coding sequence
atggcagcttccctcgtaggaaagaagatcgtatttgtgaccggcaatgccaaaaagcttgaagaggtggtgcagatccttggggataaatttccttgcactctggtggcccagaaaattgacctgccagagtaccagggcgagcctgacgaaatctccattcagaagtgccaggaagcggttcgccaggtccaaggccctgtactggtagaagacacctgcctctgcttcaatgcccttggcggtcttcctggaccatacataaagtggttcctcgaaaaactgaaaccggaaggtctccatcagctgctcgccggattcgaagacaagagcgcctatgcactctgcacatttgctctgagcacaggcgacccgagtcaacctgtccgtctgtttcgcggacgaacctccgggagaattgtagctcccaggggttgccaggatttcggttgggacccatgctttcaaccagacgggtatgagcagacttacgccgagatgcctaaggcggagaagaacgccgtttcccacagattccgtgccctcctagagctgcaagagtatttcggaagcttagccgcttag

SEQ ID NO: 226782 - DNA, 462 bp, Artificial Sequence
  Description of Artificial Sequence: Synthetic coding sequence
atggccgcttcactggttggaaagaagatcgtgtttgtgaccggaaacgctaaaaagttagaggaggtccaaggcccagtcctggtggaggatacttgtctgtgttttaacgctctggggggtctcccgggaccatacattaagtggttcttggagaagctgaaacctgaggggctccatcagcttttggctgggttcgaggataagtccgcatacgccctgtgtacattcgctctaagcactggtgaccccagccagccagtgagactgtttcgaggcagaacatcggggagaatagtcgctccaagaggctgtcaagactttggctgggacccctgcttccagccagatgggtacgagcaaacctatgccgagatgcctaaagctgagaagaatgcggtcagccaccggttccgggctctattggaattacaggagtatttcggtagcctcgcggcttag

SEQ ID NO: 226783 - DNA, 534 bp, Artificial Sequence
  Description of Artificial Sequence: Synthetic coding sequence
atggccgcttctttagtagtgcagatcctgggagataagttcccctgtactctagttgctcagaagatagatctccccgagtatcagggcgaaccagatgaaatctctatccaaaagtgccaagaggcagtgaggcaggtacaaggtccggtgctggtggaagatacctgcctgtgttttaacgcactgggaggccttcccggaccatatattaaatggttcctggaaaagctgaagccagagggactgcaccagctgctggccggattcgaagataagtcagcctatgccttgtgtacttttgccttatctactggtgacccgtcccagcccgtgcgactgtttagaggcaggacttcagggagaattgtggctccaagaggatgccaagattttgggtgggacccttgcttccagcccgatggctacgagcagacttacgcagagatgcccaaggccgagaagaacgccgttagtcacaggtttcgggcactgctggagctgcaggagtattttggttctctcgctgcatag

SEQ ID NO: 226784 - DNA, 8231 bp, Artificial Sequence
  Description of Artificial Sequence: Synthetic coding sequence
atgtccgataaaatgagtagtttcctgcacatcggggatatatgcagtctgtatgcggaaggctcaacgaatggctttataagcactctgggcctcgtggacgacaggtgcgtggtgcagccagagactggcgatttgaataatcctcctaagaagttccgcgattgcctgtttaagctgtgcccaatgaaccgatacagtgctcagaaacagttttggaaagccgctaagccaggcgcaaattctacgaccgatgctgtcctgctcaataagcttcatcatgctgcagatttagaaaagaagcagaatgaaacagaaaatcgaaaattgctgggcacagtcatccagtacggcaatgtgattcagctgctgcaccttaaatcgaacaaatatttgaccgtgaataagcggttacccgctctactcgaaaaaaacgcaatgcgtgtgaccttggacgaggcaggaaacgagggatcctggttctacatccagccattctacaaactgaggtcaatcggggatagtgtggtgataggagataaagtggtgctgaacccagtgaacgctggtcaacctctgcacgccagcagccatcaactggtggacaaccccggttgcaatgaagtcaactccgttaactgcaatacttcatggaaaatagttctgtttatgaagtggtcagataacaaggacgacatacttaaaggcggagatgtggtacggctctttcacgccgagcaagagaaattcctgacatgtgacgagcacaggaaaaagcagcacgtgttccttcggactacaggacggcagtccgcaacatcggctaccagctccaaagccctctgggaagttgaggtggtacagcacgatccttgtagaggcggagctggctattggaacagtctatttaggttcaaacacctggcaactggtcattatcttgccgctgaggtggaccctgaccaagatgcgtcccgcagtaggctgcgcaacgctcaggagaagatggtctactccctcgtatcagtgccagagggcaatgacatcagtagtatatttgagctcgatcctacaaccttaagaggcggagatagcctggtacctaggaactcatatgtgcgtttgcggcatttgtgcaccaatacgtgggttcacagtacaaatattcccattgataaagaggaggagaaacctgtgatgctgaagatcggcacctctcccgtgaaggaggataaggaagctttcgccatagtgcctgtgtcaccagccgaggtgcgagaccttgactttgcaaatgatgcgtcgaaggtgctaggaagtattgctgggaaattggagaaaggcacaataacgcagaacgaaaggcgcagcgttacaaagctcctggaagatctagtttatttcgtgacgggcggtaccaattctggccaagacgtgttggaggtcgtcttctccaaaccgaacagggagcggcagaaactgatgcgcgaacagaacatccttaagcagatattcaagctactccaagcacctttcaccgactgtggcgatggaccaatgctgaggctcgaagagcttggcgaccagcggcacgcccctttccggcatatctgccggctgtgctatcgggttctgcgtcatagccagcaagattatcggaagaatcaggagtatatcgccaaacagttcggctttatgcagaagcaaatagggtatgacgtactcgctgaggacaccatcaccgcactcttacacaataacaggaagttactggagaaacatattacagctgcagagatcgacaccttcgtgtcattggtgaggaagaatagggagccccgtttcctggactatctgtccgatctgtgcgtgtctatgaacaagtcaataccagtcacccaggaattaatctgcaaagccgtcctcaatccaaccaacgcggatatactcatcgaaaccaaactcgtgctatctcgattcgagtttgagggcgttagttccacgggagagaacgccctggaggcaggcgaagacgaagaggaggtttggcttttctggagagactcaaataaagagatcagatcaaaaagtgtgagagaactcgcgcaagacgctaaagaggggcaaaaagaagaccgggacgttcttagctattatcgctatcagttgaatctgttcgccaggatgtgccttgatcgccagtatctggctatcaacgaaattagcggtcagctggatgttgatctgatcctgcggtgcatgagtgacgagaatctcccatacgatctgagagcatcattctgccgactgatgttgcacatgcacgtggaccgcgacccccaagaacaggtgaccccagtcaaatatgcgaggttgtggtccgagataccgtctgagattgccattgacgactatgactcaagcggcgcttccaaggatgagataaaagaacgctttgcccaaaccatggagtttgtggaggagtatctgagagacgtagtgtgccagcgattcccgttctcggacaaggaaaaaaacaagctgacatttgaggtggtgaacctagccaggaaccttatttatttcggcttttataacttcagcgatctccttcggttaaccaagatattgctcgctattctggattgcgtccacgtgacaacaatatttccaattagcaagatggccaagggtgaggaaaataagggaaataacgacgttgagaagctgaaatcctctaacgttatgagaagcattcatggtgtgggcgagctgatgacacaggtggtgctcagaggaggtggctttttgcccatgacccccatggcggctgcaccggaagggaacgtaaaacaggccgagcccgaaaaggaggatataatggtcatggacactaagcttaaaatcatcgagattcttcagtttatactgaacgtaaggctggattatcggatttcctgccttctgtgcatttttaagcgggagttcgatgagagcaactcccagacatcagagacatcgtccggcaattcttctcaggaaggaccctcgaatgtccccggagcccttgatttcgagcatatcgaagagcaggcagaagggatttttggcggatccgaggaaaataccccccttgacctggatgatcacgggggacgcacgttcctgcgggtcttgctgcatctgactatgcacgattatccacccttagtttccggagctcttcagcttctcttcagacatttttcccagaggcaagaagtactgcaggcctttaaacaggtacagcttctggtgacctcgcaggatgttgataattacaagcaaataaaacaggatttggaccagctcagatcaatcgtggaaaagtcagagttatgggtatacaagggccagggtcccgatgagacaatggatggcgcatctggcgaaaacgagcacaagaaaaccgaggagggcaacaataaaccccagaagcacgagtctacctccagctacaactaccgtgtggtgaaggagatccttattcgtctgtcaaaactctgcgtgcaggagtctgcctctgttcgcaagtctagaaagcagcagcagcggttgctgagaaacatgggcgcacatgccgtggtcctagaactgttgcagattccttatgaaaaagcagaagataccaaaatgcaggagatcatgagacttgcccacgagtttctacaaaacttctgtgcgggtaaccaacagaatcaagccctgctccataagcatatcaatctgttcctaaacccgggaatactggaggcagtaactatgcaacacatctttatgaacaacttccagctgtgttctgaaataaatgagcgcgttgttcagcacttcgttcactgtatcgaaacacacggtcgcaatgttcagtacattaagtttttacagaccattgtgaaggctgagggcaagttcatcaaaaagtgtcaggatatggtaatggcagaactggtgaacagcggcgaggacgtcctggtgttctacaatgaccgcgctagcttccagactctgatacagatgatgcgaagtgagcgagatcggatggacgaaaactcacctctgatgtaccacatacacctggtggagctgctggctgtgtgcactgaggggaaaaatgtgtacaccgaaattaaatgtaattcactcctcccgcttgacgatatcgtgcgtgttgtcacacacgaggactgtattcccgaagttaagatcgcctatatcaattttctaaaccactgctatgtagacacagaggtagagatgaaagaaatatatacttccaaccatatgtggaagctgttcgagaatttcctggttgatatttgccgtgcatgcaataacacgagtgatagaaaacacgccgattctatcctcgagaaatacgtcaccgaaattgtcatgagtattgtaacaacgttcttcagctcccccttctccgatcagagcacaaccttacagactcggcaaccagtcttcgtccagttactgcagggcgtattcagggtctatcactgcaattggctgatgccttcccagaaggctagtgtggaatcatgcatcagagttctgtccgacgtggcgaagtctagagccattgcaatccccgtcgacctggactcacaggtgaataatctgtttctcaagtctcatagcatcgtccagaagacagcaatgaattggagactgtcagcccgaaacgctgccagacgtgattctgtgctggctgcttcccgggactatagaaacataattgagcgtttgcaagacatcgtaagcgcactggaggatcgactgagacccctagtgcaagcagaactctcggtcctggtcgatgtcctgcacaggcccgaactgctcttccccgagaacactgacgctcgcaggaagtgtgaatccggaggcttcatctgtaagttgattaagcatactaaacagctgttagaggagaacgaagagaaactgtgcattaaggtgctacaaacacttcgggagatgatgacaaaggacagagggtacggagaaaaactcatttcgatagatgagctggataacgccgagttaccacccgctcctgactcagagaacgctacagaggagctggagccctcacccccactgagacaactggaggatcacaaacgaggtgaagcactcaggcaagtcctggtgaacaggtactacggaaacgtaagacccagcggaaggagggagtcactaacatctttcgggaatggtcctttgagcgccggaggaccaggcaaaccaggcggtggcggtgggggatctggatcttcgtctatgagcagaggagagatgagcctggccgaagtgcagtgccaccttgacaaagaaggagcctccaacctagtcattgatctgattatgaatgcgtcttccgatagagtgttccacgaatcaattctgttggccatcgcactgttggaaggtggcaacactactatccagcattcattcttctgccgactgacggaggataagaaaagtgagaagtttttcaaagtcttttacgacagaatgaaggttgctcaacaagagatcaaagccacagtgaccgtcaacacgtcggatttaggcaataaaaagaaagacgatgaggtagatcgagatgccccttcccggaaaaaggcaaaggagcccacaacccaaatcaccgaagaagtgcgggatcagctgttggaagcttcagccgcaacacgcaaagcctttaccaccttccggcgagaggccgacccagatgaccactatcagccaggcgaaggaactcaggccacagcagataaagccaaggacgatctcgaaatgtccgccgtgattaccatcatgcagccgatactgagatttctacaattactgtgcgaaaatcacaacagagatctacaaaactttctgagatgccagaacaataaaaccaattataacctggtgtgcgagactctgcagtttctggactgcatatgtgggagcactacgggaggcttgggcttgctgggtctctatattaacgagaagaacgttgccctcattaaccagactctggaatccttaaccgagtattgtcagggcccatgtcacgagaaccagaattgtattgcaacccatgaaagtaatggtatagacatcatcactgctctgattctgaacgatatcaatcccttggggaagaagcgcatggatctggtgcttgaactgaagaacaatgcctctaagttgctgctggctattatggaatcccgccatgatagcgagaacgctgagaggatcttgtataatatgcgccctaaagaactggtggaggttattaaaaaggcatacatgcaaggagaggtggaatttgaggacggtgaaaacggcgaagacggggcagcttcaccgcgaaacgtcggccataatatctatatcctagcacatcagctggcgagacataataaggagctgcagtcgatgctaaagcccggaggtcaagtagatggggacgaagccttagaattttacgcgaagcacaccgcacagattgaaattgtcaggttggacagaaccatggagcagatcgtgtttcctgtaccgtcaatctgtgagttcctgacaaaagaaagcaaactgcgaatatactacaccaccgaaagagacgagcaaggcagcaagattaatgatttcttcctcaggtcagaagacctcttcaacgagatgaactggcagaagaagttacgagctcagcccgtgctatattggtgtgctcgcaatatgtccttttggagctccattagttttaacctggctgtgctgatgaacctattagttgcctttttctacccatttaagggggtgcgcggaggaacgctcgagccgcactggtccggcttgctctggaccgctatgctcatcagccttgcaatcgtgatcgccttacctaaaccccacggaatacgcgctctcatagcctcgacgatcttgcggctgatattttccgtgggtctacaacccaccctgttcctgctcggagcctttaatgtctgcaataagataatcttcctcatgagtttcgtgggcaactgtggtacgttcactagggggtaccgagccatggtgttggacgtagagtttctgtatcatctgctgtacttagtcatttgcgctatgggccttttcgtccacgagtttttctactcactgttactgttcgacctggtttatcgggaagaaactctgttgaacgtgattaagagtgtgacaaggaacggacgaagtatcatcttgacggcagtccttgctctgattctcgtgtacctcttctctatcgtgggctacctgttctttaaggacgacttcatcctggaggtagatcggttaccgaatgagacagccgtcccggagacaggggagagtctggcttctgaattccttttcagtgatgtatgtcgcgtagagagtggtgagaactgctccagccctgcaccccgtgaagagttagtacctgccgaagaaacggagcaggacaaggagcacacgtgcgagactcttttgatgtgcattgtgacagtactgtcacatggcctcaggtcaggaggtggggtcggcgacgtgctgcgtaaaccatccaaggaggagcccctctttgctgccagagtaatatacgatctgctcttcttctttatggtcattataatcgtcttgaatttaatttttggcgtaatcatcgataccttcgcagacctccgctctgagaagcaaaagaaggaggagattctcaagactacctgcttcatatgcggcctcgaaagggacaaatttgacaataaaacagtaacttttgaggagcacattaaggaggagcacaacatgtggcattatttgtgttttatagtgttggttaaggtgaaagatagcacagaatacacaggacccgagagttatgttgccgagatgattaaagagaggaatttggattggtttccaaggatgcgggctatgagccttgtaagctctgatagtgagggtgagcagaatgaactacggaatctccaggagaaactcgaatcgaccatgaaactggtcactaatctgtccggccagctgagcgaactcaaagatcaaatgaccgaacaaaggaaacaaaagcagcgaattgggttgctcgggcatcccccacatatgaacgttaatccccagcagcccgctta

SEQ ID NO: 226785 - DNA, 8231 bp, Artificial Sequence
  Description of Artificial Sequence: Synthetic coding sequence
atgtctgacaagatgtcctctttcctgcatatcggagatatttgttccctgtacgcagagggctcaaccaatggatttataagtacactgggactagtcgacgatagatgcgttgtgcagcctgaaacgggtgacttaaacaaccctccaaagaagttccgcgactgcctctttaagctgtgtccgatgaaccggtatagcgcacagaaacaattctggaaagccgctaagccaggcgcaaattctaccaccgacgctgtcttgttaaataagctgcatcacgccgcagacctggagaagaaacagaatgaaacagagaaccgtaagctcctcgggactgtgatccagtatggcaatgtgatccagttactacatctgaagagcaataaatacctcacagttaataaaagacttcccgcattgcttgagaagaatgccatgcgggtgacgttggacgaagccggaaacgaggggtcctggttctatatacagcccttttacaagttgagatccataggcgactccgtggtgatcggggacaaagttgtactgaacccagtgaacgccggacagccgttgcacgcttcctctcatcagttggtggacaatcctggatgcaacgaagtgaattccgtgaactgtaacacctcctggaagatagtattgttcatgaaatggagcgataataaagacgacatactgaagggcggtgacgttgtgcgcttgttccacgctgagcaggagaagttcctcacctgcgacgaacatagaaagaagcagcacgtctttctgcggacaactggacgccaaagtgcaacctcagcaacaagctctaaggccttgtgggaagtcgaggtcgtccagcacgatccatgcagaggcggtgctggatattggaattcgctctttagattcaaacatctcgcaacaggtcactatttagctgctgaagtagacccagacttcgaggaggagtgcttggaattccaaccgagtgtggacccagatcaggatgcatctcggagccggcttagaaatgctcaggagaaaatggtctacagcttggtttccgtgcccgagggtaacgatatcagttccatctttgagctagatccaaccacacttcgaggaggcgactccctcgtgccacgcaattcttatgtccgacttaggcacctgtgcacaaacacatgggttcatagcactaacatacctattgacaaagaggaagagaaacccgtgatgctgaagattggtaccagccctgttaaggaggataaagaggcgttcgcaatcgttccggtcagtccagccgaggtgagggacttggacttcgccaacgacgcatctaaggtgcttggtagcatagccggtaaactggagaagggaacaataacccagaatgaacggcgatccgtgacgaaactgctcgaggacctggtttactttgtgactggcggtaccaactcaggacaggacgttctcgaggtggtctttagcaagccaaaccgggagcgccagaaacttatgagagagcaaaatattctcaaacaaatttttaagctactgcaggcgccttttactgactgtggcgatggcccaatgctcagacttgaggagcttggagaccagaggcacgcccctttccgtcatatttgtcgcctgtgctatcgtgttttgagacattcacagcaggactaccggaaaaaccaagaatacatcgctaagcaattcgggtttatgcaaaagcagattggttacgatgtcctggctgaggataccattacagctctgctccataataatcgcaagcttttggagaagcacattaccgctgcggagattgatactttcgtgagcctagtaagaaaaaacagagagccacgcttcctcgactatctctccgacctctgcgtgtccatgaataaaagcatcccagtgacccaggaattaatatgcaaggccgtcctgaatccaactaatgctgacatactgattgagacaaagttggtgttgtctcgattcgagtttgagggggtgtcctccactggagagaatgccctggaggccggagaagatgaagaagaagtatggctcttctggagggacagcaacaaagagatcaggagcaagtccgttcgggaactcgcccaagatgccaaagaaggccagaaggaggatcgagacgtgctgtcttattaccgctaccagctgaacctgttcgcgcgaatgtgtctggacaggcagtacttggcgatcaatgaaatatccggccagctagatgtggatctgattctcaggtgtatgtccgacgagaacctgccttacgacttaagagctagtttttgccggttgatgctccacatgcacgttgacagggatccccaggaacaggttacacccgtgaaatacgcgcgtctgtggtccgaaatcccatctgaaattgccattgacgactatgactcttctggagccagcaaggacgaaataaaggagagatttgcccaaactatggaattcgtggaggaatatctgagagatgtggtctgccagcgcttccccttctccgacaaagaaaagaataagcttaccttcgaagtagtgaatctggctcggaatctgatatatttcggcttctacaatttctccgatttgctccggctgactaagatcctactagccattctggactgcgtccacgtgaccaccattttcccaatctctaaaatggccaagggcgaggaaaataaaggaaacaatgacgtggagaagttgaaaagctctaatgttatgcggtccatccatggagttggcgagttgatgacgcaagtggtcctccgcggtgggggttttctcccaatgaccccaatggctgccgcaccagaggggaacgtgaaacaggctgagccagagaaggaagacataatggtgatggatacaaaactgaagattattgagattcttcagtttattttgaacgtgagacttgattatagaatttcctgtctcctgtgtatctttaaacgcgagtttgatgagtccaattcacagacctctgaaactagttccgggaactcaagccaggagggcccaagcaacgtgcctggggctttggacttcgaacacattgaggaacaggctgaaggcatttttggcggaagtgaagagaatacaccactggatctcgacgatcacggcggtagaacatttctgcgtgtactgcttcaccttacgatgcacgattacccacccctggtgtctggagctttgcagctactgttccgccacttcagccagcggcaggaagtactgcaggcctttaaacaggtccaactgctggtgacaagtcaagatgtggataactataagcaaataaaacaggacttagaccagctcaggtcaatcgttgaaaagagtgaactctgggtgtataaaggccagggaccagacgagactatggatggggcaagtggcgaaaatgaacataagaagacagaagagggcaataacaagccgcagaaacatgagtctacaagtagttacaactatcgtgtcgtgaaggaaatcttaatcaggctctcaaaactgtgcgttcaggaatctgcaagcgtgaggaagagcagaaaacagcaacagcggctgctcaggaacatgggggctcacgcggtggtgctggagttgctgcagattccttatgagaaagctgaagacacgaagatgcaagaaatcatgaggctagctcatgaatttttgcagaatttctgtgctggtaatcaacaaaaccaggcccttcttcacaagcatatcaatctcttcctgaatccgggtatccttgaggcagtgactatgcaacatatctttatgaataacttccagctctgttcagagatcaacgagagagtcgtgcagcattttgtccactgtatcgagactcacggaagaaatgtgcagtacatcaagttccttcagacgatcgtgaaagcagaaggcaagtttatcaagaaatgccaagatatggttatggcggagctcgtaaattccggggaagacgtgctcgtattctataacgatagagcttcatttcagacactgattcagatgatgcggtctgaaagagaccgcatggacgaaaactccccacttatgtatcacattcacttagtggaactgctggcggtgtgcactgaggggaaaaacgtatacacggaaattaagtgcaactccctgctccccctcgacgacattgtacgggttgtgactcatgaggactgcattcccgaagtgaagattgcttatatcaacttccttaatcactgttatgttgatactgaggtcgagatgaaagaaatctataccagtaaccacatgtggaagttgtttgagaacttccttgttgacatatgcagggcttgcaataatacttcagatcgaaagcatgccgatagtatcctggagaagtatgtaactgaaatcgtgatgtctattgttactactttttttagctccccattttctgaccaatccaccaccctgcagacgagacagccagtgttcgttcagctcttgcagggagtattccgcgtctatcactgtaactggctcatgcccagtcagaaggccagtgtggaatcgtgcattcgggtattgtcagacgtggctaagagccgggctattgctatcccggtggatctcgattcccaggttaacaacctgtttctgaagtcacactcaatcgtgcagaagaccgccatgaactggcgcctgagtgccagaaatgccgctaggagggactctgtgcttgcagccagcagggactatcggaatattattgagcgcttacaagatatcgtgagtgccctcgaggacagactgcgccctttagtgcaggccgaactgtcagtactggtagacgtcttgcacagaccagaattacttttccctgagaacaccgatgcccgacggaaatgcgagagcggaggatttatatgcaagttgattaagcacaccaagcagctcttggaggaaaacgaagagaagctgtgcattaaggttttgcagacactgagggaaatgatgaccaaggatcgcggatacggcgagaagctgatcagtatagacgagctggacaatgccgaattaccccctgcacccgattccgagaacgcgacagaaaaaggggaagcactcagacaagtgctggtgaaccggtactacggaaacgtgaggccatccgggaggcgggaatcactgacttcgtttggcaacggaccgctatccgccggagggccagggaaaccaggcggaggcggaggagggtctggaagctccagcatgagccggggagagatgtctcttgccgaagtacaatgccatttagacaaggagggggcatctaacctcgttatcgatttgattatgaacgcatcttccgacagagtcttccatgagagcattctccttgctatcgcccttctggagggaggcaacacaacgatacaacactcttttttctgtcgcttgactgaggataagaagtcggagaagtttttcaaagtcttctatgatagaatgaaggtggctcagcaggagataaaagcgaccgtgacagtaaacacttctgatcttgggaataagaaaaaagatgacgaggtggatcgagacgctcccagcaggaaaaaggccaaggagcccacaacacagattacagaagaggtgcgtgaccagctgttagaggcaagcgctgctactagaaaagcattcaccactttccgtcgtgaagcagatcccgacgaccactatcagcctggtgagggtactcaggcaaccgccgacaaagccaaagacgatctcgaaatgagcgcggtcattacaattatgcagccgattctgcggtttcttcagctgctgtgcgagaaccacaatcgcgacctccaaaattttctgcggtgccagaataacaaaaccaactacaaccttgtgtgcgaaacattacagttccttgattgtatctgcggatccacaacaggaggtctaggactcctgggattgtacatcaacgaaaagaatgtggctctaataaatcagactctggaatcgctgacagaatactgtcagggaccctgtcacgaaaaccaaaattgtattgctactcacgaaagcaatgggatcgacattataactgcgttgatcttaaatgacattaatccactcggcaaaaagaggatggatctggtgctggagttaaagaacaacgcaagcaagcttctgctggccatcatggagagtcgccacgattctgaaaacgctgaaaggatcctatataacatgagacccaaggagctggtggaggtgattaaaaaggcatatatgcagggcgaggtggagtttgaggatggggagaacggcgaggatggcgcagcatcgccgaggaacgtgggccataacatctatatcctggcccatcagctcgctaggcacaacaaggagctgcagagcatgctcaagccgggaggacaagtagatggcgacgaagcactggagttctatgccaaacacacagcccagattgaaattgtgagactagaccgcacaatggagcagattgtgtttcctgtgccctccatttgcgaattcctaactaaggagtctaaactgcgaatctattatacaacagaacgagacgaacaggggtctaagataaacgactttttcctcaggtctgaagatctcttcaacgagatgaattggcagaaaaagttaagggcccagcccgtgctctattggtgcgcaaggaatatgtccttttggagcagcatcagctttaacttggcggtcttaatgaatcttctcgtggcgttcttctatcccttcaaaggcgtcagaggtggcacactcgaaccccattggtccggcctactgtggacagctatgctaataagccttgcgatcgtgattgcactgcccaagccccatggcatccgcgctctgatcgcatccacaatactgcggttaatcttttccgtcggcctacagcccactctctttctgttgggtgcatttaatgtttgcaataagattatcttcctgatgtctttcgtgggcaattgcgggacgttcacccgcggttatagggccatggtgctggacgtggagttcctgtatcatctgctgtatctagtaatctgcgccatggggttgttcgtgcacgaattcttttactcgttgcttctattcgatctagtctaccgtgaagaaacactactcaatgtcataaagtcagtcacaagaaacgggaggagcattattctgactgcagtgcttgccctgatcctggtctatctgttttctatcgtagggtacctgtttttcaaagacgactttatcttagaggtggaccggcttccaaatgagacagctgtgccggagacgggtgaatccctggcatcagagttcctctttagcgacgtctgccgggttgaatccggggaaaactgtagcagtccagctccaagggaggagctggtccctgcagaggaaactgagcaggacaaagagcacacttgcgaaacgttactgatgtgcattgttaccgtcctgagtcatgggctgcggtccggagggggagttggggacgtgcttcggaagccaagtaaggaggagccccttttcgccgcaagagtgatttacgacctcctttttttcttcatggtgattattatcgtgctcaatctgattttcggagtaattatcgatacttttgccgaccttcggagtgagaagcagaaaaaggaggagatcctgaaaaccacttgctttatctgcggtctagagcgggacaaatttgataataagacagtgacttttgaagagcacatcaaagaggaacacaatatgtggcactacctttgctttatcgtactggtcaaagttaaagattctactgaatataccggtcctgaatcttacgtggcagaaatgattaaggaaagaaatcttgattggttcccccgaatgagagcaatgagccttgtgagtagcgacagcgagggcgagcaaaacgagttgcggaacctacaagagaagctagaatccacaatgaaactcgtgacaaacctaagtggccaactgtcggaactgaaggatcagatgaccgaacaacggaagcaaaagcagagaataggactgctgggtcatccccctcacatgaatgtaaacccccagcaaccggcata

SEQ ID NO: 226786 - DNA, 8276 bp, Artificial Sequence
  Description of Artificial Sequence: Synthetic coding sequence
atgagtgacaagatgagttccttcctgcatattggtgatatatgtagcctgtatgctgaggggtcaacaaatgggtttatatccacactggggcttgtggatgatcggtgcgtggtccagcctgagaccggagatctgaataacccaccgaagaaattccgggactgcctgtttaaactgtgtccaatgaacagatacagcgcccagaagcagttctggaaggccgctaagcctggcgctaactccacgactgatgcggtgctgctaaataagttacatcatgcagcagaccttgagaagaagcagaatgagaccgaaaaccgtaagttgctgggaacagtgattcagtacggcaacgtgattcaactgctacatctcaagagtaataagtatttaactgtgaataagcgattacccgcactccttgaaaaaaacgccatgagagtcacgctcgatgaggcagggaatgagggctcctggttttatatccagcctttttataagctccgttccatcggggactcagtagtcatcggggacaaggtggtgctgaaccccgtcaacgccggtcagcccctacacgccagttctcatcagctggtggataacccaggctgtaacgaggtgaatagtgtgaattgtaatacgtcctggaaaattgtactgttcatgaaatggtcagataacaaggacgacattcttaaggggggtgacgtggtcagattatttcacgccgaacaggagaaatttctaacttgcgacgagcaccggaagaagcagcatgtgtttctgcgcaccaccggcaggcagagtgccacatctgccacgagcagtaaagcactgtgggaggttgaagtagttcagcacgatccatgccgcggaggtgcgggatattggaattctctgtttcggttcaagcacctggccacgggccactacttggcggcagaggtggaccccgattttgaagaagagtgtcttgagttccagccgagtgtggaccctgaccaagatgctagtaggtcaaggctccgcaacgctcaggagaagatggtttacagcttggtgtccgttcccgagggtaacgacatcagttccatcttcgagctggatccaacaaccctgagaggaggcgattctctggtgcccaggaactcctacgtgcgcctgagacacctctgcacaaacacatgggtccactctactaacatacctatcgataaggaggaggagaagccagttatgttaaagattggcacaagtcctgtcaaggaagacaaggaagcgttcgcgatcgtccctgtgtcccccgctgaggtgagagaccttgatttcgccaacgatgcttctaaagtactggggagtatcgcaggaaagttggaaaagggaacaattacacaaaacgagaggcgctccgtcactaaattgttagaagatctggtgtacttcgttaccgggggtactaattccggacaggacgtgcttgaagtggttttctcaaagcctaacagggagaggcagaagctcatgcgggagcagaatattctcaagcagattttcaagctgttacaagctccttttacggactgcggtgatggacctatgctgcgacttgaggaactgggtgatcagcggcacgcccctttcaggcacatctgtcgtctttgttatcgcgtgctaagacatagccagcaggattatagaaaaaatcaggagtacatagccaagcagtttggatttatgcagaaacagatcggatatgacgtgctggctgaagataccataactgcccttctgcacaataatcgtaaactgttagagaagcacattaccgctgccgagattgacaccttcgtgtctctcgttcgcaaaaacagggaaccccgattcttggattatctgtctgacctctgcgtcagcatgaacaaatctataccagtgacccaagaactgatctgtaaagccgtactcaatcctaccaacgctgacattcttatcgagacaaagctggtcctttctcggttcgaattcgagggagtaagcagtacaggcgaaaacgcactcgaggctggcgaggatgaagaggaggtctggttgttctggagagacagcaataaggagattagaagtaagtccgtccgcgaactggcccaggacgccaaagaggggcagaaggaggacagggacgtcctgtcgtactataggtatcagctcaatcttttcgctagaatgtgcctggatagacaatatctggctatcaatgagatctctggtcaactcgatgtggacttgatactgaggtgcatgtccgatgagaatcttccctatgatctaagggccagtttttgccggcttatgcttcacatgcatgtggaccgtgacccccaggaacaggtaacacccgtgaagtatgccagactgtggagtgaaatacctagcgagattgctattgatgactatgactcttccggcgcttctaaggatgagataaaggaacgcttcgcgcagacgatggaatttgtggaagaatacctgagggatgtagtgtgccaacggttccccttctccgacaaggagaagaataagctgaccttcgaggtcgtcaacctcgcgcgaaatctgatctatttcggtttttataactttagtgacctgttgcgactaactaagattctactggccatcttggactgtgttcatgtcacaaccatttttccaatttctaaaatggcaaagggcgaagagaacaaggggaataacgacgtcgagaagctgaagagttccaatgtcatgcgttctatccatggggtgggagaactaatgactcaagtcgtcctgcgagggggtggtttcctgcctatgacccccatggctgccgctccagagggcaatgtgaaacaagctgaacctgagaaggaggacatcatggtcatggataccaaactgaaaattattgaaattcttcagttcattctgaacgttcgcttggactacagaatttcttgtttgctctgcatattcaagagggaattcgatgagagcaattcacagacaagcgaaacgtcttccggaaacagttcccaggaaggcccttccaacgtcccgggagccttagactttgaacacatcgaagaacaagctgagggaatttttggcggatctgaagagaatacaccattggatttggatgatcacggcggaaggacgttcctgagggttcttctccacctgacaatgcatgattatcccccacttgtgtctggagcactacagttgcttttccgacattttagccagcgccaggaagtgttgcaggcgtttaaacaggttcaactcttagtgaccagtcaggatgtagataactataagcagatcaaacaggaccttgatcagttgagaagcatcgtggagaagtccgagctctgggtctacaaaggacagggacccgacgaaaccatggatggcgcttctggggaaaatgaacacaagaaaactgaggaagggaacaataaaccacaaaagcatgagagtacgagttcctataattacagagtcgttaaggagattttgatcaggctcagcaagctgtgtgttcaagagagcgcctcagtgcgcaagtctagaaaacagcagcaacgcttgctgcgaaacatgggcgcacacgctgttgtgctcgagctgttacagattccctacgagaaggcggaggatactaagatgcaagaaattatgagactggcacacgaatttttacaaaacttttgcgctggcaatcagcaaaaccaggccttactgcacaaacatattaatctgtttttgaacccgggaatcctagaggcggtgaccatgcaacatatcttcatgaataattttcagctgtgttccgagataaacgagcgggtggtccagcatttcgttcactgcatcgaaacacatggtaggaatgtgcagtatattaaatttttgcagacaattgtgaaagccgaggggaagtttatcaaaaaatgccaggatatggtgatggcggaacttgtgaacagcggggaagatgtcctggtgttttacaatgaccgcgcaagctttcagactctcatacaaatgatgagatccgaacgcgatcggatggatgagaattctcccctcatgtatcatatccatctggtggagctgcttgccgtttgtaccgaggggaagaacgtgtacacggagataaagtgcaacagcctcttgcccctagacgacattgtgagagtggtcacccacgaggattgcattcccgaggtcaagatcgcctacatcaactttttgaaccactgttacgtcgacactgaagtggaaatgaaggagatttatacctctaaccatatgtggaagttgttcgaaaactttctggtcgacatctgccgcgcatgcaacaatacctctgaccgaaaacacgcagactcaattctggaaaagtacgtgaccgagatcgtgatgagcatcgtcaccacatttttttcatcccccttctctgatcagagcaccactctccagaccaggcagcccgtgtttgttcagttactccaaggcgtctttcgggtttaccactgcaattggctgatgccctcacagaaggcatcagttgagtcatgcattcgggtactgagcgacgtggcaaaatctcgagccattgctatcccggtcgaccttgattcacaggtaaacaatctctttttgaaatcccatagcatcgtccagaagacagctatgaactggcggctgtccgctagaaacgctgcacgacgcgacagtgtgttggccgcaagcagagattacagaaacattatagaacggcttcaggacattgtgtctgccctggaagataggctgcggcctctggtgcaggcagaactgagtgttctggtggatgtacttcacagacctgagttgctgttcccggaaaacaccgacgcccgacgtaaatgtgagagcggaggttttatttgcaaactaattaagcatactaaacagctcctggaagagaatgaggagaagctgtgtattaaggttctccagacactgcgagagatgatgacgaaggacaggggttacggcgagaagctcatctccattgatgagctagataacgccgagctcccgcctgcacccgattctgagaacgctaccgaagaactggaaccatcacccccacttcgacagctggaggatcacaagcgaggtgaggcattgagacaagtgttggtgaatcgatactatggtaatgtgaggcccagtggaaggcgggaatctttaacaagtttcgggaatgggccactctcagcaggtggccctggtaaacctggtgggggaggcggaggttctggcagtagctcaatgagcaggggagagatgtcacttgccgaggtccagtgccacttagacaaggaaggcgcttcaaatctggtcatagacttaattatgaacgcctcatctgatcgtgttttccacgaatctatcttattggccatagcccttttggagggcggtaacactacaatccagcacagttttttttgccgattaaccgaagacaagaagagcgaaaagttctttaaggtattttacgatcggatgaaggtggcgcaacaggagatcaaagccacagtcaccgtgaatacctcagatctgggcaacaaaaaaaaggatgatgaagtcgaccgagatgcaccttcgcggaaaaaagccaaggagcccaccacccagataaccgaggaggtgcgagatcagctgctggaggcgtcagctgccacaagaaaagctttcactacttttaggcgggaagcggacccagacgatcattatcagccgggagaaggcactcaggctaccgctgataaagcgaaggatgaccttgaaatgtccgccgtgattacgattatgcagcctatcctacgattcctacagctattgtgcgagaatcacaatagagacctgcagaacttcttgcgctgccagaataataagaccaactacaatctggtctgtgaaaccctgcagtttctagactgcatttgcggttcaacgacaggaggcctgggcctgttaggcctttatattaacgagaagaatgtagccctgatcaatcagacattggaatccttgacagagtattgtcagggaccctgtcacgagaatcagaattgcatcgccacccatgaatccaatggtatagatatcatcacagccctgatactcaatgacatcaatcccctgggtaaaaaacgcatggatctggttctcgagcttaagaacaatgccagtaagttactgctggcgatcatggagagtagacacgactccgaaaatgccgagcgcatcctctataacatgcgccctaaagaactcgtagaagtgattaaaaaggcatatatgcagggagaggtcgagttcgaagacggagaaaatggagaagatggcgctgccagcccaaggaacgtcgggcataacatttatattctggctcatcagctcgcaagacataataaagagcttcagtctatgctgaaacctgggggacaggtcgacggtgatgaagccctagaattctacgctaaacatacagctcagatcgagatcgtccgactggacaggaccatggagcagatagtcttccccgtccccagtatttgtgagtttttaactaaggagtctaagctgcggatctattacaccacagaaagagatgaacagggcagcaaaattaatgatttctttttgcgctctgaggatctattcaacgagatgaactggcagaagaagttgagggcccagcccgtcctgtactggtgcgcgaggaacatgagtttctggagctccatctcattcaatctcgccgtgctcatgaacctgctggttgcattcttctatccttttaagggcgtgagaggaggtaccctcgagccccattggtcgggcctgctctggaccgccatgctgatatccctggcgatcgtcattgccctacccaaaccccatggaattcgggctctgatagcttccaccatcctccggttgattttctctgtgggcttgcaacctaccctatttctcttaggagccttcaatgtgtgcaacaagattatttttctcatgagtttcgttggtaactgtggaacctttacacgtggttatcgcgctatggttctggacgtggagtttctctatcatctcttgtacctcgtaatttgcgccatggggttattcgttcacgagttcttttattctctcttgctgttcgatctagtctacagagaggagaccctccttaacgtgataaaatctgttacacgcaatggcaggtcgatcatcctgaccgctgtcctggccttgattctcgtatatctctttagcatcgtgggttatctgttctttaaggacgatttcatcctcgaggtggatagactgcccaacgaaacagccgttcctgagactggtgagagcctcgctagcgaatttttattctcggacgtgtgcagagtcgagagcggcgaaaactgctcaagccccgctcctcgcgaagagcttgttcccgcagaggagactgaacaggataaggaacatacttgtgaaaccctgttaatgtgcatagtcaccgtgctgtcacacggtctgcgctccggcggaggggtgggcgacgtgcttcgaaagcccagtaaggaggaaccgctcttcgccgctcgagtgatctacgatttgctttttttctttatggtgataataatcgtgcttaacctgatcttcggcgttattattgatacatttgctgatctacggtctgagaaacagaaaaaggaggagatcctgaaaacgacctgttttatttgcgggcttgaacgtgataagtttgataataaaactgtgacgttcgaagagcacatcaaagaggagcataatatgtggcactacctttgcttcatagtcctagtgaaggtcaaggactcaacagaatacacagggccagaatcgtatgtcgccgagatgatcaaagaacgtaatctggattggtttcccaggatgcgggcaatgagtctcgtcagttcagactctgagggcgaacagaacgagctcagaaatctgcaggagaagcttgagtccaccatgaagttggtgactaacttgagcgggcagctttcagagctgaaggaccagatgacagagcagagaaagcaaaaacagagaattggattgctcggacaccctccacatatgaatgtgaacccccaacaacccgcata

SEQ ID NO: 226787 - DNA, 8132 bp, Artificial Sequence
  Description of Artificial Sequence: Synthetic coding sequence
atgtcagataagatgtccagcttcctgcacataggcgacatatgttctctgtatgccgagggatcaacaaacggttttattagcacccttggtctggtagatgatcgatgcgtagtccaacctgaaaccggcgacttgaataaccctccaaagaagtttagggattgcttgttcaagctgtgccctatgaaccgatactcagctcagaaacaattctggaaagcagccaagcctggtgccaactccacgactgacgctgtcttactaaacaagctgcaccacgctgctgatctcgaaaagaagcaaaatgagacagaaaaccggaagctgctggggaccgtgattcaatatggtaatgtgattcaattactgcacctgaaatccaacaagtacctgacagtcaacaaaagacttcctgcacttcttgagaaaaacgcaatgcgtgtaaccctcgatgaagctggcaacgaagggagctggttctatatccaacctttctacaagctaagaagcatcggcgattcagtcgtcatcggagacaaagtcgttttgaaccctgttaacgcaggccagccattgcacgcttctagtcaccaactggttgataaccctgggtgcaacgaggtcaattcagttaactgtaacacctcgtggaaaatcgtactttttatgaaatggagcgacaataaggacgatatattaaaaggaggagacgtggtacgtctctttcatgccgagcaggaaaagttcctcacctgcgatgaacacagaaagaagcagcacgtgtttctgcgcacgacaggtcgccagtccgcaacttccgccacttcttcgaaagctttgtgggaggttgaggtcgtgcaacacgatccatgccgtgggggagcgggttattggaacagcctctttaggttcaagcatttagcgactggtcattatttggccgcagaggtggatccagacttcgaggaggagtgcctggagttccagccttcagtggatccagaccaagatgctagtcggtcccgactccgaaacgcacaagaaaaaatggtctactctctggtgtcagtgcccgagggcaacgatattagcagcattttcgagctcgatcccacaaccctgagaggcggagactcacttgtgcctcgaaattcctatgtgcggctaaggcatctctgtacaaacacgtgggttcacagcacaaatatcccaatcgacaaggaggaggagaaacccgtgatgctgaagattggtacgagcccagtaaaggaggataaagaggcctttgctatcgtacccgtgtcgcctgccgaagtgcgcgatctagacttcgcaaacgatgccagtaaggtgctgggatctatcgcaggaaaactagaaaagggcactattacccagaacgagcgcagatcagtcaccaaactgctcgaagacctggtgtattttgtgactggcggaacaaatagcgggcaagatgtactcgaggttgtcttttccaagccgaaccgggaacggcagaaactgatgagagaacagaatatcttaaagcagatatttaagctcttgcaggccccttttactgactgcggcgacgggccaatgctgcgtctggaagagctgggcgaccagaggcatgcaccctttagacatatttgccgtttgtgttacagggtcctgcgccattcccaacaggactatcgcaagaaccaggagtatattgccaagcaattcgggttcatgcagaaacagatcgggtacgatgtccttgctgaagatactattacggccctgcttcacaacaatagaaaactcctggaaaaacacatcaccgccgcagaaatcgacactttcgtttctcttgtgaggaaaaatagagaacctcgtttcctagactatcttagtgacctttgtgtaagcatgaacaaatccattccagtgacgcaagaacttatctgcaaggctgtacttaacccaaccaacgctgacattttgatcgagactaagctggtgcttagtcgtttcgaatttgagggcgtatcctctactggagagaatgcgctggaggccggtgaggatgaggaggaagtctggctgttctggcgtgactctaataaagaaatacggagcaaatctgttagagagcttgcacaggacgctaaggaagggcagaaggaggatagggatgtcctttcttactaccgataccagttaaatctgttcgcacgcatgtgtttggaccgccagtatctggcgattaacgagattagcgggcaattggatgtggatcttattcttcgctgcatgtccgatgagaacctgccttacgatttacgcgcatccttctgccggttaatgctgcacatgcatgttgacagggaccctcaggaacaggtgactcccgttaaatatgcaaggctgtggtccgagatcccatccgaaatcgccatagacgactacgactcgtccggagcttctaaggacgagattaaggagaggtttgcccagacaatggaatttgtggaggagtacctgagggatgtggtctgtcagcggtttccattcagcgataaagagaaaaataagctgaccttcgaggtagttaatctcgccaggaatttaatttactttggtttctacaatttttccgacttactccgcctcaccaaaattctactggccattctggactgtgtacacgtcaccactatattccccatcagcaaaatggccaaaggggaagaaaacaagggcagtaatgtgatgcgctccatccacggggtgggagagctgatgacccaagtcgtgttacgcggagggggtttcctccccatgacgcccatggcggctgcaccggagggtaatgtaaagcaggccgaacctgaaaaagaggatataatggtgatggataccaagctcaaaatcatcgagattctccaatttattttaaacgtgcggcttgactatcgcatcagctgcttgctgtgcattttcaagagagaattcgatgaatccaactcacagaccagcgagacgagttccggtaatagcagccaggagggtccctcaaacgtcccaggcgctctcgacttcgagcacatagaggaacaggccgagggaattttcggcggaagcgaggaaaacactcctttggacttagatgatcatggaggcagaacattcctgcgcgtgctattacatttgacaatgcatgactatcccccactagtcagcggggctctgcagctgctcttcagacacttcagtcagagacaggaagtactccaggcttttaagcaggtgcagcttctggttaccagtcaagatgttgacaactacaagcagatcaagcaggacctcgaccagcttcggtccattgtggagaagagcgagctttgggtatacaaaggacagggtcccgatgagacaatggatggtgcctccggcgaaaatgaacacaagaagaccgaagaagggaacaataagcctcagaagcacgaatccacctctagttataattacagagtggtcaaagaaattctcatcagactgtccaaactatgtgttcaggagtcggcaagtgttaggaagtctagaaagcagcagcaaagactcctgcgcaatatgggcgctcacgctgtagttctggagctcctgcagatcccttacgagaaagccgaagacaccaaaatgcaggagattatgcggctggctcacgagttcctgcagaacttctgcgccggaaaccagcagaatcaggctcttctccataaacatatcaatctgtttctgaatcccggtattctggaggctgtgactatgcagcatatattcatgaataactttcagttgtgtagcgagataaacgagcgagtggtacagcatttcgttcactgcatagagacgcacggccgaaatgtccagtatattaagttcctccagaccattgtgaaagcagaggggaaatttatcaagaaatgccaggatatggtcatggctgagttagtgaatagtggcgaagacgtcctggtgttctataatgacagagcctcattccagacgttaatccaaatgatgaggagcgaaagggatcgcatggatgagaactccccactcatgtaccatattcacctggttgagctcctggcggtgtgtacagaggggaagaacgtttacactgaaatcaaatgcaactccttgcttccactcgatgacattgtgagggtggtgacacacgaagactgtattcctgaagtgaaaattgcatacatcaactttttgaatcactgctacgtagataccgaggtggagatgaaggagatctacacttcgaatcacatgtggaagctgtttgaaaatttccttgtagacatctgtagggcctgcaacaacactagcgatcgcaaacacgcagattctattttggagaaatatgtgacagaaatcgtgatgtctattgttaccaccttcttcagctccccgtttagcgatcagtccacgacattacagacacgccagccagtctttgtgcagcttcttcagggcgtcttcagggtgtaccattgcaactggctcatgccctcccagaaagcttccgtcgagagctgcatacgcgttttatcagacgtggccaagtctcgggcaatagcaattcccgtggatttggactcccaagtgaacaacctgttcctcaaatcccacagcattgtccagaaaaccgccatgaattggcgcctttccgcaaggaatgcggcaagacgtgacagtgtcttggctgctagtagagattatcgcaacatcatcgagagactacaggacatagtttctgcactggaagatagacttcggccacttgtgcaggccgaactgagcgtgcttgtggatgtccttcaccgcccagaattgctgttccctgagaacaccgatgccaggaggaagtgtgaatccggcggattcatatgcaagctgattaagcacactaaacagctcctcgaagagaacgaggagaagctgtgcattaaggttctccagacgctccgagagatgatgacaaaagaccgtggctatggagaaaaaggggaagctctcagacaagttttggtgaatcggtactatgggaatgttaggccttcaggcagaagagagtcactgactagctttggaaatggccctctatcagccggtggaccaggcaaacccggagggggagggggtggctcaggctcctcaagcatgagtcgcggagagatgagcctcgctgaagtgcagtgtcaccttgacaaggaaggagccagcaatctcgtcatagacttaattatgaacgccagcagcgatagagtgtttcacgagagcatccttttagcaatagctctcctcgaaggagggaacaccaccatacagcacagcttcttctgcaggctcacagaggataaaaaaagcgagaaattttttaaagtgttctatgatcggatgaaggtagcccagcaagaaataaaagcaaccgttaccgtgaacacatctgatttgggcaataagaagaaggatgacgaggtcgaccgcgacgcccctagcagaaaaaaggctaaagaacccactacacaaatcaccgaagaggtaagggatcagctccttgaagctagtgcagccacgagaaaagctttcactacctttagacgagaggctgacccagacgaccattaccagcctggcgaaggcacccaggcgacggctgataaggctaaggatgatctcgagatgtccgccgttatcacaattatgcaaccaattttaaggttcctgcagctcctgtgtgagaaccataacagggatctgcagaacttcctcaggtgtcagaacaataaaacaaactacaatctcgtgtgcgagactcttcagttcctggattgcatctgcggctcaacaaccgggggactcgggctcctgggtctgtatatcaatgaaaaaaatgtcgcactgattaaccagactcttgagtctctcacagagtactgtcagggtccctgccacgaaaatcaaaattgtatcgctactcacgagagcaatggcatcgacatcattacagccctcattctgaacgacattaatcccctgggaaagaaacgtatggatcttgtgctagaattgaagaacaacgcctccaagctattactggccatcatggaaagtcgacacgacagtgagaacgccgagcggattctatataacatgcggccaaaggagctggtggaagttattaagaaagcctatatgcagggggaggtggagtttgaggatggagagaacggcgaggacggagccgcaagtccacggaacgtcggacacaatatttatatcttggcccaccagctcgcccgacacaacaaagagctgcaaagcatgctgaagccagggggacaggtagacggagacgaagccctcgaattctatgcaaagcacaccgcccagatcgagatagtccgcctggacaggacaatggaacagatcgtctttccggtgccgtctatctgtgaatttctgacaaaagagtccaagctgagaatatactacactacagaaagagatgagcagggcagtaagatcaatgatttttttctccgcagcgaggacttgttcaacgagatgaattggcagaagaaactgcgcgctcagccagtcctctactggtgcgctcgaaacatgagtttttggtcctcaatttctttcaacctcgcagtgctgatgaatttactggtcgccttcttttaccccttcaagggagtgagaggaggcaccctcgaaccccattggtccggtctcctgtggacggcaatgttgatttctctggccatagtgatcgcattgccaaagccccacggaattcgcgctctcatcgcctcaaccatcctacggctgatattctccgtggggctgcagcctactctgttcttgctaggggcatttaatgtgtgcaataaaatcatattcctaatgtcttttgtgggtaactgcgggaccttcactaggggctaccgggcaatggtgctggacgttgaatttctctaccatcttctctacctggttatttgcgccatgggactctttgttcacgagttcttctacagcctacttctatttgaccttgtgtacagagaggaaacgctcctgaacgtaattaaaagcgtaactcgtaatggacgcagcatcattcttacggctgtactggccctgattctggtgtaccttttttcaattgtgggctacctgttctttaaggacgatttcatcttagaagttgataggctgcctaacgaaaccgccgttccagaaaccggcgagagccttgcatcggagttcctgttcagcgacgtgtgtagagtggagtctggtgaaaattgcagttccccggcacctcgagaggagttggtgcccgctgaagaaacagaacaggacaaggagcatacttgcgagacactgctgatgtgcatcgtcaccgtcctatctcatggcctcagaagcggcggaggtgtcggggacgtgttacgtaagccatccaaggaagagcctctgtttgcagcaagagttatctacgacctgttgttctttttcatggtgatcattatagttcttaatttgatttttggagtcatcatagatacattcgcagacctccgctccgaaaaacagaagaaggaagaaattttgaaaacaacttgctttatttgtggcttagagagggataaattcgataacaaaactgtcacgtttgaagaacacattaaggaagagcataatatgtggcactatctgtgcttcattgtgctggttaaagtgaaggacagcacggaatacaccggcccagagtcgtacgtcgcagagatgatcaaggaaaggaacctggactggtttcctcgcatgcgtgcaatgagcctcgtgagctctgactctgagggggagcagaacgaattgagaaaccttcaggaaaaactggaatcaacaatgaagctggttacgaatttgtccggtcaattgagcgaactgaaagaccagatgacagagcagcgaaagcaaaagcagcggatcggactgttgggccatccaccccacatgaacgtgaatccacagcagccagccta

SEQ ID NO: 226788 - DNA, 8132 bp, Artificial Sequence
  Description of Artificial Sequence: Synthetic coding sequence
atgtctgataagatgagttcttttttgcacatcggggacatttgctccctctatgccgaaggctccactaatggatttatatccacgttggggctggtggacgacaggtgcgtcgttcagccagaaacaggggacctgaataatccacccaagaaattcagagactgtttgtttaaattgtgtccaatgaatcgctactcggcacagaagcaattctggaaagcagccaaacccggtgccaactctacaaccgacgccgtcctgttaaataaattacatcacgcagccgatctggaaaaaaagcagaatgaaactgaaaacagaaagttattggggactgtgatccaatacggcaatgtgatccaacttctgcacctgaagtcaaataagtacttgacagtcaacaagcgcttaccagcacttttggagaaaaacgcaatgcgcgtgaccttagatgaagctgggaatgaaggcagctggttctatattcagcccttctataagttgcggtcaatcggggactcagtcgtgatcggggacaaggtggtgctgaaccccgtcaacgcaggtcagcctctgcacgcttcctcacaccagctggttgataatccgggatgtaatgaagtcaatagcgttaattgtaatacgtcttggaaaattgtcctgtttatgaaatggagcgacaacaaggacgatatcttgaagggcggagacgtggtcagactctttcatgccgaacaggaaaaattcttgacctgcgatgaacacagaaagaagcaacacgtctttctgagaacaactggccgacagtccgccacctctgccacctctagtaaagcgctatgggaagtggaggtggttcagcatgatccctgtagaggaggtgcgggatactggaacagcctgtttcggtttaaacacttagccacgggccattatcttgccgctgaagtggacccagacttcgaggaggaatgcttggagtttcaaccaagtgtggaccccgatcaggatgcttctcggagtcgactgaggaacgcacaggagaagatggtctacagtcttgttagcgttccagaaggaaacgacatcagttccatttttgaattagaccccaccacacttcgaggcggagacagcctggtgcccaggaattcctatgtgcgcctccgacatttgtgtactaatacttgggtccactccaccaacatccccattgacaaggaggaggagaagccggttatgctgaagattggcacttcgcctgtgaaagaggataaggaggcctttgctatcgtccctgtgtcccctgctgaagtcagagacttagatttcgcaaatgatgccagcaaggtcctcggatcaattgctggtaagttggagaagggaacgattacacagaatgagcgcagaagcgtaaccaagctgttggaggatttagtatacttcgtaactggcggaactaattccggacaggatgtgcttgaggtggtgttcagcaaacccaatagggagcgccagaagcttatgcgggagcaaaacatcctaaaacagatcttcaaattactgcaagcgccttttactgattgcggagatggtcctatgctccggctggaagagttaggtgatcagcggcacgcccctttcagacatatctgccggctttgttacagggtgttgagacatagtcagcaggactatcgtaaaaaccaggagtatatagccaagcagttcggcttcatgcagaagcagatcggatatgatgtgctcgctgaggataccatcacagccctccttcataataatcggaagttactggagaagcacattacagcagccgagatcgacacgttcgtttctctggtgcggaagaatagggaaccgcgatttttggactacttgtccgatctgtgtgtgagtatgaacaagagcattcctgtgacccaggagctgatttgtaaagctgtgctcaatccgacaaacgcggacattttgatagagactaagctcgtcctcagcaggtttgagttcgagggggtcagttccacaggggagaacgcccttgaagccggtgaggatgaggaggaagtctggctgttttggagagattccaacaaggaaattcggagtaagagtgtaagagaactggcccaagacgccaaagaaggccaaaaggaggatcgcgacgtcttgtcttattacagataccaattaaatctgtttgctcgtatgtgtctggacagacagtacctggccatcaatgaaatctccggacagctcgacgtcgacctgatccttcgatgtatgtctgacgagaatctgccttacgatctgcgcgctagcttctgtcgactaatgctccacatgcacgttgatcgtgacccacaggagcaggtgacacctgtaaagtacgcacggctgtggtctgaaattccctctgagatcgccattgacgattatgattccagtggggcttcaaaggacgagatcaaggagcgcttcgcccagaccatggaattcgtggaggaatatttacgcgacgtcgtgtgtcagcgcttcccattcagcgataaggagaagaataagctaacctttgaggtggtcaacctcgctcggaatctgatctacttcggattttacaatttttccgacctgttaagactgactaagatactgctagccattctggattgcgtgcatgtcactacaatctttccaattagcaaaatggccaagggggaagaaaataagggtagcaatgttatgagatcaatccacggtgttggcgagctgatgacgcaagtggtactgagagggggaggattcctccccatgactcccatggcagcagccccagaggggaacgtgaaacaggccgagcctgagaaggaagatatcatggtgatggataccaaactcaaaatcattgagattttacagtttatccttaatgtgagactggactacaggatatcctgtctgctctgcattttcaaaagggagtttgacgagtccaactctcagacttcagagactagttctggcaattcaagccaagagggacctagcaacgttcccggtgccttggatttcgagcacatcgaagagcaggctgaaggcattttcggagggagaaaggaaaacacgcctctggatctcgatgatcatggcggaagaacttttctgagagtcctgctccacctcacaatgcacgattaccctcctttggtgtcaggagccttgcaactcctatttaggcacttctcacagaggcaggaagtgctccaggctttcaaacaggtgcaactgctggttacttcgcaggacgtggataactataaacagataaagcaggacttggatcagctccgctcaattgtcgaaaaatccgaactttgggtctataaagggcagggacccgatgaaacaatggatggtgcttctggagagaatgaacacaaaaaaaccgaggaggggaacaacaaaccacaaaagcatgagagcactagttcctacaattatcgggtagtgaaagagattctgatacggctatccaagttatgcgtgcaggagagcgcgagcgtgagaaaaagccggaagcagcaacagcgcctgctaagaaacatgggcgcacatgctgtagttttagaactcctgcaaatcccgtatgagaaggccgaagatacgaaaatgcaggaaatcatgaggcttgcgcacgagttcctccaaaatttttgcgccggtaaccagcagaatcaggccctgctccacaaacatataaatctttttctgaacccaggcatccttgaggctgttacaatgcaacacatcttcatgaacaacttccagctgtgctctgaaattaatgaaagggttgtccagcatttcgtccactgcatcgagacgcatggtcgcaatgtgcagtacattaaattcttgcagaccatagtaaaggcagagggaaaattcatcaagaagtgccaagatatggtgatggcagaactcgtgaacagtggggaggacgtgttggtcttctataacgatagagcctctttccagacccttatacaaatgatgcgatctgaacgcgacaggatggatgagaactccccattgatgtaccacatccacctggtggagttgctggcagtctgcacagaggggaagaacgtgtacactgagattaagtgcaatagtctgttgccacttgacgacatagttcgcgtcgtcactcacgaggattgcatcccggaggtgaagattgcttatatcaactttctgaatcactgttacgtcgacactgaggtcgagatgaaagagatctatacatccaaccacatgtggaagctgttcgaaaacttcctggtggacatttgcagagcgtgtaacaatacttccgacaggaagcacgccgactctattttagaaaaatatgtaactgagatcgtgatgagcatagtgactaccttcttcagttctccttttagcgatcaatcaaccacactgcagacacggcagccagtattcgttcagttgttgcagggagttttcagggtttaccattgcaattggctgatgcctagtcaaaaggcatccgtggagtcgtgtattagagtcctgagcgacgtggccaaaagtagggccattgccattcctgtcgatctggactcccaagtcaataacctgttcttaaaatcccacagcatcgtgcagaagacagccatgaattggcgacttagtgcgagaaatgccgcacgtcgcgactccgtcctggcggcatctcgggactaccgtaatatcattgaacgcctgcaggacattgtctcagcactcgaggaccggctcagacccctggtccaggccgaactgtctgtcctggtggacgttcttcaccgcccagaactgctgtttcctgaaaatactgacgcacggagaaagtgtgagtcaggtggcttcatttgcaagctgattaagcacaccaaacagctcctagaagagaacgaagagaagctatgcattaaggtgttgcagactctcagggagatgatgacaaaagaccggggatacggagagaagggagaggcccttagacaagtgcttgtgaacaggtattatggcaacgtccgtccttcaggtcgccgtgagtcacttacatcgttcggaaacgggccactttcagctggtgggccaggcaagcctggaggaggtggtgggggttctggctcctcttcaatgtcacgcggagagatgtcgctggccgaggtacagtgccatctggacaaggagggggcaagcaacctcgttatagacctgattatgaatgcctctagcgaccgagtctttcacgagtccattttacttgctattgctctgctcgagggcggtaacaccacaatccagcatagcttcttttgtcgcctcaccgaggataaaaagtccgagaagttcttcaaggtattttatgataggatgaaagttgcacagcaggagataaaggcaacagtgacagtcaataccagtgacctaggcaacaagaagaaagatgatgaggtggacagagatgctccctcccgcaaaaaagctaaagaacccaccacgcaaatcactgaggaggtgagagaccaactgctggaagcctctgcggctacgcgaaaggcctttactactttccgacgtgaggccgatccagacgaccactatcagccaggagaagggacccaggccacagctgacaaagctaaagatgatctcgaaatgagcgccgtcattaccatcatgcaaccgattttgcgctttctgcaactactctgtgagaatcataatcgggacctccaaaactttctgcgttgtcagaacaataagactaattacaacttagtgtgcgagaccctgcagttcctcgactgtatctgcggctcaaccactggtggtcttggtctgctgggcctgtacatcaatgaaaagaacgttgctctgatcaaccagactctggagtctctgacggagtactgtcagggaccctgtcacgagaaccagaactgcattgcaactcatgaaagtaacggaatcgacatcatcaccgcattgatcctgaatgacattaacccacttgggaaaaagcgcatggatctcgttctcgaactaaaaaacaacgcgagtaagctcttgctggccataatggaaagccgtcacgatagcgaaaacgctgaacgtatattgtacaatatgaggccgaaagaactggtcgaggtgatcaagaaggcttacatgcagggagaggtggaattcgaagatggtgagaatggtgaggacggcgctgccagccccaggaacgttggacacaatatttatatcttagcccaccagctcgcccgtcacaataaggagctgcaatcgatgctcaaaccaggcggacaagtggacggagacgaagcactcgagttttatgccaagcataccgcccagattgagatcgttaggctggaccgcaccatggagcagatagtctttcccgtaccctctatctgcgaatttcttaccaaagaatctaagctgcggatttactacacaaccgaaagggatgaacaaggatctaagattaacgacttctttctccgctctgaggatttattcaacgagatgaattggcaaaagaagctcagggcgcagccggtattgtattggtgtgccaggaacatgagcttctggtctagtatctctttcaatctggctgtgctgatgaacctcctggttgccttcttttaccccttcaagggcgtgcggggtgggacattggagccccactggagtggcctcctgtggaccgccatgctgattagccttgccatagtcattgcgttgcctaaaccccacgggatcagggcgttgattgcgtcaacaattctgagattaatcttttccgtcgggctccagccaactctgtttctgttaggtgcatttaacgtgtgcaataaaatcatttttctgatgtccttcgtaggaaactgtggaacatttaccagaggctaccgggcaatggttttggacgtcgagtttctgtatcacctgttatacttggtaatctgcgctatgggcctttttgttcacgaatttttctactccctgctgctgtttgacctggtgtatcgcgaagaaaccctgttgaatgtgattaaatccgtgacgcgtaatggacgttcaataattttgaccgcagtgctcgccctgatcctcgtttatctgttttctattgtaggctacctattcttcaaggatgacttcatcctcgaggtggatcgcctgcccaacgagactgccgtgcccgagaccggcgaaagcttggcaagcgagttcctgttcagcgatgtgtgtagggtcgagtcaggcgaaaattgctcctcacccgctcctagggaggaactcgttcctgccgaggagacggagcaggacaaggaacatacgtgcgagacgttgctaatgtgtatcgtgaccgtcttgtcccatggcctgaggtccggaggtggggtgggggacgtcctgagaaaaccatccaaggaagagccattgttcgccgctcgcgtgatttatgacctgttattcttctttatggttatcattattgtcctgaatctgattttcggggtcatcatagatacatttgctgatcttcgcagcgaaaaacagaaaaaggaagaaatcctgaaaactacctgcttcatctgtggcctggagcgggataagtttgataataaaaccgtgacattcgaagaacatatcaaggaggaacacaacatgtggcattatctttgttttatagtgctggtcaaagtaaaagactccacagaatacacggggcctgaaagctacgtggcggagatgattaaagagcgcaatttagattggtttcccaggatgcgggctatgagcttggtatccagcgattcagaaggggagcaaaacgagcttcggaacctacaggagaagctcgaaagcactatgaaactggtcaccaacttgtccggccaactgagcgagttaaaggatcagatgaccgagcagcggaaacagaaacagcggattgggctgctggggcaccccccacacatgaacgttaacccccagcaaccagcata

SEQ ID NO: 226789 - DNA, 3615 bp, Artificial Sequence
  Description of Artificial Sequence: Synthetic coding sequence
caggaaccaggccattgccattccaggggtccaggccagcctagccagcagccactctcacaagttcctcagcactgtgcggaagctatgaactggaggctgtcggctcgcaacgccgcacgcagggactctgtgctagctgcatcaagggactacaggaacatcatcgagcgcctccaggatatcgtgtccgctctcgaagaccggctccgaccgctggtacaggcagagctcagtgttttggtcgacgtgcttcatcggcctgaacttctttttcccgaaaataccgatgctcggaggaagtgcgagtcggggggttttatttgcaaactgatcaagcataccaagcaacttttggaagagaacgaagagaagctctgtattaaggtcctgcagaccttaagggagatgatgactaaagacaggggctatggcgaaaagcttatctcaattgacgagctcgataacgcagaactgccaccagcaccagactctgagaacgccacagaagagcttgagccctccccacccctgcgtcagttggaagatcacaaacgaggcgaggcccttcggcaggtcctggttaacagatattacggaaatgtaaggccgagtggcaggcgagagagcttgacctcatttggcaatggtcccctctcagctggcggtcctggtaaaccagggggaggaggagggggatccggttcatcctccatgagccgtggggagatgtcactggcagaggtgcaatgccacctagataaggagggggcaagcaacctggtgatcgaccttatcatgaatgcatccagtgaccgcgtgtttcacgaaagtatcctcctcgcgatcgctctccttgaaggaggaaacaccactatccagcactcttttttctgccgcctcacagaagacaagaaatcggagaaattttttaaggtgttctatgacagaatgaaagtggctcagcaggagataaaggctaccgtgaccgtaaatactagtgaccttggcaacaagaaaaaagatgacgaagttgatagggatgctcccagccgtaaaaaagcaaaggaacctaccactcagattactgaggaagtaagagaccagctccttgaggccagcgctgcgactaggaaggccttcactacttttcggagggaggctgacccggatgaccattaccagccgggtgagggaacacaggccaccgcggataaagctaaggacgaccttgagatgtccgcagtgatcacaattatgcaacccatcctgaggtttttacagttgttatgcgaaaaccataatcgcgatctccagaattttctgcggtgtcagaacaataaaaccaactacaatttggtgtgcgagactctccagtttcttgactgcatatgcggaagtacaacaggtggactcggcctacttggactttacattaacgagaagaatgtggccttgatcaatcaaaccttggagtcactcacagagtactgccagggaccgtgccatgagaatcaaaattgtatcgccactcatgaaagcaacggaattgatatcatcactgcactcattctgaatgatatcaaccccctcgggaaaaagagaatggacctggtcctggagttgaaaaacaatgcctctaaacttctgcttgcaatcatggaaagcagacatgattccgaaaacgccgagcgtatcctgtacaacatgcgacctaaggagctggtggaggtgattaaaaaggcttacatgcagggcgaggtggaattcgaagacggcgaaaacggggaagatggagcagcttctccacgcaacgtgggacacaacatctacatcctcgcgcatcaattggcacgccacaataaagagctccagtcaatgctcaaacccggaggccaggtcgacggggacgaggctctcgaattttacgcgaagcataccgcccagattgagatcgtacgattggatcgcacaatggagcaaatcgtgttcccagtaccttctatttgcgagttcctgaccaaagagagtaaactgcgcatttactataccacagagcgcgatgagcagggctccaagatcaacgatttcttcctgagatcagaggatttgttcaacgaaatgaattggcagaaaaagctgcgcgcacagcccgtactgtattggtgcgccagaaacatgtccttttggtcttcaatctcttttaatttggccgttctgatgaatctactcgtcgcctttttctaccccttcaaaggagtgagaggtgggacgctcgaaccccattggagcgggctgctgtggacagctatgttgatttccctggccattgtaatcgctctgccaaaaccacacggcattcgggcactgatcgcttcaaccatcttaagattgatcttttcagtcgggttacagcctacactattcctcctcggggctttcaacgtgtgtaataaaattattttcctcatgagctttgtgggtaattgcggtacctttactaggggttacagggccatggtattggatgtggagtttttatatcacctgctgtacctcgttatctgcgcaatggggttatttgtgcacgagttcttctacagtctgctcttgttcgacttggtgtacagggaggagactcttctaaatgtcatcaagtctgttaccaggaacggtcgatctattatccttaccgctgtgctcgcactgattctggtgtatctgttttctatagtgggctatctgtttttcaaggacgacttcatcttggaggtggacaggttacccaatgagaccgcggtgcctgaaacaggcgaaagcctagcttccgagttcctattcagtgacgtctgccgtgtcgagtctggcgagaattgctcatcccctgctcctagggaagagctggtaccagcagaagagaccgagcaggacaaagagcatacatgtgagactctgctaatgtgtatagtgaccgtgctttctcatggccttagaagcggcggtggagtcggcgatgtgttaagaaaaccatccaaggaagagccgctgtttgcagccagagttatctatgacctcctgtttttctttatggtcattatcatcgtgcttaacctaatcttcggcgtgattatcgatacttttgccgacctgcgaagcgagaaacagaagaaggaagagatccttaagactacatgcttcatctgtgggctggagcgcgataagttcgataataagaccgtgacattcgaggaacacataaaagaggaacataatatgtggcactacttgtgcttcatcgtactcgttaaagtgaaggactctactgagtacactggtcctgaaagttacgtcgcggaaatgatcaaagagcggaacctggactggtttccccgtatgagagcaatgagtctggtgtcaagcgactctgaaggcgagcaaaatgagttgcggaatttgcaggagaagctcgagtccaccatgaagctggtaacgaatttaagcggccaactaagtgaactgaaggaccagatgaccgagcagaggaaacaaaaacaaagaatcgggctgctcggccacccaccacacatgaacgttaatcctcagcagccagcttag

SEQ ID NO: 226790 - DNA, 8231 bp, Artificial Sequence
  Description of Artificial Sequence: Synthetic coding sequence
atgagcgacaaaatgagctccttcctccacataggcgatatttgctccctttacgccgaaggtagcaccaacggatttatttcgactttgggcctggtggacgacaggtgtgtagtgcagcccgaaaccggagacctgaacaatcctcccaaaaaattccgcgactgtctctttaagctttgcccaatgaaccggtatagcgctcagaagcagttctggaaggctgcaaagcccggagccaattccactacggatgccgtgcttctcaataagctacaccatgccgctgatctcgagaagaagcaaaatgaaactgagaacagaaagctgctcggtaccgttatccagtacgggaacgtcatacagctgttgcacctgaagtcgaacaagtatctgacagtgaataagcgactgcctgcactcctcgagaaaaatgcaatgcgcgtcactcttgatgaggccggaaacgaaggatcttggttttatattcagccgttttataagctgagaagtatcggggattccgtcgtgatcggggacaaggtggtgctgaatccagttaacgctggccagcctcttcacgcatcttcacaccaattagtggacaacccaggctgtaacgaagttaacagtgtcaattgcaacacaagttggaaaatcgtgctcttcatgaagtggtccgacaacaaagacgacatactgaagggcggagatgtggtccgcttgtttcacgcagaacaggagaagtttcttacctgtgatgaacaccgtaagaaacagcacgtgtttctgcgcacaacagggagacaatctgccactagcgcgacttctagcaaggcactgtgggaagttgaggtggtgcagcacgacccgtgtaggggcggagccggttactggaatagcctgtttaggttcaagcacctcgccactggacattatctggccgcagaagtagacccagaccaagacgcctctagaagccgcctccgaaacgcccaagaaaagatggtgtacagtctggtctccgtccccgagggcaacgacatttcttctatattcgaactggacccaaccactctgcgcggtggcgactcgctcgtgccaagaaactcctacgtgcgtctccggcacctgtgtacaaatacgtgggtacactccacgaacatcccaatagacaaagaagaagaaaagccagtgatgctgaagatcggaacatcacctgtgaaggaagacaaggaagccttcgcaattgtgcctgtgtcccctgcagaagtgagagatcttgacttcgcaaacgatgcaagcaaggtgttaggctccatagccggtaaactggagaaaggaacaattacgcagaatgaacggaggagtgtcaccaagctgcttgaggatctagtgtacttcgtgactggcggaacaaattccggtcaagatgtcttagaggtggtgtttagtaagcctaatcgcgaacgccagaaactgatgcgagaacagaatatccttaaacagatctttaaactgctgcaggctcctttcaccgactgtggagacggccctatgctccgcctggaggagttgggggatcagagacatgccccattccgacatatttgccggctctgttacagagtgttgaggcatagtcagcaggattaccgaaaaaaccaggagtatatcgcaaaacagttcggattcatgcagaagcagattggctacgacgtgctcgccgaagatacaatcaccgctctgcttcataataatcggaagctgctggagaagcacattaccgccgcagagattgacacgttcgtgtcgctggtgcgtaagaaccgagagcctcggttcttggattacttgtccgacctttgtgtgtcaatgaacaaatccatacctgtaacgcaggagctaatctgtaaggcagtcctaaatccgacaaatgctgacatcttaatcgagacaaaactcgtgctaagccgatttgagtttgagggtgtttcctctaccggggagaatgcattggaggccggagaagacgaagaggaggtgtggctgttctggcgcgacagtaacaaagagatccggtcaaaatctgtgagggagctggctcaggacgccaaagaaggacagaaagaagacagggacgtgctgtcttattaccgttaccagttgaatctgttcgcccgaatgtgcctggaccgccagtatttggccattaacgaaatcagcggccagctcgacgtggatcttattctcagatgtatgtccgacgagaacctgccttatgacttgcgggcatcgttttgtcggctcatgctgcatatgcacgttgacagggacccacaggagcaggtgactcccgtgaagtatgctcggctttggtctgaaattccctccgaaatcgccattgacgattacgacagttcaggggcatccaaggatgaaatcaaggaaaggttcgcccagacgatggagtttgttgaagaatatctgcgggacgttgtatgtcagcggtttcccttctctgataaagagaaaaataagttgacattcgaagtcgtgaaccttgccaggaacctgatctactttgggttttataacttcagtgacctgctacggttaaccaaaatactgctcgccatacttgattgcgttcacgttacaaccatctttcccatatcgaaaatggctaaaggggaagagaacaaaggcaacaatgacgtggaaaaactgaagagtagtaacgtgatgcggtctatacacggcgtgggcgagcttatgacccaggtcgtattgcgaggcggaggttttcttccgatgactcctatggcggcagctcccgaaggcaatgtcaagcaagccgagccagaaaaagaggacatcatggtgatggataccaagctgaagattattgagattctgcagttcatattgaacgtaaggcttgactatcgcatatcatgtctgctgtgcatcttcaagagggagttcgatgagagcaatagtcagactagtgagacttcttcaggcaactcttcccaggaaggacctagtaatgtgcctggggcacttgactttgagcatatcgaggagcaggcagaaggcatctttggcggatccgaagagaataccccgcttgacctcgatgatcacggaggtaggacttttctccgcgtgctgctccacctcacaatgcacgattacccacccctggtctcaggtgcactgcagctcctttttaggcatttctcccagcgccaggaggtcctgcaggcttttaagcaagtacagttgctcgtaacatcacaggatgtggacaattataagcagatcaagcaagaccttgaccagttgcgtagcattgtggaaaagagtgagttatgggtctataaggggcagggccctgatgagactatggacggagcaagcggggagaacgaacataagaagaccgaagagggaaataataagccccagaaacatgagagtacttctagttataactacagagtagtgaaagagatccttatcaggctgtctaagctttgtgtccaggaatcagcgagtgtgagaaaatccagaaagcagcagcagcgattgctgcgcaatatgggtgctcatgcagtcgtgttggagctactccagataccttatgaaaaggccgaggacacgaagatgcaggaaattatgaggctcgcgcatgaattcctccaaaatttttgtgctggaaatcagcagaaccaggcactgctccacaaacacattaacctttttctcaaccccggtatcctggaggccgtcaccatgcaacatatctttatgaataacttccagctgtgtagcgagattaatgaacgtgtggtacagcactttgttcactgcattgagacccacgggcgaaacgtgcagtacattaagtttctgcagaccattgtgaaagctgagggcaagtttatcaaaaagtgccaggatatggtaatggccgaattagttaactccggcgaggacgtcctggtgttctataacgatcgggcatccttccagactttaattcagatgatgcggagcgaaagagaccggatggacgaaaacagcccgctcatgtatcacatccacctcgttgaattgctagctgtatgtacagaaggcaagaatgtgtataccgaaataaagtgcaactcgttacttccactagatgacattgtgcgtgttgtaactcacgaagattgtattccggaagtgaagatcgcatatattaacttcctgaatcattgctacgtcgacactgaagtcgagatgaaagaaatttacaccagcaatcatatgtggaaacttttcgagaactttctggtggatatttgtcgggcatgcaacaatacatctgatagaaaacacgcggattccattctggagaagtacgtgaccgagatcgttatgtccattgtaacaacttttttcagctctcctttctcagatcaatccaccacattacaaactcgccaacctgtgttcgtgcagctgctgcagggcgttttcagagtgtaccactgcaactggcttatgcccagtcaaaaagcctccgtggaaagctgcatccgcgtgctttctgatgtggcaaaaagtagggctattgcaatccccgttgatctggactctcaagtgaacaacttatttctgaaatcacatagtatagtccagaagaccgctatgaactggagattaagcgcaaggaatgccgctcgacgggactctgtacttgccgcaagccgcgattataggaacattatcgagcgccttcaggacattgtgtccgccctggaggacaggcttaggcccttggtgcaggctgagttgagcgtgctggtggatgtcttgcatcggccagagctattgtttccagagaacaccgacgctaggaggaaatgtgagagcgggggatttatttgcaagctaatcaaacacactaagcagctgcttgaggaaaatgaagagaagctttgtatcaaggtcttacaaacactccgagagatgatgaccaaagaccggggatatggagaaaaactaatatcaattgacgaactcgacaacgcagaactcccacccgcacccgattccgagaatgcaaccgaggagctcgaaccctctcctcccctgcggcagctcgaggaccataaacgaggagaagctcttcggcaggttcttgttaaccgatactacggcaacgttaggccatccggcagacgagaaagcttgacttctttcggaaacggacccttgtccgcgggtggcccaggcaaaccaggtggaggcggtggaggcagtggatcctctagcatgtcgcgcggtgagatgtccctcgcagaggtgcagtgccacctcgacaaggagggagcctctaacctagtcatagacctaattatgaacgcaagtagtgaccgcgttttccacgagagcatcctgctggccatcgcattgctcgagggaggcaatactaccatccagcatagctttttttgccgcctcactgaggataagaaatccgaaaaatttttcaaggtattctacgataggatgaaagtagctcagcaggagatcaaggccacggtaacagtgaatacaagcgatctcggcaataaaaaaaaggacgacgaggtggaccgggacgctccctctcgcaagaaagccaaggagccaacaacccagataactgaagaagtgagggaccagctgctggaagcctccgccgctacaagaaaggcattcactactttcagaagagaagctgaccccgacgaccactatcagcctggagaggggacccaggccacagcggacaaggcaaaggatgacctggagatgagcgccgttatcaccatcatgcagcccatcctgcggttcctgcagctcctttgcgagaaccacaaccgcgatctgcagaattttctgcgctgtcagaacaataaaacgaactataacctggtgtgcgagaccctccagtttcttgattgcatatgcggcagcactactggcggactaggtctgctgggtctgtacatcaatgagaaaaacgtggcactcattaatcaaacactggagtctctgacggagtactgccagggcccatgccatgaaaatcagaattgcatcgctacacatgagtccaacggcatcgacataatcacagcccttatcctcaatgatatcaatcccctcggtaagaagcgaatggatctagtattggaactgaaaaacaacgcaagtaaactattgctggcaattatggagtcgaggcacgactcggagaacgccgaacgtatcttgtacaacatgcgcccaaaggaactggtagaagttattaagaaggcctacatgcagggagaagtggaattcgaagatggcgaaaacggtgaagatggcgcagcttccccgagaaacgttggtcacaatatctatatcctcgcacaccagctggctaggcacaataaggagctgcaatccatgctgaaaccaggcggacaggtggatggcgacgaggctttggagttttatgccaagcatactgctcagattgaaatagtacgcctggatcggactatggaacagatcgtattccctgttccctctatttgcgagtttcttacaaaagagagcaagcttaggatctactacaccactgagcgcgatgagcagggttcaaagatcaatgacttctttcttcgcagcgaagatcttttcaacgaaatgaattggcaaaaaaagttgagggctcagcccgtgctgtactggtgtgccagaaatatgtctttctggagctccatctctttcaatcttgccgtgctgatgaacctgctggtggccttcttctaccctttcaaaggggtgagagggggaaccctggagcctcactggtccggattattgtggaccgccatgttgatttccctggctattgtgatcgcccttcctaagccgcacgggattcgagctttaatagctagtacaatattacgcctgatcttttccgtcggactgcaacctacccttttcctgctgggtgcgtttaatgtgtgtaataagattatattcctgatgtctttcgtgggtaattgtggtacatttactcggggttatcgtgccatggtcttggatgtggagttcttgtaccacctgttatatctggtaatttgtgcaatgggcctcttcgtccatgagttcttctactctctgctgctgttcgatttggtctacagagaggagaccttgctcaatgtgatcaagagtgtgacacggaacggcagaagcattatattaaccgcagtgctagccctgatcctggtgtacctgttttctatagtgggctacctgttttttaaagatgatttcatcctagaagtagatcgcttgccgaatgagactgcagtgcctgagaccggggagagccttgcttccgaatttctgttttccgatgtgtgtcgcgtggaatcgggggagaattgttcgtctcctgcccctcgcgaagagctggtgcctgccgaggaaaccgagcaggacaaggagcatacctgtgaaactctgctcatgtgtatcgtcacagtcttaagccatgggctgcggagtgggggtggtgtaggagatgtgttgagaaaaccctcaaaggaggaaccgctgttcgcagccagggtgatatatgacctcctctttttttttatggtcatcatcattgtacttaatctgatctttggagtgatcattgatacatttgccgatcttcggtccgagaaacaaaaaaaggaggagatcctcaaaactacatgtttcatctgtggcctggaacgcgacaagttcgataataaaacagttaccttcgaggagcatatcaaagaagagcacaatatgtggcactatctgtgcttcattgtgctagttaaagtgaaagactccacagaatacaccgggccagagtcctatgtagcagaaatgattaaagaaaggaatttagattggtttccaaggatgcgagcaatgtcgctcgtgagtagcgatagtgagggggagcagaatgaattacgtaacctccaggaaaagctggagtctactatgaagctagtgacgaacctgtccggtcagttatctgaactcaaggatcagatgacagagcagaggaagcagaaacaacgcataggcctccttggtcaccctccacacatgaatgtgaacccccagcagccggcata

SEQ ID NO: 226791 - DNA, 8087 bp, Artificial Sequence
  Description of Artificial Sequence: Synthetic coding sequence
atgtccgacaagatgtcaagctttctgcacattggggatatttgtagcttgtacgccgaggggtccactaacggattcatctcgacactgggtctggtggacgaccggtgcgtggtgcagcccgaaaccggtgatttgaacaacccccctaagaaatttcgggactgcctgttcaagctctgccctatgaataggtattctgctcagaaacagttctggaaggcagccaagcccggtgccaacagtacaaccgatgcggtgttactgaacaagctacaccatgctgccgacctcgagaaaaaacagaacgaaacagaaaaccgcaagttgttaggcacagtgatccaatatgggaatgtgattcagttacttcacttaaagtccaataagtatctgacagtcaacaagaggctacccgcactcctggaaaaaaatgccatgagggtgactctggatgaagccggaaatgaaggaagttggttttacatacagccattctacaaactgcgatccattggagattcagtcgtgatcggcgataaagtggtgctaaatcctgtgaatgcaggtcagccccttcacgcatcctcccatcagctggttgacaaccctggttgtaacgaggtcaactctgttaattgtaacacatcctggaaaatcgtgctgtttatgaaatggtccgataataaggacgatatcctgaaaggcggtgatgtggtgagactgttccacgcagaacaagagaagttcctgacgtgtgacgagcataggaagaaacaacatgtgtttctccgaaccacagggaggcagagcgcgacctccgcaacaagctccaaagccctctgggaggtggaggtagtgcagcacgacccatgccgcggaggagctgggtattggaatagccttttccggttcaagcacctcgccacggggcattatctagcagctgaagtagatcccgaccaggacgcgagtcggagccgtctgcgtaatgcgcaagagaagatggtttattcacttgtcagtgtccctgagggcaatgacattagttccatattcgagctcgaccccactactctgagagggggagactccctcgtccccagaaatagctacgttcggttaaggcacctgtgcacgaacacttgggtccactcgaccaacattcccatagataaagaagaagagaagcccgttatgctgaagataggcacttctcccgttaaggaggacaaggaggccttcgcaatcgtacccgtcagccccgcagaagtccgcgatctggactttgctaacgatgccagcaaagtgcttgggagtatagccggtaagctcgagaaagggacaattacccagaacgagaggcgaagtgttaccaaactgcttgaagacttggtctactttgttactgggggaacaaactccggccaggatgtgttggaagtcgtgttctccaagcccaatagagaacgccagaaactgatgcgcgagcagaacatactgaagcagatcttcaagttgctgcaggcaccgttcactgactgcggcgatgggccaatgctccgcctcgaggagctcggggatcagagacatgctcccttcagacatatctgccgtctgtgctacagggttctgaggcattcccagcaggattaccggaaaaatcaggaatatatcgccaaacagtttggttttatgcagaagcagataggttacgacgtcctcgctgaggacacgattactgccctcttgcacaataatagaaaactcctcgagaagcacatcacggctgccgagatagacacctttgtctccctggtccggaagaacagagaaccccgtttcttagattacctttcagacttgtgtgttagcatgaacaaatctataccggttactcaagaactcatctgcaaggccgtccttaacccaaccaacgccgacattctgatcgagactaagcttgtgctctcccgcttcgagtttgagggagtttcttcaactggcgaaaacgcactcgaggccggtgaagatgaggaggaggtgtggttgttctggcgggacagtaataaagaaatccgcagcaaaagcgttagagagctcgcccaagatgccaaagaaggtcagaaggaagaccgggacgttctgtcttactaccgctatcagctcaacctatttgcccgaatgtgtctcgacaggcagtatctagccattaacgagatcagtgggcagctggacgtcgatctcatccttcgatgcatgtctgacgagaaccttccctacgacctgagggcctccttttgtcgcctcatgttacacatgcacgttgacagagatcctcaagaacaggtgacacctgtgaaatacgcgaggctttggtccgagattcctagtgagatcgccatagacgactatgactctagtggcgcaagtaaggacgagataaaggaacgctttgcgcaaacaatggagttcgtagaggaatacctacgggacgtggtgtgccagcggtttccattttcggacaaagagaaaaacaagctgacctttgaggtcgttaacctcgctcggaaccttatctatttcgggttttataacttctctgatttactccgacttaccaagatcctgctggccattctcgactgcgttcacgtgacaacgatattcccgataagcaaaatggctaagggagaggagaacaaggggtctaacgtgatgcgatctatccacggagtgggcgagctgatgacgcaggtagttttaagggggggtgggtttttgcccatgaccccgatggccgctgctcctgaaggaaacgtgaagcaggccgagcctgaaaaggaggacattatggtgatggacacgaaactgaaaataatcgaaattctacagtttattctgaatgtcagactcgactatagaattagttgcctgctttgcattttcaaaagagaatttgatgaaagcaactcccagacttccgaaactagtagcggaaactcttcccaggagggtccatcgaacgtgcccggagccctcgactttgaacacatcgaggaacaagccgaaggaatctttggtggatcagaggagaatactccactcgacttggacgatcacggtggtcgaacctttcttagggtgcttctgcacttgaccatgcatgactaccctcctcttgtttctggtgctctccagctgcttttccgtcatttttcccaaaggcaagaagtcctccaggcctttaagcaggtgcaacttctggtcacttcacaagacgtagataattacaaacaaatcaaacaggatttggatcaactgaggtcgattgtggagaaaagtgaactctgggtctataaaggccagggccctgacgagaccatggatggggcttcaggagagaatgaacataagaaaaccgaggagggcaacaacaaaccacagaagcatgagtccacctcgagttataattatagggtggtcaaagagatactcatccgattgtctaagctctgtgtgcaggagagcgcgtccgtgcgtaagtctcgaaaacagcagcagagactgttaagaaacatgggggctcacgcggtcgtcctggagttacttcagattccctatgaaaaggctgaagacactaagatgcaagagataatgaggcttgcacacgagttcctccaaaatttctgtgccggtaaccagcagaaccaagcccttctgcacaaacatattaacttgttcctgaacccagggatcctggaagcggttacaatgcagcatatctttatgaataatttccaattgtgtagcgaaatcaacgaacgcgtggtgcagcactttgtgcattgcattgagacccatgggcgtaatgtccaatatattaaatttttgcagacgattgtgaaggctgagggcaagtttatcaagaaatgtcaagatatggtgatggccgaacttgtgaacagcggcgaggacgtgttggtgttctacaacgatagagcctccttccaaaccctgattcagatgatgcgatcagagagggacaggatggatgagaacagtcctctgatgtaccacatccacctcgttgagctcctggccgtgtgtactgagggcaagaacgtgtacacagaaattaaatgcaattcactcttgcccctagacgatatagttagagtggtaacacacgaagattgtatccctgaagtcaaaattgcttatattaacttcctgaatcattgttatgtcgataccgaagtggaaatgaaggagatctacacctctaaccacatgtggaagctgttcgagaacttccttgtcgacatttgtcgtgcttgcaataacacaagcgacagaaaacacgccgatagcatcctcgagaaatatgtaaccgagatcgtgatgtccatagtaacaacctttttttcttccccgtttagtgaccagtctactacgcttcagaccaggcaaccagtatttgtccagcttcttcaaggagtgtttcgggtgtatcattgcaactggctcatgccaagccagaaggcaagcgtggagagttgtatcagagtgctgtcagatgttgcaaagtctcgggctattgctatccccgtagatctggattcccaggtaaacaatctgtttctcaagagccatagcattgtccaaaagactgctatgaactggagactgtcagcgaggaacgccgcaagacgggattctgtgctggcagcctcaagagactaccggaacattatagaacggctccaggatatcgtgagtgccttggaagatcgcctgaggcccctagtgcaagcggaattgtccgtcctggtggatgtcctgcatcgacccgaattactgtttcccgagaataccgatgccaggagaaagtgtgagtcaggcggttttatctgtaagcttatcaagcacaccaaacagcttctcgaagagaatgaggaaaagctgtgcataaaagtcctacaaacactgagagagatgatgacgaaagacaggggatacggagaaaagggtgaggccctgcgacaggtgctcgtgaataggtactacggaaatgtaaggccgtctggacgaagagagtcactgacaagcttcggtaacggacctctcagcgctggagggcctgggaagcccggtgggggaggtggtggctccggatcttcgtcaatgtcaagaggggagatgtctctcgccgaagtgcagtgccatctcgacaaagaaggggcatctaatctcgtcatcgaccttattatgaacgcatcaagcgatcgagtctttcacgaaagcattttgctagccatagcactgctggagggcggaaacacaacaatccaacattccttcttttgtcggttaacagaagataaaaagtccgaaaaattctttaaggtcttctacgaccgcatgaaggttgcacagcaggagataaaagcgaccgtgactgtgaataccagcgacctggggaacaagaagaaagacgacgaagtcgacagggacgctccatcccgcaagaaagctaaggaacccaccactcagatcactgaagaagtgcgagaccagcttctcgaggctagtgctgccacacgtaaagctttcaccaccttccggagggaggcggacccggatgaccactaccagcctggagagggaactcaggctaccgcagacaaggcaaaggacgatctggaaatgtctgccgtcataaccataatgcaaccaatactgagatttttgcagctactgtgtgaaaaccataaccgcgacttgcagaatttcctgcgctgccaaaataacaaaaccaactacaatctggtatgtgagacgcttcagtttctggattgcatttgcgggtcaaccactggcggattggggctgctcggcctgtatataaatgaaaaaaacgtggctctgattaaccagacactggagtccctgacagagtattgtcagggtccttgccacgaaaaccagaactgcatcgcaacccatgaatcaaacggaattgatattatcacggccctcatattgaacgacatcaatcctttggggaagaaacgcatggacctcgtgttggagctgaagaataacgcttccaaacttttgctagctataatggaatcacgacacgacagcgagaacgctgagagaatactgtacaatatgcggccaaaggaattagtcgaagttattaaaaaggcatacatgcagggagaagtggaattcgaagacggtgagaacggtgaagacggcgctgctagtccacgcaacgtggggcacaatatttacattctggcccaccaattagccagacacaacaaggagctccaatctatgcttaagccaggaggacaggttgatggagatgaggccttggaattttacgccaagcacacagcacaaatagagattgtcagacttgacagaaccatggagcagatcgtgttccctgtccctagcatctgcgaattccttactaaagaatctaaacttcgcatttactatacaacggaacgggatgaacaggggtcaaagataaatgacttttttttgagaagtgaggatctgtttaacgaaatgaattggcaaaaaaaacttcgagcccagccagtgctttattggtgcgctcggaacatgagcttctggtcatctataagtttcaacctggctgtgttgatgaacctgctcgttgccttcttctatcctttcaagggagtgaggggcggaaccctagagccacactggtcgggccttctctggaccgcaatgctgatctccttagcgatagtgattgccttgccaaaaccacacggtataagagccttgatcgcatccacgatcttaaggcttattttttccgtggggcttcagccaacactattcctgctcggagcctttaacgtgtgtaacaaaatcattttcctcatgtcctttgtggggaattgcggcactttcactaggggttaccgcgctatggtgttagatgttgaattcttgtaccacctgctctacctggtgatctgcgcaatggggctttttgtccatgagttcttctactccctacttctgttcgacctggtgtacagagaagaaacactgctgaacgtcatcaaaagcgttactcgcaacggacggagcatcattcttactgccgtgcttgccctgatactggtctatctatttagtatagtaggctatctgttctttaaggacgactttattctggaggtcgatcggctaccgaacgaaacagcagtcccagaaacaggggagtctctagcttctgaattcctcttctctgatgtgtgcagagtagagagtggtgagaactgctcctcccccgcaccgagagaggaactggtccctgctgaagagaccgaacaggataaggagcatacctgcgaaactctgttgatgtgcatagtgactgtactcagtcatggcctgcgctccggcggtggcgtaggcgacgtgctccgaaagccttcaaaagaggagcccctcttcgccgctagagtgatttacgacttgctcttcttctttatggtgataattatagtgctgaatcttatttttggggtgattatagacacctttgcagaccttagatccgagaagcagaagaaagaagagatcctcaaaacgacgtgcttcatctgtggactggagcgggataagtttgacaacaagaccgtgactttcgaggaacacataaaagaagaacataacatgtggcattacctctgttttatcgtactagttaaggtgaaagactcaactgaatatactggccctgaaagctatgtggccgagatgataaaagaacggaatctagattggtttccccgtatgagagcgatgagtctggtgagctccgactctgagggtgaacagaacgaactcagaaacttgcaggagaagctggaatcgacaatgaagctagtaaccaacctatcggggcaactgagcgagcttaaggaccaaatgaccgaacaaagaaaacagaagcagcgcataggcctgctggggcatcccccacacatgaatgtgaacccccagcaacctgccta

SEQ ID NO: 226792 - DNA, 2166 bp, Artificial Sequence
  Description of Artificial Sequence: Synthetic coding sequence
atgtctgataaaatgagttccttcctccatatcggagacatctgctccctttacgcggaaggaagcacgaatgggtttatctccacccttggcttggtagacgatcgctgcgtagtgcaacctgagactggcgacctgaacaatccccctaaaaagtttcgggattgtctcttcaagttatgcccaatgaatcgttactctgcccagaaacagttttggaaggcagcaaagcccggtgcgaactctacgaccgacgccgtcctcctcaacaaactccatcacgctgctgacctagagaaaaaacagaacgaaacagagaatagaaagctactgggaactgtgatccagtatggaaacgtgatacagctgctgcacctcaagagtaacaagtatctcacagtaaacaaacgcttacctgcactgctcgagaagaatgcaatgcgcgtgactctcgacgaggcagggaacgaggggtcctggttttatattcagcctttttacaagttgagatccatcggagattccgtggttatcggcgacaaagtcgtcctgaatcctgttaatgccggacagcctctgcatgccagctcccatcagcttgtggataaccctggctgcaacgaagttaacagcgtaaattgcaacaccagttggaaaattgtcctgtttatgaagtggagtgataataaggacgacattctgaaaggtggcgatgtggtgagactgtttcatgcagaacaggaaaaatttctgacctgcgatgaacacaggaagaaacagcacgtcttccttaggactacagggcgtcagtccgctacgtccgcaacctccagtaaggcactgtgggaggttgaggtagtacagcacgacccttgcagaggaggtgcaggatactggaactcactctttaggttcaaacacttggcaacaggccattatctagccgctgaagtggatcctgacttcgaggaagagtgtctggagtttcaaccctcggtgtgcaataaaataatatttcttatgagtttcgtgggaaactgtggcacttttactagaggatacagagccatggtgcttgacgtggagtttctctaccatcttctctatctggtaatatgtgctatgggtctgttcgttcacgaattcttctacagtctattactgtttgacctcgtctacagggaagaaacactcttaaacgtgatcaaatccgtgaccagaaacggccgtagcattattttgaccgctgtgctggctctcatactcgtttatctgttttcgatcgtgggttatctgttcttcaaggatgatttcatattagaagtggatcggctcccaaatgagactgcagtgcctgagacgggtgagtccttggctagtgaatttctgtttagtgatgtttgtcgcgtggaaagcggtgaaaactgctctagtcccgctcctcgcgaggagttggtgccagctgaggagaccgaacaggacaaggagcacacatgcgagactctcctgatgtgtatagtaaccgtactttctcacgggttgcggtccgggggaggagttggggacgtgcttcgcaagccctcaaaggaggaaccattatttgctgccagggtaatctatgatttgctgttcttcttcatggtcattatcatcgtcttgaatctgatatttggcgttattatcgacacgttcgctgacttgcggtctgaaaagcagaaaaaagaggagatcctgaagactacttgctttatctgcgggcttgaacgtgacaaatttgacaacaaaacggtcacctttgaggagcacataaaagaagaacataacatgtggcattacttatgttttattgtgttagtgaaggtcaaggattcgaccgagtatacaggcccagaaagttatgtggccgagatgatcaaggagagaaacctcgattggttcccgcgaatgcgtgctatgtccctcgtgagttctgactcggagggcgagcagaacgaacttcgaaatttgcaggaaaagttggagagtacaatgaaattggtgactaatctctccggacagctgtcagaactgaaggatcagatgactgaacaaagaaagcagaaacagaggatcggtctgctcgggcatcctcctcacatgaacgtcaatccccagcagcctgcttag

SEQ ID NO: 226793 - DNA, 546 bp, Artificial Sequence
  Description of Artificial Sequence: Synthetic coding sequence
atgacagagaaaatgagttcattcttgtatatcggggacatcgtttccctgtacgctgaagggtcagtgaacggattcatttctacgctgggactggtggacgataggtgcgtggtgcacccggaggcaggtgacttggcgaatcctcccaagaagttcagggattgcttgtttaaggtgtgtccaatgaataggtattctgcacaaaagcaatattggaaagcaaaacaagcaaagcagggcaaccatacggaagctgccctgctcaagaaactacagcacgccgctgaactggagcagaagcaaaacgaatcagagaacaagaagctcctgggtgaaattgtcaaatatagtaacgtcattcagctcctgcacataaagagtaacaagtacctgacagtgaacaaaaggctgccagctttgctggaaaagaacgccatgcgcgtctccctcgatgcagctggtaatgagggctcatggttttatatccacccattttggaaactacgctccgagggcgataacgacgcatcattttggatttag

SEQ ID NO: 226794 - DNA, 8105 bp, Artificial Sequence
  Description of Artificial Sequence: Synthetic coding sequence
atgaccgagaaaatgtcctccttcctctatattggagatatcgtgagcctctacgcggagggctccgtgaacggttttatatccacgctggggcttgtagatgaccgttgcgtggtgcacccagaggccggagatctggcaaaccctccgaaaaagtttagggattgcttatttaaggtctgtcctatgaacaggtatagcgcccagaagcagtactggaaagcgaagcaggccaaacagggcaatcacaccgaggcggcactcttaaaaaaattgcagcatgccgctgagctggagcaaaagcaaaacgagtcagagaacaaaaaactcctcggagagatcgtgaagtactccaatgtcattcagctcctccacatcaaatctaacaagtacttgacagttaacaaaagactgcccgctctcctggagaagaacgccatgcgggtgtcactggacgccgctggaaatgagggcagctggttttacatacacccgttttggaagcttcggagtgaaggtgacaatattgtggtgggcgacaaggtcgtgctgatgcccgtaaacgccggacaacctttacacgcctctaacatagagctcctggacaatccgggttgtaaagaagtgaacgccgtaaactgcaacacttcctggaagattactctgtttatgaagtactccagctacagagaggacgtgttgaagggaggggacgtggtcaggctattccatgccgagcaggaaaagtttcttacatgtgatgaatacgagaaaaagcagcacatcttcctgagaacaaccctgaggcagtctgctactagcgccacaagctccaaagctctctgggagatcgaggtggtgcatcatgacccttgtaggggaggggctgggcagtggaactccctcttcaggtttaagcacctggctaccggtaattaccttgccgctgagcttaatccagattatcgcgacgcccagaacgaagggaaaaacgtgcgagatggtgtccctccgacctcaaaaaagaagagacaggcaggggagaagattatgtatacactcgtgtccgtaccccatgggaacgacatagcaagtctgtttgagctcgatgctactacactgcagagagctgattgtctggttccgagaaattcctacgtcaggctgcgacacctctgcaccaacacctgggtgaccagcacttccatacctatcgatactgatgaagagagaccagtcatgctgaaaatcggcacctgccagacgaaggaggacaaggaagcattcgccattgtgtctgttcctctgagcgaagtccgagacctggatttcgccaatgacgctaataaagtcctggccacaacggtaaagaagctggaaaacggcacaatcacacagaatgagaggcggttcgtgaccaaactgctcgaggacctgattttctttgtggctgatgtgccaaataatggccaagaggtgttggacgttgtaatcacaaaacccaaccgggaacggcaaaagctgatgagagaacagaacattctggcacaggtgttcgggatcctgaaagctccattcaaggagaaggccggagaaggctcgatgctgcgccttgaagatcttggagatcagaggtacgcaccatataaatatatgttgcgactctgctatagagtcctgcggcatagccaacaggactatcgaaagaatcaggagtatattgcgaagaacttctgcgttatgcagtctcagataggatacgatattctggccgaagatactataactgcgctgttgcataacaatcgcaaactgctggaaaagcacatcaccgctaaggaaattgagacattcgtgtccttgttgaggcgtaacagagaaccacggtttctggactacctgtccgatctgtgcgttagcaacactaccgccattcccgtgacccaggaactgatttgtaaatttatgttatctcctgggaatgccgacatcctgattcagacaaaggtcgtatctatgcaggcagataaccccatggagtcctctattctcagtgatgatatcgacgacgaggaagtgtggctctactggattgactccaacaaagaaccacacggcaaggctattcgtcacctggcacaggaggccaaagaagggacaaaggcggacctggaagtattaacatactatcgttaccagctgaacctcttcgcaagaatgtgcctggatcgacaatacctggcgatcaatcagatctccacccagctcagcgtggatctgatcttaaggtgcgtgagtgacgaatccttgcctttcgacctccgagcatcattttgccggctcatgctccacatgcacgtcgatcgagatcctcaggaaagcgtggtgcctgtgcgatatgcgagactctggacagaaatcccaacaaagattaccattcacgagtatgactcgatcaccgactcgtctcgcaatgacatgaaaaggaaattcgccctgaccatggagttcgtggaggaatacctcaaggaagtggtaaatcagccctttccattcggcgataaggaaaagaataaattaacctttgaagtggtccacctcgccagaaatcttatttatttcggcttttacagtttttctgagctactccgcctgactcggaccctgctagcaatcctcgacattgtccaggccccaatgtccagctactttgaaagattgtcaaaattccaggatggtggcaataatgtgatgagaaccatccacggcgtaggcgagatgatgacccagatggtgttgagcaggggatccattttcccaatgagcgtgccagacgtgccgccatccattcatccaagcaaacaggggtcacctaccgagcatgaggacgtcaccgttatggatacaaagctgaaaattattgagattctacagttcatcctctccgtaaggcttgactatcgcatctcgtacatgctgtccatatataagaaggagttcggggaggacaatgacaacgctgagaccagcgccagcggatctcccgatacactactaccttcagctattgtacctgacattgatgaaatcgccgctcaggcagaaaccatgttcgctggtaggaaggaaaagaatcctgtccagctggacgatgagggtggcaggacttttttacgggtgttaattcacctgatcatgcatgattatcctcctctgctttccggggcactccagctactgtttaaacacttctctcagcgggctgaggtgctgcaagcttttaaacaggttcagctgctggtatccaatcaagacgtggacaactacaaacaaatcaaagcagatctggaccagctaagactgacagtggaaaagtccgagttatgggtcgaaaaatcttctaattacgagaacggagagataggtgagagccaggtgaaaggaggggaggagccgattgaggagtctaatatcctatctccagttcaggatggcaccaagaagccccagatcgatagcaataaatcaaacaactaccgaattgtgaaagagatccttattagactcagcaaactgtgtgtgcaaaataaaaagtgtagaaatcaacaccagagactgctgaagaacatgggagcccacagcgtggttctcgacttgctgcagatcccttacgaaaaaaatgatgagaagatgaatgaagtgatgaatctcgcacatacgttcctgcagaatttttgtcggggaaaccctcaaaatcaggtcttattgcacaaacacctcaacctgtttctcacccctgggttactcgaagccgaaaccatgaggcatatatttatgaataactaccatctttgtaatgaaatttctgagcgcgtggtccaacactttgttcactgtattgagacccacggaaggcatgttgagtatttgagattcttacagacaattgttaaagcagacggcaagtacgtaaagaaatgtcaggacatggtgatgaccgaactgatcaatgggggtgaagatgtgttgatcttctacaatgatcgcgcatcttttcctattcttctgcacatgatgtgcagcgagagggatcgcggagatgagtccggcccactggcttaccacatcacccttgttgagttgctggcagcctgtaccgagggcaaaaatgtctacacagaaatcaagtgtaacagcctgctgcctttggatgatatcgtgcgagtggtaacacacgatgattgcatcccagaggttaagattgcttatgttaattttgtgaatcactgctatgtcgatacagaggtcgaaatgaaggagatttatacctcaaatcatatatggaagctgttcgagaatttcttggtcgacatggcaagggtctgcaacaccaccactgatcgaaaacacgccgacatctttttggagaagtgtgtcactgagagtattatgaacattgtctctggctttttcaattctccatttagcgacaattctacctctctccagacacatcaaccggttttcatccagttattgcaaagtgcttttaggatctataactgtacttggcctaatcctgctcagaaagcctctgtggagtcctgtataaggaccctggcagaagtggctaaaaatcggggtatagcaatccctgtcgacctggacagtcaggtaaacactctgttcatgaagtcccattcaaatatggtacagcgtgccgctatgggctggcggctgtcagcccgtagtggcccaaggttcaaggaagccctaggcggtccagcttgggattatcggaatatcatcgagaagctccaggatgtggtggcctcactggaacatcaattttctccaatgatgcaagctgagtttagtgtcttggtggatgtcctgtatagtcccgagctgctttttcccgaggggagcgacgctcgcattcgctgtggcgcatttatgagcaagttaattaaccatactaagaagctcatggaaaaggaagaaaaactttgtattaagatcctgcaaacgctgagggagatgctagaaaaaaaagattcttttgtagaggaagggaataccctgagaaagatcctgttaaacagatatttcaagggggactatagtatcggcgtcaatgggcacctgtctggggcatactctaagaccgcacaagttggaggcagctttagtggccaggattccgacaagatgggcatttccatgagcgacatccagtgcctgctggataaagagggggcaagtgaactcgtgattgatgtgatcgttaatacaaagaacgaccgaattttctccgagggtatatttctcgggattgctctcttggaaggaggcaacactcagacccaatattcattttaccaacaattgcacgaacagaaaaagagcgagaagttcttcaaagtgctttacgatcgaatgaaagccgcacaaaaggagatccggtccacagttactgtgaacaccattgatttgggcaacaagaaacgagacgacgataacgagttgatgacgtccggcccacgcatgcgtgttagagattctacactgcatcttaaggaaggaatgaagggccaactgacagaggccagtagcgcaacatcaaaggcctactgcgtgtaccggagggagatggatcccgaaatcgacatcatgtgcacaggccctgaggccggaaatacggaagaaaagagtgctgaagaggtcacaatgtccccagcaattgccataatgcagcccattcttcgctttctgcaacttctgtgcgagaaccacaaccgcgaattgcaaaactttcttaggaaccagaacaacaaaaccaactacaaccttgtatgcgaaactctccaatttctagattgcatctgtgggtccactacaggaggcctgggtcttctgggtttatatattaatgaaaaaaatgtggctcttgttaaccagaacctggagtccctgaccgagtactgccaagggccttgccacgagaatcagacatgtatagcaactcacgaaagcaatggaatcgatataatcatcgccctgatactgaatgatataaatcctttgggcaaatacagaatggatctcgtgctccagctgaaaaataatgcctctaaactcctattagcgatcatggaatccagacatgattctgagaacgctgaaagaatcttgttcaacatgcgtccgagggagttagttgacgttatgaaaaacgcctataatcaaggcctggaatgcgaccacggggatgatgagggaggcgatgacggagtcagccctaaggacgttggccataatatctacatcttggcccatcagctcgcaagacacaacaagctgttgcagcagatgctgaagcctggaagcgatcctgatgagggcgatgaggccctcaagtattatgcgaatcatacggctcaaatagaaattgtgcgccatgaccgcaccatggaacagatagtcttcccagtccctaatatctgcgagtatttgacgagggaaagtaagtgcagggtgttcaacaccacagagcgagatgaacagggaagcaaagtgaacgatttttttcagcagacagaggatctctacaacgagatgaaatggcaaaaaaaaattcggaataacccagcactattctggttctcaagacacatttccctgtggggcagcatcagcttcaaccttgccgtctttattaatctcgcggtggctctgttttacccattcggtgatgatggggacgagggtaccctctctcccttgttctcggtgctgctgtggattgcagtagctatttgtacatccatgctcttcttcttcagcaagccagtggggattcgaccattcctggtctcaatcatgttaaggagcatttataccatcggcttagggccaacattgatcctccttggcgcagctaatctgtgtaataaaatcgtgtttctggtgtcctttgtaggcaaccggggaacatttacacgtggatatcgggcagtgattcttgatatggcattcctgtatcacgtcgcctacgttttggtgtgcatgttagggctgtttgttcacgaattcttctacagttttctcttattcgatctggtttatagggaggaaacactccttaatgttatcaaaagtgtcacgcgcaatgggagatccattatattgactgcagttctggctctgatattggtgtacctcttcagtataatcggatttcttttcttaaaagatgactttactatggaggtggaccgattaaaaaaccgcactcctgtcactggcagtcaccaggttccgacaatgacgctgaccactatgatggaagcttgtgcaaaggaaaactgcagcccaacgatccccgcaagtaatacagccgacgaggaatacgaagatggcatcgagaggacttgtgacactctgcttatgtgtatagtcactgtacttaatcaggggctaaggaatggcggtggtgtgggcgacgtgctgagacggccaagcaaggatgaaccattgttcgctgccagagtggtttacgacctgctgttctacttcatagtcatcatcatcgtactgaacttgatcttcggcgtcatcatcgacacgttcgcagatctgaggagcgaaaagcagaaaaaagaggaaattctgaagactacctgtttcatctgtggcctggagagggacaaattcgacaataaaacagtgagcttcgaagagcacattaagagcgagcataacatgtggcattacctttattttatcgtcctggtcaaggtcaaagatcctaccgaatataccggccctgagagctacgttgcacaaatgattgtcgaaaaaaaccttgattggtttccacgtatgcgcgcaatgagcctggttagcaacgagggagattccgagcagaacgaaatcaggagtctgcaagaaaagctggagagtactatgtcactcgtgaagcagttgagcggacagttggccgaactgaaagagcagatgaccgagcagcgaaagaacaaacaaagactggggttcctcggcagcaataccccacatgtgaaccatcacatgcctccacacta

SEQ ID NO: 226795 - DNA, 8015 bp, Artificial Sequence
  Description of Artificial Sequence: Synthetic coding sequence
atgtctgagatgtctagtttcctacatattggtgatatcgtgagcctgtatgccgaagggtcagttaatgggtttatctctactttagggttggtggacgacagatgtgtggtggaaccagctgctggggaccttgacaatcccccaaaaaaattccgcgactgcctttttaaagtgtgtcccatgaaccgctactcagcccagaaacagtactggaaagccaagcagacaaaacaggacaaggaaaagattgccgacgtggtactcctgcaaaaactccagcacgcagcccagatggaacagaaacagaatgatacggagaacaagaaggttcacggcgacgtggtaaagtatggatcagtgatccaactgcttcacatgaaatcgaataaatacctaaccgtgaacaagcggttacctgccttgctggagaaaaacgccatgagggtgaccctggacgctacaggcaatgaaggcagttggttgtttatacaacctttctggaagctgcgcagcaacggagacaacgttgttgttggggacaaggtaattctgaaccccgtgaacgccggacagcctctgcatgccagcaattacgaactgtccgataacgccggatgtaaggaggtaaattcagtgaactgcaacacatcctggaaaatcaatctgtttatgcagttccgcgaccacctagaggaagtgctgaaggggggagacgtggtaaggctgttccacgccgagcaggaaaaatttctgacatgcgacgaatataagggcaaacttcaagtgtttttaaggactaccctgaggcaatcggcaacctctgccacatcaagtaacgccctgtgggaggtggaagtggtgcaccacgatccttgccgcggtggggctggtcattggaatggactctatcggttcaagcatctggccaccggcaactatctcgccgctgaggaaaatcccagttataaaggggatgcttcggatcccaaagccgctgggatgggtgcacaaggcaggacaggacggagaaatgccggtgagaaaatcaaatactgcctcgttgcagtgccccatggaaacgatatcgcatctctgtttgagctggaccccaccactctccagaaaaccgactcctttgtcccgagaaactcatacgtgagactacggcatttgtgtacaaatacgtggattcagagtacaaacgtgccgattgacatcgaggaggagaggcccattcgtctgatgctgggtacttgtcccacaaaggaggacaaagaagcctttgcaatcgtctccgtacctgtgtctgagatccgggacctggacttcgcaaacgacgcgtctagtatgttagccagcgccgtagagaaattgaatgagggatttatttctcagaatgacaggcgttttgtgatccagttgctcgaagacctggtgttttttgtttctgatgtgcccaacaatggccagaacgtgttggatattatggttactaaacctaacagggagcgccagaaactgatgcgggagcagaacatcctcaaacaagtctttggaatccttaaggctcctttcagagaaaagggtggagagggacccctggtgcgccttgaagaactgtcagatcagaagaatgccccttatcagcatatgttccgactgtgttatagggtccttcgccacagccaggaagactatcgtaagaaccaggaacatattgccaaacagtttggaatgatgcagtcccaaattggctacgatatcctggctgaggacacaataaccgccctactccacaataaccgtaaactgttagagaagcacatcactaagactgaagtggaaactttcgtttccctggtgcgcaagaaccgcgagccaaggtttctggattacttgtctgatctgtgtgtaagcaaccacattgctattcctgtaacccaggagctaatctgcaaatgcgtcctggatccaaagaacagcgacattctgattagaactgagctgcgtccagtgaaggagatggcccagtcccacgagtacctgtctattgagtacagtgaggaagaggtctggttgacttggaccgataaaaataatgagcatcacgagaaatctgtgcgccagctggcacaagaggcccgtgccggaaacgcacatgatgagaatgtcctcagctattatcggtaccagcttaaactgttcgccagaatgtgtctggatagacagtatctcgcaatcgatgagatctcacagcagttaggagttgatctcattttcctgtgcatggcagacgagatgctccccttcgaccttcgtgcgtcgttctgccacttgatgttgcacgttcatgttgaccgggatcctcaggagttggtgaccccagtcaagttcgccaggctgtggacggagatacctaccgccataaccatcaaggactatgattcaaatttgaatgctagccgagatgacaaaaaaaacaagttcgctaatactatggaattcgttgaagactatctgaataatgtggtaagcgaagccgtcccatttgctaacgaagaaaagaataagttgacattcgaagtggtcagtctagcccacaatttgatatacttcggattctatagcttctcggaactccttcgcttgactaggaccttactgggcataatcgactgtgtgcagggtccccctgccatgctgcaggcttacgaagacccgggtgggaagaacgtgagacgatcaatccagggcgttggacacatgatgagcacaatggtgctcagtcggaaacagtccgttttcagcgcaccaagcctgagtgccggagcatctgccgcagaacctctggacagatctaagtttgaggaaaacgaagatattgtcgtaatggagactaagctgaagattcttgagatccttcagttcatacttaacgtccggctcgattatcggatatcgtatctgctgagcgttttcaagaaagaattcgtggaagtgttccctatgcaggactccggtgccgacggtaccgcacccgctttcgacagtaccactgccaatatgaatttagaccgaattggggaacaggcggaggctatgttcggggtgggtaagactagcagcatgctggaggtggacgatgaaggcggtcggatgttcctgcgggttctgatccatctgaccatgcacgattatgcaccacttgtgtcgggcgctctccaactgttgttcaagcatttttcccagcgccaggaggcaatgcacacctttaaacaagttcaattattgatcagcgcccaagatgtggagaattacaaagtcatcaagtccgagctggaccggctccgaacgatggtggaaaagagcgagctctgggtggataaaaagggcagcggcaagggggaggaagtagaagccggagctgccaaagataagaaagagcgtcccaccgacgaagaggggttcctgcaccctcctggcgagaaaagttctgagaattaccagatcgtgaaaggcattctggagaggctgaacaagatgtgcggcgtcggcgaacagatgcggaagaaacaacagcgcctcctgaagaacatggacgcccacaaggttatgctggatctgctccagattccctatgacaaaggggacgctaagatgatggagatcctgagatacacccaccagtttctgcagaagttctgtgccggtaatcctgggaatcaagctttgctgcataagcatctgcatctatttctcacccctgggctgctggaggcggagaccatgcagcacatctttctgaacaactaccaactgtgctccgagattagcgaaccagtactacaacacttcgtgcacctcttggcaacacacgggagacacgtacagtacctggactttctgcacactgtgatcaaagcggagggcaagtacgtcaagaagtgccaagacatgattatgaccgagctgactaacgccggagacgatgtagtcgtgttctacaatgacaaggcctctctcgctcatctgttggatatgatgaaagcagctcgcgacggggtagaggaccacagccctttaatgtatcatatctcgcttgtggacctgctggccgcttgtgctgagggcaagaacgtgtatacagagattaagtgcacttctttgctgccactggaagacgtggtgtccgtggtgacacatgaggactgtattaccgaggttaaaatggcgtacgtcaatttcgtgaaccattgttacgtggatacagaagtggagatgaaggagatctatacttctaaccacatttggacactgtttgagaactttaccctcgatatggcgcgagtatgttccaagagagaaaagcgagttgcggaccccactctggaaaagtacgtactttccgtggtactggatactatcaacgctttcttttcctcacctttttccgagaattcgacaagcctacagacacaccagaccattgtagtccaattgctccagtccactacaagacttctggaatgtccctggttgcagcagcagcacaaagggtccgtggaagcctgcatccgaacactggccatggtcgccaaagggagggccattctattgccaatggatctggacgcccacatctcttccatgctgtctagcggtgccagttgcgccgcagccgcacaacggaatgcctcatcctataaagctaccactagggccttcccaagggtcacgcccaccgcaaaccaatgggactacaaaaacatcattgagaagctgcaggacatcataaccgctctggaggagcgactgaaacccctggtgcaggctgagctgtctgtgctggtcgacgtgttgcactggccagaactcctatttctggagggaagcgaagcctaccagagatgcgaatctggaggattcttgtcgaaactgatccaacacacaaaagacctgatggaatctgaggagaagttatgtattaaagtgttaagaacactacagcagatgttactcaagaagacgaaatatggcgatcgtgggaaccagctgcgcaagatgctcctccagaactacctgcaaaaccgtaaatccactagtaggggcgacctccccgatccgatcggcacgggccttgatccagattggtccgccatcgctgctactcagtgtcggctcgacaaagagggggctaccaagctggtatgtgatctcatcacttccactaagaacgaaaaaatctttcaagagagcataggcctggctattcacctactggatggcggtaatacagagatccaaaagtctttccacaacttgatgatgtcggataagaaatccgagcgtttcttcaaggtgcttcacgatagaatgaagagggctcaacaggagacgaagagcaccgttgcagtgaacatgaacgacctcgggtcccaaccccacgaggaccgtgagcctgtcgaccccactactaaaggacgcgtagcgtcattttctatccctgggagctccagtaggtattccttaggaccatccctgcgtcgaggacacgaagtgagcgaacgggtgcagtcatcagaaatggggacatccgtgctcatcatgcagccaatcctcaggtttctccagttactgtgcgagaaccataaccgagacctgcagaacttcctgcgatgtcaaaacaacaagacaaattacaatctggtttgtgagacactgcagttcctcgatatcatgtgtggcagcacgaccggcggattgggactcctaggcctttatatcaacgaagacaatgttggccttgtgatccagactttagagactttaacagaatactgccaggggccatgtcatgagaatcagacatgtatcgtgactcacgaatcaaacggcattgatataatcaccgccctgatcctgaatgatatttctcctctttgcaagtatagaatggatctggtcctccagctaaaagataacgcaagcaagctgctgcttgcacttatggaatcccgacacgacagtgaaaacgctgagcggatcttgatttcacttagaccacaagagctagttgatgtgatcaaaaaggcctacttgcaggaggaggagcgcgagaacagcgaggtgtcccctagggaggttggacacaacatttacattttagccctgcaactcagcagacacaacaagcagctgcagcacctcctaaagccagtgaagcgcatccaggaggaggaggcggaaggcatttctagcatgctaagcctgaataacaaacaactgagccagatgttgaaaagttctgctcctgcccaggaggaagaagaagacccactcgcctactatgaaaaccacacttctcagatcgagatcgtgagacaagatagatccatggagcaaatcgtgtttccagtcccgggtatttgtcagttcctgacagaggaaacaaagcaccgactcttcacaacaactgagcaggatgaacagggatcaaaagtgagcgacttctttgaccagtcctctttcctccacaacgagatggaatggcagagaaagctccggagcatgccactgatctattggttttctaggcggatgacattatgggggtctatctctttcaatttggccgtgtttatcaacattatcatcgcgttcttttacccgtacatggagggcgcttctactggtgtccttgactctcctctgattagtctgctcttctggattttgatttgcttctccatagccgctctgttcactaagcgctatagtattaggcctctgatcgtggccctaatactgcggagtatctactatttgggcattggtcctacactgaatattctgggtgcactcaatctcacaaacaagatcgtgttcgtcgtttcttttgttggcaaccgaggaacatttatcagagggtataaggcaatggttatggatatggaatttttgtatcacgtaggttacatattgacctccgtgctgggcctgtttgcacacgagcttttttactctatcctcctgttcgatctgatttacagggaagagacactctttaatgtgataaagtcggtgactagaaacggaaggtccattctcctgaccgcgctgctggcactgattctggtttatctcttctctatagtcgggtttctttttcttaaggacgattttatcctggaggtcgacaggttgccaaataatcacagtacagctagccctctggggatgcctcatggcgctgcagcttttgttgatacctgttccggcgacaagatggactgcgtctctggattgtctgtaccagaggtactcgaggaggacagagagcttgattccacggaacgtgcatgcgatacgctgttgatgtgcatagtgacagtgatgaaccatggcctccgcaatgggggtggggttggtgacatcttgcggaagcccagcaaagatgagtcactgtttcctgccagagtagtttatgatctactgttcttctttattgtgataatcatcgttctgaaccttatttttggagtaatcattgacacctttgctgatctgcgaagcgaaaagcagaaaaaagaggagattctgaaaaccacttgttttatctgcgggctggagcgcgataagttcgacaataaaacagttagcttcgaggagcacattaaactggagcacaatatgtggaactacctctacttcattgtgctagtgcgagtcaaaaacaaaacagactacacgggcccagaaagctacgtggcccagatgatcaagaacaagaatttggactggttccctcggatgagagccatgagtcttgtctctaacgagggggagggtgaacagaatgagataagaatacttcaagataaactcaacagcacaatgaagctggtctcacatttgacagctcagctgaacgaactgaaagaacagatgaccgaacagcgcaagaggcgccagaggcttgggttcgtggatgtgcagaattgtatctctcgtta

SEQ ID NO: 226796 - DNA, 1326 bp, Artificial Sequence
  Description of Artificial Sequence: Synthetic coding sequence
atgtgtgtctgtcagacgatggaagtaggtcagtacgggaagaacgcctcccgagccggtgataggggtgtgcttctagagccattcatccaccaggtgggcggacactcctctatgatgcggtacgatgaccacacagtttgtaaacccctgatttcccgcgaacagaggttctacgaaagcttgcctcccgagatgaaggagttcacacctgagtataaaggagtggtgagcgtgtgctttgaaggcgactccgatgggtacattaacctggtcgcatacccatacgtggaaagtgaaactgtggaacaggatgacactactgagcgtgaacagcctagacgcaaacattctagacggtccctacacaggagcggctcgggatctgaccacaaagaggagaaggcctcactatccttagagaccagcgagtcttcccaggaagctaagtctccaaaagtagagctacatagccactccgaggttccctttcaaatgttagacgggaatagtggcctaagtagtgaaaaaatctctcacaacccttggtcccttagatgccataagcagcaattgtccagaatgagaagcgaatcaaaggaccggaaactttacaagtttttgctcctagagaatgttgtccatcacttcaaatacccatgcgtgctcgatctcaagatgggaacacgccagcatggagacgacgcgtctgctgaaaaggccgcaaggcaaatgcggaagtgcgagcagtctacaagtgccaccttgggggtccgcgtctgcggcatgcaggtctaccagctggataccggacactacctttgtcggaacaagtattacggcagagggctcagcattgagggatttagaaacgctctgtatcagtatttacataacggtctagatttgagaagggacttgtttgaacccattctttctaaactccgcggactcaaagctgtgctggagcgtcaggccagttataggttctacagcagtagccttctggtgatctacgacggaaaagaatgtcgcgcagaatcatgtcttgatcgccgaagcgaaatgagactcaagcatcttgatatggtgctccccgaagtggcatcctcatgtggaccctctacaagcccaagcaatacgtcgcctgaagcaggcccaagctctcagcctaaggtggatgttaggatgattgacttcgcgcattctacgtttaagggcttcagagatgatcctacagtgcatgacggaccagaccgtgggtatgtctttggactcgagaatctgatctctatcatggagcagatgagagatgagaaccagtag

SEQ ID NO: 226797 - DNA, 831 bp, Artificial Sequence
  Description of Artificial Sequence: Synthetic coding sequence
atgttagatggtaatagtggcttgtcatctgaaaagatctcacacaacccgtggtctctgcgttgccacaagcaacagctgtcccggatgcgctcagaatcaaaagatcgaaagctgtacaagttcctcctgcttgagaatgtggttcatcacttcaaatacccatgcgtcctggatctgaagatgggaactagacagcacggggacgacgcctcagccgaaaaagccgcaagacaaatgagaaagtgcgaacagtccacatcagccactctcggagtacgggtctgcggcatgcaggtgtatcagttggatacaggtcactacctttgtcggaacaaatattacggcagaggcctgagtatcgaggggttccgtaatgccctatatcagtacctccataacgggttggacctcagaagggacctgttcgagcctattctctccaaactgcggggactcaaggccgttctcgagagacaagcctcctatcgattctacagctcatccttattagtgatctacgatggcaaggaatgcagggcagagagttgcttggatagaaggtccgagatgaggttaaaacatttggacatggtgcttcccgaggtcgcatcctcatgcgggccttctaccagcccttcgaatacctcgcctgaagccggtccatcctcacagcccaaggtggatgtccggatgatcgacttcgcccactctaccttcaaagggttccgagacgaccctaccgtccacgatggacccgaccggggatacgtgtttggcttagagaatctcatctctataatggagcagatgagagatgagaatcagtag

SEQ ID NO: 226798 - DNA, 831 bp, Artificial Sequence
  Description of Artificial Sequence: Synthetic coding sequence
atgctggacggcaattccgggctctcttcagagaagattagtcacaatccttggtcgttgcgctgtcacaaacagcagctgagccgaatgagatccgaatcgaaagacagaaaactgtataagttcctgcttctggaaaatgtcgtccaccatttcaagtacccatgcgtattggacttaaaaatgggaacccggcagcatggcgacgacgcctccgcggagaaggccgcacgacagatgaggaagtgtgaacaatctacatctgcaaccttgggcgtgagggtatgcggaatgcaggtctaccaactagatacgggtcattacctctgtaggaacaagtactacggtagaggcctgtctatcgagggcttccggaacgccctgtaccagtacttgcacaacggcctggatttgcgccgagacttattcgaacccattctgtctaaacttcgcggtttgaaggccgttttggagagacaagccagctatcgcttttatagctcctctctgttggtcatctatgacggtaaagagtgccgtgccgagtcgtgcttagaccggagatccgaaatgcgactgaagcatctggatatggttctccctgaggttgcaagtagttgcggcccatctactagcccgtcaaatacctcccctgaagctggaccctcctcccagccgaaagtggacgtccgcatgattgattttgctcactccacctttaagggcttcagggatgaccctactgtccacgatgggcctgatcgaggctacgttttcggcttagagaacctcatctctatcatggagcagatgcgggacgagaatcagtag

SEQ ID NO: 226799 - DNA, 1281 bp, Artificial Sequence
  Description of Artificial Sequence: Synthetic coding sequence
atgtctcctgcctttcgggcaatggatgtggagcctcgcgctaaaggtgtcctgctagaaccatttgtgcaccaggtcggtggccatagttgtgtacttcgatttaacgaaacgacgctgtgtaaaccccttgtgccacgagaacatcaattctacgagactctcccggcagaaatgaggaaattcacacctcagtacaaaggcgtggtttccgtgaggttcgaggaggacgaggatagaaacctctgcctaatcgcttaccccctgaaaggggatcacggaattgtagatattgtcgacaacagtgactgtgaacctaagagcaaactcttacgctggacaactaacaagaaacaccacgtactggaaaccgaaaagaccccaaaggattgggtcaggcagcacaggaaagaagaaaagatgaagagccataagctcgaagaggagttcgagtggcttaaaaagtccgaggtactctattatacagtggagaaaaaaggtaatatcagttcacagctgaagcattataacccttggtctatgaaatgtcatcagcagcaacttcagcggatgaaggagaatgccaaacatcggaatcaatacaaattcattctcttagagaacctcacatcgcggtacgaagtgccctgcgttctggacctgaagatggggaccagacagcacggggatgacgcttccgaagagaaggcagcaaaccaaatcaggaagtgtcagcagagcacatcagcagttatcggtgttcgcgtgtgcgggatgcaggtctatcaagccggaagcggccagctcatgtttatgaacaagtatcacgggcgaaagttatctgtccagggttttaaagaggcactgttccaatttttccataacggtagatacttacggagggaactgctgggcccagtgctaaagaagcttaccgaactgaaagcagtgcttgaacgtcaagaatcttacaggttttacagtagctctctcttggtgatttatgatgggaaggaacgaccagaggttgtgcttgattctgacgctgaagacctcgaagacctgtcagaggaatccgcggatgagtcagcaggcgcatatgcctacaagccaatcggagcgtccagtgtggatgtgcggatgatagactttgcccatacaacgtgccggctatacggagaagacactgttgtgcacgaagggcaagacgccggttatatttttggtctgcagtctcttattgatattgtcacggaaatttcagaggagtcgggcgaatag

SEQ ID NO: 226800 - DNA, 294 bp, Artificial Sequence
  Description of Artificial Sequence: Synthetic coding sequence
atgtctccagctttcagggctatggacgttgagcccagggcaaagggggtcctgctcgagcccttcgtgcatcaggtgggaggtcacagctgcgtcctgaggtttaatgaaaccaccctgtgtaaacctctggtgccccgtgaacaccagttctacgagaccctgcccgctgagatgcgcaagtttaccccacagtataaggggcagagccagcggccactggtgtcctggccttccttgccccacttttttccctggtcctttccactgtggcctcagggttctgtagcatag

SEQ ID NO: 226801 - DNA, 294 bp, Artificial Sequence
  Description of Artificial Sequence: Synthetic coding sequence
atgtcaccagcgttccgtgctatggacgtggaacctcgggctaagggtgtactattagagcctttcgtccaccaagtggggggacacagttgtgtgctaaggttcaacgaaacaacattgtgcaagcctttggtccctagagaacatcagttctacgaaactttacctgccgaaatgaggaagttcacaccacagtataaggggcagagccaaagacccctggtgtcatggcccagcctgcctcacttctttccgtggagtttccctctgtggccccagggatcagtggcctag

SEQ ID NO: 226802 - DNA, 558 bp, Artificial Sequence
  Description of Artificial Sequence: Synthetic coding sequence
atgagcctgaatctgccggaggcctctctcctctccagggccagctggccagagcaggccaaagagccgcgacgagagggccacaccgataagcagcagacagaggacgtattggccgcagggctgcgatgtcttccacacctgccagctatttgtgcccgacggatgagtcccgcttttcgggctatggatgtagaacccagagccaagggcgtgctgctggagcctttcgtgcatcaggtaggcggtcactcctgcgtgctccggttcaatgagactacattgtgcaagccattggtgcccagggagcatcaattttacgaaaccctgccggctgagatgcgaaagttcacaccgcagtacaaggggaagtcacaacttttggaaggccttccccactggcgcggagacgtgagggataggggccatgggaggccgtggcagccaagcctagagccaagcctgccacccaccctgtgctttccgtcactctctagtttctcaagcagttggccttctgcgcaacatcttaccccaagcgtgtttaacccatggtag

SEQ ID NO: 226803 - DNA, 264 bp, Artificial Sequence
  Description of Artificial Sequence: Synthetic coding sequence
atgtctcctgctttcagggccatggacgtcgaaccccgagccaaaggggtgctgctcgaacctttcgtccaccaggtgggcggtcactcttgcgtgctgaggttcaacgaaactactctgtgcaaacctctggtcccccgagaacaccagttttacgaaaccctccctgctgagatgcgcaaattcactccccaatataaaggagatatctcttcccatcagcatggcggagtatttgtcggggaatgggggtcattgctgtag

SEQ ID NO: 226804 - DNA, 567 bp, Artificial Sequence
  Description of Artificial Sequence: Synthetic coding sequence
atgaacctctgccaatctccttttcaggaaggttgccagtctttgttggcctcgtggcctgagcaggccaaggaacctagacgagagggacatacagacaaacagcagacggaggatgttcttgccgctggcctgaggtgcctaccccatctgccagccatctgcgcaagacgaatgagcccagctttccgcgcaatggacgttgaaccccgtgctaagggggttctcctggagccatttgtacatcaagtcggaggccactcgtgtgtcctcagattcaacgaaacaacattgtgtaaacctctggtgccaagggagcatcagttctacgagacactgcccgcagagatgcgaaagttcaccccccagtacaaagggaagtcgcaactgcttgaagggcttcctcattggaggggtgacgtacgagatcgcggacacggcagaccctggcagccatccctggagccctcattgccacccaccctttgcttcccctccttaagcagcttctcctccagctggccctccgcccagcaccttactccatcagtgttcaacccgtggtag

SEQ ID NO: 226805 - DNA, 1233 bp, Artificial Sequence
  Description of Artificial Sequence: Synthetic coding sequence
atggttgttcaaaattccgccgacgccggagacatgcgtgcaggtgttcagcttgagccattcctgcatcaggttggtggccatatgtccgtgatgaagtacgacgaacacaccgtctgcaagccgcttgtcagccgcgaacaaagattctatgaatctctccctctggccatgaaacggttcactccacagtataaagggacggtcaccgtgcatttgtggaaagacagtacggggcacctgtcactggtggctaaccctgtgaaggaaagccaggagccttttaaggtaagcaccgagtcggcagctgtcgctatatggcaaaccctgcagcagacaaccggtagcaacggttcagattgcaccctggctcagtggccccatgcccagcttgcacggtccccgaaagagtcaccagcaaaggcgctcctcaggtccgagccccacctcaataccccagccttctcgctggttgaggacaccaacggaaatcaggtggagcggaagtccttcaacccctgggggctgcagtgccaccaggcacatctgactcgcctctgctcggaatacccggagaacaagaggcaccgattcctgctgctggagaatgtcgtgagccagtacacccacccatgcgtcctggacctgaaaatgggcactcgccagcatggtgacgacgctagtgaagagaagaaagctagacatatgcgtaagtgcgcccagagcacaagtgcatgtctgggcgtgagaatttgcggaatgcaggtatatcagacagacaaaaaatactttctctgcaaagataagtattatgggaggaaattatcggtggaaggttttagacaggccctgtatcagttccttcataatggcagccacctaagacgcgaactcctagagccgattctgcatcagttgcgggctttgctcagcgttatacgcagccaatcttcataccgtttttactccagtagcctgctggtcatctatgacgggcaggagccaccagagagagctcctggctctccccatccacatgaagcgcctcaggctgcccacggctctagcccaggcggtctgacaaaggtagacatccgtatgatcgacttcgcccacacgacgtataagggatactggaacgaacacaccacatatgacgggccagatcctggatacatttttgggctggagaatctcatccgcatactccaagatatccaggagggcgagtag

SEQ ID NO: 226806 - DNA, 1233 bp, Artificial Sequence
  Description of Artificial Sequence: Synthetic coding sequence
atggtggttcagaattccgctgacgctggtgatatgcgtgcaggggtccagttggagccatttctgcaccaggtgggcggacacatgagcgtcatgaaatatgatgagcatacagtgtgcaaacccctggttagtcgggagcagcggttttacgagagcctccctctcgctatgaaaaggtttactccccagtacaaaggcaccgtgactgtgcacctctggaaggactctaccggacatctttcactggtggccaatccagtgaaagagtcacaagagccatttaaggtcagtaccgagagcgccgcagtcgcaatctggcagaccctgcagcagactaccggatctaatggctccgactgcactctggcacagtggcctcacgcccaacttgctcggagccccaaagagtctccggcaaaagccctcttaaggagtgaacctcatctcaacacacctgcgttctccctcgtggaagatacgaacggaaaccaggtggagcggaaaagttttaacccatggggactgcaatgtcatcaggcccacttgacgaggctgtgttctgagtaccctgaaaacaaacggcacaggttcttgctcctggagaatgtggtcagccagtatacccacccttgcgtgttggacctgaaaatgggaacacggcagcacggcgacgatgcctccgaggaaaagaaagctaggcacatgcgaaagtgtgcacagagtacttcggcttgtctgggcgtcaggatatgtgggatgcaggtgtatcagaccgacaaaaaatactttctctgtaaggataagtactatgggagaaagctcagcgttgagggcttccgccaggctttatatcagttcctccataatggctctcacttgagacgcgagctgctggagccaattctccaccagctgcgggctctcctgtctgtcattcgaagtcagagctcctataggttctatagtagcagcctattggtcatctacgacggtcaggaaccgccagagagggccccaggctccccgcatccccatgaagcacctcaggccgctcacggcagttctcctgggggacttacgaaggtagatataagaatgatagattttgcccacactacttataagggttactggaacgagcacactacgtatgatggtcccgatcctgggtacatctttggactggagaatctgattcggatcctccaggacatccaagagggcgaatag

SEQ ID NO: 226807 - DNA, 1080 bp, Artificial Sequence
  Description of Artificial Sequence: Synthetic coding sequence
atggcgcctatgggaatccggttgagccctctcggggttgccgtgttttgccttctgggactgggagtcttgtaccatctgtatagcgggtttttagccggaaggttctccctttttggtctggggggagagcctgggggaggagctgccggacccgcagctgccgctgacggcggtactgtggacttgcgagagatgctggccgtgagtgtcctggctgctgtgagagggggtgatgaggttcggcgagtgagagagtcaaatgtgctgcatgagaaaagcaaaggcaagacccgagaaggagctgaagacaagatgacctccggcgatgttttgtcaaatcgaaaaatgttctacttgctgaagactgcctttccctcagttcaaatcaataccgaggagcacgtagacgccgcagaccaggaagtgattctgtgggaccacaaaatacccgaagacatcctgaaggaagttacaacgcccaaggaggtccccgcagaaagcgtcactgtctggattgatccccttgacgccactcaagaatacacagaagacctgaggaagtatgtcactacaatggtgtgcgtggctgtgaacggcaagccaatgctcggggtcatccacaagccattctctgaatatactgcatgggctatggtggacggagggtcaaatgtcaaagcaaggtcttcttacaacgagaagacgccacgaatagttgtgagccgttcccactccggcatggtcaagcaagtagcgttacagacatttgggaatcaaaccaccatcattcccgctggcggagcgggttataaagttctagcgctcctggatgtaccagataagagccaagagaaagccgacctttatatccacgttacatacatcaaaaagtgggatatctgcgccggaaacgctattctcaaggctcttggcggtcatatgaccacactcagcggcgaggagatcagttacaccggatccgacggcatcgagggcggactgctcgcttcaatccgcatgaatcatcaagcgctggtgcgcaaactccccgacctggaaaagaccggccacaagtag

SEQ ID NO: 226808 - DNA, 1251 bp, Artificial Sequence
  Description of Artificial Sequence: Synthetic coding sequence
atggcgacagagccgccttcccctctgcgcgttgaggccccagggcctcccgagatgcgaacatccccagccatagagagtactcctgagggcaccccacagccagccggaggacgcctgcggtttcttaatgggtgcgttccactatctcaccaagtcgccggacatatgtatgggaaagataaggtcggaatcctgcaacacccggacggcacggtgctgaagcagttgcagccccctcccaggggacctagagagctagaattttacaacatggtctacgctgccgactgctttgatggagtgctcctggagctgaggaagtacttgccaaaatattacggaatctggtccccacctacagcccctaatgatctttacctgaagcttgaggacgttactcacaaatttaacaaaccttgcattatggatgtcaaaatcggccagaagtcctatgacccgttcgcaagttctgaaaaaattcaacagcaagtgtcaaaatacccactgatggaagagatcggcttcttggtcctgggtatgcgggtatatcatgttcactctgactcttatgagacagaaaaccaacattacggacgtagtcttaccaaagaaacaatcaaagatggggtgtctcggtttttccataatggctactgcctgaggaaggatgccgtggctgcatccatccagaagatcgaaaaaattttacagtggtttgaaaatcagaagcagcttaacttctacgcaagctccctgctgttcgtgtatgaaggctccagccagcctaccacgacgaaactgaacgatagaactctggccgaaaagtttctctcaaagggtcaactaagcgataccgaggttctcgagtacaacaataattttcatgtcctttcatccactgcaaatgggaaaatagagagttcagtaggtaaatctctgagtaagatgtacgctcgccacaggaaaatttataccaaaaagcatcacagccagaccagcctgaaagtggaaaacttagaacaggacaatgggtggaagtcaatgtctcaagagcacctcaacggaaacgtgctttctcagctggaaaaagtgttctatcacctccccacaggctgccaagaaatagccgaggttgaggtgcgcatgattgacttcgcccacgtgtttccgtcaaacaccatcgatgaagggtacgtttacggcctgaagcacctcatttccgtgctgcgttctatcctggataactag

SEQ ID NO: 226809 - DNA, 3777 bp, Artificial Sequence
  Description of Artificial Sequence: Synthetic coding sequence
atggctagcgcctgtggggcacccggaccgggaggtgcgttaggatctcaggccccatcatggtaccaccgggacttgagtcgggctgccgcagaagaactgcttgctagggcgggtcgagatggatcctttctcgtgcgcgactctgagagtgtggctggagcatttgccttgtgcgtgttataccaaaagcacgtgcacacttaccgcatcctgcccgatggtgaggatttcctggcggtgcaaacctctcaaggggtcccagtccggaggtttcagacactcggcgaactcattggactttatgctcagcccaatcaaggcttggtgtgtgcactgctgctgcccgtggaaggtgagagagagccggatccccctgacgatagggatgccagcgatggcgaagatgagaagccccctttgcctccaagatccggatccacgtctatttctgcacccaccggccctagctccccactgcctgcacccgagacacccaccgcccctgccgctgagtctgccccaaacgggctgagtactgtctcccatgattatcttaaaggttcttacggactagacctggaagctgtcaggggaggcgcatctcatctgccccacctgaccaggacgcttgcaacttcttgcagacgcctgcatagcgaagtcgacaaggtgctatccggattggaaatcttgtcgaaagtgttcgaccagcagtccagcccaatggtgacacggctgctacagcagcagaacctgccacagacaggagaacaggaactggagagcctggtactcaagctgtcggtcctgaaggacttcctctccggaatccagaaaaaggccctaaaagccctccaggacatgtcctcaacagcccctcccgctccacagcccagcacaagaaaggccaagacgatcccagtgcaagctttcgaggttaaacttgacgtgactctgggggaccttaccaaaatcggcaaaagtcagaagtttacactgtcagttgacgtggaagggggtcggttagtcttactgagacggcagagagattctcaagaggattggactactttcacacatgaccgaataaggcagcttataaagtcccagagagtgcagaataaattaggcgtggtgtttgaaaaagagaaggataggacccagcggaaggatttcatcttcgtctccgctcggaaacgtgaagcgttctgtcaactcttacagttgatgaaaaataagcacagcaaacaggatgaacctgatatgataagtgtattcattggaacatggaacatgggatcagtgcccccacctaaaaacgtgacatcatggtttacgtcaaaaggcttaggaaaaacgctcgacgaagtcaccgtaaccattcctcatgatatttacgtatttgggacacaagaaaatagcgttggtgatcgcgagtggctcgatcttctccgcggaggtttgaaggagttgacagacctagattacaggcccattgcaatgcaaagcctgtggaacatcaaagtggctgtcctggtgaaacccgagcacgaaaaccgtatttctcacgtctcaacctcctctgtgaagacaggaatcgccaataccctaggcaataagggtgcggtcggcgtttcatttatgtttaacggcacctccttcggctttgtgaattgtcacctgacgagcggaaatgagaagactgctcgcaggaatcagaattatctggacatcctgcgactactaagcctgggtgataggcagttaaatgcttttgatatctccctccgatttacgcatcttttctggttcggagatcttaactataggttggatatggatattcaggaaattctgaattacataagccggaaggaattcgagccgctgctcagagtcgaccagctgaacctcgaacgtgagaaacacaaggtttttctgaggttttcagaggaggagatttcattcccacctacgtatcggtatgagagaggatcgcgggatacctacgcttggcacaaacaaaaacctactggtgtccgcacgaacgtaccttcatggtgtgaccgcattctctggaaaagttaccctgagactcacattatatgtaatagttacggatgtactgatgatatagtgacctctgaccactccccggtatttgggacattcgaggtaggtgttactagccagttcatttccaaaaagggcttgtctaagacttctgaccaggcttacattgaattcgaaagcatcgaagcaattgtgaaaaccgcgtcacgcacaaagttcttcatcgaattttactcaacttgtttagaggagtataagaaatccttcgagaatgacgcacagtcttcagataacatcaactttcttaaagtgcaatggtcttctaggcaacttcccacactaaaacctatcctcgctgatatcgaatacctccaggatcagcacctgctacttaccgttaaatctatggatgggtatgaaagctatggcgaatgtgtcgtggcattgaagtcgatgatcggaagtacagctcaacagtttctgaccttcctgagtcatcgcggagaagagactggcaacatacggggatctatgaaggttagggtgcctacagaacggctgggaactcgcgaaagattatatgaatggatcagcatcgataaagatgaggccggtgccaagtcaaaggccccttcagtgagccgaggctcacaggagccccgttccgggtccaggaaacccgcatttacagaagcctcatgccccctcagccgtctattcgaggaacccgagaagcctccacctaccgggagaccgccagccccacctcgcgctgccccaagggaagaaccactgaccccaagattaaagccagagggagccccagagcccgagggcgttgctgcgccaccccctaagaattcctttaacaaccctgcttattacgtgcttgagggcgtaccccaccagctgctccctcccgaacctccatccccagcgcgagctcctgtcccttctgccacaaagaataaggtggcaatcaccgtgccagctccccaactgggacatcacaggcatccacgggtgggagaagggagctcctccgatgaggaaagcgggggtaccctacctccccctgacttcccaccgcctcccttgccagatagcgctatctttctgccgccttcccttgaccctctgcctggccctgtcgtgagggggagggggggagctgaggctagaggtcccccacccccaaaggctcatcccaggcctccactgcccccagggccaagccctgctagcacctttctgggagaggtggcaagtggcgatgatagaagctgcagcgtgttacagatggcgaagacactgtccgaagttgactacgcccctgcaggaccggctaggagtgctctcctgccaggacctctggagttgcaaccacccaggggactgcccagcgactacgggagacccctgtcttttccacctccccgtataagggaaagtattcaggaagatctcgctgaggaagccccttgtctgcagggcggacgggcttccgggctcggcgaagccggtatgtctgcatggctccgggctattggtctcgagagatacgaagaaggacttgtccacaacggctgggatgatctagagttcctgtccgacattactgaagaggatctggaagaagccggagtacaggaccctgctcataagcggctcctcctggacacactgcagctatcgaaatag

SEQ ID NO: 226810 - DNA, 105 bp, Artificial Sequence
  Description of Artificial Sequence: Synthetic coding sequence
atggttactagacttttacaacagcaaaatctgcctcaaactggagaacaagagctcgagagtctagtcctgaagcttagcgttctcaaagatttcttaagttag

SEQ ID NO: 226811 - DNA, 3051 bp, Artificial Sequence
  Description of Artificial Sequence: Synthetic coding sequence
atggtgacaagactactccagcagcagaatctcccgcagacaggcgagcaagaattggagtccctggtgctgaagttgtccgtcttgaaggactttctcagcggtattcagaagaaggctctgaaggcccttcaggacatgtcgtccacagcccctccagcccctcagccctccactcggaaggcgaaaaccatacccgtgcaagccttcgaggtgaagctggatgtgacactgggggacctcacaaaaattggaaaaagccaaaagttcaccctgtccgtggacgtagagggcggtcggcttgtactgctgcgccgtcagcgggattcccaagaggattggaccactttcacccacgacagaatccggcagttgatcaaatcacagcgggtgcagaacaaactgggcgtcgtgtttgagaaagagaaagaccgcacccagcgcaaggactttatttttgtgtctgcaagaaagcgagaggccttttgtcagttgctgcaactgatgaagaataaacactctaagcaggatgagcccgatatgataagcgtgttcatcggaacatggaacatgggcagcgtccctcctcctaaaaacgttacttcttggttcacctcaaaggggctgggaaagacactcgatgaagtcactgttactattcctcacgacatttacgtgttcggcactcaggagaattctgtgggagacagagaatggttggacttgctcagaggaggcctgaaagaacttacggacctggattataggcctatcgccatgcagtccctttggaacatcaaggtggcggtccttgtgaagccagaacatgagaacagaatatcacatgtatcgacctccagtgttaaaacagggatcgcaaatactttgggcaataaaggcgctgtcggagtctcctttatgttcaacggtacttcgttcgggtttgtcaattgccacctgactagcggcaacgagaaaaccgcacgcagaaatcagaactatcttgacatcttgcgattactttctctaggagataggcagttgaacgccttcgacattagcctccgattcacccatctgttttggttcggagatctgaattatcgcctagacatggatattcaggagatcctaaattacatcagtcgaaaggagttcgagcccctcctgagagtggaccaattgaatcttgagcgcgagaagcacaaagttttcttaagattctctgaggaggaaatcagtttccctcctacctatagatatgagaggggcagccgagatacatacgcttggcacaagcagaaacccacaggcgtgcggacgaatgttccaagctggtgcgatcggatcctctggaagtcctatcccgaaacccacattatttgtaattcctacggctgcaccgacgacattgtcaccagcgatcactcaccagtgtttggaactttcgaggttggcgtgacctcgcagtttatcagcaagaagggcctttcgaagacctcggaccaagcctacatagaattcgaaagtatcgaggccattgtgaagacagcctctagaaccaaattttttatcgagttttatagtacttgtctcgaagaatataaaaaatctttcgaaaacgacgcccagtcctcagacaatataaacttcttgaaggtgcagtggagttcacggcagctcccaacactcaagcccattctagccgatattgagtatctgcaggatcagcatcttctgcttactgtcaagagcatggatgggtatgagtcctatggtgagtgcgtggtcgcactgaaaagcatgattggcagtacggctcaacagtttcttacctttctctcccaccggggtgaggaaacaggtaacataagaggcagcatgaaggtcagggttccaacagaacggcttggcacccgcgagcgactctacgaatggatttccattgacaaagacgaggcgggagctaaatcaaaggcgcctagtgtgtctagagggagtcaggaaccccgttccgggtctaggaagcctgcttttacagaggcttcttgtccgctatcaaggttgtttgaggagccagagaagccaccccctacgggaagaccacccgctcccccacgcgcagccccacgggaggaacctctcactccacgactgaagcctgagggagccccagaaccggagggagttgccgctccccctcccaagaacagttttaataatcccgcatactatgtgctagaaggagttccacaccagcttctccctcccgaacccccaagtcccgcaagggcccctgttcccagcgccacaaagaacaaggttgccataacggtccccgcaccccagttggggcaccatcgccaccccagagtcggggagggctcttcgtctgacgaggagtcaggcggaactctccctccacctgattttccccctcctcccttgcccgactcagccattttcctgccaccatctttagacccactccccggtcccgtcgttaggggcagggggggtgcagaggccaggggcccaccccctcctaaagcacatccccgacccccactccccccaggtccaagtcccgcatccactttcttaggagaagtagcttcaggggatgaccgctcctgcagcgtactacagatggcgaaaactctgtccgaggtggattatgcacctgccggaccagcccgatcagccctgctccccggacctctcgagctccaacctccacgcggacttcctagcgattatggacggccactctcctttcctccacctaggatcagggagagcatccaggaggatctcgcagaagaagctccttgcctgcagggagggagagcctccggtttaggcgaagcaggtatgtctgcatggctgcgggcaatcgggctcgagagatatgaagaaggactcgtccataacggatgggatgacctcgaattcctttctgatataacagaagaagacttggaggaggctggtgtccaggatccagcccataagaggctcctgctcgataccctccagcttagcaaatag

SEQ ID NO: 226812 - DNA, 69 bp, Artificial Sequence
  Description of Artificial Sequence: Synthetic coding sequence
atggcgtctgcttgcggggcaccaggccctgggggagcactcgggtctcaagccccaagttggtattag

SEQ ID NO: 226813 - DNA, 3051 bp, Artificial Sequence
  Description of Artificial Sequence: Synthetic coding sequence
atggtgacaaggctgctgcagcagcagaaccttccacagactggagagcaagaactggagtccttggtactgaagttaagcgtgctgaaggatttcctttcgggaatccagaaaaaagctctcaaggccttgcaggatatgtcatccacagcccctcctgcacctcaacctagcacacggaaagctaagaccataccagtacaggctttcgaagtgaagttggatgttaccctgggcgaccttaccaagatcgggaaatcccagaagttcactctgtcggtcgatgtggaaggcggacgtctggtgctcctacgacggcaaagagatagccaggaggactggaccacatttacgcacgataggattaggcaactgatcaagtcacagagagttcagaataaattgggggttgtttttgagaaagagaaggatcgtacacagagaaaggattttatcttcgtgtccgcacggaaaagggaagccttttgccagctcttgcaactcatgaaaaataaacacagcaagcaggatgaaccagatatgatcagcgtgttcatagggacgtggaatatgggtagcgtgcctccaccaaagaatgtgacaagttggtttactagcaaagggctgggtaagactctggacgaagttaccgtgacgatcccccacgacatctacgtgtttggaactcaggaaaacagtgtgggggaccgagagtggctcgatctcctcagaggagggttgaaagagctcaccgatctcgattaccggccaatcgcgatgcaatctctgtggaatatcaaggtagcagtgctggtgaaacctgagcacgaaaaccggattagccatgtgtccacctcatccgtgaagacaggaattgcaaatacgctgggcaacaagggcgcagttggcgtcagtttcatgttcaatgggacaagctttggctttgttaactgtcatttaacatcaggaaacgagaagactgctcggagaaatcagaattacctggatattctccggctgttatccttaggcgataggcagctcaatgcttttgatatatccctacgatttacgcacctcttttggtttggcgatctcaattatcgcttggatatggatatccaggaaattctgaactatatctcccggaaagaatttgagccgctactgcgagtggatcagctgaatctggagcgggaaaaacacaaagttttcttgagattttccgaagaagaaatatcatttccccctacctaccgctacgagcgaggcagccgggatacatacgcatggcataaacagaaacctaccggagtccggactaacgtgccgtcgtggtgcgaccgaatcctatggaagagttatccagaaacgcatataatatgcaactcctacggctgtacagatgatatagtgacaagcgaccactctccggttttcggcacgttcgaggtgggagtgacaagtcagtttatcagtaaaaagggcctttcaaaaacatctgaccaggcatatattgagtttgaatctatagaggcaattgtgaagactgcttctcgaacgaagtttttcatagagttttattctacctgcctcgaggaatacaaaaagagcttcgaaaatgacgcccagtcttccgataatattaacttcttgaaagtccagtggagctccagacagctgccgaccttaaaacctattctggctgatatcgaatatctccaagatcagcaccttttactcaccgtaaaatcgatggacggatacgaaagttacggagagtgcgtagtggcgttgaagagcatgatcggatctacagcacagcagtttctaaccttcctctcacatcggggagaggaaaccggaaacatccggggttccatgaaggtgcgcgtacctacagagaggctgggaacccgtgagcgcctctacgagtggatctcaatcgataaggatgaagctggagctaaatccaaagcgccttccgtcagcagaggatcacaggagcctagaagtggatcgcgaaagcccgcatttacagaagccagctgtcccttgtctcggctcttcgaagaaccagagaaaccccctcccaccggtagacctccagctccgcctagggcagcccctagggaagaaccactgacacctcgcctgaagccagagggagcgccagagccagagggggtggctgctcctcccccaaaaaattcctttaataatccagcctactacgtcctggagggtgtgccccatcagctgctccctcccgagccaccctcccccgctcgggctccagtgccgtcagctacgaagaataaagtcgccatcacagtacctgccccacaactgggccaccatagacatccccgagtgggggaaggctctagcagcgacgaagaatcaggcggaacactgcccccacccgatttcccacctccgccactgcccgactcggccatctttctgcctcccagtctggaccccttacccggtccggtggtcagaggcagagggggagcagaggccagaggccctcccccacctaaagcacacccgagaccacccctgcccccaggcccaagtcccgcatcgacctttttgggggaggtcgcttctggcgatgatcgttcctgctccgtgctgcagatggccaagacactctccgaggtagactatgccccagccggtcctgcacggtcggccttactgcccggtccactggagctgcaacctcctcgaggcttgccctccgattacggcaggccattatcgttccctcctccgaggatcagggagtccattcaggaggacctggcggaggaagctccttgtctgcaggggggtcgagccagcggtctgggagaggccggaatgtccgcttggctccgtgcaataggactcgagaggtacgaggagggcttagtgcacaacggctgggacgatctggaatttctgagcgatataacagaggaggacctggaagaagcaggggtacaagatccagcccacaagaggttgctacttgacacgctccagctgtctaagtag

SEQ ID NO: 226814 - DNA, 57 bp, Artificial Sequence
  Description of Artificial Sequence: Synthetic coding sequence
atggcatccgcatgcggtgctccaggacccggaggggcacttggatctcaggcttag

SEQ ID NO: 226815 - DNA, 474 bp, Artificial Sequence
  Description of Artificial Sequence: Synthetic coding sequence
atggtgacacgactgctgcagcaacagaatttaccccagactggggagcaggaattagaaagtctcgtgctcaaactgtccgtgctgaaggattttctgagtggaattcaaaaaaaagctctcaaggctctgcaggatatgtccagcaccgcacccccagcgccacagccttcaacgcgtaaagccaagactatccccgtacaagccttcgaagtcaagctagacgtgaccctcggcgatctgaccaagattggaaagtcccagaaattcacgctgagtgtggacgttgaaggaggcagactggtgttgcttcggagacagcgcgatagccaggaagactggaccacttttacacatgatagaattaggcagcttattaaatcccaaagagtccagaataagctaggcgtcgtgttcgagaaagagaaggacagaacccagagaaaggatttcatatttgtgagcgctcggtag

SEQ ID NO: 226816 - DNA, 1200 bp, Artificial Sequence
  Description of Artificial Sequence: Synthetic coding sequence
atgtcagacatattgcgggaactcttgtgcgtgagcgagaaagccgcaaatatcgcaagagcttgtcggcagcaagaggccctttttcagttgctcatcgaagaaaaaaaagagggcgagaaaaataagaaatttgccgtggatttcaaaactctggcggatgtgttggtgcaggaagtgatcaaacagaacatggagaataagtttcccggtctggagaaaaacatcttcggggaggagtcaaacgaatttaccaacgattggggcgaaaaaatcacactaaggctctgcagcacggaagaggagactgctgagctgctctctaaggtgctgaatggaaataaggtggcgtctgaggctttagcaagggttgtgcatcaggacgtcgcctttactgaccccacactcgattccactgagattaacgttccacaggacattctgggcatatgggtggatcccatcgattcaacttaccagtacattaaagggtctgccgatatcaaaagtaaccagggcatcttcccttgtggactgcagtgcgtgactattctgatcggggtgtatgatatacagaccggggtgcctctcatgggcgtgattaaccaacccttcgtcagtagggatccaaataccctgcgttggaagggacagtgttactgggggctaagttatatgggaaccaacatgcactctttgcagctcacaatctcccgcagaaatgggtcagagacccacactggcaacacaggtagtgaggccgcattttccccttccttctctgccgtgatctctacttccgagaaagaaactatcaaggccgctctctcccgcgtctgcggagaccggatcttcggggcagcgggagccggatacaaatctctgtgcgtagtgcagggcctcgtcgatatttatatcttttccgaggataccaccttcaagtgggacagttgcgctgctcatgccattcttcgggctatgggagggggtattgtggatctgaaagagtgcttagaaaggaacccggaaacaggtctggacctgccccagctggtttaccacgtggagaatgaaggagccgcaggcgtggaccggtgggctaataaaggaggactgattgcctaccgaagtcgcaaacggctggaaacattcctctcgttactagtccagaatctggctcctgcagagacccatacctag

SEQ ID NO: 226817 - DNA, 1200 bp, Artificial Sequence
  Description of Artificial Sequence: Synthetic coding sequence
atgagtgacatcctccgcgagctgctgtgtgtttccgagaaggccgctaacattgctcgagcttgccgtcaacaggaggctcttttccaattgttaatcgaggaaaagaaggaaggagagaaaaacaaaaagttcgcagtagacttcaagactctggcagacgtcctggtgcaagaagttattaagcagaacatggaaaacaagtttcccggactggagaaaaatatcttcggtgaggaatcaaatgagttcaccaacgactggggcgagaaaatcactctccggctgtgcagcacagaggaggagacggcggaactgttgtccaaggtcctcaatggcaacaaggtagcgagcgaggcattagcaagagtagttcaccaagacgtggctttcacagatcccaccctggatagcaccgaaatcaatgtgcctcaggatatacttggaatctgggtcgaccctattgactctacttatcagtatatcaagggaagtgccgacatcaagtcaaatcagggtatttttccttgcgggctgcagtgcgtgacaatcctgatcggagtgtatgacatccaaacgggtgtgcccctgatgggagtcatcaaccagcccttcgtcagccgggatcccaatacattgcgttggaagggacagtgttattggggcttatcctacatgggcacgaacatgcacagcctgcagttaactattagccgaagaaatggatctgagacacacacaggaaacactggttcagaagctgcttttagtccgagtttctctgcggtgattagcacctcagaaaaggaaactatcaaggccgcactgtccagagtgtgcggagatagaatctttggggctgccggagccggttacaaatccctctgcgtggttcaggggttggtggacatctatatcttcagcgaggataccactttcaagtgggattcctgtgctgcccacgcgatactgcgcgcaatgggcggtggcatagttgatcttaaagaatgtctggagagaaaccccgaaacaggcctggatctgcctcaactggtctatcatgtggagaacgaaggtgccgcaggggtcgaccggtgggccaacaagggcggtctgatcgcctatcgcagtcgtaaacgcctcgagacatttctgtcgctccttgtccagaatttggcccctgctgaaacacacacctag

SEQ ID NO: 226818 - DNA, 468 bp, Artificial Sequence
  Description of Artificial Sequence: Synthetic coding sequence
atgagtgatatcctccgggagctactctgtgtgagcgagaaagcggctaacattgccagagcatgcagacagcaggaagcgctgttccagctcctgatcgaggagaaaaaggaaggcgaaaagaacaagaaattcgccgtggacttcaagacactcgccgacgtcctggtgcaggaagtcatcaagcagaatatggagaataaattccctggcctggagaagaacatattcggcgaggagtccaacgaatttactaacgactggggagagaagattactctgcgcttatgctccaccgaggaagagaccgccgagcttctatctaaggttctgaatggcaacaaagtcgcaagcgaggctctcgctcgggtggtgcaccaggatgtagcgtttaccgaccccactctggactctacagaaatcaatgtgccccaagatatcctgggcatttgggtcgaccccatctag

SEQ ID NO: 226819 - DNA, 267 bp, Artificial Sequence
  Description of Artificial Sequence: Synthetic coding sequence
atgtccgacatcctgagagagctactgtgcgtgtccgaaaaggcggcaaacattgccagggcttgtcgccaacaggaggctctgtttcaactgctgattgaggagaagaaagagggcgagaagaataaaaagtttgctgtggactttaagacgcttgccgacgtcctggtgcaggaggtgattaaacaaaacatggagaataagtttccgggactcgagaagaacatcttcggcgaggaatctaatgagttcactaatgattggtag

SEQ ID NO: 226820 - DNA, 639 bp, Artificial Sequence
  Description of Artificial Sequence: Synthetic coding sequence
atgagcgacattttgagggaattgttatgcgtttctgagaaggccgctaacattgctagagcctgccgccaacaggaagcccttttccagctactcattgaagagaaaaaagagggagagaagaacaagaagtttgctgtggacttcaagacgctcgccgacgtgctcgtccaggaggtgatcaaacagaatatggaaaacaagtttccagggctcgaaaagaacatctttggggaggaatccaatgaatttaccaatgattggggcgagaaaattacattgcggctctgcagcactgaagaagaaactgccgaactgctgagcaaagtgcttaacggcaataaggtcgcctctgaggccctagcgagggttgtgcatcaggacgtggcttttactgacccgacccttgattctactgaaatcaacgtcccccaggatatcctcggcatttgggtagatcctatcgactctacgtatcagtacatcaaaggatcagcggacattaagtctaatcaaggtattttcccgtgcgggctgcaatgcgtgacaatcctgattggagtatacgatattcagactggcgtgccattaatgggggtaataaaccagcccttcgtatcccgggatccaaatacatag

SEQ ID NO: 226821 - DNA, 30 bp, Artificial Sequence
  Description of Artificial Sequence: Synthetic coding sequence
atgagcgatattcttagagagctgctctag

SEQ ID NO: 226822 - DNA, 642 bp, Artificial Sequence
  Description of Artificial Sequence: Synthetic coding sequence
atgagtgatatattaagggagctgctttgtgtctccgaaaaggcagccaacatcgcaagggcgtgccgccagcaggaggcgttgtttcagctgcttatcgaggagaaaaaggaaggggagaaaaataagaagttcgccgtggattttaagacgctggcggatgtattggttcaagaggtcataaaacaaaatatggagaataaatttcccggtcttgagaagaacatatttggcgaagaatccaacgagtttaccaatgattggggggagaagattacattgagattatgctctacagaagaagagactgcagaattgctttctaaggtattgaacggcaacaaggtagcctctgaggccttggctcgggtggttcaccaggatgtggcttttaccgatcccacattggacagtaccgaaatcaatgttccccaggatattcttgggatctgggtggatcccatcgactctacctaccagtacattaaggggtccgccgacattaagagtaatcagggaatcttcccctgtggcctccagtgcgttacaattctaatcggcgtgtacgacattcaaaccggcgttcccctcatgggtgttatcaatcagcctttcgtgagcagggatccaaataccctgtag

SEQ ID NO: 226823 - DNA, 573 bp, Artificial Sequence
  Description of Artificial Sequence: Synthetic coding sequence
atgagtgacatcctgagagaactgctatgcgtgagtgagaaggcggctaacattgcacgcgcttgccggcaacaggaggctctttttcagctcttgatcgaggagaaaaaggaaggggaaaagaacaaaaagtttgcagtggacttcaaaactttagcagatgtgcttgtccaggaggttataaagcagaacatggaaaataagtttcccggactggaaaagaacatcttcggcgaggagagcaatgagtttacaaacgattggggggagaaaataacactcaggctgtgttctactgaggaggagaccgcggagctattgtctaaggttctgaacgggaacaaagtagccagcgaagctctcgcgcgagtggtccaccaggatgtggcgtttaccgaccctacactggactctaccgagattaacgtgcctcaagacatcctgggtatctgggtggaccctatagattctacttaccagtacatcaaagggtctgctgatatcaaatccaatcaaggaatctttccgtgtggcctacagtgcgtcactatactcattggtgtctacgactag

SEQ ID NO: 226824 - DNA, 93 bp, Artificial Sequence
  Description of Artificial Sequence: Synthetic coding sequence
atgtctgatattctgcgagagctactgtgtgtgtccgagaaggccgctaatattgcaagggcttgtcgacagcaggaggccctgtttcagtag

SEQ ID NO: 226825 - DNA, 207 bp, Artificial Sequence
  Description of Artificial Sequence: Synthetic coding sequence
atgtctgatatcctgagagagctgttatgtgttagcgagaaggctgccaatatcgcaagagcctgtcgtcagcaggaagcactcttccagctcttgatcgaggagaaaaaggaaggtgagaagaacaagaagtttgccgtcgacttcaaaactctggccgatgttttggttcaggaagtgatcaagcagaacatggagaacaagtag

SEQ ID NO: 226826 - DNA, 432 bp, Artificial Sequence
  Description of Artificial Sequence: Synthetic coding sequence
atgtccgacatcctgagggagctgctttgcgttagtgagaaagccgctaatatagcccgagcctgcagacagcaggaagcactttttcagctgctgatagaggagaagaaagagggggagaaaaacaaaaagttcgccgtggactttaagacgctcgctgatgtactcgtgcaagaagtgatcaaacagaatatggagaacaaatttccaggcctggagaagaatatattcggcgaggaatctaacgagtttacgaacgactggggggagaagatcacacttcgtttgtgtagcacagaggaagagactgctgagctgctcagtaaagtactgaacggcaataaagtggcttctgaggctctggcacgtgtcgtgcatcaggacgttgcgtttacagatcccactctggacagtactgagataaacgtatag

SEQ ID NO: 226827 - DNA, 1200 bp, Artificial Sequence
  Description of Artificial Sequence: Synthetic coding sequence
atgtccgatattctgcgtgaactcctctgcgtaagcgagaaggctgccaatatagctcgcgcttgccggcagcaggaagcgctcttccagctgcttatcgaggaaaaaaaagaaggggagaaaaataagaagttcgccgttgatttcaagaccctagccgatgtcctggtgcaggaagtgattaagcagaatatggaaaataagttccccggacttgagaagaatatcttcggagaagagtctaatgagtttaccaacgactggggtgaaaagataacattacgactctgcagtaccgaggaggagacggccgaactactgagcaaagtcctgaacggcaacaaggtagcttctgaagctctggccagggttgtccaccaggatgtagcttttacagaccccactttagattccaccgagatcaacgttcctcaggacattcttggaatttgggtagatccaatagacagcacataccaatacatcaaggggtctgcggacataaaaagcaaccagggaatatttccgtgcggtctacagtgtgtcacgatcctcattggagtgtatgatatccagacaggcgtgcctctaatgggcgtgataaatcagccctttgtgagtcgggacccgaacacattaaggtggaaggggcaatgttactgggggctttcgtacatgggaacaaatatgcacagtctgcagctgaccatctccagaaggaatggcagtgaaacgcacaccgggaataccggtagcgaggccgcttttagcccttcttttagtgccgtcataagtacctccgagaaggaaaccatcaaggcagcgctttcccgggtgtgtggcgaccggattttcggtgctgccggtgccggttacaaatcattgtgtgtcgtgcagggattagtggatatctacatcttctcagaggataccaccttcaagtgggactcttgcgcagcacacgcaatcttgcgtgccatgggcggagggattgttgaccttaaggagtgtctggaacggaatcccgagaccggtctggatctccctcaacttgtctaccacgttgaaaacgaaggcgctgccggagtggaccggtgggcaaacaagggcggactgatagcctaccggtcccgaaagcgcttggaaacatttctgagcctgctggtgcagaacctcgcgcctgcggaaacccacacatag

SEQ ID NO: 226828 - DNA, 2934 bp, Artificial Sequence
  Description of Artificial Sequence: Synthetic coding sequence
atgaccgctcgtgagcatagtcctagacatggcgcacgggctcgcgcaatgcaaagagctagcacgatagacgtcgctgccgatatgctggggctgtcgctcgctggaaacatccaggatcccgacgaacctatcctggaattctctctggcgtgttctgagctgcacacaccaagcctggacagaaagcctaatagcttcgtggctgtgtcagtgacaacaccgcctcaggccttctggaccaaacacgcacagacagaaataattgaagggaccaataaccccatattcctgtcaagcatcgccttctttcaagatagtcttatcaaccagatgacacaggtcaagctgtccgtctatgatgtgaaggataggagccaggggaccatgtacctgctgggcagtggtaccttcattgttaaggatctgctgcaggatcgccaccacaggcttcatctcacactccgtagcgcagagtccgatagggtcggcaatattaccgttatcggctggcagatggaggaaaaatctgaccagcgccctcccgtaactcggagcgtggataccgtcaacggacgtatggtgctgcctgtggacgaatctctgacagaggcactcgggattaggtctaaatacgcgtctctgaggaaggacacacttcttaaaagtgtgttcggcggagcgatatgtcgcatgtaccggttccccaccacagacgggaaccacctgcggatactcgaacagatggcggagagtgtactgagtttacacgttcctcggcaatttgtgaagttgttgttagaggaggacgccgctcgcgtgtgtgagctggaagaattgggggagctttccccctgctgggagagcttgagaaggcagatcgtaacacaataccaaactataatactgacctaccaagagaacctgacagatttgcaccagtacaggggaccctcttttaaagcttcttccctgaaggcagacaagaagttagagttcgtccctactaatttgcatatccagaggatgcgcgtccaggacgatggcggatcagaccagaattatgatatcgtgacaatcggcgcacctgctgctcactgccaaggctttaagagtggcggactccgcaaaaagctgcacaaattcgaagaaactaagaaacatttcgaggaatgctgtacctcttccggatgtcagagtattatttatatcccacaggacgtcgtgagagctaaagagatcatcgcacagatcaatacattaaaaacacaagtgtcttattacgccgagagactgtctagggcagcaaaggaccgaagtgccactggattagagagaacgcttgccatcctggcggacaagacacgtcagttggtgaccgtgtgtgactgtaagctcctcgctaactcaattcacggcctgaatgcagctcgcccagattacatcgcatcaaaagccagccccactagcacggaggaggaacaggtgatgcttagaaacgatcaggatacactcatggcacggtggaccggcaggaatagtagaagctccctgcaggttgattggcatgaggaagagtgggagaaggtctggctcaatgttgacaaatctctggagtgcattatccagagggtggataagcttttgcagaaagaacgccttcacggagaaggctgcgaagacgtcttcccttgcgctggttcttgtacttccaagaagggaaacccagattcgcacgcgtattggataagacccgaggacccattctgcgatgtgcccagcagcccctgtccaagcaccatgccctcaacagcttgtcacccccatctgacaacacactgctccccccctcccgaagagtccagccccggtgagtggtctgaggccctgtacccactcctaacgactctgacagattgcgttgccatgatgtccgacaaggcaaaaaaagcaatggttttcttgctcatgcaagattctgcaccgacgatcgccacttacttatcacttcagtacagacgagacgttgtgttctgtcagacactgactgccctaatctgtgggttcatcatcaaattgcgcaactgtctccacgacgacggcttcctgcgacagctgtatactatcgggctgcttgctcagttcgagtccctgctcagcacctacggggaagagctggccatgcttgaggatatgagtctcggaattatggacctgcggaacgttaccttcaaagttacacaagctactagctcagctagtgccgatatgctcccagttatcacaggaaaccgcgatggttttaacgttcgggtccctctgcctggtccgctctttgatgccctgcccagagagattcagtcaggcatgctgctccgggttcagccagtgttgtttaatgtcgggattaacgagcagcaaacactggccgaacgctttggagatacgtcactccaggaggttattaatgtagagagtctagtccgcttaaactcttactttgagcagtttaaagaagtgcttcccgaggattgtttgcccaggtcacgcagtcaaacatgtctgccagagctcctgcggtttctgggtcagaacgtgcacgcgaggaaaaacaaaaatgtggatatcctgtggcaggcagcagagatctgccggcgactgaatggggtaagatttacatcttgcaagtcagccaaggacaggaccgcaatgagcgtgaccctagagcaatgcctgatactccagcacgagcatggtatggctccccaggtgtttactcaagctctcgaatgcatgagatcagaaggttgtcgaagagaaaatactatgaagaacgtggggagtaggaaatacgcctttaatagtctgcagctcaaagccttcccaaagcattatagaccaccagaaggaacatatggtaaggttgagacttag

SEQ ID NO: 226829 - DNA, 2817 bp, Artificial Sequence
  Description of Artificial Sequence: Synthetic coding sequence
atgacagcacgcgagcattcacccagacacggtgcccgtgctcgtgctatgcagcgcgcatctaccattgatgtagctgctgatatgctcggtttgagcctagcaggcaatattcaggatccggacgaacccattcttgaattctctctggcctgtagtgaactgcacacaccttccctagaccgaaagccaaattcctttgttgccgtgtccgtgacaactcccccacaagctttttggaccaagcacgctcagactgagataatagagggcacaaacaatccaatattcctgtcaagcatcgcctttttccaggactctctgatcaatcagatgactcaagtgaaactctccgtgtatgatgtgaaagatagaagtcagggtaccatgtacctcctgggaagtggaacctttatcgtcaaagacttgttgcaggaccggcatcatcggctccacctcaccctcaggagtgctgagtcggatcgcgtgggaaatatcactgtgattgggtggcagatggaggaaaagtcggaccaacgtcccccagtcactcgatccgtcgacaccgttaatgggagaatggttttgcccgtggacgagtctctgacggaggctctggggataaggtcaaagtatgccagtctccgtaaggatacattactcaagagtgtgtttgggggagctatttgtcggatgtaccgctttccaactacggacggcaatcacctgaggatcctggagcagatggctgaatccgtgctcagccttcacgtcccccgtcagttcgtgaaactcctgctcgaggaggacgctgccagggtgtgcgaattggaagaattgggcgagttaagtccctgttgggagtctctcaggcgccagatcgtgactcagtaccagaccataatcctgacttaccaggaaaatctaacagacctacatcagtatcgcggaccctctttcaaggcctcctcactcaaagctgacaaaaagctcgagttcgttccaaccaatctgcatatacaacgcatgagggtgcaggatgacggcggttccgatcagaattacgatatcgtgactatcggcgcacccgctgcacactgccaaggatttaaaagtggcggattacgaaagaagcttcacaaattcgaagagactaagaaacacttcgaagaatgctgtacaagctccgggtgtcagagtatcatctacatcccacaagatgtcgtgagagcaaaggagattatcgctcagatcaacacactcaagacgcaggtgagctactatgccgagcgattatccagagctgcgaaagaccggtcggcaacagggctggagcgcactcttgccattctggctgataagacacgccagttggtgacagtgtgcgactgcaagctcttggccaacagcatccacgggctgaatgcagctagaccggattatatcgccagcaaggccagccccacgagtacagaggaggaacaggttatgctgcggaatgatcaggacaccttgatggctcgctggaccggtaggaatagtagatcaagtctccaggtggattggcacgaagaagagtgggagaaggtatggctgaacgtggacaagtctttagaatgtataattcagcgcgtggacaagttgctgcagaaagagagactgcacggagagggatgcgaggacgtctttccttgcgcaggatcatgtacgtctaagaaggattgctctccacccccagaggagtcatcccctggagagtggagcgaggccctgtaccccctcctcaccacactcactgactgcgtggctatgatgtcagacaaagctaagaaggccatggtcttcctgttgatgcaagacagtgctcctacaattgcaacctacctatctcttcaatacaggcgagacgtcgtcttttgtcagaccctgactgcgcttatttgcgggttcatcattaagctccggaattgtctgcacgacgatgggttcctcagacagctttacaccattggtcttctggctcagtttgagagtctgctgagcacgtatggggaggaactggcaatgctggaggacatgagtttgggcattatggacctgcggaacgtaacattcaaagtcactcaggccacttcaagcgcctccgcagatatgctgcctgtgattactgggaacagagatggattcaatgtcagggtgcccctgccgggacccctcttcgatgcgctccccagagagattcaatcagggatgttgctccgcgttcagcctgtgctgttcaatgtgggcattaatgaacaacagacactcgccgaacggtttggcgacaccagccttcaggaagtcatcaacgtagagtctctcgtcaggctgaattcttacttcgaacagtttaaggaggtgctcccagaggattgtctgcccagaagtagaagccagacgtgcttacctgaactgttgcgattcttaggtcagaacgttcacgctaggaaaaataagaatgttgacattctttggcaggcagccgagatatgcagaagactgaacggagtgcggtttacaagctgtaagtccgcaaaggacaggaccgcaatgagtgtcacactggagcagtgtttaatactgcaacacgaacacggaatggccccacaagtgttcacccaagctctcgagtgcatgcggtccgaagggtgtagacgcgagaatactatgaaaaacgtcggtagcagaaaatacgcttttaattcactacagctgaaggcttttcccaagcattatagacctccagaaggcacatatggcaaggtggaaacctag

SEQ ID NO: 226830 - DNA, 2865 bp, Artificial Sequence
  Description of Artificial Sequence: Synthetic coding sequence
atgacagcgagggagcacagcccaagacatggggcaagagctcgcgcaatgcagcgcgcaagcacaattgatgtcgctgccgatatgcttggcctcagtctggccggtaacatccaagatcccgatgagcccattctggagttttccttggcctgctctgaacttcataccccctctttagacagaaagcccaactccttcgtcgcggtgtctgtaaccactcccccacaggccttctggacaaaacacgcccagacagagattattgaaggcaccaacaaccccatttttctgtcttccatcgcctttttccaggatagcttgataaaccagatgacccaggtgaaattaagtgtgtacgacgtgaaggaccggtctcagggcaccatgtacctgttgggcagtggaacctttatcgttaaagacttgctgcaggaccggcatcacaggctgcacttgacgctgcggtcagcggagtctgacagagtgggtaatatcacagtgatcggatggcagatggaagaaaagtccgaccagcgccctccagtcacccggagcgttgacaccgtgaatgggcgaatggtgttgcctgtcgatgagagtctcaccgaggctctaggcatcagaagcaaatatgcaagtcttaggaaagatactctgctaaagtccgtgtttgggggagcgatctgtaggatgtaccggttcccaaccactgatgggaaccatttaaggattctcgagcaaatggccgaaagcgtgttaagtctgcatgtcccccgacagttcgtgaaactgcttctggaagaggatgctgcaagggtgtgcgaattagaagaattgggggagttgagcccgtgctgggagagtctacgtaggcagatcgtcacacagtaccagacaataatcctcacctatcaagaaaacttaaccgatcttcaccaatacagagggccaagttttaaggccagcagcctaaaggccgacaaaaaattggagttcgtgcccaccaatcttcacatccagcggatgcgcgtacaggacgatggagggtctgaccagaattacgatattgttacaatcggggctcccgcagctcactgccaagggttcaagagcgggggtctgcgaaagaaactgcacaaattcgaggaaaccaagaaacacttcgaggagtgttgtaccagcagcggctgtcagagcatcatctatatccctcaggatgtcgtgcgcgctaaagagatcatcgcacagatcaatactctgaagactcaagtaagctactacgctgagcgcttgtctagggcggcaaaggatagatctgccacggggctagaacgtaccctggccatcctggccgataagaccaggcaattagttaccgtgtgcgattgtaagttgctggccaatagtattcacggcttaaatgctgcaagacctgactacattgccagtaaggcctcccctacatccacagaggaggaacaggtcatgctgcggaatgaccaggataccttaatggccagatggactgggaggaattcccgttctagtcttcaagttgattggcatgaggaagagtgggaaaaggtgtggctcaacgttgacaagtccctagaatgcattatccagcgggtcgataaacttctgcagaaagagaggctccacggggaaggatgtgaagatgtgtttccatgcgccggaagctgtaccagcaagaaggactgtagcccacccccagaggagtcaagtcctggtgaatggtcggaggctctgtatccattactgacaaccctgaccgactgcgtcgcaatgatgagtgacaaagctaagaaggccatggtgttccttctgatgcaagactccgcgccaacgattgccacctatctgagcctccagtacagaagggatgtcgtcttttgccagactttgactgcactgatttgtggtttcatcataaaattgcgaaattgtttgcatgatgatggcttcctgagacagctgtacaccattggcctgttggcgcagtttgaatccctcctgagcacgtatggagaagaactcgcaatgctcgaggatatgtcactaggcatcatggacctgaggaacgtgacattcaaagtgactcaagctacctcatccgcttctgctgatatgttgccagtgattacgggtaacagggatggtttcaatgtacgagtacctcttcctggtcccttgtttgacgctcttcccagagagattcagtctggaatgctcctcagagttcagcccgtgctgttcaatgtgggcatcaatgagcagcagaccctggctgagcggtttggtgatacctcactgcaagaggtcatcaatgtcgaaagcttagtgcggctgaacagctattttgagcagttcaaggaagtgctcccagaggactgtttgcctaggtctagaagccaaacatgcctgcctgaactgctgcgcttcctaggacaaaacgtgcacgcaagaaaaaacaaaaacgtagacatcctgtggcaggccgcagaaatctgccggaggctgaatggagttcggttcacctcctgcaaatctgcaaaggacaggacagcaatgtctgtcactctcgaacagtgcctgattctgcaacacgagcacggtatggccccacaggtgttcactcaagcactggagtgcatgcggtccatcggaaccagagaagtggtcacccaaaagaatctgtctggcttggtcccaattcgagacttgagactcgacccatccctgctgtgctcgatccctctgctggctctgtccccgaacctcttaatagtatggctctttctgagtatcgcctatttggtcaccaagctgagatgcaagtag

SEQ ID NO: 226831 - DNA, 2919 bp, Artificial Sequence
  Description of Artificial Sequence: Synthetic coding sequence
atgactgcgagagaacatagtcctcgacacggcgcaagagctcgggcaatgcagagggcctcaacaatagacgtggctgcagatatgctaggattatccctggccggaaatattcaggatccggacgagccaatcctcgaattctcactggcctgcagcgaacttcacactccaagtttggacaggaagccgaattctttcgtcgcagtcagcgtgacgacgccacctcaggccttttggaccaagcatgcccagactgagattattgaggggaccaacaacccgatttttttgtcttccatagccttctttcaggatagtctgattaaccagatgactcaagttaaactgagcgtctatgatgtgaaggatcggtcccaagggacgatgtacctgcttgggtctggcacttttattgtcaaggatctgttgcaggaccgccaccacaggctgcatctcacactccgaagtgcagaaagcgatagggtgggaaacatcaccgtgatcggttggcagatggaggaaaagtccgaccagcgcccacccgtgactaggagtgttgatacagtcaatgggcgtatggtactgccggtcgacgaatctctaaccgaagccctcggcatccgcagcaaatacgctagccttaggaaagacacactgttaaaaagtgtcttcggcggtgccatttgtcgtatgtacagatttccaaccacagatgggaaccacctccgcatcctcgagcagatggccgagtctgtgctctctctgcatgtgcctcggcagtttgttaagctactcctcgaggaagacgccgcacgagtctgcgagttggaggagctcggtgaactgagtccctgttgggagagccttaggcgacaaatcgtgacgcagtaccagacaattattctcacttatcaagaaaatttaaccgacctccatcaataccgcggtccttcctttaaagcctcttcgctcaaagccgacaagaagctagaattcgtgccgaccaatctgcatatccaacgcatgagggtacaagatgacgggggaagtgaccaaaactatgacatagtcactattggggctccagccgcacactgccaaggtttcaaaagcggtggcctgaggaagaaactgcataagtttgaagagacaaagaaacatacatcttcgggctgtcagtccatcatctatattccacaggatgtggtccgcgctaaagagataattgctcagataaacactctcaaaactcaggttagctattatgcggagcggctttcccgggcagccaaagacagaagcgctactgggctggagcggacactggcgatattagctgacaagacccgccagctggtgacggtctgtgactgtaaactcctggctaattccatacatggattgaatgcagctagacctgattatatcgcctcaaaggcttctcctacaagtaccgaggaggagcaggtaatgctcaggaacgaccaggacaccctgatggcacgctggaccgggagaaacagccgttctagcctgcaggtagattggcacgaggaggagtgggagaaggtttggctgaacgtggataaatctctggaatgtataattcagagagtggataagcttttacagaaagagagattacacggtgaagggtgtgaggacgtcttcccttgtgcagggagttgtactagcaagaagggaaaccccgatagtcatgcatattggattagacccgaagaccccttctgcgacgtgccaagtagtccttgtccatctactatgccttctaccgcttgtcacccacatctgactacacattgcagcccacctccggaggagagcagtcccggagaatggagtgaagccttataccccctcctaactaccctaacagactgtgtagccatgatgtccgataaagcgaagaaagcaatggtgttcctcctcatgcaggactccgcgcctaccatagctacttaccttagcttgcagtaccgcagggacgtggttttctgtcagactctcaccgctctcatctgtggttttattataaaactgagaaactgcctgcatgacgatggctttctgagacaactgtacacaattgggctcctcgcacaattcgaaagcctcctttccacctatggcgaagagctggccatgctcgaagacatgtctctgggcattatggacctgagaaacgtgacttttaaagtcacacaggcaacaagctcggccagcgcggacatgctgcccgttattaccggcaatagagatggcttcaacgtccgggtcccacttcccggaccactctttgatgcgctgcctcgcgagattcagtctggcatgctcctgcgtgtgcagccggtgctgtttaatgttggcatcaacgaacagcagaccttggcagaaaggttcggcgatacatccctgcaagaagtgatcaacgttgagtccctggtgcggctgaattcctacttcgagcagtttaaggaggtccttccggaagattgcctccctaggtctcggtcccagacctgcctgccggagctcctccgtttcctgggtcaaaacgtccacgcaagaaagaacaaaaatgtagatattctttggcaagccgctgaaatctgccgacgtctcaacggagtgcgatttacgagctgtaagtcagcaaaagacagaaccgcgatgtctgtcactctcgaacaatgtctaattcttcagcatgagcacgggatggctccccaggtgtttacacaggcattagagtgcatgcgtagcgaggggtgcagacgggagaacactatgaaaaacgtcggcagcaggaaatatgcattcaactccttgcaactcaaggctttccccaaacactaccggccacccgagggcacatatggcaaagtggagacatag

SEQ ID NO: 226832 - DNA, 2934 bp, Artificial Sequence
  Description of Artificial Sequence: Synthetic coding sequence
atgactgccagggaacactcaccgaggcacggggcaagagcaagggcgatgcaaagggcgagtaccattgacgtggcagccgatatgttggggctgtcactagccggtaacatacaggatccagatgagcccattctggaattctcactggcatgttccgagctgcatacacccagcctcgatagaaaacccaacagcttcgtggctgtgtccgtcacaactccccctcaggcattttggaccaagcacgctcagacagaaatcatagagggaacaaacaatcctatctttctgtcgtccatcgctttctttcaggattctcttataaaccagatgacccaagtcaaactctccgtctatgacgtgaaagacaggtcccaggggacaatgtacctgctcgggtcaggaacatttattgtgaaggacctgctgcaggaccgccatcacagactccacctgacattgaggtctgcagaatcagacagggtaggcaacataactgtcatcggctggcaaatggaggaaaagtcagaccagaggccccctgtgacacggagcgtggataccgtcaatggaagaatggttctgcctgtcgatgaaagcctgaccgaagccttgggaatccgttctaagtacgcaagtctgaggaaggataccttactaaagagcgtctttggcggtgcgatctgccgaatgtaccggtttccaacaacagacggcaaccatcttcgtatactggagcaaatggcagagtctgtcttgagtttgcacgttccgagacagttcgtcaagctgctcctcgaagaggacgctgccagagtctgtgagctggaggagctgggggaattgagtccgtgttgggaaagcctgcggagacaaatagtgacacagtatcagaccatcattttgacgtaccaggagaatttgacagacttgcatcagtaccgagggccttctttcaaggcttcgtcactcaaagctgacaagaaacttgagtttgttcctaccaatttgcacattcagcgcatgcgggtccaggacgacggagggtccgaccaaaactatgatattgtcaccattggggcacccgctgctcattgccagggcttcaagtcagggggtctccggaaaaagttgcataaattcgaggaaaccaaaaagcatttcgaagaatgttgcacatctagcggctgccagtcaattatttacataccacaggatgtggtgagggccaaagaaattattgctcagatcaataccctgaagacccaggtcagttattatgcagaacgccttagtcgcgctgctaaggatagatcggccaccggcctcgaacggaccttggctatcttagccgacaagacccgccagttggtaaccgtgtgcgactgtaagttgctcgccaattctattcacggtttaaacgcagcacgcccagattacattgcttcaaaggcctcccccacgagcacagaagaagaacaagtgatgttacggaacgaccaggatacacttatggcaagatggaccggaagaaattctcgctctagcctgcaagtagattggcacgaggaagagtgggagaaggtgtggcttaacgtggacaagtctctggagtgtattattcagcgggtcgataaactgctacaaaaagagaggctgcatggagaagggtgtgaggacgtatttccttgtgctggctcctgcactagcaaaaaaggtaatccagatagccatgcctattggatcaggccggaggaccctttctgcgacgtgccctcctctccttgcccatccacaatgccttccaccgcatgtcatcctcatcttaccactcattgcagtcctccaccagaggaaagtagcccaggagagtggagcgaagcgctgtatccactgcttacgacgctgaccgattgcgtggcaatgatgtcagacaaagcaaagaaagccatggtgttcctgctaatgcaggactcagccccaacgatcgcgacctacctttcactgcaatatcggagagacgtggtgttttgtcagactctgaccgccctgatctgcggtttcattatcaagttgcgcaactgtctgcatgacgacgggttcctgcgacaactatacacaatcggtctgctggcacagtttgagtcactgctgtcgacttacggagaggaattagccatgctggaggacatgtccctggggatcatggatcttaggaacgtgacatttaaggtgacacaggccactagcagtgcctcagccgacatgctgccagttataaccggcaacagggacggcttcaatgtgagggtcccactgcccggtccactgtttgacgcgctgcccagagaaattcagtcaggcatgctgttaagagttcagcccgttttatttaacgtcggcattaatgaacagcagactctcgctgagagattcggagacacatctctgcaagaggtgatcaacgttgaatctctggtgcggctaaactcctattttgaacagttcaaagaagtattgcccgaggattgcctaccacgatctcgcagccagacctgcttgcccgagttgttacgtttcctcgggcaaaatgtccatgctcggaagaataaaaacgttgatatcctttggcaagccgctgagatatgccggagactgaatggggtgaggtttacctcctgtaaatccgccaaagacaggaccgccatgtcagtcactctcgagcagtgcttaatccttcaacacgagcatggcatggctccccaagtgttcacccaagccctcgaatgtatgagatcagagggttgcaggagggaaaacacaatgaaaaacgtcggtagcagaaagtacgccttcaactcactgcagctaaaggcctttcccaagcactatcgacctcctgaagggacctacggtaaagtagagacctag

SEQ ID NO: 226833 - DNA, 2817 bp, Artificial Sequence
  Description of Artificial Sequence: Synthetic coding sequence
atgactgctcgcgaacattcgccacgacatggcgctcgcgcacgggcaatgcaacgggcatccaccatcgatgtggctgctgacatgcttggactgtctttggcgggaaatatccaggacccagatgaacctattctggagtttagcttagcctgctcggagctgcacactccgtcactggaccgcaaacctaattcttttgtggccgtgtccgtgaccactcccccacaggctttctggacaaaacatgctcagaccgagatcattgaaggtacaaacaaccccatttttctttcctccattgctttctttcaagattctctgattaaccagatgacccaggtgaagctctctgtgtacgacgtcaaagaccggtcacagggaacgatgtatctgctgggctcaggcacctttattgtcaaggatctgctgcaggacaggcatcatagactccatctgactcttagaagtgccgagtcggacagagtcggtaacataacggtcattggatggcagatggaagagaagtcagatcagcgtcctcctgtgacccgctctgtggacaccgtgaacgggagaatggttctacccgttgatgagtccctcacagaagctttgggcattcgaagtaagtacgcaagtctgagaaaggacaccttgctgaagagcgtgttcggaggggcaatttgtcgaatgtatcgattcccgaccactgatgggaatcaccttagaattctggaacagatggcggaaagtgtgctttccctgcacgtccctagacaatttgtgaaacttctgcttgaggaagacgcagcaagggtgtgcgagctggaggaacttggagaactgtctccgtgctgggaatccctgcggaggcagattgtgacccagtatcagacaataattctgacttaccaggaaaatctgacggatctgcatcagtatagaggtccctcttttaaagcgagctccttaaaagctgacaaaaagcttgagttcgtgcccaccaatctccacattcaacgcatgcgtgtacaggatgacggcggatctgaccagaattatgacattgtcaccattggtgctcctgctgcacattgtcagggttttaagtcagggggattgagaaaaaaattacataaattcgaagaaacaaagaagcagcaagaagaatcccgtacgtcctcaggctgccagagtattatctacatcccccaggatgttgttcgcgcaaaggaaattattgctcagatcaataccctcaaaacccaggtgtcctactatgcggagcgactgtcccgcgctgccaaggaccggtcggcgaccgggctcgaaagaaccctggctatactggcagataaaactaggcagcttgtgacagtctgtgattgcaaactgctggccaacagcattcatgggctgaacgcggcacgcccagactatatagcctctaaagccagccctacttccaccgaggaggagcaggtcatgttgcgtaatgatcaggatactctgatggctaggtggacaggaagaaacagcaggtccagcctccaagtggactggcacgaggaagagtgggagaaggtgtggctaaatgttgataagtcactcgagtgcatcatacaaagggttgataaattactgcagaaagaacgcctgcacggggagggctgcgaagacgtatttccttgcgctgggtcctgtacttcaaagaaggactgttcgccacctcctgaggaatcttcacccggtgaatggagtgaagcactttacccactgctgaccacactgaccgactgtgtggcgatgatgagtgacaaagcgaaaaaggccatggtgttcttgctgatgcaggacagcgcacccaccatcgccacttacctctcactgcagtaccgacgagatgtggtgttttgccagacactgacagctctcatttgtgggtttattatcaagcttcgtaattgcctgcatgacgacggcttcctacggcagctatacaccatcggcctgctggcccagttcgagtcactgctgtctacttacggcgaggagcttgcgatgctagaagacatgtcactcgggatcatggacctacggaacgtcacctttaaggttacacaggccacctcatctgcatcagccgacatgctgccggtaattacaggcaatagggatggttttaatgttcgggttccactgcctgggccactcttcgatgcactcccgagagagatccagtcagggatgcttctccgagttcaacccgtcctgttcaacgtagggataaacgaacagcagactctggcagagaggttcggcgacacgtccttgcaggaagtgataaatgtcgagagcctggtgcgattgaatagctacttcgaacagtttaaggaggtcctgcctgaggattgcctgcctcggtcccgaagccagacctgccttccagagcttctgagattcctgggtcagaatgtgcatgccaggaagaacaagaacgttgacattctttggcaggccgctgaaatttgcaggagattgaacggtgttcggttcacctcttgtaagtcggccaaggacaggaccgcgatgagcgtgactctggagcagtgtctcatccttcagcacgagcacggaatggcccctcaagttttcactcaggctctagagtgcatgcggagtgagggctgcagacgcgaaaacactatgaagaacgttggctccaggaagtacgccttcaacagcttgcagctgaaagcatttcccaaacattatcgaccaccagaaggaacatacgggaaggtggaaacatag

SEQ ID NO: 226834 - DNA, 3021 bp, Artificial Sequence
  Description of Artificial Sequence: Synthetic coding sequence
atggaggggcagtcgagccgtggctcccgtcggcctggtactcgtgctggcctaggctcgctcccaatgccacaaggagttgctcagacgggcgcacctagtaaggtggacagttccttccagctaccggcaaagaagaatgcagcgctaggaccctctgagcctcgcctcgcattagctccagtcggaccaagggctgctatgagcgcatcaagtgagggccctagactggcactggcttcaccaaggccaatcttggcccctctctgcacaccggagggacagaagaccgcaaccgcacaccgatctagcagcctggcccctacttccgtgggacagttagtgatgtctgccagtgccggtcctaagcctcccccagcaaccactggttctgtgctagcaccaacttctctgggcctggtgatgcctgcgtcagccggtccaagaagccctcccgtgaccctaggtcccaacctagctccaacttcacgcgaccagaagcaggagcctcccgcttcggttggacctaagcctacgctggctgcatcaggcctgtctttagctctggcctcagaggagcaacctcccgaacttcccagcacgcccagtcctgtgccgtctccggtactttcccctactcaggaacaggctctggcccctgcttctacggcttctggggcagccagcgtagggcagacgtccgctcgaaaacgggacgccccagcacccagacctttgcctgcatccgagggacatctccaacccccagcacagactagtggccctactggctctccaccatgcatccaaacctctccagaccctagactgtctccttcattccgcgctagacccgaagcccttcacagcagtcccgaggacccagtgctgccgaggcctccccagacactccctctggacgtcggccagggtccaagcgaacccggtacgcattcgcctggccttttgtcacctaccttccgtcctggagcgccatccgggcagaccgtgccgccacctctaccgaaacctccgaggtctcctagtagatcccccagccatagtccaaatagatctccctgcgtccctcctgctccggatatggcacttccccgactaggaactcaatcaactggcccaggacgctgcctttcacccaatcttcaggcccaagaggcaccagccccagtaaccacatcttcttccacatctactctatcatcctcgccgtggtcagctcaaccgacctggaagtctgaccccggatttagaatcaccgttgtgacttggaatgtcggcacagccatgcctcccgacgacgtgacatctctccttcacctggggggtggtgacgactcagacggagcagacatgatcgctattggacttcaggaggtgaatagcatgctgaataagaggctgaaggacgctctgtttaccgatcagtggtctgaattattcatggacgcactcggccctttcaattttgtgctcgtctcatccgtacgcatgcagggcgtgatcctgctactgtttgccaaatactatcacttgccttttttgcgagacgtgcaaaccgactgcactcggaccggtctgggcggatactggggaaacaagggtggtgtctctgtgcgtctggcggcatttggccatatgctttgctttctcaattgccacttacctgcacacatggacaaagccgaacagcgcaaagacaactttcagactatcctttccctgcaacagtttcagggcccaggggctcagggcatccttgatcacgacctagtcttttggtttggcgatctgaattttaggattgaaagctatgatcttcatttcgtcaaattcgcaattgattctgaccaactgcaccagctatgggaaaaagaccagctgaatatggcgaagaacacatggccaatcctcaagggcttccaggagggccctctgaatttcgcaccgacttttaaatttgatgtgggcactaacaagtacgatactagcgcgaagaaaaggaaaccagcctggactgatagaattctgtggaaagtcaaagcccctggaggaggaccgtccccctccgggcgaaagagtcacagactgcaggttacccagcattcatatagatcccacatggagtacactgtctctgaccataaacctgttgcggctcagttcttattgcagttcgcattccgagatgatatgcctctggtcaggctcgaagtggccgacgaatgggtacgacctgagcaggcagtggtgcggtatcgcatggaaacagtgttcgcacgaagtagttgggactggatagggctgtatagagtaggctttaggcattgtaaagactacgttgcttacgtgtgggccaagcatgaagacgttgacggtaatacataccaggtcacatttagcgaggaatcgctgccaaaaggccatggcgactttatcctcggttattatagtcacaatcacagcatcctgattggaatcaccgaaccattccagatatcccttccctctagcgagttagcttccagttcaactgactcttccggaaccagcagtgagggcgaagacgactctacactcgaactgctcgcccctaaatcccgcagccccagcccagggaagtctaaaagacatagaagtcgttcaccgggactcgcaagattccccggacttgcgctccgaccaagctccagagagaggcgcggtgccagccggagtcccagcccccagtcccggcgtctgtctagggtcgccccagaccgctcttctaacggtagctcacgtgggagctccgaagaaggtccttccggcctcccaggcccatgggcttttcctccggctgtgccacggtccttgggtttattaccagcactacgtttggaaactgttgatccaggtggtgggggttcctggggcccagaccgagaggctcttgccccaaatagcctcagtccatccccgcagggccaccgagggctcgaagagggcggtctgggcccttag

SEQ ID NO: 226835 - DNA, 1920 bp, Artificial Sequence
  Description of Artificial Sequence: Synthetic coding sequence
atggcgctgcctcgccttggtacccagtccactggacccggacgctgcttgagccccaatttgcaggcgcaggaagcccctgcacccgttactacttctagctccactagcaccctgtcttccagcccttggagcgcccaacccacctggaagagcgaccccggtttcagaataactgtggttacttggaacgtgggtaccgcaatgccccctgatgacgtaacttccctgctgcacctaggcggaggcgatgatagcgatggggcagacatgattgcaatcgggcttcaggaggtcaatagcatgctgaacaagaggctcaaagacgcgttgttcaccgaccagtggtctgaactgtttatggacgctcttgggcctttcaacttcgttcttgtgtcctccgtacggatgcaaggggtcatattactgctgttcgctaaatactaccacctgcctttccttagagatgtgcagacagattgtactagaactggtcttggaggctattgggggaacaaaggtggggtgagcgtgaggctggccgcatttggacacatgttgtgctttcttaattgtcatctaccagcacatatggataaagccgaacagcgcaaagacaattttcaaactatactgtccctccaacagttccagggacccggagcccaaggcatactggaccacgacttggttttttggttcggagacctaaattttagaattgagtcttatgatcttcacttcgttaaattcgctattgactctgaccaactccaccagctgtgggaaaaagaccaactgaatatggccaagaacacatggccaatcttgaaaggctttcaagagggaccccttaactttgcgcctacattcaaattcgatgtaggcacaaataagtacgacaccagcgctaaaaaaagaaagcctgcctggacagacagaatcctctggaaggtgaaggctcctggtggaggtcctagcccgtcaggacggaagagccacagactacaggtcacacagcatagctaccgaagtcatatggagtataccgtatccgaccacaagccggtcgccgctcagttcttgctgcaattcgctttccgagatgatatgccacttgtccggctagaagtggcggatgagtgggtgcgccctgaacaggccgttgtaagatatcgcatggagaccgtgttcgcaaggtcgagctgggattggatcgggttatatagagtgggattccgccactgcaaggactacgtggcttatgtctgggctaagcacgaagacgttgatgggaatacctatcaggtaacctttagtgaagagagccttccaaaggggcatggggatttcatactggggtattactcacacaatcactcaattttaataggcataacggagccttttcaaatttccctgccttctagcgaactcgccagctcaagcactgactcttcaggaaccagttcagagggggaggacgattcaacgctggagctgctggctcccaaatctcgaagcccctctccaggtaagtcaaaaagacatcgatcaaggtctccaggactggccaggttcccaggactcgccctcaggccttcgtccagggaacgcagaggggcatcgcgatcaccaagtccacagtctaggcgtttgagcagagtcgcaccagaccggtcctcaaacgggagtagtcgcggatccagtgaggagggaccatctggattgcccggaccgtgggcttttcccccagcagtgcctcggtcattaggcctgctccctgccctacgactggaaaccgtggacccaggtggaggaggaagctggggaccggatagggaggctttagccccaaactcactgagtccctctccacagggacacagaggcttagaggagggtggccttggcccttag

SEQ ID NO: 226836 - DNA, 1917 bp, Artificial Sequence
  Description of Artificial Sequence: Synthetic coding sequence
atggagggccagtcatcccggggatcccgtagacctggtacaagagccggattgggcagtctgcctatgccacagggagtggcacagactggcgcacccagcaaagtcgattcctcctttcaacttccagcaaaaaagaacgcagccctggggccttccgagccccgaattacagtggtgacctggaacgtgggcaccgctatgcccccagatgacgtgacaagcctcctacatctgggtggaggggacgattccgacggggctgatatgatcgccattgggttgcaagaggttaattccatgctgaacaagcgtctgaaagacgccttatttaccgatcagtggagcgagctgtttatggatgccctgggcccattcaactttgtgctagttagcagcgtccgcatgcagggcgtcatcctccttctgttcgctaaatactaccatctgccattcctgagggacgttcagactgactgcactcggactggtctgggtggttactggggaaataaggggggtgtgtctgtgcgtcttgccgcttttgggcacatgctctgctttttgaactgtcacctgcctgctcatatggataaagcagaacaaaggaaagataactttcagaccattttgagcctacagcagttccagggacctggcgcacagggcattttggaccacgacctggttttctggtttggggatctaaattttagaatcgagtcatacgatctccattttgtgaagttcgctatcgattctgaccagctacaccagctttgggaaaaggaccaattaaacatggccaaaaacacctggccgatactaaaaggattccaggagggccctctcaactttgctccaaccttcaagtttgatgtggggaccaataaatacgatacaagcgcaaaaaagaggaagcccgcatggacagaccgcattttgtggaaggttaaagccccaggagggggtccgagcccttccgggagaaagtcccatagactccaggtgactcaacactcgtatagatcacacatggaatacaccgtgtctgatcacaaacctgtggcagcccaattcctcctgcagttcgcgttcagagatgacatgccccttgtacgcttggaggtggccgacgagtgggtccgcccagaacaggccgtggtgaggtaccggatggaaacagtgttcgctaggtcctcgtgggactggatcggattataccgcgttggttttcgacactgcaaggactatgtggcctacgtgtgggccaaacatgaggacgtagacggaaacacttatcaagtaactttctctgaagaatccttacccaagggccacggagattttattcttggctattattctcacaaccactctattctgataggcatcacggagccctttcaaatttcactaccctccagcgaactggcctcctcttcaaccgactcctctgggacctctagtgaaggtgaggacgattcaacactggaactcttggctccaaaaagccgatctcctagtcctgggaagtccaaacgacaccgttctcgcagccccggactcgcacggttcccgggactggctctccggcctagttctcgagagagacggggagcctcacggagcccaagcccacagagcagaaggctttccagagtggcccctgatcgctcttcaaacggctcctcccggggttcaagcgaggaaggtcctagtggactgccgggaccttgggccttccccccagccgtgcccagaagtctaggcctcctgccggctctccgactcgagacggtggatcccggaggcggaggaagttggggcccagaccgcgaggccctggccccaaactctctcagccccagtccgcaaggacacagaggattagaggaggggggacttggaccctag

SEQ ID NO: 226837 - DNA, 1920 bp, Artificial Sequence
  Description of Artificial Sequence: Synthetic coding sequence
atggcactgccaagactaggcacccagagcacagggcctgggcgatgcctatcccccaatctgcaggcccaggaagcgcctgccccagtgacgacctccagttcaaccagcaccttaagctcaagcccatggtcagcccaaccaacctggaagtctgatcccggattccgtatcaccgttgttacctggaatgtggggactgcaatgccccctgacgacgtcacttctctgttgcatctaggcggaggagatgactcagacggcgcagatatgatcgcaatcggactgcaggaggttaactccatgcttaacaagcgactgaaagacgctctctttactgatcagtggtccgagctgttcatggatgcgctcgggccttttaatttcgtgctggttagctctgtgaggatgcaaggggtgattctgctgctgttcgccaagtactaccatctcccctttttgcgggacgtgcaaaccgactgtacccggaccgggttggggggatactggggtaacaaaggaggagtgtcggtacgcctggcagcattcggacatatgctgtgtttcctgaattgtcaccttcccgctcacatggacaaggcggagcaaaggaaagacaatttccagacaattctctctcttcagcagtttcaaggtcccggagcacagggaatcctggaccacgatctggtgttctggttcggcgacctgaactttcgaattgagagctatgacttacactttgtgaaattcgcaattgactcagatcagttgcaccaactgtgggaaaaagaccagctgaacatggccaagaacacatggcccatacttaaggggtttcaggaaggaccgctcaacttcgccccaactttcaaatttgatgtaggaaccaataagtacgacacttccgccaaaaagaggaaaccagcctggaccgacagaatcctctggaaggtcaaagcacctggaggcggaccgtccccatctgggcgaaaatcacatcgcctgcaggtgacacagcatagttataggtcacacatggaatataccgtgtctgaccataagcctgtggccgctcagttcctgctgcaattcgccttccgggatgatatgccattggtgcggctggaggtcgccgacgagtgggtgaggcccgaacaggccgtagtgaggtaccgtatggaaaccgtatttgcacgttcatcttgggactggataggcctctatcgtgtcgggttcagacactgcaaagattatgtagcgtacgtatgggccaaacacgaagatgtggatggaaacacataccaggtgaccttttcagaagaaagcctacctaagggtcacggcgactttatcctgggttactacagtcacaaccactccatcttaattggtatcaccgaaccctttcaaatctctttgccaagttcggaattggcctctagttcaaccgatagttccggaacatcttccgagggagaggatgacagtactctggaacttttagctccaaagagccgtagcccttctcccggaaaatcgaagcggcacagaagccggagtccgggtcttgctcgcttcccaggtctcgcactaagaccctcctctcgtgagcgaaggggagcaagtaggagcccatccccccagtcccgacgcctatcccgcgtggctccagataggtcctcaaacgggagtagcagaggcagcagcgaagagggcccaagcggcctccctggcccttgggcttttccaccagctgtaccaaggtcgctcggccttctgcccgcattgcgactggaaacagtcgatccaggaggaggcggttcgtggggccctgacagggaagccctggcacctaatagcctgtctcccagcccacaggggcatcgtggcctagaagaaggtggacttggaccttag

SEQ ID NO: 226838 - DNA, 2820 bp, Artificial Sequence
  Description of Artificial Sequence: Synthetic coding sequence
atgagcgcgtcctctgaagggcctcgcttggccctcgcctcaccgaggccaattctggccccattgtgtacacccgagggccaaaagactgctaccgctcaccggagttcgtctttggcgcctacctcggtcgggcagctcgtgatgtccgccagtgccggacctaaacccccacccgctaccaccgggagcgttcttgccccaacttctttggggctggtgatgccggcatctgctggtccgcgaagtccaccagtgacactcgggccaaacttggcaccgacatctcgagaccaaaaacaagaaccccctgcgtccgtgggtcccaagcctacgctggccgcatctggtctgtccttggcattagcctccgaagagcaaccacctgaattaccatctactccatctcccgtgccgtcaccggtgctgtctcccacgcaggaacaggctcttgcccctgcatctaccgcatcaggcgcagcctcagtgggccagacctcagccagaaagcgcgatgctccagcacccagacccctgcctgccagcgagggacacttacagccgcctgctcaaacatcaggtcccacagggagtcctccgtgcattcaaacttctcccgatcctcgcctctccccttcctttcgggctagacccgaggccctgcactctagccccgaagacccagtactgcctagacctccccagacactgccactggacgtggggcagggcccaagcgagccaggcactcactcccccggattgctcagccccacttttcgacccggtgcacctagcggccagactgtgccaccgccattgcctaagcccccaaggagtcccagtcgcagtcccagccattctccaaacaggtccccttgcgtcccgcctgctcccgacatggctctcccaaggctcggaactcagagcacgggtcccggtaggtgtctcagccccaacctgcaagcccaggaagctcctgcccctgttactacttcatcctcaacttcaacccttagctctagtccctggtccgcccaacccacgtggaaaagtgacccaggcttcaggatcacagttgtgacgtggaatgtgggcactgccatgcctcctgatgatgtgacttcactgttacatctcggcggtggggacgattccgacggggctgatatgatagctattggcttgcaggaggtgaactccatgctgaacaagcgactgaaagatgccctctttacagatcagtggtccgaactgttcatggacgccctagggcctttcaactttgtgttggtgtctagtgttcgcatgcagggcgtgatcctcttgctgtttgctaagtactatcatcttcccttcttgcgggacgtgcaaacggattgcactcggactggcctcggcggttactggggcaataagggcggtgtcagcgttcggttggccgcattcggacacatgctgtgtttcctaaattgccatcttcctgcccacatggataaagccgaacagcgtaaagacaattttcaaaccattctgtcactccagcagttccagggtcctggggcacaaggaatcctcgatcacgatctggtgttctggttcggggacttaaactttcgtatcgagtcatacgatctacacttcgtaaagtttgctattgactccgatcaattgcaccaactgtgggagaaagatcagctgaacatggccaagaatacttggcccatcctgaaggggtttcaagaggggccattaaacttcgcacccacatttaagtttgacgtaggaactaataagtacgatacatctgcaaagaagagaaaacccgcatggaccgatcgaatcctctggaaagtgaaggcgcctggcggaggcccatctccaagtgggcgaaaaagtcatcgtctccaagtgactcagcattcatataggagccatatggaatataccgtttcagaccataagcctgtagcagctcagtttttgctgcaatttgcatttcgggatgacatgcctcttgtacgactcgaggtggcagatgagtgggttcggcctgaacaggccgttgtcaggtacaggatggagaccgtgttcgcgagaagcagctgggactggattggcttatatcgggttggctttcgccattgcaaagactacgtggcctacgtgtgggcgaaacacgaggatgtggacggcaatacctatcaggtgacgttctctgaggagagcctccccaagggtcacggtgacttcatcttggggtactactcacataaccatagcattttgattgggattacagaaccttttcagatcagcttaccttctagcgagctggcgtcctccagtacagacagttcgggaacttcatccgagggggaggatgatagcacccttgagttgcttgctccgaaaagtaggagcccatccccaggcaagagtaagcgtcataggtcccgctccccgggactcgcaaggttccctgggctggccctgcggccttcgagtagagagaggaggggcgcatcaagaagcccgagtccgcagagccgcaggctgtcgcgtgttgcgcctgacagatcgtctaatgggtcctcgagaggatcctctgaggagggcccttcaggccttccagggccatgggcctttccccctgccgtgccccgatctttagggttgcttcctgccctgcgtttggagaccgtcgaccccggaggtggtggaagttgggggcctgatcgggaggccttagctcctaacagcttaagcccttctccacaaggccatagaggactcgaagagggcggtctgggaccttag

SEQ ID NO: 226839 - DNA, 3534 bp, Artificial Sequence
  Description of Artificial Sequence: Synthetic coding sequence
atggtcccatgctggaatcacggaaacataactcggtctaaggccgaggagctgttatcccgcacagggaaagacgggtcttttcttgtcagggcgtcagaaagtatttcccgggcttatgcactttgtgtcctttaccggaattgtgtgtacacctatcgcattctgcctaacgaagatgacaagttcaccgttcaagcctcagaaggcgtgagcatgcgatttttcactaagctcgatcagcttatagagttctacaagaaagagaacatgggtctcgtaacgcacctgcagtatccggttcccttagaggaggaggataccggagatgatcccgaggaagacactgtcgaaagtgtcgttagcccgcctgaactccctcccagaaacatacccctgactgcttcatcatgtgaagccaaagaagtgccgttcagtaacgagaatcccagggcaactgagacctcacgcccatctctcagcgagacactattccaaaggctgcaaagcatggatacgagcggcctgcccgaggagcatctcaaagcaatccaggactacctgagcacccagctagctcaggactccgaatttgttaaaaccggctctagtagcttaccacacctgaagaagttgactactctgctgtgcaaggagctgtacggccagatgctgcggactgtgccgggtatcgggaaggtgaaggaggaggatcacgtgcccggagaggccaaccctatcaacatggtaagtaagctgtcccaactgacaagcctcctgtcttccatcgaagacaaggtgaaagcactgctgcatgaaggccctgaatccccccaccgccctagcctcattcccccagtgaccttcgaggtgaaagctgagagtctggggatcccacagaagatgcagctgaaagtagacgtggaaagtggaaaattgatcatcaagaagagcaaggacggctcagaggataagttctatagtcacaaaaagattctacagctcatcaaaagtcaaaaatttctgaacaagttggtcattttggtcgagacagagaaagaaaagatcctccgcaaggagtatgtgttcgccgatagcaagaaacgagagggcttttgccagctcctacagcagatgaagaataagcactcagagcagcctgagccagatatgataaccatctttatagggacatggaacatggggaatgcaccccctcctaaaaaaatcacctcatggttcttgtcgaagggtcagggtaagactcgggacgattcggccgattatatcccccatgacatctacgtcatcgggactcaggaagaccccctgtccgagaaggagtggctggagattctgaaacacagcctgcaagagattacctcagttacttttaagacagtcgccatccacaccctgtggaacatcagaattgtggtcctcgcaaagcccgaacacgagaaccgaatcagtcatatttgtacagacaacgtgaagaccggcatcgcgaatacgctgggaaacaagggggctgtaggcgtgtcatttatgtttaacggcactagtctggggttcgtcaactctcatcttacctctggctctgagaagaaactccgacgcaaccagaactacatgaatatcttgagattcctggcccttggcgacaaaaagctcagtcccttcaacattacacacaggtttactcacctgttctggttcggtgatctcaactaccgcgttgatctccccacctgggaggccgaaacaattattcagaagattaaacagcagcagtatgctgacctgctatctcatgaccaactccttaccgagagacgcgagcaaaaagtttttctgcacttcgaagaggaagagattaccttcgctcctacatacagatttgagcgtctaacccgcgacaagtatgcatacacgaaacaaaaggctacgggcatgaagtataacttgccctcctggtgcgatcgggtgctatggaaatcatatccattggtgcacgtcgtctgccagagttacgggtcgacttccgacattatgacttctgaccattcacccgtgttcgctacatttgaagccggagtcacatcccaatttgtgtcaaaaaatggaccagggaccgtggatagtcaaggtcaaattgagtttctcaggtgctacgctactctgaagaccaagagtcaaaccaagttttacttggagtttcacagttcctgccttgagagcttcgttaagtcccaggaaggcgagaatgaagaaggttctgaaggggagcttgtagtaaaattcggagagaccctgccaaagttaaaacctattatctcagaccccgagtacctgctagatcagcacatactcatcagtatcaaatcctctgactccgacgaatcttacggtgaaggctgtatcgctctgcggctcgaagcaactgaaacccagctgcccatttacacacctctaacgcatcatggagaactgactggccactttcagggcgagatcaaattgcagacaagtcaggggaaaacccgggagaagttgtacgacttcgtgaagacagaacgcgacgaatccagcggacctaagacacttaagagccttacaagccatgatcccatgaagcaatgggaagttacaagcagggccccaccctgctccggatcctctatcactgagataatcaaccctaattatatgggcgttggtcccttcggcccacccatgcctctgcatgtaaaacaaaccctgagcccagatcaacagcccacagcttggagctatgaccagccaccaaaagactcccccctcggcccatgccgaggggaatctcctccgacacccccaggtcagccacctatttctcccaagaaattcttaccttccactgcaaatcgaggccttcctcccagaacccaggaatcccgcccatccgacctgggcaagaacgctggagataccttacctcaagaagatcttccactgactaaacccgagatgtttgagaatcccctgtatggcagtctgtcatcatttccaaaacctgcaccccgtaaagaccaggagtccccaaaaatgccgaggaaagaacctcctccgtgtccagagcctggaatcctctccccctccattgtgctgacaaaagcacaggaggcagacagaggcgagggaccgggaaagcaggtgcctgccccaaggttgagatcgttcacgtgcagttcaagtgctgaaggacgcgcagccggtggcgataagtcccagggcaaacctaaaactccggtatcttctcaggcacctgtgccagccaagcggccaattaaaccttccagaagcgagatcaaccaacagacacccccaacaccaaccccacggccacctctaccagtgaaatctccagccgtcttacacctccagcattccaaaggacgggattatagggataacaccgaactgcctcaccacggcaaacatcgaccagaggaggggccacccggtccacttggccgtactgccatgcagtag

SEQ ID NO: 226840 - DNA, 2433 bp, Artificial Sequence
  Description of Artificial Sequence: Synthetic coding sequence
aagcgcgaaggcttctgccagctcctccagcagatgaagaacaagcattcagagcagcccgagccggacatgatcaccattttcatcggcacatggaacatggggaacgccccacctcccaagaaaatcaccagctggtttctgagtaagggacagggtaaaaccagagatgattccgctgattacatacctcacgatatctatgtaatcggcacccaagaggacccactgtcggagaaagagtggctcgaaatattgaagcattctctccaagagatcacgtccgtgaccttcaagactgtggccatccatacactatggaacatcagaatcgtggtgctggccaaacccgaacacgaaaaccggatctctcacatttgcaccgataacgtaaagaccggcatcgcaaatacactcggaaataagggcgcagtcggcgttagcttcatgttcaatggaaccagccttggattcgttaacagtcacctgacatccggctccgaaaaaaagctgaggcgcaaccaaaattacatgaacattctgagattcctggccttaggcgataaaaaactttctccgttcaacatcacacaccgttttactcatcttttttggtttggtgatctgaactaccgggtggacctccctacctgggaagccgaaacaatcattcagaagataaagcagcagcaatatgccgacctcctttctcacgatcagctgctcacagagaggagggagcagaaggtcttccttcattttgaggaggaggaaataaccttcgcaccaacataccggttcgagcggcttactcgggacaaatacgcctatacgaagcagaaagccacagggatgaaatataatctgccaagctggtgtgaccgcgtcctgtggaaatcgtatccactggttcacgtagtttgccagagttatggatctacttcagacattatgacctccgaccactccccggtatttgctacattcgaagctggggtgaccagccagtttgtgagcaagaatggaccaggaaccgttgattcccagggtcagattgaattcctgaggtgctatgctaccctgaagacaaagagtcagactaaattttatttggaattccactcctcctgtttggagtcatttgtcaagtctcaggaaggcgaaaacgaggaaggcagcgagggggagttagtggtaaagtttggcgagactcttccgaagctcaaacccattatcagcgacccggagtatcttttggaccaacatatcctcatttctattaaaagctccgatagtgatgaaagctacggcgaggggtgcatagcactgcgattggaggcgaccgaaactcagctcccgatctataccccccttacccaccacggcgaactgactggccactttcagggcgagattaaactgcagacctctcagggaaagacccgcgagaagctctacgactttgtcaaaacagaacgggatgagtctagcggtccaaagacactgaagtccctgacctcacatgaccctatgaagcagtgggaggtcacttctagggcacccccttgtagcggaagctccattactgaaatcatcaaccccaactacatgggggttggccctttcggcccaccgatgcctcttcatgtgaagcagaccctgagccccgatcagcagcctaccgcctggagctatgaccagcctcccaaagatagtccactcgggccatgccgcggagaatcgccgccaacacccccaggacagccacccatctcacctaagaagttcctgccatctacagcaaaccgcggattaccacctcggacacaggaatccagaccctccgacctggggaagaacgctggagacactctcccgcaagaagaccttcccctgactaagccggagatgttcgaaaaccccctgtacggctccctaagttcatttccaaagccagccccacgtaaagatcaggaatctcctaaaatgcccaggaaggagccccctccgtgtcccgagcccggaattctgagtccctctatagtgctgaccaaggcccaggaggccgatagaggtgaagggccaggaaagcaagtcccagcaccccgtcttcgaagctttacatgttcatccagtgcggaagggagggccgcaggtggcgacaaatctcagggaaaaccaaaaaccccggtctcatcgcaggcaccagtgcccgctaaacgacctatcaaaccatctaggagcgagattaaccaacagaccccacccacgccaaccccgaggcctccactgccggtgaaatccccggcagtactgcacctgcaacatagcaagggtcgcgactacagagacaacactgaactcccacaccacgggaaacatcgacccgaggaaggcccacccggaccattaggcagaactgcaatgcaatag

SEQ ID NO: 226841 - DNA, 666 bp, Artificial Sequence
  Description of Artificial Sequence: Synthetic coding sequence
atggtaccatgttggaatcatgggaatattacccggtcaaaagccgaggaacttctctcacgaaccggtaaggatggctcctttctggtgagagctagcgagtccatcagccgggcatatgcgctatgcgtgttatatcgcaactgtgtctatacatatagaatcctgcctaatgaggatgacaagttcactgtgcaggccagtgagggagtgagcatgagattcttcacaaagctggaccagctcattgaattttataaaaaagagaatatggggctagttactcatctgcagtaccccgttccactggaagaagaggacaccggggatgacccagaggaagataccgagtctgttgttagcccccctgagctgccgccacggaatatcccacttaccgcctccagctgtgaggccaaggaggttcccttcagcaatgaaaaccccagggcaactgagacttctcggccttcactcagcgaaaccctgttccagcggctgcagtctatggacaccagcggattgcctgaagagcacctcaaggccattcaggattacctctctacacagttggctcaagactctgagttcgtgaagacaggttccagtagtctcccccatctgaaaaaattgacgacactgctttgcaaggagttgtacggttag

SEQ ID NO: 226842 - DNA, 2433 bp, Artificial Sequence
  Description of Artificial Sequence: Synthetic coding sequence
aaacgggagggattttgccagctgcttcagcagatgaagaacaaacatagtgagcaacccgaaccggatatgataactatctttattggcacctggaatatgggaaacgctcctccacccaaaaaaatcactagctggttccttagtaaaggacaggggaagacccgagatgactccgcggattatatcccccacgatatctatgttattggaacccaggaagatcccctttcagagaaggaatggctggagattcttaagcattcactccaagaaatcacaagtgtgacgtttaaaacggtggccatacacactctgtggaatattcggatcgtggtactcgccaagcctgaacatgagaatcggataagccatatctgcacagataatgtgaagacaggaatcgcaaatacattgggaaacaagggcgctgtgggtgttagctttatgttcaatgggacatccttggggtttgtgaattcccacctgacaagtgggtcggagaaaaagttgcgtaggaaccagaattacatgaacatcctgcgctttctggcgttgggggacaagaagctgagccctttcaacatcactcaccgtttcacgcacctgttctggttcggcgacctgaactatagagtggatctcccgacctgggaagccgaaaccataatacagaaaataaagcagcagcagtatgcagatttgctcagtcatgatcagcttctgaccgaacgcagggagcagaaagtatttctgcacttcgaagaagaggagattaccttcgctccaacttatcggttcgaacgtttgaccagagacaagtatgcatacaccaagcaaaaggccactgggatgaaatacaacctgccatcatggtgtgatagggtgctgtggaagagctacccccttgtgcatgtggtgtgtcagagctatggctcaaccagcgacataatgacctcggatcattcacccgtgttcgccacttttgaagctggagttacgagccagtttgtaagcaagaatggtcctggtacagtggattcccagggccaaatcgagttcctgaggtgctatgcaacccttaagaccaaatctcagactaaattctaccttgaatttcattcgtcttgtctggagtctttcgttaaaagccaggagggcgaaaacgaggaaggctcagagggagaactggtagtgaaatttggggagacactgccaaaattgaagcccatcatcagcgatccagagtacctgctggatcagcatattttaatatccattaaaagttccgatagtgacgaatcgtacggagagggatgtatagccctgagactggaggcgaccgagacacagctgcctatctacactcccctgactcaccatggcgaactgactggacactttcagggcgagatcaagcttcagacctctcaagggaagacgcgcgagaagctttacgattttgtcaaaacagagagggacgaatcctccggccctaaaactctaaagtcactcacttcgcatgacccgatgaagcagtgggaggttacttcccgcgctccaccatgctcaggatcgagtatcactgagattatcaaccctaactatatgggagtggggccatttggaccccctatgccactgcatgttaaacagaccctcagtccagatcagcaaccaaccgcgtggagttatgaccagccacctaaagatagtccccttggaccttgcagaggagagtcgcctcctacaccccctggacagccgccaatctctccgaaaaagtttctcccgagcaccgcgaaccgcggtctccctccaaggacccaggaatcaagaccttcagacttggggaagaacgccggagacacgctgcctcaagaggacctgccccttaccaaacctgagatgttcgagaatcctttgtatggcagcctgtctagcttcccgaaaccagcaccacgaaaggaccaagagagtcctaagatgccaagaaaagaaccacctccctgccccgagccaggtatcctttcgcccagcattgtactcacaaaggcacaggaggcagatcgtggcgaagggccaggcaagcaggtaccagcccctcggttgcggtccttcacatgctctagctcagccgaggggagagcagctggtggcgataagagtcagggtaagcctaagacccctgtttcatctcaggctcctgtacctgctaagcgacccatcaagccctcacgaagtgagattaaccaacagaccccccctacgcctacaccgagaccacctctgccagtgaagagtccagcagttctgcacctccagcattcaaaaggtcgagattatagggacaacactgaacttcctcaccacggtaaacatcgcccagaggaggggccacctggacccttagggagaacggccatgcagtag

SEQ ID NO: 226843 - DNA, 2433 bp, Artificial Sequence
  Description of Artificial Sequence: Synthetic coding sequence
aaacgggaaggattttgccaattactccagcagatgaagaataagcactcagagcagcctgagccagacatgataacgatcttcattgggacatggaacatgggtaatgccccaccccctaagaagatcaccagctggttcctgagcaaagggcaaggcaaaaccagggacgactctgcagattatattccccatgatatttacgtcatcggcacccaagaagatccactgtcagagaaggaatggctcgagatattaaaacactccctgcaggagattacttctgtgacatttaaaaccgtagccatacacactctttggaacatccgcatagttgtccttgcaaagcccgaacacgagaatcgcatctcccatatctgcaccgataatgtgaaaaccggtatagctaacactcttgggaataagggcgctgtgggggtctctttcatgttcaatggcaccagcttggggttcgttaacagccatttaacaagtgggagcgaaaaaaaattgagacggaatcagaattacatgaacatactgcgattcctcgccctgggcgataagaaacttagccctttcaacatcacccatcggtttactcacctgttctggttcggggatttgaactaccgagtcgatctgcctacctgggaggcggaaaccatcatacagaagatcaaacaacagcagtatgccgacttattatctcatgatcagctacttactgagcggcgagagcaaaaagtttttctgcactttgaggaggaggagatcacattcgcccctacataccgctttgaaaggcttacaagggacaaatacgcatataccaagcagaaggccaccggcatgaagtataatctgccgtcgtggtgtgacagagttttgtggaaatcttatcccctcgtccacgtggtatgtcagagttatggctcaacatccgatatcatgactagcgatcacagccctgtcttcgctacatttgaggcaggggtgacctcccagttcgtaagcaaaaacggacctggtacagtggattcgcaagggcagattgaatttttgaggtgttatgctacgttgaaaactaagagtcagacaaagttctatctggagtttcattcaagctgtttggagagtttcgtgaagagccaggagggagagaatgaggaaggaagtgagggggagctggtagtgaaattcggtgaaacgctgccaaagttaaagcccattatatctgaccctgaatacttgctcgaccagcatatattgatcagtatcaagtccagcgatagcgacgaatcttacggagaggggtgcattgctcttagactggaagcaacggagacccagcttcccatatatacgcctctgacccaccatggggagctgacgggacatttccaaggagagataaaactgcaaacaagccaggggaaaacgcgggaaaaactttatgattttgttaagaccgagcgtgatgaatcaagtgggccaaagactctcaagagccttaccagtcacgatccaatgaaacagtgggaggttaccagccgcgctcccccatgcagtgggtcaagcattactgagatcatcaatcccaattatatgggcgtggggccttttgggcctccaatgcctttgcacgtgaagcagactttgagtcctgatcagcagccaactgcatggagctacgaccagccacctaaggattcaccgctaggcccatgccgcggagagtcccctcccacgccacccggtcaaccacctatcagtcccaaaaaatttttacctagtaccgctaatcgcggactgcctccgagaacacaggaaagccgccctagcgacctcggcaagaacgcaggggacactctgccacaggaagatctccccctcactaagcctgaaatgtttgaaaatccactctatggaagtctttctagtttcccgaagcctgccccacgcaaggaccaggagagcccgaagatgccgcgtaaagagccgcctccatgtcctgaacccggaatcctctccccctctatcgtcctgacaaaggcccaggaggcggacaggggagagggccctggaaaacaggttcccgcaccgaggcttcgttctttcacctgcagcagctcagctgagggacgggcagcaggaggagacaaatctcagggcaaacctaagacacccgtgagcagccaggcccctgtcccagccaaaagaccaattaagccaagtcgctccgagattaaccaacaaactccaccaacccctactcctagaccacctctgcctgtgaagtctccagccgttctgcacctccagcattccaaagggagggattatagagataacaccgaattgcctcaccacgggaaacaccggccagaagaaggcccaccaggcccattaggcaggaccgccatgcagtag

SEQ ID NO: 226844 - DNA, 2826 bp, Artificial Sequence
  Description of Artificial Sequence: Synthetic coding sequence
cgtcctcaggtgccgggagaagccaaccctattaacatggtgtccaaactctctcaactgactagcctgctgagctcaattgaagataaagtgaaagctctgctgcacgaagggccagagtcccctcatcgtcccagccttatcccccctgtgacattcgaggtgaaggccgagtccctgggcatcccacagaaaatgcaactcaaagtggacgtcgaaagcggcaagctgatcattaagaagtctaaggacggatctgaggataaattttacagccacaaaaagatactgcagttaatcaagtcacagaagttccttaacaaacttgtgattttggttgagacagagaaggaaaagatcctgcggaaagagtacgtgttcgcagactcgaaaaaacgcgagggcttctgccagctgctgcaacaaatgaagaataaacacagtgagcaaccagagcctgacatgatcacaatttttatcggcacctggaacatgggaaacgcaccgcctccaaaaaagatcacatcctggttcctgagtaagggacaaggtaaaacgcgggatgattctgccgattacataccccacgacatttacgtgattggtacccaagaagacccactgtccgaaaaagagtggttggagatactcaagcactcattacaagaaattacttccgtgacctttaaaaccgtcgccattcacaccctgtggaatattaggattgtggtcttggcaaagcctgagcacgaaaacaggatatcacacatctgtactgacaacgtgaagacgggtatcgccaacaccctaggcaataagggcgctgttggcgtgtcattcatgttcaacggtacctctctcggattcgtgaactcacacctgacatctggctctgagaaaaaactgcgaaggaatcagaattatatgaatattctgcgctttctcgcactcggagataaaaagcttagcccctttaacatcacgcacaggttcacccacctcttctggtttggagatctgaattaccgagtcgatctgccgacctgggaggccgaaactatcatccaaaaaattaagcaacagcagtatgccgacctcttgtcacatgatcagctgctaaccgaacgtagggaacaaaaagtgtttctacactttgaggaggaggagataaccttcgctccaacatatcgtttcgagaggctgacccgagataagtatgcctataccaaacagaaggccacgggcatgaagtataatcttccctcgtggtgcgatagggtgctttggaagtcctaccccttggtacacgtggtatgtcaaagctacggctccacttccgacatcatgacgtcagaccatagtcccgtctttgctacatttgaggcgggagtgacctcccagtttgtgagcaaaaacggcccaggaactgtcgatagccagggacagatcgagtttctccgatgttatgctaccctgaagacaaaatcccaaactaaattctatttggagttccactccagctgcctcgagagctttgtgaagtctcaggagggcgagaatgaggagggaagcgagggggaactggtagtgaagtttggcgaaacacttcccaagctcaagcctataatatctgatcccgaatacctgttggaccagcatatacttatttctattaagagttccgatagcgatgaatcttacggagaaggctgcatcgccctgcgcttagaagcgaccgagacccaactaccaatatatacgccactgacccaccacggggaactaaccggccacttccagggcgagataaagttgcaaactagccagggcaagacacgagaaaagctttatgactttgtgaaaaccgagagagatgagtcgtccggtcctaagactctgaagtccctgacttcacacgatcccatgaagcagtgggaggttacctccagggccccaccttgttctgggtccagcatcacagagattattaatcctaactatatgggggtcgggccttttggccctcccatgccgctccacgtaaaacaaaccctatctcccgaccaacagcccactgcctggagttacgatcagccgcctaaggattctcctctgggaccatgtcggggagaatccccacccactccaccagggcaaccacccatttcacccaaaaagtttttaccttctaccgctaaccgcggtctccctcccaggacacaggaatctcggccaagcgatctgggcaaaaacgccggagacacactgccgcaagaggacctccctctgactaagccagagatgttcgagaacccgctgtatgggtcactctcttctttccccaaacccgctccgcgtaaagaccaggaaagccccaaaatgcccaggaaggaacctccaccctgtcctgaaccaggaatcctgtccccgagtattgtactcaccaaggctcaggaagccgatcgaggagagggcccaggaaagcaggtcccagctcctcggttgcggtctttcacctgctcctcgtctgccgaagggagggcggctggcggtgataaatcccagggtaagcccaagactcccgtcagctcccaggcgccagtgcctgcaaagcggcctattaagccatcacgcagcgagatcaaccaacagacaccccctactccgacgccgaggcctcccctgcctgtgaagtcccccgcagttctccacctgcagcactccaaaggtagggactaccgagacaacaccgagctgcctcaccatggaaaacataggccagaggaggggccacccggacctttggggaggactgcgatgcagtag

SEQ ID NO: 226845 - DNA, 669 bp, Artificial Sequence
  Description of Artificial Sequence: Synthetic coding sequence
atggtaccctgctggaatcacgggaacattacaagaagcaaggccgaagagcttctgtcccgaactgggaaggacggtagctttctggtgagagcaagtgaatctataagccgcgcatatgctctttgtgttctgtatagaaattgtgtgtacacataccgcatcctaccgaacgaggatgacaagtttacagtgcaggcttcggagggagtgagcatgagatttttcactaagctcgatcagctaattgagttttacaagaaggaaaatatgggattggtgacccacctccagtaccctgtccccttggaagaggaagatacaggagatgatccagaggaagatacagtggagagcgtcgtctctccgcctgagctgccgcctcgcaacatacctctgacagcttcatcctgcgaggctaaagaggtcccattcagcaatgaaaatccccgagccaccgagacatcgcgcccatccctaagtgagacactattccagagattgcagagcatggacacttctgggctgcctgaagaacacctcaaggcaatccaggattacctgagcacccagttggcgcaagattctgaatttgtcaaaaccggctcctcaagtctccctcatctgaaaaagctgacaaccctcctgtgtaaagaactctatggatag

SEQ ID NO: 226846 - DNA, 2826 bp, Artificial Sequence
  Description of Artificial Sequence: Synthetic coding sequence
ccaccacaggtcccaggcgaagccaatcccatcaatatggtaagcaaactgtcccagcttacctctcttttgtcgtcgatcgaggacaaagtcaaagcacttctgcatgaaggcccagagtccccccaccgacctagcctgattccacccgttacctttgaagtgaaggctgaaagtctcggaatcccccagaagatgcaactaaaggtggatgtggagtctggcaagctaattattaaaaaaagtaaagatggttctgaggataaattctatagccacaagaagatactccagctgataaagagccagaaatttctgaacaaactggtcattctagtagagaccgagaaagaaaagattctcagaaaagaatacgtatttgctgacagcaagaagcgcgaaggcttctgccagctgcttcagcagatgaaaaataaacatagcgaacagcctgagccggatatgattacaatctttattggtacgtggaacatgggtaacgcccctccacccaaaaagatcacctcatggttcctgtcgaaaggacaggggaagacgagagatgattccgctgactatatcccccacgacatctatgtgatcggcacccaggaagacccgttgagcgagaaagagtggctggaaatcctcaagcacagcctgcaagagataacttctgtaactttcaaaaccgtggcgattcacaccctttggaatatccgaatcgtcgtgctagccaaacctgagcacgaaaaccgcatcagccacatatgtacggacaatgtgaagacagggattgctaataccctgggcaataagggtgctgtgggtgtatcatttatgtttaacgggaccagcctgggctttgtcaattcacacctgacctctgggagcgagaaaaaacttaggaggaaccagaactacatgaacatactgcgtttcctggcacttggtgataagaagctctcaccgtttaacataacgcatcgattcacccaccttttttggttcggggatttaaactatcgggtcgatctgccaacctgggaggctgaaacaatcatccagaaaatcaagcagcagcagtatgctgatcttttatctcatgatcaactcctgacagagagaagggagcagaaggttttcctgcatttcgaggaggaggagatcacattcgctcctacctacaggttcgagagactgacacgagacaaatatgcctacactaagcagaaagccaccggaatgaaatacaacctgccttcctggtgcgatagggtattatggaagagctaccctctggtgcatgtggtatgccagtcttacgggtccacgagcgacatcatgacatccgatcattcgccagttttcgctacatttgaggctggggtgaccagccagttcgtgagcaagaacgggccaggtacagtggattcccagggccagattgaatttcttaggtgttacgctaccttgaaaactaagtctcaaactaaattctatttagagttccatagttcttgccttgaatccttcgtcaagagtcaagagggtgagaacgaggagggatcagaaggcgaactagttgtcaagtttggcgagacactcccaaagctgaagcctatcatatccgacccagaatatctcctggatcaacatatattaatttccatcaagtccagtgactcagacgaatcttacggtgagggctgcatcgctctaaggctggaggctaccgagacccagctgccgatttacactcctcttacacaccacggcgagctgactggccacttccagggtgagatcaagttgcagacatctcagggcaagacccgcgagaagttgtacgattttgtgaagaccgaaagggatgaaagttccggcccaaagacactaaagtccctgactagtcacgatcccatgaaacaatgggaagtcacttccagagccccaccctgctccggtagcagtattacagaaataatcaaccctaactacatgggggttgggcctttcgggccaccaatgcctctccacgtgaagcagactctcagccccgaccagcaaccaacggcctggagctacgaccagccgcctaaagatagccccctcggaccatgccggggtgaatcgccacccaccccacctggacagccccctataagccctaagaaatttctgccctccacagccaatcgaggtttgcctccacgcactcaagagagccgcccatccgatctcgggaagaacgccggagacacactgccgcaggaagaccttcctctgacaaagccagaaatgttcgagaaccccctgtacggctcccttagtagctttcccaaacccgcacccaggaaagaccaggagtcaccaaaaatgccaaggaaggaacctccaccgtgccccgagcccggaatcctctccccctccatagttctcacgaaggcccaggaagctgaccggggagaaggccctggaaaacaggtgccagcgcctcggttacgttcattcacatgttccagcagtgcagaagggagggccgcaggcggagataagagtcagggaaaacccaagaccccagtgtcttcgcaggccccagtgccagccaagcgtccgattaaaccatctcgatctgagatcaaccagcagacccctcccacacccacaccgagaccgccactgcccgtcaagtccccggctgtgctgcacctgcagcacagcaaaggccgagactaccgtgacaacacagaactgccgcaccatggcaagcaccgccctgaggaaggtccccctggacctctgggccgtaccgccatgcagtag

SEQ ID NO: 226847 - DNA, 1791 bp, Artificial Sequence
  Description of Artificial Sequence: Synthetic coding sequence
atggttccctgttggaaccatggaaacattacccgatccaaagcggaagagctgttgtcccggaccggaaaggatgggagctttttagtcagagcatctgagagcatctctcgtgcctacgctttgtgtgttctctataggaactgtgtatatacatacagaatcctcccgaacgaggatgacaagttcaccgtccaggctagcgagggagtgtcaatgcgcttttttaccaaattggaccaactaatcgaattttacaagaaagaaaacatgggattggtgacacacctccagtacccggtgccattggaggaggaggacaccggagatgaccccgaggaggacacagtagagtctgtggtttcccccccagagctgccacccaggaacatccccctaacggctagttcatgtgaggctaaggaggtaccattttcgaatgaaaaccctagagctactgagacttctcggcctagtctcagtgagacactgtttcagaggctccagagtatggatactagtggcctgcctgaggaacacttgaaagccattcaagattatctgtctacacaactcgcgcaagacagtgagtttgtgaagaccggttcttcaagcctgccccatcttaagaaactgacaactctgctttgtaaggaactgtatgggtattgtctggaagtgctgctcagttatccactttctctgctgagccaagtcccaggagaagcaaatcccatcaatatggtttccaagctgtcacaacttacaagccttctcagctccatcgaggacaaggttaaggccctcctccacgaggggccagagtcaccccacaggccttccctgatacctcccgttactttcgaagtgaaggcagaaagtctgggaatcccacaaaaaatgcaacttaaagtcgacgtggagtccggaaaactgattataaagaaaagcaaggatggcagtgaggacaagttttactctcataaaaagattctgcagcttattaaaagccagaagttccttaataagctggtgatcctggtcgagacggaaaaagagaaaatcctcaggaaagaatacgtgttcgctgacagcaagaagcgggagggattctgtcagctcctgcaacaaatgaaaaataagcactcagaacagcccgagcctgacatgattaccatctttataggaacctggaacatggggaatgccccaccacctaaaaaaattactagctggtttcttagcaaggggcagggcaagacgcgagatgacagcgctgactatatccctcacgacatatatgtgatcgggacccaggaggatccgctttctgagaaggagtggctggagatcctcaaacacagcctgcaagagattacttcagtcacctttaagacggtcgctatccacacactttggaacatcaggattgtggtcttagccaagcctgagcatgagaatagaattagtcatatttgtacagacaatgtgaaaactggaatcgccaacacgctcggcaacaaaggggctgtgggagtgtccttcatgtttaatgggacttccctcgggtttgtcaacagccacctgacctcggggtctgaaaagaagctccgacggaaccaaaattacatgaacatcttaaggtttttagcactgggcgacaaaaagttaagcccgttcaatatcacgcacaggtttacgcacttattttggttcggtgacctgaactacagggtagacttacctacatgggaggccgaaacgatcattcaaaagatcaagcagcaatag

SEQ ID NO: 226848 - DNA, 837 bp, Artificial Sequence
  Description of Artificial Sequence: Synthetic coding sequence
tgacagaaaaactggctgagagaattctaccaggtggttcacacccacaagccgcactttatggcactgcactgtcaggaatttggaggaaagaattatgaggcttctatgagccatgtggataagttcgtgaaagaactgctgagcagtgacgccatgaaggaatacaaccgggctcgtgtgtacctggacgaaaattacaagagccaggagcattttacagctctcggttcattttacttcctccatgagtccctgaaaaatatctatcagtttgattttaaggctaagaaatacaggaaggttgcagggaaagaaatttacagcgatactctggaatccacccctatgctggagaaagaaaagtttcctcaggactactttcctgaatgcaagtggtcaaggaagggtttcatcaggacgcgttggtgcattgcggattgtgcattcgaccttgtgaacattcatctctttcacgacgctagcaacctagtggcctgggagacatctccatcagtgtactccggaattcggcataaggccctgggttatgtcttggatcgcataatagatcagagatttgagaaggtgtcctactttgtattcggagactttaactttaggctggatagcaaatctgttgttgagttgttggaattcgacaaggagcttagcgtgttcaaggacagactgtacgaattggacatatctttccctccaagctacccatatagcgaggacgcacgtcagggggagcagtacatgaacacccgctgccctgcgtggtgtgataggattctgatgagtcctagcgcaaaggaacttgtccttcgttag

SEQ ID NO: 226849 - DNA, 1164 bp, Artificial Sequence
  Description of Artificial Sequence: Synthetic coding sequence
atggccggaaaggctgctgcacccggaactgccgtacttctggtaacagctaacgttggctccctttttgatgatcccgaaaacctccagaagaattggctgcgcgagttttaccaagtagtgcatactcataagccacactttatggcgctgcattgccaggaattcggagggaaaaattacgaggctagcatgagccatgtggataaattcgtaaaggaacttttatcctccgatgccatgaaggagtacaatcgggctagagtgtacctcgatgaaaattacaagagccaagagcacttcactgcgttgggttcattctattttctccacgagtcacttaaaaatatatatcagttcgattttaaggctaaaaaatatcgcaaggtcgcaggaaaggagatttactcagacaccctggagtcaactcccatgcttgagaaggaaaagttccctcaagattactttccagagtgcaagtggtcacgtaagggattcattcgtaccaggtggtgcatagccgattgtgccttcgacctagtcaacattcatctgtttcatgatgcaagtaaccttgtggcctgggaaacctcaccttctgtttacagcggaattcggcataaggccctcgggtatgtgctggaccggatcatcgatcagcgcttcgaaaaagtgtcctacttcgtgtttggggatttcaactttcgcctggatagtaaatctgtcgtagagaccctatgcaccaaggccacaatgcagacagtgcgagcagccgacaccaacgaggtggtgaagctaatattcagggagtccgacaacgatagaaaagtcatgctgcagctggaaaagaaactgttcgattactttaatcaggaggtatttagagacaacaatggcacggcacttctcgaatttgataaggagctatctgtgtttaaagatcgcctctacgaactggatatttccttccctccatcatatccatatagcgaagacgcccgtcagggagagcagtatatgaacactagatgtcctgcttggtgcgatcgcattctgatgtctccaagcgccaaggagctcgtgttgcgtgtcagtgtgtgctgccctagtccaggtcacagggggatgtggtcggctggatccgggctggctcagccttggtag

SEQ ID NO: 226850 - DNA, 1239 bp, Artificial Sequence
  Description of Artificial Sequence: Synthetic coding sequence
atggctggaaaggccgcagccccaggcactgctgtcctcctggtcaccgctaacgtcggctctttatttgatgaccccgagaacctccagaagaattggttgcgggaattctatcaggttgttcatacacataagccccactttatggccctccattgtcaggagttcggtggcaagaactacgaggccagcatgagccacgttgacaaatttgtcaaagaattactgagctccgacgccatgaaagaatacaaccgcgcacgcgtgtacctcgatgagaactacaaatcccaggagcactttaccgccttagggtccttctattttttacatgaatccctgaagaatatttatcagttcgactttaaagccaaaaagtataggaaggtagccggaaaagagatctattcggacaccctcgagtccacaccaatgctcgagaaagaaaagttccctcaggattatttccccgagtgcaagtggtcccgcaaaggctttatcagaacaagatggtgtatcgcggactgcgcttttgacctcgtcaacatacacctgttccacgacgcctcaaacttggttgcatgggaaacatccccttccgtttacagcggaataagacataaggcattaggatacgtgctcgatcgaattatcgatcagcggtttgagaaggtcagttatttcgtcttcggcgacttcaatttccgcctggattccaaatccgtggtcgaaactctatgcaccaaagccacgatgcagactgtgcgggctgcagacactaacgaagtggtaaaactgatcttccgcgagtcggataacgatagaaaggtaatgcttcagctcgaaaagaaactctttgactactttaaccaggaggtgttccgagacaataatgggaccgctctgctggagtttgacaaagagttatcggtgtttaaggaccggctatacgagctggacatctccttccccccttcttacccatacagtgaggatgccagacaaggtgagcagtacatgaacacccggtgtcccgcatggtgtgacaggatcctcatgagtccttctgcaaaagaactagtgctgaggtccgagagtgaagagaaggtggttacctacgaccacatcggcccaaatgtctgcatgggcgaccataagccagtgtttctggctttcaggatcatgccaggtgcgggtaagcctcacgctcatgttcacaaatgttgcgtagtacagtag

SEQ ID NO: 226851 - DNA, 558 bp, Artificial Sequence
  Description of Artificial Sequence: Synthetic coding sequence
atggccggaaaagctgccgctcctgggacggccgtgctcttagtgacagctaacgtagggtccttatttgatgatccagagaatctccagaaaaattggctgcgagaattttatcaggttgtccatactcacaagcctcactttatggccctgcattgccaagagttcggaggaaagaactatgaggcatcaatgagccacgtcgataaattcgtaaaggaactcttgagttcagacgcaatgaaggaatacaatcgggcaagggtttacctcgacgagaactataagtcccaggagcacttcaccgcattagggagtttctatttcttgcacgaatccttgaagaatatataccagtttgacttcaaggccaaaaagtacagaaaagtggcaggcaaggagatctactctgataccctagaaagcacccctatgctcgagaaagaaaagtttccgcaagattatttcccggagcggcacgtgccccacaccagcctggaggccctgttgatactccacgaggatccgcagctcccagacccccacctacccctgtag

SEQ ID NO: 226852 - DNA, 1068 bp, Artificial Sequence
  Description of Artificial Sequence: Synthetic coding sequence
atggccggaaaggctgctgctcccggtacagcagttctgctcgtgactgcaaatgtgggtagcttattcgatgacccggagaacctgcagaagaattggctcagagaattctaccaagtcgtgcacacacacaagccccattttatggcattgcactgccaggaattcgggggtaaaaactatgaagccagcatgagccacgtagacaagtttgttaaggaactcctgtcaagtgacgcaatgaaagagtataatagggctagagtgtatctggatgagaactataagtcgcaagaacatttcactgcgctgggcagtttctatttcctgcatgaatccctgaagaacatatatcagtttgacttcaaggctaagaagtacagaaaagttgccggaaaggaaatctattcagataccctggaatcgacacctatgcttgagaaggagaagttcccccaggattactttcccgaatgtaaatggagtcggaagggatttattagaacccgatggtgtatcgctgattgtgcattcgacctcgtcaacattcaccttttccatgatgcctctaacctggtcgcctgggagacttccccgtcagtctatagtggaattcgccacaaagccctggggtatgtgctggacaggatcatcgaccaaagattcgagaaagtgagttactttgtcttcggcgatttcaatttcagactagactccaagagtgtggtggagttattagaattcgataaagaactctcggttttcaaggacaggttgtacgaactagatatctcgttccctccatcctacccctatagcgaggacgccaggcagggtgaacaatacatgaatactaggtgccccgcatggtgtgataggatattaatgtccccatctgccaaagagttggtgctacggtcagagtccgaagagaaagttgtaacttacgaccatatcggcccaaacgtttgcatgggcgatcacaagccagtcttcttggcatttaggattatgcctggggcaggaaaacctcatgctcacgttcataaatgttgcgtggtacaatag

SEQ ID NO: 226853 - DNA, 417 bp, Artificial Sequence
  Description of Artificial Sequence: Synthetic coding sequence
gtgacggccaatgtggggtctttgtttgacgatcctgaaaaccttcagaagaactggctgcgagagttctaccaggctttgggttcattttacttcctccatgaaagtcttaagaacatctaccaattcgactttaaggcaaaaaaatatcgcaaggtagccggaaaagaaatatactccgacactctggagtccacaccaatgctcgagaaagaaaagttcccccaggactacttcccagaatgtaagtggtccagaaaagggtttatccgcaccagatggtgtatcgccgactgtgcgttcgatttggtgaacatccatctgttccacgatgcatctaaccttgtcgcttgggaaacttctccctctgtgtactccggcatccgccataaagccttaggctatgtgctggactag

SEQ ID NO: 226854 - DNA, 990 bp, Artificial Sequence
  Description of Artificial Sequence: Synthetic coding sequence
atgaaggagtataacagggctagagtgtacctggatgagaactacaagagtcaggaacactttacagccctgggttctttctattttttgcatgagtcactgaagaacatctatcaattcgacttcaaagctaaaaagtatcgcaaggtggctggtaaagagatatactcagatacattagagtcaacgcctatgctcgagaaagaaaaattccccctgctgccgagagtgcagatggtcaaaaagcggctccatccggacgaggtgatcgcggattgtgctttcgacctggtgaacattcacctgtttcacgacgcctccaatttagtggcatgggaaacaagccccagcgtatactcggggatccggcacaaagcattaggttacgtcttagataggataatcgatcagcggttcgagaaggtctcttactttgtgttcggggatttcaactttcgtcttgattctaaaagtgtggtggagaccctctgtacgaaggccactatgcagactgtgcgtgctgccgacactaacgaggttgtcaaactcatctttcgagagagtgataatgatagaaaagtcatgctgcaactggagaaaaaactgttcgattactttaatcaggaggtgttccgagataataacggcactgcgttgctcgagtttgataaggagctctcagtatttaaggatcgcctgtacgagctggacatcagcttccctccttcctacccttattccgaagacgctcggcaaggcgaacagtacatgaacactagatgccccgcatggtgtgaccgtatcctcatgagtccctcagccaaggagcttgtcttgcggtcggagagtgaagaaaaagtcgttacctacgaccacattggaccaaacgtgtgcatgggcgatcataaaccagtattcctagcctttcggattatgccaggcgcaggcaagccccacgcacatgtccacaagtgctgtgtagtgcagtag

SEQ ID NO: 226855 - DNA, 315 bp, Artificial Sequence
  Description of Artificial Sequence: Synthetic coding sequence
ctggatatttcgttccctccgagctatccctatagtgaagacgccagacagggcgagcaatatatgaacacgaggtgcccagcctggtgcgatcgcattttaatgtctcccagcgcaaaagagctagttctaagaagcgagagtgaggagaaggtcgttacatatgaccatattggacctaatgtgtgcatgggcgatcataagcctgtcttcttagctttccgaatcatgccaggcgcaggtaaacgttgccagagacatgaacgaaccctgcgagagcctccatgctccagaggacctaacactcacagctag

SEQ ID NO: 226856 - DNA, 546 bp, Artificial Sequence
  Description of Artificial Sequence: Synthetic coding sequence
gccgcagcaccgggaacagcggtactgctggtaactgctaatgtgggctcactgttcgatgaccctgaaaacttacagaagaattggcttcgagaattctatcaagtagtccacacccacaagccccactttatggcactgcattgtcaggaattcggtggaaaaaactacgaggctagtatgagccacgtcgataagttcgttaaggaactgctctcctccgacgccatgaaagaatataatagggccagagtctatctggacgagaattataagtctcaggagcacttcactgccctgggctctttctatttcctgcacgaatccctgaaaaacatctatcaatttgactttaaggctaagaagtataggaaggtagccggaaaagagatctactcagacactctggaaagcaccccaatgctggaaaaggagaaattcccgcaggattacttccctgagcggcatgttccccacacgtcactagaggccttactgatcctgcatgaggatcctcagctcccagatcctcacctcccactttag

SEQ ID NO: 226857 - DNA, 459 bp, Artificial Sequence
  Description of Artificial Sequence: Synthetic coding sequence
atggcaggaaaagccgctgcgccaggcactgctgtgctcctagttaccgcaaatgtgggctctctctttgatgaccctgaaaacctgcagaagaattggctcagagagttttatcaggctctgggttccttctactttctccacgaaagcctcaaaaatatttatcaatttgacttcaaagccaagaagtacaggaaggtcgccggtaaggaaatctactccgacaccctagagtccacaccaatgcttgaaaaagaaaagtttccccaagactactttcccgaatgcaagtggagtcgtaagggattcattaggacaaggtggtgtattgctgactgtgcgtttgatctggtgaacattcacctctttcacgacgccagcaatcttgtggcatgggagacttcgccatctgtctattctggcattcgccacaaggccctcggttatgtgttggactag

SEQ ID NO: 226858 - DNA, 1935 bp, Artificial Sequence
  Description of Artificial Sequence: Synthetic coding sequence
atgccctctaaggcggagaatcttcgtcctagtgaaccggcaccccaacctccggaaggcagaaccctccaggggcagctgccaggagccccacccgcacagcgagccggttcaccgcctgacgctcccggatccgagtcccccgcattggcttgctcgaccccagccacaccttcaggagaagatccgcctgccagggctgcccctatagctcccaggccccctgcacgaccaaggcttgagagggccttaagtctggacgacaagggatggagacgaagacgtttccgaggctcacaggaggatctcgaggccagaaacggcactagtccttcccgcggaagcgttcagagcgaggggccaggtgcaccagcacactcgtgtagccctccctgtttgtctacctctcttcaggagatacctaagtctcggggagtgctaagcagtgagcgaggatccccgtcatctggcggaaaccctctctccggcgtggcttcctcctctcccaacctgcctcaccgggacgcggctgtcgcgggttcatcacctaggctcccatcactattaccaccacggccacctccagctctctcgctggacatcgcgtctgatagcttgcgtacagcaaacaaagtggattccgatttggctgattacaagctgcgcgctcagcctttgttggtcagggcccactccagcctcgggcctggaaggccgagatcccccctggcgtgcgacgattgctctctacgatcggctaagtccagcttttcgctgctggcccctatccgctccaaggacgttcggagccgatcttacctcgaaggcagtctgctagcctccggcgcactgctcggcgcagatgaactcgcacgctatttcccagaccgaaatgtcgccctcttcgtggcgacctggaatatgcaaggtcagaaggagctccctccatcactggacgagttcctcctgccagccgaggccgattatgctcaggacctgtacgtgattggcgtgcaggagggctgttcagatagaagggaatgggagactcgcctgcaggagacactgggaccccactatgtgctgctgtcctccgccgcacacggggtgctttatatgtctttatttattcgccgtgacctgatttggttctgctccgaagtggagtgttccacggtcactaccaggattgtgtctcagatcaagacaaagggcgcactcggcatctccttcactttctttggaacttcctttctttttatcacttcccatttcacttccggagacggtaaagtagctgaaagattactcgactacacaagaacagttcaggctcttgtcctgcccaggaacgtgcccgatactaatccctatagaagctccgctgcagacgttactacacgatttgacgaggtgttttggttcggggacttcaattttcgcctaagcggtggcaggacggtcgttgatgcactgctgtgccaaggcctggtagtagatgttccagctctgttgcagcacgaccagctgatcagagaaatgcgcaaaggctccatttttaaggggtttcaggagcccgatatccatttcctgcccagctataaattcgatatcggcaaagatacctacgactcaacttctaaacagagaactccttcctatactgaccgggtgttgtaccgttctagacacaagggagatatctgcccggtgagctatagttcatgccccggtattaagacatctgatcaccgtcccgtgtacgggctctttcgggtgaaagttagacccggaagggataatattcctctcgcggcaggaaagttcgaccgcgagctttacctgctgggaattaaacgaaggatatccaaggagattcaacggcagcaggcattgcaatcccagaactcatcaaccatctgctcggtttcttag

SEQ ID NO: 226859 - DNA, 960 bp, Artificial Sequence
  Description of Artificial Sequence: Synthetic coding sequence
atggatcagtccgtggccatccaggagaccctggccgagggggagtattgtgtaatcgcggtccagggcgttctctgcgagggcgattcccgacaaagtcgcctgctcggcttagtaaggtaccgcctggagcacggtggtcaggaacatgccttattcttgtatactcataggcgaatggctatcactggtgacgacgttagtctcgatcagatcgtccctgtatcacgcgattttactctggaggaggttagtccagatggcgaactgtacattttgggttcagatgtcaccgtgcagctggacacagcagagctgtcgctagtgttccagctaccctttggtagtcagactaggatgttcctgcatgaggtggcccgagcctgccctggctttgactccgcaacaagggacccggagttcttatggctgtccaggtatagatgcgctgaactggaactggagatgcctacccccagaggctgcaattccgcacttgtgacctggcctggatatgccaccataggaggaggcaggtacccatctcgtaagaagagatggggtttagaagaggctaggccccagggggcaggctctgtgctgttctggggtggggctatggaaaaaactggcttccgcctgatggagcgggctcacggcggaggattcgtgtggggcagatccgctcgtgacggcagaagggacgaggagttggaggaggccggtcgagaaatgagcgctgcggcagggtctagggagagaaacaccgccggatcggccggaggcggtaagctgggctggggcgctggccctggagctgcggtgcggcctgccctggggtgggcagggagtgcggtttggcccgttgacgccaggggtgaggaccagagtcccggagggcctttggaagccggaacgctggggcagaaattttgtgatgtcttgctgcggcgtgcgtag

SEQ ID NO: 226860 - DNA, 2982 bp, Artificial Sequence
  Description of Artificial Sequence: Synthetic coding sequence
atggatcaatcagtggcaatacaggaaaccctagcggagggcgagtactgtgtgatcgcagtacagggcgttctctgtgaaggcgactctagacagagtaggcttttgggtcttgtaaggtataggctggagcatggcggacaggaacacgctttgttcctttacacgcatcggaggatggcaattaccggggatgacgtgagcctggaccaaatcgtgccagtatcgcgcgacttcacgcttgaagaggtaagtcctgatggagagctgtatatcctgggatcagacgttaccgtccaattggacactgccgagcttagcctagtgttccaactgccgtttggctcccagaccaggatgtttctccacgaagtcgctcgggcttgccccggtttcgatagcgccacacgcgaccctgaattcctgtggttgtctcgttaccgctgtgcagaactggaactggaaatgccgacacctcggggttgcaattccgctctggttacttggcccggatacgccacgatcggagggggtagatatccttctaggaaaaagagatggggattagaagaggcacgtcctcagggcgcaggatccgtgctcttctggggcggagctatggaaaagacgggctttaggctgatggaaagagcccacggcggagggtttgtgtggggacgcagtgctcgagatggccgtcgggatgaggaactggaagaggcaggaagggaaatgagcgccgctgccggatctcgggaacgcaacacagctggcggatctaatttcgatggtctgaggcctaacggaaagggcgtgccaatggatcaatcaagtagaggacaagacaaacccgagtccttacagccccgacagaataagagcaagtcggagatcacagacatggtccggagctccacaatcactgtcagtgataaagcccatattctcagcatgcaaaaattcggtctgcgcgataccatcgtaaaatctcacctgctgcaaaaagaggaggattacacttacatccaaaacttcaggttctttgctggtacttataacgttaacggtcaatctcctaaggaatgcctgcggctttggctgtccaacggaatccaggccccagacgtctattgtgttggcttccaggagctggatctgagtaaggaggccttcttttttcacgatacccctaaggaagaggagtggttcaaagccgtgtctgaaggcctgcatcccgacgctaagtacgccaaagtgaagctcatacgactagtgggtattatgttgctgctgtacgtaaaacaggaacacgcagcctatatcagcgaagttgaggccgaaacagttggtactggcattatgggcaggatgggcaataagggcggagtcgcaatcaggtttcagtttcataataccagtatctgcgtggttaattcacaccttgccgcacacatagaagagtacgaacgcagaaatcaggattacaaagatatctgctcgcggatgcagttctgccaacccgaccctagtctgccaccactgacaatctcaaatcacgacgtcatcttgtggctgggcgacctgaactacaggatagaagagctggatgtagaaaaagtgaagaagcttattgaggagaaagacttccagatgctgtatgcgtacgaccagctgaagattcaggtggccgctaagactgtcttcgagggcttcactgaaggagaactcacctttcagcctacttacaagtacgatacgggcagcgatgactgggacaccagtgagaagtgcagagcccctgcatggtgcgaccgaattctctggaaaggtaaaaacatcacgcagctctcctatcagtcacacatggctctaaaaacgtccgatcataaacccgtatcctccgtctttgatatcggggtgcgcgtagtgaatgatgagctttaccggaaaaccctcgaggaaattgtgcgctcgctcgacaagatggagaacgccaacatcccaagcgttagcctgagtaaaagggagttctgcttccagaacgtaaagtatatgcagctgaaagtggagtcgttcacaatccacaatggacaggtgccctgtcattttgaattcattaataagccagatgaggaatcctactgtaagcaatggctcaatgcaaacccctctaggggcttcctactgcccgactccgatgtggagatcgacctagaactgttcgttaacaaaatgactgctactaagcttaattcaggagaggataagatcgaggacattttggtgttgcatcttgatcggggtaaagactacttcttgtcagttagtggtaattacctcccaagctgttttggaagtcctatccacacgctatgctacatgcgcgaaccaatcctggatctgcccctggagactatcagcgagctgaccctgatgccagtttggaccggcgatgatggctcccaattagacagtcctatggagattcctaaggaactttggatgatggttgattatctttacagaaacgcggtgcagcaggaagacttatttcagcagccgggtctgagaagcgaattcgagcacattcgcgactgtctcgataccgggatgatcgacaacctatcggcatctaatcattcagtggccgaggccctactgcttttcttggagagccttcccgaacctgttatctgctacagcacttatcataactgcttggaatgctcaggcaattacaccgctagcaaacaggtcattagcaccctcccaatatttcataagaacgtgtttcattacctgatggcgttcttaagagagctgttgaaaaattcagcaaagaaccatcttgatgaaaacatcttagcatccatctttggatctttgctacttcgaaatcctgcaggccaccagaaactcgacatgaccgagaagaaaaaggcacaggagtttatccatcaattcctttgtaatcccctttag

SEQ ID NO: 226861 - DNA, 2742 bp, Artificial Sequence
  Description of Artificial Sequence: Synthetic coding sequence
atggaccaaagtgtggccattcaggaaaccttggccgaaggggaatattgtgtaattgctgttcagggggtactatgcgaaggcgactcacggcaaagcagactgctgggcctggttagatacaggttagagcatggaggccaggagcacgcgcttttcctgtacacgcacaggcggatggccatcacaggggatgatgtgtcgctagatcagatcgtgccagtcagcagagatttcactctggaagaagtaagccccgacggggaactgtacatcctgggctcggatgtcaccgtgcagctggacactgccgagctcagcctcgtcttccagttgcctttcggatctcagactaggatgttcttacacgaagttgccagggcgtgcccgggattcgattctgctacgagggatccagagtttttatggctgagccgataccgttgcgccgagcttgaactcgagatgcccacgccacgtggatgcaatagcgctctggtgacatggcctggctacgctacaataggaggcggagggtctaattttgacgggctgaggcctaatggcaagggcgtacccatggatcaaagctcacgcggtcaggataagcctgaaagcctgcagccccgacagaacaaaagcaagtctgaaattactgacatggttcggtctagcaccatcacagtcagcgataaagcccatatactgtcaatgcagaaatttggattacgggacacaatcgtaaaatcacacctcctacagaaggaagaggactacacctacattcaaaatttccggtttttcgccggaacctacaatgtcaatggccagagtccaaaagaatgtctgcgcttgtggttgagcaacgggatccaggcacctgatgtatattgcgttggttttcaggagctcgatctcagcaaggaggcgttttttttccacgacactcctaaggaggaagaatggttcaaggcagtttccgagggactccaccccgacgcgaaatatgctaaggtaaaactgattagactggtggggatcatgctgctcctttacgtgaagcaagagcacgccgcttacattagcgaggtcgaggctgagacggtgggtactggcatcatggggagaatgggcaataaaggaggggtggccataaggtttcagttccacaacacaagtatctgtgttgtcaacagtcacctggccgctcacattgaagaatatgagcgcagaaatcaggattataaagatatctgttctaggatgcagttctgccagcctgatccctcacttcctccccttaccatctccaatcatgatgtgatcctgtggctgggagatctgaattacagaattgaagagctggacgtggagaaagtaaagaagctgatcgaggaaaaagattttcagatgctctacgcctacgaccagttaaagatacaggtggcagcaaagactgtgttcgagggtttcaccgaaggggaactaacattccagcctacatataagtacgacaccggttcagacgactgggacacaagcgagaagtgccgcgctcccgcatggtgcgatcggattctgtggaaaggaaagaatataacccagctgtcttatcagtctcatatggccttgaaaacatccgatcacaagccagtgagcagtgtctttgacattggggtgagggtggtcaatgacgaactctaccgaaagaccctggaggagatcgtgagaagcctggataagatggagaatgcaaatattcctagcgtcagcctctcaaagagggagttttgcttccaaaatgtcaaatacatgcagctgaaggtggaatcatttaccatacacaacgggcaggtgccatgccacttcgagttcatcaacaaacctgacgaagaaagttattgcaagcagtggctgaacgccaacccgagcagaggattcctgttgccagatagcgacgtggaaattgatctggaactgttcgtcaacaaaatgacagcaactaaactgaactccggggaagacaagatcgaagacattctggttctgcatctggatagaggcaaggattatttcctgtcagtctccggtaactacctgccctcctgtttcgggagccctatccacacattgtgctatatgcgagaacctattctggatctgcctttggaaaccatttccgagttgaccctgatgccagtttggacaggtgacgacggctcccagctggacagccccatggaaatacccaaggagctgtggatgatggtcgactacttgtatcgaaatgcagtccagcaggaagacctcttccagcagcctgggttgcgctctgagttcgagcacatccgggattgcctcgatactggaatgattgataatctatcagcttcaaaccattcggtcgcggaagccctcctgttgttcttggaaagtctgcctgaacctgttatttgctattccacatatcacaattgtttggaatgttccggcaattatacggcctcaaagcaagtgatcagtactctccccattttccataagaacgtttttcactacttgatggccttccttcgcgagctgctgaaaaactccgccaagaaccatctggacgagaatatccttgcgagtatcttcggaagcctcctccttagaaaccccgctggtcatcagaagctggacatgacagagaagaaaaaggcccaggagtttattcaccaattcctgtgtaatcctctctag

SEQ ID NO: 226862 - DNA, 2982 bp, Artificial Sequence
  Description of Artificial Sequence: Synthetic coding sequence
atggatcagagcgtcgcaattcaggagaccctggctgaaggcgaatattgtgtgattgcagtacagggggtgctgtgcgagggggacagtcgccagagccggctgctgggtctggtccggtacagactggagcatggagggcaggagcacgccctgtttctgtacacacataggagaatggccattaccggtgatgacgtatccctggaccagatcgtccccgttagccgcgacttcaccctggaggaagtgtcccccgatggtgaactctacatacttggaagcgatgtgacggtccaattagacacagcggagctgtcactggtgtttcagctccccttcggctcacagacacgaatgttccttcatgaagtggctagagcatgccccggatttgactcagccacacgcgatcctgagttcctgtggttgagccgttacagatgcgccgagctcgaacttgaaatgcccactccacgtgggtgtaatagtgctctagtcacttggcccggatacgctactatcggaggcggacggtatccctcccggaagaagcggtggggcttggaagaggcccgaccacagggggctgggtccgtgctgttttggggcggagcgatggagaagaccgggtttcgactcatggaaagggctcacggcggtggcttcgtctggggacgttcagctcgggatgggaggagagacgaagaactcgaggaagccggacgagagatgtctgcggctgcaggctcacgcgaacgcaatactgccggaggctccaacttcgatggtctgaggccaaacgggaagggcgtcccaatggaccagtcaagtaggggtcaggataagccagagagcctccagcccaggcagaacaagagcaaatcggagattacagatatggtgcggtctagcacaattacagtcagtgataaggcacacatcctgtctatgcagaagtttgggttacgagatactatcgtgaagtctcaccttctgcagaaagaggaggattatacttacatccagaatttcaggttctttgctggtacttacaatgtgaacggccaaagccccaaggaatgtctgcgtctttggctcagcaatggcatacaggctcctgacgtttattgtgttggattccaggagctggatctgagcaaggaggcattcttttttcatgacacgccaaaggaagaggagtggtttaaggccgtgagcgaggggctgcaccctgacgcgaagtatgcaaaggtcaagctgattcgattagtcgggataatgctgctgctatatgtgaagcaggaacatgccgcatatatctccgaagtcgaagccgaaactgtcggcacagggatcatggggagaatggggaacaagggcggagtcgccattcgctttcagtttcacaacacatccatttgcgttgtcaactctcatctcgccgcacatattgaagagtatgagagaaggaaccaagattataaggacatatgtagccggatgcaattctgccaacccgacccatccctcccacctctcacaatctccaaccacgatgtcatcctttggctcggcgacctcaactatcgaatagaggaactggacgtcgagaaggtgaaaaagctcatcgaggagaaggactttcagatgctgtacgcctacgatcagctgaagattcaggtggccgctaaaactgtattcgagggattcacggaaggcgagttgaccttccagcccacttataagtacgacacaggttcagatgattgggacacctctgaaaaatgccgggcacctgcctggtgtgaccgtatactgtggaaaggcaagaacatcacccaactgtcatatcagtcacatatggccttaaaaacatctgaccacaaaccagttagctccgtgtttgacatcggagtacgcgtcgtgaatgacgagctgtatcggaagacactggaggaaattgtgcgttccctggataagatggagaatgcaaatatcccgagtgtgagcctgagcaagagagaattttgtttccagaatgtcaagtatatgcagcttaaagtggagagttttacaattcacaatggtcaggtgccctgtcattttgagttcatcaataagcctgacgaggagtcatactgcaagcaatggcttaacgcaaacccatcacggggatttcttctgccagactccgacgtggaaattgacctcgagttgttcgtcaataagatgacggcaaccaagcttaattctggggaagacaagattgaggacatacttgtgctccacctcgaccgcggtaaagattattttcttagtgtgtcgggaaactatttgccttcatgcttcggaagcccaatccacacattgtgctatatgagagaacctatcctggatctgccccttgaaaccatctccgagctcacattgatgcccgtgtggacgggggacgatgggtcacaattggattcccccatggagattccaaaagagctgtggatgatggtggactacctctaccgcaatgccgtccagcaggaggaccttttccagcagccaggtctgcggtcagagttcgaacatatcagggattgtttggataccgggatgatcgacaatctgtcagctagcaaccacagcgttgccgaagccttactcctgtttctggaatcccttcctgagcctgtcatttgctactctacctaccataattgcctagagtgctcaggaaactacaccgccagcaagcaggtgatatccactctcccaatctttcacaagaatgtgttccattaccttatggcattcctgagggaactgttaaaaaatagcgccaaaaaccatctggatgagaatattttggcttctatcttcggaagccttctactccgcaaccccgcaggccaccagaaactggatatgacggagaagaagaaggctcaggaattcattcaccagttcctgtgtaatcctctgtag

SEQ ID NO: 226863 - DNA, 2250 bp, Artificial Sequence
  Description of Artificial Sequence: Synthetic coding sequence
atgtcagccgctgcaggctctagggaacgcaacacagctgggggtagtaatttcgacggtttgagaccgaatggaaagggagttcccatggatcaatcttcccgcggtcaggataagccagagtccttacaaccaaggcagaacaaaagcaaaagtgagatcacggatatggtacggtcttctacgattactgttagtgataaggctcatatcctcagtatgcagaagtttggtctgcgagatactattgtgaagtctcacctgctacagaaagaagaagactatacatacatccagaatttccgcttttttgcaggaacctacaacgttaatgggcagagccccaaggagtgtctgcggctctggctctcaaacggcatacaggcacccgatgtctattgtgtcggcttccaggagttggacctgagtaaggaagcgttctttttccacgatacgcccaaagaggaggaatggtttaaagcagtgagtgaaggcttacacccggatgccaaatatgccaaggtcaagctgatcaggcttgttgggatcatgctgctgctctatgtcaaacaggagcatgccgcatatatctccgaggtagaggccgagaccgtgggtacaggtattatggggaggatgggcaacaagggcggagtggccataaggttccagttccacaacacctctatttgcgtggtgaactcccatctagctgcgcacattgaggaatatgagcgcaggaatcaggattataaagacatctgttcccggatgcagttctgccagcctgacccctccctaccccctctgacaatctccaatcacgatgtgatcctctggctgggcgacctgaactatcgcattgaggagcttgatgttgagaaagtgaaaaagctgattgaggagaaggacttccagatgctgtatgcctatgatcagttaaagattcaggtggccgcaaagacagtttttgaaggcttcacggaaggcgagcttacttttcagcccacttataagtatgatacgggaagtgatgactgggatacttcggagaagtgcagagctccagcctggtgcgatcggattctgtggaaggggaagaacatcacgcagctttcatatcagagccatatggcgctcaaaacaagtgaccacaagcccgtgtccagtgttttcgatattggcgtgcgtgttgtgaatgacgaactttacagaaagaccctcgaagaaattgtcagaagccttgataagatggagaatgccaatattcctagtgtttctctttccaagagagaattctgcttccaaaacgtcaagtacatgcagttaaaggttgagtcttttactatacataacggacaggtgccttgtcactttgaattcattaacaaaccagacgaggagtcctactgcaagcagtggttgaatgctaacccatcaagagggtttctgctgcccgactcggacgtagagatagatctcgagctctttgtcaacaagatgacagccactaagctcaactcaggcgaagacaaaattgaagatatactggtgctgcatctggatagaggaaaggattatttcctctcagtgtcaggaaattatttaccaagttgtttcggtagcccgattcacacactctgttatatgcgcgaacccatcctggacctgccgctggaaaccatttctgagttaaccctcatgcctgtctggactggtgacgacggcagtcagctcgacagtcctatggaaatccctaaagaactttggatgatggttgattatttataccgcaacgctgtccagcaggaagacctgttccaacagcctggtctgcggagcgagttcgagcatattcgcgattgtctcgatacagggatgattgacaatctatccgcatctaaccactctgtggccgaggcgttactgctcttcttggagtctctgccagagccagtcatttgctacagcacctatcataattgcctggagtgctcagggaactacaccgctagcaagcaagttatttccacactgccaatattccacaagaacgtcttccactatcttatggcattcctgagagagttactgaagaacagcgcaaaaaatcatcttgacgagaacattctggcatcaatctttggatcattacttctgcgaaacccagctggacatcaaaagctagacatgacagagaagaaaaaggcgcaggaattcattcaccagtttctatgcaaccccctgtag

SEQ ID NO: 226864 - DNA, 2487 bp, Artificial Sequence
  Description of Artificial Sequence: Synthetic coding sequence
atggaccagtcagttgctatacaggaaaccctggcagagggggagtattgtgtcatagccgttcagggtgtgctgtgtgagggggactctaggcagagccgcctgctgggactggtcaggtaccgactggaacatggcggacaggagcacgccctgtttctatatacccacagacgaatggccataactggtgatgacgtgagcttagatcagattgtcccagtaagtagagactttacgctggaggaagtaagccctgatggcgaactgtacatcctaggttccgatgtgacagtgcagctcgacaccgctgagctctctctggtgtttcagcttcctttcggcagccagaccagaatgtttttgcatgaggtagcacgtgcctgccctggcttcgatagcgctactcgcgaccccgaattcctctggcttagtaggtatagatgcgccgagctggagctggaaatgcctacccctcgtggatgcaactcagcccttgtgacttggccgggatatgccactattggaggaggacggtacccttcaagaaaaaagcgctggggcctggaggaggctagaccccagggggcaggctccgtgctgttctgggggggtgccatggagaagacagggtttaggctgatggagagggcccatggagggggtttcgtctggggccgttcagcacgcgatggcaggagagacgaggagttagaagaggctggtagggagatgtcggcagccgcaggctctcgagagcgaaacacagctggtggctctaactttgatggtctgcgacccaacgggaaaggggtgcctatggatcagagctcccgcggacaggataaacccgaatctttgcaaccaaggcagaataagtcgaaatccgagataaccgacatggtgagatcctctacaataaccgtatccgataaagcccatatcctctctatgcagaagtttggcctgcgagatacaatcgttaagtcgcatctcctacagaaagaggaagactacacctacatccagaacttccgatttttcgcaggcacttacaacgtgaacggccagagtcccaaagaatgcctgcggctctggctgtcaaacggtatccaggcaccagacgtgtattgcgttggatttcaggaattggaccttagcaaagaggcttttttcttccacgacacccccaaggaggaggaatggttcaaagccgtgtccgaaggcttgcatcccgatgccaaatatgccaaggtgaagcttattagactggtcgggatcatgttgttgctgtatgttaaacaggagcatgccgcatatattagcgaggtggaggctgagaccgttgggacaggaatcatggggcgaatggggaataaaggaggcgtggccatcagattccagtttcataatacctcaatctgcgtggttaacagccacctggcagcgcacatcgaggagtatgaacgcaggaatcaggactataaagatatatgctcccgaatgcagttttgtcagccagatccgtcactgcccccacttacgatttctaaccacgatgttatcctatggttaggtgacctgaattacagaatcgaggagctagacgtagagaaggttaagaaactgatcgaggagaaagacttccagatgctgtatgcctacgatcagctgaaaatccaggtggccgctaagacagtgttcgagggttttactgagggagaactgacttttcagcctacatacaaatacgacaccgggagcgacgactgggatacaagcgagaagtgtcgagctcctgcatggtgtgatcggatcctctggaagggaaagaacataactcagttatcttatcaaagccacatggcacttaaaacctccgaccataagccagtgtcctcagtgtttgacatcggcgtgagagtggttaacgacgaactgtatcggaaaacactggaagagatcgtcaggtccttggacaaaatggaaaatgctaatatcccttcagtgtccctctccaaacgggagttctgcttccaaaatgttaagtacatgcaattgaaggtagagtccttcactatacacaatggtcaggtcccatgccattttgaattcatcaataagccagatgaagagtcatactgcaagcagtggctaaacgctaatccaagccgagggttcctcctgccagattcggatgtggagatagatctcgaactgttcgttaacaagatgactgccactaaactcaattctggggaggataaaatagaggacatccttgtgctgcatctagacagggggaaggactatttcttgtctgtatcaggcaattatctgccctcttgctttggcagcccaattcatactctgtgctatatgcgcgagcctatacttgaccttcctctcgagacaatatccgaattgttagcttacctggcggcatactgctttgaaacgcaactcgtaacgaagagcctgatatag

SEQ ID NO: 226865 - DNA, 528 bp, Artificial Sequence
  Description of Artificial Sequence: Synthetic coding sequence
atgcagaagttcggccttcgggataccattgtgaagagccatctactgcaaaaggaggaggactacacttatattcaaaactttagattcttcgcagggacatacaatgttaacggccagtcccctaaggaatgcctgcggttgtggcttagcaacggcatccaggccccagatgtgtattgtgttggctttcaagagctcgacttgagcaaagaagctttcttctttcatgacacccccaaggaagaagagtggttcaaggctgtgtctgagggcctgcaccctgacgcaaaatacgccaaagttaagctaatccgtcttgtaggtatcatgttactgctctatgtgaaacaggagcacgcggcatacatcagtgaagtcgaggcggagaccgttggcacaggtattatgggccgaatgtgtgacttagtcgctggcggaccgcagctccaagacaggcgggctggctgcgggaagtccgaaaaagctcaccgtcgagaggggttgtccaacgctgtgtgcatttag

SEQ ID NO: 226866 - DNA, 834 bp, Artificial Sequence
  Description of Artificial Sequence: Synthetic coding sequence
atggctgatccttggcaggagtgcatggactatgccgtgacccttgccagacaggccggagaagtggtgtgcgaggcgatcaagaacgagatgaacgtaatgcttaagtcctcgccagtggacctggtcactgcgacagaccaaaaggtcgagaagatgctgatatcctcaattaaagagaaatatccgagtcattcattcataggagaagaaagcgtcgctgcgggagagaaatcaattttgaccgacaacccaacttggatcatcgaccctatcgatggcacgaccaactttgtccacaggtttcctttcgtggcggtttccattggattcgcggtgaataagaaaatcgaatttggcgttgtgtactcctgcgtagaaggcaagatgtacactgctcgaaaaggaaagggtgctttctgcaacggccagaaacttcaggtgagtcagcaagaagatattaccaagtcattgctggtgacagagctgggctctagtagaacacctgagaccgtgagaatggttctcagcaacatggaaaagctgttctgcatacctgtgcatgggattcggtcggttggaacagccgcagttaacatgtgtttggtggccacagggggagccgatgcctattatgagatggggatccattgctgggacgtagcaggagcaggaatcatcgtgaccgaagctggaggcgtcctgatggacgtgaccgggggaccattcgacttaatgagcaggagggtgattgcggcaaataaccgcatactggcagagcgtatcgctaaggagatccaggtgattcccttgcagcgcgacgatgaagattag

SEQ ID NO: 226867 - DNA, 597 bp, Artificial Sequence
  Description of Artificial Sequence: Synthetic coding sequence
atggctgacccttggcaggaatgcatggattatgccgtcaccttggccagacaggcaggcgaggtggtgtgtgaggccatcaaaaacgaaatgaacgtcatgctgaagtcttcacccgttgacttagttacggctacagaccagaaagtggagaagatgctgattagctctatcaaggaaaaatacccgagccacagctttattggcgaggagagcgtcgccgctggtgaaaaatccattttgacagataatcccacttggatcatagacccgattgacggaaccaccaactttgttcatcgcttccctttcgtggccgtgtctatcggatttgccgtgaataagaagattgagtttggcgtggtgtattcatgcgtcgagggaaagatgtacaccgcccgtaagggcaaaggcgcattctgcaacgggcagaaactccaggttagccagcaggaaggttccggcgtactggagcagcagttgctgatatgcgccctgtggcagctggcagagcagatgcatattatgaagtgggaattcacagccggtatgctgcaagagctcgccctcctcttactgaagttagttgcttgctag

SEQ ID NO: 226868 - DNA, 1011 bp, Artificial Sequence
  Description of Artificial Sequence: Synthetic coding sequence
atgggtcagagaccagggccagtgctgcccgctgtcgcagtattagggcaagttgcaaagcggaaagtcgcctggttgcttcggtggaaagccgtaaccagaaccgaaaccgccggtaattccagcggcgtatacggctttgggaaaatgaaaatctttgtcaaatactttcagaagatggccgacccctggcaggagtgtatggactacgctgttacactggctagacaggccggagaggtcgtatgcgaggccataaaaaacgagatgaacgtgatgctgaaaagcagccccgtggacctcgtcactgccacagaccagaaggtggagaaaatgctcatcagctccattaaagaaaaatacccatcccacagcttcattggagaagagtccgtggctgctggagagaagtctatactcaccgataacccaacctggattatcgacccaatcgatggaactactaatttcgtgcatcggtttcctttcgtagccgtctccattgggttcgctgttaacaagaagatagaatttggggtggtctactcgtgcgtggaggggaagatgtataccgcacgtaagggtaagggcgcattctgtaatgggcagaaactgcaggtatcccagcaggaagatataacaaaaagcttgctggtaacagaactgggaagctcccgtactccagaaactgtcagaatggtccttagtaatatggaaaaactgttctgtatccctgtccatgggattcggagcgtgggaactgcggctgtgaacatgtgcttggttgccacgggtggcgcagatgcatattacgagatgggcattcactgctgggatgtggccggtgcaggaattatcgtgaccgaggcgggaggagtcctgatggacgtgacaggagggccttttgatctgatgtctaggagagtgattgcagccaataatcggatactggccgagcgaattgcgaaggaaattcaggttattcctttacaacgagacgacgaggactag

SEQ ID NO: 226869 - DNA, 462 bp, Artificial Sequence
  Description of Artificial Sequence: Synthetic coding sequence
atggctgacccttggcaagaatgcatggattacgctgtgacactggcacgacaggctggcgaggtcgtgtgtgaggctataaagaacgagatgaacgtgatgctgaagtcctcgccggtggacctggttaccgctaccgaccaaaaagtcgaaaagatgcttatttcttcaatcaaggagaagtacccttcacaccggttccccttcgtcgctgtgagcatcggattcgctgtaaacaagaaaatcgagttcggcgtggtatactcgtgcgtggaaggcaaaatgtacactgcaaggaagggcaagggggctttttgcaacggtcaaaaactacaggtgagccagcaggaggatataaccaagtcgttgctggtgaccgagcttggttcctctcgtacgcctgaaacagtgagaatggtcctttcaaatatggagaagctcttttgtattccagtgcactag

SEQ ID NO: 226870 - DNA, 636 bp, Artificial Sequence
  Description of Artificial Sequence: Synthetic coding sequence
atggggcagcggccagggcctgttctccctgcagtggcagtgctggggcaggtggccaaaagaaaggtcgcctggctgcttcggtggaaggctgtaacgcggaccgagacagcagggaatagcagcggtgtatacggtttcggcaagatgaagatttttgtgaagtacttccaaaagatggcagacccctggcaagagtgtatggactatgccgtgacactcgccagacaggcgggagaagtcgtctgcgaggctattaaaaatgaaatgaatgttatgctgaagtcatcacccgtagatctagtaaccgcaacggaccagaaagtggagaagatgctgattagcagcatcaaggaaaaatacccaagtcactcttttattggcgaagaatcagttgctgccggtgagaagagcattctgacagataatcctacatggattattgaccccattgacggcaccaccaattttgtgcaccgctttccctttgtcgccgtaagcatcggcttcgcagtaaacaagaagatcgaatttggagttgtgtattcctgcgtcgaggggaagatgtatacagccagaaaaggaaaaggagccttttgtaatggtcagaagctccaggtgtcgcagcaagaatag

SEQ ID NO: 226871 - DNA, 867 bp, Artificial Sequence
  Description of Artificial Sequence: Synthetic coding sequence
atgaagccctcaggcgaggaccaggcggcactggctgccggtccctgggaggaatgcttccaggcggctgtccaactagcactgagggcgggtcagattatccgcaaagctctgaccgaagagaagagagtgtcaactaaaacatcagcggctgatcttgtgactgagactgatcaccttgtggaggacctcattatcagcgagcttcgcgagcggttcccaagccataggttcatcgccgaagaggccgcagctagtggtgctaagtgcgttctcactcacagcccaacatggatcattgaccctatcgacgggacatgcaactttgtgcaccgttttcccaccgtcgccgtgtctatcggattcgctgttagacaagaactggaattcggggtcatctaccattgcaccgaggaacgcctctacaccggacgacgcggaaggggagcattctgtaacggtcagaggctgagggtgtctggggaaacagacctgtctaaggccctggtgctgaccgagatcggacccaagcgcgacccggctactctgaaactgtttttgagtaatatggagcgtcttcttcatgctaaagcccacggagtgcgcgtaattggctctagtactctggctctgtgccatttggcgtccggcgcagccgatgcctattaccagttcggcctgcactgttgggatctcgctgccgcaacagttatcattcgtgaggcaggtggcatcgtgatcgacaccagtgggggtcccctcgacctgatggcctgtagggttgtcgccgcttcaactagggaaatggccatgctgattgctcaagctcttcagacaatcaactacggacgggatgacgagaaatag

SEQ ID NO: 226872 - DNA, 258 bp, Artificial Sequence
  Description of Artificial Sequence: Synthetic coding sequence
atgaagccgagcggggaggatcaggctgctttggccgctggtccttgggaggagtgcttccaggccgcagtgcagcttgcgctgagagcgggtcagatcattcgcaaagccctaacagaggagaaacgggtcagcaccaagacctccgcagcagatttagtcaccgagaccgaccacctggttgaggacctgattatatctgagttacgtgagcgttttccctcccaccggagtccattctcactggtgcatatgtag

SEQ ID NO: 226873 - DNA, 1071 bp, Artificial Sequence
  Description of Artificial Sequence: Synthetic coding sequence
atgctcgaacaaatacgccgtgatattagagacttcagaagcagcgcaggtctggacaaggtcatcgtgttgtggaccgctaacaccgagagattctgtgaggtcatcccgggtctgaacgacactgctgagaacctactaagaacaattgaactgggcctcgaagtgagccccagtacgctcttcgccgttgcctcgattctggagggatgcgctttccttaatggcagcccccaaaacactctggtgcccggtgccctggagctggcttggcaacaccgggtgtttgtcggcggagatgacttcaagtctggccagaccaaggtaaaaagcgtattggtggattttctcatcggctctggcctgaagactatgtcgatcgttagttataatcacctgggcaataatgacggcgaaaatctgtctgcacccctgcagttcaggtctaaggaagtaagcaagtcaaatgttgtggacgacatggtccagtccaacccagtcctgtacacaccgggtgaggagcccgatcactgcgtagtgataaagtacgtcccctacgtgggggactcaaagcgggctttggatgagtacacatccgagctgatgctgggcggaactaataccctggttcttcacaatacttgcgaggacagcctcctggcagcccctatcatgctcgaccttgcattgttaactgagttatgtcagcgcgtgagcttttgtaccgatatggaccctgagccccagactttccatcctgtcctgtccctcttgtcatttctcttcaaagcccctctagtaccccctggatcaccggtggtcaatgctctgtttcggcagcgcagctgcatcgaaaatatcttgagagcttgcgtcggactgccaccccaaaatcatatgctgctcgaacacaagatggaaagacccggtccatctcttaaacgggtgggacccgttgcggcaacttatcctatgctgaataaaaagggtcctgtacctgccgcaactaatggatgtactggcgatgccaatggtcatcttcaggaagaaccacctatgcctacaacttag

SEQ ID NO: 226874 - DNA, 1677 bp, Artificial Sequence
  Description of Artificial Sequence: Synthetic coding sequence
atggaagccgcagcccagttttttgtggagtcaccagacgtagtgtatggtccagaggccatcgaggcccagtacgagtacagaacgaccagggtgagccgcgagggaggagtgctcaaagttcatccgactagcacccggtttactttccggaccgcacggcaggtcccaagactcggggtgatgctcgtgggatggggcggtaacaacgggagcaccctgactgctgccgtgctggctaataggctacggctatcttggcctacgaggtcagggaggaaagaggctaactactacggatccctcactcaggccggaaccgtgtccctggggcttgatgcggaggggcaggaggtgtttgtgcccttctccgcagtcctgccaatggttgcacctaacgacttggtgtttgacggctgggacatatcgagcttaaacctggcagaagccatgcgaagagctaaggtgctggactggggcctgcaggaacagctgtggccacatatggaggccctgcgaccgagaccttccgtctatatcccggagtttattgccgcaaatcaatctgctcgtgccgataacctgatccctggatccagagctcagcagcttgaacagattcggagagatattagagacttcagatcttccgctggcttagacaaggtaatagtgctgtggaccgctaacaccgagcggttttgcgaagtgatccccggtttgaacgatacggctgaaaacttattgcggacgatcgagctgggcttggaggtaagcccatccactctatttgccgtggcttctatccttgagggttgtgcctttctgaacgggtcccctcagaacacgctggtcccaggggctcttgaactggcctggcagcacagggtctttgtaggaggagatgacttcaaatccggccagactaaggtaaagagcgttttggtagatttcctgatcggaagcggcttgaaaacaatgagcatagtgagctacaatcatctgggtaataatgacggagaaaacctgagcgctccgctgcagttcaggagcaaggaggtgtccaaaagcaacgtcgtggacgacatggtgcagtctaatccagtcttatatactcctggagaggagccagaccactgtgtggtaatcaaatacgtgccgtacgttggtgattccaagcgagcacttgatgaatatacaagtgagctaatgcttggtgggacaaataccttggttctgcataacacctgtgaagattccctgctcgcggcacccatcatgctggatctggccctcctgactgagctctgtcagcgtgtcagtttctgtacggacatggaccccgagcctcagacattccatccggtcctctctttgttaagttttctatttaaagccccacttgtcccacccggatcacccgtggtaaacgcactgttcagacagcgaagctgcattgagaacatcctgagggcctgtgtcggactgcctccacagaatcacatgttgcttgaacacaaaatggagaggccgggtccatccttgaagcgcgtggggcctgtggcggcaacctaccccatgctgaataaaaagggccctgtacccgcagccacaaacggttgcaccggcgatgccaatggccatctgcaagaagaaccacccatgcccactacgtag

SEQ ID NO: 226875 - DNA, 1515 bp, Artificial Sequence
  Description of Artificial Sequence: Synthetic coding sequence
atggaggccgctgctcagttctttgtggagtcaccagatgtcgtttacgggccagaggccatagaggcccaatatgagtatagaacgacaagggtgagtagggaaggaggggtccttaaggaggctaactattatggatctctgacccaggccggtacggtttccttgggacttgatgcggagggccaagaggtgttcgtacctttttctgcagtgctcccgatggtggctcctaatgacttggtgtttgatggctgggacattagttctctgaatctcgccgaagcaatgcgcagggccaaagtgctggattggggcctacaagaacagctctggccccatatggaggcgttgcgaccccgtccttctgtgtacatcccggaatttattgccgctaaccagtctgctagggctgacaatctgatccctggatccagggcccagcagctggagcagatccgaagggacataagggactttcggtcaagcgctggcctcgacaaagtgatcgtgctgtggacggcaaacacggagaggttttgcgaggtgattccgggactaaacgatacagccgagaatctgctgcgtacaatagaacttggtctggaggttagcccatcaactctctttgctgtggcttcgattttggagggttgtgcgttccttaacggcagtcctcaaaatactttggttcctggcgcattagagctggcctggcagcatcgtgttttcgtggggggtgacgattttaaaagtggccagaccaaggtgaaaagtgtcctggttgactttctgattggctccggattaaagacgatgtcaatcgtcagctataatcacctcgggaacaatgatggtgagaacttgagcgctcccctgcagttccgctctaaggaggtcagcaagagcaacgtagtcgacgatatggtgcaaagcaacccagtgttgtacactccaggagaggagccggaccattgtgttgtcatcaaatacgtcccttacgtcggagattctaagcgggctctggacgagtatacgtcggagctcatgctggggggaaccaatactctggtgttgcataacacgtgcgaggactcactgctggccgcacctattatgctagatttggctctgctgaccgagctgtgtcagagagtgagtttttgtaccgacatggatcctgaacctcagacgttccatccagttctttcccttctgtcctttcttttcaaggcaccactagtgccgccaggatccccagttgtaaatgcactgtttcgtcagagatcatgcatagagaacattctgagagcttgcgttggcctgcctcctcagaaccacatgctgctagagcataaaatggaacgtcccggaccaagcctcaaacgggtcggccctgtggcggctacttaccccatgttgaataagaagggccctgtccctgccgctaccaacggctgtactggcgatgccaacggccaccttcaggaggagccacccatgcctaccacttag

SEQ ID NO: 226876 - DNA, 1227 bp, Artificial Sequence
  Description of Artificial Sequence: Synthetic coding sequence
atgaggcgagccaaagtgctggattgggggttgcaggaacaactctggccccatatggaagcactgcgcccacgcccatctgtttatatccccgaattcattgcagctaatcagtctgcccgtgccgataatctcatcccaggaagtcgagcacagcagcttgagcagatacggcgtgatatccgagatttccgttctagtgccggattggacaaggtcatcgttctgtggaccgcaaatactgagcgcttttgcgaggtgatcccaggtttaaacgacaccgccgagaatctgctacgaaccattgagctaggactggaagtctctccgtccaccctcttcgcggtcgcctccatcctcgagggctgcgcctttcttaacggtagtcctcaaaatactcttgtgcctggggctctagaattggcgtggcaacatcgagtatttgtcgggggagatgattttaaaagcgggcagactaaggtcaagagtgtactggttgactttctgatagggagtgggttgaaaaccatgtctattgtatcttataaccatctgggcaacaacgatggcgagaacctttccgcgccactgcaattcagatcaaaggaggtgagcaagtctaacgtggtagatgacatggtacaatctaatcccgtgctctatacaccgggagaggagccagatcattgcgtagtaattaaatatgtcccctacgtgggagattcaaagcgtgcattggacgagtacaccagcgagctgatgctgggcggaaccaacaccttggtgctgcacaacacctgtgaagatagtctactcgccgcacctataatgttggatcttgccttactgacggagctttgtcaacgggtgtccttctgtacagatatggatcctgagccacagacgtttcaccccgttctctccctcctgtccttcctgtttaaggctcctttggttcctccaggcagtcccgtcgtgaatgcgctttttcgccaacgcagctgcattgaaaatatactcagagcttgcgttggactgccccctcaaaatcacatgctcctggaacacaagatggagcgccctggcccttctctcaaacgtgttggcccagtggcagccacataccccatgttgaataaaaaagggccagtacccgcagccaccaacggttgcacaggcgacgccaacgggcatctacaggaggagccgccaatgccaacgacttag

SEQ ID NO: 226877 - DNA, 1386 bp, Artificial Sequence
  Description of Artificial Sequence: Synthetic coding sequence
atgactctgccgggtggccctacggggatggcacgacctggcggtgcaagaccctgcagccccggattggaacgggcaccccgaaggtcggtgggggagctacgcctgctgttcgaagctaggtgtgccgcagttgcagcagctgccgcagcaggcgagcctagggctcggggagctaaacggcgaggcggtcaggtacctaatggactgcccagagcacccccagcgccagttatccctcaattaaccgtaacggccgaagagccagacgttccccctacctcccctgggcctcctgagagagagagagattgcctgcctgccgctggaagttcacacctgcagcagccgaggcgccttagcacttcgtccgtctcctcaacaggctcatcttcactgctggaggatagcgaagacgacttgcttagcgattccgagtcccgttcacggggtaacgttcaattggaagccggagaggatgttggccaaaaaaaccactggcagaaaatccggacgatggtgaacctcccggttatctctccttttaaaaaaagatatgcctgggtccaactggcagggcacactgggagctttaaagcagctggaacatctggcttgatcttgaagagatgctccgagccagagcgctactgcctcgcaaggctgatggcagacgctctgcgtggttgcgtcccggcttttcacggggtggttgaaagggacggtgaatcctatctccagctacaagacctgttggatggttttgacgggccttgcgtgctggactgtaagatgggagtcagaacatatctggaggaggagttaaccaaagcacgagagaggccgaaactgcggaaggatatgtacaagaagatgctcgcagtggacccagaggcaccaactgaggaggaacacgcacagcgagccgtgaccaagcctaggtatatgcaatggcgggaggggatctccagctccactaccttgggctttcgaatcgagggtataaaaaaggcagacggcagttgctctactgattttaagactactcgcagcagggagcaagtactgcgcgtgttcgaggagtttgtccaaggcgatgaggaggtgctgcggaggtatctgaacagactccagcagatccgtgacaccttagaagtgagtgagttttttcgtaggcacgaagtgatcggctcctccctcctgttcgttcatgatcactgccaccgcgcaggggtctggttgatcgacttcgggaaaaccacgcctctgccagacggtcaaatcctggaccaccgcagaccatgggaggaggggaaccgagaggacgggtacttgcttggtctcgacaatctcatagggattctagcgagcttggcagagcggtag

SEQ ID NO: 226878 - DNA, 2841 bp, Artificial Sequence
  Description of Artificial Sequence: Synthetic coding sequence
atggccgtgtattgctacgcccttaactcgcttgtcatcatgaatagcgccaatgaaatgaaaagcggaggaggtcccggaccttccggaagcgagactccccctcctccacggagagcagtactgagtcccggtagcgtgttctcacctggtaggggagccagcttcctgtttccaccggcagagtctttgtctcccgaggaacctcgcagccccggtggatggaggagcggccgaagaagattaaatagctcctccggcagcgggtctggtagcagcgggtctagtgtgagcagtccatcatgggccggtaggcttcgcggagatcggcagcaggtcgtcgctgccggaaccctaagtccgcctgggcctgaagaagcaaaaagaaagctccggattctgcagagggagctacaaaatgttcaggttaatcaaaaggttgggatgttcgaggctcatattcaggctcagagttcagcaatccaggcgcctaggagccccaggctggggagggcacgcagccccagtccgtgtcccttccggtcaagtagccaaccccctggaagagttttggtgcagggtgctagatcggaagaaagacgcacaaaaagctggggggaacagtgccctgaaaccagcggcactgactctggcagaaagggcggtccttcgctgtgttccagccaggtaaagaaagggatgccccctctgccgggtcgggctgccccaaccggttctgaggcacaaggtcctagcgcatttgttcgtatggaaaaggggatccctgcttccccgaggtgtggaagtccgacggccatggaaattgataagcgcggttctccaacaccgggaacacgcagttgtttggcaccttccctgggcttattcggtgcctcactgacgatggccaccgaagtggccgctagagtgacatctactggaccgcatcggccacaggatttggctttaacggaaccatccggcagagctagagaactggaagatctgcagcctccagaggccctcgtcgagaggcaggggcaattccttggatctgagacttcccctgccccagagcgtggtggccctagagacggcgagccccctgggaaaatgggaaaagggtaccttccatgcgggatgcctggttccggtgaacctgaagtggggaagagaccagaggagaccacagtgagtgtccagtcagcggagagctccgactcgctgagttggtcacggctgccacgggcattggccagcgtcggtcctgaggaggcgcgaagcggcgctcctgtgggagggggaagatggcaactcagtgatcgagtggaaggcggatctcccacccttggtcttctagggggtagcccctccgcccagccgggaacaggtaacgtcgaagctggaattccaagcggcaggatgctggagcctttgccttgttgggatgctgccaaggacctgaaagagccacagtgcccgccaggagacagagtaggagtacaacctggaaattcccgcgtgtggcaaggcactatggagaaggcaggcctcgcttggacccgcggaaccggggtacaatccgaggggacatgggaatcccagaggcaggactctgatgctctgccctcaccagagctgcttccccaggaccccgataaaccatttctgcgtaaagcatgttccccttcgaacattccggcagtgatcattacagacatgggtactcaggaagatggtgcactggaggaaacacagggatctccgcgaggaaatttgcccctccgaaagctgtcaagtagctccgcctcttccacaggcttcagtagctcctatgaggacagcgaggaggatatttcgagcgaccctgagaggactcttgatcctaacagcgctttcctgcacacactggatcagcagaagccccgtgttagtaagtcatggcgcaaaatcaaaaacatggttcattggtctccattcgtgatgtcattcaagaagaagtacccctggatccagcttgctggccacgctgggagcttcaaggctgcagccaacggacgcatcctgaaaaagcactgtgagagcgagcaacggtgtcttgacaggttgatggtggacgtgctcaggccattcgtacccgcttatcacggcgatgtagtgaaggacggggagagatacaatcaaatggacgatctactcgcggattttgactccccttgcgtgatggactgcaaaatgggaattcggacctacctggaggaggagctcactaaagccaggaaaaaacccagtcttcgaaaggatatgtatcagaagatgatcgaagtggacccagaagctcccacagaggaggagaaggctcagcgggcagtgaccaagccacggtatatgcagtggcgggagacgatcagttccactgccacacttggatttaggattgaggggattaagaaagaggatggaacggtcaatagagacttcaagaaaaccaagacacgcgagcaggtgacagaggcgttcagggaatttaccaaaggtaaccataacatcctgattgcctatcgagacaggcttaaagcgatcaggacgacccttgaagtatcaccttttttcaagtgccacgaagtgataggttccagtctgctgtttatccatgacaagaaggagcaggccaaggtgtggatgattgattttggaaaaacgactccattacccgagggtcagaccctgcagcacgacgttccctggcaagaagggaacagagaggatggctacttatccgggctgaacaacttggtggatatactgaccgaaatgtcccaggacgctccattagcctag

SEQ ID NO: 226879 - DNA, 1935 bp, Artificial Sequence
  Description of Artificial Sequence: Synthetic coding sequence
atggcagtttactgctacgccctgaacagccttgtgataatgaatagcgcaaatgagatgaagtccggcggaggcccaggccctagtggctcagagactcctccgcctcccaggagggctgtccttagcccaggatcggtttttagcccgggaaggggggcatcattcctgttccctccggcagaaagcctaagccccgaggagcctaggtcgcctggaggctggaggtccggccgacggagactgaactccagcagtggctccggtagcggcagctccgggagctctgtctccagtccatcctgggcaggacgactacgcggagatcgccagcaggtggttgccgctgggacccttagcccacccggtcccgaagaggccaagcgaaagcttaggatactgcagagagaactgcagaatgtgcaggtgaaccagaaggtgggaatgttcgaggctcacatccaagctcaatccagcgcaatccaagcgcctcgctcacccagactgggtagggccagatctccctccccatgtccattcaggtcaagcagccagcctccgggtcgcgtcctggtccaaggcgcaaggagtgaggaacgccgtaccaaaagctggggggagcaatgtcctgaaacctcgggcacagactcaggccgtaagggcggtccctctctgtgtagttcacaggtgaagaagggtatgccaccgttgcctgggagagcggctcccacaggctccgaagcacaaggcccaagtgcctttgtgcgcatggagaaaggtattcccgcttcacccaggtgtggatcaccaacagctatggaaatcgataaaagaggaagtcctaccccaggcactcgcagctgcctggctcctagtctgggtctgttcggcgctagtctgactatggccaccgaagtggccgcacgcgtcacaagtacgggacctcacagaccacaggatctggccctgactgaacccagcgggagagccagagagttggaagatctccaaccacccgaggccctggtggagaggcagggccagtttctgggtagtgagacatcccccgctcctgaacgcggaggcccacgcgacggggagccgcctgggaagatggggaaggggtacttaccttgcggcatgcccggtagcggggaacctgaagtggggaagagacctgaggaaacgactgtcagtgtgcagagcgccgagagttccgactccctgagttggtctaggttgccgagggctctggcctctgtgggacctgaggaggcacgctctggcgcacccgtgggcggaggtaggtggcaactgtctgaccgtgttgaaggtggatcgcccactctgggactcctcggagggtctccttccgctcagcccggaacgggcaacgttgaggcaggtattccttcaggtaggatgctagagccccttccctgttgggatgcagccaaagatctgaaggagccacaatgcccaccaggcgatcgcgtgggcgtccaaccagggaactccagagtgtggcagggcacaatggagaaggcgggactggcttggacaagggggacaggagttcagagtgaggggacatgggagtcccagagacaggactcagatgcactgccctcccccgagttactgccgcaggatcccgataaacccttcctcagaaaggcttgttctccatctaatattcccgctgtgatcatcacggacatgggcacgcaagaagatggcgctctggaagagactcagggcagccctcggggtaatctccccctgcggaagttgtctagttccagcgcatcatccacgggatttagttcaagctatgaggattccgaggaggatatctccagtgaccctgagcggaccctagacccgaacagcgcatttctccatacattggaccagcagaagcctcgcgtatag

SEQ ID NO: 226880 - DNA, 2841 bp, Artificial Sequence
  Description of Artificial Sequence: Synthetic coding sequence
atggccgtttactgttacgctttaaacagtctggtcatcatgaactcagccaacgagatgaaaagcgggggaggacctggcccttcaggctccgaaacacccccacccccacgtcgcgctgtactttcaccgggatctgtttttagcccaggtcgaggagcttcttttctctttccaccagccgagagcctaagccccgaggaaccccgtagtcccggaggttggagatctggcaggcgccgtctgaatagttctagtgggtccggatctggatcctccggctcatccgtgtccagcccaagttgggcaggccgactacgcggtgatcggcaacaggtggtggccgcaggcactcttagccctccaggccctgaagaagctaaacggaaattgcggatcctgcagcgggagttacagaacgttcaggtaaaccaaaaagtaggtatgttcgaggcccacattcaagcacagtctagcgccatccaggcccctaggagccccagactaggaagagcccgttctccaagtccttgcccattccggtcatcctctcagccgcctggtcgtgtactggtgcaaggtgcccgaagtgaggaacgccgaacaaagtcctggggggagcagtgccccgaaacctccggtaccgactcggggaggaagggcggtccctcgttatgtagctcacaagtgaagaaagggatgccgcctctgcccggtcgggcagccccaactggctcagaagctcagggtccaagcgccttcgttcgcatggagaaagggatccctgcgtcacccaggtgcggatcgccaaccgctatggaaattgacaagcgcggtagccctacacctggcactcgctcatgcttggccccatctctgggccttttcggggcatccctgaccatggccactgaagtggctgctcgggtgacctctacaggccctcacaggccccaggacctcgctctgacagaaccgagcggtcgcgctcgggaattggaagacctgcagcctccagaagctctggtggaacgccaagggcagttcctagggtctgagacctcccccgctcctgagagagggggacccagagacggagaacctcctggaaaaatgggcaagggttaccttccatgtggcatgcccggttccggcgagcctgaggtgggcaagcggccagaagagactacggtctcagtccagagtgcggagtccagtgattctctgagttggtctaggcttccaagggccctcgcctccgttggcccagaggaagccagatctggagccccagtgggcggaggcagatggcagctctccgaccgcgtggagggcggttcccccacgctcggattgctggggggttccccttccgcccagccgggaaccggcaatgtggaagcgggaataccctccgggaggatgcttgagccactcccttgttgggacgccgctaaagacttaaaggaacctcagtgcccccctggggacagagtgggagtgcagcccggaaattcccgtgtctggcaaggaacgatggagaaggctgggttggcatggactcggggtacaggcgtgcagtccgaaggtacctgggaaagccagagacaagacagtgacgccttgccttcacccgaattgctgccacaggatcctgataagccattcctccgaaaagcttgttccccaagtaacatacctgctgttattatcaccgacatgggcacccaggaagatggggcacttgaagagacacagggctcacccagaggtaacctcccacttcgcaagttatcaagcagttcagctagttcaaccggttttagctcgtcatatgaggacagtgaggaagatatcagctctgacccagaacgtactcttgacccaaacagtgcctttctgcatacactggaccaacagaagccgagggtgtctaaaagctggcgaaagattaagaacatggttcattggagtccttttgtaatgagtttcaagaaaaaatatccctggattcagttggccggtcacgcgggatccttcaaagccgcagccaatggcagaattctaaagaaacactgtgagtccgagcaaaggtgtctggacagactcatggttgatgttctccgcccatttgtgccagcataccacggagacgtcgtcaaagacggcgagaggtacaatcagatggatgatctgcttgctgacttcgactcgccctgcgtgatggattgtaagatgggaatcaggacttacctcgaagaagaattaacaaaagccaggaaaaaaccctcactccgcaaggatatgtatcagaagatgatcgaagttgaccccgaggcgccaaccgaggaggagaaggcccaacgggctgtaaccaagccccgttacatgcaatggagggagactatctcttcaaccgcgacacttggattcagaatcgaggggataaaaaaagaggacggcacagtgaatagagactttaagaagactaaaacacgcgagcaggtgacagaggccttccgggagttcacgaaggggaaccataacatcctcatcgcttaccgggaccgcctgaaggctatcaggacaacgctcgaagtctcaccctttttcaagtgccacgaggtgatcgggtcatctttactattcatccatgacaagaaggaacaagcgaaagtctggatgatcgacttcgggaaaactaccccgttgccggaaggccagacgctccagcatgacgtcccttggcaggagggtaaccgcgaggacggctatctctcggggctgaataacctggttgatattctgaccgagatgtctcaagacgctccactggcctag

SEQ ID NO: 226881 - DNA, 2052 bp, Artificial Sequence
  Description of Artificial Sequence: Synthetic coding sequence
atgcgcaggtgcccatgccgaggatccctgaatgaggcagaggccggagccctgccagctgccgctcgcatgggattagaggccccaagagggggacgcagacgccagcccggtcagcaacgccctggacccggtgcaggagctcctgcgggtcgaccagagggcggaggcccatgggccaggacggaaggaagcagcttgcactccgagccagagcgggcaggcttgggacccgctcccggaaccgagtcaccccaggccgagttctggactgatgggcagaccgagccagcggcagcgggactcggggttgaaactgagcgtcctaagcagaagaccgaaccggacaggagctctctgagaacccacctcgaatggtcctggtctgagctcgaaacaacctgtctttggaccgaaactggcaccgatgggctgtggactgaccctcatcgtagtgatctccagttccagcccgaggaagcgtctccttggactcagccaggcgtgcacggcccatggactgagctggagacacacggcagtcaaacacaaccagagcgcgtgaagtcttgggccgataatttatggacgcaccaaaacagctccagcctgcaaacacatcccgagggggcatgtccgtctaaggaacccagtgcagacggctcctggaaagaactgtacaccgatggctctaggacccagcaggatatagaaggaccctggacagagccctataccgatggcagccagaagaagcaggatacagaagccgcaaggaagcaacctgggacaggtgggtttcaaattcaacaggacaccgatgggtcctggactcagccctctacagatggatcacagacagctcctgggaccgattgtctgctcggcgaaccagaagacgggccattggaagagcccgaacccggagagctcctgactcatctttactcacatctaaaatgcagcccactgtgtcctgtgccaagactgatcattacccccgagactccagagcctgaagctcaaccagtggggcctccatcaagagtcgaaggaggatctggcggattcagttccgcgtccagctttgatgagagcgaggacgatgtggtggctggaggcggtggtgcatctgaccctgaagacaggtctggtagtaagccatggaaaaaattgaaaaccgtcttaaaatacagtccctttgtggttagctttcgtaaacactatccttgggtgcagcttagtggccacgccggtaactttcaagccggtgaagacggcagaattcttaaacgattctgccagtgtgagcagcgaagtctggaacaactgatgaaagacccgctcagaccttttgtgcctgcatattatggtatggtattacaggatggtcaaacgtttaaccagatggaagatttgcttgcagacttcgaggggccttctatcatggactgtaaaatgggctcaaggacttatctggaagaagagttggtgaaagctagggagaggcctcgaccgagaaaagacatgtatgaaaaaatggtagccgtggatccaggtgcccctactcccgaagagcacgcccagggggcagttacaaagcccaggtacatgcagtggcgcgaaaccatgagcagcacatcaacactcggattcagaattgaagggataaagaaagcagatggtacgtgtaatactaatttcaagaaaactcaggctcttgagcaggtgaccaaagtgcttgaggacttcgtggatggcgatcacgtaattctccaaaaatacgtagcgtgtctggaggagcttcgcgaagcattggaaatttctcccttttttaagactcatgaagttgtgggcagctctttgcttttcgtccacgaccataccggactggctaaggtctggatgattgattttgggaagactgttgcacttccagatcaccagactctgtctcacagattgccttgggcagaaggtaatcgagaggacggctacctctggggcctggataacatgatctgcctcttgcagggtctggcacagagttag

SEQ ID NO: 226882 - DNA, 1740 bp, Artificial Sequence
  Description of Artificial Sequence: Synthetic coding sequence
atgagaaggcccccaggcaacggcgaagctgcaagcgaaggccctggagggtggggcctatggggggtgcaagagtcccgccgactctgctgtgccggacacgaccgctgtaaacaggctttactccaaattggcatcaacatgatggcgctgcccggaggtcgccacttggactctgtgacactcccaggtcagcgcttacacctgatgcaggtggactcagtgcagcggtggatggaagatctcaagctgatgaccgagtgcgagtgcatgtgtgtgctgcaggctaaaccaatcagcttagaagaagacgctcagggcgatttgattttagcaggcggaccagggcctggcgaccccttacaactgttattgaaacgtgggtgggtgataagtacagaactgcgcagaatcgggcagaaactcgctcaggacagatgggccagagtgcactcaatgtcggttcgcttgacctgtcatgcgcgaagcatggtgtctgaatactcagccgtctctcggaactcacttaaggagatgggagagattgaaaagctgctgatggaaaaatgtagcgagctgtccgcagtcaccgagagatgcttgcaagtggagaatgaacatgtcctgaagagcatgaaagcttgcgtgtcggagactttgagcatgctgggtcagcattttggacagctcctggagttggcacttaccagagaggtgcaagcgctggtgcggaagatcgacgcatccgataacatttataccacagagagtaccaccggtaatctcttctccttaactcaagaaggggctcccctctgtagaattatagcaaaggaagggggagtcgttgccctgttcaaggtgtgtcgccaggattcttttaggtgcctttaccctcaggccctgcgaacgcttgcttcaatctgctgcgttgaggagggggtgcatcaattagagaaagtggacggcgtgctgtgtctcgccgacatcctgactgataacagtcacagcgaggctacaagggccgaagcagccgcagtcgtggcgcaggtgactagccctcacctgcccgtcactcaacacctctcatcttttctggaatctatggaagagatcgtgacagctctggtgaagctttgccaagaagcgtcttccggcgaagttttcctcctggccagtgccgcactggctaacatcacgttcttcgacactatggcttgcgaaatgttgttgcaattgaacgccatccgagtcctgttagaggcttgcagcgataagcagcgggttgacaccccctatacaagagaccaaatcgtcaccattctggcaaacatgtcggtgttagaacagtgcgcctccgacataatccaggagaacggcgtccagctgataatggggatgctaagcgagaaaccaaggtctggaactccagcagaagttgctgcctgcgaacgggtgcaacagaaggcggcagtgaccctcgcccgtctctctagagatccagacgttgcgagggaagccgtccgattgtcctgtatgtccagattaatcgagctctgtcgtagcccatctgaaagaaattccagcgatgcagtgcttgtcgcttgcctggcagccctgcgacgtcttgccggagtctgcccagagggattacaggactcagattttcagcagttggtgcagcccaggctagtcgacagcttcctcctctgctcaaacatggaggaatccttcgtgtag

SEQ ID NO: 226883 - DNA, 1599 bp, Artificial Sequence
  Description of Artificial Sequence: Synthetic coding sequence
atgatggcactgcctggagggcgtcaccttgatagcgtgactctgcctgggcagcgtctgcaccttatgcaggtagatagtgttcagcgctggatggaagatctcaaactgatgactgagtgcgagtgcatgtgcgtgctgcaggccaagccaatttctctagaggaggatgcgcaaggggacctgatactggcaggaggcccaggcccaggagacccacttcaactacttctaaagagaggctgggtgatctccacagaactcaggcggatcgggcagaagctcgcccaggatcggtgggctcgggtacactccatgagcgtgagattgacatgtcacgccagaagcatggtttccgagtacagtgctgttagccgtaattccctaaaggagatgggtgagatcgaaaagctcctgatggaaaagtgttctgagttgtccgccgtcacagagagatgcctgcaggtggagaacgagcacgtcctcaagagcatgaaagcctgtgtttctgagaccttgtccatgcttggacagcatttcgggcagctgcttgaactagcgttgacccgcgaggtacaggccctggtgcggaagatcgacgccagcgacaacatttacacgactgagtccacaacaggaaacctgttttccttgacccaggagggggctccgctgtgtcgcatcatcgcaaaggagggtggagtggtggcactctttaaagtttgtcgtcaggacagcttccggtgcctctacccccaagccctccgaaccctagcctccatctgctgcgttgaagaaggggttcatcagttagagaaggtggacggcgtcctctgtctggctgatattcttacagacaattcccacagcgaggcaactagagccgaagctgccgctgtcgtggctcaggtgactagcccgcacttgcccgtcacacagcatctgagcagctttctcgaaagcatggaggagattgtgaccgctctggtcaaactgtgtcaggaggcctcttcaggagaagtgtttctgctggccagcgcggcactggcaaatattacattttttgatactatggcctgtgagatgcttcttcagctgaacgccattagggtcctccttgaagcatgcagtgacaagcagagagtggacaccccgtacacacgggatcagatcgtgactatcctggccaatatgtctgtgctggagcagtgcgccagcgacattattcaggaaaatggggtgcagctcattatgggaatgctcagcgagaaacctcggtccgggacacctgccgaggtagcagcctgcgagcgggtacagcaaaaagcagccgtcacattggctcggctcagccgcgatccagatgtcgcacgcgaagcggtgagacttagttgcatgtctcgcttgatcgaattgtgccgctctcctagtgaacgaaatagtagcgacgcagtgctagtggcatgcctcgctgcgttgcggagattagccggtgtgtgccctgaagggctgcaagattctgactttcagcagcttgttcagcctcgcctggtggactcttttctcctgtgctctaacatggaggaaagctttgtgtag

SEQ ID NO: 226884 - DNA, 927 bp, Artificial Sequence
  Description of Artificial Sequence: Synthetic coding sequence
atgatggccctgcccggaggaagacaccttgattctgtgaccttgccaggccagagactccacctgatgcaggtggattctgttcaacgctggatggaagatttaaaactaatgacagagtgcgagtgcatgtgcgtactacaggctaagcccataagccttgaggaggacgcccaaggtgatctgattctggccggaggccctggtccaggggaccctttgcagctcctgctaaagcgtggctgggtgatctcgaccgagcttagacggattgggcagaagctcgcgcaggaccgttgggctagggtgcatagcatgtccgttcgcctgacctgccatgcccgttccatggtgagcgaatactccgcagtgtcgcggaacagcctcaaagagatgggagaaatcgagaaactgctgatggagaaatgtagtgagctgtcagcagtcaccgaacggtgtctgcaggtagagaatgaacacgtgctgaaaagcatgaaagcgtgcgtctccgagacactgagcatgctgggccagcacttcgggcagctgctggagctggccttgactagggaggtgcaagttgagagccattccgtgactagactcgagtgttctggagccatcagcgcacagtgtaatctccgtctgctagggagtagtgatagtcccgcttctgcaagtcaggcccttgtgagaaaaatcgacgctagcgacaacatatacactaccgagtcaaccactggaaaccttttcagtctgacacaggagggtgcacctctatgtaggattattgccaaagaggggggtgtggttgctctgtttaaagtctgccggcaggacagcttccgctgtctgtacccccaggctctgcggaccctagcttcaatctgttgtgtggaggagggcgtgcaccagctcgagaagtag

SEQ ID NO: 226885 - DNA, 1473 bp, Artificial Sequence
  Description of Artificial Sequence: Synthetic coding sequence
atgatggcgttgccaggtggaagacacctcgactcggtgaccctcccagggcagaggctgcacctcatgcaggtggattccgtccagaggtggatggaggatctgaagcttatgacagaatgcgaatgcatgtgcgtgcttcaggccaaacccatcagtctggaggaagatgcccagggggacttaatcttagcagggggtcctggaccgggagatccactgcagctcttactgaaaaggggctgggtaattagcaccgagctgagaaggattggccaaaagctggcccaggatcggtgggctcgggtccacagcatgagtgtgcggctgacttgccacgctcgctctatggtaagcgagtactccgctgtgtccagaaattccctcaaagagatgggagaaatagaaaagctgctgatggagaagtgtagtgaactctctgcggtgaccgaacgctgcctgcaggttgaaaatgaacacgtcctgaagagcatgaaggcatgtgtcagcgagacactgtcaatgttagggcagcatttcggtcaactgctcgagctcgctttgactagagaagtgcaggcccttgtacgtaagattgatgcttctgataatatttacacaactgagtctacgaccggcaacctcttttcactgacacaagagggagctccgctgtgccgaattatcgcgaaggtcgatggagtactctgcctcgccgatattctcacagataactcccactctgaagccacgagagctgaagctgccgctgttgtggcgcaggttacctcacctcatctccccgtgacacagcacctttcctctttccttgagagcatggaagaaatcgtgactgccttagtaaagctctgtcaggaggctagctctggagaggtgttcttattggcttcggctgccctggccaatatcaccttcttcgacactatggcttgcgaaatgctcttgcaactgaacgctataagggtactacttgaggcatgttcagacaagcagcgagtggacaccccctacacccgcgatcagattgtaactattcttgcaaacatgagcgttctggaacagtgcgcatccgatataatccaggagaatggagtccaactcatcatgggcatgctctctgagaagccaagatcaggaacacccgctgaggtggccgcatgcgagcgggtacaacagaaggccgctgtgaccctggccaggctgtccagggacccagatgtggctcgagaggctgtgcgcttgagctgcatgtctaggctgattgaactgtgcagaagtccttccgagagaaactcctccgatgccgtccttgtcgcctgtctggcggcactgagacgcctggcaggggtgtgtcctgaaggtttgcaagacagcgacttccagcaactggtccagccacggttagtggactccttcctactgtgttccaatatggaggaaagcttcgtgtag

SEQ ID NO: 226886 - DNA, 1473 bp, Artificial Sequence
  Description of Artificial Sequence: Synthetic coding sequence
atgatggccctgcctggaggacgtcaccttgatagcgtgacccttccagggcagcggttgcacctgatgcaggttgatagcgtccagagatggatggaagacctgaaactaatgaccgaatgcgaatgtatgtgcgtgctgcaggcaaaaccaatctcccttgaggaagatgcccagggagatctaattctggccggaggtcctgggcctggagaccctttacaactgctgctgaagcggggttgggtcatcagcactgagctccggagaatcgggcaaaagcttgcccaggatcgctgggccagagtccactccatgtccgttcggctcacatgccacgccaggagcatggttagcgaatactctgctgtgtcaagaaactccctgaaagagatgggcgaaatagagaaacttctcatggaaaagtgtagcgaactaagcgcagtaacagagcggtgtctccaagttgagaatgaacacgtcctcaaaagcatgaaagcgtgcgttagcgagaccctgagcatgcttgggcaacacttcggccaactgctcgagctggcgctcacacgcgaggtacaggccctggtgcgaaagattgacgctagtgataatatttacaccacagaatctactacgggcaatctgttctccctgacccaagagggtgcccctctgtgtagaatcatcgctaaggttgatggcgtgctatgcctggctgacatcctgactgacaactctcactctgaggccacccgcgcagaggccgctgctgtcgtggctcaggtcactagtcctcacctgcccgtgactcagcatctgtctagttttctcgagtctatggaggaaatcgtcacagcattggtcaaattatgtcaagaagcatcctcgggagaggtgtttttgctagcctccgccgcactcgccaatattacattctttgacaccatggcttgcgaaatgctgttgcagctgaacgcaatcagagtgctgctcgaggcgtgcagtgataagcagcgagtcgatactccatacacacgggaccaaattgtgactattctggcaaacatgtctgtgcttgaacagtgcgcctctgacataatccaggagaacggagtgcagcttattatgggaatgctcagcgagaaaccacgctctggaaccccagccgaggtggccgcttgcgaaagggtgcaacagaaggccgctgtaactcttgcaagattatcacgagaccctgatgttgcacgggaagcagtccgactgagctgtatgagccgtctgatagagctgtgccggtctccctctgagaggaattcaagtgacgcagttttagtcgcctgtcttgccgctctacggagactggccggagtctgtcccgagggactgcaagactccgacttccaacagctggttcagcctcgtcttgtggactccttcctgttgtgctccaatatggaagaatcctttgtgtag

SEQ ID NO: 226887 - DNA, 1599 bp, Artificial Sequence
  Description of Artificial Sequence: Synthetic coding sequence
atgatggctctgcccggagggcgacacctggattcggttacactcccaggccagaggttacacctcatgcaggtggactccgtgcagcgctggatggaagacttgaaactgatgacagaatgcgaatgtatgtgcgttttgcaggccaagcctatctccttagaggaggacgcccagggcgatctgattctggcaggtggtccaggtcccggagatcctctgcaactattgctcaagaggggttgggtgatctccacagaacttagacggattggccagaagcttgcccaggacagatgggctcgggtgcatagcatgtcagttcggctcacatgtcatgcaaggagcatggtgtccgagtactccgcggtttcaaggaattctctcaaagaaatgggggaaatcgagaagctcctgatggaaaaatgttccgaactgagcgcagtgacagaaaggtgcttgcaggtcgagaatgagcatgtcttgaagtcaatgaaagcttgtgtctcagaaactttgtctatgctagggcagcattttggacaacttctggagttagccctcaccagagaagtgcaagctttggtgaggaagatcgatgcatccgataatatctatacgaccgagagcactaccggaaacttattttcattaacccaggaaggagctcccttgtgcaggatcattgccaaggaaggcggtgtggtggccctttttaaagtatgccgccaagacagcttccgttgtctttacccccaggctctgagaaccctggcatccatctgctgcgtggaagagggagtgcaccaactcgagaaggtggatggagtgttgtgcctcgctgacattctaaccgacaattcacattctgaggccactcgggctgaggccgctgccgtcgtggcccaggtcactagccctcacctgcctgtgacccaacacctaagctcctttctggagagtatggaagaaatcgtgacagccctggtcaagctgtgccaggaagcgtcgtctggcgaggttttcctgctggcctcagccgctctggctaatattacgttctttgatacaatggcctgtgaaatgttattacagctaaatgccattcgggtcctcctagaagcttgcagtgataagcagagagtcgacacaccctatacccgcgaccaaatcgttaccatcctggctaatatgtccgttctcgaacagtgtgcttcagacataatacaggagaacggagtgcagctgataatggggatgctgagcgagaagccgaggtctggaacccctgctgaggtcgccgcatgcgagagggtacagcaaaaggcagcagttacactcgccagactctcccgagacccagacgttgcacgggaggccgtcagattgagctgcatgtctcgtttgatcgagttgtgtagatcccctagcgagaggaacagttccgatgccgtgttggtggcctgtcttgccgcactgcgcaggctagcgggagtatgcccggagggactgcaagattctgatttccaacagctggttcagccacgactcgtagactccttcttgctttgttcaaatatggaagagtcttttgtctag

SEQ ID NO: 226888 - DNA, 834 bp, Artificial Sequence
  Description of Artificial Sequence: Synthetic coding sequence
atgcccagattgcatgaccacttctggagctgctcatgtgcccacagtgctcgcaggcgcggtccccctcgcgcttctgccgcagggcttgcagctaaggtgggcgagatgatcaatgtatccgttagcggtccctctcttctggccgctcacggagcccctgacgctgatccagcccctcgcggaaggagcgctgccatgagcgggccagaacctggaagcccatacccgaatacctggcaccatcgtctgttgcagagaagcctcgttctcttcagcgttggcgtggtccttgccctggttctcaacctgctgcaaatacaaaggaacgtcacgctgttcccagaggaggtgatcgctacaatcttttcttccgcgtggtgggtcccaccatgctgtgggacggccgcagctgtggtgggcctcctctacccatgcatcgattcacatctcggggagccacataaattcaagagagaatgggcatccgttatgcgttgtatcgctgtcttcgtgggcatcaaccacgcctcagccaaactggactttgctaataatgtccagctgagcttaactctggcggctctaagcctcggcttatggtggacctttgacagaagtcgcagtgggcttggactcggcattaccatcgcgtttttggcaaccctcattactcagttcctcgtttacaacggagtttaccagtatacctccccagattttctatacattcgaagctggctcccttgcatcttcttctctggtggagtgacagttggtaatattgggagacagctggctatgggcgtcccagagaaaccacattcggattag

SEQ ID NO: 226889 - DNA, 537 bp, Artificial Sequence
  Description of Artificial Sequence: Synthetic coding sequence
atgccgcgtctccatgatcacttttggtcatgctcctgtgcacatagcgcacggaggaggggcccacctagagcctctgccaaactggacttcgctaacaacgtgcagttgtccctgactctcgcagctctatctctggggctatggtggacatttgacagaagtcgttctggtctagggctcgggattacaatcgccttccttgccacccttatcactcagtttctggtgtataacggagtgtatcagtacacatccccggattttctctacatacggtcctggctcccttgtattttcttctcagggggagtgacagtgggcaatattgggcgtcaactcgctatgttaataccattttgcgaagaattaaaccttaaaaccacatggctgtttcacaagacccggtctaactatagggtgtttctcaaatcaccgatcgtaatcgaatcctctaagcccccaattctccgcgcacggaaaatcctggaagaaaaccttacagtggattacgacaaggattatctgttctcatag

SEQ ID NO: 226890 - DNA, 372 bp, Artificial Sequence
  Description of Artificial Sequence: Synthetic coding sequence
atgccccgtctacatgaccacttttggtcgtgtagctgtgcccacagcgcacgtcggaggggtccacctcgcgcaagcgccgcaggattagctgctaaagtcggtgagatgatcaacgtgtcagtgagcggcccatcactgctcgcagcccacggcgctccggacgccgacccagcacccagggggaggtcggctgctatgagtggccctgagccaggcagcccctaccctaatacttggcatcaccgcctgctccagcggtcactggtcctcttcagtgtaggggtcgtgcttgctctggtattgaatctgcttcagatccagcgtaacgtcaccttgttccctgaggaagtgattgccaccatcttttag

SEQ ID NO: 226891 - DNA, 495 bp, Artificial Sequence
  Description of Artificial Sequence: Synthetic coding sequence
atgccacgcctgcatgatcacttttggtcttgttcatgcgcccattctgccaggcggcgtggacctccacgcgcttcagccgcaggactcgccgcaaaggtcggcgagatgattaacgtgagtgtgagtggaccttcgctcttggccgcacacggggctccggacgctgaccctgctccacggggacgttccgctgccatgagcggacctgagcccggtagtccttatccgaacacttggcaccataggctgctgcagcgtagtctagtcctgttctcggtgggtgtggttttggctctcgttcttaaccttctccaaatccagcggaatgttactttgttcccagaagaagtcattgcaaccattttcagcagcgcctggtgggtaccaccgtgctgtggtacagccgctggcattcacccacagatttcttctatctttgttttaggatccctggtgtactttagccaggaggcaagtaggtggggtacctag

SEQ ID NO: 226892 - DNA, 678 bp, Artificial Sequence
  Description of Artificial Sequence: Synthetic coding sequence
atggctgagggagaaactgagagtccaggacccaagaaatgtggcccatacatcagcagtgtgacaagccagtctgtgaacttgatgattcgcggagtagtcctcttcttcataggggtcttcttggcactcgtacttaacttgttgcaaattcaacgcaatgtgactctcttccccccagacgtgattgccagtatcttttcctctgcatggtgggtgcctccttgttgcgggacagctagcgccgtgattggtctactttatccatgtatagaccgtcacttgggcgagccccataaattcaagagggagtggagctcagtcatgaggtgtgttgctgtgtttgtgggcataaaccacgccagcgccaaagtggactttgacaataacattcagctgtccctgacactggccgcactgagcatcggtttgtggtggacctttgatagatcgcggagcggctttggcttgggcgtcggtattgcttttctggctacggtggtgacccagttgctggtatataatggggtatatcagtatacatctccagattttttgtatgtgcggagttggctgccatgcatttttttcgcgggaggaattacgatgggcaacataggacgccagctggctatgtatgagtgcaaagtaattgctgaaaagtctcatcaggagtag

SEQ ID NO: 226893 - DNA, 4149 bp, Artificial Sequence
  Description of Artificial Sequence: Synthetic coding sequence
atggcaactggcggaaggagaggcgcagctgctgcccctctgctcgtggctgtggccgctctgctgctcggagctgccggacacctctacccaggtgaagtgtgcccagggatggacatccgcaataacctcacaaggttgcacgagttagagaactgtagtgtcattgaaggacatctgcagatattgctcatgtttaaaacaaggccagaggacttccgcgacctaagtttccctaagctgatcatgatcacggactacctgttgttgttcagggtgtacggcctcgagagcttaaaagatctcttccccaatctgaccgttattaggggttctagattattctttaattacgcactggtcatctttgagatggtccacttgaaagagttaggtctctataacctgatgaatattactcggggaagcgtccggattgagaaaaacaacgagctgtgctacctggccaccatagattggagccggatactggactcagtcgaagataactacatcgtgttgaataaggacgataatgaggagtgcggtgacatatgtcctggcaccgcgaaggggaagaccaactgtcccgcaactgtgatcaatggtcaattcgtggagcgatgctggacccactctcactgtcagaaagtgtgccctaccatttgcaaatcccacggatgtacagcggagggcctgtgttgccatagcgagtgcctcggaaattgcagccagcccgatgatccgaccaagtgtgtagcatgcaggaacttttatttggacggcaggtgcgtcgagacatgcccacccccttattaccactttcaggattggaggtgcgtcaacttctcattctgccaggatcttcatcacaagtgtaagaacagtcggaggcaggggtgtcatcaatacgtgatccacaataacaagtgtatacccgagtgccccagcgggtacactatgaactcgagcaatctcctttgtacaccatgcctgggtccctgccccaaggtgtgccacctgctcgaaggggaaaagacgatcgacagcgttactagtgctcaagaattgcgtggctgcacagtaattaacgggtcattgataattaatattcggggaggcaataacctcgccgctgagttggaggcaaacctgggactcatagaggagatatcaggctatctcaagatcagacggagctacgccttagtcagtctatctttttttcgcaagctgcgccttatcaggggagaaaccctcgaaattgggaactattccttttacgccctggacaaccagaaccttagacagctgtgggattggtccaagcataaccttaccatcactcaagggaagctctttttccattataatcccaagttatgcttatctgaaatacataaaatggaagaggtaagcggaaccaagggaagacaggaacggaatgatatagcccttaagacaaacggagaccaggccagctgtgagaatgaattgctgaaattttcctatattcgaacgagttttgacaaaatcctcttgcggtgggaaccctactggcctccggatttccgagatctcctgggattcatgctgttctacaaagaagcgccatatcagaacgttaccgaattcgatggccaggacgcctgcgggagtaacagctggactgtggtcgacattgacccgcctttgcggagcaacgatccaaagtctcagaaccatcctgggtggcttatgcgtggactgaagccctggacacaatacgccatctttgtcaagacgttggtgactttctccgacgagagaaggacatacggcgcaaagagcgacataatttatgttcagacagacgccaccaacccgtcagtgccactggatccaatttccgttagcaatagcagcagccaaattatcctgaaatggaaaccccctagtgatcccaacggaaacataacacactatctggtgttttgggaaagacaggccgaggacagcgaattattcgagttggattactgtctgaaaggattaaaactgccatcgcggacatggtcacccccattcgaatccgaagatagtcagaaacacaatcagagcgaatacgaagactctgcaggggaatgttgtagctgtccaaagacagattcccagatattgaaggagctggaagagtcgtcatttcgaaaaacctttgaagattatttacacaatgtcgtgttcgttcccagaaagacgtcttcagggaccggcgctgaagatcctcgtccttctcggaaaagacgaagtctcggggatgtcggcaacgttacggtggcagtcccaaccgtggcagctttccctaacacctcaagcactagcgtgccaacttcaccggaggaacatagacctttcgaaaaggtagtgaacaaagaatcattggtgatttctggtctccggcacttcacaggctacaggatcgagctgcaagcatgcaatcaggatactcccgaggagcgttgtagcgtggctgcctacgtgtctgcgcgaacgatgcccgaggccaaggccgatgacatcgtgggccctgtcacacatgagatcttcgagaacaacgtagttcacctgatgtggcaagagcctaaggagcctaatggactcatagtgctgtacgaggtgtcctacagacggtacggcgatgaggaactacatctttgtgtatcccgtaagcacttcgccctggagcgtgggtgtagattacggggactgagcccaggaaactacagcgttagaatccgcgcaacaagccttgccggtaatggttcctggacggagcctacctacttttatgtgacagactacttagacgtcccaagcaacatcgctaaaattattattggacccctgatatttgtctttctgttcagcgtggtgatcggatctatatacctgttcctgagaaaacgccagcctgacggcccactgggaccgctctacgcgagctccaatcctgaatacctctccgctagtgacgtgtttccgtgctccgtctacgtccctgatgaatgggaagtgtccagggaaaaaataacactgctaagggagctggggcagggatcctttggaatggtgtacgagggaaatgcacgggacatcatcaagggcgaggccgagacacgcgtggcggtgaagacagtaaatgaaagcgcatcgctgcgggagcggatcgaatttctgaatgaagcttccgtaatgaaagggttcacatgccatcacgttgtgcggctgctgggcgtcgtatcgaaaggacagccaacgctggtggtgatggagctgatggcccacggggacctcaagagctacttgagatctttgagacctgaggctgaaaacaacccgggtcgcccacctcccacgctgcaggagatgattcagatggcagccgaaatcgcggacgggatggcctacctaaacgcaaaaaagtttgtgcacagggatctggcagctaggaactgtatggtagctcatgatttcacagtgaaaattggcgacttcgggatgacccgggacatctacgagacggactattatcgtaaaggagggaagggactgctgcctgtccggtggatggcgccagaatctctgaaagatggcgtgtttactacctcgtctgacatgtggtctttcggggtagttctgtgggaaatcacttccctggcagaacagccttatcaggggctgtccaatgagcaggtgcttaaatttgtcatggacggcggttatctggaccaacccgataattgccctgaacgggtcaccgatctgatgcgaatgtgctggcagtttaatcccaaaatgcgccctacgtttctggagatcgtaaatctcctgaaggacgatttgcacccctctttccccgaagtgtctttcttccatagcgaggaaaataaggcccctgaatctgaagaactggagatggagttcgaggatatggagaacgtgccccttgatagatcaagtcattgccagcgggaggaggcgggaggacgggacggaggttcatccttgggatttaagcgcagctacgaggaacatatcccttatacccacatgaatggcggtaagaagaatggtagaatcttgacattgccccgttccaatccctcgtag

SEQ ID NO: 226894 - DNA, 4113 bp, Artificial Sequence
  Description of Artificial Sequence: Synthetic coding sequence
atggccacaggcggacgtcgcggagccgcagcagccccactgctcgtggctgtcgctgccctcctactgggagccgcaggacatttgtaccccggagaggtatgtccgggtatggatatcagaaacaatttgacccggttgcacgagctcgaaaactgttccgtgattgaagggcacctgcaaatcttgttaatgtttaagacgcgcccagaagacttccgcgacttgtcctttcctaagttaatcatgatcactgactatctattgctgtttagggtctatggattggaatccctcaaggatctgttccccaacctaacagtgatacgcggttcgaggctcttctttaactacgcccttgtcatctttgagatggtgcatctgaaggaactcgggttatacaacttgatgaatataacacgaggaagcgtgaggatcgagaaaaacaatgagctctgttacttggcaaccattgattggagccgcattttagactcagttgaggacaactatatcgtgctaaacaaagacgacaatgaggaatgcggggacatatgccctggaacagctaaggggaagactaactgcccagctaccgtgataaacgggcagttcgtggaacggtgctggactcacagccattgtcaaaaggtttgtcctacaatatgtaaatctcacggatgtactgcagagggcctgtgctgccacagtgaatgcttaggcaactgcagtcagccagacgaccctaccaagtgtgtggcatgccgaaacttctacttggacggaagatgtgtggaaacctgtccacctccttactatcacttccaagattggcggtgtgtcaatttcagcttttgtcaagacctgcaccacaagtgcaaaaactccaggagacaaggatgccaccaatatgtgatccacaataataaatgtatacccgaatgccccagcgggtataccatgaattcctcgaaccttttgtgcacaccctgcctggggccatgtcccaaggtttgtcatcttctcgaaggtgagaagactatcgattctgtgactagtgctcaggaactccgcggatgcactgtgattaatggatctctaattataaacataagagggggtaacaacttggctgccgagctggaggccaacctcggactaattgaggagatctctggctatctgaaaataaggagatcttatgctctggtgagcttgagcttttttaggaaattacgcctgataaggggcgaaactctggagattggaaactactccttctacgccctggacaatcagaatctccgccagctctgggactggagtaaacacaacctaacaatcacgcaaggtaaacttttttttcactataatcctaagctgtgcttatccgaaattcataagatggaagaggtgtccggtacaaagggacgtcaggagaggaatgacattgccctgaagaccaacggagatcaagccagttgcgagaatgaactcttaaagttcagctatattaggactagcttcgataaaatactattaagatgggagccctactggcctccagactttagggatttactcggtttcatgcttttttataaggaagcaccctatcagaacgttaccgagtttgacggccaagatgcctgcggatctaatagctggaccgtcgtggacattgacccaccgctccgaagtaacgatcccaaatcccaaaaccatcctggctggcttatgcgcggattgaagccttggactcagtacgccatcttcgtgaagaccctggtgactttctccgacgagaggaggacctatggggcaaagagcgacataatttatgtccagaccgacgccaccaatccaagcgtccccttagaccctatatcagtctcaaatagttccagtcagattattctgaaatggaagccaccctctgatccgaacggaaatattacacactacctggtcttctgggagcgtcaggccgaggacagcgaacttttcgaactggattactgcctgaaagggctgaagctgcccagcagaacttggtcccctcctttcgagagcgaggattctcaaaagcataatcaaagcgagtacgaagacagtgccggagagtgttgcagctgccctaaaaccgattcgcaaattctgaaggaacttgaagagagctctttccgaaagactttcgaggattaccttcacaatgtcgtttttgtacccagaccctctagaaagagacgctcccttggtgacgttggtaacgtgaccgtggccgtgcccacggtcgctgcattccccaacacatcttccacgtctgtgccaacgtcacccgaggaacataggccctttgaaaaagtggttaataaggaatctctcgtgatatcgggactgcgccacttcaccggttacaggattgaactccaggcctgtaaccaggatacaccagaggaacgttgttccgtagcagcctacgtgtcagctcggaccatgccagaggctaaagctgatgacattgtggggccagtgacccacgagatatttgagaacaatgtcgtccatcttatgtggcaggagcccaaggagcccaatggactcattgtgctttatgaggtttcttaccgcagatacggagatgaggagttgcatctctgcgttagtaggaaacacttcgctctggaacgaggctgccggctgcgcggtctgtctccagggaattactctgtgcggattcgggctactagcctggccggaaacggatcatggacagaacctacatatttttacgtcacagactatctggatgtgccctcaaacatcgctaaaataatcatcggccctctcatattcgtctttttattctccgtagtgatcggtagcatttatctatttctcaggaaaagacagcccgatggcccacttggccctctctatgcatcttcaaatcccgaatacctcagtgcttccgacgtgtttccgtgcagcgtatatgtccctgatgaatgggaggtttccagggaaaagatcacactacttcgcgagctaggccaagggtctttcggcatggtctatgagggcaatgcgagagacatcatcaagggagaagcggagacgcgcgtggctgtgaagaccgtgaacgaaagtgcatcattgagagaaagaatcgagttccttaacgaggcatccgtaatgaaagggttcacgtgtcaccatgtggtacgcctgttgggcgtagtgagtaagggccagcccactctggtagtgatggagttgatggcgcacggagatctcaagtcataccttcgaagtcttcggccagaggccgaaaacaatcctggcagaccccctcccacactgcaagaaatgatccagatggccgcagagatcgcagatggtatggcttacctcaacgccaagaagtttgttcatagggatcttgctgccagaaactgtatggtggctcatgatttcaccgtcaagattggagactttggcatgacacgcgacatttatgaaactgattattacaggaaaggaggaaagggactgctacccgttcgctggatggcacccgaatctctgaaggacggggtgtttaccacttcatctgatatgtggtcttttggggtagtgctctgggaaatcactagcctggcggaacaaccctatcagggattatccaatgagcaggtgttgaagttcgttatggatggaggatatttagaccaaccagacaactgccctgagcgagtgactgacctgatgagaatgtgttggcagttcaaccccaagatgcgaccgacatttctggaaatcgttaacctacttaaggacgacctacacccatctttcccggaagtgtcatttttccactctgaggagaacaaggcccctgaaagcgaagaactcgaaatggagttcgaagacatggaaaacgtacctctggacaggtccagtcattgccagcgggaggaggccggtggaagagatggtggcagttcactggggtttaagcgctcctatgaagagcatatcccctatacccacatgaacggaggcaagaagaacgggagaatcttaactctccctaggtcaaatccatcatag

SEQ ID NO: 226895 - DNA, 252 bp, Artificial Sequence
  Description of Artificial Sequence: Synthetic coding sequence
ccatatcagaatgtcactgaatttgatggacaggatgcatgcgggagtaatagctggaccgtcgtggatattgacccacccttgcgcagtaacgatccaaaaagtcagaatcaccctggatggctaatgcgaggactgaaaccctggacccagtacgctattttcgttaaaacgttggtcacattttctgacgagagacgtacgtacggcgcaaaaagcgatattatttacgtacaaacagacgccacctag

SEQ ID NO: 226896 - DNA, 4017 bp, Artificial Sequence
  Description of Artificial Sequence: Synthetic coding sequence
atggccagcccgccacgccacggaccaccaggcccagcatcaggcgacgggcctaatctcaataataataacaacaataataaccacagcgtccgcaaatgcggatacctgagaaaacagaaacacggtcataaaagattttttgttctccgtggccctggcgctggcggagatgaggccacggccggaggtgggagtgctcctcaaccccctcgattagaatactatgagagtgagaagaagtggcggtctaaggcgggagcacctaaaagagtgatcgcattagattgttgccttaatatcaacaaacgagcggatgcaaaacacaaatacctgattgccctgtatacaaaagatgaatactttgctgtcgcggctgagaatgagcaggagcaagaaggctggtatcgagcgcttacagatttagtgagcgaagggagggcagccgctggggacgccccacccgcagctgcccctgccgctagttgttcagcatcgttgcccggagcgctgggtgggtctgcgggagctgccggagccgaggacagctatggactagtggctccagccaccgctgcatatagagaggtctggcaagtcaatctgaaacctaaggggctgggacagtctaagaatctgacaggggtctaccggctgtgcctgtccgccaggaccatcggttttgtgaagctgaattgtgaacagcctagcgtgaccctccagctcatgaatattcgtcgatgcggacattccgattcattcttcttcattgaagtcggaaggagtgctgtcacgggtcccggagaactctggatgcaagcggatgactccgtggtggcccagaacatccatgaaacgatcttggaggcaatgaaagctctaaaggagctgttcgagttccgacccaggagtaaatctcagtcatctgggtcctctgctacacacccaatctccgtccccggagctaggcgacaccatcatttggttaacttacccccaagccaaacgggcttggttcgacgatcccgtactgactctttagccgcaaccccccctgcagcaaagtgctccagttgcagagtgaggactgcctccgaaggagatgggggagccgctgccggtgccgcagctgctggggcacgccctgtgtccgtggccggatcaccactgagtcccggaccggtgcgggcacctctgtcacgatcacacaccttgtcaggcggatgtggagggaggggttccaaagtggccttgttgcctgccggtggggcactccagcattctcgctcaatgtctatgccagttgcccactcacccccagcagctacaagcccgggatcactcagctcgagcagcgggcatgggtcaggtagctacccgccaccacctgggccacaccccccactgcctcacccattacaccacggtcctggccagcgcccttctagcggcagcgcttctgccagcggttcaccttccgacccaggattcatgtctctggatgagtatgggagctccccaggagacctgcgcgcattttgcagtcatcgatcgaatactcctgaaagtattgcagaaacccctcctgctcgcgatgggggtggcggaggagaattctatggatacatgaccatggatcgaccgcttagtcattgtggcaggtcttatcggagggttagcggagacgccgctcaagacctggacagaggcctgcgcaagaggacttactctcttactacccccgctagacaaaggccggtcccccagccatcatcggcctccctggacgagtataccttgatgagagctacctttagcggcagtgctggtcgcctgtgcccttcatgccccgcaagcagtccaaaagtagcctaccatccttatcctgaagactatggagatatcgaaattggtagccacaggtcctcttcatcgaaccttggagcggatgatggctacatgccaatgacccccggtgcggcactggccggatcgggctcaggcagctgtcgctccgacgactatatgcctatgagtccagcaagcgtgagcgcaccaaaacaaattctgcagccacgcgcagctgctgctgcggctgccgctgtgccatccgcgggaccagctggacctgcccctacgagtgcagcgggtagaaccttcccggcatccggcggaggatacaaagccagcagcccagcagagagcagccccgaggattctggatatatgcgcatgtggtgtggctctaagctttcgatggagcacgccgatggaaagctgctacccaacggggactatctaaatgtttctcctagtgacgctgtgacaacagggactccacccgattttttctctgccgctttgcatcccggaggggaaccactgcggggagtgcctggctgctgttactctagtttaccaaggtcctacaaggctccttatacatgtggcggtgacagcgaccagtatgttttgatgagctcccctgtcggcagaatcctggaagaagaacggctcgaaccccaggcgacccctggaccttcccaggctgccagtgcattcggtgccggaccaacccagccccctcacccagtcgttccatccccggtgagaccctctggcggacggccagagggcttcctcggtcagagggggagggcagtaagacctactaggttgtcccttgaaggcctgccaagcctcccctccatgcacgaatacccgcttcctcccgaacctaagagccccggtgagtatatcaatattgatttcggggaacccggagctcggttgagccccccagcaccaccgttgctggcaagtgctgcctcatcttcgagcctgctctctgcaagctcccctgcttcctcgctgggatccggaaccccgggtactagctctgactcacgccagcgctctccattgagtgactatatgaacctggacttcagcagccccaaaagccccaagccaggtgcgccatctggacaccctgtgggatcgctggatggcttactgagccccgaggccagctcaccctacccccctctgcctccaagaccttcagcctccccctcctcttcactccagccccctcccccacctcctgctcccggtgaactctatcggctcccgcctgcttccgctgtggccactgcccaagggcctggggcagcaagctcgttgtcaagcgacactggggataacggcgattacactgaaatggcctttggggtggcagcaactcctccacagcctattgctgcaccaccgaaaccagaggccgctagggtcgcctctcctactagcggggtgaaacggctctctctcatggagcaggtttcgggtgtagaagccttcctccaagcaagccaaccaccagacccccatagaggggctaaggtcattagggctgacccccagggcggacggagacggcatagctctgagacgtttagctcaacgaccactgtgactccagtgtcaccttctttcgcccataatcccaagcgccataacagtgccagtgtggaaaacgttagcctgcgtaagtccagcgagggcggagtgggcgtggggccaggcggtggagacgagccccctacttcgcctagacagctgcagcctgctccgcctttagctccgcagggccgtccctggacacctggacagccaggtggcctggtaggctgccctggaagcggcggatcgcctatgaggcgggagacttctgccggatttcagaatgggctgaactatattgctatagacgtgagggaggaacctggtctaccccctcaaccccaaccccctcccccacccttgccccagcccggtgacaagagttcgtggggtaggaccagatccttgggcggactgatctccgctgtgggggtgggttctacagggggagggtgcggcggtcccggtccaggagctttgccaccagcaaacacctatgcctccattgacttcttgagccaccatctcaaagaagcaacaatcgtcaaggaatag

SEQ ID NO: 226897 - DNA, 3894 bp, Artificial Sequence
  Description of Artificial Sequence: Synthetic coding sequence
atggctgtaccgtccctgtggccttggggtgcctgtctgccggttatcttcttaagcctcggattcggtctcgacaccgtcgaggtctgcccctctctcgacattcggagcgaagtagcagaactgcggcagcttgagaattgctcagtcgttgagggacacctgcagatcctgcttatgtttacagcaacaggggaagatttccgtggactaagttttccaaggcttacgcaggtgaccgactacctgctgctgttcagggtgtacggactcgagtcactccgagatctatttcctaacttagcagtgatcaggggaacccgtctctttctgggatacgccttagtgatttttgaaatgccccacttgcgagacgtggcactccccgctctaggcgctgtgctgcggggtgctgtgagggtggagaaaaaccaggaactctgccacctctccacaatcgactggggtctcctacagccggctcctggcgctaatcacattgttgggaacaagctcggcgaggagtgcgcggatgtgtgtccaggagtgcttggggcagccggtgaaccctgtgcgaagacaaccttttccggacatacagattaccgctgctggactagttcccattgccagagggtttgcccatgcccacacggcatggcatgcacggcgcgaggggaatgttgccacactgagtgcctgggcggttgttcccagcctgaggacccaagggcctgtgtggcctgcaggcatctttactttcagggcgcatgcctatgggcttgccctcctggcacataccagtacgagagttggaggtgcgtaaccgctgaaagatgtgcatccctacacagcgtcccgggacgcgctagcacctttgggatacatcagggaagctgccttgcccagtgtccgagcggattcacccggaactctagctccatattttgccacaagtgtgaggggttatgtccgaaagaatgtaaggttgggaccaaaacgatcgacagcatccaagctgctcaggacctggttgggtgcacccatgtggagggttcgttgatcctgaacctgcgccaaggctataacctggaacctcagctccaacatagtctgggactggttgaaactattacgggctttttaaagattaaacattcttttgccctggtgtcactcggattcttcaagaacctgaaactaatccggggagacgctatggttgacggaaactatactttgtatgtgttggataatcagaaccttcagcagctggggagctgggtggcagcgggactgacaattcccgtggggaaaatttactttgcctttaatcctaggctttgtctcgaacatatctacagacttgaggaggtgacaggcactaggggcaggcagaataaggcggagatcaaccccagaactaatggcgatcgggctgcctgtcagactcgcacactccggtttgtttccaacgtgacagaagctgatcggatcttactcagatgggagcgttacgagcctttggaggccagagaccttttgtcctttatcgtctactacaaggagtcacctttccaaaacgctactgaacacgtgggccctgatgcttgcggcactcaaagctggaatctgctggatgtcgaactgcctctctcaaggacacaggagccaggcgttactttggcctccttgaagccctggacccagtacgcagtctttgtacgggctatcactttaacaacggaggaggatagcccccaccaaggagcccaatctcccatagtgtacctacggaccctgcctgctgccccaaccgtgccacaggacgttatttccacttctaatagttccagccatctgctagttcgatggaagccccctacccaacgcaacggaaatctcacatactatcttgtgttgtggcaacggctggctgaggatggggacctgtaccttaatgactactgtcacaggggattacgtctgcccacatcaaataatgaccctaggtttgatggtgaagacggcgacccggaggccgagatggagagtgactgctgcccctgccagcatccaccccctgggcaggtattgccccctttggaggctcaggaagcttctttccagaaaaagtttgagaacttcctccacaacgcgattacaatccccatcagtccatggaaagtcacatctatcaataaatcccctcaacgcgatagtgggaggcacagacgcgcagccggtcctcttaggcttggaggcaactcctctgacttcgaaatacaggaagataaagtgcccagggagagagcagtcctgagtggactccgccattttacagaatataggatagacatccacgcctgcaaccatgctgcgcacacagtgggctgctcagcagctacttttgtcttcgctcgcacaatgccacaccgggaggccgacggcatcccaggcaaggtggcctgggaggcctcctcaaaaaactcagtgctccttaggtggctggagcctcctgaccctaatgggctaatcctcaagtacgaaattaaataccgtagactgggggaagaggccacggtgctgtgtgttagtcgactgcggtatgcaaaattcgggggtgtgcacctagctctacttcctcctgggaactattctgcgagagtcagggctacatcgctggctgggaatgggtcctggacagattctgttgcattctatatcctgggtcccgaggaagaggatgctggcggactccacgtgctgctaaccgccacccctgtaggcctgaccttgttgatcgtgcttgctgcattgggctttttctacggcaagaagaggaatcgcaccctttatgcgtcagtgaacccagagtatttttcagcctccgacatgtatgtcccagatgagtgggaagtgcccagagagcagatttctattatcagggaactggggcagggatcattcggaatggtgtacgaaggtttggccagggggttggaagcgggtgaagagtcaacaccagtggctcttaagacagttaatgaactggctagtccaagagagtgtatcgagttcctgaaggaagcttccgtcatgaaggcctttaaatgtcatcacgtggtccggcttcttggagtggtttcccagggacagcccacacttgtcatcatggagctgatgacccgtggagatctgaagtctcacctgagaagcttaaggccggaggccgagaacaaccctggcctgccccagcctgcactaggggaaatgattcagatggcgggagagatcgccgatggcatggcctacctggctgccaataagttcgtgcatcgcgacctggcggcacggaactgcatggtaagccaggactttacagtgaaaatcggagatttcgggatgacccgggacgtgtacgagactgactattacagaaagggcggtaaagggcttctgcccgtgagatggatggcccctgagtctctgaaagacggaatctttacaacacacagtgacgtgtggtcttttggcgtcgtgctgtgggagatcgtgacactggctgagcagccgtatcagggcttaagcaacgaacaggtgctcaaatttgttatggacggtggagtcctcgaagaactggaaggctgcccacttcagctgcaagaactgatgagccgctgttggcagcctaatcccagactccggccatccttcactcatattttagattccatccaggaggagctgcgcccttccttcagactgctttccttttattattctcctgagtgccgcggtgcccgaggcagcctaccaactactgacgcggagcctgatagcagcccgaccccgagagactgttccccacagaacggagggccagggcattag

SEQ ID NO: 226898 - DNA, 3060 bp, Artificial Sequence
  Description of Artificial Sequence: Synthetic coding sequence
atgcgctaccgcctggcttggctgctgcatcctgccctgccatccactttcaggtcagtgctcggggctcgactccctccccctgagcgattgtgcggatttcagaagaaaacatattccaagatgaacaatcccgcaatcaaaagaattggcaaccacattactaagtcacccgaagacaagcgcgaatacagaggcctcgagcttgccaatggaattaaagtgctcttaattagtgaccccacaaccgataaatctagcgcggcactcgacgtccatataggatcgcttagcgatcctcccaacattgctggactcagtcacttttgcgaacacatgctgttcctggggaccaaaaaatatcctaaagagaacgaatactcccagttcctgtcagaacatgcaggcagcagtaacgcattcacgtccggggagcacaccaactattattttgatgtttcccatgagcacctcgaaggcgcattagatcgattcgctcagttttttctgtgcccgttgttcgatgagagctgcaaagacagggaggtaaatgccgtggatagcgagcatgaaaaaaacgtgatgaatgatgcctggcgtctcttccagttggagaaagctactggcaacccgaaacatccattttcaaagttcggcaccggaaacaaatatactctcgaaacacgcccaaatcaggagggcatcgatgtgagacaggagctgctgaaattccattccgcttactactccagtaatctgatggccgtgtgtgtgttggggagggaatcgctcgacgatctgacaaatctggtcgtcaagcttttttccgaggttgagaacaaaaatgtgcccttgcctgagttcccagagcatccctttcaggaagagcacctgaagcaattgtacaagattgttccaatcaaggatatcagaaatctgtatgtcaccttccccattccggacctccagaaatactacaaaagcaacccaggccattacctcggtcacttgatcgggcacgagggtcctggtagtctcctgtcagaacttaagagtaaaggttgggttaatactctcgtcggaggtcaaaaagaaggggcaaggggtttcatgttttttattattaatgtggacctcaccgaggaaggcttactccacgtggaggacattatcttacacatgttccaatacatccagaagcttagggccgagggacctcaggaatgggtgttccaggagtgtaaggatttaaacgccgtggccttccgtttcaaggacaaagagcgtcctcgcggttacacaagcaagatcgctggcatccttcattattacccactcgaagaggtcctgaccgccgagtacctgctggaagaatttcgcccagacctaattgagatggtgctcgataagttaagacccgaaaacgtgcgtgtggcaattgtgtctaaatcttttgagggaaagacagaccgaactgaagagtggtacggcacccaatataagcaggaagccatccctgacgaggtcattaaaaagtggcaaaatgccgatctaaatggcaaatttaaactgcccactaaaaatgagtttatccctaccaactttgaaattctgcctctggagaaagaggctacaccctaccctgcactaatcaaagacaccgcaatgtcaaaactctggttcaagcaggacgacaagttttttctccccaaggcttgcctaaatttcgaattctttagccctttcgcttacgtggatcctctgcattgcaacatggcctacctgtatctagaactcctcaaggattcactgaatgaatatgcatatgcagccgaactggccggactgagctatgatctgcaaaatacgatctatgggatgtaccttagcgtgaagggctacaatgacaaacaacctatactgttaaaaaagataatcgagaaaatggctacgttcgaaatcgacgagaaacgcttcgagataatcaaggaagcatacatgcggtctctgaacaattttagggccgaacaaccccatcaacacgccatgtattacctacggctgctgatgacggaggttgcttggacaaaggatgagttgaaggaggccctggatgacgtgacccttccaagattaaaagctttcatcccccaactgctgagccggttgcatatcgaagccctgctgcatggtaacatcacaaagcaagctgcgctcgggatcatgcaaatggtggaagatacccttatcgaacacgctcatactaaacctctcttgcctagccagctggtgagatatcgcgaagtccagttaccagatagggggtggttcgtttatcaacagaggaacgaggttcacaacaactgtggcatagagatttactaccagacagatatgcagtccactagcgagaatatgttcttggagctcttctgtcagatcatctccgagccctgtttcaacactctgaggacgaaggagcaactgggatatatcgtgttctcagggccaagacgtgctaatgggatccaaggccttaggttcattatccagtctgagaagccccctcattatctggaatcgagggtggaggccttcctgattacgatggaaaagagcatcgaagatatgacggaagaggcttttcagaagcacatccaggctctcgctatccgtaggctggacaaaccaaaaaagctgtccgctgaatgcgctaagtattggggtgaaattattagccaacaatacaattttgatagggacaacaccgaagtggcatatctgaaaacactgacaaaggaggatataatcaagttctacaaagaaatgcttgcagtcgacgccccacgaaggcacaaagtttcagtccacgtgctggccagagaaatggattcctgtccggtggtgggcgagtttccatgtcagaatgacatcaacctcagccaagcacccgcactccctcaacctgaggtgatccagaacatgacagagttcaaacgcggtctgccgttgttccccctcgttaaaccacatattaactttatggctgcaaaactatag

SEQ ID NO: 226899 - DNA, 1395 bp, Artificial Sequence
  Description of Artificial Sequence: Synthetic coding sequence
atgtctaagctgtggttcaagcaggatgacaagttctttttgcccaaagcctgtctcaactttgaatttttctcaccttttgcctatgtggaccctctacactgtaatatggcgtacttgtatcttgaactcctcaaagattccctgaatgagtatgcatatgccgctgaattggcaggcctatcctatgatctgcagaacaccatctatggtatgtatctcagtgttaaaggatacaatgataaacagcctattctgctgaagaaaataattgagaagatggcaactttcgaaatcgatgagaaacgattcgaaataattaaagaagcctacatgcgctctctgaacaacttccgagccgagcagccacatcagcacgctatgtattacttgaggctgctcatgacggaggtggcgtggaccaaggacgaactgaaggaggcactggacgacgttacattgcctcgccttaaggcatttatcccccagcttttatctcgccttcacattgaggcactcctgcacggcaacatcaccaagcaggcggcactgggcatcatgcagatggttgaagacactctgattgaacacgcgcataccaagcccttgctcccctctcagttagtgaggtaccgcgaggtgcagctgcctgatcgcggatggttcgtgtaccaacaaagaaatgaggtgcacaataactgcggaatcgaaatttactatcaaacagatatgcagagcacgagcgagaacatgtttctggagctgttttgtcagataatctccgagccttgtttcaatactctccgcactaaagagcagctcgggtacattgtgttttccggacccaggcgggctaatggcatccaaggtcttcggtttattatccagagcgaaaagccaccacattacctggagagccgtgttgaggcgttcctcattaccatggagaaatctattgaagacatgacagaggaggcgtttcagaaacatatccaggcgctcgccatccgaaggcttgataaaccgaagaagctttcagctgaatgcgccaagtactggggagaaattatttctcaacaatacaacttcgaccgagacaacactgaggtggcctacctgaagactcttacgaaagaagatattatcaagttctacaaggagatgctggccgtagacgcccctcggaggcataaagtgtccgtgcacgtgctcgccagggagatggattcttgccctgtagtgggagaattcccctgccagaatgacatcaacttgagccaggcgcctgccttgccccagcctgaagtcattcagaacatgaccgaattcaaacgtggcttgcctctattcccacttgtgaagccacatataaactttatggcagccaagttatag

SEQ ID NO: 226900 - DNA, 774 bp, Artificial Sequence
  Description of Artificial Sequence: Synthetic coding sequence
gagttcattatacgtgggggtcgcgtgccctctcactgtttgcatttcagccggagctttcagaagaagacatattccaaaatgaataaccccgctatcaagcggataggtaatcacattacaaagtctcccgaagacaaacgcgagtatcggggacttgaacttgccaacgggattaaggtgctgttaataagcgatcctactactgacaagtcatccgccgcactggacgtccatatcggatctttgtccgacccccctaatattgctggcttatcccatttctgtgaacacatgttgttcctgggaacgaagaaataccctaaagagaatgaatactcacagttcctatccgaacatgccggaagtagcaacgcgtttactagcggtgagcacacaaattactacttcgatgtctcacatgagcatctggaaggcgcacttgataggtttgcccagttcttcctgtgccccctcttcgacgaaagttgcaaagacagagaagtgaatgccgttgattctgagcatgagaaaaatgtcatgaatgacgcatggcgattgtttcagctcgagaaagccacagggaacccaaaacaccccttcagcaagttcggaactgggaacaaatataccctcgagacccgccctaaccaggagggcattgacgtgcggcaggagctattaaaattccactccgcatattacagcagtaatcttatggccgtgtgtgtcctaggccgagaatcactggatgatttgacgaacctcgtgtag

SEQ ID NO: 226901 - DNA, 396 bp, Artificial Sequence
  Description of Artificial Sequence: Synthetic coding sequence
atggaccccaggttgcccgcatgggcactggtccttctgggtcccgcattggtgttcgcactggggcctgctccgaccccagagatgagagaaaagctgtgtggacaccattttgtacgggctctggttcgggtctgtgggggtccccgatggagtacagaggcacgacgccctgcgactggcggagacagggagctgctccagtggctcgagcgaaggcacctgctgcacgggttggtggcagactccaatttgacccttggtcctgggttgcaaccacttccccagacctctcatcaccaccgccaccaccgagctgcagccactaaccccgcacggtactgctgtctgtccgggtgcactcaacaggatctgctgactctgtgtccctattag

SEQ ID NO: 226902 - DNA, 474 bp, Artificial Sequence
  Description of Artificial Sequence: Synthetic coding sequence
atggatccgaggctgcctgcttgggcattagtcctgctgggcccagcgctagtgttcgccttgggacccgcacctactcctgagatgagggagaaactgtgtggacatcattttgtgcgcgcactcgtcagggtctgtggcggacccaggtggtcgactgaagcaaggcgcccagcaactggaggtgatcagagagagagtcacagcgtgtcccaagcagggctcaagctgctgtcatcttccaatcctcctacgctcacatttcaaagcgttggaatctccgatgtatcctgttactctgggtggcgggatgacatctgctccatgggctggtggcccacagtcatatcccgctgggatctggcctgcagcccatgccctcgtccactgaccatcactgcaactacggtacagctgcccccaacactgcacgccaccgccgcttccgttgccgtccccaataaaacttgttag

SEQ ID NO: 226903 - DNA, 420 bp, Artificial Sequence
  Description of Artificial Sequence: Synthetic coding sequence
atggctagtttgtttaggtcctaccttccagcaatatggctccttctgtctcagttgctgcgcgagagcctagccgcagaactcagagggtgcgggccaagatttgggaagcacctgttgtcctattgtccaatgcctgagaaaactttcaccaccacacctgggggatggttattggagagtggccgacctaaagagatggtgtccacctccaacaataaagatggacaggctttgggcacgacctccgaattcatcccgaatcttagccccgaactcaaaaagccgctgtcagaaggacagcccagccttaaaaaaattatcctcagccgcaagaagcggtctgggaggcacaggttcgaccctttctgctgtgaggtaatctgcgacgatggcaccagcgtgaagctgtgcacctag

SEQ ID NO: 226904 - DNA, 408 bp, Artificial Sequence
  Description of Artificial Sequence: Synthetic coding sequence
atgaaaggcagtatctttacactcttcttgttttcggtgctcttcgccattagtgaggttcggtcgaaggagagcgtcagactgtgtggcctcgagtacatccgtacagtgatttacatatgcgccagttcgcggtggagaaggcaccaagaaggcatcccccaggctcagcaggccgaaaccggcaattccttccagcttcctcataaacgggagtttagcgaggaaaacccagcgcagaacctcccaaaggtggatgcgagcggtgaagatcgtctttggggtggtcagatgccaaccgaggagttgtggaaaagcaagaaacactctgtaatgagcagacaggacctgcaaacactatgctgtactgatgggtgcagcatgacagatctgtccgctctgtgttag

SEQ ID NO: 226905 - DNA, 642 bp, Artificial Sequence
  Description of Artificial Sequence: Synthetic coding sequence
atgccacggctactcaggctttcgttactgtggctgggccttttgctagtccggttttctagggagctgagtgacatcagttctgcccgaaagttgtgcgggaggtatctggtgaaggaaattgaaaaactttgcgggcacgctaattggtctcagttcagattcgaggaggagacgcccttctcgcgcctgattgcccaggcctcagagaaggtagaagcctattcaccgtatcagtttgagtctccccaaaccgcctccccggctcgcggacgcggaacaaatccagtctccacctcctgggaagaagcagttaactcttgggagatgcagagtttgcccgaatacaaagataagaaaggctactcacccttgggcaagactcgagagttcagctccagtcacaatatcaacgtgtacattcacgagaatgcaaagttccaaaagaaacgacgaaataaaattaagactcttagcaatctcttctgggggcaccatcctcaacgaaagagacggggttattcagagaagtgttgcctgaccgggtgtacaaaggaggaactttcgatcgcatgcctaccgtacatcgacttcaagcgattgaaggagaaaaggtctagcctggtcaccaagatctactag

SEQ ID NO: 226906 - DNA, 1734 bp, Artificial Sequence
  Description of Artificial Sequence: Synthetic coding sequence
atgaataagctatatatcggaaacctgaatgaatctgtcactccggctgatctagaaaaagtgttcgcagaacataaaattagttacagcgggcagtttctcgtcaagtctggatatgcgtttgtggattgcccagatgaacactgggcaatgaaagctattgagacattcagtggcaaggtcgagctccagggtaaacgcttagagatagaacatagtgttcccaagaagcagcggagccgcaagatacagattcggaacatacccccacagcttcgatgggaggtgctggatagcctcctcgcgcagtacgggacagtggagaattgtgaacaggttaacaccgagagcgaaacagctgtggttaatgtgacatatagcaaccgagagcagacacgccaggcaattatgaagcttaacggacatcagctggaaaatcacgctctgaaagtctcctacatcccagacgagcagattgctcaaggcccagaaaacggtagacggggaggctttggcagtcgcggacagcctagacaagggagcccagtggccgcaggtgcgcctgcaaaacaacagcaagtcgatattcctctgcggctgcttgtccctactcagtacgtgggggctatcataggcaaggagggcgcaacaatcagaaatatcaccaaacagacgcagagcaaaattgacgtacaccgcaaggagaacgccggtgcagccgaaaaggccattagcgtgcactctacgcccgagggttgttcttctgcatgcaagatgattctagagataatgcacaaagaggcaaaggacacaaaaacagccgacgaagttcctctgaaaatcctggcacacaacaactttgtaggacgacttatcggaaaggagggcagaaatctaaaaaaagtggagcaggatactgaaaccaaaatcaccatttcctctctgcaggacctcaccctctacaaccctgagcggaccattacggtaaaaggtgccattgagaactgttgccgagccgaacaggaaattatgaaaaaggtgcgcgaggcatacgaaaacgacgttgcggctatgagtctgcagagccatttgattcctggtctgaacctcgctgccgtcggactgttccctgcaagcagctccgccgtgcctcctcctccttcgagcgttactggggcagccccttactcatctttcatgcaggcacctgaacaggagatggtccaggtcttcatccccgcacaggccgtcggtgctatcataggcaagaagggccagcacattaagcagctgtcacggtttgccagcgcttcaatcaagattgccccacctgagacgcccgactccaaggtgcgcatggttattatcacggggcctccagaagctcagtttaaagcacagggcagaatttatgggaaactgaaagaagaaaattttttcgggccaaaggaagaggtgaagctggagacgcacatcagggtgcccgcttccgcagcaggcagggtgattggaaagggagggaagaccgtgaacgaactccagaacctcacggcagccgaagtggtcgtcccacgggaccaaactccagacgagaacgatcaggtgattgtcaagattattggccacttttacgcttcccagatggcacagcgtaagattcgcgatatcctcgcacaggtcaaacagcagcaccagaagggtcagagtaaccaggctcaagcacgtcgaaaatag

SEQ ID NO: 226907 - DNA, 1317 bp, Artificial Sequence
  Description of Artificial Sequence: Synthetic coding sequence
atgaacaagctctacatcggaaacctgaatgagtcagtcaccccagccgatttggagaaggtttttgcagagcacaaaatttcttatagcggtcagttcctggttaaatcaggctacgcctttgtggattgccccgatgagcattgggcaatgaaagcaatagagacgttttctggaaaggtggagcttcagggaaaaagactggagattgagcacagtgtccccaagaagcagcgctcgcgaaaaatccagattagaaatattccaccacaattgagatgggaggtgctcgactcattgctcgctcaatatggcacagttgaaaactgcgagcaggtgaatactgaatctgagacagcagttgttaatgtaacctacagtaatcgggagcagacgaggcaggcggacgaagtacctttgaaaattctggcccataacaactttgtcgggaggctgattggcaaagagggaaggaacctgaagaaggtggaacaggacaccgagaccaaaataaccatctctagtctgcaggatcttactctgtataacccggagcggaccattacagtcaaaggcgcaatcgaaaattgctgccgcgcagagcaagaaatcatgaaaaaggttagagaggcctacgagaatgacgtagccgctatgtccctgcagtcacacttgatcccagggctcaaccttgctgcagtggggctgttcccagcaagttcctctgccgttcctccccctccaagctcagtaacgggcgcagccccatacagttcctttatgcaggccccagaacaagaaatggtccaggtgttcatacctgcccaggcagtaggtgctataatcggtaaaaaggggcagcacattaagcagctctccagatttgcgtctgcctccatcaagatcgcccctccagagacaccggactctaaggtccgcatggtcatcattaccggaccccctgaagcccaattcaaggcccagggacgaatctacggaaagcttaaggaagaaaacttttttggccctaaggaggaggttaagttagagactcacatccgggtcccggcatcagccgcaggaagggtcatcgggaaagggggtaaaaccgtgaatgagctacaaaacttgactgcggcagaagtggtcgtgccacgcgaccagacacccgatgaaaatgaccaggtcatcgtgaagatcattggccatttctatgccagtcagatggcacagagaaaaataagagacattctggctcaggtgaaacagcagcaccagaagggccagagcaaccaggctcaggccagaagaaaatag

SEQ ID NO: 226908 - DNA, 1671 bp, Artificial Sequence
  Description of Artificial Sequence: Synthetic coding sequence
atgatgaacaagctgtatatcgggaacctgagccctgctgtgactgcagacgatcttcgccagctgtttggggatagaaaactgcctctggccggacaagtgttgctaaaatctggctacgcatttgtagactaccccgaccagaactgggctattagggccatcgagaccttgtcggggaaagtggaactgcatggcaagattatggaggtcgactattcagtctccaaaaagctccgtagccgaaagatacagatccgcaacattcctccccatttacagtgggaagtgctggacggcttgctggcacagtacggcacagtggaaaatgtggagcaggttaacaccgacaccgagacagcggtggtcaatgtgacgtatgcaacacgcgaggaggccaagatagccatggagaaattgtcaggccatcagttcgaaaactattctttcaagatttcgtacatcccagacgaggaggtgtcttcaccatctccaccccagcgggcacaaaggggcgatcattccagccgagagcagggccacgctccgggagggaccagtcaggctcgccagatcgatttccccctgcgtattttggtccctactcagtttgtaggcgctatcataggtaaggaaggtcttactataaagaatatcactaagcagacccaatctcgcgtagatatacatcggaaggagaacagcggcgctgctgagaaaccagttactattcacgctacacccgaaggcacttcagaagcctgtcgtatgatcctggaaataatgcaaaaggaggctgatgaaacgaaactagcagaagagattcccctgaaaatcctagctcacaacggtctggtcgggagattgatcggaaaagagggcaggaatctcaagaaaattgaacatgagaccggcactaaaatcactataagctcgctccaagacctgtccatctataatcctgagcggacaatcacagtgaagggaacagtcgaggcgtgtgcctctgctgaaatcgagatcatgaaaaagctgagagaggcttttgagaacgacatgctggccgtcaatacacatagcggctacttttcaagtctttatccacaccaccaattcgggccattcccccatcatcacagttatcccgaacaggagatagtgaacctgttcattccgacccaggctgtgggtgcgatcatagggaagaaaggggcacacatcaagcagctggctaggttcgccggagctagcatcaaaatcgcacccgcagaggggccagatgtgagcgagcggatggttatcattaccggacctcccgaggctcagtttaaagcacaggggagaattttcggcaagcttaaggaagagaactttttcaatcctaaggaagaggtgaaactcgaagctcacatcagagtgccctccagtaccgcaggacgggtgatcggcaagggtggtaagacagttaatgagcttcagaacctgaccagtgcagaagtgatcgtgcctcgggaccagacccctgatgaaaacgaggaggtgatagtgcggatcattgggcatttttttgcaagccaaacagctcaaaggaagatccgtgaaatcgtgcagcaagtgaagcagcaggaacagaagtaccctcagggagtggcttcccaaagatcaaagtag

SEQ ID NO: 226909 - DNA, 1800 bp, Artificial Sequence
  Description of Artificial Sequence: Synthetic coding sequence
atgatgaataagctctacatcgggaacctgtcacccgcagtgacagcagatgatttgcggcagctgtttggagacaggaaacttccgctggccggacaggtactgctcaaatctggttacgcctttgtggattacccagatcaaaactgggctatacgagcaatagaaactctatccgggaaggtggaactgcacgggaagatcatggaggtggactattcagtgtctaagaaattacggagtcggaagatccagatccggaatataccaccccaccttcaatgggaagtactggacggcctgcttgcccaatacggaaccgtggagaacgttgagcaggtgaatacggataccgaaaccgctgtcgttaacgtcacctacgcaacccgcgaagaggctaaaatcgccatggagaagcttagtggacaccaattcgaaaattatagtttcaagatttcctacatacctgacgaggaggtgagtagtcctagcccaccacagcgagcacagcgtggcgatcattcttcgagagagcagggacatgctcccggtggtacctcacaggccaggcaaatagacttccccctgcggattctggtacctactcagtttgtgggggcaatcattgggaaagaaggcctgacaattaagaatatcaccaagcagactcagtctcgtgtggacatacatcggaaggagaacagcggcgctgccgagaagccagtgactattcatgctacccccgaagggactagcgaagcctgtcgtatgattctagaaatcatgcaaaaggaagctgatgagacgaagctggcagaggaaatcccactgaaaattctggcacacaacggtctggtcggacgcctgatcgggaaagagggccgaaacctgaagaagattgagcacgaaacgggaactaaaatcacaattagcagtctccaagatctatcaatctataacccagagcggacaattactgtgaaggggaccgtcgaagcatgtgcttccgccgagattgaaatcatgaagaagctcagggaggcttttgagaatgacatgctcgccgtgaatcaacaagccaacttgattccgggtcttaacctgtcggccctcgggattttctctacaggactcagcgtcctctcaccccctgcgggaccacgcggagcacctccagcagcgccttaccatccctttacaacgcactccggctacttctcatcactttaccctcaccatcagttcgggcctttcccacatcatcattcttatcctgagcaagagattgtgaatctctttatccctacacaggccgtgggcgctattatcggcaaaaagggggctcacatcaaacagttggccagatttgcaggcgcatcaattaagattgcacctgctgagggcccagatgtatccgagcggatggtaatcattactggacccccagaggcacagtttaaggctcagggtaggatcttcggaaaattgaaagaggaaaatttctttaatcccaaagaagaagtgaagctggaggcacatatcagggtacccagctctacagctgggagagtgattggtaagggaggcaagactgttaacgaattgcagaatctgacctcagctgaggtgattgttccgagggaccagacccctgacgaaaatgaagaggtcattgtccggattataggacacttttttgcctcgcaaaccgctcaaagaaaaatacgtgaaatagttcagcaggtcaagcagcaggaacagaaatacccacagggtgtagcaagtcaacgtagcaagtag

SEQ ID NO: 226910 - DNA, 1629 bp, Artificial Sequence
  Description of Artificial Sequence: Synthetic coding sequence
atgtttagttgtcctggacactatcatgtggatgggttcctgaatcctggcagtcggaagatccagattcgcaacattcctccccacctgcaatgggaggtgctcgatggcctcctggcccagtacggcacagtggagaatgttgaacaggttttcgcctttagcctggtgaataccgataccgaaacagctgtcgtgaatgtcacctatgctacccgggaggaagctaaaattgccatggagaaactgtcggggcatcagtttgaaaactacagctttaagatctcatatatcccagatgaggaggtgtcgagcccaagccctccacagcgtgctcagagaggcgaccactcatcccgtgaacaggggcatgcccctgggggtacgagccaggcacgccagattgacttccccttgaggatcttggttcccactcaattcgtgggcgcaatcatcggcaaggaggggcttacgatcaaaaacattacaaaacaaacacaatccagagtagacattcaccggaaggaaaatagtggagcagccgagaagcccgttactattcacgccaccccagaaggcacgtctgaggcttgccgtatgatcctcgagattatgcaaaaggaggccgatgagactaagctggccgaggagatccccctgaaaattctggcgcataacggcttggttggtcggctgatcggcaaggaagggagaaacctgaagaaaatcgagcatgaaacaggcactaagattactatttcctctcttcaggatctcagtatttacaatccagaaagaactatcactgtgaaagggaccgtggaggcctgtgcatccgccgagattgagatcatgaaaaaactcagggaggccttcgagaacgacatgcttgctgtcaatcagcaagctaacctcattcctggcctgaatctgagcgcgctggggatattctctacaggcctttctgtcttgagcccacctgcaggcccaagaggcgcacccccagccgcaccctatcaccctttcacaacacattcaggctacttctcatctctgtacccccaccatcagtttggaccgttcccgcaccatcattcttacccagaacaggaaatcgtgaatctcttcattcccacccaggctgtcggagctataattggcaagaagggcgctcacattaagcagctggcacgctttgcgggtgccagtattaagatcgctcctgcagagggaccagacgtctccgaaaggatggtgatcatcaccgggccaccagaggctcagtttaaggctcagggcaggatcttcgggaaactgaaggaagagaacttttttaatcctaaagaggaggtgaagctggaagcacatatcagagttccatcttccaccgccggacgtgtgattggcaagggtggtaagaccgtgaacgaacttcagaatttgactagtgctgaggtgatcgtccccagagaccagacaccagatgagaatgaggaggtgatcgttaggattataggtcatttttttgcctcccaaactgcccaacgtaaaattagggaaatcgtgcagcaggttaagcagcaagagcagaaatacccgcagggtgtggccagccaaaggagcaagtag

SEQ ID NO: 226911 - DNA, 1740 bp, Artificial Sequence
  Description of Artificial Sequence: Synthetic coding sequence
atgaacaagctgtacatagggaatctttcagaaaacgccgctcctagcgatctggagagcattttcaaggacgcgaagattccggtttcagggccatttttggtcaaaacaggatatgctttcgtggattgtcccgatgaaagctgggccctgaaggcaatagaagccctttctggcaaaatagaactgcatgggaaacctattgaagtcgaacacagtgtgcccaaacgacaacgcatccggaaactgcaaataagaaatatcccccctcaccttcagtgggaagtcctggacagcctgctggtgcaatacggggtcgtggagtcgtgcgagcaggttaatacagactccgaaacagctgtcgttaatgtgacatattcatcaaaagaccaggcacgccaggcactggacaaactgaatggattccagcttgaaaatttcactctgaaagtggcttatatacccgatgagatggcggcacagcagaatccgctgcagcaaccgagggggagacgaggtctggggcagcggggaagcagtcggcaggggtcccctggcagtgtaagcaagcagaagccctgtgatcttcccctgcggctactcgtccccactcagtttgtcggagccataatcggcaaagagggggctacaataagaaatataactaaacagactcagagcaagattgatgtacaccggaaagaaaacgccggagcagccgaaaagtcaattactatcctaagcacacccgaggggaccagcgcagcatgtaagtctatcttggagattatgcacaaggaagctcaagatataaaatttacggaagagatcccactcaagatcttggctcacaacaatttcgtaggccgtcttatcggaaaagagggtcggaatctcaagaagatcgaacaggacactgatacgaagattacgatctctcccctgcaggaactgactctttacaaccccgagcgtaccatcactgtaaagggtaatgtggagacttgcgctaaggctgaggaggagattatgaagaaaatcagagaatcctacgagaacgacatcgccagcatgaacctccaagcacacctaatcccaggcctaaatctgaacgcactgggcctgttcccaccaacctcaggcatgccgccaccaactagtgggccacccagtgctatgacgcccccttatcctcagtttgagcaaagcgaaaccgagaccgtgcaccttttcatcccggcactgtctgtaggcgctatcatcggaaagcagggccagcacatcaagcaactctctcgatttgccggtgcgagtataaagatcgcccctgccgaggcacccgacgctaaagtcaggatggtaatcattactgggcctccggaagcccagtttaaagcccagggacggatctatgggaaaatcaaggaggaaaatttcgtatcacctaaagaggaggtcaaactcgaggctcatattagggtacccagcttcgcagcaggcagggtcatcggaaaaggcggaaagactgttaacgagcttcagaatctatctagcgctgaagtggtggtccctcgagatcagacacccgacgagaatgatcaggtggtcgtgaagatcacagggcatttctacgcctgtcaagtcgctcagaggaagatacaagagatcctgacacaggtgaaacaacaccagcaacaaaaggcccttcaatccggtcctcctcagtcgagacggaagtag

SEQ ID NO: 226912 - DNA, 7475 bp, Artificial Sequence
  Description of Artificial Sequence: Synthetic coding sequence
atgggtgccgctgccggacgttccccacacctggggcctgcaccagctaggaggccccaacgtagtctgttactgctacaattactgctgttggtcgccgcaccgggtagtacacaggcccaggcagccccatttcccgagctgtgtagttatacctgggaggccgtggacactaaaaacaatgttctgtacaagattaatatctgcggatccgttgacattgtccaatgcggaccatctagtgccgtttgcatgcacgacctgaagacacgcacttaccacagcgtcggtgactccgtcctgagaagtgccacacgctctctgctggagtttaatactaccgttagttgtgatcagcaggggacaaaccacagagtccagtcttctatcgctttcctgtgcggcaaaaccctgggaacacctgagttcgtgacggctaccgaatgcgttcattacttcgaatggagaacaaccgctgcatgcaaaaaggacatctttaaggcaaataaggaagtgccctgttacgtctttgatgaggagcttcgcaaacacgacctcaaccctctgattaaacttagcggcgcatacctggtcgatgatagtgatccggatacaagcctttttatcaatgtctgccgagatattgacacacttcgcgacccgggaagtcaactgcgggcatgtcccccagggaccgccgcatgtctggtcagggggcaccaggcctttgacgtcggacagccacgcgatgggttgaagctggtcagaaaggatagactggtgctctcatatgtccgtgaagaggctggtaagttggacttctgcgacgggcactcccccgcagtgactattacttttgtctgccctagcgagcgtcgagaaggtaccattcccaagctaacagcaaagagtaactgccggtacgagatcgaatggattacagagtacgcctgtcacagggactaccttgaatcgaagacgtgctctctgtcaggcgagcagcaagacgtttcaattgatcttacaccccttgcacagagtggcggttcttcctacatctccgacggcaaggagtatttattttacttaaacgtgtgtggggagaccgaaatacagttttgtaacaagaaacaagccgctgtgtgccaggtgaagaagtcagatactagccaggtaaaggccgcaggtagatatcacaaccagaccctgaggtacagtgatggggaccttaccctgatttatttcggaggtgatgaatgtagcagcgggtttcagagaatgagcgtgatcaatttcgagtgcaacaaaacagcaggcaatgacggcaagggcacaccagtttttaccggcgaggtcgactgcacatatttttttacgtgggatacggaatatgcatgcgtgaaggagaaggaagatcttctctgcggcgctaccgacggaaagaagcgctacgatctcagtgccctggtgcgccacgcggagccagagcagaactgggaagccgtcgatggcagtcaaaccgaaaccgagaaaaagcactttttcatcaatatctgtcaccgagttctccaggaaggcaaggcacgcggatgccctgaagacgccgcagtttgtgcggtggacaaaaatggttcgaagaacctgggcaagttcattagtagccctatgaaggagaagggaaacatccagctgtcatatagcgacggtgacgattgcggtcacggtaagaagataaagacaaacatcactctggtgtgtaagccaggtgatctggagtctgcaccagtgttgcgcactagtggggaaggtggatgcttttatgagttcgaatggcataccgcagccgcatgcgtgctatccaagacggaaggcgaaaattgcaccgtgtttgacagccaggccggtttctcatttgacctgagccccctgacaaaaaagaacggggcatataaggtagagacaaaaaagtatgatttttacatcaatgtttgcgggcctgtgtctgtcagcccatgtcaaccggattcgggagcctgtcaagtggcgaagtccgatgaaaaaacatggaatcttggtctctccaatgccaagctgtcatactacgacggtatgatccagttaaactatagggggggaacaccatacaacaacgaacggcacaccccacgcgctacgctgataacattcttgtgcgaccgggacgcgggagtggggtttccagagtaccaagaggaggataactccacctacaactttcgttggtatacttcgtacgcatgcccagaagaacctttggagtgtgttgtgactgacccctccacacttgaacagtacgatctctcatcgctggctaaaagcgagggagggctgggaggcaactggtacgccatggataacagcggcgagcacgtgacttggcggaagtactacattaatgtctgtagacctctgaatcccgtccccggttgtaaccggtacgcctctgcctgccaaatgaaatacgaaaaagaccagggatcttttaccgaggtggtgagcatctcaaatctgggcatggctaaaactgggcctgttgtagaagactccggtagtctgcttcttgaatatgtgaatggaagcgcgtgcaccacaagtgacggacgacaaactacatatacaacaagaatacacctggtgtgcagccgcggacgacttaattcccaccccatcttttctctgaactgggagtgcgtcgtgtccttcctgtggaatacggaagcggcttgccctatccaaactaccaccgatacagaccaagcttgtagcataagagatcctaatagtggcttcgtgttcaacctgaatcccctcaatagtagtcagggctacaacgtcagcggtataggtaagatcttcatgttcaacgtgtgtggcaccatgccagtgtgcgggacaatcctcggcaagcccgcatccgggtgcgaagctgagacacaaaccgaagaactcaagaattggaagcctgccaggcctgtgggaatcgaaaaaagtctacagctgtcaacagaaggttttataacgctgacatacaagggaccccttagcgctaagggcacagctgacgccttcatcgtgcgcttcgtgtgcaacgacgatgtttattccgggcctctgaaattcttgcatcaagatattgatagtggacagggaatccggaatacgtacttcgaatttgaaaccgcattggcttgtgtcccctctcctgtggattgccaagtgaccgatctggccggtaacgagtatgatttaaccgggcttagcactgtcaggaagccctggactgccgtcgatacatccgtcgacggacgcaaacgcactttctatctgagtgtctgcaatcctctaccttacatccccggatgccaaggaagtgctgtcggcagctgcctggtgagcgagggcaactcatggaacctgggtgtcgtgcagatgagcccacaggcagccgcaaacggatcattgtccatcatgtatgtgaacggcgataaatgtggcaatcagcgcttctccacccggattacgttcgagtgtgctcagatttcaggatccccggcttttcagctacaggacggctgcgagtacgttttcatttggcgcactgtagaagcatgtccagtggttagagtggagggagataactgtgaggtgaaggatcccaggcatggcaacctctatgatcttaagcccctggggctcaacgataccattgtctccgccggtgaatacacctactatttccgcgtgtgtggaaagctgtcaagtgatgtgtgtcctacatctgacaaaagcaaggtcgtgagctcatgtcaggaaaaaagagagcctcagggattccacaaagttgcaggattgctcactcagaaattgacgtatgagaatgggctgctgaaaatgaacttcaccggtggagatacgtgccataaggtctaccaacggtccacagcaatattcttttattgcgaccgaggcacccaacgtccggtctttctcaaagaaaccagtgactgtagctacctcttcgagtggcgaacccaatacgcttgccccccatttgacctgacagaatgttcttttaaggatggagcagggaacagcttcgatctgtccagcttgtcaaggtattctgacaactgggaagctatcaccggtaccggcgatcctgaacactacttaatcaatgtctgtaagtccctggccccacaggccggtactgaaccttgcccaccagaagccgcagcttgcctgcttgggggatcaaagccagtcaacctgggccgagtacgcgatggtccgcagtggcgtgatggtattattgtgcttaagtacgttgacggtgatctctgtcccgatggcatccgcaaaaagagtaccaccattcgtttcacatgtagcgaaagccaggtgaattcccgtcccatgtttatatctgccgtcgaggattgtgaatacactttcgcttggcctacagccaccgcctgcccaatgaagagcaacgaacacgatgattgccaagttaccaatcccagtaccggacacttattcgacctgtcatcacttagcggcagagccggattcacagctgcttacagcgagaaagggctggtttatatgtctatctgtggcgaaaacgagaattgcccccctggggtcggcgcatgttttggccaaacccggatttctgtcggcaaggcaaacaagaggcttagatacgtcgaccaggtgctacagcttgtgtacaaggacggctcaccatgtccttccaaaagcgggctgtcttataaatctgtgatctcgtttgtctgtaggccagaagctcgcccaacaaaccggccaatgttaatctccctcgataagcaaacttgtaccttgttcttcagctggcacactccattggcctgtgaacaggccacggaatgttcagtgaggaatggctcttccattgtggacctgagcccactgattcacagaactggtgggtacgaagcttatgacgagtcagaagacgatgcctctgacacaaaccctgacttttatattaatatctgccagcccctgaatcccatgcatggcgttccctgtcccgcaggtgcagctgtgtgcaaggtgcctattgacggcccacctatcgatattgggcgtgtcgccggacccccaattctcaacccgatcgctaatgaaatctatctgaattttgagtcctccacaccttgtcttgccgacaaacactttaactacacctctctcattgctttccattgtaagcgtggtgttagcatgggtacccccaagctgctgaggacctcagaatgcgattttgtgtttgaatgggaaactcccgtcgtctgtccagacgaggtccgcatggacggttgtacccttacagatgagcagctgttgtatagcttcaacctctcctcactctccacaagcacttttaaggtgacacgtgactcaaggacctatagcgtgggcgtctgcaccttcgcggtgggaccggagcaaggagggtgtaaagatggcggagtctgcctattgagcgggacaaaaggggcttctttcggaagactgcagtcaatgaaactcgattaccgccaccaagacgaagcagtggttctctcttacgttaatggcgataggtgtcccccagaaaccgatgatggggttccctgcgtctttccattcattttcaatggaaaatcatacgaggagtgtattatcgaaagcagggctaagctctggtgtagcaccacagccgactatgacagagatcacgagtggggattctgcagacactcgaactcatatcgtacgtcctcgataatcttcaagtgtgacgaggacgaagacattggcaggcctcaagtgttctccgaagtccgcggttgcgatgtgacctttgaatggaaaactaaagttgtgtgcccgcctaagaaactcgagtgtaaattcgttcagaagcataaaacttacgatcttcggcttctctcaagcctgacaggctcctggagcctggttcataacggcgtcagttactacatcaatctgtgtcagaaaatttataaggggcctctgggatgttccgaaagggcgtcgatctgccgcaggaccacaacgggagatgtccaagtacttggtcttgtgcacacccagaaattgggtgtcatcggagacaaggtggtggtaacctattcaaagggatacccctgtggtggcaacaaaactgcctcttcagtcatcgaactgacgtgtacaaaaacagtgggccgacccgcttttaagcgctttgacatcgatagttgtacttactacttttcatgggattcccgggctgcatgtgccgtcaagccccaggaagtacaaatggttaacgggacaatcactaaccccatcaatggaaagtctttctctcttggtgatatatactttaagctattccgggcttcaggtgacatgcgcaccaacggggacaattatctttacgagatccaacttagcagcataacctcatctcggaacccagcatgctcaggagccaatatttgccaggtgaagccaaatgatcaacatttcagccggaaagtaggcacttctgataagactaagtactacctgcaggacggagacctggacgttgtgtttgcatcatcgagtaaatgcggtaaagataaaactaaatccgtttcttctacaatctttttccactgcgacccgctggtcgaggacggtattccggagttcagtcacgagactgcagattgtcagtacttgttcagctggtacacatcagccgtttgtcccttaggcgttggtttcgacagcgaaaatcctggagacgacgggcaaatgcacaagggactctcggagcgcagccaggctgtaggtgccgtgctgtcattacttctggtcgccctgacttgttgcttgcttgctcttctgctctacaagaaggagcgcagggagacagtcatttcaaaacttaccacatgttgccgccgaagtagcaacgtgtcctataagtattcaaaggtgaacaaggaagaggaaaccgatgagaatgagaccgagtggctgatggaggagattcaactgccaccacccaggcaggggaaggaaggacaagagaacggacatatcacaaccaaaagtgtgaaagccttatctagcctccacggcgacgaccaggactccgaggacgaggttttgacaattcccgaagtaaaggtacattcagggcgtggagccggtgccgagtcttctcaccccgttcggaatgcacagagtaacgctctgcaagagcgcgaagacgaccgtgtaggtctggtgcgcggtgagaaggcgcgtaagggcaaatcatcaagcgctcagcagaagacagtgagctccaccaaattggtctcctttcatgatgattcagacgaggatctgttacatatcta

SEQ ID NO: 226913 - DNA, 780 bp, Artificial Sequence
  Description of Artificial Sequence: Synthetic coding sequence
atgagtgaagtgcctgtggcaagagtatggctggtcttgttattgctaacagtccaggtcggagtcaccgctggagccccatggcagtgcgctccatgttcggccgaaaagttggccttatgcccacccgtgagcgcttcgtgcagcgaggtgacacgtagtgccggttgcgggtgctgccccatgtgcgccctgcctctgggtgccgcatgcggtgtggctacagcaaggtgcgctagaggactctcttgtagggccctgcccggtgaacagcaaccactgcacgctctgactcggggacagggcgcttgtgtacaggagtctgatgcgtccgccccacacgccgctgaagccggaagccccgagtctcccgagagcactgagattacagaggaggagttgctggataactttcacctcatggccccatcagaggaggatcattcaatactttgggacgcaatatcgacatacgacggttcaaaggccctgcacgttaccaatatcaagaagtggaaggaaccctgccgcattgaactttacagagtggtagaatcacttgcaaaggctcaggagacaagtggggaggaaattagcaagttttacttgcctaattgtaataagaatggattctatcattcccgccagtgcgaaacaagcatggacggcgaagccggtctgtgctggtgcgtctatccgtggaatgggaaacgaatcccaggatctccagaaattcggggtgatccaaactgccagatatatttcaacgttcaaaattag

SEQ ID NO: 226914 - DNA, 777 bp, Artificial Sequence
  Description of Artificial Sequence: Synthetic coding sequence
atgttaccgttatgcctcgtggccgctcttttgcttgctgccggtcccggtcccagtcttggggacgaagccatccactgtccgccttgctctgaagagaagcttgcccgttgtcgtccgccagtgggttgtgaagaactcgtgagggaacccggatgtgggtgctgcgccacctgcgcccttgggctgggaatgccatgcggcgtatacactcctagatgtggttccggcctgcgctgctatcctcctcgtggtgtcgaaaagccccttcatactctgatgcacggtcaaggcgtgtgcatggagttagcagagattgaggcgattcaggagtcactgcagcctagtgacaaagacgagggagatcatcctaacaacagtttctcaccctgcagtgcgcatgatcgtcggtgtcttcaaaaacatttcgccaagatacgggatagatccacctccggtgggaaaatgaaggtcaacggcgctccacgggaggacgcacgacctgtgcctcaagggagctgccagagcgagctgcaccgggctcttgagagacttgccgcaagtcagtctaggacgcatgaggatctctatattattcccatacctaattgcgaccgtaacggcaacttccacccgaaacaatgtcatcctgcgctagatggacaaaggggtaagtgctggtgcgtggacaggaagaccggagtcaaactgccaggcggactcgaaccaaagggtgagttggactgccaccagcttgcagatagtttccgagagtag

SEQ ID NO: 226915 - DNA, 477 bp, Artificial Sequence
  Description of Artificial Sequence: Synthetic coding sequence
atggagctggccgaaatagaagcaatacaggagtctttgcagccttccgacaaagacgagggcgaccacccgaataatagcttctccccttgcagcgcccacgaccggcgatgcctccaaaaacattttgcaaagatacgggataggagtacatcaggtggcaaaatgaaggtgaatggagcccctagagaagatgccaggccagttccacagggaagctgccagagtgaactccacagggctttggagagacttgcagcctctcagtcacggacccatgaagacctctacatcatacccatcccaaactgcgaccgcaacggcaattttcaccccaagcagtgccatccagctttggatggacagcgtggcaagtgctggtgtgtggaccgcaagacaggtgtgaaacttcccggaggcctcgaaccgaagggcgagctggattgtcatcaactcgccgatagcttcagggagtag

SEQ ID NO: 226916 - DNA, 849 bp, Artificial Sequence
  Description of Artificial Sequence: Synthetic coding sequence
atggagagaccatccctccgagccctcttgctgggtgccgctggcttactcctgctgcttttacccctctcaagcagtagcagttctgacacctgcgggccatgcgagccggcatcttgccctccccttccaccactcggttgcttgctgggcgagacgagagacgcctgcggatgctgtcccatgtgtgcccgtggtgaaggcgagccctgcgggggtggtggagccggaaggggatattgcgctccaggtatggagtgcgtgaaaagcaggaaaaggcggaaaggcaaagccggagctgccgcaggcggtccgggagtgagcggggtatgcgtatgcaagtcacggtatccagtatgtgggtctgacggaacaacgtacccttccggatgccaattacgcgctgcgtcccaaagagccgaatcccgcggagaaaaggcaatcactcaggtaagtaaggggacctgcgagcagggcccatccattgttacacctcctaaggatatttggaatgtaaccggggcacaggtgtatctaagttgcgaggtaattgggattcctacacccgtgctgatctggaataaagttaaacgaggccactacggtgtccaacgcacagaactgctcccaggcgacagggacaacctggcgattcaaaccagagggggaccagaaaaacatgaagttacagggtgggtgttagtgtctccgctgtcaaaggaggatgcgggtgagtacgaatgccacgcgtcgaattctcaggggcaggccagcgcatccgccaaaataaccgtggtcgacgcactgcacgagatcccggtcaaaaagggggagggcgcagagctatag

SEQ ID NO: 226917 - DNA, 840 bp, Artificial Sequence
  Description of Artificial Sequence: Synthetic coding sequence
atggaacggccatctctccgcgctctgcttttgggtgccgctggcttgctccttttgctgctgcctctctctagctccagcagctcggatacctgcggcccatgcgaacccgcttcttgccctcccctcccacccctgggctgcctcctgggtgaaactagagacgcttgtggctgttgcccaatgtgcgccaggggcgaaggagagccatgcgggggagggggtgccggtcgaggctattgcgctccagggatggagtgcgttaagtcaaggaagcgtaggaagggcaaggccggagcggctgctggtggacctggggtctcgggagtgtgcgtgtgtaagtctaggtacccggtgtgcggatccgacggcactacctatccctcaggctgccaactgcgagcagcttcacagcgagccgaatctcgtggcgagaaagccatcacacaggtgtcaaaaggtacctgcgagcagggtccctctattgtaaccccgcctaaggatatctggaacgtgacaggagcccaggtgtacctgtcgtgtgaggttatcggaattcctactcctgtgctaatatggaacaaggtgaaaagggggcactatggggtccagaggactgaactgcttccaggagacagagacaaccttgccatccagacaaggggaggcccagaaaagcacgaagtgacaggctgggttcttgtgagccctctctccaaagaagacgccggagagtacgagtgtcatgcatctaactcccaagggcaagcaagtgctagtgccaagatcacggtcgttgatgccctgcacgagatacccgtcaaaaagggcacccaatag

SEQ ID NO: 226918 - DNA, 393 bp, Artificial Sequence
  Description of Artificial Sequence: Synthetic coding sequence
atggagacacttggtgcactgctcgtactggaattcctgctgctctcccccgtcgaagctcagcaagccaccgagcacagactgaaaccatggttggtaggcctggcggcagtggtgggatttctgttcattgtctaccttgtgttactagctaacaggctctggtgctctaaggcacgcgctgaggacgaagaagagaccaccttccgcatggaaagcaacttatatcaggatcagagtgaagacaagcgcgaaaaaaaagaagcgaaggagaaggaggaaaaacgaaaaaaggaaaagaagaccgcaaaggagggagaatccaacctaggactggaccttgaggagaaggaaccgggtgatcacgagagggcaaagagtactgtgatgtag

SEQ ID NO: 226919 - DNA, 1932 bp, Artificial Sequence
  Description of Artificial Sequence: Synthetic coding sequence
atggccctgcgaaaagccggagatctggagcctcaatttactccggagagaagattcagactgtgttggtatcaggcccattcaggaagagctcttttgggcccacccccacaggccagccccccagccggtgggctcgcgctggccctcttgctgctgagctgggtcgccctgggaccacgatcattggaaggagctgatccgggtacccctggggaagctgagggaccagcctgtcccgctgcctgcgtctgtagctacgacgatgacgccgacgagctgagcgttttttgcagcagccgaaatctgacccggcttccagacggtgtgccgggtggaacacaggctctttggttggacgggaataatctctctagcgttcctcccgctgctttccagaatctttcctcactgggttttttgaacctccaggggggtcagctgggctctttggagccccaagcactcttgggtttagagaatctatgccacctccatctagaacgcaatcagctgcgaagccttgcattaggaacctttgcgcacacaccagcccttgctagtctggggctctccaacaaccggctctctcggttagaagacggattgtttgaaggactcggctctctgtgggacctgaatctcggttggaacagccttgcagtgctgccggacgctgcttttaggggactgggctctctcagggagctcgtcctcgccggtaacagactggcttacctccaaccagccctgtttagcggacttgccgagctccgcgaactcgacctctcgaggaatgccctacgtgccataaaagcgaacgtcttcgtgcagctgccaaggctacagaagctctatctggaccgcaacttgatcgctgccgtggcacccggagccttcctgggcctcaaggcactccgctggctagacctcagccacaatcgggtggccggacttttggaggacacattccctggactgctaggtctcagggtgctacggttgtcccacaacgctattgcgtctctgcgcccacggacatttaaagaccttcacttccttgaggagctccaacttggccacaataggatcaggcagctggcagagaggagcttcgagggtctagggcagctcgaagtgctaaccttggaccacaatcagctgcaggaagtcaaagcgggtgccttccttgggctaaccaacgtcgcggtgatgaacctgtccggtaattgtctgagaaacctgcccgagcaggtcttccgtgggctgggaaaattgcatagccttcatctggaaggtagctgcctaggccgaatacgtccccacacattcaccgggttgtctggcctgaggcggctgtttcttaaggataatggcctcgttggaatagaagaacagtctctgtggggtcttgcagaactcctagagctggatctgactagcaatcagttaacccacctgcctcaccgtctctttcaaggcctgggcaagttagaatatttactgctctctcggaatagattggctgagctccccgctgatgccctgggaccactgcagcgcgctttttggctggatgtttcacataataggctcgaagccctcccaaattccttgctggctccgctgggccgactcagatacttgtctctgcggaacaactcgctgcggaccttcaccccccagcctcccggtctggaacgtctgtggctcgagggcaatccctgggattgtggatgtccgctcaaggcccttcgggactttgcccttcagaacccatctgctgtcccgcgtttcgtgcaggctatctgtgaaggagatgattgtcaacccccagcgtacacctataataacatcacttgtgcaagtccacctgaagtcgttggactggatttgagagatttaagtgaggcccatttcgccccatgctag

SEQ ID NO: 226920 - DNA, 1533 bp, Artificial Sequence
  Description of Artificial Sequence: Synthetic coding sequence
atgcctcgcggtttcttagttaagcgaagtaagaagtcaacccccgtctcctatagggtgcgaggtggtgaggacggggatcgcgctcttttgttatcacccagttgcggcggagccagggctgagcccccagctccatcacccgttcctggccctctgcctcccccaccccctgctgagcgagcccacgcagccctcgctgctgccctcgcttgcgcacccggtccacagcctccgcctcaagggccacgagctgcgcacttcggtaaccccgaagcggcacaccccgctccactgtatagtccgacccgtcccgtatcacgcgaacatgagaagcataagtattttgaacggagttttaacctgggatcccctgtgagtgcagagagcttcccgacacctgctgcgttgctgggaggaggcggagggggtggcgcttctggcgctggaggcggaggtacatgcggaggagatcccctgctctttgcaccagctgaattgaagatgggcacagcattctccgccggagctgaggctgccagagggccagggccagggccacctctgccccctgctgcggctctaagaccaccaggaaagcgccctccccctccaacggctgctgagccccctgccaaggcggtcaaggccccaggcgcaaagaagcccaaggccatcaggaagctgcatttcgaagatgaggtgactacttctcccgtgctcggacttaaaatcaaagaaggtcctgtagaagcacctagagggagagctggcggagccgcaaggccactgggcgagttcatctgccagttgtgcaaggaggaatacgccgacccgtttgcccttgcacagcacaagtgttcaagaatagttagggtggaatacaggtgccccgaatgtgcaaaagtgttttcttgtcctgccaaccttgcgtctcatagacgctggcacaaaccacgacccgctccagccgctgcccgtgcccctgagccggaggccgctgccagagcagaagcacgtgaggctcccggaggcggaagcgacagggatacaccttcccctggcggtgtgtctgagtcgggctctgaggatggtctctacgagtgccatcactgcgctaaaaagtttagaaggcaggcctatctgaggaagcacctgctcgctcaccaccaggccctgcaggccaagggggcacccctggccccacctgccgaggacctgttagccctctatcctggtcccgacgaaaaggctccccaggaggctgcgggtgatggcgagggagccggagtccttgggttatcagcttctgcagagtgtcacttgtgcccggtgtgtggggagtcttttgcaagtaaaggggctcaggaaagacacctcagactgcttcatgctgctcaggtatttccgtgcaagtattgccccgcaactttttactcttcaccgggactcacccgccacattaacaaatgtcatccttctgaaaatcgccaagtaatactactccaggtccccgtgagacccgcatgttag

SEQ ID NO: 226921 - DNA, 1701 bp, Artificial Sequence
  Description of Artificial Sequence: Synthetic coding sequence
atgccacgagggtttttggttaaacgtacaaaaaggacaggtggtctgtatagggtgaggcttgccgaaagggttttccccctcctcgggccacagggagctcccccattccttgaggaagccccaagtgcctctctgccaggcgcagaacgggcaacgccgccaactcgtgaggaacctggcaaaggactcactgccgaagcagcccgagaacagagtggctctccctgcagggctgctggtgtgagtccaggaactggcggaagggagggtgccgagtggcgcgctggcggtcgagaaggacccggtccatctccatccccgagcccctcgccagccaagccagctggggcagaactgcgccgtgcctttctcgaaagatgtctgtcaagccccgtgtccgccgagtcgttcccaggtggcgctgctgccgtggctgctttctcctgctctgtggcccctgccgctgcacccacccctggggaacagtttcttctgcctttgcgggctccattccccgaacctgccctgcagcccgaccccgcacctctgagcgcggcactgcaaagccttaagcgagcagccggaggcgagcgcagaggcaaagcacctacagattgcgcctcaggacccgcagctgcaggtattaagaagccgaaggcaatgcgcaagctctcctttgccgacgaagtcaccacatccccagtgctcggactcaagatcaaagaggaagaaccaggtgccccatctcgtgggttaggaggcagtcgaacacccctgggcgagttcatctgccaactgtgcaaagaacagtacgctgacccctttgctctagcccagcaccgatgtagcaggatcgttagggtcgagtacaggtgcccagagtgcgacaaagtcttttcatgcccggctaacttagcctctcaccgtcgatggcacaaaccaaggcccgcagctgccaatgccgctaccgtgtcgagcgcagacggtaagccaccctcttccagctcctcttcctccagagactcgggagccatcgcctccttcttggcagaggggaaagagaattcccgcattgaaagaacggcagaccaacatccacaggctcgcgacagctctggggctgaccaacatcctgatagcgcaccccgacagggactccaggtccttactcatccggaacccccactcccacagggaccatacacggaaggtgttctcggcaggcgagttccagtcccgggatctaccagtgggggtcgcggatcagagatctttgtctgcccttactgccataaaaagttcaggcgacaggcttacctgaggaagcatcttagcactcacgaagccggatcagcaagggccttagcccctgggtttggctccgaacgcggagcacccctggccttcgcctgtcctctctgcggagcccattttccaacagctgatattcgggagaaacacagactgtggcacgctgtgagagaggaactgctccttccggctttagctggcgctccacctgagaccagcggacctagtgggccaagtgatggaagtgctcaacagattttttcctgcaagcattgcccttccacttttttcagctctccgggtctaactcgccacataaacaaatgtcatccctccgagtccagacaggtcttgctgcttcagatgcccctgcgccctggatgttag

SEQ ID NO: 226922 - DNA, 792 bp, Artificial Sequence
  Description of Artificial Sequence: Synthetic coding sequence
atggtcaagatagcttttaacacccctacagctgtgcagaaggaagaagcgcgtcaggacgtggaggcgctgctctcccggaccgttagaacccagatactgactggcaaagagttgagggtggccacacaggagaaggagggatcttccggcaggtgtatgcttacgcttctcggcctgagctttatcctggctgggctcattgtcggcggagcttgtatttacaagtattttatgccaaagagcaccatttatcgcggagagatgtgcttcttcgatagcgaggacccagccaatagcttaaggggcggtgaacctaatttcctgccagtgaccgaagaagcagacatccgcgaagacgacaacattgccatcattgatgtgcccgtaccttccttttccgactctgatccagccgcaattattcacgactttgaaaagggaatgacagcctacctggatcttctactggggaattgctatctgatgccattaaacacgagcatagtaatgcctcccaaaaatttagtagaactgttcggcaagctggcgtccgggaggtatctgccacagacctatgtagtgagggaagatcttgtcgctgtggaggagattagagatgtgtcaaatttgggcatcttcatctatcagctgtgcaacaatcgtaagtcttttcggctgagaagacgggatctgttattgggcttcaacaaacgcgctattgataaatgttggaagatcaggcacttccccaacgagttcatcgtggagaccaagatatgtcaggagtag

SEQ ID NO: 226923 - DNA, 660 bp, Artificial Sequence
  Description of Artificial Sequence: Synthetic coding sequence
atggtaaagatcgctttcaacacacccactgccgtgcagaaggaagaggcccgacaggatgtcgaggcactgctgagccggactgtgcggacacagattctaaccggcaagagcacgatctatcgaggcgaaatgtgtttcttcgattctgaggacccagccaactctctgcggggaggcgaacccaactttctcccagtgactgaggaggcagacattagagaagacgacaatatagccattattgacgtgcccgtgccctccttctccgatagtgacccggctgcaatcattcacgacttcgagaaaggaatgaccgcctatctggatctgctcctggggaattgctacctgatgcctctgaatacctcaattgtgatgcctcctaagaatctggttgagctattcggcaaactcgcctctggcagatatctgcctcagacatacgtggttcgcgaagacctagtagctgtcgaggaaatcagggatgtctccaacttgggtatattcatttatcaactctgtaacaacaggaaaagctttaggctgaggaggcgtgaccttttattagggttcaataaacgcgctatcgataaatgctggaaaatcaggcactttcctaatgagttcattgtggaaaccaagatttgccaggaatag

SEQ ID NO: 226924 - DNA, 801 bp, Artificial Sequence
  Description of Artificial Sequence: Synthetic coding sequence
atggttaaggtcacttttaattctgcattggcacaaaaggaggccaagaaggacgaacccaagagtggcgaagaagccctgataattccacctgatgccgtggcggttgattgcaaggatccagatgatgtagtgcctgttgggcagcggagagcctggtgttggtgcatgtgtttcggacttgcgttcatgcttgctggtgttatcctgggtggagcctacctgtataagtatttcgccctgcagcccgatgacgtatattattgtggcatcaaatatattaaggacgatgtgattcttaacgagcccagcgcagatgcccctgccgcactgtaccagactatagaggagaatattaaaatttttgaagaggaagaggtggaatttatcagcgttcccgtacccgaatttgccgattccgatcccgcaaacatagttcacgatttcaacaagaagctgaccgcttacctggatctgaatttagataaatgctatgttatcccactgaacacatccattgtcatgcctcccagaaacctgttagaacttcttataaacataaaagctggcacctatcttccccagtcctatctgatccacgagcatatggtgataacagacagaattgaaaacattgatcatctggggttcttcatctaccgtctgtgccatgacaaggagacttataaactccagaggagagaaaccattaaagggatccagaagagggaggcttccaattgctttgctatcagacattttgaaaacaagtttgcagtcgagaccctaatctgctcctag

SEQ ID NO: 226925 - DNA, 693 bp, Artificial Sequence
  Description of Artificial Sequence: Synthetic coding sequence
atggtgaaaatcagtttccagcctgctgtcgcaggcattaagggggataaggctgacaaggctagtgcctccgctccagctcctgcctcagccactgaaatccttctcacacctgcacgggaagaacagccccctcagcatagatcaaaacggggaggctctgtgggtggagtgtgctacctgtctatgggtatggtcgtgttgctgatggggctggtgtttgcgtcggtgtacatttacaggtacttcttcctcgcacagctggctcgtgataactttttccggtgtggcgtactgtacgaagactcactcagttcccaggtccggacccagatggaactcgaggaagacgtgaaaatctacctggatgaaaactacgaacggattaacgttcctgtgccacagttcggaggaggtgaccccgcagacatcatccacgactttcaacggcgaggaacgtacttgccacagacctacattatccaagaagaaatggtagtaacagaacacgtgtccgacaaggaagccctcggctcatttatctatcacctgtgcaacgggaaggatacctacaggttgagacgcagggccacaagaagacggattaataagcgcggtgccaaaaattgtaatgctattagacacttcgagaacacctttgtggtggagacactaatttgcggcgtcgtatag

SEQ ID NO: 226926 - DNA, 804 bp, Artificial Sequence
  Description of Artificial Sequence: Synthetic coding sequence
atggtgaagatttcctttcagccagccgtggcaggaatcaaaggggacaaggcggataaagccagcgcatccgctccagcacctgcctcagctacggaaattctcctgacccctgccagagaggaacaaccaccccagcacagaagtaaacggggaggatccgtcggcggagtgtgctacctctccatgggcatggtggtcttacttatggggctggtgtttgcttcagtgtatatttacaggtatttctttctcgcacagctggccagggataattttttcaggtgtggggtcttgtatgaggatagcctatcctcccaggtacggacccagatggaacttgaggaggacgtcaagatttatctggacgagaattacgagcgaattaacgtgccagtgccccagttcgggggaggcgatccagccgatataattcatgattttcagcggggtctgacagcttaccacgacataagcctggataagtgttatgtcatagagctgaatactaccattgtcctgcccccacggaatttttgggaactcctgatgaatgtgaagcggggtacatatcttcctcagacatacattatccaagaggagatggttgtgaccgagcatgtgagtgacaaagaggcactgggctcctttatctaccatttgtgtaatggcaaggatacatatcggctaaggcgcagagcaactcgaagaagaattaataagaggggagctaaaaactgtaatgccattcggcactttgaaaacacattcgttgtggaaacgctcatttgtggcgtcgtctag

SEQ ID NO: 226927 - DNA, 663 bp, Artificial Sequence
  Description of Artificial Sequence: Synthetic coding sequence
atggtcaaaatatcctttcaacccgcagttgctgggatcaagggcgacaaggccgataaagcctccgcttcagctcctgccccagctagtgccacagaaattctcctaacccccgctcggctcgcaagggataactttttcagatgtggcgttctgtatgaggattccctgtcaagccaggttcggacccagatggagctggaagaggacgttaaaatctatctagatgagaactacgaaaggatcaatgtgccagtcccacaattcggcggaggggaccccgcagatatcatccatgatttccaaagaggcctcaccgcctaccacgatatatcactagacaagtgttacgtgatcgagctgaacaccacgatagtactccccccaagaaacttctgggaattgctgatgaacgtaaagagagggacctatctgccacagacttacatcattcaggaggagatggtagtgactgagcacgtctcagacaaagaggctctcgggtcattcatctatcatctgtgcaacggtaaagacacataccgtctgagacgcagggccactcgccgtagaataaacaagaggggagccaaaaactgcaacgctatcaggcatttcgagaatacctttgtggtggagacgctcatctgcggcgtggtatag

SEQ ID NO: 226928 - DNA, 543 bp, Artificial Sequence
  Description of Artificial Sequence: Synthetic coding sequence
atggttaagatttcttttcagcctgctgtcgcgggtatcaagggagacaaagcggacaaggcttcagcttctgctccggctcccgcttcggcaactgaaatcttactgaccccagcgagagaagagcaaccccctcagcataggtcaaaacgtgggggaagcgtaggcggagtgtgctacctttctatgggcatggtggttctgctgatgggcctggtcttcgcttctgtctatatttaccgatatttctttctggcacagctcgcgcgagataactttttcaggtgcggcgtgttgtacgaggattcactcagctcacaagtgcgcacccagatggagcttgaggaggatgttaagatctaccttgatgagaactacgaaaggatcaatgtacctgtgccccagtttggcggaggagacccggctgatatcatacatgactttcagcggggactcacggcttaccacgacatatctctggacaagtgttacgttatagaactgaatactacaatcgtcttgccgcctcgtaacttctggtag

SEQ ID NO: 226929 - DNA, 1839 bp, Artificial Sequence
  Description of Artificial Sequence: Synthetic coding sequence
atggcggctgcaggaagacttccctccagttgggccttgttttcacctctgcttgcgggtttggctctgctgggcgtcggtccagtccctgccagagccctacataatgtaactgctgaactgtttggcgcagaggcatgggggactttggcagcattcggggacttgaacagcgataaacaaactgaccttttcgtgttgagagagagaaatgacctgatcgtgttcctagcggaccagaacgccccatactttaaacctaaggtcaaggtttcgtttaagaatcatagcgcactgatcacgagcgtggtccccggagactatgacggtgacagccagatggatgtgttgttaacgtatttacctaagaactatgctaaaagcgaactcggggctgtcatcttttggggacagaatcagacactggatcccaataacatgacgatcctcaatcggacttttcaggacgaacccctgatcatggactttaacggcgatctcattcccgacatatttggtattacaaatgagagcaatcagccccagattctgctcggtggtaacctgagttggcaccccgcacttaccacaacaagcaagatgcggataccacacagccacgctttcatcgacttgaccgaggactttaccgccgatctcttcttgaccacactgaacgcaactaccagtactttccagttcgaaatctgggagaatctagatggtaactttagtgtctccacgattcttgagaagccacagaacatgatggtggtagggcagtccgcctttgcggacttcgatggagacggccacatggaccacctgctccccggttgtgaagacaagaattgtcagaagtcaacaatctatctggttcgttccggaatgaaacaatgggtaccagtgttgcaggactttagcaacaaaggaacactatggggatttgttcctttcgtggacgagcagcagccaacggagatccctatacccattacgctgcatatcggggattataatatggacgggtaccctgatgctctggtcattctaaagaacacctccggcagcaatcagcaagcatttttgctggagaacgtaccatgcaataacgctagctgcgaagaagcccgacggatgtttaaagtgtattgggaactcacagatctcaaccaaataaaagacgctatggtcgccaccttcttcgacatctatgaggacgggatccttgacatcgtggttctgagcaaaggatataccaaaaacgacttcgccattcacacattgaaaaataattttgaggccgacgcatacttcgtgaaggttattgtactgagcggcctatgctctaatgattgtccacggaaaattacccccttcggcgtgaatcagccaggcccatacatcatgtatactactgttgatgcaaatggatatctcaagaatggttccgcagggcaactatctcaaagtgctcaccttgctctacagttaccttacaatgtgttaggcttggggagatccgctaacttcctcgaccacctttatgtagggatacctcgccctagcggagagaagtcaataagaaaacaagaatggacggctatcattcctaatagtcagttgattgtgatcccctatccccacaatgttccccgttcttggtccgcgaaactgtatttaaccccctccaatattgtcctcctgaccgctattgccctcattggtgtttgtgttttcatcttggctatcatcgggatcctccattggcaggagaagaaagccgatgatagagaaaagcgccaggaggcccatagatttcattttgatgcaatgtag

SEQ ID NO: 226930 - DNA, 819 bp, Artificial Sequence
  Description of Artificial Sequence: Synthetic coding sequence
atggatggatacccagatgctctggtaatcctcaaaaatacctctggaagcaaccagcaggcttttctcctggagaacgtcccctgcaacaacgcttcgtgcgaagaagccagacgtatgtttaaagtgtactgggagctgaccgatttgaaccagataaaggatgccatggtagctacttttttcgatatttacgaggacgggattctagacatagtagtactcagtaaaggctatactaagaacgacttcgccatacacaccctgaaaaacaattttgaagcagatgcatacttcgtcaaggtgatcgtcttatctggactatgctccaatgattgtccaagaaagattactccattcggggtaaatcaacctggcccttacatcatgtacacgactgtggacgcgaacggatatctgaagaacggctcagccggtcagttgagtcagtccgcacacctcgctctacagctgccatacaatgtcctggggctgggtcgctcagccaactttctggatcacctgtacgtgggtatcccacgaccctcaggtgaaaaatccatcaggaaacaggagtggacggcaataatcccaaatagccagctaatagtgattccgtatccacacaacgtcccacggtcatggagtgctaagttgtacttgactccctctaatatcgtcctcctgacggctattgctctgattggggtatgtgtcttcatattagcaataataggaatcctgcactggcaggaaaaaaaggccgatgacagggagaaacgacaggaggcccatcggttccacttcgatgccatgtag

SEQ ID NO: 226931 - DNA, 1074 bp, Artificial Sequence
  Description of Artificial Sequence: Synthetic coding sequence
atgatggtggtgggtcaatcagcttttgctgatttcgatggagacggccacatggaccacctgctcccagggtgtgaggacaagaactgtcagaagagcactatttatcttgttaggtctggaatgaagcagtgggtgcccgtgctgcaagacttttccaataaaggcacgctctggggcttcgttccctttgtggacgaacagcagccaaccgaaatcccaatccccataacccttcatattggcgattacaatatggacggataccccgacgccctggttatcctgaaaaacacttccggaagtaatcagcaagcttttctgcttgagaatgtgccatgcaacaatgcgagttgcgaagaggcgaggcgtatgtttaaagtgtattgggaactgacagatttaaaccaaattaaggatgcgatggtggccaccttcttcgacatctacgaggacggaattctcgacattgttgtcctgagcaagggttacactaagaatgacttcgccattcatacacttaagaataattttgaggccgatgcttacttcgtaaaggtgattgtcctgagtggactgtgctccaacgactgccctcggaagatcaccccatttggtgtgaatcagcccggtccatacataatgtacacaactgtggacgcaaacgggtacctgaaaaatggatctgcaggccagctttcccaaagcgcacatcttgcccttcagttgccatacaatgtgcttgggttgggtagatccgctaactttctggaccatttgtatgtgggcattccacgccctagtggagaaaaatccatacggaaacaggagtggacagccatcattcctaactcacagcttatcgtgataccttacccacataatgtacccaggtcctggtcggctaaattatatctaacgccatccaatatcgtccttctcactgcaatagccttgatcggcgtctgtgtcttcatactggccatcattggaattctgcactggcaggaaaaaaaggcagatgacagggaaaaacggcaggaagcccataggtttcacttcgacgccatgtag

SEQ ID NO: 226932 - DNA, 1395 bp, Artificial Sequence
  Description of Artificial Sequence: Synthetic coding sequence
atggacgtcctcttaacttacctccctaaaaactacgccaaaagcgagctgggagctgttatattctgggggcaaaaccagaccctcgatccgaacaacatgacgatattgaaccggaccttccaggacgaaccactgatcatggacttcaatggtgatctgattccagatattttcgggataactaatgagagcaatcaacctcagatcctcctcggcggaaacttaagttggcaccccgctttgaccactaccagcaagatgcgaattccacatagtcacgcattcatagatctgacagaggacttcaccgccgacctgtttctcacaaccctcaacgccactactagtactttccaattcgagatttgggagaacctggatggcaacttcagcgtgtcaacaatcttggagaagcctcagaacatgatggtcgtggggcaaagcgccttcgccgattttgacggcgatgggcacatggaccacctgctgcccggatgtgaggataagaactgccaaaagtctacaatctacctggtgcggagcggaatgaagcagtgggtccccgtgctccaggacttctctaacaagggtaccctgtggggctttgtgccatttgtagatgagcagcagcctacagaaattcccataccaatcacattgcacataggcgactacaacatggatggttaccctgatgctttggtgattctgaaaaatacatctggttccaaccagcaggcctttctgctggaaaatgttccatgcaacaacgcatcatgtgaggaagcacgcagaatgttcaaggtgtactgggagctcacagacttgaatcagatcaaagacgccatggtcgcaacttttttcgacatctacgaagacggcattctggatattgtggtgctgagtaaggggtacacaaagaacgacttcgccattcatacactaaagaataacttcgaagctgatgcgtactttgtcaaggtaatcgtgctgtcgggcctatgttccaacgactgccccaggaaaattactcccttcggcgtgaaccagccgggaccttacataatgtatacaaccgtagatgccaacgggtacctaaagaatggatctgccggacaactttctcaatcagcccacttagccttacagctgccgtacaacgtactagggctgggacgcagtgctaattttctcgaccacctgtatgttggaatcccaagaccctccggagaaaaatccattcgaaagcaggagtggacagccatcatcccgaacagccagcttattgtcattccttaccctcataacgtgcctaggagttcccaccggtgcctgtgtttccatctagggaataactggcactttacgttggccggaaaagaaagccgatag

SEQ ID NO: 226933 - DNA, 1044 bp, Artificial Sequence
  Description of Artificial Sequence: Synthetic coding sequence
atgtccctactgtgcaggaataaaggttgtgggcagcacttcgaccctaacactaaccttcctgatagctgctgccaccacccaggcgtgccgattttccacgatgccctgaaaggctggtcttgttgccgtaagcggactgtcgatttctctgaatttttaaacattaaaggatgtaccatggggcctcactgcgccgaaaaactgcccgaagcccctcagcctgagggccctgccacatcctcaagcctacaggagcagaagcctctgaacgtcattccaaaatctgcggagacactaagacgtgagcgcccaaagagcgaacttcccctcaaactgcttcccctaaatatttcgcaggccctcgagatggctttagagcagaaagagctggaccaggaacccggtgcgggtttagactccctgatccgaaccgggtcctcctgccagaatcccggatgtgacgctgtataccaggggcctgaaagtgatgctacaccctgcacatatcatcccggtgccccacgattccacgaggggatgaaatcttggtcgtgttgcgggattcaaacactagacttcggagcctttctcgcgcagcccggatgtagggtcggcagacatgattgggggaagcagctgcccgctagttgcaggcacgactggcaccagaccgattctctggtcgtcgttacggtctatggtcagatccccttacccgctttcaattgggtaaaggcttctcagacagagctgcacgtccatatagtcttcgatggcaaccgggtgttccaggcacagatgaaactctggggagtcataaacgtagagcaaagcagcgtgttcctaatgccatctcgggtagagatcagtctggtcaaagccgatccgggatcatgggctcagctggagcacccagacgctctggcaaagaaagccagagcaggcgtggtactcgaaatggacgaagaggagagcgacgatagtgatgacgatctgtcctggaccgaggaggaagaggaggaagaggccatgggcgaatag

SEQ ID NO: 226934 - DNA, 990 bp, Artificial Sequence
  Description of Artificial Sequence: Synthetic coding sequence
atgtcgacggacagctgctgccaccaccctggagtgcccatcttccacgacgcgcttaaggggtggtcttgctgtcgcaagaggaccgtcgatttttccgagtttctgaatataaagggatgcactatgggaccacactgtgccgagaagttaccagaagcaccgcagccggaagggcctgcgacctctagctctcttcaggaacaaaaaccgctcaatgttatcccaaagagtgctgagacgctccgcagagagcgccctaaaagtgagttgccactgaagctactcccgttgaacatcagtcaagccctcgaaatggctttagaacaaaaggaactagatcaggaacccggtgcagggctcgatagccttatcagaactggttctagttgtcaaaatccaggatgcgacgccgtgtaccaggggcctgagtcagatgccaccccttgtacctatcatcctggtgcccctcgatttcacgagggaatgaagagctggtcctgctgcggtattcagacactggatttcggagcttttctagcacaaccaggctgtcgggttggacggcatgactggggcaagcagctgccagcatcctgtaggcacgattggcaccagacagattctctcgtggtggtcactgtgtacggccagatccctctacctgctttcaactgggtgaaagcttcccagaccgagctacatgtgcacattgtgttcgacggtaatagagtctttcaggctcaaatgaagctgtggggagtcatcaacgtggagcagtcctccgtatttctgatgcctagccgggtggaaatctccctcgtgaaagcagaccccggatcttgggctcagctcgagcatcccgacgctctggcaaaaaaagctcgggcaggggtcgtgctggaaatggatgaggaagagtccgacgacagcgatgacgaccttagctggaccgaggaggaggaggaagaagaggccatgggtgaatag

SEQ ID NO: 226935 - DNA, 603 bp, Artificial Sequence
  Description of Artificial Sequence: Synthetic coding sequence
atgttccgcaaaggcaagaagagacactcgtcatcctcctcacaaagtagcgagatcagcactaaatccaagtcagtagatagctccttagggggacttagccgaagttctacagtggcgtccctggacacagattctactaaatcatcaggccaaagtaacaataattcagatacatgcgccgaattccgcattaagtatgtgggcgcaatcgagaagctgaaactcagcgaggggaaaggcctggagggccctctggatctcattaactacatagacgttgcccagcaagacggcaagctccccttcgtgccaccggaggaagaattcattatgggcgtgtcaaagtatggcatcaaggtctccacctccgatcagtacgacgtgcttcaccggcacgcactctacctgattattcggatggtctgttatgacgatgggcttggtgcaggaaaaagtctgttagctttgaagactactgacgcgtccaacgaagagtactcgttatgggtctatcaatgtaattccctggagcaagcacaggctatctgtaaagtgttgtccactgccttcgactccgtcttgacatccgaaaagccgtag

SEQ ID NO: 226936 - DNA, 603 bp, Artificial Sequence
  Description of Artificial Sequence: Synthetic coding sequence
atgttccggaagggcaagaagagacattcgtcctcctctagtcagtcctctgaaatctctactaagtccaagtctgtggactccagcctgggtggacttagcaggagtagcactgttgcttccctggatacagacagcacaaaatcaagtggccagagtaataacaactccgatacatgtgcagagttcaggattaagtacgtgggtgcgatcgaaaaactcaagcttagcgaaggcaagggtttagagggacccctggaccttattaactatattgatgtggcacagcaagacggaaagcttccgttcgtgccacctgaggaggagtttataatgggcgtgtctaagtatggcatcaaggtgtcaacttccgatcaatacgatgttttacatcggcacgccttatacctgataatcagaatggtgtgctacgatgacggtttgggagccggaaagagcttgttggctctgaaaaccaccgatgctagtaacgaggagtactcgctttgggtgtatcaatgcaacagtctcgaacaggcccaggcaatctgcaaggtcctaagtacagcgtttgatagtgtactcacttcggaaaagccgtag

SEQ ID NO: 226937 - DNA, 255 bp, Artificial Sequence
  Description of Artificial Sequence: Synthetic coding sequence
atgttccggaaggggaaaaaacgacacagctcatcatccagccagtcttccgaaatttcgactaaaagtaaatcagtggacagcagcctcgggggacttagtcggtcaagcacagtagcctctctcgacaccgatagcaccaaatcctcaggccagtctaataacaatagtgatacgtgtgccgagttcaggatcaaatacgtaggggctatcgagaaattgaaactttccgaggggaagggcctcgagggctag

SEQ ID NO: 226938 - DNA, 291 bp, Artificial Sequence
  Description of Artificial Sequence: Synthetic coding sequence
atgttcaggaagggcaagaagcgccactcgtcatcctccagtcagagtagtgagatctctactaagtccaagagtgtcgattcaagtctggggggtctgtccaggtctagtactgtggcctctttggacaccgattctacaaaatccagcgggcagagtaataacaactcagacacttgcgctgaatttagaatcaagtacgtgggagccattgagaagcttaaactgtctgagggtaagggactcgagggtccactggacctcatcaactatattgatgttgcccagtag

SEQ ID NO: 226939 - DNA, 261 bp, Artificial Sequence
  Description of Artificial Sequence: Synthetic coding sequence
atgttcagaaagggcaaaaaacggcatagttctagctccagtcagtcttctgagatatccaccaaaagtaaatctgttgactcatccctcgggggtttgtctagatcatcaaccgtggctagcttagatactgactcgactaagagttcagggcagtccaacaataactccgatacgtgcgcggaatttagaattaagtacgttggagcgatcgagaagttgaagttgtccgaggggaagggactggaaggccctttatag

SEQ ID NO: 226940 - DNA, 411 bp, Artificial Sequence
  Description of Artificial Sequence: Synthetic coding sequence
atgttccgcaagggcaagaagcgtcactcatcttcatctagtcagagctccgagataagcaccaaatcaaaatccgtcgatagcagtttgggaggcctgagtcgcagcagtacagtggcctcattagatactgattctacaaagtccagcggacagtcaaacaacaactccgacacctgtgcagagtttcggattaagtatgtcggtgccatcgagaagctcaagctgtcagagggaaaaggcctggaagggccactcgacttgattaattacatcgatgtggcccagcaagacgggaaattgccctttgtgcctccggaagaagagtttattatgggagtgtccaaatacggcatcaaagttagcaccagcgaccaatatgatgtgctccaccgccacgccctgtactag

SEQ ID NO: 226941 - DNA, 345 bp, Artificial Sequence
  Description of Artificial Sequence: Synthetic coding sequence
atgttccgaaaaggcaagaagaggcatagctcttctagctctcagagctcagaaatctccaccaagtctaagtccgtagactcttccctgggtggtctgtctcgctcctctacggttgcatccctggataccgacagcaccaaatcttccggtcagtctaataataacagtgacacctgcgctgaattccgaattaagtacgtgggagccatcgagaaattgaaactgtctgaagggaagggacttgaggggcctctggaccttatcaactatatcgacgtggcccagcaggatggaaagctacccttcgtgccacccgaggaagagtttatcatgggagtgtag

SEQ ID NO: 226942 - DNA, 198 bp, Artificial Sequence
  Description of Artificial Sequence: Synthetic coding sequence
atgttccgcaaaggaaaaaagagacattcttccagcagctcacagagcagcgaaatttctactaagtctaaatccgtggactcttccctgggcggactctccaggtcatccaccgtggcctctctggacaccgattcgaccaagagcagtggccagtctaataacaactcggacacttgcgcggagtttaggatttag

SEQ ID NO: 226943 - DNA, 453 bp, Artificial Sequence
  Description of Artificial Sequence: Synthetic coding sequence
atgttcagaaaggggaaaaagaggcactcatccagtagctctcaaagttctgaaatcagcactaagtccaaaagcgtggatagtagcctcggcggtctgagtcgaagcagcactgtcgcctcattggatactgatagcacaaagtccagcggtcagagtaacaacaattcggacacctgtgccgagttcaggattaagtacgtcggcgctattgagaagcttaagctgagcgaggggaagggcctagagggcccattagaccttattaactacattgatgtggctcagcaggacggtaaactgcccttcgtcccgccagaggaggagttcatcatgggcgtcagtaagtacggcataaaggtgagtacatctgaccagtacgaacaggcccaggcgatttgcaaggttcttagcaccgcattcgattcagtgctaaccagcgaaaagccttag

SEQ ID NO: 226944 - DNA, 534 bp, Artificial Sequence
  Description of Artificial Sequence: Synthetic coding sequence
atgccagtcaagaggtctctgaagttagatggtctgcttgaggaaaacagcttcgacccatcaaaaatcacccgaaagaagagtgtgataacctacagccctacaactggcacctgccagatgtccttatttgcaagccccacatcctcggaggaacagaagcacaggaatgggctttctaatgaaaagaggaaaaagctgaatcacccttccctgaccgagagtaaagagtccaccacgaaggacaacgatgaatttatgatgctgttgtctaaggtggagaagctctctgaggaaatcatggagataatgcagaatctctctagtatccaggctttggaaggatctagggagttggagaatctcataggcatatcctgtgcttctcatttcctgaaacgcgagatgcagaagaccaaggaattaatgacaaaggtcaacaagcagaaactcttcgagaaatccaccggtttaccacacaaggcttctcgacatctggattcctacgaatttctgaaggccatcctgaattag

SEQ ID NO: 226945 - DNA, 513 bp, Artificial Sequence
  Description of Artificial Sequence: Synthetic coding sequence
atgcctgtcaaaaggagtcttaagctggacggacttcttgaagaaaactcgtttgacccatccaagattacaaggaagaaaagtgtcattacatattccccaaccaccggaacctgccaaatgagcttatttgccagccctacatcttctgaggagcagaaacaccgtaacgggctgtcaaatgaaaagagaaagaagctgaatcatccgagcctgaccgagtctaaagagtctacaacaaaagataatgacgagtttatgatgctgctctctaaggtcgaaaaattatccgaggagatcatggagattatgcagaatctgtccagtatccaggccctggaaggctcgcgagaacttgaaaatctgattggaatcagttgcgcttcccacttcctcaaacgcgaaatgcagaaaactaaggagcttatgactaaggtcaacaaacagaaactgttcgagaagtcaactggcctgcctcacaaaggccaacctcaaatgagccagcccctgtag

SEQ ID NO: 226946 - DNA, 651 bp, Artificial Sequence
  Description of Artificial Sequence: Synthetic coding sequence
atgcctttcgctcctgttgcccaggcccgagtccaatggcacgacttcaggtcgttgcagcatctcctaccggcattcaagcggtttagttgtctgtcactcggctcctcctgggattatagcgttaagcggagtcttaaattagacggactgcttgaggagaatagtttcgatcccagcaaaattacgagaaaaaagtccgtgatcacatacagccccaccacgggcacatgtcaaatgtctctatttgccagccctacctcctccgaggaacaaaagcacaggaatggactgtctaacgaaaaacgtaaaaaattaaaccatccaagtttgacagaaagcaaagagtcaaccacgaaagacaacgacgagtttatgatgcttctgagcaaagtcgagaagctgtcggaagaaatcatggaaattatgcagaaccttagcagcatccaagctctggaagggagtcgcgagctcgagaatctcatcggaataagctgcgccagccatttccttaaacgggaaatgcagaagacaaaagagctgatgacgaaggttaacaaacagaaattgttcgaaaagtccaccggactcccacacaaagccagccgacacctggattcttatgagtttttgaaagctatactaaactag

SEQ ID NO: 226947 - DNA, 3540 bp, Artificial Sequence
  Description of Artificial Sequence: Synthetic coding sequence
atggccccacggccaagagccagacctggcgtcgccgtagcctgctgctggctgcttaccgtagtgctccggtgctgcgtaagctttaatgttgatgtcaagaattcaatgacttttagtggcccagtggaagacatgttcggttataccgtgcaacaatatgagaatgaggagggcaaatgggtcttgatagggagtccgctggtcggacagcccaaaaacaggaccggtgatgtttataaatgtccagtggggcgaggagagagcctgccgtgtgtcaagttggacctccctgtgaatacgagtatcccaaacgtcaccgaggtgaaggagaatatgaccttcggcagcacgctggtgaccaatcccaatgggggatttctggcctgtggcccactatacgcctatcgctgcgggcacctccattacaccaccggaatctgttcggatgtatccccaacctttcaggtcgtgaacagtattgccccagttcaagagtgcagtacccaattagatattgtaattgtgctcgatggtagtaatagcatctacccttgggacagcgtcacggcatttcttaatgaccttctggagcggatggatataggtcctaaacagacccaggtgggtatcgtgcagtacggggagaacgtgacacatgaatttaacctgaacaaatattctagcacagaagaagtattggtggctgcaaagaaaatcgtgcagcgaggcggtcgacagacaatgactgccctggggattgatactgctcgtaaagaagccttcacggaggcccgaggagcaagacggggagtcaagaaggtaatggtgattgtcactgacggtgagtcccatgataatcacaggcttaagaaggtgattcaggattgtgaggatgaaaatattcagagattctccatcgctatattggggagttacaataggggcaatctgtctaccgaaaaattcgtggaagagattaaaagcatcgctagtgagcccactgagaaacacttttttaacgtctctgacgagttggctctcgtgacaatagtgaagaccctcggagagagaatcttcgctttagaggccacagctgatcagtcagccgctagtttcgagatggagatgagccagactggtttttcagcccactactcccaggactgggtcatgctgggcgctgtgggagcttacgactggaacggcacagttgtgatgcagaaggcttcacaaatcattattccccgtaatactacgttcaacgtggagagcaccaaaaagaatgagccgttggcgtcatacctgggatacactgttaactcagccacagcatcctccggagatgtgctctatattgctggacagcccagatacaatcacaccggccaggtgatcatctacaggatggaggatggtaacattaagattcttcagactctgagcggcgagcagatcggctcgtactttggctctatcttgacaactactgacatagacaaggatagcaacaccgacatcttattagtcggcgctcccatgtatatgggaactgaaaaagaggagcagggcaaggtctacgtttatgctctgaaccaaacaaggttcgagtatcagatgagtttggagcctatcaaacaaacttgctgttcttcgcggcagcacaacagctgtaccacggagaataagaacgaaccatgtggcgctcgcttcggtacggccattgccgctgtcaaggacctgaacctggatggttttaacgacatagtcatcggggctcctttggaggacgatcacggcggagccgtctatatttatcatgggtctggcaagacgatccgtaaggaatacgcacagcggattccgagcggtggcgatggtaagactctgaagttttttggacaatccattcacggagagatggacctgaacggtgacgggctaactgatgtaacaattggcggtctcggaggcgcagccctgttctggtcgagagacgttgctgtggtcaaagtcacaatgaatttcgagcccaataaagtcaacatccagaagaaaaactgtcatatggaaggcaaggaaactgtatgcattaacgccacggtgtgtttcgacgtgaagctgaaaagcaaggaggacaccatctatgaagctgacctgcaatatcgcgttaccctcgactcgctgcggcagattagtagatcgtttttttcaggcacccaagagagaaaggtgcaacgtaatattacagtcaggaaatctgagtgcacgaagcacagcttctatatgttggacaagcacgatttccaggactcagtcaggattactctggacttcaacctcacagaccctgagaatgggccagtgctagatgacagcctgcctaattctgttcacgaatatatccccttcgctaaggactgcggaaataaagaaaagtgtatatccgacctctccctgcatgttgctaccacagagaaggatctgctgattgtgaggagtcagaatgacaagttcaacgtgagcctgacagttaaaaatactaaagattccgcgtataatactaggactattgttcattactctccgaacctggtgttcagcggaatcgaagccatacaaaaggatagttgcgagtcgaatcataacattacttgcaaagtgggataccccttcctgcggcgaggtgagatggtgacctttaaaatcttgttccaatttaacactagttatctgatggagaacgttactatctatttgtcagctacttctgatagcgaggagccacctgagacactgtcggacaacgtggttaatatttcaatacctgtgaaatatgaggtgggtctgcagttttattcctccgctagcgaataccacatctccatcgcggctaacgagactgtccccgaggttataaattcaacggaggatatagggaacgagatcaacatattttatctaatcaggaaatccgggtcctttcccatgcccgaactgaagcttagcatctcttttcccaacatgacctcgaacggttaccctgtactttatccaacaggtctgagttcaagcgaaaatgctaattgcaggccgcatatcttcgaagacccattttcaataaattccggcaaaaagatgacaacaagtaccgatcatctgaagcgtggaacgatactcgactgcaatacatgtaagtttgctactattacctgtaatcttacatcttctgacataagtcaggtcaacgtgtcactgattttgtggaaacctaccttcataaagtcctacttcagctccttgaacctgacaatacgaggtgaacttcggagtgaaaatgccagcttggttctttccagcagtaaccaaaaacgcgagcttgccatccagataagcaaagacggcctgcctggacgggtgcccctctgggtgatactgctgagcgctttcgcgggattgctgctgctgatgttactaatcctagcactgtggaaaatcggattttttaagaggcctttaaagaagaagatggaaaagtag

SEQ ID NO: 226948 - DNA, 3567 bp, Artificial Sequence
  Description of Artificial Sequence: Synthetic coding sequence
atggacctgccccgaggcctagtggttgcatgggcactttccctttggcccggattcacggataccttcaacatggacacgcgcaagccgagggtgataccaggctcaagaaccgcctttttcggatatacagtacagcaacacgacataagcggtaacaagtggctggtggtcggcgctcccctcgagactaatggatatcagaaaaccggggacgtatataagtgccccgtgattcacggcaactgtaccaaactgaatctgggacgagtaactttgtccaatgtgtcagagcgcaaagacaatatgcggttgggtttatctcttgccaccaaccctaaggataactccttcctagcatgctcgcccctgtggtcgcacgaatgtggatcatcttattacactacaggcatgtgttcccgggtcaactcgaatttcagatttagtaagacagtggcgcctgcgctgcagaggtgccagacctatatggatatagtcattgtgcttgatggtagtaatagcatttacccgtgggtggaagtacagcacttccttatcaatatcctcaagaagttctatatcgggccaggccaaatccaagtgggcgttgtgcaatatggggaggacgttgtccacgaatttcatcttaatgactatagaagcgttaaggatgtcgttgaagccgcatctcatattgaacagagagggggaaccgagacgcgcactgccttcggcatcgagttcgcaaggtcagaagccttccaaaaaggaggacgaaagggagccaaaaaggtcatgatagtgatcacagatggggaatcacacgattctcccgatcttgagaaagtcattcagcagtctgaacgtgacaacgtcacccgctacgcggtggcggtgctggggtattataatcgcaggggaatcaatccagagacttttttgaatgaaatcaaatacatcgcctctgatccggatgacaaacactttttcaacgttactgatgaggccgctctgaaggatatcgtcgatgccttgggcgacaggattttcagcctggaggggaccaacaaaaatgagaccagcttcgggctggagatgagccaaaccggattttctagtcacgtggttgaggacggcgtgttgttaggagcggtcggtgcttacgattggaacggtgctgtgctcaaggagacctcagctggaaaagtgatccctctgcgtgaatcctacctgaaggagtttcccgaggagctaaaaaatcacggcgcataccttggatacacagttacttcagttgtctcaagtagacaaggtagggtttatgttgcaggggctcctagatttaaccacactggcaaggtcatcttgtttactatgcataataacagatctctgacaatacaccaggccatgagaggacagcaaattgggtcctattttggaagcgagatcacgagtgtagatatcgatggtgatggggtgaccgatgtcctcctcgtgggggctcccatgtactttaacgaaggaagagagcgaggtaaggtgtatgtgtatgaactcagacagaatctgtttgtgtacaacgggactttgaaagacagccactcctaccaaaacgcacgctttggcagtagtatagcctccgtcagggatctaaatcaggacagctacaacgatgtcgtggtgggggctcccctggaggataatcatgctggagcaatctacatatttcatgggttccgcggttccatcctgaaaacacctaagcagagaataaccgccagcgaactggctacaggcctacagtatttcggatgctctatccatggacagctcgatctcaatgaagacggactcatagaccttgcagtgggagcattgggcaacgcagtcattctctggtccaggcccgtggtgcagataaacgcttccctgcactttgagccctccaagattaacatcttccatagagattgtaagagatccgggcgtgacgccacctgcttagcagcatttttgtgttttacccccatcttccttgctccccacttccagacaaccacagtcggcataaggtacaacgctactatggatgaacggaggtatactcccagggcccacctggatgagggcggagacaggttcactaaccgtgccgtgttgctctcctccggtcaggagttatgcgagcgtattaacttccacgtccttgacactgccgactatgtgaaaccagtgactttcagtgtcgagtacagcctggaggacccagatcatgggccaatgctggatgacggttggcctaccaccctacgggttagcgttcccttctggaatggatgcaacgaggacgagcattgtgtgccagacctcgtgctcgacgccagaagtgacctgcctacagctatggaatactgccagcgcgtactgcggaaaccggctcaggactgcagcgcttatacgttgtccttcgacacaacggtatttattattgaatccaccaggcagagagttgccgtggaggccactcttgagaaccgaggcgaaaacgcctactccaccgtgctgaacatttcccaatctgctaatttgcagtttgcttctttaatccagaaggaggacagtgatggttctattgaatgcgtcaatgaagaacggagactccaaaagcaagtctgtaacgtctcctaccctttttttagggctaaagccaaagtggcattccgtctggattttgagttttcaaagtcaatctttctgcaccatctggagattgaactagcagccggatccgattccaatgaacgggattctaccaaggaagataacgtggctccactccgtttccacttgaagtacgaagctgacgtgctttttacccggagttcttcactgagtcattacgaagtgaaacccaattctagtctagaacgctatgatggcatcggccctcccttcagttgcatattccggatacagaatctcggcctattcccaatccatggcatgatgatgaagatcaccatccccattgccactaggagcggaaacagactgctgaagctccgcgatttcctaaccgacgaggcgaataccagctgcaacatttggggtaactcaactgagtaccgacccactcccgttgaagaggacctgaggcgcgcaccccagctgaaccattctaattcagacgtggtgagcattaattgtaatattagactggttccaaaccaggagattaacttccacttgctaggaaacctgtggctccggtcactgaaagcactcaagtataagtccatgaagattatggtgaatgccgctctgcaacgtcagtttcattctccttttatctttcgcgaagaagatcctagtagacagatcgtctttgaaatttcaaagcaagaagattggcaagtaccaatttggataattgtcggctccacacttggcggacttctcttgctggctctattggttcttgctctgtggaaactgggtttttttcggagcgctaggcgcagacgagagcccggactggaccccacacccaaagtattagaatag

SEQ ID NO: 226949 - DNA, 3570 bp, Artificial Sequence
  Description of Artificial Sequence: Synthetic coding sequence
atggacctccctagagggctggtcgtggcatgggccctgtcactgtggccgggtttcacggatacctttaatatggacacccgcaagccacgggttattcctggctcccggacggcgttttttggttatacagtgcagcagcacgacatatccggtaacaagtggttagttgtaggggctccactggaaaccaatggctaccagaaaacaggggacgtttataagtgtccggtcatccacgggaattgcaccaagctgaaccttggaagagtgacacttagtaatgtgagcgaacgcaaggataacatgcgcttagggctcagtctcgcaacaaaccctaaagacaactcctttctggcctgttccccactgtggtctcatgagtgcggatcctcctactacacaaccgggatgtgttctagagtcaatagcaattttcgcttttctaagaccgtggcccctgcactccagcgctgccagacgtacatggacatcgttatagtattagatggatctaattcaatctacccgtgggtggaagtccagcattttctgattaacattctgaagaagttttacatcggcccaggacagattcaggtaggagtcgtccaatatggagaggacgtggtccatgagtttcacttaaacgactatagatctgtgaaggatgtggtggaggccgctagccatatcgagcagcgaggaggcacagaaacccgcactgccttcggcattgagttcgctagatcagaagccttccagaaaggtggcaggaagggcgcaaaaaaggtgatgatcgtgatcacagatggcgagagccacgatagccctgatctcgagaaggttatccaacagtccgagcgtgataacgtgacacgatatgccgtcgcagtgcttggatattacaatagacgaggaattaatccagaaaccttcctcaacgagataaagtacatcgcttctgatccagatgataagcacttttttaatgtgaccgacgaagctgcgctgaaggacattgttgatgcccttggcgaccgtatcttcagtctcgaggggacaaacaagaacgagacctcttttggtctggagatgagccaaaccggcttttctagtcacgtggtggaagacggagtcttgctcggagctgttggtgcttatgactggaacggcgctgtgttgaaagagacctctgctggtaaagtcattccactgcgcgagagctatctcaaagaatttcctgaagaacttaaaaaccatggtgcgtacctcgggtacacggtgacaagcgtggtgagctctagacagggacgagtatacgtcgctggagccccacgctttaatcacactggcaaagtgatcctgttcacaatgcacaataacaggtccttaactattcatcaggcaatgaggggccagcagattggatcttactttggttcggaaataaccagcgttgacatcgatggcgatggggtgaccgatgtcctcctggtgggtgcaccaatgtatttcaacgagggtagggaacggggaaaggtgtatgtgtacgagctgaggcagaatctgtttgtgtacaacgggaccctcaaggattctcattcctaccaaaacgcacgcttcggtagcagcatcgcctccgtccgcgatttaaatcaggacagttataatgacgtggttgttggagcaccacttgaagacaatcacgctggcgctatctacatctttcacggctttcgcggttctatcctgaaaacccctaagcagagaatcacagcttctgaactggccacaggactacagtactttgggtgcagcatacatgggcagctggatctgaacgaagacggactgatcgacctggctgtgggggctctgggcaacgccgtgattctatggagccgacccgtcgtccagataaatgcatctctgcacttcgagccttccaagattaacatcttccatcgggactgtaaaaggtcaggtcgagacgctacctgcctggctgccttcctctgcttcaccccaatttttctggctccccactttcagaccactacagtaggcatccgctataatgccactatggatgaacggagatatactccaagagcccaccttgatgaaggcggagatcgttttacgaacagagcagtattgttatcctcgggccaggagctttgcgaaaggataaattttcacgtgctggataccgcagattacgtaaagcccgtgacctttagtgtggaatacagcctggaggatccagaccacggtcccatgttagatgatggctggccgaccaccctgcgggttagtgtccctttctggaacgggtgcaatgaagatgagcactgtgtgccggacttagttctcgatgcgagaagtgatttaccaacggctatggagtattgccagcgcgtgctccgaaaaccagctcaggactgcagtgcatacaccctttcatttgatacaactgtgtttattatagagagtaccaggcagagagttgctgttgaggctactctcgagaatcgaggtgagaatgcgtacagcaccgttctcaatatttcgcagagcgccaatttgcaatttgcttcgctcatccagaaagaagactcagatggaagcatcgaatgcgtgaatgaggaacgtcggttgcaaaagcaggtgtgcaacgtaagctatcctttctttcgggcaaaggccaaagttgcatttcgtctggatttcgagttctcgaagagtatatttctgcaccatctggagatcgagctggcagcgggaagtgactctaacgaacgtgattccaccaaagaagacaacgtggcacctctgcggttccatcttaagtatgaggctgacgttctgttcacgcggtcatctagcctgtcacattatgaggtgaagccaaacagttccttagaaaggtatgatggaatcggcccacctttttcctgcatatttagaattcagaatctgggccttttccctatccacggcatgatgatgaaaataactattccaatcgctacaagatccggcaatcggttgctgaagctgcgggatttccttacagacgaagtggccaacacttcctgcaacatttgggggaactcaaccgaatacagaccgacccctgttgaggaggatctgcgacgcgcaccgcagctgaaccattccaattcagacgttgtgtcaatcaattgcaacattagactggtccctaaccaggaaattaacttccatttgctcggcaatctgtggttgcgaagtctgaaagccctcaagtataagtccatgaaaataatggttaacgctgccctgcaaaggcagttccattcaccgttcatctttcgggaggaagacccatctaggcagattgtatttgagatctctaagcaagaagactggcaggtgccgatttggatcatcgtgggttccacactcggaggtctgttgctgctggcgctgctcgtgcttgccctatggaagctcggcttctttcggtccgcaagacggcgacgggaacccggtctggatcctaccccgaaggttttggagtag

SEQ ID NO: 226950 - DNA, 2472 bp, Artificial Sequence
  Description of Artificial Sequence: Synthetic coding sequence
atgtcacagactggattctcatctcacgtagtagaagatggggtgcttctgggcgctgtgggagcctatgactggaacggcgctgtgcttaaagagacctccgctgggaaagtgatcccattgcgggaatcttacctaaaagaatttcctgaggagctaaagaaccacggtgcctaccttggctacactgttacctcagtcgtatcgagccgtcagggcagggtgtacgttgctggagcccctcggtttaaccacacgggcaaagtaatcctcttcacgatgcacaacaaccggagtcttacaattcaccaggcaatgaggggtcagcaaattggcagttactttggcagtgaaattacttctgtggatatcgacggcgatggagtcacagacgtgttgctggtaggggctcccatgtactttaatgagggcagggagcgtggaaaagtgtacgtttacgaattgcggcagaacttatttgtctacaatggaaccctgaaagacagtcacagttaccagaatgctagattcgggagttccatagcatctgttcgggaccttaaccaggattcttacaacgatgtggtcgtgggcgcaccactagaagataatcacgccggagcaatttacatctttcacggttttaggggaagtatactgaagacccctaaacagcgcataaccgcttccgaactggcgaccggccttcagtattttgggtgcagtatccatgggcaattagatctgaacgaggatggcctgatcgacctggccgtgggggcattgggaaatgccgtaattctctggtctcggccagtggtacaaatcaacgcgtctctccacttcgaaccttcaaagatcaacatattccaccgtgactgtaagcgcagtggaagggatgctacctgtttggccgcttttctctgttttactccaatctttctggcacctcacttccagacgacaaccgtgggcattaggtacaatgcaactatggatgagcggcgttacaccccacgagcccacctggacgagggcggagacaggtttacaaatcgcgctgtcctgctgtccagcggacaggaactgtgtgagcgcattaacttccacgtccttgatacagcagattacgtgaaaccagtgacattctcagttgaatattccctcgaagatccagaccacggtccaatgctcgacgacggatggccaaccactctgagagtgagcgtgccattctggaacgggtgcaacgaggacgaacactgtgtgccggacttggtgcttgacgccaggtccgatttgcctaccgctatggagtattgtcagcgcgtgttgcgaaaacctgcacaggattgttccgcatacacactcagcttcgataccacagtcttcatcatcgagtctactcggcagagggtggccgtcgaggccactttggagaacaggggcgaaaacgcttattctaccgtcttgaacatctctcagagcgccaacctgcaatttgcctctctgatacaaaaagaagactccgacggctctatagaatgtgtgaacgaggagagaaggctgcaaaagcaggtgtgcaacgtgtcctaccctttcttccgggcaaaagcaaaggtcgctttcagactagactttgagttctctaaaagcatattcctgcaccacctcgagattgagctggcggctggcagtgattctaatgaacgcgactccactaaggaagacaacgtggcccctttgcggttccatcttaagtacgaggctgacgtactgtttacccgctcttctagtctgagccattacgaggtgaaacctaatagcagcctcgaacgctacgatggtataggtcctccattttcctgcattttcaggatccagaacttgggtctgttcccgatccacggcatgatgatgaaaattaccatccctatcgccaccagatcagggaacagactgcttaagctgagagacttcttgacagacgaggctaacacatcttgcaatatatggggaaactcgactgaataccgcccaactcccgtagaagaggacctgcgtcgggcacctcagctgaaccacagtaactcagatgttgtgtccatcaactgcaacatcagacttgtacccaatcaagagattaactttcacctgctgggaaacctgtggctgagaagtctcaaggccctgaagtataagagtatgaaaattatggtgaatgctgcgctccagcggcagttccattcacctttcatcttcagagaggaagacccatcccgtcaaatcgtcttcgagatatccaagcaagaggactggcaggtccctatatggatcattgttggaagcacactcggaggcctcctactgctcgcgctcttagtgctggcactgtggaagcttggctttttccgtagcgcaaggcggagacgggagcctggcctggatcccactccaaaggttctcgagtag

SEQ ID NO: 226951 - DNA, 1953 bp, Artificial Sequence
  Description of Artificial Sequence: Synthetic coding sequence
atggatctaccaagaggattggtggtggcatgggcattgagcctctggcccggtttcaccgacacatttaacatggacacacggaaaccacgcgtcatcccgggatcacgtacagcgtttttcgggtatacggtgcagcagcacgacatatccggcaataagtggcttgtggtcggtgctcccttggagaccaatgggtatcagaaaactggggatgtttataagtgccccgtgattcatgggaactgtaccaagttgaacctgggccgtgtcacgctcagcaatgtgtctgagcggaaggacaacatgagactgggcttatcgctggccacaaatccaaaggataacagctttctcgcctgttctcccttgtggtcacacgagtgtggctcttcatactacacaaccggcatgtgcagccgggtgaactccaacttcaggttttccaaaacggttgccccagctctccagcggtgccaaacctacatggacattgtcatagttttagatggcagcaacagcatatatccctgggtggaagtccaacacttcctcatcaatatcctaaaaaaattctacattggacctggccagatacaggtcggagtggtccagtacggtgaagacgtggttcacgagttccacttaaacgactaccgctctgtgaaagacgtggtggaggccgcaagccacattgagcaaaggggcggaacagaaacgaggaccgccttcggcatagagttcgcacgttctgaggcctttcagaagggtggcagaaagggcgcaaagaaggtgatgatcgtcattactgatggtgagtcccatgatagtcctgacctggagaaagttatccagcagagcgaacgggacaatgtcaccagatacgcagtagccgtgctcggctattacaaccgacgaggcatcaaccctgaaacattcctgaatgaaatcaagtacattgccagtgaccctgatgataaacatttttttaatgtgacggacgaggctgctttgaaggacattgtcgatgcccttggagaccgcattttctcactagagggcaccaacaagaacgaaacctcctttggcttagagatgagccagaccgggttttccagccatgttgttgaggacggtgtcttactcggggctgtgggcgcttatgactggaacggagccgtgctgaaggaaacaagcgctgggaaggtcattcccttacgggaatcctatctcaaagagtttccagaagagctaaagaaccacggagcatacctgggatataccgtgaccagcgtggtgtctagccggcaaggtcgcgtgtatgttgcaggggctcccaggtttaatcacacgggcaaggttatcctgttcactatgcacaacaatcgtagcctcaccattcaccaggccatgcgaggccagcaaataggatcctacttcggttccgagattacatcagtggatatagacggtgacggagtgaccgacgttcttttagtcggggctcccatgtacttcaacgagggaagggagcgcggaaaggtgtatgtgtacgaactgcgtcagaacctcttcgtgtacaatggaacactcaaggattcccacagctaccagaacgctagatttgggtcttcaattgcctcggtgcgcgaccttaaccaagactcctataatgacgtggttgtcggcgctcctctggaggataaccacgccggagcgatctatatcttccacggatttagaggcagcattcttaagactcctaaacaacgaatcacagcaagcgaacttgcaactggactccagtattttgggtgttccatccatggtcaactggacctaaacgaggacggcctcatcgacttagccgtgggcgcactcggcaatgcagtgattttatggaccccaccccctaaatgctggtcagaggctcccgaggaaaccctgtcatag

SEQ ID NO: 226952 - DNA, 3546 bp, Artificial Sequence
  Description of Artificial Sequence: Synthetic coding sequence
atggggcctgaaagaaccggcgctgcccctctcccactcttactggttctggctctgagtcagggcattctgaactgctgcctggcttacaatgtgggcctgccagaggctaagattttcagcggtcccagcagcgagcaattcggatacgccgttcagcagtttattaacccaaaagggaattggttacttgtgggctctccatggtccggctttcctgagaaccggatgggtgacgtttataaatgtccagtggacctttctacagccacttgtgagaagttgaacctgcagacgtccacctctatacccaacgttaccgagatgaagacaaacatgagcctgggtctgatcttaaccaggaacatgggaaccggcggattcctgacgtgtggccctctgtgggcacagcagtgtgggaaccaatattatacgacaggcgtgtgcagcgacatcagcccagacttccagctctcagcctctttttcgcctgcaactcagccctgcccttcgctgatcgacgtcgtggtagtgtgcgacgaaagcaatagtatctatccatgggacgccgtaaaaaactttctggaaaaatttgtccagggactagacatcggcccaacaaaaacccaagtgggcctgatccagtacgctaataacccacgggttgtgtttaacctaaacacttacaagactaaggaagaaatgattgttgctacttctcagactagccagtatggcggtgacctgactaataccttcggggcaatccagtacgcgcgaaagtacgcgtacagtgcggcatccggcggaagacggagtgccaccaaagttatggtggtcgtcaccgacggtgagtcccatgatggatcgatgctgaaggcagtgattgatcaatgcaatcacgataacattttaaggtttggcatcgccgtccttggctatttgaatagaaacgcactggatactaaaaacttaatcaaagaaataaaggcaattgcatcaattccgaccgagaggtattttttcaatgtatctgatgaggccgctcttctggaaaaagctggaactttgggcgagcagatcttttctattgaggggacggtgcaagggggagacaattttcagatggagatgagtcaggtgggcttctcagccgattattcttcccagaacgacatcctcatgctgggcgcagtcggcgcatttgggtggtccgggaccatcgtgcagaagacctctcacggccatttaatcttccccaaacaggcattcgaccaaatccttcaggataggaaccactcttcatatctaggatactctgtagctgctatctcgaccggagaaagcacacattttgtggctggcgctcccagagctaattatacagggcagattgtcctttactctgtgaacgaaaatggcaatattacggtgattcaggcacacagaggcgatcagattggaagttacttcgggagcgtgctatgtagcgtcgatgtggacaaagataccataacagacgtcctgctagttggcgcacctatgtatatgagcgacctgaagaaagaggaaggacgcgtgtatctgttcactatcaaagaaggaatattggggcaacatcagttcttggagggtcctgagggtatcgaaaatacccgttttggcagcgcgatcgccgctctgtccgacatcaatatggatggttttaatgatgtaatagtcgggtcacctctggaaaatcagaactcgggcgcagtgtacatttacaatgggcatcaggggaccataaggactaagtatagccaaaagatactgggttcagacggtgccttcagaagccacttgcagtactttggccgttctctggatggctatggcgatttgaatggcgactccattaccgacgtatccatcggcgctttcgggcaagtggttcagttatggagtcagtcaatcgccgatgtggctatcgaagcatcatttacaccagaaaagatcacattggtgaataagaacgcccagatcattctgaagctgtgtttctctgcaaaatttagacctacgaagcaaaataaccaggtggctatagtttataacatcaccttggacgccgacggcttttctagtcgggtgacctcgcgcggtctgttcaaagagaacaacgagcgctgtctgcagaagaacatggtggtgaaccaagcccagtcttgtcccgaacatatcatctacatccaggaacctagcgatgttgtgaattccttggacctaagggtcgacatatcattggagaatccaggaacctctcctgccttagaggcttactctgaaacggcaaaagtgttctctatacctttccacaaggattgcggggaagacggtttgtgcatttcagatctcgtgttagatgttcgtcagattcccgcagcgcaggagcagcctttcattgtcagcaatcagaacaagagactcaccttctctgtgacacttaaaaacaaacgcgagtcggcttacaatacaggaatagtggttgacttcagtgagaacttgttttttgctagcttttccctgcctgtcgacggaaccgaagtgacatgccaagtagcagcaagccagaagtccgtagcctgcgacgtagggtatccggcactcaagcgtgagcaacaagtgacgtttactattaatttcgatttcaatcttcaaaatttacagaatcaggctagcttaagctttcaggcactgtccgagagccaagaagagaacaaggcggacaatttggtgaatctgaaaatccccctgttgtacgatgccgaaatacacctgacccgctccacaaacatcaatttctacgaaatttcaagcgacggcaatgtgccaagtatcgtccactcgtttgaagatgtgggtcctaagttcatattctcccttaaggtcaccacagggagcgtcccggttagcatggcaacggtgatcattcacatcccccaatacacaaaagagaaaaacccactgatgtaccttaccggggtgcagaccgataaggcaggcgatatttcgtgcaatgcggatattaaccccctgaaaatcggacagacgagctctagtgtatctttcaaaagcgaaaattttcgacataccaaggagttgaactgtagaaccgctagctgctccaacgtgacttgctggttgaaggacgtgcatatgaagggcgaatacttcgtgaatgtgaccacccgaatctggaacgggacatttgcaagcagcacttttcagacggtgcagctcacggctgccgctgagattaacacctacaatccagagatctacgtgattgaggacaacacagttacaattccactcatgattatgaaacctgatgagaaagccgaagtgccaacgggggttatcatcggatcgattatcgctgggatattactgctgttggctctagtggcaatcttgtggaagcttggctttttcaagcgtaagtacgaaaagatgaccaaaaaccctgacgagatagatgagacaactgagctctccagttag

SEQ ID NO: 226953 - DNA, 2448 bp, Artificial Sequence
  Description of Artificial Sequence: Synthetic coding sequence
atggggccagaacgaactggcgctgctccactgcctctccttctggtgttggctttatctcagggcatactcaactgttgcttagcctataacgtgggtttgcccgaagccaagattttctccggcccatcctcggaacaatttggttacgcagtgcaacagttcatcaaccctaaaggaaactggttgctcgtaggtagcccttggtcaggcttccctgaaaaccgcatgggcgatgtctacaagtgtcctgtggatctgagtacggccacatgcgaaaagctgaacttgcaaacaagcacatccattcctaacgttaccgagatgaagactaatatgagcctcggcttgatcttgaccagaaatatggggactggcggatttttgacttgcggcccactttgggcgcagcagtgcggcaaccaatattacacaactggggtgtgttctgacatttccccagacttccaactcagtgcttccttctcccccgctacccagccctgcccaagtttgattgacgtagtagtggtctgcgacgagagtaattcaatttacccctgggacgccgtcaaaaattttttggagaaatttgtgcaaggcctcgatatcgggccaaccaaaacacaggtgggacttattcagtatgctaataaccctcgggtcgtattcaatttaaatacctataaaaccaaagaggagatgattgtcgcaacctctcaaacctcccagtatggaggggacttgacaaatacttttggcgcaatacagtacgccaggaaatatgcctactctgccgctagtgggggtaggcgatccgctactaaggttatggtcgtggtaaccgacggggaaagccatgatggtagtatgctcaaggccgtgatcgatcagtgtaaccatgataatattctgagattcgggattgccgtgcttgggtacctaaaccgaaacgcgttagacactaagaatcttatcaaagagattaaagctatagcctccatccctacagagagatattttttcaatgtcagcgacgaagccgctctccttgagaaagctgggacactaggcgagcaaatcttttcgatcgaaggcaccgtccagggcggagacaacttccagatggaaatgagccaggtcgggttctctgccgactactcctcccagaatgacatcctaatgctgggagcggttggggcatttgggtggtctggcacgatcgttcaaaagacaagtcacgggcatctcatctttcccaagcaggcttttgaccaaatcttgcaggaccgcaatcactcctcctaccttggctattctgtggccgctatcagcacaggcgaaagcactcatttcgtggccggtgcccctcgggctaactacaccggtcaaattgttctatactccgtcaatgaaaacgggaatatcaccgtgattcaggcccatcggggtgaccagattgggtcatatttcggcagcgtgttatgtagcgttgacgtagacaaggacactattaccgatgtgcttctcgtgggagcaccaatgtacatgtctgaccttaagaaagaggagggaagggtttacttgtttactataaaggagggaatacttggacagcaccagtttctcgaaggcccagaagggatcgaaaacaccagattcggcagcgccattgccgctctttcggacataaatatggatgggtttaacgatgtgattgttggtagccctcttgaaaatcaaaattctggtgctgtatacatttacaacggacaccagggcactataagaacaaagtactcccaaaagatcctgggctccgatggtgcatttaggagccacctgcagtatttcgggaggtcactggacggatatggcgatctgaacggcgattcaataacagacgtgagtatcggcgcattcggccaggtggtgcagttgtggtcccagagtatagccgacgtggcgattgaggcctctttcactccagagaagatcacccttgtgaataagaacgcccaaatcattctgaagctctgtttttccgcgaagtttaggcctactaaacagaataatcaggttgcaattgtgtataacattacactggatgcggacggtttttctagccgagtgaccagtaggggcttgttcaaggaaaacaatgagcgctgtttgcagaaaaatatggtagtgaaccaagcacagagctgtccagaacatatcatatatattcaggaaccttcagatgttgtgaatagcctggacttaagagtcgatatcagcttggagaaccctggaacgagtccagcactcgaggcttatagcgagacagctaaagtgttttctattccattccataaagattgtggagaggatgggctgtgtattagcgatttagtcctcgacgtcaggcagatcccagcagcacaactcatgggccagaagtag

SEQ ID NO: 226954 - DNA, 1926 bp, Artificial Sequence
  Description of Artificial Sequence: Synthetic coding sequence
atggggcctgaacggacaggggctgcccctctcccgttgcttctcgtgttggctctgtcccaaggtattcttaactgttgccttgcatacaatgtggggctccccgaggccaagatcttttcaggtccctctagtgagcagtttggatatgctgtgcaacagttcataaatcccaagggcaactggctactggtgggatctccttggtccggctttccggagaaccggatgggagatgtgtataagtgccccgtggatctgagtaccgccacctgcgaaaagctgaatctccaaacatctacctcgattcccaacgtaactgaaatgaaaaccaatatgagtctgggtctgatactgacacgcaatatgggcactgggggatttttaacatgtggtccgctttgggctcagcagtgcggcaatcagtattatactacaggcgtgtgctctgacatcagtcccgatttccagctgtccgcatcattctccccggctactcagccctgtccctccctgattgatgtggtggtggtctgtgacgaatccaacagcatctatccctgggacgcagttaagaactttctagagaagttcgtgcagggcctggacataggacccacgaagactcaggtcggtctaattcagtatgcgaataacccaagagttgtctttaacctgaacacctataaaactaaggaggagatgatcgtggcaacatcgcagacctcacagtacggcggagatctgaccaacactttcggcgctatacaatatgctcgcaagtacgcttactccgcggcttcaggtggtcggcgatcagcaactaaagttatggtagtcgtcacagacggcgagagtcacgatggcagcatgttgaaggcggtcatcgatcagtgtaatcacgacaacattcttcgctttggcattgcagttctcgggtacctgaacaggaatgctttggacacaaagaacctgattaaggaaatcaaggcaatcgcctccatccctacggagcggtactttttcaacgtctccgacgaagcagcactgttggagaaggctggaacactgggcgaacaaatctttagcatcgagggcaccgtgcaggggggtgacaattttcaaatggagatgtcccaggtgggcttctcagccgactactcgagccagaatgatatcctgatgctaggtgcggttggggctttcggatggagtggcacaattgtgcagaaaacttcgcacggtcatttgatttttccaaaacaggcttttgatcagatcctgcaggaccgtaatcactcctcttacttgggctacagtgtcgcagcaatctcaaccggcgaaagcacccattttgttgctggtgcgcctcgcgcaaattacaccggccagatagttctgtacagtgtcaatgagaatggtaacattacggttatacaagctcaccggggtgatcagatcgggtcatacttcggtagtgttctttgtagcgtggacgtcgataaagataccatcacagacgtcttgctcgtgggggctcccatgtacatgtctgatttgaaaaaggaggagggtagggtttatctttttacaatcaaggagggcatccttggccagcaccaatttctcgaaggtcctgagggcatcgaaaacaccagatttggatctgctattgccgctctctcagacatcaacatggacgggttcaatgatgtaattgtcgggtcaccgctagagaatcaaaactcaggagccgtgtatatctacaatggacaccagggcaccatcagaacgaagtatagccaactcctctgcacgatcattagctgccagacctgctctttccgcaagagctgggatccgatggagcccctcggcgctattagctcaactcttgggggaccctggatggccatggagatctag

SEQ ID NO: 226955 - DNA, 2829 bp, Artificial Sequence
  Description of Artificial Sequence: Synthetic coding sequence
atggggccagaacgtacaggggcagcacccctgccgttgctgctggtgttggcactgagccagggaattctaaactgttgcctagcatataatgttgggctgccggaggcaaaaattttctctggtccttctagcgagcaatttggctatgctgtgcagcaatttatcaatcctaaaggaaattggcttttggtaggctctccctggtctgggtttcctgagaacaggatgggagacgtgtacaaatgcccagtggatctcagcaccgccacatgcgaaaaattaaaccttcaaacctcgacatccatccctaatgtaaccgaaatgaaaacaaacatgagcctgggcctcattctaacacggaacatgggcacagggggatttctgacgtgcggacccctgtgggcacaacagtgtggtaatcaatactacacaacgggcgtatgttccgacatctctcctgatttccagctgtcagcatcttttagtccagccacccagccttgtccatctttgatagatgtggtggtggtctgcgacgagtctaatagtatctatccttgggacgcagtgaagaacttcctcgagaagttcgttcagggactggacattggcccaaccaagacacaggtgggactgatccagtacgctaataacccaagagttgtatttaacttgaatacctataagactaaggaggagatgatcgtggccactagccagacaagccagtatgggggtgacctcacgaacactttcggggcaatacagtatgcacggaagtatgcttacagcgcagcgtcaggcggacggcgatcggctactaaagtaatggtggttgtgaccgatggggagtcccatgatggaagcatgttaaaggcagtaatcgatcaatgcaatcacgataatatcctccggtttggaatagctgtgctcggatacctcaatcggaatgccctggacaccaaaaatctgatcaaggaaatcaaggcaatcgcctcaatacccacggaacggtattttttcaatgtgtcagatgaagctgcccttctagaaaaggcaggcactctcggggaacaaatcttttctatcgaagggactgtgcagggaggggacaactttcagatggagatgtcccaggttggattctccgctgattactcctcccagaacgatatcctgatgctgggcgctgtgggtgcatttggctggtcgggaacaatcgttcagaaaaccagtcatgggcatctgatatttcctaaacaggccttcgaccagattctccaagacaggaatcacagctcttatctggggtacagcgtggcagccatttctaccggtgagagcacacacttcgtcgctggagccccacgcgctaattacacaggtcagattgtgctctattccgtgaatgaaaacggcaatatcactgtgatccaggctcatagaggcgaccagatcggaagttattttgggagtgtcttgtgctccgtggacgtagataaagacacaataacggacgtgctgctggtcggagcacccatgtacatgtccgatcttaagaaggaggaggggcgtgtgtatctctttaccatcaaagaggggatccttggacagcaccaatttctcgagggtcccgagggcattgagaacaccaggttcggttccgccatcgctgccttaagcgacattaacatggacggcttcaacgacgtaatcgttgggagtcccctagagaatcagaatagcggcgcagtgtatatttataatggtcaccaaggcacaattcggactaaatattcccagaaaatattgggctctgacggcgctttcagatcacacttgcagtacttcggacgaagtctcgatggatacggggatctaaatggcgactctatcacggacgttagcattggtgccttcggtcaggtggtgcagctatggagccagtccatcgctgatgtcgctattgaggccagcttcacgcccgaaaaaattaccctggtgaataaaaacgctcagataattcttaaactctgcttctcggcaaagttcagacccaccaaacaaaacaatcaggtggccattgtgtataacataactctggacgctgatggattctcatctcgcgttacttctcgcggtctattcaaggaaaataacgaaagatgcctgcagaagaatatggtggtgaaccaggcccaatcatgcccggagcatatcatctacattcaagagccatctgacgtggtgaattccctggacctgagggttgatatctctctggagaacccaggcacatctcccgctctggaagcatatagcgagacggccaaagtgtttagtatcccatttcacaaagactgcggcgaggatggcctgtgtatatcagacttggtactggacgtccgtcagatccctgcggctcaggagcagccatttatcgtgtccaatcaaaacaaacggctgaccttcagcgtgaccctcaagaacaaacgcgagtctgcctacaacaccgggattgtcgtagactttagcgagaacttattctttgcctcgttctctctccccgttgatgggacagaggtgacgtgtcaggtcgccgcatcccaaaaatctgtagcatgcgacgttggctatccagcactgaaaagagagcagcaggtcacttttaccattaacttcgattttaatctccagaacctgcaaaatcaggcgtctttgtccttccaggccctttcagagagtcaggaggagaacaaggctgacaacttggtgaacctcaaaatccccctactgtatgatgctgaaattcacctgaccaggtag

SEQ ID NO: 226956 - DNA, 3120 bp, Artificial Sequence
  Description of Artificial Sequence: Synthetic coding sequence
atggctcgtgccctatgcccactgcaggccctctggttgcttgagtgggtgctgctccttttaggcccatgcgctgccccacccgcatgggccttgaacctggatcccgtgcagctgactttctacgccggaccgaacggttcccaatttgggttctctctggattttcacaaggactctcacggacgcgtggccatcgtggttggggcacccagaactctgggtcccagccaggaagagacaggtggggtcttcctctgtccctggagagctgagggtggacaatgcccgtctctgctcttcgatcttagggacgagactagaaacgtcggaagccagacactacagaccttcaaggcccgtcaggggctcggggcaagcgtcgtgagctggagtgatgtgatagtggcatgtgctccttggcagcattggaacgtgttggaaaagacagaggaagctgagaaaactcccgtcgggtcttgcttcttggctcaacccgagtccggtagaagagcagagtacagcccctgtagaggaaatactctttctcggatctacgtggagaacgacttctcgtgggataaacgatactgtgaagcaggtttctcctctgtagtcacgcaagccggagagttggtgttaggtgcaccaggtggatattactttctgggcctgctggcccaagcgccagttgctgacatcttcagcagttacagaccaggcatcctcctctggcatgtttctagccagagcctgagcttcgattcatctaatcctgagtactttgatggatactggggctactccgtggccgtgggggagtttgatggagacctcaataccaccgaatatgtcgttggggcacccacatggagctggacgctcggcgcagttgaaatactcgacagctattatcagcgcttgcatagactgcgaggagagcagatggcctcctatttcggacactcagtggcagttacggacgtaaacggggatggcagacacgacctcctggttggggctcccctctacatggagtcacgcgctgatagaaagctggctgaagttggacgcgtgtatttgttcctgcaacctagaggccctcacgcactgggagctccaagcttactactcacaggtacacaactgtatggtaggtttgggagcgctatagcccctctgggagatttggaccgtgatggatacaatgacattgccgtggcagcgccttacggcggaccaagcggaaggggacaggtattagtgttcctaggtcagagcgaggggttaagatcccgccctagccaagtgctggattccccgttccccaccggatcagcttttggtttttctctgcgcggagcggttgatatcgacgataacggctatcccgatctgatcgttggagcatatggagcgaaccaggtggcagtgtacagggctcagcccgttgtcaaggccagtgtccaactgctggtgcaggacagcctgaacccggctgtgaagtcctgcgtgctcccacagaccaagacccccgtgtcttgcttcaacattcagatgtgcgtaggagcgacaggtcataacataccccagaaactaagcctcaacgcggagctccagcttgatagacagaaacctaggcagggccgaagagtgctcctactcggctctcaacaagccggaactactctgaacctggacctgggcggaaaacatagccctatctgtcacactactatggccttcttaagagacgaggcagattttcgggataaactgtctcctatagtgctgagccttaacgtaagtctccccccaactgaagcaggaatggcccctgccgtggtgctgcacggtgacacgcatgtccaggagcagacaaggatcgtgctcgactgcggcgaagacgacgtctgcgtgccccagctgcaactgactgcgtctgtcacaggcagtccgttgctggtcggcgctgacaacgttttagaactgcagatggatgcggctaatgagggcgagggtgcttacgaggccgaactagctgtacatctgccgcagggggcacactatatgcgagccctttccaatgtggaggggtttgagaggcttatttgcaaccaaaagaaggaaaacgagacccgagtggtgttgtgcgaactgggaaaccccatgaagaaaaacgctcagatcggcatcgccatgcttgtgtccgtcggcaacctggaggaggccggagaaagcgtgtcatttcagcttcaaatacgtagcaaaaattctcaaaatccaaactctaaaatcgtgctgcttgacgtgcctgtcagggcagaggcacaagtcgaattgagagggaactcattcccagcatcactcgttgtcgcagcagaggaaggagagagagagcagaactctctggattcatgggggcctaaagtcgagcacacgtacgagctgcacaacaatggaccaggaacagtgaatgggctacacttgtctatccacttgccgggtcagtctcagcccagtgatctgctatatattttggacatccaaccccagggcggtctccagtgcttccctcaacctcctgttaaccctctgaaagtggactggggcttaccaattcctagtccctctcccattcaccctgcccaccacaaacgggataggaggcagatcttcctgcccgagccagagcagccgagccgcctgcaggatcccgtccttgtatcttgtgactcagcgccatgtactgtggtccagtgcgatctgcaggaaatggctcgaggccagcgggctatggtgacagtgcttgccttcttgtggttaccatccttataccagcgccctctggatcagtttgtcctgcagtcacatgcttggttcaacgtatcatccctcccgtatgccgtaccacccctgtcacttccgcgaggcgaggctcaggtgtggacccagctgttgcgcgctctggaggagagagctatccccatctggtgggtgctggtgggggtgctgggaggccttctgctcctgacgatccttgttctggcaatgtggaaagtgggattctttaaaaggaacagaccccctcttgaggaagacgatgaggagggcgaatag

SEQ ID NO: 226957 - DNA, 3018 bp, Artificial Sequence
  Description of Artificial Sequence: Synthetic coding sequence
atggcaagggcattgtgcccacttcaggcgctgtggctactcgaatgggtactgttactcctgggaccgtgcgcggctccgcctgcgtgggctttgaatctggatcctgtccagttgacattttatgctggaccaaatggctctcagtttgggttctctttagacttccacaaggactcccacggtagagtggcgatcgtggtcggcgctccacggaccttaggcccaagtcaggaggaaactggcggtgtttttttgtgcccctggcgcgcagaggggggacagtgccctagcctgctgttcgacctgcgcgatgagaccagaaacgtgggttcccagacactacaaaccttcaaagcaagacagggcctgggggcatccgtcgtttcttggagtgacgtgatcgttgcctgcgccccatggcagcactggaacgtgttggaaaagacagaggaggctgagaaaacacccgtcgggagttgctttctggcgcaacctgagtcagggaggcgggctgagtactcaccctgccgcggaaacacgttgtccaggatctacgtggagaacgacttcagttgggacaaaaggtactgtgaagccggtttcagctctgtggttacgcaagctggagagctcgtcctgggcgctcccggtggttactacttcctgggattgttggcacaagcgcctgtggctgacatcttttccagctacagacccggtattctgttgtggcacgtgtcttcacagtcattatctttcgactcatccaatcccgagtactttgatggttactggggatactcagtagccgtcggagaatttgatggcgacctcaacacaaccgaatacgtggtgggagccccaacgtggagctggactctgggtgctgtagagatccttgactcatactatcagagactccacagactaagaggggagcagatggcatcctactttggccatagcgtggctgtgacagatgtcaacggcgatgggaggcatgatctcctggtgggtgccccattgtacatggagtctcgcgctgaccgtaagttggccgaagtggggagagtgtacctcttcctgcagcctagagggcctcacgctctgggcgcacctagcctgctcctcaccggcacacagctgtatggtcggttcggctcagctattgccccactaggcgacctggaccgcgatggctacaatgacatcgccgtggccgctccctacgggggacccagtgggcgtggtcaggtacttgtgtttctgggccagtccgagggcctccgctctcggccaagtcaggtactggattctcccttccccactggcagcgccttcgggttctcccttcgcggagcagtggatatcgatgacaacggataccccgatttgatagtgggcgcatatggcgctaatcaggttgccgtgtacagagcgcagcccgtggtgaaggcctcagtgcaactcttggtgcaggattctctgaaccccgcagtcaaaagctgcgtgctgccacagaccaagaccccagtgtcctgctttaacatccagatgtgcgtcggggcaaccgggcacaacatcccacaaaagttgagcctgaatgccgaactccagttggatcgccagaagccacgccaaggtcggcgtgtgctgctcttgggatcccagcaggccggaaccactcttaacttagatttggggggtaagcactcaccgatttgtcatactacaatggcctttctgagggatgaagcggactttagggataagttgtcaccaatcgttctgtccttgaatgtgagccttccgccaactgaagccggtatggcccctgccgtggttcttcatggtgacactcacgtacaggagcagacccggattgtgctggattgtggagaagatgacgtgtgtgtgccacagcttcagttgaccgctagcgtgaccggtagcccgttgttggtgggggctgataacgtacttgagctgcagatggacgcggcaaatgaaggcgagggcgcatacgaggccgagctggccgtccacctacctcagggtgcgcactacatgcgggctctgtccaacgtcgaaggattcgagcgtctgatttgtaaccagaagaaagaaaacgagacgagagttgtgctgtgcgaactcggaaacccaatgaagaaaaatgcacagattgggattgccatgctggtcagtgtgggaaacctggaagaagcgggagaatccgtttccttccagcttcagatcaggagcaagaactctcagaaccctaactctaagatagtgttgcttgacgtgccagtgagggccgaagctcaagtggaactcagaggtaactctttccccgctagtctggtcgtggccgctgaggaaggggagcgcgaacagaatagccttgactcctggggaccgaaggtggagcatacctacgaactccacaacaacggaccagggactgtgaacggactgcacctgtcaatccacctgccagggcaaagccagccgtccgacctactgtacatactggatatccagccacagggcggtctgcagtgctttcctcagccaccagtaaaccctctcaaggttgactggggattgcccatcccatctccatcccccattcatccagcccaccacaaaagggaccgcaggcagatctttcttcctgaaccggaacaaccatcaaggttacaggaccccgtgctggtgtcctgcgactccgccccttgtactgtggttcagtgtgacctgcaggaaatggctagaggtcagcgcgcaatggtgacagtcttagccttcttgtggctgccatctttatatcaggtgtggacacagctcttaagggcactggaggagcgagcgattccaatatggtgggtgctggtgggagtgttaggtggcttgctcctcctcactatcctggttctggcaatgtggaaggttggcttttttaaacggaataggccaccgctggaggaggatgatgaggaaggggaatag

SEQ ID NO: 226958 - DNA, 660 bp, Artificial Sequence
  Description of Artificial Sequence: Synthetic coding sequence
atggcgagctatttcggacatagcgtcgctgtgaccgatgtgaatggagatgggcgtcatgatcttctagttggggctcccttatacatggagagcagggcagacagaaagctggccgaagtcggacgagtctaccttttcctacagccaagaggaccacacgcgttgggcgctcctagtctcctcctaacaggtacccagttatacgggaggtttggatctgctatcgccccactgggcgacctggaccgtgatggttacaacgacattgccgttgctgccccatatgggggaccctctgggagaggtcaggtgctggtgtttctggggcagtcagaaggtctgcggtcccgcccttctcaggtcctggactctccattccccactggttcagccttcggcttcagcctgaggggtgccgttgacatcgatgataatgggtatcccggtgccttggactgtctccagctggaaatgcccaaaaaggggccatggactttcgctggctcagcaaaaaggcacggacagggactgatgcccggactggtatctcactacggcctcccagaaggtctgggtgagacatcctccggaggaggcggagtgggtaatccttgggaggatgagatgaggataccctgtcccaaccggcagttctag

SEQ ID NO: 226959 - DNA, 3201 bp, Artificial Sequence
  Description of Artificial Sequence: Synthetic coding sequence
atggggcctggacctagtcgagcccctagggcacctaggctgatgctgtgtgccctcgctctaatggtggcggctgggggttgtgtggtcagtgcctttaatttggacacccgttttttggtagtgaaagaggccggaaatcctgggagtctgtttggttattccgtcgcgctacataggcagaccgagcgccaacaacgctacctcttattggctggagctcccagagagctggctgttcctgacgggtacacgaatcggaccggggctgtttacctgtgtcccttgaccgcgcacaaggacgactgcgagcggatgaatattaccgtgaaaaacgatccaggacaccacatcattgaggatatgtggctgggagtaactgtggcgtcccaaggcccagctggcagggtgcttgtgtgcgcccacagatacacccaggtgctgtggagtggttccgaggatcagcgacgcatggtaggaaagtgctacgttcggggtaatgatctggagctggattccagtgacgactggcagacataccataatgagatgtgcaattctaacacggactacctggaaactggaatgtgccagctgggaacaagtgggggattcactcaaaataccgtgtactttggggctcccggagcatataactggaaggggaactcgtacatgattcagaggaaggaatgggatctctctgaatactcttataaggatccggaagatcaaggcaatctctatattggctacactatgcaagtcggctctttcattttacaccctaaaaatattaccatagtgaccggagcgccacgccacagacatatgggagctgtcttcctgttatcccaggaggccggaggcgatctgcgtcgacggcaggtgttagagggcagtcaagtcggcgcttacttcggatccgctattgccctggccgacttgaacaacgatgggtggcaggacctactggtgggggctccctactattttgaacggaaagaagaggtgggcggagctatctatgtgttcatgaatcaggccggtacctcattcccggcacacccctctttgctgctgcatggccctagcggtagcgcgtttgggctttccgtagcctcgatcggagacatcaaccaggatgggtttcaagacatcgccgtgggcgctccgttcgagggactgggaaaagtctacatttatcattcctccagcaaaggacttctgagacaacctcaacaggtgatccatggcgaaaaacttggcctgcccggattagccacgttcggatactctctcagcgggcagatggatgtagatgaaaacttttacccagaccttctggttggcagcctgtccgaccatatcgtcctgctacgggctagacccgtgatcaatatagtgcacaagaccctggtcccaagaccagcagtgctggatcccgcattatgcactgcaaccagctgtgtgcaggtcgagctgtgcttcgcttataatcagtctgcaggcaaccccaactatagaagaaacattacactcgcctatacgctagaagccgatcgcgaccgtcgtccccctcgcctccggtttgccggttctgagagtgctgtgttccatggctttttctccatgccggaaatgcggtgtcagaagctagagctgctgctcatggacaatctacgggataaactgcgacccattattatctcaatgaattactccttgccactgcgcatgccggaccgaccccgtctgggactgagaagtttggacgcttacccaatccttaaccaggctcaggccctcgaaaatcatactgaggtccaatttcaaaaggaatgtgggcctgataacaaatgtgagtccaatctgcaaatgagggcagcgttcgtttctgagcagcaacagaaactgtctcgattgcagtattcccgcgacgtgcgcaaactgctgttaagtattaacgtaactaatacgcggacctcggaacgtagtggcgaggatgcccacgaggccctcttgactctggtcgtacctccggcactgcttctatcctcagtgcggccacccggtgcatgtcaggccaacgagacaattttttgcgagttgggaaatccttttaagcgcaaccaacgtatggagttactgattgccttcgaagtgatcggagtcacccttcacacgagagacctccaggtgcagctgcagctttcgacaagctcccatcaggataatttgtggccaatgatcctgaccctgttggttgattataccctccagactagcttgagcatggttaaccatcggctccaaagctttttcggaggcacggttatgggggagagcggcatgaagactgtcgaggacgtcggaagccccctgaagtacgaattccaggtggggccaatgggcgaaggattagtgggcctgggaaccttggtacttggactggaatggccctacgaggtttctaatggtaaatggctcttgtacccaacagagatcaccgtccacggtaatgggagctggccctgcaggccccctggcgacttgatcaaccccctcaatctgaccctgtcagatcctggcgaccgtccttcatccccacagagaagaagacgacaactcgacccaggcggaggacaggggccaccacctgtgactctcgccgcagctaaaaaggccaagtccgaaaccgtcctgacgtgcgctactgggcgtgctcattgcgtgtggcttgaatgtccaatacccgacgcacctgttgtgacaaatgtgacagtaaaggcacgggtgtggaactcaacattcatcgaggactatagggacttcgatcgtgtgcgcgttaatggatgggcgaccctcttcctcaggacatcgatcccgaccataaacatggaaaataagacaacctggtttagtgtggacatagactcagaactcgtggaggaacttccggctgaaatagagttatggcttgtgttagtggccgtgggcgcagggctgctgttgctcgggttgattatcctgttactttggaagtgcgatttcttcaagaggacacgatactaccagatcatgcctaagtaccacgcagttagaatacgcgaggaagagaggtacccgccacccggatcaactctgcctaccaagaagcactgggtgacaagctggcaaacccgggaccagtattattag

SEQ ID NO: 226960 - DNA, 3156 bp, Artificial Sequence
  Description of Artificial Sequence: Synthetic coding sequence
atgggccctggcccaagccgggcaccacgggcacctagactcatgctctgtgccctggctctgatggtcgctgcaggtggctgcgtggtttctgcctttaatctagatacacgattcctggtggtcaaagaagccggaaatcccggatctcttttcgggtacagcgtcgccctgcaccgccagacagagcggcagcaaagatacctgttattagcaggcgctccaagggagctggcagtgccagatgggtacacaaataggaccggagctgtttatctctgtcctctgacagcgcataaagacgactgcgaacgaatgaatattactgttaaaaatgatccaggccatcacatcattgaggatatgtggttgggagtgacggtggcctctcagggaccagccggacgcgtcctggtgtgtgctcaccggtatacccaggtgctgtggagcggcagtgaggaccagcggagaatggttggcaagtgctacgtgagaggcaatgacctggagctggactcttccgacgattggcagacttatcacaacgagatgtgtaatagtaatacagactacttggaaaccgggatgtgccaactcggtacaagcgggggattcactcaaaataccgtgtactttggtgcccctggggcatataactggaagggcaactcatacatgattcagcgcaaagagtgggacctgagcgagtacagctacaaggatcctgaggatcaaggtaacttgtatatcggttacacaatgcaagtgggttcattcattctgcaccctaagaacattactatcgtgacgggcgcacccagacatcgtcatatgggagcagtctttctcttgtcacaagaagcaggcggagacctgcgcagaagacaagttctcgaaggctcccaggttggcgcatacttcgggtctgcaatagcattggccgatctgaataacgacgggtggcaggacctgctggtgggagccccatactatttcgaacgaaaagaggaagtcggtggtgccatctacgtgttcatgaaccaagccggaacttccttccccgcacatcctagcctgctgctgcatggcccatctggaagcgccttcggcctgagcgtggcctctataggggatattaaccaagacggttttcaggatatcgccgtcggcgctccattcgaaggactaggaaaagtgtacatttaccatagtagctctaaagggctgcttaggcagccacagcaagttattcacggcgagaagctcggccttcctggactcgctactttcgggtattctctcagcggccagatggatgttgacgagaatttttaccctgacctgctggtgggtagtctgtccgatcacattgttctgctccgtgccaggccagtgattaatatagtccacaaaactcttgtgccccgtcccgctgtactcgaccccgctctctgtacggccaccagttgcgtgcaggttgaactctgctttgcatacaaccagagcgcaggaaatcctaactaccgaaggaatatcaccctcgcgtacacgctggaggcagatcgggatcgcagacctccgcgtctcagattcgcgggatccgagagcgccgtatttcacgggttcttttctatgcctgaaatgagatgtcagaaactagagctcctactgatggataatctcagggacaagcttagacctatcattatttccatgaactattcgctgcctctgagaatgcctgatcgccctcgtttgggattgcgctccctcgacgcttaccccatccttaaccaggcccaagctctcgagaaccataccgaggtgcagttccagaaggagtgcgggccagataacaaatgcgagagtaatctgcagatgagggccgcttttgtgtccgagcagcagcagaaactctcgcgcctccagtacagtcgtgacgtgagaaagttgctgctgagtatcaacgtgacaaacacacgcacgtcagagcggtctggcgaggacgcgcacgaagcactcctgaccctggttgtaccccctgccttgcttctatcgtcagtcaggccacccggagcttgtcaggctaatgagaccatattctgcgagttgggaaacccctttaaacgtaaccagcgaatggaactgcttatcgcctttgaagtcatcggagttaccctgcatactcgcgacctccaagtacagttacagcttagtacctcaagtcaccaagataacttgtggcccatgatcctgaccttactggtcgattacacattgcagactagtctcagcatggtcaaccaccgcttgcagtccttctttggcggaactgtaatgggcgagagcgggatgaagactgttgaggacgtcggcagcccattgaagtatgagttccaggtggggcctatgggggagggactggttggcctcgggaccttggtcctcggtctggagtggccctacgaggtgagcaatgggaaatggctgttgtaccctacagaaattacagtgcacggcaatggcagctggccatgtcgacccccaggggacctcattaaccctttgaacctgactttatccgatccgggagatagaccgtcatcaccccagcgcagaaggaggcagcttgatcctggtggcggtcaagggcctcctcccgtgaccctcgccgctgcgaaaaaagcaaaatctgaaactgtcctgacatgcgcgacaggacgtgctcattgcgtgtggctggagtgtccgattcctgacgcccctgtcgtgaccaacgtcactgtgaaagccagggtgtggaatagcacatttatcgaagactacagggattttgatagggtccgggtgaatggttgggcaacactgtttttacgcacatccatcccaaccatcaacatggagaataaaacaacctggttttctgtggacatcgactcagaacttgtggaggagctcccggcagagatcgaactgtggctcgtcctagtggccgtcggcgctgggctgctcctcctaggcctcatcatcctgctgctctggaagtgcggcttcttcaagagggctcggacgcgggcattgtacgaggctaaaaggcagaaggcggagatgaagtcacaaccctccgagactgaacgtctcactgacgactactag

SEQ ID NO: 226961 - DNA, 3114 bp, Artificial Sequence
  Description of Artificial Sequence: Synthetic coding sequence
atgctctgtgccctcgcactaatggtggccgctggcggttgcgtcgtgtcggcttttaacctggatactcgttttctagttgtcaaggaagccggaaatccaggtagcctgttcggttattccgttgctcttcacagacagacagaacgccagcagagatacttgctgctcgccggagctcctagagagctggcagtaccagacggatatacaaatcgcaccggagccgtgtacctatgcccactaaccgcacacaaagatgactgcgagcggatgaacattacagtgaaaaatgatcctggtcatcatatcatcgaagacatgtggttgggggtgaccgtcgcgagccagggacccgcagggagggtgctggtttgtgcccatcggtacacacaggtcctttggagcgggagtgaagaccaacgcaggatggtgggtaagtgctacgtacggggtaacgacctggagctggactcgtccgatgactggcagacctaccacaatgagatgtgcaactcgaataccgactaccttgagactggtatgtgtcagctgggcacctccggaggctttactcagaatacagtctactttggtgctcctggcgcttataattggaaaggaaacagctatatgatccagcggaaagagtgggacttgtctgaatactcttataaggaccctgaggatcagggaaatttatatatagggtatactatgcaagttggatccttcatactccatcctaagaatattactatcgttaccggcgctcccaggcataggcatatgggggctgtcttcctgctgagccaggaagctggcggtgacttaaggagacgccaagtcctagaggggtcccaggtaggggcttacttcggcagtgctatagcgctggccgacctgaataacgacgggtggcaggatctattagttggtgccccttactactttgaaagaaaagaggaggtcggcggagccatttatgttttcatgaaccaggccggaacaagctttcccgctcatccttcactcctgcttcacgggccatccgggagcgccttcgggttgtccgttgcaagcatcggtgacattaaccaggatggattccaggatattgccgtgggggcacctttcgaagggctgggcaaggtgtatatctaccacagtagtagcaaaggattgctccggcagccacagcaagtgatccacggagaaaaactgggccttccaggactggcaaccttcggttactccctgtctggccaaatggacgtggacgaaaacttttatcccgacctccttgtagggtccctatctgatcatatcgtgctccttagggccaggcctgttattaacatcgtgcacaagacactggtgccaagaccggctgtgttagacccagccctttgtacagccacatcctgtgtgcaagtggaactgtgctttgcctacaatcagtccgcaggtaatcccaattaccgcagaaacatcactcttgcttacacgctagaggccgacagggacagaagacctcccaggttgagattcgctggaagcgaaagcgctgtatttcatggctttttctccatgcctgagatgaggtgccagaagctagagctcctactaatggataaccttagagacaaactgcgccctattataattagtatgaactactccctcccactccgaatgccagatcgacccaggctcgggctgaggagcctcgatgcgtacccaatactaaatcaggcccaggccctggagaaccacaccgaagtccagtttcagaaagagtgcggcccagataataaatgcgagtctaacctccagatgcgcgctgcgtttgtctccgaacagcagcagaaactgtcccgtctccaatactcacgagatgtacggaagctgctgctctctatcaatgtgactaatactagaacctctgaacgcagcggagaggacgcacacgaggcactcctgaccctagtcgttcctcctgctctgctgctttcctccgttcgccctccaggcgcatgtcaggcaaatgaaacgatcttctgcgaattggggaatccatttaaacggaaccagcgtatggagcttctgatcgcttttgaagtcataggcgtgacactccacaccagggatctgcaggtacagctccagctctccaccagctcccatcaggacaatctgtggccaatgatcctaacactgttagtggactacacactacagaccagcctgagcatggtgaaccaccgccttcaatctttttttgggggtacagtcatgggggaaagtggtatgaaaaccgttgaggatgtgggcagcccacttaagtacgagttccaggtgggacccatgggtgaaggccttgtgggcctcggaactctcgtccttggtttagaatggccgtatgaagtcagtaacggaaagtggctgctgtatcccacagagatcactgtacacggaaacggaagctggccttgtagaccaccaggagatctgataaaccctctcaaccttaccctgtcagacccaggcgatcggccttcttcaccacagcgtaggcggcgacagctcgatccagggggaggacaggggcctccccctgttactctggctgccgcaaagaaagctaaatcagagactgttctgacatgcgctactgggagggcacactgcgtgtggctcgaatgtcccatccccgacgcccctgtagtgaccaatgtgacagtcaaagctcgtgtgtggaactccaccttcattgaggactatcgtgactttgatagagtgagggtcaacggttgggctacccttttccttcggacgtctatccccactattaatatggagaataaaacgacttggttcagtgtcgatatagacagcgaactggtggaagaactaccagcggaaatcgagctctggcttgtactggtggctgttggagccggattacttctcctcggtctcataattctccttctctggaagtgcggcttctttaaaagggccaggacaagagccctgtacgaggccaagcggcagaaggccgagatgaagagccaacccagcgagacagagcgcctgacggatgactactag

SEQ ID NO: 226962 - DNA, 885 bp, Artificial Sequence
  Description of Artificial Sequence: Synthetic coding sequence
atgatacagaggaaggaatgggacttatcggagtattcgtataaagatcccgaggaccaggggaacctctacatcggttacactatgcaagttggctcgttcatccttcacccaaagaatataacgatcgtgacaggagctcccagacatcggcatatgggcgcagtgttcctactgtctcaggaagcagggggagacctcagacggcgacaagtattggagggctcccaggtcggggcttattttggctccgccatcgctttggctgaccttaataatgatggctggcaggatctgcttgtgggcgctccttactactttgaacgaaaggaggaagtcggaggcgcaatctatgtgttcatgaatcaggccggaactagctttccggcacaccccagccttctgctgcacggtcctagcgggtctgcttttggtctgtccgtggcatccatcggggacatcaatcaggacgggtttcaggatattgcggtgggtgccccttttgagggactggggaaagtctacatctatcactccagctccaagggtcttttaaggcaacctcaacaggtgatacacggcgaaaaactcggactcccaggactggcaacatttggctattcactcagtggacagatggacgttgatgagaatttctaccctgacctgctagtgggaagtctcagcgatcacattgtcctcctgagagcaagacccgtgatcaatatagtccacaaaacattagtccctcgccctgcggtactggatcccgctctgtgcactgccacttcctgcgtgcaggtggagctctgcttcgcctacaaccagtccgccggtaatccaaattaccgaagaaatatttcagagtgttggggggctgcgtag

SEQ ID NO: 226963 - DNA, 3108 bp, Artificial Sequence
  Description of Artificial Sequence: Synthetic coding sequence
atgggcggtcccgcagccccacgtggagctggccgtctgcgcgcacttttgctcgctctggtggtcgccggtattccagccggtgcctacaacctggacccccagcggccagtccacttccaggggccagcggatagcttcttcggctacgcagtcttggaacattttcacgacaacacaaggtgggtgttagtcggggctcctaaagctgattctaagtattcaccaagtgttaaaagtccaggagctgtgttcaagtgccgcgtccacaccaatcccgatagacgatgcaccgaactcgacatggctcggggtaagaatcggggaacttcctgcgggaaaacctgtcgggaagaccgagatgacgagtggatgggggtctcattggcaagacagcccaaagcagatggcagagtgctggcatgcgcacacaggtggaaaaatatctattacgaagctgatcacattttgcctcatggcttttgttatatcatcccatcaaacttgcaggccaaaggtagaacactgatcccttgttacgaagaatacaagaagaagtacggtgaagaacatgggtcctgtcaggcaggaattgccggattcttcactgaggaacttgttgtgatgggggcacctggctccttttactgggccggaacgataaaagtactgaacctgaccgataatacctacctgaagctaaacgacgaagtgattatgaaccggaggtacacatatctcggctacgcggtcactgcagggcacttctctcatccgtccactatcgacgtagtaggcggtgcccctcaagataaaggtattgggaaggtgtacatttttagggccgaccgacgaagtggcacactgatcaagattttccaggccagcggcaagaagatgggttcctatttcgggtccagcctatgcgcagtggatctcaacggagacggtctgagcgaccttcttgtgggggcacccatgtttagcgaaatccgtgatgagggacaggtgactgtgtacatcaatcgcggtaacggggctttagaagagcaactggctctgacgggagacggggcttataacgcccacttcggggaatcaatagcttctctcgacgatctggataacgacgggttccccgacgtggccattggcgcacctaaggaggacgacttcgctggggctgtatatatttatcatggggacgcaggcggaatagtgccccagtatagcatgaaactgagtggacaaaagatcaatcccgtgctcagaatgtttggccaatcaatctccggaggcatcgacatggacggcaatggatatccagatgttacggtcggtgccttcatgtccgattcagtcgtgcttctgagggccagacccgtcatcacggttgatgtgtcgatctttttacctggatctataaacattacagcccctcagtgtcacgacggccaacagcctgtgaattgtttgaatgtcaccacatgcttcagcttccacggtaagcatgtgcctggggagatcggcctcaactacgtcctgatggctgacgtggcaaagaaggagaaaggccagatgccacgagtctattttgtgctgttgggcgaaacgatgggacaggtaacggagaagctgcaactgacttatatggaagagacatgccggcactacgttgcccacgtaaaaaggagagtacaggacgtgatcagtcccatcgtgttcgaagccgcatacagcctcagtgagcatgtgactggggaggaggaacgggaactgcccccactgacccccgttctccgttggaaaaagggccagaagatcgcccagaagaaccaaacagtatttgaaagaaattgcagaagtgaagactgtgcagctgacctgcagctacagggcaagttactgctctcaagtatggatgaaaaaacgctatatctcgccctgggcgcagtgaaaaatatctctcttaatatttcaatctccaacctgggagacgatgcgtacgatgctaacgtaagctttaacgtcagtagagagttgttcttcatcaatatgtggcagaaggaagaaatggggataagctgtgaacttctggaaagcgacttcctaaaatgttcagttggcttccctttcatgcggtcaaaatctaaatatgagttctcagttatattcgacactagccacctttcaggcgaagaggaagtactgagttttattgtaaccgcccagtccggcaataccgagaggagtgaatctcttcacgataacaccctggtgttgatggtgccactgatgcatgaggtggacacatccatcacaggcattatgtctccaacaagcttcgtgtatggcgaatccgtggacgccgctaattttattcagttggacgatttggaatgtcatttccaacctatcaacattaccctgcaggtatataatacaggcccatcaacactgccaggaagcagtgtatctattagcttcccaaatcgtttgagttctggcggtgctgaaatgttccacgtgcaagagatggtggtgggccaggagaagggaaattgctccttccaaaaaaatcccacgccttgcatcattccacaggaacaagagaacatatttcataccatatttgcattctttacgaagagcggcaggaaggtcctggactgtgaaaagccaggcattagttgtctgacggctcactgcaatttttctgccctggccaaggaggaatccagaacgatcgatatctatatgctgctcaataccgaaattttgaagaaggattcaagttctgtcatacagttcatgtcccgcgctaaggttaaagtggacccagcactccgagtggtggagatcgctcatggaaaccccgaagaggtcaccgtcgtgttcgaggcccttcacaacctggagcctcggggatacgtggtaggctggatcatcgctatctccctgctggtcggcattctgatctttctgctgctggctgtgctcctttggaagatgggctttttccggaggcgctacaaggagattatcgaagcggaaaagaaccgcaaagaaaacgaggactcttgggactgggtgcagaagaatcagtag

SEQ ID NO: 226964 - DNA, 696 bp, Artificial Sequence
  Description of Artificial Sequence: Synthetic coding sequence
atgtgccagccccctccaacagcaccaggatcctggcccgttgcccgaccatgtaccgaatccgtggggagaactcatacacagcgagtccctgctagctgctgggctcgagcaggtcgtagctctcgccagtcaccaacacctagacaattcgccctcatgcagtacagcaacttgctcaagattcatttcacatttacgcagttcaggaccagccccagccaacagagcctggtcgacccaatcgtgcagctgaaaggcctcacattcaccgctaccggcattctgaccgtcgtcactcaactatttcatcataagaacggagcgaggaagagcgccaaaaagatactcatcgtgatcacagacggtcagaaatataaggatcccctcgagtattctgacgtgatccctcaggcagagaaggcgggaattatacggtatgccatcggcgtacgattatttttcactcctgccccaggaagcgcctgtatctccttcaggtgctccgcggctgggctcattcttttgggctgcctttctgcagccggaggcaccaggtttcccggaacacactgtcaggcaggagccgaataccaccagctgtctgcatccgcagggcctcgtgtgcagggcggtcagctctgctcaccgtggcagcatccagaggccgcagcgggagaggacctttgcagctag

SEQ ID NO: 226965 - DNA, 3486 bp, Artificial Sequence
  Description of Artificial Sequence: Synthetic coding sequence
atgacctttggcaccgtcctgttgctgagtgtcctcgcctcataccacggctttaacctggacgtggaggagcctaccatattccaggaagacgcagggggattcgggcagagcgtggtgcagtttggtggatcacgtctggtagtaggggctccactagaagtggtggccgcaaaccagacaggacggctctacgactgcgccgcagccaccggtatgtgccagccaattcccctgcatatcaggcctgaggcagtgaatatgagcctcggcttgactcttgctgctagtactaatggaagtagattactagcctgcggccctactctgcatagagtctgtggggagaacagttattccaaaggttcatgccttctgctgggatccagatgggagatcatccagactgtcccagatgctaccccagagtgccctcaccaggagatggacattgtgtttctcatagacggcagcgggtcaatcgatcagaacgactttaaccagatgaaagggtttgtccaggctgtgatgggccaatttgaaggaacagataccctctttgccctgatgcaatactcaaacctgcttaagatccattttaccttcacacagttccgtacgagcccatcacagcagtcactggtggaccccatcgttcagctgaaaggcttaacattcacggcaaccgggattctgacagtcgtaactcaactgtttcatcataaaaacggagcccgtaaatcagccaagaagatcctgatcgtaattaccgacggccaaaagtataaagaccccctcgagtacagtgatgtgattccacaggccgaaaaggccggaatcatcaggtacgccattggtgtaggtcatgcctttcaaggacccacagctcggcaggagttgaatactatttcaagcgcccctcctcaggaccacgtgtttaaagtggataacttcgcagctctcggctccattcagaaacagcttcaggagaagatctatgccgtggagggcacacagtcacgagccagcagcagcttccaacatgaaatgtcgcaggaaggattttctacagcactgacgatggacggactctttctgggcgcagtcggcagtttttcttggtctggcggagcttttttgtatcccccaaatatgtccccgacatttatcaacatgtctcaagaaaacgtggatatgagagattcctatctagggtacagtaccgaactggcactatggaagggagtgcagaacctggtgctgggcgctcctagatatcagcacacaggaaaagcagtgattttcactcaggtgagccgccaatggcggaagaaagcggaggtcaccgggactcagattggcagttactttggtgcctccctttgtagtgtcgatgtcgactcggacggcagcaccgacctgatactgattggcgctccgcactactacgaacaaacaagggggggacaggtttctgtatgcccccttcctcgaggccgtgtgcaatggcagtgcgatgctgttttgagaggtgaacagggacacccatggggcaggttcggcgctgcgctaactgtcctgggagacgtcaacgaggataaactgatcgacgtagccattggggctcccggtgaacaggaaaaccgaggggcagtatacctgtttcatggagctagcgaatcaggaatcagcccaagccattcccaacgcatcgcttcaagtcagttatctcctagactccagtacttcgggcaggcgctgtccgggggacaggatcttacacaggatggcctcatggacctggcggtgggggcacgcggacaggttttgctgctccgcagtctgcctgtgttgaaggtgggagtagcgatgcgcttttccccggtggaggtggccaaggctgtttataggtgttgggaggagaaacccagcgcgcttgaagcaggggatgcgaccgtatgcctcaccatccagaagagctctctcgaccagctcggagatattcagtcttcagtgcgattcgaccttgcactggatccagggaggcttacatcgagagcaatattcaatgagactaagaatcctaccctcacacgccgaaaaaccctcggcctggggattcactgcgagaccctcaagctgttattacccgactgtgtggaagatgtggtctcaccaattattttacacctgaatttctccttggtgcgggagcccatcccatctccccagaaccttagacctgtgctggctgtaggatcacaggatcttttcaccgcatctctgccgtttgagaaaaattgtggccaggatggtctgtgtgaaggagatttaggggtgacactaagtttttccggcctgcaaacactgaccgtgggatcctccctggagctgaatgtgatcgtaacggtctggaacgccggtgaggattcgtatggcactgtggtgtccctgtactaccccgctggcctgtctcaccgccgagtttccggggcacaaaagcagccacaccaatccgcattgaggctcgcgtgtgaaactgtacccactgaggacgaggggctcaggagcagcaggtgctctgtcaatcatccaatttttcatgaaggttctaacgggacttttatagtcaccttcgatgtttcctataaagcaacactcggggataggatgctcatgcgagcttccgcttctagtgaaaataataaggctagcagcagcaaagcaaccttccagctggaactccctgtcaaatacgccgtatataccatgataagcagacaagaagagtccacaaaatactttaactttgcaacctcagacgagaaaaaaatgaaggaagctgagcacaggtatcgcgttaataatctaagccagagggacctggccatcagcataaatttctgggtacccgtcctgctcaacggtgtggcagtttgggatgtggtgatggaagccccttctcagtcactgccctgcgtgtccgaacgtaagcctcctcagcacagcgattttctaacacagatatccaggagtcctatgttggactgtagcatcgccgactgcttgcaattcagatgtgacgtgccaagttttagtgttcaagaagagctggattttaccctgaagggtaacctttcttttggatgggttagagagaccttgcagaagaaagtcctggttgtatccgtggcagagatcacgtttgacacgagcgtctatagccaattacccggacaggaggccttcatgagagcgcagatggagatggtgctcgaggaggacgaggtttataacgcgatccccatcatcatgggctcaagcgtcggggcactgctgctgttggccctcatcacagccacactgtacaagctgggcttttttaagcggcactacaaagagatgctggaggataagcccgaagacactgccacctttagcggagatgatttctcttgtgttgcccctaacgttcccctgagttag

SEQ ID NO: 226966 - DNA, 3534 bp, Artificial Sequence
  Description of Artificial Sequence: Synthetic coding sequence
tgcgccctctcaccaacctttcatttccctagtaccagatgttctggcatgactttcggcactgtgcttctcctctctgtgttagcaagttaccacggattcaatctcgatgttgaggagcccacgatctttcaggaggacgccggtggcttcggtcagagcgttgtgcagttcggtggtagccgactggtggtcggggcaccactcgaggtggtcgctgccaatcaaacgggcaggttatacgattgtgcggcagcgacaggcatgtgtcaacctatccctctgcacattcgcccagaagccgtgaatatgagcctcggtctgaccttggctgctagtacgaatgggagcaggctcttagcctgtgggcctaccctgcatagggtctgtggtgaaaacagctacagcaagggttcctgccttctgctggggtcacgttgggagataatacaaacggtacccgacgctacacctgagtgccctcatcaggaaatggacatcgttttcctcattgatggatcggggagtatcgatcagaatgacttcaatcagatgaaaggcttcgtgcaggccgtcatggggcagttcgaaggcaccgatacactttttgcactgatgcagtatagtaacctgcttaaaatacatttcacctttacccagttccggaccagtccttcacagcagtcattagtggatcctattgtgcaacttaagggcctcacttttactgctacgggaattctgaccgtggtgacacagctgtttcaccacaagaatggcgctcgaaagtccgctaagaaaattctgattgtgataaccgacggacaaaaatataaagatcctttagagtactccgacgtgatcccacaggccgagaaagcgggtatcatccgatatgccataggtgtaggtcacgccttccagggccctaccgcccgtcaggagctgaatacaatcagctcagccccaccccaggatcacgtcttcaaggtggacaatttcgcagccctcgggtccatccagaagcaactgcaagaaaaaatctacgcagttgagggcacacagtcacgcgcttctagttcatttcaacatgaaatgagtcaggaggggttcagtaccgccctaacaatggacggactgttcctgggcgcagtcggaagcttttcttggagtggcggagcttttctgtaccctcccaacatgtcaccaacgttcataaatatgtcccaggaaaatgttgacatgagagactcgtacttaggctattcaacagagctagctctatggaaaggagtgcagaatcttgtcttgggggctccgagataccaacacaccggcaaagccgtgatcttcacccaggtatctcgccagtggagaaaaaaggccgaggtgaccggcactcagatcgggtcctatttcggcgcttctctctgcagcgttgatgtcgactccgatggcagcacggacctcattctcatcggagcccctcactactacgaacagacacgagggggacaggtatcagtgtgtcccttgccgaggggcagggtccagtggcaatgcgatgcagttctgcggggtgagcaggggcatccttggggacgttttggcgctgcgctaacagtgcttggcgacgtgaacgaagataaactcatcgacgtggccataggcgcaccgggagagcaggagaatagaggcgcagtttacttgtttcacggcgcttctgagagtggcatctccccttcgcactcacagcggattgcttcatcacagttgagccctcgccttcagtattttgggcaagcactgtcgggtgggcaggacttaactcaagacggtctgatggatctcgctgtgggagcccgtggacaggtgttacttttgcggtcactgcccgtcctgaaggtgggcgtggctatgcggttctcccccgtggaggtggcaaaagctgtgtatcgatgttgggaggaaaagccatcagccttagaggccggtgacgctaccgtgtgcctgactatccagaaatcgtccctggatcaacttggggacattcagtccagtgtgagatttgatctcgccctggatcctggcaggttgacgagcagggccattttcaacgagacgaaaaacccaacacttacacggagaaagacgttggggttgggcatccactgcgaaacgctcaagcttctgctgccagactgcgtggaagacgtggtttcccctatcatcttgcacctgaatttctctctggttagagagcccattccgtccccccagaatctgcgtccggtgctcgcagtcggctctcaagacctgttcacggcttctttgcccttcgagaagaactgcgggcaggacgggttgtgtgagggagacctgggcgtgactctgtccttctctggcttacagacgcttaccgtagggagcagcctggaactgaacgtcattgtgacagtatggaacgccggagaggactcgtatggaaccgtagtatctctgtattatccggcaggactttcccatcgtcgggtcagtggagcacaaaaacagcctcaccaatctgccctgcgccttgcttgtgagactgttcctactgaggatgaaggtcttaggtcttcacggtgctcagtaaatcaccccatcttccatgaaggctccaacggtacttttatagtaaccttcgatgtgtcctacaaagctactctcggagacaggatgttgatgagggcgtcagctagtagcgagaacaataaagctagttcatctaaggcaacatttcagctcgagctgccagtgaagtacgcggtgtacaccatgataagccgacaggaggaatcaaccaagtactttaacttcgccaccagcgatgaaaaaaagatgaaggaggccgagcatagatatcgagtcaacaatcttagccagcgcgacttagcaatatccatcaatttttgggtaccagtgttgctgaatggggtagccgtatgggatgtggttatggaagccccatcgcagtccctgccttgtgtctccgaaagaaaacctcctcaacactccgattttctgacacagatcagcaggtcacccatgctcgactgtagcatcgctgactgcttacaatttaggtgtgacgtcccatcattctcagtccaggaagaactcgactttacactgaaagggaacctgtccttcggatgggtccgggaaactctgcagaagaaggtgctggtggtgtcagtggcggaaatcacatttgacacgtctgtctatagccagctgccaggacaggaggctttcatgcgagcccaaatggagatggtgctcgaagaggacgaggtgtataatgctataccgattatcatggggtccagcgtaggagccctgctgttactggccctgatcacagcgaccctgtataagttggggtttttcaagcgccactacaaggaaatgctggaggataagccagaagacaccgcaactttcagcggggatgacttttcatgtgtcgccccaaatgttccactctcatag

SEQ ID NO: 226967 - DNA, 3513 bp, Artificial Sequence
  Description of Artificial Sequence: Synthetic coding sequence
atgaaagactcatgcatcaccgtcatggctatggctctgctgtctggatttttcttctttgccccagcatcaagttataacttggacgtgaggggcgcaaggagcttttctcccccaagagcaggcaggcactttggctatcgggttctccaggtgggaaatggcgttattgtaggcgcaccaggtgaaggaaatagtaccggctcactgtaccagtgccaaagtgggaccggccattgcctgcccgtgaccctacgaggtagtaactatacctctaaatatctgggaatgacactcgcaactgacccaaccgacggctccattctcgcctgcgaccccggtctgtccaggacctgtgatcagaacacatacttaagcggtctctgttacttatttcgccaaaacctgcagggccctatgctgcagggacggcctggattccaggaatgcataaaggggaatgtggatcttgtgttcctcttcgacgggtcgatgtctctgcagccagacgagtttcagaagattctggattttatgaaggacgttatgaaaaaattgtcaaacacgagttatcagtttgccgcagtacagttcagcacaagctataagaccgagttcgatttttcagactatgttaagcggaaggaccccgacgctttgctcaagcacgttaaacatatgctgctgctgaccaatacttttggagcgatcaactatgtggccacagaggtgttcagagaagaattgggagctcgcccagacgccactaaagtgttaatcattataaccgatggggaggccacagactccggaaacattgatgctgcgaaagacattattaggtacatcattggaatcggaaaacacttccagacaaaggaaagccaggaaaccctgcacaagttcgcttctaagcctgcctcagagtttgttaagatcctggataccttcgagaaactcaaggacctgttcacggaactgcagaagaaaatctacgtaatcgaagggacgagcaaacaggacctgacgtccttcaacatggagctcagctcatcaggaatcagtgccgatctttcccgcggacatgcagtggtgggcgctgtaggcgcaaaggactgggcaggaggtttcctggacctgaaagccgacctccaggacgatacattcattgggaacgagccattgacaccggaggtgcgggcaggctatttaggctacacagtgacgtggctaccatctaggcagaaaacttctcttctcgcttccggggctccgagatatcagcatatggggagggtgcttcttttccaggagccccaggggggtgggcactggagccaggttcaaaccatacacggcactcagatcggctcctactttgggggagagttgtgcggagtggacgtcgaccaggacggagaaacggaattgttgctgattggggcaccactgttctacggtgagcagagaggaggcagggtgtttatctaccagcggaggcagctgggctttgaagaggtgagtgagcttcagggcgatcctggatatcctcttggaaggttcggcgaggctatcactgcccttaccgatatcaacggcgacggcctggtggatgttgcggtcggtgcaccgttggaagaacagggggctgtgtatatcttcaatgggaggcacgggggtcttagcccacagccctcccagaggatcgagggtacgcaggtgctttctggcatccagtggtttggaagaagcatccatggggtaaaggacctcgagggtgacggtctggcagatgtggccgtgggggcagagtcccagatgatcgtactcagtagccgcccagttgtggatatggttactctgatgtctttctcccccgcagagatccccgtacacgaggtggaatgtagctactctaccagcaataaaatgaaggaaggcgtgaatattaccatctgttttcaaattaaatctctgatcccccagttccaagggcgattggtggctaatctgacttacactcttcaactggatggtcatcgcacacgacggaggggcttgtttcctggcggaagacatgaactaagacgcaacattgccgtcacaacctctatgtcctgcacggatttttcattccacttcccagtgtgtgtacaggatctgatcagccccatcaatgtcagtttgaacttcagcttatgggaggaggaaggcactccccgagatcagcgtgcacaaggtaaagatatcccccctatcctgagaccaagtttacacagcgagacatgggaaatcccctttgaaaagaattgcggagaggataaaaagtgtgaggctaatctgcgtgtcagcttcagcccagcgcgttctagggccctgaggttgacagcatttgctagtctgtctgttgaattgagcctgagcaatctggaagaagatgcatattgggtccaattagacctacacttccctccgggtctcagttttagaaaggtggagatgctgaaacctcatagccaaatcccagttagctgtgaagagttacctgaggagtctaggctgctgagccgagccttgtcttgcaatgtcagcagtcccatatttaaggccggacactcggttgctcttcagatgatgttcaacactctcgtaaatagcagttggggtgatagtgtcgagttgcacgccaatgtgacatgcaataacgaggacagcgacctgctggaggacaatagcgccacaacaattatccccatcctgtacccaattaacattttaatacaggatcaggaagactccaccctgtacgtgagctttacccccaaaggccctaaaattcaccaagtaaaacacatgtatcaggtgagaatccagcccagcatccatgatcataatatccccacccttgaggcagtcgtcggcgttccgcagccaccgagcgagggcccaatcacccaccagtggtccgtgcagatggagccaccagtgccctgccattatgaggatctcgagagactcccagatgctgccgagccctgcctgcctggagctctctttcgttgtcctgttgtgtttcggcaggaaattctggtgcaggtgattggcactctggagctggtcggcgagatcgaagcttcctccatgttctcactctgttctagtctatccataagtttcaactcttcgaagcactttcacttgtacgggagcaacgcgagcctggctcaagtggtcatgaaagtcgacgtcgtatatgaaaagcagatgctctatctatacgttctgagtggtatcgggggtctcctgttacttctattgatctttatagtgctgtataaggtgggattttttaagaggaatcttaaggaaaagatggaggccggaagaggcgtgccaaatggtatcccagcagaggattccgaacagctggctagtggacaagaagcaggcgaccctggttgcctgaaaccactccacgaaaaggactccgaatcggggggtggaaaagattag

SEQ ID NO: 226968 - DNA, 3261 bp, Artificial Sequence
  Description of Artificial Sequence: Synthetic coding sequence
atgaaagattcctgtatcacagtcatggccatggctctcctgtcaggattttttttttttgcccctgcttcttcatacaatctggatgttagaggcgctcgatccttttcccctcctcgggctggacgtcatttcggttatcgggtgctccaggtgggtaatggagttatcgtgggcgcacccggagaaggaaatagcactggaagcctttatcagtgtcagagcggcaccggccactgtctgcctgttactctccgcggatccaactacacttctaaatatttaggaatgacgttggccacagatccaacagatggttcgatcttgttcgccgctgttcagttcagtactagttacaaaaccgaatttgatttctctgactatgtcaaaagaaaagatccagatgcccttctgaagcatgtgaagcacatgctgctattgaccaacacctttggagcgataaactacgtggcaactgaggtttttcgcgaggagctgggagctagacccgatgccacaaaggtgctgattataatcactgacggcgaggccactgactcaggtaacatcgacgccgcaaaagacattatccggtatataataggaatcggtaaacactttcagactaaagagtctcaggaaaccctacacaagttcgcctcaaaaccggcttccgagttcgtgaaaattctggacacgtttgaaaaactcaaggatcttttcactgaactccagaagaagatttacgtgatcgaggggaccagcaaacaggacctcacctcttttaatatggagctttcttcctcagggatttccgcagacctttctcgaggacatgcagtcgtaggagcagttggtgcgaaggactgggccggtggatttttggatctcaaagccgacttgcaagacgatacattcatcggcaacgaaccccttacgccagaagtcagagccggatacctgggatataccgttacgtggcttcctagcaggcagaagacgagcctgcttgctagcggcgcacctaggtaccagcatatgggaagggtgttgctgtttcaagagccacaggggggtgggcactggtcacaagtgcagacgatacatggaacgcaaatcggatcttactttgggggtgaactatgcggcgtggatgtggatcaagacggggaaacagaactgctactgatcggagcccctcttttctacggagaacagcgagggggtagggtttttatctaccagaggcgacagttgggttttgaggaggtgtccgagttgcaaggagacccaggctatcccctgggccgatttggcgaagctatcactgccctgacagacatcaacggcgatgggctagtggatgtcgcggtgggtgctcctctcgaggagcagggcgctgtgtacatttttaatgggagacacggcggactgtcaccacagcccagtcagcgcattgagggaacacaagtattatcgggcattcagtggttcgggaggtctatccacggcgtgaaggatctggaaggcgacggactggcagatgtagctgtgggagcagaatcacagatgatcgtgttatcatcccgcccagtggtagatatggtgactttgatgagcttctcccctgcagaaattccagtccatgaagtggaatgtagctatagtaccagcaataagatgaaggaaggggtgaacatcacaatatgtttccagataaaatctctgattccccagttccaaggacgactagtggcaaatctgacatataccctgcagctcgacggccatcggacaaggaggaggggcctctttccgggtgggcgacacgagttaagaagaaacatagccgtcactacatccatgagctgcactgacttctcatttcacttccccgtatgtgtgcaggacctcatctcccccatcaacgtgagtctcaatttcagtctgtgggaggaagaggggactcctcgcgatcagagggctggaaaagacatcccccctattctgcgaccatcattacatagcgaaacttgggagattcccttcgaaaagaactgcggcgaagataagaagtgtgaagcaaatctgagggttagcttttctccagctcgctccagggcactgaggctcacggcgttcgctagcctttccgttgagctcagcttgtcaaatctggaggaggatgcttattgggtgcagctggacctgcacttccctccaggtctttcttttcgcaaggttgagatgctgaaaccacactctcagatacctgtgtcatgtgaggagctgccggaagagagccgactcctatctagagctctctcctgcaatgtgtcaagtcccatattcaaagccggacatagcgttgctttacagatgatgtttaataccttagtaaactcaagctggggggacagtgtggaactacatgccaacgtcacttgtaataatgaagatagcgacttgcttgaagacaacagtgccacaaccattataccgatactctatcctatcaatatcctaatccaggaccaggaagactccaccctgtatgtatcattcacgcctaagggccctaagattcaccaggtgaagcacatgtaccaggtgcggatacagcccagtatccacgaccataacattcctacactggaggctgtagtcggggttcctcaacccccatcagagggccctataacgcatcagtggtcagtccagatggagccacccgtgccttgtcactacgaggacctggagagattgccagacgcagctgaaccttgtttaccaggggcactgttcagatgcccagtcgtatttcgacaagaaatcttagtacaggtcatcggcaccctggagctcgtgggagaaattgaggccagcagcatgttctctttgtgcagcagtcttagcatctccttcaacagctcaaagcactttcacttatatggctcgaacgcctcgctggctcaggtagtgatgaaggtggacgtggtgtatgaaaaacagatgctatacctctacgtgctgtccggtattggcggactcttgctcttgttgttgatctttatcgtgctttataaagtagggtttttcaagcggaatctgaaggagaaaatggaagcagggagaggcgtgccgaacggcatccccgctgaggactctgagcagttagcatccggccaggaggccggagatcccggatgcctgaagcccctgcacgaaaaggactctgagagcggcggaggaaaggattag

SEQ ID NO: 226969 - DNA, 1215 bp, Artificial Sequence
  Description of Artificial Sequence: Synthetic coding sequence
atgaaggacagctgcatcactgtcatggcaatggccctcctctctggtttcttcttctttgcacctgcctcctcctataatctggacgttagaggagcaagatcctttagtccaccccgagcgggtaggcattttggctaccgcgttctgcagatcaagagtctgatacctcagttccaggggcgactcgtggctaaccttacctataccctacagctggacgggcaccggacccgtcgccgtggcctgtttcctggagggagacatgaactccggagaaacattgcggtgacaacatctatgagttgcacagacttcagcttccacttcccaatgatgttcaacaccctcgtcaactcttcttggggcgattctgtagagctgcatgccaatgtgacatgtaacaatgaagactccgatctgctcgaagataatagtgctaccacaattatccctatcttgtacccaattaacatactaattcaagatcaggaggatagtaccctgtatgtgtcatttactcccaaaggaccgaagatccaccaggtgaaacacatgtatcaggttcggatacagccaagcatccacgatcataacatcccaaccctggaggctgtggttggtgtgccccagcccccatccgaagggcctattacccatcaatggtcagtgcagatggaacctcctgtgccctgtcactatgaggatcttgagcgcctgcccgacgccgcagaaccttgtctcccaggggctctgttccgctgccccgtggtgtttcggcaagaaatcctggtacaggtgattggcactctagaactggtgggggagattgaagcatcttcaatgtttagcttatgctcttctttgtcgatatccttcaattcttcgaagcacttccacctgtacggttcaaacgcctcgttggcacaggtggtgatgaaagtggacgtagtgtatgaaaaacaaatgctgtatctgtatgttctttccggcataggtggtttgcttcttctgttacttatctttattgttctgtacaaagtcgggttctttaaaagaaacttgaaagaaaagatggaagctggccgaggcgtcccaaatgggatccctgccgaagactctgagcaattggcatctggacaggaagcaggcgatccaggctgcctgaagccgttgcacgagaaggactcagagtctggcggagggaaagactag

SEQ ID NO: 226970 - DNA, 489 bp, Artificial Sequence
  Description of Artificial Sequence: Synthetic coding sequence
atgaaggattcttgtatcaccgtaatggccatggccctgctctcggggttttttttcttcgcccctgcttcaagctataatctcgatgtcagaggcgctcggtcgttctctccacccagggccggaaggcactttggctaccgcgtcttacaggtggggaacggggtaattgtcggagccccaggtgaggggaattctaccggatctctgtaccaatgtcagagcggtactgggcactgcctgcctgtcacattgagagggtctaattatacatctaaatacttgggcatgaccctcgccacagatcctactgacgggagcatattggcatgtgaccccggtctcagccgtacatgcgaccaaaatacttatctatcaggcctctgttacctgttccgccagaacttgcaaggcccaatgctccagggtcgcccaggattccaggtctgctgctgcagtgtgtttcacaagctgcaaaatcgcatctag

SEQ ID NO: 226971 - DNA, 3459 bp, Artificial Sequence
  Description of Artificial Sequence: Synthetic coding sequence
atggcgctgagagtgcttctgcttacagcactcaccctgtgccacggattcaatttggatacagaaaacgccatgacttttcaagagaatgcccgaggctttggacagtccgtggtccagttgcaggggagcagagtggtggtcggcgctccacaggagattgtcgcagctaaccagagaggaagcctttatcagtgcgactatagcaccggaagctgtgaaccgataagactgcaggtgccggttgaagcggtgaatatgagccttggactctccctggccgcaaccacatctcctccacagctactcgcatgcggtccgacggtacaccagacgtgttctgaaaatacttacgtcaaggggctgtgctttctgttcgggagtaaccttagacaacagccacagaaattcccagaagcacttcgcggatgtcctcaggaggactcagatattgccttcttgatcgacggctccggaagcatcattccacatgattttaggagaatgaaagaatttgtttcaaccgtgatggagcagctcaagaaatctaagaccctcttcagtctgatgcaatattccgaggaattcagaatccattttacgtttaaggaattccagaacaaccccaacccacggtcgctcgtcaagcccataacgcagttactcgggaggacacacactgccaccggaattcggaaggttgtgagagagttgttcaacatcactaacggagcgcgaaagaatgcgttcaagatcctcgtcgtgatcaccgacggcgaaaaatttggggatccactgggatacgaagatgtaatcccagaagctgacagagagggagtgataagatatgtcatcggggttggtgacgcctttcgctcggagaagtcaaggcaggagctcaacaccatagcaagcaaaccaccgagagaccacgtttttcaggttaataattttgaggcattgaaaaccatccagaaccaactgcgggagaaaatcttcgcgatcgagggaacccagacaggtagttcttcatcctttgagcatgagatgagtcaggaggggttttccgccgcaatcacatcaaatggaccacttctgagcaccgtcgggtcatacgattgggcaggaggagtatttttgtacacatccaaagaaaagtcaaccttcatcaacatgacacgggtcgactctgacatgaacgacgcctatttagggtatgctgctgcaataattctgagaaatagggtccagtccctggtgcttggcgcacctcgctaccagcacatagggctcgtggcgatgtttcggcagaataccggaatgtgggagtcaaacgcaaacgtgaagggaacacaaataggagcgtacttcggagccagcttgtgttctgtggacgtggacagtaacggctctactgacctcgttcttattggggctcctcactattacgaacaaacacgcggtgggcaagtgagtgtgtgtccactgccacggggaagagctaggtggcagtgcgacgccgtgctgtatggcgagcagggacagccctgggggcgtttcggcgctgcgcttacagtcctgggggatgtgaatggagacaaattgacagacgtggctataggggcacctggcgaggaggataacagaggagctgtctaccttttccacggcaccagcggttccgggatttctccatcacatagccagcgcattgctggaagcaagttatctccaaggttacaatatttcggtcagagcctttcaggcggacaggacctgacgatggacggtctggtggacctgacagtcggagcccaagggcacgtgctccttctgcgctcccagccggtcctaagagtgaaagctatcatggaatttaaccccagggaagtggccaggaacgtctttgaatgcaacgaccaggttgtgaaaggtaaagaggctggcgaggttcgtgtgtgtcttcatgtacagaagagcaccagggatcgactgagagaaggccagattcagtctgtagtgacttatgatctggcacttgattctggtagaccccacagccgagcagtctttaatgagactaaaaactctaccaggaggcagacgcaggttctggggctgacccagacttgcgagaccctcaagcttcaacttccaaattgcattgaagaccctgtgtcccctattgtactccgattaaattttagcctggttgggacaccactgtctgcgttcggtaacctcagacccgttctagcagaggacgcacagcggctcttcacagccctgttcccatttgaaaagaattgtggcaacgacaatatttgccaggacgatctgagcatcacgttttcattcatgtccctggactgtctggtggttgggggacctagagagttcaatgtgaccgtgaccgtgcgcaatgacggtgaggacagttaccggacccaggtcactttcttcttccccttggacctgtcttatcggaaggtctcgacccttcaaaatcaacggtcacagaggagttggaggttagcctgtgaaagcgcgagttctacggaagtttctggggctctcaaaagcaccagctgcagtataaatcaccctatcttcccggagaattctgaggtaacctttaacattacatttgatgttgactctaaggcgagtctagggaacaaattgctgttaaaagctaatgttacatctgaaaataatatgcccaggactaataaaactgagttccaactggagcttcctgtgaagtatgccgtatatatggtagtgaccagccatggcgtgtctacaaaatatctgaactttactgcgagcgaaaacactagccgcgtgatgcagcaccagtatcaggtaagtaacctggggcagcggagtcttccaatttctttagtgtttctagtaccggtgagactcaaccagacagtcatttgggaccggcctcaggtgaccttctcggagaatctgtcttcaacatgccacacgaaagagaggttaccttcccattccgattttttagctgagttaagaaaggcccctgtcgtgaattgttcaattgctgtgtgccagcgcatccagtgcgatataccttttttcggtattcaagaggaatttaatgccacactgaagggcaatctaagtttcgactggtatataaagacaagccataatcacctcttgattgtgagcaccgctgaaatcctgttcaacgactctgtctttactctgttacctggtcagggtgcattcgttcggtcccagacggaaaccaaagtggaacccttcgaggttcctaatccactgcccctgatcgtgggcagcagtgtgggaggcctcctgcttctagctctgattactgctgctctttacaagcttggcttttttaagagacagtacaaggatatgatgagcgagggtggccctcccggtgctgagccccagtag

SEQ ID NO: 226972 - DNA, 3462 bp, Artificial Sequence
  Description of Artificial Sequence: Synthetic coding sequence
atggctctcagagtactgctgttgactgccctgaccctttgccacgggtttaatctggatacagagaacgccatgacattccaggaaaacgccagagggtttgggcagtccgttgtccagcttcaaggtagccgcgtcgtggtgggggcaccgcaggaaatcgtggctgccaatcaacgcggttcactgtatcagtgcgactactctaccggttcgtgtgagccaatcagactgcaggtgccggtcgaagcagttaacatgtcactggggttgtccctggcagccacaacctccccaccacagttgcttgcgtgcggccctaccgtacaccagacttgctccgaaaatacctatgtgaagggtttgtgtttcctgttcgggagcaacctccggcaacaaccccagaaatttccagaggccctgcggggatgcccacaggaggactcagacatagccttccttatcgacgggtcaggaagcatcatccctcatgatttccgtcgcatgaaagagtttgtgagcaccgtgatggagcagctcaaaaaaagcaagactctattttctctcatgcaatattccgaagagtttcggatacacttcacctttaaagagttccagaataaccctaatcctaggtctttggtgaaacctatcacacagctgttgggcagaactcatactgcgactggaatccgtaaggtggtgcgagaactgtttaacatcaccaacggcgctcgcaagaacgctttcaagattctggtggtgattaccgacggggagaagtttggagacccgctcggatatgaggacgttattccagaagcagaccgagagggagtcatccgctatgttatcggtgtgggagacgctttcagatccgaaaaatcaagacaggaactcaatacaatcgcttcaaagcctcctcgggatcacgtgttccaggtaaacaatttcgaggccttgaagacaatccagaatcagctgcgcgagaaaatctttgcaattgaagggacgcaaaccggatcctctagctcctttgagcacgagatgtcccaggaagggttctcagctgccatcaccagtaacggtcctcttttgagcacagtaggctcttatgactgggctgggggtgtcttcctgtatacctccaaggagaaaagtaccttcatcaatatgacacgagtggatagcgacatgaacgatgcctatctgggatacgccgcagccatcatactgagaaatcgggtacaaagcctggtgctgggtgcgcctaggtaccaacacataggcttggttgcaatgttccggcagaatactggaatgtgggaaagcaacgccaatgttaagggaacacagatcggcgcttacttcggggcttcgttatgttcagtcgacgtcgattctaatggatcgacggatctggtgctaatcggcgcaccacattattacgaacagacacgaggagggcaggtgtcggtgtgcccccttcccaggggtcaaagagcccgttggcaatgcgacgcagtgctctacggcgaacaagggcagccttggggaagattcggggctgccctcactgtgctcggggatgtgaacggcgataaactgaccgatgtcgctatcggcgctcccggtgaggaggacaataggggcgctgtgtacctgtttcatggcacctccggaagtggtatcagtccaagccacagtcagcgtattgctggctcgaagctttctcccaggctgcagtacttcgggcagtctctgtccggcggtcaggacttaactatggacggactggttgatttgaccgtaggcgctcagggccatgttctactgctacgcagtcagcccgtactccgagttaaagccattatggagtttaatcctcgcgaggtggcaaggaatgtatttgaatgtaatgatcaggttgtaaaggggaaagaggctggagaagttagagtttgtctgcatgtgcagaaaagtacacgcgataggctcagagagggacagattcaaagcgttgtgacctatgatctggccctggattctggacggccacattcacgggctgtgttcaacgagaccaaaaactccacccgcaggcagacgcaggtactcggactgacccagacatgtgagacactgaagctacaactaccaaactgcatcgaagatccagtctcccccatagtgctcagattaaacttttccttagtgggaacgcctctaagcgcctttggaaatttacggcctgtcctcgcagaagacgcccaacggctcttcaccgccttgttcccattcgaaaagaattgcggtaacgacaacatttgccaggacgatctatcaataaccttctcgttcatgtccctggactgtcttgttgtcggtggcccacgtgaattcaacgtcaccgtgacagtgcgcaatgacggagaggatagctatcggactcaagttacattcttcttccctctagatctgagctataggaaggtgagcaccttacagaaccagagatcccagcggagctggcgactggcttgtgaaagcgcttcttccacagaggtgagcggcgctctgaagagtactagctgctctattaaccatcccatttttcccgagaactcagaggttacattcaatattaccttcgacgtggactccaaagcaagcctgggcaacaaacttctccttaaagccaatgtgacctccgagaacaacatgcccagaacaaataagacagagttccagctggagctgccagtgaagtacgcagtctatatggtcgttacatctcacggggtgagcactaagtatctcaacttcacagcctcagaaaacacctcacgtgtcatgcagcaccagtatcaggtaagcaatttgggacagcgctctctgcctatttctctagtgttcctggtcccagttcggctgaatcagaccgtgatctgggaccgtccccaagtgaccttctccgagaacctgtcctccacctgccacaccaaggaaagactgccatcacacagcgattttttagcagaactccggaaagcaccagtagtgaattgttctatcgctgtgtgtcagcgcatccagtgtgacattccctttttcggcattcaggaagaattcaatgctacgctcaaggggaatctcagctttgattggtatatcaaaacctcccacaaccacctgctgatcgtcagcactgccgagatactgttcaacgacagtgtgttcaccctgctgcctggacagggtgcattcgtgagatcccagactgaaacgaaggtcgagccattcgaggtaccaaatcctctgcctttgattgttggtagttcagtcggaggtctgctactactggccctcatcaccgctgccctctacaaactgggttttttcaaacggcaatataaggatatgatgagcgaaggaggaccacccggagcggagccccagtag

SEQ ID NO: 226973 - DNA, 3492 bp, Artificial Sequence
  Description of Artificial Sequence: Synthetic coding sequence
atgactcgcacccgcgctgccctacttctcttcaccgcactggccaccagtttaggcttcaatcttgacacggaggagttaactgccttccgagtggacagtgccggatttggcgactctgtggtacagtatgcgaattcatgggtcgtggtgggcgctcctcagaagataacagccgcaaaccaaacaggaggcctgtatcagtgcggctactcaaccggggcttgcgaacccattgggcttcaggtcccgccagaagcagtgaacatgtcattagggctgagtctggcttccactacgagcccatcccaactgctggcttgtggccctacagtgcaccatgaatgcgggcgaaatatgtatttaactggcctgtgcttcctgctcggcccaacccaacttacacagcgactgccagtgagccggcaggagtgtccaagacaggagcaggacatagtttttcttatcgacggttccggatctatttcttctcgaaattttgctacgatgatgaactttgtgagagcggtgatcagccagttccagaggcctagcacccagttcagccttatgcaattttccaacaagttccagacccactttacctttgaggaatttaggcgcagctctaaccctttatcactgctggcatccgtccaccagttgcagggctttacttacacagccactgccatacagaatgtggtgcatagactgtttcatgcctcctacggggctaggagagacgcagcgaaaatacttattgtgattaccgatggcaagaaggagggggatagcctcgactataaggacgtcattccaatggcggacgcagctgggatcattcgatacgcgattggcgtgggcctggcattccaaaacagaaattcctggaaggagttaaacgatatagcttcaaagccttcgcaggaacacatcttcaaagtggaggattttgacgcacttaaagatatccagaaccagctcaaagagaaaatttttgccattgagggaacagagactacatcatcctcctccttcgaattggaaatggcccaggaggggttctcagccgtcttcacacccgacggaccagtacttggagcagtggggtcgttcacatggagtggaggcgcatttctgtaccctccaaacatgtcccccacatttatcaacatgtctcaggagaatgttgatatgcgggacagttacctagggtacagcacagaactcgcgctgtggaagggtgtccaaagcctagtcctcggagctccaagatatcagcacaccgggaaggccgtgatctttactcaggtgtccaggcaatggcgcatgaaggcagaggtgacaggaacccagatcggctcttactttggtgctagcctctgctccgtagacgtcgactccgatggctcaaccgatttagttctgattggcgcaccgcattactacgagcaaacgaggggtgggcaggtctctgtgtgccctttacccagagggtggcggcgatggtggtgtgatgccgtgctgtacggcgaacaagggcatccatgggggagatttggcgcagctctcaccgtactgggcgacgtcaatggtgacaagctaacagatgtagtcattggagcaccaggagaagaggagaaccgtggcgctgtgtacctcttccatggtgtgctgggcccttccatctcaccttcccactctcagcgtatagcaggttctcagcttagttcacgattgcagtactttggccaggccctgtctgggggtcaagacctcacacaagacggtttagtggacctcgcggtgggcgcacggggacaggttctcttgctacgtacccgccctgtcctgtgggtaggcgtgtccatgcagtttattccagctgagattcctcgatctgcctttgagtgtcgcgagcaagtagtctccgagcagacactggtccagtctaacatttgcttgtacattgataagcggtccaaaaatcttttaggcagcagggaccttcagagctcagttactcttgacctggccctcgaccccggacggctgtcccctagggccaccttccaggagactaaaaatcgaagtctgtcccgggtgagagtactaggtctaaaggctcactgtgaaaacttcaacctgttactcccttcctgcgtcgaagacagtgttactcctatcacactccggctgaatttcacactggtggggaaaccactcctcgcattcaggaatcttagacctatgctggctgccgacgcccaacggtactttacggctagtcttccgtttgagaaaaattgcggagccgaccacatttgccaggataatctcggcatcagtttctccttcccagggctcaagagcttactggtgggctcaaacctggaactgaatgcagaggtgatggtgtggaatgacggggaagatagctacggcaccaccattactttttcacaccctgcaggtctcagttacaggtacgttgcggaggggcagaagcagggacagcttcggagccttcatctgacgtgtgattccgcgcctgttgggtcacagggaacatggagcaccagttgccggataaatcacctgatcttccgtggaggagcccaaatcacttttttagcaacattcgacgtgtctccaaaggcagtactcggagacaggctgttgctgactgccaatgtatcctcagagaacaataccccgagaaccagcaagactacatttcagctggagctgcccgtgaaatacgcagtctacacagttgtttcaagccatgaacagttcactaaatacctgaatttcagcgaaagtgaggagaaagagagccatgtcgctatgcaccgctaccaagtcaataatctcgggcagagagacttgccagtctcaataaatttttgggtgcccgtagagttaaatcaagaagccgtctggatggacgtcgaagtctcccatccccaaaatccatcactgcggtgcagtagtgagaagatcgcacctcctgcctcagacttccttgcccatatccaaaagaatcccgtcctggactgctcaatagctggctgccttcgcttccgctgcgatgtgccgagtttcagtgtgcaggaagagctagattttacattaaaaggcaatttgtcatttggctgggtcaggcagatcctgcaaaagaaggtgtctgtcgttagcgtagccgaaattacgttcgacacgtcagtgtatagccaattgccgggacaggaagcgtttatgcgggctcagacaacgaccgtcctggagaaatacaaggtccacaatccaacaccgctgattgtaggaagtagtataggcggacttctgttactggctcttattaccgcagtgttgtacaaggtggggttctttaaaagacaatacaaggagatgatggaggaggcgaacgggcagatcgccccagagaacggcactcagaccccgtccccaccttccgagaagtag

SEQ ID NO: 226974 - DNA, 5469 bp, Artificial Sequence
  Description of Artificial Sequence: Synthetic coding sequence
atggccggaccacgaccctccccatgggccagactgctcctcgccgctctgatctctgtctctctttctgggactttagcgaatcgatgtaagaaggccccagttaagtcatgcactgaatgcgtacgcgtggataaagactgcgcctactgtacggacgaaatgtttcgagatcggaggtgtaatacccaggccgaacttctggccgctggatgccaacgggaatcgattgttgtcatggagagctccttccagatcacagaggagactcaaattgataccaccctgagacgctcgcaaatgagcccccagggccttagagttcgcctgcgccctggtgaagaaaggcactttgagttagaagtattcgaacccctcgaatctccagtcgacctttatatcctgatggacttctcgaactctatgtctgacgacttggacaatctgaaaaagatgggtcagaacttggcccgagtgctgtcccaacttacatccgattacacaatcggctttggcaaatttgtcgataaggtgtccgtgcctcagacagacatgaggcccgaaaaactgaaagaaccttggcccaacagcgacccaccattcagcttcaagaatgtcatcagtctaactgaagatgtggatgagttcaggaataagctacagggagaaaggatcagtggtaatctggacgcacccgaggggggattcgacgccatcttgcagactgctgtgtgcacgagggatatcggctggagaccagattccactcacttattagtcttcagcaccgaatcggcctttcattacgaggccgatggggctaatgtcttggccggaataatgagccgtaatgacgagcggtgccacctagacacaacaggaacgtacacacaataccggacccaggactaccccagcgtgccaacactagtgcgcctgttggcaaaacacaatatcatccctatctttgcggtaaccaactacagttactcatactacgagaaattgcatacttattttccagtgtcttccttgggcgtcttacaggaggacagcagtaatattgtggaactacttgaagaagcattcaataggatccgtagcaacctggatatccgggcattggacagtcctcgcggtctgcgcacggaagttacaagtaaaatgtttcaaaagacccgaaccggctccttccatatcagaaggggcgaggtgggcatttatcaggtacagctgagggccttggagcacgtcgatggtacacatgtttgtcagctgcctgaggaccaaaagggcaacatacacttgaagcctagcttttctgacggtctgaaaatggacgctgggatcatttgcgacgtctgcacatgtgaactgcagaaagaggttaggtccgccagatgctcatttaatggcgatttcgtttgcgggcagtgtgtctgttctgagggttggtcgggccagacatgcaactgcagcacagggtctttatctgacatccagccctgtctgagagagggggaggacaaaccttgctccgggcgaggggagtgccaatgtggccactgtgtctgctatggcgagggtcgatatgaaggtcagttctgcgaatatgataattttcagtgccctagaaccagtggtttcctctgcaacgacaggggcaggtgctcaatgggccaatgtgtgtgtgaaccgggttggacgggaccctcatgcgactgtcccctgagcaacgccacatgtatagattctaacggcggaatatgcaatggacgaggccactgcgaatgtgggagatgccactgtcatcagcagtctttgtacactgacaccatctgtgagattaactactcagctatacaccctggactgtgtgaggacctgcggagttgcgtccagtgccaggcatggggcactggcgaaaaaaagggcaggacctgcgaagagtgcaatttcaaagtcaagatggtggatgagctgaaaagggctgaggaagtcgttgttaggtgctcttttcgcgatgaagacgatgactgcacatacagctacactatggaaggcgatggagcaccaggccctaattcaaccgtcctcgtgcataaaaaaaaggactgcccaccaggaagcttctggtggcttatccccctgttgctgctgctgttgccactgctcgccttactactattgctgtgctggaaatattgcgcgtgctgcaaggcatgccttgccctcctaccctgttgcaaccgtggtcacatggtgggctttaaggaggatcactacatgctcagagagaacctgatggcctctgatcatctagacacacctatgctccgtagtggtaatctgaagggtagggacgtggttcggtggaaagtgacaaacaatatgcagagacctggctttgctactcatgccgcttcaattaaccccactgagctggtgccttatggcctttctttacggcttgcgagactttgtaccgagaatcttttaaagcccgacactcgggagtgtgcccagctgagacaagaggtggaggagaatctcaacgaggtctaccggcagatcagcggagtccataagcttcagcaaactaagtttcgacagcaacctaacgctggaaaaaagcaagaccacaccatcgtcgacaccgtgctgatggcacctagatctgcgaagcctgctttgctgaaactgacagagaagcaagtggagcagagagcctttcacgatttgaaggtggcaccaggctactacacattaacagcggaccaagatgccaggggcatggtggagtttcaggaaggggttgaactggttgatgtccgagtgccactgtttattcggcctgaggacgatgatgaaaaacagctacttgtcgaggcgatcgacgtgcctgctgggacagcaacattgggtaggcggctggttaacattactattatcaaggagcaggctagagatgttgttagctttgagcaaccagagttttcagtaagccgaggcgaccaggtggccagaatcccagttatccgcagagttcttgatggcggaaaatctcaggtgagctataggacccaggacggcactgcccagggcaacagggattatatccccgtggagggagaactgctattccagccaggcgaggcctggaaagagctccaggtcaagctcctcgagcttcaggaggtggatagcctgctgagaggacggcaagtaagaagattccacgtccagctttccaacccaaaatttggagctcaccttggtcaaccccactccaccactatcatcattagagatccggatgaactggatagatcttttacgtcacaaatgttatcaagccaacctcccccacatggagacctcggagcccctcagaatcccaacgccaaggcagccggatcccggaaaattcactttaactggctgccacctagcggaaagccaatgggatatagggtaaaatattggatacagggagattccgagtcagaagcacacctgttggacagcaaggtgccaagcgtagagctgactaacttatatccctactgcgactatgagatgaaggtttgtgcttatggtgcccaaggcgaggggccatacagctccttggtgtcctgcagaacccatcaggaggtgccttcagaaccagggcgacttgctttcaatgttgtgagctccactgtgactcagttgagctgggccgagcctgcagagactaatggcgaaatcaccgcctacgaggtgtgttacggactggttaatgatgacaatcgcccaattggtccaatgaaaaaggtcctcgtggataatccaaagaatcgcatgctgttaattgaaaacctgagagagagtcagccctaccggtatacagtgaaggcccgaaacggagcaggctggggcccagagagggaagcgatcattaatctggctacccaaccaaaacgacctatgtctatccccattattcctgacattccaatcgtggacgcccaatctggagaggactacgatagcttcttgatgtatagtgatgatgtcctacgcagtcctagcggctcacaacgccctagcgtgtccgatgacaccggatgcggatggaaattcgagcccctcctgggagaggagctggatctgaggcgggttacttggcgattgcctcccgagctgattccacgcttgagcgcttcttccgggagaagctctgatgccgaggcaccacacggaccacctgacgatggaggcgctggaggcaaggggggaagtctcccacgatcagcaaccccaggaccacccggtgaacatttagtcaacggaaggatggactttgcctttcctggtagcacgaactcactgcatcgaatgaccaccacttccgcagctgcatacgggacccacctgagtccacatgtcccccacagggtgctgagcacctcttcaactctgactagagactacaatagtctcacgcggagcgaacactctcatagcactacccttccacgcgactatagcaccctgacgtccgtgtccagccacgacagccggttaacagcaggcgtgcccgacacaccaacccggcttgtgttttctgcattaggtccaaccagcctgcgagtcagttggcaggagcctcggtgcgagcgcccactgcagggttactctgttgagtaccagctgctgaacggcggtgagctccaccggctgaacatccctaatccagcacagacttctgtggtggtggaagatcttctgcctaaccattcctatgtgtttcgcgtaagagcccagtcccaggaaggttggggaagggagcgagagggcgttatcacaatcgagtcacaggtccaccctcagagccctctgtgccccctgccaggctcagcattcaccttgtctacgccatctgccccaggtccgctcgtctttaccgcgttatccccagatagcttgcagctctcgtgggagcggcctcgcagaccaaatggtgacatcgtcggctatcttgttacctgtgaaatggctcagggaggcggtcctgccactgcattccgagttgatggcgattctcccgagtcccggctgacggtgcctggactgagtgaaaacgtgccttacaagtttaaggtgcaggctcgtacaactgagggatttggcccagaacgagagggtataatcaccatcgagagccaagacggagggcctttccctcagcttggttcccgggcaggacttttccagcaccctttgcagtcagaatattcctcaattaccactacgcacacttccgccacagaaccgttcctggtagacggtctcacccttggagcacaacacctggaggctggcggatcactcactagacacgtcactcaagaattcgtgagccggactctaacgacaagcggcaccctgtcgactcacatggaccagcagttctttcaaacctat

SEQ ID NO: 226975 - DNA, 5417 bp, Artificial Sequence
  Description of Artificial Sequence: Synthetic coding sequence
atggcaggccctaggcctagcccttgggcacgcttgctcctggcagccctgatcagcgtaagtctctccggtacactcgctaaccggtgcaaaaaagctcccgtgaagagttgcactgagtgcgtgagggtggacaaggattgtgcatattgcaccgacgagatgtttcgggaccggagatgtaacactcaggcagagctgctggccgcaggatgccagagggaatcaattgtagtgatggagtcatcatttcagattacagaggagacacagattgacacaactcttagacgctcacaaatgtctcctcaggggctgagagtccgcctgcgccctggcgaagagcggcactttgagcttgaggtgtttgagccactcgaaagcccagtggatctgtacatactcatggacttcagtaactctatgagtgatgatcttgacaatctcaagaagatgggccagaatctggctcgcgtgctgagtcaactgaccagcgattatacaataggatttggcaagtttgtagacaaggttagcgtgcctcagaccgatatgcggcctgaaaaactcaaagagccctggccaaattctgaccctcccttttcatttaaaaacgtgatcagtctgaccgaagatgttgatgagttccgaaacaaactgcagggggagagaatttctggcaatttggacgctcccgagggcggatttgatgcaatcctgcagactgctgtatgtacaagagacattggatggcgcccagattcgacccacctgctggtgttctctactgagagcgctttccattacgaagcagatggagctaacgtgttggccggtattatgagccggaacgatgagaggtgccacctcgatacaaccgggacctacacacagtatcgcacacaggactacccctccgtccctaccttggtccgactgctggccaaacataatataattccaatctttgccgtgacgaactatagctattcctattacgaaaagctccatacgtacttccccgtcagcagcctcggcgtgctgcaggaagactcaagcaatattgtcgagctccttgaggaggcttttaataggattaggagcaacttagatattcgggcacttgactccccccgtggtttacggacagaagtgacatccaaaatgttccagaaaacgcgcaccggcagctttcacattcgacggggagaggtgggaatctaccaggtgcagctgcgggctttagagcacgtcgacggcacacatgtgtgtcaattgcctgaagaccaaaagggcaacatccacttaaagccaagcttttccgatggtctcaagatggatgccggaattatttgtgatgtgtgcacttgcgaactccagaaggaggtgcgcagtgccaggtgttcctttaatggcgacttcgtgtgtggacagtgcgtgtgttccgagggatggtccggacagacctgcaattgctccacgggaagcctgtccgacatccagccttgtcttcgcgagggtgaggataaaccttgctctggcagaggggaatgtcaatgcggccattgtgtctgctacggggaggggcgatatgaaggacagttctgtgagtacgacaattttcagtgccctaggacctccggtttcctttgtaacgaccgcggtcgctgttccatgggtcaatgtgtgtgtgaaccgggatggacgggaccctcatgtgattgcccactgagtaacgctacgtgcatagactccaacggcggaatttgcaacggtcggggacactgcgagtgtggccgatgtcattgccatcagcagagtttgtacactgatacgatctgtgaaattaattatagtgccatccatccaggactctgtgaggaccttagaagctgcgtgcagtgccaggcttggggaactggtgaaaagaaagggcgtacctgtgaagaatgtaactttaaggtcaaaatggtggacgaactcaaacgggcagaggaagtggtggtgagatgcagtttcagagatgaagatgatgattgcacctatagctatacaatggagggcgacggagcccctggcccaaactcaaccgttctggtacataaaaaaaaggactgcccaccaggttccttctggtggctcatccccctgttgctcctgctcctgccgctcctggcactcctgctgcttttgtgttggaagtactgcgcgtgttgcaaggcatgtctggctctgctcccctgttgtaatcgtggccatatggtggggttcaaagaggaccactacatgctgagagagaatctgatggccagcgaccacttagataccccaatgctacgctcaggaaatcttaaaggaagagacgtagtccggtggaaagtgactaacaatatgcagcgcccaggattcgcaacacacgccgcttcaataaaccctactgagttggtgccttacggactctctctacgactcgcacgcttatgcacggaaaatctcctgaaacctgatacacgggaatgtgcccaactccgacaggaggtcgaagaaaaccttaacgaggtgtataggcagatatccggagtgcacaaactgcagcagaccaagtttagacaacagcctaatgcaggtaagaaacaggaccacaccatcgttgatacagtgctgatggccccacgttctgctaaaccagcgctacttaaactgacagagaaacaagtagaacagcgggcatttcacgatttgaaagtggcccctgggtactacactcttactgccgatcaagatgcaagagggatggttgagttccaggagggtgtggagctggtggacgtgcgcgtgcctctttttattcgaccggaagacgatgacgagaaacagctgttggtggaagccatcgatgtgccggcaggtactgccacccttggacgtaggttagtcaacattaccattataaaagaacaggcacgggacgttgttagttttgaacagcccgagttctccgtctccaggggtgatcaggtggcaaggattcctgttatcaggcgggtcctcgatggtggtaagtcccaggtatcataccgcacacaggatgggacagcccagggaaacagagactatatcccagtggagggggaacttctgttccagccaggcgaagcctggaaagagctgcaggtcaaacttctagaattgcaagaagtcgatagcttgttgagaggcaggcaggtcagaagatttcacgtacagctcagcaatcccaaatttggcgctcacttgggacaacctcactccaccactatcatcataagagatcccgatgagctggatcggagcttcacgtcccagatgcttagctcccaaccccctcctcacggagacctaggggctccccagaatcccaatgcaaaagctgccggatcacggaaaattcatttcaactggctgcctccctccggcaaacctatgggctacagggtcaaatattggattcagggtgactccgaaagtgaagcccatctcttggacagcaaagtgccttccgtcgagctgaccaatttatatccctattgcgattatgaaatgaaggtgtgtgcctatggggctcagggcgagggcccatacagcagtctcgtgagttgcagaacccatcaggaagtcccaagcgagccagggcgactggccttcaacgtcgtgtccagcacagtcactcagctgtcctgggccgagccagccgagaccaacggcgagattaccgcttacgaagtctgctacggcctggtcaacgatgacaacaggcccatcgggccaatgaagaaggtcctggttgacaaccccaaaaaccggatgctacttatcgaaaatctcagagaatcacagccttaccggtatactgtaaaggctcgtaatggggcaggatgggggccagaaagagaggccattattaatttggcgacccagcctaagcgacccatgagcattccaattattcctgacatccccattgtggatgctcagagtggggaggactacgacagcttcctgatgtactctgatgacgtcttgaggtccccaagcgggtcacagaggcccagcgtgtcagatgatactgagcacctggtaaacggacgcatggattttgctttcccgggatcaacaaactctttgcatagaatgacgactacatccgccgctgcatatggcacccacctttctccacacgtgccgcatcgtgtcttgtctacaagctctacactgactagggactacaactcgttaactcgtagtgaacattcacactcaacaaccctgcctcgggactattccaccctcactagcgtgtcatctcacgggctgcctccaatctgggagcatggccgtagccgtctgcccctgtcttgggccctgggaagtagatcccgcgcacaaatgaaggggtttccgccttcccgtggacctcgcgatagtatcatcctggcgggacgacccgcagctccgagctggggacctgactccaggctcacagcgggagtcccagacacacctactcggctcgtattttcggcattggggccaacctcattgcgggtcagttggcaggagcctcggtgtgaacggccactgcaaggttattccgtggagtatcagcttttaaatggcggagagttgcatcggctgaacattcccaatccagcccagacttcggttgtggtggaagacctcctgcctaatcattcctacgtgttccgtgtccgggctcaatcccaggaaggctggggccgagagcgagagggagtgatcaccatagagagtcaggtacatccgcagagcccgctatgccccttgccaggtagtgcctttactttgagcaccccctctgcccctgggccactggtctttacagcgctgagccccgactccctccagctttcttgggaacgcccacgcaggccgaatggggacatcgtgggctatttagtaacatgcgaaatggcacaagggggtggcccagcaacggcgtttcgggtagacggggacagcccagaaagtaggctaactgtgccgggtctttccgagaacgtgccgtacaagttcaaggtccaggccaggaccactgagggattcggccctgaacgggaaggcatcattactatcgaaagccaggacggcggacccttcccccaactggggtcaagggccggactattccaacacccattgcaaagcgaatatagcagtatcactacaacccatacaagcgctaccgaacctttccttgtagacggcttaacgctcggagctcagcatctcgaggccggaggatccctgactcgccacgttacccaggagtttgtgtctcggactctgacgacatccggtactttgtcgacccatatggaccaacagttttttcagaccta

SEQ ID NO: 226976 - DNA, 5417 bp, Artificial Sequence
  Description of Artificial Sequence: Synthetic coding sequence
atggccggacctagacccagcccatgggcacggctgctgctggccgcattaatttcggtgtccctgtctggcacactcgccaataggtgcaaaaaggcccctgtgaagagctgcaccgagtgtgtcagagtcgacaaagactgtgcctactgtaccgacgagatgtttagggaccgcagatgtaatacccaagctgagctccttgccgctggatgccagagggaaagcatagtcgtgatggagagctctttccagattacagaggagacgcagatcgacacaaccttgcggaggtctcagatgtcccctcaaggtttgagggtgaggctccgcccaggcgaggagcgacactttgaactcgaagtttttgagcctctggagtcccccgtggacctgtatattctgatggatttctctaatagtatgtccgatgacctcgacaatctgaagaaaatggggcagaatctcgccagagtgctgagtcagcttactagtgactatacaatcggttttgggaaattcgtggataaagttagtgtgcctcaaacagatatgcgacccgaaaagctcaaagagccttggcccaactcagaccctccatttagttttaaaaacgtgatctccctcactgaagacgtggacgagttcaggaataaactccagggggagcggatctccggcaacttggacgctcccgaaggcggttttgatgctatactgcagaccgccgtgtgcacccgcgatattggatggagaccagactccacccaccttttggtatttagcacggaatccgcattccattatgaggccgacggcgctaacgtccttgctggcataatgtcgagaaacgatgaaaggtgccatctggacacgacaggtacatatactcaatatcgtactcaggactatcccagtgtaccaacactggtacgccttctagcgaaacacaacattataccgatcttcgccgtcacaaattatagttactcttattacgaaaaactccatacgtacttccccgtaagcagcctcggtgttctgcaggaagatagtagcaatattgttgagcttcttgaagaagcctttaacagaattagatccaacctggacatccgcgctctcgatagccccaggggactccggactgaggtaacatccaaaatgtttcagaagacacggaccggcagtttccacatcaggagaggggaagtgggcatctatcaagtgcagctgcgagccttggagcatgtcgacggcactcacgtgtgccagctccccgaggatcaaaagggcaacatccacctcaagccgtcctttagtgacgggctgaaaatggacgcagggatcatatgcgatgtgtgcacctgtgagctgcagaaagaagtgagatcggctcggtgcagtttcaacggcgacttcgtgtgtggacagtgcgtttgtagtgaaggatggagcggccagacatgtaactgttcaaccggtagcctgtcggatatccagccctgcctcagggagggcgaagataaaccttgctccgggaggggggaatgtcagtgtgggcactgcgtttgctatggcgagggtaggtacgaggggcaattctgtgaatatgacaactttcagtgtcctcggaccagcggttttctgtgcaatgatcgcggaaggtgtagtatgggccagtgcgtttgtgagcctgggtggactgggccttcctgcgattgtccgctctccaacgccacttgtatcgacagcaacggcggaatatgtaacggccgtggccattgcgaatgtgggagatgtcattgccatcagcagtccctttatacggacacaatttgtgaaatcaactattcagcaatccatccagggttatgcgaagacctcagaagctgcgttcagtgccaggcctggggcactggcgaaaagaaagggaggacctgcgaggaatgcaatttcaaagtcaagatggtcgacgagctgaaaagagctgaggaggtcgtcgtgagatgctcgtttcgcgatgaagacgacgattgtacctattcctacactatggaaggcgacggcgctcctggacccaactctactgtcctcgtgcataaaaagaaagattgtccccctgggtctttttggtggctgattcccctgttgctgttgctcctgcctcttttggcactactgttattattgtgctggaagtattgcgcatgctgtaaggcgtgcctggccctcctgccgtgttgtaaccgcggacatatggtaggattcaaggaagaccactatatgcttcgtgagaacctgatggctagcgatcatctagacacgccaatgttgaggagtggtaaccttaagggacgagacgttgtacgatggaaggtgaccaacaacatgcagcgtccagggtttgccacccacgccgcatccatcaatcctactgaactggtgccttacggactttcgttgaggctcgcccgactgtgcacggagaatcttctgaagcccgacacccgggaatgcgcgcaactccgccaagaggtggaggagaaccttaacgaagtgtaccggcagatttccggagtgcacaagttgcagcagactaaattccgtcaacagcctaatgctggaaagaagcaggatcatacgattgtcgatactgtgcttatggcacccagaagtgccaagccagccctgctaaagttaaccgagaagcaggtagagcaacgagccttccatgatctgaaagtcgctcccggatattatacactgacagcagaccaggacgccagggggatggtggagttccaggagggggtggaacttgtcgatgtcagggttcccctgttcatcaggcccgaagatgatgacgagaagcagctgctcgttgaggccatcgatgtgcctgccggaacggccacactgggacgacgcctggtcaacatcaccataattaaggagcaggccagagatgttgtgtccttcgagcagcctgaattcagtgtcagcaggggagaccaggtggcacgaataccagtaattcgacgggtattggacggaggcaagagccaagtcagctataggacccaggacggtacagcacaaggcaatcgagactacatccccgtagaaggagagctactgtttcagcctggcgaggcatggaaggaacttcaggtgaagcttctcgagctgcaggaagtggatagtctgctcagaggacgccaggtgagacggttccatgttcagctgagcaaccccaagtttggggcacatctgggccaaccacactccacaacaataatcattagagatccagacgaactcgaccgtagctttactagccagatgctcagcagtcagccccctccccacggcgatttgggcgcaccgcaaaaccccaacgcaaaagccgcagggtccagaaagattcacttcaactggttgcccccatcagggaaacctatgggctacagggtgaaatactggatccagggagactccgaatcagaagctcacctcctggactccaaggtgccctctgtggagctcacaaatctgtatccttattgcgactacgagatgaaagtgtgcgcctacggtgctcaaggcgaaggcccatactcctccctggtgtcctgtaggacacatcaggaggtgccttcagaaccaggtagattggcatttaatgttgtgagcagcaccgtgacccagctgagctgggctgagccagctgagacaaatggtgaaattaccgcttatgaggtttgctacggattggtgaatgacgacaatagacctatcggtcctatgaagaaagtgctggtcgacaaccccaagaatcgcatgctattaattgaaaatcttcgggagtctcagccctacaggtacacggtcaaagctcggaacggtgccggttggggacccgagagagaagccatcatcaatctggcgactcagccaaagagacctatgagcattccaatcataccagatatccccatcgtcgacgctcagtcgggggaggactacgacagttttctgatgtattcagacgatgtgctcaggagtccgtcaggctcgcagcgcccatctgtgtccgacgatactgagcatctagtgaatggaaggatggacttcgcttttccagggagcaccaactccctgcatcgcatgaccaccacttccgccgcagcatatggcacacacctcagtcctcatgttccacacagggtcctttctaccagtagcacccttaccagggattacaatagcctgacccgatcggagcactcccactctacaacacttcctcgcgattactcaactctcacttctgtctcctcacacggcctgcccccaatctgggaacacggcagaagcagattgcccttaagttgggccctgggaagcaggagccgtgctcagatgaagggatttccaccctcacggggtccccgtgacagcatcatcctcgcagggagaccagccgcacctagctggggccctgattcccggctcacggccggagttcctgatacaccaacgcggttagttttctccgcattggggcctaccagtctgagagtgtcctggcaggaacctagatgtgagaggcctttacagggttacagcgttgagtatcagctgcttaatggcggagaactgcaccgtctgaatatccctaatccagcccagacctcagtcgtcgttgaggacctgttgcccaaccacagctacgtctttagagtgcgcgctcaaagccaagaaggatggggtagagagagagagggcgtcattaccatagagagccaagtccaccctcagagccccctttgtccactgccaggttcagcttttactttgagtactccttcggcccctggccctctcgttttcacagccctttcccccgacagtctgcagctttcctgggaaagacccaggagacccaatggtgatatcgtaggctatctcgtcacttgcgaaatggcccagggcggaggtccagcaaccgcgtttagggtggacggagactcacccgaatctcgcctgactgtacctggtttgagcgagaacgttccttacaagttcaaagtccaggcacggaccaccgaagggtttggacctgagagagagggaatcatcacaatcgaatctcaggacggcggaccgtttccccagcttggctctcgcgctggactcttccagcacccacttcagagcgagtactcttctatcactaccactcatacttccgccaccgagccttttttggttgatgggctaaccctaggtgcccagcatctcgaggctggtggctctctcactagacacgtgactcaggagtttgtcagtagaactcttactacatcgggaactcttagcacacacatggaccaacagttttttcaaactta

SEQ ID NO: 226977 - DNA, 1932 bp, Artificial Sequence
  Description of Artificial Sequence: Synthetic coding sequence
gggggaattgaagaaacacagattgacactactctccgacgaagtcaaatgagtccccagggacttagagtgagattgagacccggagaggaacggcactttgaactggaagtcttcgagccactggaaagtcctgtagatctctacatcctcatggatttcagtaacagcatgagcgatgatctcgataaccttaagaaaatgggacagaaccttgccagggtcctgagtcagctgaccagtgattatactatcgggtttggaaagtttgtggataaggtttcagtaccccagaccgatatgcggccagagaaattgaaagagccatggcctaactccgacccaccttttagcttcaagaacgtaatctcactgaccgaggatgttgacgaatttagaaacaagctgcagggagaacgaattagcggcaatctcgatgcacctgagggaggcttcgacgccattctacaaaccgccgtgtgcaccagagatatcgggtggcgcccagatagcacacatctgctggtatttagtaccgaatcagcctttcattacgaagcggatggtgcaaacgtcctagcgggtatcatgagcaggaatgacgagcggtgccatcttgataccacaggtacatacacacagtatcgcacccaagattacccttccgtcccaactctggtgcggctgttggcaaagcacaatataattcccatcttcgcggtgacaaattactcgtacagttattacgagaaactccacacgtactttccagtgtccagcttgggcgtcctgcaggaagattcaagtaatattgtagagctcctcgaagaggccttcaatcgcatacgatctaaccttgacattagagccctagacagtccgagaggacttaggacagaggtaacaagtaagatgttccaaaagaccaggacgggtagctttcatattaggagaggggaggtcggaatttaccaggtgcaactgagggctctggagcacgtggatggaacacacgtgtgtcagttgcctgaggaccagaagggtaacatccacctcaagccgtctttctccgatggactgaagatggatgctggaattatctgcgatgtttgcacctgtgaactacagaaagaggtgcggagcgccagatgttcttttaatggagactttgtctgtggccaatgcgtatgttcagaaggctggtctgggcagacatgcaactgtagcaccggttccttgtcagacatccaaccttgcctgagggaaggtgaggacaagccatgtagcggccgtggcgagtgccagtgcggccattgtgtctgttacggggaaggccgatacgaaggccagttctgcgaatacgataattttcagtgtccaaggacatcaggcttcttgtgtaacgatagaggacgatgctcgatggggcagtgcgtttgcgagccaggatggaccggaccaagctgtgattgtcctttgtctaacgcgacatgcatcgatagcaacggagggatctgtaatgggaggggacactgtgaatgtggacggtgtcattgtcaccagcaaagtctttatacagacactatctgtgaaatcaactacagcgccatccatcctggattgtgcgaggacctacgcagctgcgtccagtgccaagcctggggcacgggtgaaaaaaaagggagaacgtgtgaggagtgcaatttcaaggttaaaatggttgacgagctgaagcgagccgaagaggttgtggttcgctgtagcttccgggatgaggacgatgattgcacatatagctacacaatggaaggcgatggtgctcccggaccaaacagcacagtgttagttcacaagaagaaagattgtccacctggaagcttttggtggttaatcccattgctcctcctgctcctccccctgctggcactgtag

SEQ ID NO: 226978 - DNA, 2367 bp, Artificial Sequence
  Description of Artificial Sequence: Synthetic coding sequence
atgggcatcgagttgttatgcctgttcttcctctttctggggcgaaacgaccacgtgcagggcggttgtgcgttaggcggagccgagacctgcgaggactgcttgctgatcggaccccagtgcgcctggtgtgcgcaggaaaattttactcatccttccggggtcggcgagcgatgcgacacacctgctaacctgcttgcaaagggatgtcagctgaacttcattgagaacccagttagccaggttgagatcctgaagaataagccactttccgtcgggcgacaaaagaactcctctgatatcgtgcaaatcgcccctcagagtctcatccttaagttacgacctggaggcgctcagacactgcaggtgcatgttagacagactgaagactatcctgtagatttgtattacctcatggatctcagcgcgtccatggacgatgatctgaataccatcaaggagcttggatcccgcctgagtaaggagatgagtaaactgacatctaattttcgcctgggcttcggttcttttgtagaaaaacccgtgtctccgttcgttaagacaacgcctgaggaaatcgccaatccctgttcgagcatcccatatttctgcctccccacttttggttttaaacatatcctgccccttacaaatgacgctgagcgatttaatgagatagtgaagaaccagaagatctccgcgaatatcgacactcccgaaggaggatttgatgccatcatgcaagcagcagtttgtaaagagaagattggttggcgcaacgactctctccaccttctggtgtttgtgagcgatgcggacagtcacttcggtatggactccaagctagctggaattgtgattcctaacgacggcctctgccaccttgactctaagaatgagtactctatgtctacagtacttgagtatccgaccatcggccagctcattgacaagcttgttcagaataacgtgctcctaatctttgctgtgacacaggaacaggtacacctctacgagaactacgctaaacttatccctggagccacggtggggctgttgcaaaaggactccggcaacatccttcagctgatcatctcagcctatgaggagttgagaagcgaagtagagttagaggtactgggtgacacagaaggactgaacctctctttcaccgcgatctgcaataatggaaccctttttcagcaccagaagaaatgcagtcacatgaaagtgggggataccgctagcttttctgtgaccgtcaacattccacattgtgagaggaggagtaggcacatcattatcaaaccggtagggctgggtgatgcactggaactgctggtatcccctgaatgtaactgcgactgccagaaagaggtggaggtcaacagcagcaaatgccaccatggaaatgggtcctttcagtgcggcgtgtgcgcttgtcacccaggccacatggggcctagatgcgaatgtggcgaagatatgctgtccaccgacagttgcaaggaggcacccgatcaccctagctgttccggccgaggtgattgctactgcgggcagtgtatttgccatctctccccctacgggaacatatacggtccctattgccagtgtgataacttctcatgcgtgcgccataaggggctgctgtgcggaggaaacggggactgtgactgcggcgagtgcgtatgtagatccggctggacaggagaatactgtaattgcacgacctctacggactcctgcgtgtcagaggacggcgtgctgtgttccgggaggggcgactgcgtgtgcgggaagtgcgtttgtactaaccccggagctagcggacctacatgtgaacgctgtcccacctgtggggacccatgtaactccaagagatcttgtatcgagtgtcacctgagtgccgctggccaggcgagggaggagtgcgtggacaaatgtaaattagctggggctactattagcgaggaagaagattttagcaaagacggcagcgtgagctgctctttacagggcgagaatgaatgcctgataacatttttaatcaccactgacaatgagggtaagaccatcattcattctatcaacgaaaaggattgcccgaagccaccaaatattcctatgatcatgctgggagtgagtctggcaattctcctgatcggcgtggtcttactgtgcatctggaaactcctcgtgagcttccacgaccggaaagaggtcgcgaagtttgaagccgaacgatccaaggcgaaatggcagaccgggactaacccactgtatcggggatctacaagcacatttaaaaatgtgacatataagcatcgagaaaaacaaaaagtggaccttagtacagactgctag

SEQ ID NO: 226979 - DNA, 2367 bp, Artificial Sequence
  Description of Artificial Sequence: Synthetic coding sequence
atgggaattgagctgctgtgtttattctttctcttcctgggcaggaatgatcatgtacaggggggttgcgccttgggcggtgccgaaacttgcgaagattgtctgctgatcggcccacaatgcgcctggtgcgctcaggaaaatttcacccatccttcaggggtgggcgagcgctgcgacacacccgcaaacctcctggctaaagggtgccaactcaattttatagaaaatcctgtctcgcaggtggagatactaaagaacaaaccactgagtgttggtagacagaagaattcgagcgacattgtgcagattgcaccccagtccttgatattaaaactgcggccagggggtgctcaaacactccaggttcatgtgcggcagaccgaagactatccagtggacctttattatctgatggatctgtccgcctccatggatgacgacttgaatactattaaagaactgggtagccggctcagcaaagagatgagcaaactaacatctaattttaggcttggctttggcagctttgtcgagaaacctgtatccccatttgtcaagacgacccccgaggaaatagcaaacccttgtagttcaattccttatttctgtctgcctacattcggtttcaagcatatcctgccccttactaatgacgccgagcggttcaacgagatcgtaaaaaaccagaagatatcggctaacatcgacaccccagaaggcggatttgacgcaattatgcaggccgctgtgtgcaaagaaaaaattgggtggcggaacgattctctgcacctgttggtgttcgtctctgatgcagatagccacttcgggatggactctaagctggcaggcatcgtcattcctaatgatggtctgtgccatctggactctaagaatgagtactcaatgtcgacggtgctagaatacccaaccattggtcagctgatcgacaagttggtgcagaacaacgtgctcctgattttcgccgtcacccaggaacaggtgcacctgtatgagaactatgctaaacttattccgggagcaacagtggggttattgcagaaggatagtggtaacattttgcagcttatcatcagtgcatatgaagaactgagaagcgaggtcgaacttgaggtgctaggtgacacagaaggcctgaacctgtctttcacagccatctgtaacaacgggactctgttccaacaccaaaagaaatgctctcacatgaaagtgggagataccgcttctttttcggtcaccgtgaacatcccacattgcgaacggagaagccgacacattattatcaagccagttggattgggggacgcgttggagctactggtcagcccagagtgtaattgcgactgtcaaaaagaggtggaagttaactctagcaagtgccaccacggaaatggcagtttccaatgcggtgtctgcgcatgccatccaggtcacatggggcctcggtgtgagtgcggtgaagacatgcttagcactgactcttgtaaggaggcccctgatcacccgtcttgttcaggaaggggagactgttattgtggccagtgcatctgtcacctctcgccctatgggaatatttatggcccatattgccagtgcgataacttttcatgtgttaggcacaaagggctcctttgtggaggcaacggcgactgcgactgcggcgagtgtgtgtgtaggtcgggatggacgggcgagtactgcaactgtacaacttccaccgactcctgcgtgtctgaggatggggttctgtgcagtggtcggggtgactgtgtgtgcgggaagtgcgtgtgtactaatcctggcgcttccggccctacctgtgagcggtgtcccacctgtggcgatccgtgcaattccaagcgcagttgtatcgaatgccacctctccgccgctggccaggccagggaagaatgtgtagacaagtgtaaattagcaggcgctactattagtgaggaggaggatttctcaaaggacgggagtgtgtcttgctccttacaaggagaaaacgagtgcttgattacctttctaattactacggataacgaaggcaagacaattattcactccatcaatgagaaagattgccccaaaccccctaatatcccaatgattatgctgggtgtctcactcgccattttgctcattggggtcgtcctcttgtgcatctggaagcttctggtctcgttccatgacaggaaggaagtcgcaaaatttgaagcagagagatcaaaagcgaaatggcaaactggtactaaccccctgtataggggtagcacctctacttttaaaaacgttacttacaaacatagagagaaacagaaggtcgatctcagtacagactgttag

SEQ ID NO: 226980 - DNA, 2397 bp, Artificial Sequence
  Description of Artificial Sequence: Synthetic coding sequence
atggtcgctctgcctatggttctagtgttgctactggtgttgagtaggggagagagcgaattagacgcgaagattccatccaccggcgatgcaaccgagtggcgaaacccccacctgtccatgctcggtagttgtcagccggctccctcctgccagaaatgtatcctgtctcatccctcctgtgcctggtgcaagcagctgaatttcaccgcaagcggcgaagccgaggctcgaaggtgcgcacggagagaagagctgctcgcccgaggctgtccgttggaggagcttgaggagccaagagggcagcaggaggttctccaggaccagccgctgtctcagggagctagaggcgagggggctactcagctcgcccctcagcgggttagagtgaccctgcggcctggtgaacctcagcagctgcaggtccggttcctgagagcagagggttaccccgttgatctgtattatctgatggacctgagttactctatgaaggatgatctggaacgggtgcgccaactggggcatgccctccttgtgcggttacaagaagtaacccactccgtccgcattggctttgggtcttttgtggacaagacggttctgccgttcgtatctaccgtgccaagtaagctgcgacacccctgtcctacgcggcttgaaaggtgccagtccccattctccttccatcacgtgctctccctcacaggcgacgcgcaggcctttgaaagagaggttgggcgacagtcagtgtccggcaatttagacagtccagagggcggtttcgacgccattttacaggccgctctgtgccaggaacagatcggatggaggaatgtgtcacggttactggtgttcactagcgatgatacttttcatacagctggggatggcaagctgggcggaatcttcatgccttctgatgggcattgccacctggactcaaatggcctgtactcacgatctaccgaattcgattatccctcagtggggcaggtagcccaggccctgagcgccgctaacattcagccaatctttgccgtcaccagtgcggctctgccggtatatcaggaattatcaaagctgattcctaaaagtgccgtgggcgaactttctgaagacagctctaacgtggtgcaattaatcatggacgcctacaactccctgtccagcacagtaaccttagagcatagcagcttgcctcctggagtccatatttcttatgagtcacagtgtgaaggtccagagaaaagagagggcaaagccgaggaccgtggccagtgcaatcatgttcgcataaaccaaaccgtgacattctgggtatccctgcaagccacccactgcctccctgaaccgcatctgctacgcctgagggccctcggcttctctgaagagctgatcgtcgagctgcataccctgtgcgactgtaattgttctgatactcaaccccaggcacctcactgttctgacggtcagggccacctgcagtgtggagtgtgctcttgtgctcctgggcgactgggcagactttgcgaatgtagcgtggctgaactttcgtcacccgatctcgaatccggatgtagagctcctaatggcaccggtcccttgtgttccggtaaggggcactgtcagtgcgggaggtgcagctgttctgggcagtcgagtggccacctgtgcgagtgcgacgacgccagttgtgagagacatgaaggcatcttgtgcgggggttttggacggtgtcagtgtggggtttgtcattgccacgctaaccgcactgggagggcttgcgagtgctctggagacatggattcgtgcatcagcccagaaggtggtttgtgtagcggacatggcaggtgcaagtgcaaccgctgccagtgccttgacggttattatggtgctctctgtgaccagtgtccaggttgcaagaccccctgtgagaggcaccgggactgcgctgagtgtggcgcatttcgaaccggaccactggcaacaaattgcagcacggcctgcgcacacacgaacgtaactctggccctcgctcccatcctggacgacgggtggtgcaaagagcgtactttggacaaccagctcttttttttcctggttgaggatgacgccaggggcacggtggtgctgcgggtgaggccccaggagaagggcgcagaccacactcaggctatagttctgggatgcgtcggcggaatcgtggcagtcggacttggacttgtgctggcatatagactctcagttgaaatctatgatagacgcgaatattcccgttttgagaaggagcagcaacagctgaactggaagcaggatagcaatcctctctataaaagtgccattaccacgaccatcaaccctaggttccaagaggctgactctcccacactctag

SEQ ID NO: 226981 - DNA, 1953 bp, Artificial Sequence
  Description of Artificial Sequence: Synthetic coding sequence
atggtcgcattgccgatggtgctagttttgcttctcgttttgtcacgtggagagtccgaactggacgctaaaataccctcaacgggtgacgcaaccgaatggcgtaacccacacctgtctatgttaggctcctgtcaacctgccccatcgtgtcagaagtgtatcctgagtcaccccagttgtgcgtggtgtaaacaattgaacttcacagcatcaggcgaggccgaggccaggcggtgcgcacgcagggaggaactgcttgccagaggatgccccctagaggaactggaagagcctcgagggcagcaggaggttttgcaggatcagccactgtctcagggcgcacggggagagggcgctactcagctggctccccagcgcgtaagggtgacattaaggcccggagagccccagcaactgcaggtgcgcttcttacgcgctgaaggctacccggtagacttgtactacctgatggatctatcatattccatgaaggacgatcttgagcgcgtccggcaacttgggcatgctctactcgtgaggctgcaggaagtgacacatagtgtgcgaatcggtttcggatcctttgtggacaaaaccgtgttacccttcgtgtccaccgtgccctccaaactgagacacccatgcccaactcgtctggaacgatgccagtctcctttcagtttccatcatgtcttgtccctgaccggcgatgcccaggctttcgagcgggaagtcgggcgacagtctgtgagtggcaatctcgacagtcccgaaggaggtttcgacgctatactacaggccgctctctgtcaggaacagatcgggtggcgtaatgtatcaagactgctggttttcacatcagacgataccttccatacagcaggcgacggtaagttgggaggtatcttcatgccaagcgatggccactgccaccttgatagcaacggactctacagccggagcacggagttcgattatcccagcgttggccaggtcgctcaggcgctctccgcagctaatatccagcccatttttgccgtgacctcggctgctctcccggtgtaccaggagttgagcaagttgatccctaagagcgctgtgggtgaactaagtgaggatagcagtaatgtggtgcagttgataatggacgcatacaactccctgtcatccacagttactctcgagcactcaagcctgccgccaggggtgcatatatcatacgaatctcagtgtgaaggccctgagaagagagaggggaaagcggaagatcggggacaatgcaaccacgtccgaattaaccagacggtgactttctgggtttctctgcaggccacccactgtctccccgagccgcatttgctcaggctccgcgctcttgggttctccgaagaattgatcgtggaattgcacacgctctgtgattgcaattgtagcgatacccagcctcaggcaccacattgcagtgacggacagggccacctacagtgcggagtctgccgggattgcgcggaatgcggcgcattccgaactggcccactcgctacgaactgtagcacagcgtgcgcccacacgaatgttaccttggccttagcgcctatattggacgatggctggtgcaaggagagaaccttggacaaccaattgtttttcttcctagtcgaagacgacgcccgaggcactgtcgtcctgcgcgtgagaccccaagagaaaggtgcggatcatacacaggccattgtactgggctgtgtgggaggcattgtagctgtcggcctgggactcgtgctcgcctataggctgagcgtggagatctatgaccgcagagaatactcccgctttgagaaggagcagcaacagctgaactggaagcaggacagcaacccgttatataagtcggcgataacaaccacaatcaatccaaggtttcaggaagccgatagtcctacactttag

SEQ ID NO: 226982 - DNA, 2397 bp, Artificial Sequence
  Description of Artificial Sequence: Synthetic coding sequence
atggtcgccctgccaatggtccttgtgctgttattggtcctctctagaggcgagtctgagcttgacgcaaaaattccttccacaggagatgcaactgaatggaggaacccacacctgagcatgcttggctcttgtcagcctgccccatcctgtcagaagtgcattctcagtcatccaagttgcgcctggtgcaaacagctgaacttcacagcttccggggaggcggaagcacgcagatgtgcacggagggaggagctcctcgccaggggctgtccccttgaagagcttgaggaacccaggggccagcaagaagtgctgcaagatcagcccctcagccagggtgcgaggggagagggcgctacccaactggccccacagagggtcagggtaactctccgaccgggtgagccccaacagctgcaagtgcgatttctgcgagcagaaggctacccggtagatttatattacctaatggatctgagttactctatgaaagacgatctggagcgcgttagacaactgggacacgccctgttggttcgactgcaggaagttacacacagtgtccggatcggcttcggctcatttgtagataaaacagtgctgccattcgtctccactgtcccaagcaagctgagacacccttgcccgacccgcctggaacgctgccagagcccttttagcttccaccatgttctctcattaactggagacgcacaagcgtttgaacgagaagtcggtcgacagagtgtaagcggcaacctggattcgccagaaggcggatttgacgctattctccaggccgctctgtgccaggaacagatcggatggcgcaacgtgtcgaggttgttggttttcacatccgacgataccttccacacagctggtgatggtaagttgggcggaattttcatgccaagtgatggccattgtcatctcgatagcaatggcctctactctcggtcgacggagtttgattacccctctgtaggccaggtggcacaggcactctctgcagctaatatccagccaattttcgcagttacatcagccgctctccccgtgtaccaggagcttagcaagttgatccccaagagcgccgtaggcgagctaagtgaagactcctccaatgtggtgcaattgattatggacgcatacaattccctgagctctacggtaaccctggaacacagttccttgccccctggcgtgcatatatcttacgagagccagtgtgagggcccagagaagcgagaaggcaaggccgaggaccgcggacaatgcaaccacgtccggattaatcagactgttacattttgggtgtccctgcaggccactcattgcctgcctgagcctcacctgctgaggctgcgcgctctgggattttcagaggaactgattgtcgaactccatacactgtgcgactgtaattgtagcgatactcagccccaggcccctcactgcagcgacggacagggacatctacagtgtggggtgtgctcctgcgccccaggtagactggggcgtctgtgcgaatgctctgttgccgagctctcaagtccggatctggagtccggatgcagagccccaaacggaacagggcctttgtgttctggaaaaggccactgtcagtgcgggagatgttcctgttctgggcagagctctggacacctctgcgagtgcgatgatgcatcctgcgagaggcatgagggcatcctttgtggaggatttggtcggtgtcagtgcggggtctgccattgtcacgcaaacagaactggcagggcctgcgagtgttccggggatatggacagttgtatctcccctgagggtggactgtgtagcggtcacggaagatgtaagtgcaatcgatgtcagtgcctggatggctactatggcgcactctgcgatcagtgcccaggctgcaaaactccttgcgaacgccaccgtgactgcgcggagtgtggagcgttccgcacaggccctctggccactaactgtagcacagcttgcgcccacactaacgtcacattggccttggccccaatattggacgatggctggtgcaaggaacgcacactggacaatcagctgttcttttttctggtggaggatgatgcaagaggtactgtggtcctgagggtgagaccccaagagaagggagcagatcatacacaggcgatcgttttggggtgtgtgggagggattgtggccgttggcttgggacttgtgctggcctacagactcagcgtggagatctatgataggcgggaatactctcgcttcgaaaaggaacagcagcagctcaactggaagcaggatagcaatccactgtacaagtccgctatcactactactattaatcccagattccaggaagccgatagtcctaccctctag

SEQ ID NO: 226983 - DNA, 1206 bp, Artificial Sequence
  Description of Artificial Sequence: Synthetic coding sequence
atgaatctcgtggcggttatgggagctttcaacaagggccacggtaaatgtgattgcgggaaatgtaagtgtgaccagggatggtacggagatgcatgccagtatccaacgaattgcgatcttacaaagaagaagagcaaccagatgtgtaagaactcccaggacatcatctgcagtaatgcgggtacgtgccattgcggccgttgtaaatgtgataactctgatggtagcggcttagtatacggcaaattctgtgaatgcgatgatagagagtgtatcgatgacgagactgaggaaatatgcggtgggcacggaaagtgctactgcggtaattgctactgcaaagcaggttggcacggcgacaagtgcgagttccagtgcgatattacaccatgggagagcaagagaagatgtacctccccggacgggaagatctgtagtaataggggcacatgtgtgtgcggcgaatgcacctgtcatgacgtggaccctactggcgattggggtgacattcacggcgatacgtgtgaatgtgatgagcgcgactgtcgggctgtgtatgacaggtactctgatgacttctgttccggtcacggacagtgtaactgtggacgatgcgattgcaaagctgggtggtatggcaagaaatgcgaacacccccagtcgtgtacattgagcgccgaggagagtatccgtaagtgtcaggggtcaagcgacctcccttgttccggtcggggaaaatgcgagtgcggaaaatgtacctgctacccccctggggacaggcgagtttacggaaaaacatgtgagtgcgatgatcggaggtgtgaggatctggatggggtggtgtgtggtggccacgggacctgtagttgcgggaggtgtgtatgcgaaaggggttggttcgggaaattatgccaacatccgcgtaaatgcaacatgactgaagagcagagtaaaaacttgtgtgaatctgctgacgggatcttgtgtagcgggaaagggtcatgccactgtggtaagtgcatatgtagtgccgaagaatggtatatcagcggggaattttgtgattgtgatgacagagactgcgacaagcacgatggcttgatttgtacagggaatgggatttgttcttgtgggaactgcgaatgttgggacggatggaatggcaatgcatgtgagatatggcttggcagcgaatacccttag

SEQ ID NO: 226984 - DNA, 1485 bp, Artificial Sequence
  Description of Artificial Sequence: Synthetic coding sequence
atgcggcctcccggatttagaaactttttactgctcgcctcatcactgttatttgccggtctgtcagcagtgccccagtcattttctccctcactgcggagttggcccggtgccgcttgccggctctcacgggctgagagcgagcgccgttgtcgggctcctggtcagcctccaggcgctgccctgtgtcacggaagggggagatgcgactgcggcgtgtgtatttgtcatgtgacggagcctgggatgttttttgggccactttgtgagtgccatgagtgggtatgtgagacatacgatggttcaacatgtgccggacatggaaagtgcgactgcggcaagtgcaaatgtgaccaaggctggtacggagatgcttgtcagtacccgaccaattgcgatcttacaaaaaaaaagtctaaccaaatgtgtaagaattcccaggacataatatgttccaacgccggaacttgccactgtggtcgctgcaagtgtgataactcggacggtagtggattagtatatggcaaattttgcgagtgcgacgaccgggaatgcattgacgacgagacagaggagatttgcggcggacacggcaaatgctattgtggtaattgttactgcaaggctggttggcacggcgataaatgtgagtttcagtgtgatataacaccgtgggagtctaagaggaggtgcaccagccccgacggaaagatatgttctaacagaggcacatgcgtatgtggggaatgtacatgtcacgatgtagacccgaccggtgattggggagacattcatggtgatacttgtgagtgtgacgagagagattgtagggcggtttatgatcggtatagtgatgatttttgtagcggacacggtcagtgcaattgcgggcgatgcgattgcaaagccggttggtatgggaaaaaatgcgagcatccccagtcctgtacactgagtgctgaggaaagcataagaaaatgtcagggttcaagcgaccttccttgctccgggagaggaaaatgtgaatgcggcaagtgcacatgctaccccccaggcgaccgtagagtgtacgggaaaacatgcgaatgcgatgatagacgctgtgaggacctagatggcgtcgtttgcgggggacatggaacctgcagctgtgggaggtgtgtctgcgagcgcggttggtttggcaaattgtgccaacaccctcgaaaatgtaatatgactgaggagcagtccaagaacctgtgtgaatcggcagatgggatcctgtgttcaggaaagggcagctgtcattgcgggaaatgcatttgcagtgcggaggagtggtatatctctggagagttttgtgattgcgatgaccgcgactgtgacaagcacgatggtctgatctgcactggaaatggcatatgctcctgcgggaattgtgagtgctgggatggttggaacggtaatgcctgtgaaatttggctagggtcagaatacccttag

SEQ ID NO: 226985 - DNA, 1209 bp, Artificial Sequence
  Description of Artificial Sequence: Synthetic coding sequence
atgagtggatgtgcgaggccgactactggcgctccggtgcaggctatggtctcagttactggcaaatgcaaatgtgaccagggctggtacggagacgcttgtcaatacccaacgaactgcgatctgacaaagaaaaagtctaaccagatgtgtaagaatagccaagatatcatatgctccaacgccggtacatgccattgcggacgttgtaagtgtgacaatagcgatgggagcgggctagtatatggcaagttctgcgagtgtgatgaccgcgagtgtatcgacgacgagacagaggaaatttgcggaggacacggaaagtgctattgtggaaattgctattgcaaggccggatggcatggtgacaagtgcgaattccagtgcgatattaccccctgggagtccaaacgaaggtgcaccagccccgacgggaagatatgttctaaccgcggtacgtgcgtctgcggcgaatgtacctgtcacgatgttgatccgacaggagattggggcgacatccacggcgatacctgtgaatgtgacgagagagattgtcgagctgtttacgaccgatacagcgatgacttctgttccgggcacggacagtgtaactgcggacgatgtgactgcaaggcgggttggtacgggaaaaaatgtgagcacccgcagagttgcaccctgagtgcagaagagagcatcagaaagtgccagggcagctccgacttaccttgcagcggccgtggtaaatgtgagtgcggtaagtgtacctgttaccccccaggtgacaggcgtgtctacggaaagacttgtgagtgtgacgacagacggtgcgaagacctggacggggtggtgtgcggcggacacggcacctgctcctgtggtcgatgtgtgtgcgagagaggctggttcggcaagctgtgccagcacccaaggaaatgtaacatgacagaagagcaaagtaaaaatctttgcgaatccgcggatggcatcttgtgttctggtaaaggctcttgccactgcggaaagtgcatctgtagcgcagaggagtggtacatctccggcgaattttgcgattgtgatgaccgcgactgtgataaacacgatggcctgatctgtaccggtaacgggatttgtagctgtgggaattgtgagtgctgggatgggtggaacggcaatgcctgcgaaatctggctggggtctgaatacccatag

SEQ ID NO: 226986 - DNA, 1062 bp, Artificial Sequence
  Description of Artificial Sequence: Synthetic coding sequence
atgtgcaaaaactctcaggacataatttgctcaaacgccggaacatgtcactgtggcagatgtaaatgtgacaactctgatggaagcggacttgtctacggcaaattctgcgagtgcgacgatcgcgagtgtattgacgatgagactgaagaaatatgcggcggtcacggcaaatgctattgtgggaattgttattgtaaggccggttggcacggggataaatgtgagtttcaatgtgatattaccccgtgggaatcaaagaggcggtgcacgagcccagacgggaagatctgcagtaataggggcacatgtgtatgcggggagtgtacctgtcatgacgtggaccctactggcgactggggtgatatacatggggatacatgcgagtgcgatgaaagggactgcagagctgtttacgaccggtactccgacgacttttgtagcgggcatggtcagtgtaattgcggtcgctgtgattgcaaagcgggatggtacggaaagaagtgtgaacacccacaaagctgcaccctgagtgccgaagagagcattagaaaatgccagggatcaagcgatttaccctgctctggacggggtaagtgcgaatgtggcaaatgtacttgttatcctcccggagataggcgggtctatggaaagacctgcgagtgcgacgatcgcagatgcgaggatctggacggcgtggtgtgtgggggtcatggcacgtgttcctgtgggagatgtgtgtgcgaacgtggctggttcggtaagctgtgccagcatccacgtaaatgtaacatgacagaagaacagagcaagaacctgtgcgagtccgcagatggcatactttgttctggaaagggcagctgccactgtgggaaatgtatctgcagcgccgaggagtggtacatatcaggcgaattttgtgattgtgatgatcgcgattgcgacaagcacgatggcctcatctgtaccgggaatggaatctgcagctgcgggaactgcgagtgttgggacggctggaacgggaacgcctgtgaaatttggctgggctccgaatatccttag

SEQ ID NO: 226987 - DNA, 1062 bp, Artificial Sequence
  Description of Artificial Sequence: Synthetic coding sequence
atgtgcaagaactcccaggatatcatttgcagcaacgccggtacgtgccactgcggtcgctgtaaatgtgacaattccgatggctcggggctggtgtatggaaaattttgtgaatgcgacgaccgagaatgtattgacgacgagactgaggagatttgcggtggtcatgggaagtgctactgtgggaactgctactgtaaggctggttggcatggcgataagtgtgagttccagtgcgacatcacgccatgggaatctaagaggaggtgtaccagcccagacggcaaaatatgtagcaaccggggtacgtgcgtttgcggcgagtgcacctgtcacgacgtggatcccactggtgactggggtgacatccatggggacacatgcgagtgcgatgagagggattgtcgggcagtgtatgaccgttattctgatgatttctgctctggacatgggcagtgtaattgcggcaggtgcgactgtaaggctggatggtatgggaagaaatgcgaacaccctcagtcctgcacattatctgccgaggagtccatccggaagtgtcaagggagttccgatttgccttgctccggccgaggtaaatgtgagtgcggaaagtgcacctgctaccccccaggtgacagacgagtgtacgggaagacttgcgaatgtgatgatcgtcgctgtgaggacctggatggggtggtatgtgggggtcatggcacatgctcatgtggaagatgtgtatgtgagagagggtggttcggtaagttgtgccagcatcccagaaagtgcaatatgacagaagagcaatccaaaaatttgtgcgaatctgcagatggcattctttgctctggcaaggggtcctgccattgtggtaaatgcatctgctctgccgaagagtggtacatcagcggcgagttttgcgattgcgacgaccgggattgcgataagcatgacggactgatctgtaccgggaatggcatctgttcttgcgggaattgcgaatgttgggatggatggaatggtaacgcctgcgaaatctggcttggatccgaatatccatag

SEQ ID NO: 226988 - DNA, 903 bp, Artificial Sequence
  Description of Artificial Sequence: Synthetic coding sequence
atggctaactgtgaattttcaccagtatccggtgacaagccatgctgtcgattgagcaggagagcacaactctgtcttggagtatcaatactcgtgctcattctggtggtggtactggcagtcgtcgtgccccgatggcgccagcagtggtcaggcccaggtacaacaaagaggtttcctgagaccgtcctggccaggtgtgtcaagtataccgagattcaccccgagatgcggcacgtggactgtcagagcgtgtgggacgccttcaaaggagcctttatctctaagcacccatgcaacatcacagaggaagattaccaaccgctgatgaaactcggtacacagacagtgccttgcaacaagatcctcctgtggtctcgaatcaaagatctcgcgcaccagtttacccaggtgcagcgcgatatgttcaccctggaggacacattgctcggctacctcgccgacgatctgacctggtgcggagagttcaacacgtctaagatcaattaccagtcctgcccagattggcgaaaagattgttccaacaatcctgtgagtgtattctggaagactgtgtcaaggaggttcgccgaagccgcatgcgacgtcgtccacgttatgctgaacggtagccgcagtaaaattttcgacaagaattctacattcggttctgtagaagtccacaatttgcaaccagaaaaagtccagacgctcgaagcctgggtgatacatggaggccgagaagattccagagatttatgccaggacccaaccataaaggagcttgaatccattatcagtaagagaaacatacagtttagttgcaaaaatatctacaggccagataaattcctgcagtgcgtgaagaatcccgaagatagctcgtgcacttcagagatctag

SEQ ID NO: 226989 - DNA, 942 bp, Artificial Sequence
  Description of Artificial Sequence: Synthetic coding sequence
atgaaccagctgtcattcctgctctttctgatagcaactacacgtggctggtcgacagacgaggcaaacacctacttcaaagaatggacctgctcttctagtccatccctccccagaagctgcaaggagataaaggacgaatgtccaagtgcatttgacgggctttacttcctgcgcaccgagaatggggtgatctaccaaacattctgcgacatgacaagcggcggtggaggatggacacttgtcgcctctgttcacgagaatgacatgcgcggaaaatgcacggtgggcgacagatggtcaagtcagcaaggatccaaggccgtttatcctgagggagacggtaactgggcaaactataacacttttggatccgccgaggccgcaactagcgatgactataaaaaccctggatactacgatattcaggccaaggatttgggcatatggcacgtgccaaataagagccccatgcaacattggcgtaattctagtttgctccgatacagaacagatacgggattcctccagacactgggtcataaccttttcgggatttaccagaaatacccagtaaagtatggtgaaggaaaatgctggaccgacaacggtccggtcattccagtagtttacgacttcggtgacgcacagaaaacagcaagttactatagtccctacgggcagcgagaatttaccgccggattcgtacagttcagggtgttcaacaacgaaagagccgctaatgcgttgtgcgcgggaatgcgagttaccggatgtaatacagagcaccactgcatcggcggaggcggatatttccccgaggcctctccccagcaatgtggagactttagcgggttcgactggagtggctacggaactcatgtgggttattcctcctcacgagagatcactgaagcagccgttcttctgttttacaggtag

SEQ ID NO: 226990 - DNA, 978 bp, Artificial Sequence
  Description of Artificial Sequence: Synthetic coding sequence
atgttgtctatgttgaggacaatgactcgattatgtttcctcctcttcttcagtgtggccacttccgggtgttcagcagcagctgcctcatcacttgaaatgctcagtcgagagtttgagacctgcgcattcagctttagcagtctgccaagaagctgcaaagagataaaggaacgctgtcattctgcaggagatggtctatatttcctgagaacaaagaatggagtggtctaccagactttttgcgatatgactagcggagggggtggttggacgttggtggcctcagtgcacgaaaacgacatgagaggtaagtgtactgtgggtgacagatggtcttcccagcaaggcaacaaggccgattatcccgaaggagacggcaattgggcgaactacaatactttcggatctgccgaagcggctacatcagacgattataaaaacccaggatactatgatatccaggccaaggatctcgggatttggcatgtacccaacaaaagtcccatgcagcattggagaaacagcgccctgctgagataccggaccaacaccggttttttgcagcggttaggtcataatctatttggcatttatcaaaagtacccagttaaataccggagcggcaaatgctggaacgataatggtcctgccattcccgttgtatacgacttcggggacgctaaaaaaactgcctcttactactcaccctacggccagcgagagtttgtggctggttttgtgcagttccgcgtgttcaataacgaaagagctgccaatgcactgtgtgcaggaatcaaggtaactggatgcaatacagagcatcactgtatcggaggtgggggatttttcccccaaggtaagccgaggcagtgcggtgacttcagcgccttcgactgggacggatatggtactcatgtgaaatcttcttgttcacgggagatcactgaggccgcagtgctactgttttaccggtag

SEQ ID NO: 226991 - DNA, 2736 bp, Artificial Sequence
  Description of Artificial Sequence: Synthetic coding sequence
atggatggagccatgggaccacggggtctgcttctatgcatgtacctggtgtcactcctgattctacaggctatgccagctctggggtctgccacaggaagatcaaaatcatccgagaaacgccaggccgtggacactgccgtggatggagtgttcattaggtcgctgaaggttaattgtaaagtcacttctagatttgcccactacgtggtaaccagtcaggtggtgaacactgccaacgaggcgagagaggtggcattcgacctggagatcccaaagactgcttttatatccgatttcgcagttaccgccgatggcaacgcctttattggcgacataaaagacaaggttaccgcgtggaagcagtatagaaaagccgctatcagcggagagaacgccggactcgtgagagcttctggcagaacgatggaacagttcactattcatctgaccgttaacccccagtcgaaagtgactttccagttgacatacgaagaggtactgaagagaaaccatatgcaatacgagatcgttataaaggtcaagcctaagcagctagtgcaccatttcgagatagatgtggacattttcgaaccccagggcatctctaagctcgacgcacaggcctctttcctgcccaaggaactcgcagcacagactattaagaagtctttctctggaaagaaggggcatgttttgtttagaccaaccgttagccagcaacagagctgtcccacatgtagtacctcactgctgaatgggcactttaaagttacatatgatgtatctcgagacaagatttgtgatttacttgtggccaataatcattttgcgcatttcttcgccccacagaacctgaccaacatgaataaaaacgtggtcttcgtaattgatatctcggggtctatgaggggccaaaaagtgaaacagactaaagaagctctgctgaaaatcctgggtgatatgcagcctggcgattattttgacctggtcctgttcggaactagagtccagagctggaagggttccttagtgcaggccagcgaggctaacttacaggccgctcaggacttcgtccgcggtttcagtctggacgaggcaacgaacctgaatggcggtttactccgagggatcgagattctgaatcaggtacaggagtctttgcccgagctcagcaaccatgcatcaattctgatcatgcttacggatggcgatcccactgagggagtgaccgatcggagccaaattctcaagaatgttcggaatgcgatacggggaaggtttcccctctataatctcggcttcggccacaacgtggatttcaacttcctcgaagttatgtccatggaaaacaatggcagagcgcaacgaatttatgaggatcatgacgccacccagcaactgcagggtttttatagccaggtggccaagcccttacttgttgacgtggaccttcagtatcctcaggatgccgttctggctttaactcagaaccaccacaagcaatattacgaggggtccgagatcgtcgtagccggtcgcattgctgacaacaagcaatcatcctttaaagctgatgtgcaggcgcacggggagggccaggaattctccataacctgcttggtcgacgaagaagaaatgaagaagctcctgagagaaagggggcacatgcttgaaaatcacgttgagaggctatgggcctacctaaccatccaggaactcctggcaaagaggatgaaggtggacagggaggaacgcgcaaacctgagttcacaggctctgcagatgtctctggactatggctttgtgacgcccctgacaagcatgtctattagaggtatggctgaccaggacggacttaaaccaaccatcgataagcctagcgaggatagccctcctcttgaaatgctgggccctcgcaggacattcgtactaagcgcactgcagccctcacctacacactccagttccaatacgcaaagactgcccgacagagtcacaggagttgatacagatcctcactttatcatccacgttccacagaaagaggacaccctctgtttcaacatcaatgaagagcctggagtgattctgtccctcgtgcaagatcccaacaccggttttagtgtaaatgggcaactgataggcaataaggcacgtagcccgggacagcatgacgggacctattttggcaggctcggcattgctaacccagcaaccgattttcagctggaagtcacaccacagaacatcactttgaatcctggatttggaggtccagtgttctcttggcgtgaccaggctgtcctgaggcaggacggagtcgtagtgactatcaacaaaaaaagaaatctggtagtgtcggtggatgatggcggtacttttgaagtggtccttcaccgagtttggaagggttccagcgtgcatcaggattttctgggcttctacgtgctggacagtcacagaatgtctgccaggacccacggactgttagggcagttttttcatcccatcggctttgaagtctccgacatacacccagggtcggatccaaccaagccagacgccaccatggttgtgaggaatcgaaggcttactgtaacaagggggctgcagaaagactacagcaaggatccctggcatggcgctgaagtttcatgttggttcattcacaataatggggctggactgatcgatggggcttacaccgactacatcgttcccgacattttctag

SEQ ID NO: 226992 - DNA, 1872 bp, Artificial Sequence
  Description of Artificial Sequence: Synthetic coding sequence
atgaacaagaatgtcgtcttcgttatcgatatttcaggctccatgagaggccaaaaagtaaaacagacaaaggaagcccttctgaaaatcctcggagacatgcagccaggagattattttgatctggtgctcttcggaacaagggtgcaaagctggaagggttctttggtccaggcttcggaagcaaacctgcaggccgcacaggactttgtgcggggtttcagccttgatgaagcaaccaacctgaatgggggattattacggggaatcgagattttgaaccaagtgcaggagtcgctcccagaattgagcaatcacgctagcatcctcattatgctgacagacggcgatcctaccgagggggtaaccgataggagtcagattctcaagaatgtacgaaacgccatcagaggtcgcttcccgctgtataatctgggctttggacacaacgtagattttaattttttagaggtgatgagcatggaaaataatggacgcgcacagagaatatatgaagatcatgatgcaacccaacagcttcaaggcttttactcgcaagtagccaagccactgctggttgatgtggaccttcagtaccctcaagacgctgtgctggctctcacacagaatcatcataagcaatactacgaaggtagcgagatcgtggttgcaggccgaatcgctgacaataagcagagttcattcaaggcagacgtccaggcccacggtgaaggccaagagtttagcatcacctgcttagtcgatgaggaagaaatgaagaagttattaagagagcggggtcatatgctcgaaaatcatgtggagaggctgtgggcatacttaactatccaagagctgctcgctaagaggatgaaagtggatagggaagaaagggccaacctgtcatctcaggccctacagatgtctctggattacggctttgtcacgccactgacgtccatgagcattagaggaatggccgatcaggatgggctgaagcccactattgacaaaccttctgaggacagtcctcctcttgagatgttggggccaaggcggactttcgtcctgagcgccctgcagccctcccctactcacagttcctcaaatacacagcgtctgcccgaccgcgtaactggggtggataccgatccacattttatcattcatgtgcctcagaaagaggataccctgtgctttaatattaatgaggagcctggtgtgattctctcattagtgcaggatcctaatacgggcttcagtgtgaatggccaactcatagggaataaggcgcgtagcccaggccagcacgacggtacctacttcggaaggctgggaatcgccaacccagcaaccgatttccagcttgaagtcactcctcagaacattactcttaatccaggctttggcggtccagtcttttcctggcgtgaccaggccgtgctgaggcaagacggagtggtggtgactatcaacaaaaaacgtaatctcgttgtttcggtggatgatggcggtacttttgaggtggttctgcaccgggtctggaaggggagcagcgtacatcaggacttcctgggcttctatgtgctggatagccatagaatgtccgcacgaacgcatgggctgttaggccagttctttcaccctattgggtttgaggtgagcgacatccatccgggatccgaccctaccaagccagacgcaaccatggttgtcagaaatcgccgattgaccgtaacccgtggcctgcagaaagattattctaaggatccttggcacggcgctgaggtatcttgttggttcatccacaacaatggcgcaggtttgattgacggtgcgtatacagattacatcgtacctgatatcttttag

SEQ ID NO: 226993 - DNA, 2310 bp, Artificial Sequence
  Description of Artificial Sequence: Synthetic coding sequence
atggaacaattcactatccatcttactgttaaccctcaatccaaagttacttttcagctgacttacgaggaggttctgaagaggaatcacatgcagtatgaaattgtgatcaaggttaaacccaaacagttagtgcaccactttgagatagacgttgacatcttcgaaccgcagggaatatccaaactcgatgcccaagcgagctttctgcctaaagagctggctgcccagaccatcaaaaagtctttttctggcaaaaagggccatgtgctttttcggccaactgtctcacagcaacagtcatgccctacatgcagcacttctcttttaaacggtcactttaaagtcacctacgatgtgagccgggataagatttgcgatctgctggtggccaacaaccacttcgcgcatttcttcgcaccgcagaaccttactaacatgaacaaaaatgtagtctttgttatcgatatctccggtagtatgcgaggccagaaggtgaagcagaccaaggaggctctgttaaagatcctcggtgacatgcaaccaggcgactatttcgaccttgtcctgttcgggacccgcgtacagtcttggaaggggtcccttgtccaggcatcagaggccaatttgcaggctgcgcaggacttcgttcggggatttagcctcgacgaagccacaaacttaaacggaggcctgttgaggggaatagagattctcaaccaggtgcaggagagtctgccagagctgtcgaatcacgcaagcatcctcatcatgttaacggatggcgatccaaccgagggagtgacagacagatcccaaatcctaaagaacgttcggaacgctataaggggaagattccctttgtacaacctagggtttgggcataacgtggacttcaactttctggaggtcatgtcaatggagaataatggacgtgctcagcgcatatatgaggatcatgatgcaactcagcagctgcaggggttttattctcaggtggccaagcccctgttggtggacgtggaccttcagtaccctcaggacgccgtgctagcactcactcagaaccatcacaagcaatattacgagggaagtgaaatagtggtcgccggtcgcattgcagataataaacagtcgtcattcaaagcggacgtgcaggcccacggcgaagggcaggagttctccatcacttgcctagtcgacgaagaggaaatgaaaaagcttttgcgggaacgaggccacatgctcgagaatcatgttgagagactgtgggcctacctgaccatccaggagctcctggctaagcgcatgaaagtagatcgggaggagagggccaatctgtcaagccaagcattacagatgtccttggactacggatttgttacccccctcacaagcatgagtattcgaggcatggcggaccaggacggtctgaagccaacaattgataaacccagcgaagactcccctccccttgagatgctcggccctaggcggacctttgtgttgtctgcattgcaaccttctccaacacactcttcttcaaatacacagcgactccccgatcgagttaccggggtggataccgatccccatttcattatacacgttccacaaaaagaggatacattatgtttcaacatcaatgaagagccaggcgtgatcctgtccctcgtccaggaccccaacactggtttttcggtgaatggccagctgattggaaacaaagccagaagcccgggtcaacacgacggaacctacttcgggcgactcggaatcgccaaccccgctactgatttccaattagaagtgactcctcagaatataacactgaatcctgggttcggcggtcctgtgttctcttggagggaccaggcagtattgagacaggatggcgtggtggtgacaatcaacaagaaacgtaatctcgtcgtgtctgtggacgatggcggaacatttgaggtggttctgcacagagtgtggaagggatcaagcgtgcatcaggattttctggggttttacgtccttgactcccaccgcatgtctgccaggactcacgggctgctgggccagtttttccacccaatcggcttcgaagtgtcagatattcatcctggctctgatcctactaaacctgatgcaactatggtagtaagaaatcggaggctgaccgttactcggggactgcagaaagactactctaaggacccatggcacggagccgaggtgtcctgctggtttattcataataatggagcaggtctcatagacggggcttatactgattatatagtgcctgacattttttag

SEQ ID NO: 226994 - DNA, 1938 bp, Artificial Sequence
  Description of Artificial Sequence: Synthetic coding sequence
atggatggcgcaatgggccctagggggctgctactgtgtatgtacttagtctcactgctgatccttcaggccatgcccgctctaggcagtgcgacaggtaggagcaaatcgtcggagaagaggcaggctgtggataccgccgtggacggtgtcttcatcagaagtcttaaggttaactgtaaagtaacatccagattcgcacactacgtggttacgagtcaagtcgtgaacactgcaaacgaagccagagaggtggcctttgatttagaaatcccgaaaactgcctttatttctgacttcgctgtgaccgcagacggcaatgccttcattggcgatattaaggataaggtgactgcctggaagcaatatcggaaagccgctatttccggtgagaacgcaggactggtacgggcatcaggtagaacaatggagcaatttactattcacttgaccgtcaacccccagtctaaagtgacattccaactgacatacgaggaagtgcttaaacggaaccacatgcagtatgagatcgtgatcaaagtcaagcccaaacaactggtccatcatttcgagatcgacgtcgacatttttgaaccacagggaatctccaagttggacgcccaggcgtcttttctgcctaaggagctcgccgcacagacaattaagaagtcgttcagcggcaagaaaggacacgtattgttcagaccgacggtctcccagcagcagtcgtgcccgacttgtagtacgtctcttcttaatgggcacttcaaggtgacatacgatgtgagtagagacaaaatctgtgatctgctcgttgcgaacaaccactttgctcacttcttcgcgcctcagaatttgacaaacatgaataaaaatgttgtcttcgtaattgacatttccggcagcatgcgtgggcagaaggtcaagcagaccaaagaggccctcttgaagatcctcggcgatatgcaacccggagattattttgacctggtgctatttggcacccgggtgcagtcttggaaaggatctctggtgcaggcctctgaagctaacttgcaggcagcacaggactttgtgaggggcttttccctggacgaagctactaacttaaacggcggactgctgcggggtatcgagatcctaaaccaggtgcaagagtcactcccggaactctcgaaccatgcgagtatcctgataatgttgacagatggagaccctacagagggcgtcaccgacagatctcagatcttaaaaaatgttaggaacgccatccgcggtcgattccctttgtataaccttgggttcgggcacaacgtagattttaattttctagaagtcatgagtatggagaataacggtagagctcagcgaatttacgaggatcacgacgctacccaacaattacagggtttctactcgcaagtggcaaagcccttgctcgtggacgtggacctccagtatccgcaggatgctgtgttagctttgacccaaaaccaccacaaacagtattatgaaggctccgagatagtggtggctgggcgtattgccgataacaaacaatcctcttttaaggcggacgtccaggcacatggagagggtcaggagttctctatcacatgcttggttgatgaggaagagatgaaaaaacttcttcgcgaaagaggccatatgctcgaaaaccacgtggagaggttgtgggcttatctgacaattcaggaattgctggctaagcggatgaaggtggaccgggaggagcgcgctaatttgtcgagccaggcactgcagatgagtctcgactacggctttgtcacccctctgacatccatgtcaatccgtggaatggctgaccaagacgggctcaaaccaaccattgacaaacccagcttgcatcacccaagggcacctgaacgtggtcatccagtccttcagcaccaatag

SEQ ID NO: 226995 - DNA, 2841 bp, Artificial Sequence
  Description of Artificial Sequence: Synthetic coding sequence
atgaaacggttgacctgtttcttcatttgcttttttctgtccgaagtctcaggttttgaaatccctatcaacggactgagtgaatttgtggactacgaggatcttgtggaactggcgcctggaaaattccagctggtggccgaaaacaggcggtatcagagaagtctgcccggagaatcagaggagatgatggaagaggtggaccaggtgacgctgtactcatacaaggttcagtccaccattacctcccggatggccacaacaatgatccaatccaaggtcgttaacaacagtccacagccccagaatgtggtctttgatgtgcagattccgaagggagcttttatctcaaacttttctatgactgtggatgggaagaccttccgtagctctattaaagaaaaaacagttgggcgagccctctacgcgcaagcacgcgcaaagggaaaaactgcaggactggtgcgcagctctgcgctagatatggaaaatttccgcaccgaggtaaatgtcttacccggtgctaaagtccagtttgaactacattatcaggaggtgaagtggcgaaagctaggcagttacgagcataggatttatctgcaacccggaagactggccaaacatctggaagtcgacgtatgggtgattgaaccccaggggctccgattcttacacgttccggacacatttgagggacatttcgacggagtaccagtaatttctaagggccagcagaaagctcacgtatcatttaagccgacagtcgcacagcagcgaatttgtcctaattgccgtgagaccgcagtcgacggggaattggtcgtgttatacgatgttaagcgcgaagaaaaagctggggagttagaggtttttaatggatatttcgttcatttcttcgcgccagacaatctggatccaatccccaaaaacattttgtttgtgatagatgtcagcggttcgatgtggggggtcaaaatgaaacagactgtggaagctatgaagactatcttggacgaccttcgggcagaggatcatttcagtgttatcgactttaaccaaaacatcagaacatggcgcaatgatctaatcagtgctactaagacacaggtggcagatgccaagagatatatagaaaagatccagccatctgggggtacgaacatcaacgaggcattgctgagggccatctttattctcaatgaagccaacaacctagggcttttagatcctaacagcgtgtcactcatcattttggtgagtgatggcgatcctacagtcggagaactaaagctgtcaaagattcagaagaatgtgaaagagaacatacaagacaatatcagcttattcagcctcggcatggggtttgacgtggactatgactttttgaagaggttatccaatgagaaccatggaattgctcagcgcatttatggaaatcaggatacttcctcacagctgaagaaattctataaccaagtcagtacacctttactgcgcaatgtgcagttcaattatccccatacgtctgtgaccgacgtgacacagaacaattttcataactattttggtgggagcgagattgtcgttgcgggtaagtttgacccggcaaaactcgatcagattgagagtgtcataaccgctactagtgccaacacacaattagttttagagacactggctcagatggacgatctgcaggattttctgtccaaggacaaacacgctgatccggatttcactcgcaagctttgggcttacctcactattaaccagctccttgcagaacgatcactcgctcccaccgctgcagctaagaggagaattacaaggagtatactccagatgagtcttgatcatcatatcgtcacaccactcactagtcttgtgattgaaaatgaggctggcgacgagcgaatgctggccgatgcccctccacaggatccttcctgttgctcaggagcattatattatgggtctaaagtggtccccgatagcacacctagttgggccaaccctagcccaacaccggtgatcagcatgttggcccagggatctcaggtactggagtctacacctccccctcacgtgatgagagtggagaacgatccacacttcatcatatacctcccaaagtctcagaagaatatctgcttcaacatcgatagtgagccagggaagattctcaatttggtgtccgatccggaaagtgggatagtggttaacggccagctggtcggagcaaagaagcctaataatggaaaactcagtacctattttgggaagctcggattttatttccagtccgaagatattaaaattgagatatcaactgagaccatcactctgtctcatgggtcctcgacttttagtctgagctggtctgacactgctcaagttaccaaccagcgcgtgcagatctctgtgaaaaaggagaaagtagtaaccatcaccctggacaaagaaatgtccttcagtgtgctcctgcatcgggtgtggaagaagcacccagtaaatgtggattttctggggatatacattccccctacgaacaagttcagcccgaaagcgcatggactgattggccagttcatgcaggagccaaagatccatatcttcaacgaaagacctgggaaggatcccgagaagcccgaggcttctatggaagttaagggccaaaagctgatcatcaccagaggcttacagaaagactatcgaactgacctggtctttgggactgatgtgacctgttggtttgtccacaacagcggaaagggcttcatagatggtcattataaagactacttcgtcccccaattatacagttttctcaagagaccatag

SEQ ID NO: 226996 - DNA, 2658 bp, Artificial Sequence
  Description of Artificial Sequence: Synthetic coding sequence
atggttgcactgtctcatctggggtctgctctgcaactgggcagcttgttcccccgaagccccttcagactgctgggcaaacggtccctccccgagggcgtcgccaatggaattgaggtgtattcaactaaaattaactcaaaggttaccagtcgctttgcacacaatgtggtgacaatgcgggctgttaacagagcagacaccgctaaggaagtatcttttgacgtcgaattgcccaagacagccttcatcaccaatttcaccctgacaatcgacggtgtaacttaccctggcaacgtaaaagagaaagaagtagccaaaaagcagtatgagaaggcggtcagtcaaggtaaaacagcgggactcgttaaggcttctggcagaaagctcgagaagttcactgtcagcgtaaacgtagcagcaggatcaaaagtgaccttcgaacttacatacgaagaactcttgaaacgacacaaagggaaatatgagatgtatctgaaagtacaacctaagcagcttgttaagcattttgaaatcgaggtcgacatctttgagccccaggggatctccatgttagacgccgaggcttccttcattactaatgacttgctggggtctgccttgaccaaaagtttttctgggaaaaaaggacatgtgtcttttaaaccttcattggaccagcagaggagctgcccaacttgtactgactcacttctcaacggcgactttacaataacttacgacgtgaatagggaaagtccaggaaacgtgcagattgtaaacggatacttcgtacattttttcgcaccacaggggctgcccgtggtccccaagaacgtggccttcgtgatcgatataagcggcagtatggctggacgcaagctcgagcagaccaaggaagcattgctccggatcctcgaggacatgcaagaggaggattatctaaatttcatattgttcagtggtgatgtgagcacttggaaggagcatcttgtgcaagccactcccgaaaacttacaagaagctagaactttcgtgaaatctatggaggataaaggcatgactaacataaatgatggactcctgcgcggtatttctatgctgaacaaagcaagagaagagcaccgaatccctgagcgatccaccagcattgtgataatgttgaccgacggtgacgcaaacgtaggagaatcgcggcctgaaaagatccaggagaatgtgagaaacgctatcggtggcaaattcccactgtataacctgggctttggtaacaatctcaattataactttctcgagaacatggcactggagaatcacggatttgcccgaagaatctatgaggactctgacgccgacctccagctgcaggggttctacgaggaggtggctaaccccctcctgaccggtgttgaaatggaatacccagaaaacgctatcctggacctgacacagaatacctaccagcatttttacgacggcagcgagatagtcgtggcgggtcgactggttgacgaagacatgaatagctttaaggcagacgtgaagggtcacggggctaccaatgatctgacctttaccgaggaggtggacatgaaagagatggagaaggcgctgcaggagcgcgattacattttcggaaattatatcgagcgactatgggcctacttgaccattgaacaattgcttgagaagagaaagaacgcacacggcgaggaaaaagaaaaccttacggcaagagctcttgacctaagtctcaagtaccactttgttacccctttaacttctatggtggttacgaagcccgaggataacgaagatgaaagagccatcgccgataaacccggagagggattcagtgctacacccgtctcaccagcgatgagctacctgacctcttaccagcctcctcagaatccgtattactacgtggacggtgatccccactttattatacagattccagagaaagatgatgcactttgttttaacattgacgaagcccctggcacagttttacgcctgattcaagatgccgtgaccggcctgactgtgaatgggcaaatcaccggtgataagcgagggagcccggactcaaaaaccaggaagacatactttggtaaacttggaatcgccaacgcgcagatggactttcaggtggaagtcaccacagaaaaaatcaccctctggaacagggctgtaccaagcacctttagttggctggacactgtcactgttacccaggatgggctgtccatgatgatcaaccgaaagaatatggtggtctcatttggtgacggtgtgacgttcgtggtagttttgcaccaggtgtggaaaaaacaccccgtgcatcgtgatttcctgggattctatgtggttgattcacacagaatgtccgcacagacacacggacttttaggccagttctttcagcccttcgactttaaggtgtctgacatccgacccggttcagacccgaccaaaccagatgccacattggtagtgaagaatcaccagttgatagtgacaagggggtcgcaaaaggattatagaaaggacgccagtataggaaccaaggtggtctgctggttcgtacataataacggggaaggattgattgacggagtgcacacggattatatcgtgccaaatctattctag

SEQ ID NO: 226997 - DNA, 2013 bp, Artificial Sequence
  Description of Artificial Sequence: Synthetic coding sequence
atggcgttcgcctggtggccatgcttgatcctggccttactgtcctcgctagccgcaagcgggtttccaagatctcccttccgccttttgggaaagcgctctctgcctgagggcgtcgcaaacggtatcgaggtgtactccaccaagattaatagcaaggttacctctagatttgcccacaacgtcgtgaccatgagggccgtgaatcgcgcagatactgccaaggaagtgagcttcgacgttgagcttcctaagacggcttttatcaccaacttcacactcaccattgacggtgtcacctacccaggcaatgttaaagaaaaggaagtagccaagaagcagtatgagaaggcggtgtctcagggaaagactgcaggactagttaaggcgagcgggagaaagcttgaaaaatttactgtttccgttaatgttgcggcaggcagcaaagtcacattcgagctcacctacgaagaattactgaagcgccataaagggaagtatgaaatgtacctgaaggtgcagcccaaacagctcgtcaagcattttgagatcgaggtggatatcttcgagcctcagggcataagtatgcttgacgccgaggcatcattcattacaaatgacctcctgggctccgcactaacaaaaagcttctccggcaagaaaggccatgtcagcttcaagccgtccctggaccagcagcgcagctgtccaacgtgcactgactccctacttaatggcgatttcacaatcacatacgacgttaatcgggagagccctggcaatgtgcaaatcgttaatggttatttcgtacacttttttgcgccacagggactgcccgtggtgcccaaaaatgtcgccttcgttatcgatattagcggttcaatggcaggtcgaaaattagagcaaactaaggaggctcttttacgcatacttgaagacatgcaagaagaagactaccttaattttatattatttagcggcgacgtctcaacatggaaagaacatttagtgcaggccactccggagaacctccaggaagcgagaacttttgtgaaatcaatggaagataagggaatgacgaatattaatgacggcttactgcgtggcatatcgatgctgaataaagccagggaagaacacagaattccagagcgctctacttcaattgtcattatgctgaccgacggggacgcgaacgtgggcgagtcacgccctgaaaaaattcaggagaacgttcggaatgccattgggggaaagttcccactgtataatctggggttcggcaataatcttaattacaacttccttgagaacatggctctggaaaatcatggctttgctcggagaatttacgaagattcggacgcggatctccaactgcaagggttctacgaggaagtggccaaccctctgttgacgggagtggaaatggagtaccctgagaatgccattttggacttaacacaaaacacatatcagcacttctacgacggcagtgaaatcgtggttgcaggtcgcctggtggacgaagatatgaacagctttaaagccgatgtgaagggccacggagctactaacgacttaactttcacagaagaagtggatatgaaagaaatggagaaggctctccaggagagggattacatctttggcaactacatcgagagactgtgggcgtacttgaccatcgagcaattgttggaaaagaggaagaatgcacatggcgaagagaaagagaatttgactgcacgcgcattggacctcagcttgaaataccactttgtcacccccctgacgtctatggtggtgaccaaaccagaggacaacgaggacgagagagccatcgccgacaaaccaggtgaagggggagactcacatacaggcgagcctaggcatgtgttaccagaccaactgcccgcatcttcaaaaccactgcttctatgtggtcggggaagtccactgcatcaccccaatagcggtgagcgccgttgtcctctgctccaacacagatag

SEQ ID NO: 226998 - DNA, 2673 bp, Artificial Sequence
  Description of Artificial Sequence: Synthetic coding sequence
atggctttcgcctggtggccttgcctcatccttgcattgttgtcaagccttgcagcttccggtttccccagatccccattcaggcttcttggaaagcgctctcttccggaaggggtcgccaatggtatcgaggtttactctaccaaaatcaactcaaaagtaaccagtagatttgctcataacgtggttaccatgcgcgctgtcaacagagccgacacagcaaaggaggtgagctttgacgtggagctgccaaaaaccgccttcatcacgaatttcaccctgacaatcgatggcgtgacataccccggaaatgtcaaggaaaaggaagtggctaagaagcagtacgagaaggccgtgtcgcaaggcaaaacggctggcttggtcaaggcgtccggtcgcaaactggaaaagtttacagtttccgttaatgtggcagccggaagtaaggttacctttgagctcacatatgaggaactgttgaaacgccataaaggtaagtacgagatgtatttaaaggtgcagccaaagcaactcgtgaaacattttgaaatcgaagttgacattttcgagccgcagggcatttctatgttagacgctgaggcttccttcattactaacgatttgttaggcagcgctctaacaaagagcttttccggcaagaagggccacgtgtcctttaaaccttcactcgaccaacaaaggtcttgccctacctgcacagactccctgctgaacggagatttcacaataacttatgatgttaatagggagtctcctggaaatgtgcagattgtgaatggctattttgttcatttttttgcgcctcagggactgcccgtcgtacctaaaaacgtggccttcgttatcgatatctccggcagcatggcgggaaggaagttggagcaaactaaagaggcgctacttcgcatcttggaagatatgcaggaggaggactacctcaatttcattttattttcaggcgacgtgagtacgtggaaggaacacttagttcaggcaacccccgagaacctccaggaggcacgaacctttgtgaagtctatggaagataaagggatgaccaacataaacgatggtctcctgagaggtataagcatgctcaacaaggctagggaagagcataggatcccggaacggagtacctccatcgtgataatgctgaccgatggggatgctaacgttggagagagtcggcctgaaaaaattcaggaaaacgtccgaaatgctattggtggaaagttccctctgtacaacctcggctttggaaacaacctaaattacaattttttagagaatatggccctggaaaaccatggttttgcaaggaggatttatgaggactccgatgcagaccttcagttgcaggggttctacgaggaggtggcgaacccgctgctcacaggggtcgaaatggaatatccagagaatgccatccttgaccttactcaaaacacatatcaacacttttatgacggatcggagattgtggtcgctgggcgactggtagacgaggacatgaacagtttcaaagccgatgtgaaaggccacggggctacaaacgacctaacttttacagaagaagtagacatgaaagaaatggagaaggccctgcaagaacgggactacatttttggcaattatatcgagaggttgtgggcctacttgaccatcgagcagcttctggaaaaaaggaagaatgctcacggggaagagaaggaaaatcttacggcccgagccctggatctgtcattaaagtatcacttcgtgactccattaacgagcatggtggtgactaaacctgaggataacgaagacgaaagagccatcgcggacaagccgggagaggatgccgaagccactcctgtgtcccctgcaatgtcatacctgacatcttaccagccacctcagaacccttactactatgttgacggcgatccacacttcatcatccaaattccagagaaggatgacgccctatgcttcaatatagatgaagccccaggcacagttctaaggctgatccaggacgccgtgacgggtctcaccgtgaacggacagattactggcgataaacggggttctcctgactccaaaacaaggaagacttacttcgggaaactcggaatcgctaacgctcagatggattttcaggttgaagtcactactgaaaaaatcaccctttggaacagggcggtgccttcaaccttcagctggttggatacagtaactgtgacccaggacggcttaagcatgatgatcaatcgtaagaatatggttgtatcattcggtgacggagtcactttcgtggtcgtcctgcaccaggtttggaaaaaacacccagttcacagggattttctggggttctatgtagtggattcccatcgcatgtccgcccagacccacgggctcctaggacaatttttccagccgtttgacttcaaggttagcgatatacggccaggatccgaccctactaagcctgatgccacgctcgtggttaaaaatcaccagctgatagtcacaaggggcagccaaaaggattatcgtaaagatgcctctattgggaccaaagtggtgtgttggttcgttcataataacggtgaaggcctgatcgacggcgtccatactgattatatcgtcccgaacctgttttag

SEQ ID NO: 226999 - DNA, 1977 bp, Artificial Sequence
  Description of Artificial Sequence: Synthetic coding sequence
atggcctttgcctggtggccctgcctgatcttggcccttctgagcagcctggctgcctcaggctttcctcgctcccccttccgtttacttggaaagcggagtctccccgaaggggtcgccaacggaatcgaggtgtactcaaccaaaataaattctaaagttacaagcagattcgcccataacgtggttaccatgcgcgctgtcaacagagcagatacggcgaaggaggtcagcttcgatgtggaactgccaaagacagcctttatcaccaactttactcttacaatagatggcgtgacttatcctggtaacgttaaggaaaaggaggtggctaaaaaacagtacgagaaagcagtgagtcagggcaaaacagccggtctcgtgaaggcaagcgggaggaagctagaaaaattcacagtcagcgtgaacgtggcagctggctccaaaaggcacaaagggaagtacgaaatgtacttgaaggtgcagcctaagcaactggtgaaacactttgagatagaggttgacattttcgagccccagggcatctccatgctggacgcagaagcaagcttcatcacgaacgacctgctggggagcgctcttactaagtcttttagtggtaagaagggccacgttagctttaagcctagcctggatcagcagcgctcatgccctacctgcacagatagtctactgaacggcgactttacaatcacgtacgatgtgaatagagaaagtcctgggaatgttcaaattgttaacggatacttcgtgcatttcttcgctccccagggccttcctgtggtgcctaaaaatgtcgccttcgtaatcgacatttcaggcagcatggccggacggaaactggaacagactaaggaggctctactgcgtattctggaggacatgcaggaagaggattatctcaattttatcctgtttagcggcgatgtgtccacttggaaggagcacctggtccaggctaccccggagaatctccaggaagcgaggacatttgtgaaatcaatggaagacaaaggaatgaccaatatcaacgatggactgttaaggggcataagcatgttaaataaggccagggaggagcaccgcatccccgaaagatctacctctatcgtaatcatgctgaccgacggcgatgccaacgtcggtgaatccaggcccgagaaaatacaggaaaacgtaaggaacgctatcgggggaaagttccctctttacaatctgggatttggaaacaatctgaattataacttcctcgagaatatggccttagaaaaccatggttttgcacgacggatttacgaagacagcgacgccgaccttcagttacaggggttctacgaggaagtggctaaccccctcctgacaggggtggaaatggaatatcctgagaatgccattctggacctgacacagaatacataccaacatttttacgacggatctgagattgttgtggccggaagactggtagacgaggatatgaattcttttaaggcggacgtgaagggccacggtgcaaccaatgacttgacttttactgaggaagttgacatgaaggagatggaaaaggcacttcaggagcgtgactacatatttggaaactacatcgaacggctctgggcctacctgacaatcgagcagctgctcgagaaaaggaaaaacgcccacggggaggagaaagaaaacctgaccgcgagagcgctggacctgagcttgaaatatcacttcgtgacccctctgacatccatggtggtgacgaagccagaggataatgaggacgaacgcgcaatcgcagacaagcctggcgagggcggtgattcacacactggtgagcccaggcacgtattaccggaccagttgcctgccagcagtaagccgctcctgttgtgcggcagaggttctccactccaccatccaaacagcggggaaagaaggtgccctctgctgcaacaccgctag

SEQ ID NO: 227000 - DNA, 2793 bp, Artificial Sequence
  Description of Artificial Sequence: Synthetic coding sequence
atgaaaccccctcggccagtgaggacttgcagcaaagtcttggtactgttgtcgttgctcgccatccatcaaacaacgaccgcggagaagaatggcatagatatctattccctgacagtcgattcgcgagtgagcagtcgcttcgcacacactgtggttacctcaagagtggtcaaccgggctaacacagtgcaggaggctactttccagatggagttgccgaagaaagcatttataacgaacttcagcatgatcatagacggcatgacgtacccaggtatcatcaaggaaaaggctgaggcccaggcacagtactcagccgctgtcgccaaggggaagagtgccggtctcgtaaaggctactggcagaaacatggagcagttccaggtgagcgtgtcagtagcccctaacgcaaagatcaccttcgagctagtgtatgaggaactgctcaagcgccgactcggggtatatgagctgctgttgaaggtgcggccacagcagctagtgaaacatctgcagatggatatacatatctttgagcctcagggaatcagttttctggagactgaaagcaccttcatgacgaatcagcttgtcgacgccctgaccacctggcagaacaaaacgaaagcacacatacggttcaaacctacattatcacagcagcagaaatcccccgaacagcaagaaacagttctggacggcaacctgattatcagatacgacgtggatcgagccatttccggaggttcaatccagatagagaatggctacttcgtgcactactttgcaccagaaggactcaccactatgcccaaaaatgtcgtgtttgtcatcgataaatccgggtcaatgtctggacggaaaatccagcaaacccgggaggcactgatcaagatcctggatgacctgagccccagagatcagttcaacttgatagtgttcagcacagaagcaacacagtggagaccttcacttgtccccgctagcgccgagaatgtgaataaagcgcgtagcttcgcagccggtatacaggctctcggcggtacaaatatcaacgacgctatgttaatggcagttcagcttctggactcgagcaaccaggaagaaaggcttccagaaggcagtgtgagtcttataatcctgcttaccgatggagatcctaccgttggagaaactaacccgagaagcatccagaataacgtgcgcgaggcagtgagtggtcggtacagcttattctgcttgggatttggtttcgacgtgtcatatgcatttctcgagaaactggccctggacaacgggggacttgcccgaagaatccacgaggattccgactcagctcttcagctccaggatttctaccaggaggtggcgaatcctctcctgacggccgtaaccttcgaatacccgagtaacgcagttgaggaagtgacccagaacaatttcaggctgctgtttaaaggctccgagatggtggttgccggtaaactgcaggaccgtggtcctgacgtgctgactgcaaccgttagcggaaaactccccacccaaaacatcacttttcagactgaatcttctgtggccgaacaggaagcagagtttcagtcccccaagtacatcttccacaatttcatggagcggctgtgggcatatttgacaattcagcaactgttagagcaaaccgtcagcgcgagtgacgcagaccaacaagctctccggaaccaggcgttgaacctgagcttagcttacagcttcgtaacgcccctgacatccatggtggtgaccaagcctgacgaccaggaacaatcacaggtggcagagaagcctatggagggtgagtccaggaataggaatgtccattccggttcgacattttttaagtactatttacagggtgcaaaaatcccaaaaccagaggctagtttcagcccgaggcgcggttggaaccgccaggctggagcagccggatccaggatgaatttcagacctggcgtgctctcgagccgtcagcttggactgcccggacctccggacgtgcccgatcacgccgcttaccatccattccgacggctcgccatcctgccagcatcggccccacccgcaacatccaaccccgacccagccgtgtctcgagtcatgaacatgaagatcgaagaaaccaccatgactacacagaccccagcccctattcaagcaccgtctgccatcctgcccctgcccggtcagtctgtggaacggctatgtgtggaccctagacatcggcagggacctgtgaacctgctgtcagacccagaacagggagtcgaagtgaccggacagtatgagagagagaaagccggtttttcttggatcgaagtgaccttcaaaaaccccctcgtctgggtgcacgcatctccagaacacgtcgtggtgaccaggaaccgccgaagctcagcttacaagtggaaggagacgctctttagtgtcatgccaggacttaagatgacaatggacaaaacagggctgcttctgctctccgatcccgacaaagtcacgatcggacttctgttctgggacggacggggtgaagggctgcgattgctcctgcgggacaccgatagattttcttcccatgttggagggacgttaggccagttttatcaagaggtgttgtgggggtcacctgccgcaagcgacgatggcagacgtacactaagggtacagggcaacgatcactcggcaactcgagaacggaggctggactaccaggaagggcctcccggtgtcgaaatctcatgttggagtgtcgagctgtag

SEQ ID NO: 227001 - DNA, 2745 bp, Artificial Sequence
  Description of Artificial Sequence: Synthetic coding sequence
atgaaaccgcctaggccagtccggacatgctctaaggtgctggtgcttctgtccttgctcgcaattcaccagaccaccaccgcagagaagaacggcatcgacatttattccctgaccgttgattctcgcgtgtccagtcgcttcgctcacaccgtggtaacctccagggtggtgaatcgtgccaacacagtgcaagaagctaccttccagatggagctccctaagaaggcatttattaccaatttttcaatgataatcgatggaatgacataccccggaatcatcaaggaaaaagccgaagctcaggctcaatattcagccgcagttgcaaagggcaagagtgccggtctagtaaaggcaacgggtaggaacatggagcagttccaagtctcagtgtccgtggctcctaacgccaaaattaccttcgagctggtttacgaggagcttttaaagcggaggttgggcgtgtacgagctcctgttgaaagtgcgaccacagcagctggtgaagcacctccaaatggacatccatatattcgagccacaaggcatatcctttctagaaaccgaatctacgttcatgactaatcagctcgttgatgcacttacaacatggcagaacaaaactaaggcgcacatacggttcaagcccaccctgagccaacagcaaaaatcccctgagcagcaagaaaccgtgttggatggaaacttgattattcggtatgatgttgaccgggctatttctggaggaagtattcagatcgagaacgggtactttgtacactacttcgcccctgaagggttgaccacgatgcccaaaaacgtggtttttgtgatcgacaaatccgggtctatgtcagggagaaaaatccaacaaacacgggaagcccttatcaagattctggacgacctctcacctcgggaccagttcaatttgatcgtgttctcaaccgaggccacccagtggagacctagcctggtacccgctagcgccgagaacgtaaataaagcaaggtcctttgctgcaggtatccaggctttagggggaacaaacattaacgacgcaatgctaatggctgtgcagctgctagacagtagtaaccaggaggaacggctgccagaggggtctgtttctctgataatcttgctgaccgacggcgacccaacagtgggggaaacaaatcccaggtctattcagaacaacgtgagagaggctgtgtccggaagatactcattgttctgcctgggttttggctttgatgtatcgtacgcctttttagagaaactcgcactggacaatgggggtctggccagacggatccatgaggactccgacagcgcactacagctgcaggacttttaccaggaggtagccaatcccctccttactgccgtgacttttgagtatcccagcaatgcggtcgaggaagtcacacagaataacttccggcttctgttcaaaggctccgaaatggtagttgccggaaaactgcaagatcggggaccagatgtcctcaccgccaccgtctcaggcaagcttcctacccagaatatcacctttcagaccgaatcttctgtcgctgaacaagaagcagaattccagtcaccaaagtatattttccataacttcatggagaggttgtgggcttatcttactattcagcagctactggagcagaccgtatccgctagtgatgccgatcaacaagctttgcgcaatcaagctctcaacttatcactggcctacagcttcgtcacgcccttgactagcatggtggtgactaaacctgatgatcaggagcagagtcaagttgccgagaaacccatggaaggcgagtctcggaaccgcaacgtgcattccgccggagccgctggatcccgcatgaatttccggccaggggtacttagctcaagacaactgggtctcccaggtccacctgacgttcccgaccatgctgcctatcaccccttcagacgcctcgcaatcctgcccgcttcagctcctccagccaccagcaatcctgatccagccgtgagtagggtcatgaacatgaaaatagaggaaacaacgatgacgacccaaacacctgcctgccccagctgcagcaggagtcgagcccctgctgtacctgcgcctatccaggccccatctgccatcctgcctctgccaggacagagcgtcgaaaggttgtgtgtagatccccgacacagacaaggacccgtcaacctcctgagtgatccggagcagggcgtggaggtgaccggccagtacgagagggaaaaggcgggatttagctggatcgaagtgacgtttaaaaacccccttgtctgggttcacgcttccccagagcacgtagtggtgacacgcaaccgcaggtcgtcagcctacaaatggaaggagacactgttctcagttatgcctggattgaagatgacaatggataaaaccggattattattgttgtcagaccctgataaggttactatcggtctgttgttctgggacggccgaggtgaaggcctgcgtctgcttctgagggacacagatagattttcctcacacgtaggcggaaccttaggacaattctaccaagaagtgctgtggggcagccctgctgccagcgatgatggacgtcgtaccttgagagtgcagggcaatgatcattcagccacaagggaaaggcggcttgactaccaggaaggccctccaggcgttgagatttcctgttggtctgtggaactgtag

SEQ ID NO: 227002 - DNA, 2703 bp, Artificial Sequence
  Description of Artificial Sequence: Synthetic coding sequence
atgaagccacctagaccagtacggacgtgctcaaaggtcctggttcttctgtccttgctagctattcaccagacaactacagctgagaaaaacgggatcgatatctacagcctgaccgtcgactcacgagtctcttcaaggttcgctcacacagtggtaactagtagggttgtcaaccgtgccaacaccgtccaagaggccacatttcagatggaactaccgaaaaaggccttcatcactaatttctctatgattattgacggtatgacttaccccggaatcatcaaagaaaaggctgaggcgcaggcccagtactccgccgcagtggctaaggggaaaagcgctggcctggtaaaggccacaggcagaaacatggagcagtttcaggtgagtgtttctgtggctcctaacgctaaaatcacctttgaactggtctacgaggagctcctgaaacgtcgcctgggtgtatacgagttgctgctgaaggtgcgtccccaacaactcgtcaagcacctgcagatggatatccatatctttgagccccagggtattagttttctggagacagagtctaccttcatgacaaaccagttggtcgatgctctcaccacctggcagaataagacaaaggctcatatccgctttaagccaacactgagccagcaacagaaatcgcccgagcagcaagaaaccgttctcgatggtaatctgattatccgatatgacgtggacagggctatatccggtggctccatccagatcgaaaacggttacttcgtccattacttcgcgcctgaagggttgaccactatgcctaagaacgtcgttttcgtgatcgacaagtctggctccatgtcgggcaggaaaattcagcagactagagaagccttgatcaaaattttggacgatctctcccccagggaccagtttaacttgatagtgttctcgaccgaggctacgcagtggcgccctagcttggtccccgcttctgcagaaaatgtgaacaaggcaagaagttttgccgctggaatacaggcactggggggtacgaatattaatgacgctatgctgatggcggttcagcttctggatagctcaaaccaggaagagagactgccagaaggcagtgtcagcttgattatactgctgactgacggggatcccacagtcggggaaactaacccaaggtcgattcagaacaacgttagggaagcagtgtcaggtcgttacagtctgttttgtctaggttttgggttcgatgtttcatatgcgtttttagaaaaactggcacttgataatggtggcctcgcccgacgcattcatgaagacagcgatagcgccttgcagttgcaggacttctaccaggaggtggcgaaccctctcctgacagccgtgacttttgagtatccaagcaacgccgttgaggaagttacgcagaacaacttccgattactgttcaagggaagcgagatggtcgtggccggaaagctgcaggatcgcggtccagacgtgctgaccgcaacagtgtccggaaagctgccgacccagaacattacattccagacggagagctcggttgccgagcaggaggcagaattccagagcccaaaatatatttttcacaatttcatggagcgtctgtgggcctatttgaccatccaacagttgctggaacagaccgtatccgcgagtgacgcggaccagcaggccctgagaaaccaggcactgaacctgagcttggcttattccttcgtgaccccactcacctctatggtggtcaccaaacctgatgatcaggaacaaagccaggttgccgaaaaacctatggagggcgagtccagaaaccggaacgtccacagcgctggggctgcaggaagcaggatgaatttccggccaggggtgctgagctcccgccagttgggcctgcccggacctcctgatgttcccgatcacgctgcttaccacccatttagacgcctagccatcctacccgcttctgcacctcctgcaacctctaatcctgacccagctgtgtctcgtgtcatgaacatgaaaatcgaggaaaccaccatgactacccagacaccggcacctattcaggcccctagcgccatcctgcccctgcccggacaaagtgtagagcggttgtgtgttgatcccagacatcgtcaaggccctgttaacctcctctccgatcctgagcaaggcgtggaggtcactggccaatacgaaagagaaaaggcgggatttagctggatcgaggtcacttttaagaaccccctggtgtgggtgcatgcgtcccccgagcacgtggtagtgacccgaaaccgccgtagctctgcctataaatggaaagagacactattcagcgtaatgcccggactgaaaatgacaatggataaaaccgggcttctgctgctaagcgatccagataaagttaccattgggctgcttttctgggatggacgtggtgaagggttgcgacttctgttgagggacacagacagatttagcagtcacgttgggggtacgctgggccaattttatcaggaggtgctatgggggagtcccgcagcaagtgacgacggcaggcgcactttgcgtgtacaggggaacgatcactcagccacaagggagaggaggctggactaccaggagggacccccaggcgtcgaaatcagctgctggtccgtcgagctgtag

SEQ ID NO: 227003 - DNA, 1683 bp, Artificial Sequence
  Description of Artificial Sequence: Synthetic coding sequence
atgacataccctggtatcatcaaggagaaagcagaggcccaggctcaatacagcgctgccgtggccaagggaaagtccgctgggctggtgaaagcaaccggaagaaatatggagcagttccaggtctccgtttccgtggccccaaatgcaaagattacttttgagttagtctacgaggagttgctgaagcgacggctcggagtatacgaactgcttttaaaggttaggccgcagcagctcgtgaaacacctgcagatggatatacatatcttcgaaccccagggtatatcatttctggaaactgagagtacgtttatgaccaatcagttggtagatgctctgacaacctggcaaaataaaaccaaagcccatattagattcaaacctacactgtctcagcagcaaaaatcccctgagcaacaagaaacagtgctcgatgggaatcttattataagatacgatgtggaccgagctatctcgggcggatcaatccaaatagagaatggctacttcgttcattacttcgcaccagaggggttaactacaatgccaaagaacgtggtatttgtgatcgacaagtcgggatcaatgagcggcagaaaaatccagcaaactagggaggctctgataaagattctcgatgacctgtctcctcgtgatcagttcaatctgatagtatttagcactgaggcaacccagtggaggccatcccttgtgccggcttccgccgagaatgtgaacaaagcccgtagcttcgccgctggcattcaggcactgggtgggactaacatcaacgatgcgatgctaatggcagtgcaattactcgattcctcaaatcaggaggaaaggctccccgagggtagcgtcagtctgatcattctgctaacagacggagaccctaccgtgggagagacaaaccctcggtctatccagaataatgttagggaagccgtttccggaagatattcgctcttttgtctaggttttggatttgacgtttcctatgccttcctagaaaaactcgctttggataatgggggtctggctcggaggatacacgaggactcagatagtgctttgcagttgcaggatttttatcaggaggttgccaaccccctgcttactgcggttacatttgaatatccaagcaacgcagttgaggaagttacccaaaacaattttaggctcctatttaaaggttcggaaatggtcgtcgccggtaaactgcaggaccgcggacctgatgtcctcacagccacagtatcaggaaagttgccaacacaaaatattacttttcagactgaatcttccgtagctgagcaagaggctgagttccaatctcctaagtatatatttcataacttcatggaaaggctctgggcctacctaacgattcaacagctgctggagcagactgtgagcgcttcagacgctgatcagcaggccctgagaaaccaggccctaaacctcagtcttgcttattctttcgtgacgcccctaacttccatggtcgtgaccaagcccgacgaccaggaacaaagccaagtggccgaaaagcctatggaaggagaatctcgtaacaggaatgtgcatagcggcagtacttttttcaaatactacctgcaaggcgcaaagatccccaagcctggagacaaggtcgggggtggcggaagaggagactag

SEQ ID NO: 227004 - DNA, 2667 bp, Artificial Sequence
  Description of Artificial Sequence: Synthetic coding sequence
atgaaaccccctcggccagtaaggacttgtagcaaagtactcgtcttactctcattattagccatacaccagacgacaaccgctgagaagaatggcatcgatatctattctttgacagtcgactcgcgagtgtcgtctcgctttgctcatactgtggtcacgtctagggttgtgaacagagccaacactgtgcaagaagcaacatttcagatggaactacccaagaaggcttttatcactaatttcagcatgatcattgatggcatgacttatccaggtattatcaaggagaaagccgaagcgcaggcccagtactctgccgcagtagccaaaggaaagtccgccggactggtcaaagccactgggcgtaatatggagcaatttcaggtcagcgtgagtgtggcacctaacgcaaaaagacgtttaggggtgtacgaactgctgctgaaagtccgaccacagcagctggtcaaacacctccagatggacatccacatcttcgagccccaggggatctcctttctggaaactgagagtacttttatgacaaaccagttagtggatgctctgaccacgtggcagaacaagacgaaggcccatatacgttttaaacctactctgtcacagcagcagaagtcacctgagcagcaagaaacagtgcttgatggtaaccttattattcgttatgacgtggatagagctatatcaggcggaagtatccagattgaaaatggctacttcgtgcattacttcgctccagaaggcctgaccacgatgccaaagaatgtggtgtttgtcatagataagtcaggcagtatgagcggacgtaagatccagcaaactagagaggcactgataaagatcctggatgatctctccccccgagaccagtttaatctaatcgtattcagcactgaggccactcagtggaggcctagcctcgtgcctgctagcgccgagaacgtgaacaaagctagatcatttgctgcaggaatccaggccctaggcggaaccaatattaacgacgccatgctaatggcagtacagttgcttgatagttccaaccaggaggaaaggttgccagagggttcagtttctctgatcatccttctgacagatggagacccaacggtcggcgagactaaccctcggagtatccagaacaatgtccgcgaagccgtgagtggtcgctatagtctcttttgtctgggttttggatttgacgtgtcgtacgccttcttggaaaagctcgccttggataatggaggtcttgctaggcgaatccatgaggatagtgacagcgctctgcagctgcaggacttctatcaggaggtcgctaatccgcttctgacggctgttacattcgagtatccgtcaaacgccgttgaggaggtgactcagaacaatttcaggctcttatttaagggcagcgagatggtggtcgctggtaaactgcaggacagagggcctgatgtgcttacggccacagtgtcgggcaagctccccacacagaacatcacttttcagactgaaagcagcgttgcggaacaggaagcagagttccagtcgcctaaatacatctttcataacttcatggaacgtctatgggcgtacctcaccatccagcaattactggaacagaccgtctcagcaagtgacgccgatcagcaggcactacgcaatcaggccctgaacctttcactggcctattctttcgtcaccccactgacttccatggtcgtgaccaagcccgacgaccaggagcagagccaggtggcggaaaagcctatggaaggcgagagccggaaccggaacgtccatagtgcgggagccgctggatcaagaatgaattttcgcccaggggttctgtccagccggcaattgggcttgcccggtccacctgacgtacccgatcacgcagcctatcatccttttcgacggctggcaattctccctgcatcagcccctccagcaacatctaaccccgatccagccgtgtcccgagtaatgaacatgaagatagaagagactactatgactactcagacacccgctcccattcaggctccgtccgccatccttccactgcctgggcaaagcgtggagaggctgtgcgttgatcctcgccaccggcaggggcctgtcaatctcctgtccgatccggagcagggagttgaagtaacggggcagtatgagcgggagaaagctgggttctcctggatagaggttacgttcaagaatcccctcgtgtgggtacatgcatcaccagagcacgtcgtggtgactaggaatcgcagatctagcgcttataagtggaaggagaccttgttttcagtgatgccgggactaaaaatgacaatggacaagacaggactgcttctgctgagcgacccagacaaggtgactattggtctcctgttctgggacggtcggggtgagggcctgcggctgctgctccgagacacagaccgtttcagctcccacgttggtggaacgctgggacagttctatcaagaggtgctgtggggttcccctgccgcttctgatgatggtcgccgaaccctcagggtacagggtaatgatcacagtgcaacccgagagaggcgcctcgactaccaggagggccctccgggagtggagatcagctgttggagtgtagagctctag

SEQ ID NO: 227005 - DNA, 2871 bp, Artificial Sequence
  Description of Artificial Sequence: Synthetic coding sequence
atgctgctcctgctcggactctgcctggggctgagtctgtgtgtgggttcccaggaggaagcgcagtcttggggccatagcagtgagcaggacggattacgggtcccaagacaggttaggttgctgcaaaggttgaaaacaaaaccccttatgacagagttcagtgtcaagtcaactattattagcagatacgccttcactactgtgtcctgtaggatgctcaaccgcgcatctgaggatcaggacattgagtttcagatgcagattcccgctgccgcttttatcaccaactttacaatgctgatcggcgataaggtgtaccagggtgagatcacagaacgggaaaagaagagcggagatagggtgaaagagaagagaaataagactacggaagagaatggggaaaaagggactgaaattttccgtgcttctgcagtaataccaagcaaagacaaggctgcttttttcttgagctacgaagaactactccagcggagactcggaaagtacgagcactcaattagtgtgcggccacagcagcttagcggaaggctcagcgtcgacgtgaatatcttggaaagcgctggaatcgccagcctggaagtgctccctctccataattcacgtcaacgcggatcgggaagaggagaagacgacagcggccctcctccgtctaccgtaatcaatcaaaacgaaacattcgcaaatatcatctttaaaccaacagtggttcagcaggccagaatagcccagaatggcatcctcggagacttcatcattaggtatgacgttaaccgggaacagagcataggtgatattcaggtattgaatggttatttcgtacactatttcgcacctaaagatttgccaccgttgcctaagaacgtggtgttcgtgttagattcaagcgcctccatggttggaacaaaactccggcagacaaaggatgcactgttcacaatccttcatgatctgaggcctcaggaccgcttttcaattattgggttttccaataggatcaaagtctggaaagaccacttgataagcgtgaccccagattctattagggatggaaaagtgtacatccaccacatgtctcctacagggggaacagacattaacggtgcactgcagagagctattcgactgttaaacaagtatgttgcccacagtggaattggagatcggagcgtcagcctcatcgtatttctgactgatggcaaacctacggtcggagagacacacacactaaaaatccttaataacacccgcgaagccgcaagagggcaggtctgcatcttcactattggaataggtaatgacgtcgacttcaggctgctggagaaactatccctggagaattgtggtctaacccggagagtgcacgaagaagaggatgccggatctcagctgataggattttatgatgagattaggaccccgcttctgtctgacatccggatagactacccaccaagcagcgtagtccaggcgacaaagacactattccctaattactttaacgggtcagagattattatagcaggcaaactggtagacaggaagctcgaccatttacacgtagaggtaaccgccagtaattctaagaagtttatcatcctgaaaactgatgtccccgttcggcctcagaaggccggaaaggacgtgaccggaagtccacggccagggggtgatggagagggagacaccaaccacatcgagcgactctggtcgtatctcacgacaaaggaactactttcttcctggcttcagtctgacgacgagcccgaaaaagagagactccgccaaagagcccaagcactcgctgtgagttatcgattcctgactcccttcacaagtatgaagttgaggggccctgtccccagaatggacgggctggaggaggcgcatggtatgtccgctgcgatgggacctgaacccgttgtccaaagtgtacgaggagcaggcacacagccaggacccttattgaagaaaccataccagcctcgcattaaaatcagtaaaacatctgtcgatggggatcctcacttcgtagtcgacttccccctgtcgagactgaccgtatgtttcaacattgatggacagcccggagacatcctccgccttgtgtctgaccatcgggattctggcgtgacagtcaatggtgagctgatcggtgctcccgctccccctaatggacacaaaaagcagcggacctatctgaggaccattacgatcctaatcaacaaaccggaacgctcctacctggagattactccatcccgcgtcatcctcgatggcggtgaccgcttggtgctaccctgcaaccaatccgtcgtggtggggtcctggggacttgaggtgtcagtgagcgcaaatgccaacgtgacagtaaccattcagggctcaattgccttcgttatcctgattcatctgtacaaaaagcctgcgccatttcaaaggcatcacctagggttctacatcgccaattccgagggactgagttcaaattgtcatggtctgctcggacagtttctgaatcaagacgcccgtctgacggaagatccggctggaccatcccaaaacttgacacacccactgctcctgcaagtgggagagggcccagaggccgtcctcactgtgaagggacaccaagtccctgtggtttggaaacagaggaaaatttataacggcgaggaacagatcgattgctggttcgctcgcaataatgccgctaagcttatcgatggagagtacaaggattatctcgccttccacccctttgatacgggcatggatacctggcccggaaatgtgcagggtgcactgaaactggccgcactgaaaatgcaagtacacgagggacagtag

SEQ ID NO: 227006 - DNA, 2229 bp, Artificial Sequence
  Description of Artificial Sequence: Synthetic coding sequence
atgcgcaattatgactccggtccgcctccttctaccgtgatcaatcagaacgaaacattcgcgaatatcatcttcaagcctaccgtagtacagcaagccagaattgcacaaaacggaatactgggcgacttcatcatacggtacgacgtgaatcgtgagcaatcgattggagatatccaggtgttgaatggctacttcgtccactatttcgctcctaaggatttgccccctctgcctaagaacgtggtttttgtgcttgactcatcagcatccatggtgggaactaagttgcggcagacaaaagacgccctgttcaccattcttcacgaccttaggccacaggacagattctcaataattggattcagcaaccggataaaagtctggaaagatcatctcatctccgtgactcccgactccatccgcgacggcaaagtatacatacatcacatgtctcccacagggggaaccgacataaacggagcactccagcgggcaattaggctgttaaataagtacgttgcccactccggaatcggcgaccgctccgtttcgctaatcgtgttcctgactgacggcaaaccaacagtgggcgaaacgcacactctcaaaatactcaataataccagagaagcagcacggggacaggtatgtatttttaccattggcattggcaacgatgttgatttcaggctgctggaaaagctgtcattagagaactgcggcctgaccagaagggtgcatgaggaggaggatgctgggagccagctcatcggcttctatgatgagattcgcaccccactgctgtccgacatccgtatcgactatcctccgtcatctgttgttcaagccacaaagacgcttttcccaaattattttaacggatctgaaattatcatcgctggcaaactcgttgatcgaaagctggatcacctgcatgttgaagtaacagcctccaattcaaagaaattcattatactaaaaaccgatgtgcccgttcggcctcagaaagctggaaaagatgttacaggctcacccaggcctggaggtgacggagagggggacactaatcatatcgagagactgtggtcgtaccttactactaaagagttgctgagtagctggcttcagagcgacgatgaacccgaaaaggaacgcctgcgccagcgcgctcaggcactagctgtaagctaccggttcctgacccctttcacctcaatgaaactgagaggcccagtgccacgtatggacgggctcgaagaagcccatggcatgagtgccgctatggggccagaacctgtcgtccagtcagtccgtggggctggtacccaaccaggccctctcctgaaaaagccttaccagcctcgcataaagatttccaagactagcgtggacggggatcctcacttcgttgtggacttcccactctcacgcctgacggtctgctttaatatcgacggacagcctggagacatcctgagactggtgtctgaccatcgggactcaggggtgaccgtgaacggagagcttatcggcgcaccagcaccccctaacggacacaaaaagcaacgtacatacttgcgaacaataaccatcctgattaataagccagaaagatcttacctcgagattacaccaagcagggtcatactggatggcggtgaccggctcgtattaccctgcaaccagtctgtggtggtcggatcatggggcctggaggtttctgtttccgctaatgctaacgtgacagttacgattcaggggagcattgccttcgtcatcctgatccacttatacaaaaaacctgcaccattccagagacaccacctcgggttctatattgctaatagcgaaggcctgagcagtaattgccacggactccttggacaattcttaaaccaagatgcaagactcactgaggacccagctggcccaagccagaaccttacccatccactactactccaggtgggagaagggcctgaggccgtactgaccgtcaagggtcaccaggtgcccgttgtctggaaacagaggaagatctataacggggaggagcagattgattgctggttcgcaagaaacaacgcggcaaagctcatagacggggagtacaaggattacctggctttccatcctttcgatacgggaatggacacgtggcccggaaacgtgcaaggggcactgaagctagctgcgctcaagatgcaggtgcacgagggtcagtag

SEQ ID NO: 227007 - DNA, 2109 bp, Artificial Sequence
  Description of Artificial Sequence: Synthetic coding sequence
atgcttcttctcctgggtctgtgcctaggactcagtttgtgcgtcgggtcccaagaagaagcccagtcttggggtcatagcagcgaacaggatggtctccgcgttccccgacaagttagactgctgcagcgcctcaaaacaaagcctctgatgacggaattcagcgtcaaatcaactatcattagccgatatgccttcaccaccgtaagttgccggatgcttaatcgtgcatccgaggaccaggatattgagtttcagatgcagattcctgcagcagccttcatcaccaactttacaatgttgataggcgacaaggtgtaccagggagagattaccgagagggaaaaaaagagtggggaccgggtgaaggagaagcgcaataaaaccacagaggagaatggtgagaaggggactgagatttttcgagctagcgctgttattccatctaaggacaaggccgcattttttcttagctacgaggagttactacagcggaggctgggaaaatacgagcacagcatctctgtccggccacagcagctctctggacgtttgtccgtggacgtgaacattctggaatctgctggtatagcctcattggaggtgctaccactgcataattcaagacaacggggatccggacgtggagaggacgattcgggacctccaccttctaccgtcatcaatcaaaacgagacatttgctaacattatctttaaacctacagtagttcagcaggctcggattgctcagaacgggatcctcggggacttcatcattaggtacgacgttaatcgcgagcagagcataggcgatatacaggtgctaaacgggtatttcgtccactactttgctcccaaggaccttcctccgttgcccaagaacgttgtcttcgtactggacagctccgcttctatggtcggcacgaagctgcggcaaaccaaggacgcactgtttaccattctgcatgacctgagaccccaggaccgatttagtattattggatttagtaatcggattaaggtgtggaaagatcacctgatctccgtgactcctgactccataagggacggaaaggtttacatccatcacatgtcacctactgggggaacagacatcaacggggctctgcagagggccatacgcctcctgaataaatatgtcgcacattccggcattggcgatcgttctgtgagcctcatagtgtttttaacagacggaaaacccaccgtgggcgaaacccacaccctgaaaattctgaacaacaccagggaggcggctcgtggacaggtctgcattttcactatcgggatcggcaacgatgtggattttcgacttttggaaaagctgagtttggaaaattgtgggctgactaggcgtgtgcacgaggaggaggacgcaggatcccaactgattgggttttatgacgagatccgcaccccgctgctcagcgacatccgaatcgattatcccccttcttcagttgtgcaggctactaagacactgtttcctaattattttaacggatccgaaattatcattgcaggcaagttggttgatcggaaactggatcacctccatgtggaagtcacagcttccaattcaaaaaaattcatcatcctgaagactgatgtccctgttcggcctcagaaagcagggaaggacgtcactgggtcacccaggcctggaggcgacggagaaggcgacaccaatcacatcgagcggctgtggtcctaccttacaaccaaagagttgctgagtagctggttacagagtgatgatgaaccggagaaggagcgcttaagacagcgcgctcaggcactcgccgtctcttataggttcctgacaccctttacctccatgaaactgaggggcccagtgcctaggatggacggactggaggaagctcacggcatgtcggctgctatggggccagaaccagtggttcaatctgtcaggggtgccggtactcagccaggacccttactcaaaaaaccttaccaacctcgaatcaagattagcaagacttcagtccgcggattccggagagaggagcagatattctctaatgtcatgaagttcccatttgcctctattctggagctgtag

SEQ ID NO: 227008 - DNA, 2088 bp, Artificial Sequence
  Description of Artificial Sequence: Synthetic coding sequence
atgctgctcctgttggggctgtgtctcgggctgtccctatgcgttgggtcccaggaggaggcccaaagctggggtcactccagtgaacaggacggtctgagggtgccccgtcaggttagactgctccagcgactcaagacaaaaccactgatgaccgagttttccgtcaagtcaaccatcattagcaggtacgctttcactaccgtgtcttgtcgcatgttaaatcgagcatctgaggatcaggacatagagtttcagatgcagattccggcagctgcctttatcaccaactttacaatgctgatcggcgataaggtctaccagggcgaaattaccgaacgcgaaaagaagtcaggcgacagggtgaaggagaaacgcaacaaaactaccgaagagaatggcgagaaaggcactgaaatcttccgagcctccgctgtcataccctccaaggacaaagccgctttttttttatcctatgaggaacttctccagagaagattagggaaatacgaacatagcatctcagtcaggcctcagcagttatctgggaggctttcagttgatgtcaacatcttggagagcgccggaattgctagcttggaggtgttacctcttcataactcccgacagagggggtctgggaggggcgaagacgactcagggcctcctcccagcactgtcataaaccagaacgagacctttgcaaacatcatctttaagcctacggtcgtccaacaggctagaattgcgcaaaacggaatcctgggcgactttattatacggtacgatgtgaacagagagcagtctatcggcgatattcaggttctgaacggatacttcgtgcactacttcgccccaaaagacttacccccattgcccaaaaatgtcgtgttcgtcctggatagtagtgcctcgatggtgggcacaaagctgagacaaacaaaggacgccctctttacgattctgcacgacttgaggccacaggacagattttctatcattggcttcagcaaccgcatcaaagtgtggaaggaccatttgatctctgtcactcctgatagtatccgggatgggaaagtatacatccaccacatgtctccgacgggcggtaccgacattaatggagccctgcagcgcgcaataagattgcttaacaaatacgttgctcacagcggaataggagaccggagtgtatcgctgattgtgttccttaccgatggtaagccgactgtaggcgagactcacacgctgaagatcctgaacaacaccagggaagccgctcggggacaggtctgtatctttaccatcggcatcggaaatgacgtggactttaggctgctggaaaagctcagcctggaaaattgcggactgactcgccgagtacatgaggaagaagatgcgggttcgcagctgattggcttttatgatgagataagaactcccttgctgtccgatatccgcattgactaccccccaagcagtgtcgtccaggcgacgaagacgctcttccctaattactttaatgggagcgagattatcatcgccggaaagctagtcgatagaaaacttgaccatcttcatgtggaagtgaccgccagcaattccaagaagtttataatcttaaagaccgatgtgcctgttaggccccagaaggctggaaaagatgtgacaggaagcccgaggcccggaggcgatggcgaaggggatacaaaccacattgaaaggctgtggtcatacctgacgacaaaggaactgctgagcagttggctgcagtcagatgacgaaccggagaaagagaggcttcgacagcgggctcaggctctagccgtctcctatcgctttctgacgcccttcacttctatgaagctgcggggtcctgttccacggatggatggcctggaggaagcccatgggatgtcggcagcaatgggccctgagcctgtagttcagtcagtgcgcggagcaggaactcaaccaggacccctgctgaaaaagcctcccaattcggtgaagaagaaacagaataagacaaaaaagcgacacgggcgtgacggcgttttccctctgcaccacttggggatcaggtag

SEQ ID NO: 227009 - DNA, 2172 bp, Artificial Sequence
  Description of Artificial Sequence: Synthetic coding sequence
gactctgggccaccccctagtacagtgatcaaccagaatgagacttttgcaaacataatcttcaagccaactgtggtgcagcaggcccgaatcgcccagaatggaatactgggggactttataattcggtacgatgtgaaccgtgaacagtcaattggggacatccaggtgttaaatgggtattttgttcattacttcgcaccaaaagatcttccacctctgccaaagaacgtggtgtttgtgttagacagcagtgcctccatggttggcacgaagctgcgtcagacaaaagatgcgctgttcaccatattgcacgatctgcggcctcaggacaggttctcaattattggtttttcaaatcgtattaaggtttggaaggatcatctgatttcggtgacacctgattctatccgcgatggaaaggtgtatattcaccatatgtcgcctacgggcggaaccgacattaatggtgccctccagagggccattagactgctcaacaagtacgtcgcccattctgggatcggagatcgctctgtgagtctgattgtctttctgactgatgggaagcccactgttggggaaacccatacacttaaaattctgaataacaccagagaggcggcacgcggacaggtctgcattttcactattggaataggaaatgacgtggattttcgccttcttgaaaaactgtctcttgagaactgcggcttaactaggcgcgtccacgaggaagaggatgctggctctcagttaatcggcttttacgacgagattcggacacccctcttaagtgacattcgtattgactacccaccttcaagtgttgtacaggcaactaagacccttttcccaaactacttcaatggatccgagatcattattgctggcaagcttgtggatcggaagctcgatcacctccacgtcgaggtcacggcttcgaattcgaaaaaatttatcatcttaaaaacagacgtgcccgtgagaccccagaaggctggtaaggacgtgacgggaagtcctagaccaggcggagacggagaaggggatacgaatcatattgagcggctatggtcctatttgacaaccaaagaactgctgtcatcttggctgcagagcgacgatgagcccgagaaggagcggctgcgacagagagcccaagccttagctgtatcctatcggttcctcacaccttttactagtatgaagttgaggggtccagttcccaggatggatggcttagaggaggctcacgggatgtccgctgccatgggcccagagcctgtcgtgcagtcggtaagaggcgctgggactcagcccggaccactgctgaaaaagccataccagcccagaatcaaaatatcgaagaccagcgtggatggtgacccccactttgtggtggatttcccactttcacgcctgaccgtctgttttaacattgacgggcagcccggagatatcttaaggctagtgagtgatcatcgtgactccggtgtcactgtcaacggggagctcattggcgcacccgcaccaccaaacggtcacaaaaagcagaggacatatctccgaaccataacaatacttataaataaacccgagcgttcatatctggagatcaccccctcccgggtaatcctggatggcggtgatagattagtcttaccttgcaaccaatcagtggttgtaggaagctggggtcttgaagtgagtgtgagcgctaacgccaacgtaaccgtgacgatccagggctcaattgccttcgttatactgatccatctgtataaaaagccagccccttttcagaggcatcaccttgggttctacatcgccaattctgaaggtctttccagcaactgtcatggactgttagggcaatttctgaatcaggacgcgcgtctgacggaagaccccgctggcccttcccagaatctgactcatcccctgttgctgcaagtaggcgaggggccagaagcagtgcttacagtgaaggggcaccaggtcccagtggtttggaaacaaaggaagatctacaacggagaagagcagatagattgttggttcgccaggaacaacgccgctaaattaattgatggggaatataaggattacctggcctttcaccccttcgatactggcatgttaggtcgagggatgagcagggagttatag

SEQ ID NO: 227010 - DNA, 1599 bp, Artificial Sequence
  Description of Artificial Sequence: Synthetic coding sequence
atggccccaagcagcccaagaccggctcttcccgcactgctggtcctgttaggcgcactcttccccggacccggtaacgcacagacaagcgtaagcccaagcaaagtaatccttcccaggggagggagcgtcttggtgacgtgtagtacatcgtgtgaccagccaaagcttctcggtattgagacgccccttccaaaaaaagaactgctcttgccaggaaacaatagaaaagtttatgaactgtccaacgtgcaggaggattcccaacctatgtgttactcaaattgtcctgacggtcaatctacagcgaagacctttttgaccgtctactggaccccggagcgggtcgagttagccccactcccctcctggcagcccgtggggaaaaacctgactctgaggtgccaggtggagggaggcgctcctagagccaacttgacagttgtacttctgaggggggagaaagaattaaagagggaacctgctgtgggcgagccagcagaggtcaccactactgtgttggtccgacgcgatcatcatggggctaacttttcgtgtcgaacagaactggacctccgcccacagggactcgagctgttcgagaacacgtctgctccctatcagctgcaaaccttcgttttaccggctacgccaccccagctggtctcacctcgtgtcctggaggtggacacacagggaaccgtggtttgttccctcgacggtctgtttccggtgtcagaggctcaggtgcacctggcgctgggggatcagaggctgaatccaacagtgacctacggcaatgattcgtttagtgccaaagcttccgtgtctgtgaccgccgaggacgaggggactcagcgattgacttgtgctgttatactgggaaaccagagccaggagacattgcagaccgtcaccatatattcctttccagcccctaatgtcatcctgaccaagccagaagtatcggagggcacggaggtgacagttaagtgtgaagcccatcctcgagcgaaggtcacgctgaacggagtgccagctcaaccactgggcccacgtgcccagctgctgctcaaagccactcctgaagataacggccgaagcttttcctgcagcgctaccctcgaagtcgccggacagctaatacataagaaccagacccgcgaactgagagtcctgtatgggcctaggctggatgagagggactgcccaggcaactggacttggcctgagaattcacagcagactccaatgtgccaggcctggggtaatccactacccgagttaaaatgcctgaaagatggcacattccccctccctattggagagagtgtaaccgtaacgcgggacctggagggaacctacctatgtcgggctcgcagtacgcagggagaggtaactaggaaggtgaccgtcaacgtgctttctccgagatatgagatcgtcatcatcactgttgtcgccgctgctgtgattatgggaacagccggtctcagcacatatctctacaacagacaacgcaagataaagaagtatagactgcaacaggctcagaaaggcaccccgatgaaacccaacacccaggcaaccccaccctag

SEQ ID NO: 227011 - DNA, 933 bp, Artificial Sequence
  Description of Artificial Sequence: Synthetic coding sequence
atggcaccttccagtccccgacccgcactccccgctctgctggttctactgggggcactcttccccgtctccgaagcccaggtccatctggcacttggtgaccaaagactgaatccaaccgtgacgtacgggaatgacagtttcagcgccaaagccagcgtgtccgtcactgctgaagatgagggtactcagcgcctgacttgcgcagtcattctgggcaaccaatcccaagagaccttacagaccgtgaccatttactcttttccggctccaaacgtgatcctgaccaaacctgaggtctcggaaggcacagaagtcacggtgaagtgtgaagcccacccgagggctaaagtgaccctgaatggcgtgccagctcagccacttggacccagggcgcagctcctgctcaaggccacacccgaagacaacggaagaagttttagctgctcggctaccctcgaagtagctggacagctgatacacaagaaccagacaagggagctgcgcgtgctctacgggccaagacttgacgagagggactgcccaggtaactggacatggccagaaaattcacaacagaccccaatgtgccaggcatggggcaaccctctacccgagctaaagtgcctcaaagatggtacattccctcttccaattggtgagagcgtgaccgtgacccgggacctggagggcacttatttgtgtcgggcacgaagtacacagggagaagtaacccggaaagtgactgtaaacgtgctatcaccccgttacgagatcgtgatcattacggtggtcgcagcagcagttattatgggcaccgccggactcagcacttacttatacaatagacagcggaagatcaagaaatacagacttcagcaggcccagaaaggcacgccgatgaaacccaatactcaggccacgcctccatag

SEQ ID NO: 227012 - DNA, 828 bp, Artificial Sequence
  Description of Artificial Sequence: Synthetic coding sequence
atgtccagtttcggctatcggaccctgaccgtggctctcttcacccttatatgctgtcctggttcggatgagaaggtttttgaagtgcatgtgcggcctaagaagctggccgtggaacctaaagggtcactcgaggttaattgcagcaccacgtgtaaccaacccgaagtgggcggtttagaaactagcctggataagattcttctggacgagcaggctcagtggaagcactatctggtctccaacatttcccacgatacagtgcttcagtgccacttcacctgctccggcaagcaagaatccatgaacagcaatgtgtctgtttaccagccccctcgccaggtgatactcactctacagccgaccctggtcgccgtgggtaagtctttcacaatcgaatgtagagtccctactgtggagcccctggatagccttactcttttcctttttcgcggtaacgaaactctgcattacgaaacgttcgggaaagcagcgcctgcccctcaagaagccactgctacttttaactccacggcagatcgtgaggatggtcacagaaatttttcgtgtctggctgtgctggacttgatgtcgcgcggaggcaatatatttcataagcattcagcccctaagatgttagagatctacgaacccgtttctgactcccagatggtcattattgtcaccgtcgtatcggtgttgctttcactgttcgtgacatcagtgctgctgtgtttcattttcggccagcacctgaggcagcagcggatggggacttacggggtgcgtgccgcttggcggcgactgcctcaggcttttagaccatag

SEQ ID NO: 227013 - DNA, 828 bp, Artificial Sequence
  Description of Artificial Sequence: Synthetic coding sequence
atgtcctcctttggctatagaacacttaccgtcgcactattcacactaatctgctgccccggttctgatgaaaaggtctttgaggtgcatgttcgccctaaaaaactggctgtggaaccaaaagggtcactcgaggtaaactgcagtacgacctgcaatcaacctgaggtaggcggactagaaacgtctctagataagattttactcgatgaacaggcacagtggaaacactacctggtctcgaatatttcgcatgacacagtgctacagtgtcactttacctgcagcggaaaacaggagtctatgaactctaacgtctctgtctaccaacctcccagacaggtgattttaaccctccaacctacgcttgtcgccgtgggcaagtcctttaccattgagtgccgcgtcccaacggtcgaaccactcgatagtcttacattgtttctgtttcggggaaatgaaacgcttcactatgaaacttttgggaaagccgctccagcaccccaggaggccactgctacctttaactccaccgcagatcgcgaggatggccatcggaattttagctgcctcgctgttctggacctcatgtccagaggcggtaacattttccataaacattcagcccctaagatgctggaaatttacgaaccagtttctgattcacaaatggtcattatagtgacggtggtgtccgtcctgttgtccctgtttgttaccagcgtgctgttgtgttttatttttggtcagcatctccgtcagcagcgcatgggcacttatggagttagggccgcatggcggcgtttgccacaggctttcaggccttag

SEQ ID NO: 227014 - DNA, 828 bp, Artificial Sequence
  Description of Artificial Sequence: Synthetic coding sequence
atgtccagctttgggtaccggactctgacggtggctcttttcactctaatttgttgtccgggatcagatgaaaaagtattcgaggtccacgttagacccaaaaagctagccgtagagcctaaagggtctcttgaagttaattgttccacaacatgtaatcagccagaggtggggggtctggagacatctctggataagatcctcctggacgagcaggcgcaatggaaacattacctcgtgagtaatatctctcatgacactgtcctgcaatgccactttacctgttccggtaaacaggagagtatgaacagtaacgtctctgtgtaccagccaccacggcaggtaatcctgaccctgcagcccacgctcgtagccgtcggaaagtcattcactatagaatgcagggtgcctacagtggaacctctggattccctaaccctgttcctattcagggggaatgagactctccactacgaaactttcggaaaagctgcccctgccccacaggaagcaaccgctaccttcaattcaaccgccgatagagaggacggccatcggaactttagttgtcttgcagtgcttgatttgatgagtcgtgggggaaacatctttcataagcacagcgcgccaaaaatgctggagatctatgagcctgtttcggattcccaaatggtcataatagtcaccgtggtgtctgtgttgctgtccctctttgtgacgagtgtcctgttatgctttatcttcggacaacacttgcggcagcagagaatgggcacatacggtgtgcgagccgcatggagacgccttccgcaagcgtttcgcccttag

SEQ ID NO: 227015 - DNA, 828 bp, Artificial Sequence
  Description of Artificial Sequence: Synthetic coding sequence
atgagctcattcgggtaccggactctcacggtggcgctctttaccctcatctgctgtccaggtagtgatgagaaggttttcgaagtacatgttagacccaaaaagttggctgtggagcctaaaggaagcttggaggttaattgcagtacaacttgcaatcagcccgaggtcggcggtctcgagacgtctctggataagatcctgttagatgagcaggctcaatggaagcattacttagtcagcaacatttctcacgatacggtgcttcagtgtcactttacatgcagtgggaagcaagagtcaatgaacagcaacgtgagcgtataccaaccacctcgccaggtgatactgactctccagccaactttagtggccgtgggcaagtcttttactatcgagtgtcgagttccgaccgtggaaccccttgactccctgactctcttcctattccgaggtaacgaaactctgcactatgagaccttcggcaaagctgcgcctgccccacaggaggccaccgcgacattcaactcaacagccgacagagaagacggacacagaaacttttcctgtctcgctgttctggacctcatgagtaggggcggtaacatctttcataagcactccgcccctaagatgttggaaatctatgagcccgtgagtgacagtcagatggtgattatcgttacggtcgttagcgtgctcctcagcctcttcgttacgagcgttttgctctgttttatatttgggcagcatttgagacaacagagaatgggcacctacggcgttcgcgcagcttggcgaaggctcccccaggctttccgtccatag

SEQ ID NO: 227016 - DNA, 828 bp, Artificial Sequence
  Description of Artificial Sequence: Synthetic coding sequence
atgtcttccttcggatacaggacactgactgttgctctgttcaccctaatctgctgcccaggtagcgacgagaaggtcttcgaggtgcacgtacggcctaagaaacttgctgttgagccaaagggatcactggaagtgaattgcagtacaacatgtaaccagccggaagtcggaggactggaaacatctctcgacaagatcctcctggacgaacaggcccagtggaagcactatctggtctcaaatatatctcatgacactgtgctgcagtgtcattttacctgctcaggaaagcaggagtcaatgaacagcaacgtatctgtgtaccaacctcctaggcaggtgattcttacgcttcagccaacacttgttgccgtgggtaagtccttcaccatcgagtgcagagtccccaccgtggagcctttagactccctgaccttgttcctgttcagaggaaatgagactttgcactatgaaacatttggcaaagctgcacccgctccccaagaagcaactgccacgtttaatagcactgcagatagggaagatggacacaggaatttttcatgcctggccgtccttgacttgatgtctcgagggggaaatattttccacaagcacagcgctccaaaaatgttggagatctacgaacctgtttccgattcacagatggtcattatagttaccgtcgttagcgttcttctaagcctgttcgtgacgtctgtgctcctctgtttcatctttggtcaacacctgcggcagcagcgtatgggtacttacggagtcagggccgcttggcgcagactcccccaggcttttagaccgtag

SEQ ID NO: 227017 - DNA, 1644 bp, Artificial Sequence
  Description of Artificial Sequence: Synthetic coding sequence
atggcgaccatggtaccatccgtactatggccacgggcatgctggacacttttagtatgctgtctccttacgcccggtgtccaagggcaggaattcctgcttcgagtggagccacagaatcccgtgctgtctgctggcggatccctgttcgtcaattgctcaactgactgtccctcctccgagaagatcgcactagagacaagtctgtcaaaagagctagtagcgtcaggtatgggctgggccgcattcaacctgtccaatgtgaccggaaacagtcggattctatgttctgtgtattgcaacgggagccagataaccgggtccagcaacataactgtttatcgtctgcctgaacgggtggagctggcgcctttgccgccttggcaaccggtagggcaaaattttaccctgaggtgccaggttgaggacggaagtccgcgtacttcccttacagtggtgcttctacgatgggaagaagaactcagtcggcaacccgctgtggaagaaccagctgaggtcacggcaactgttctggccagccgcgatgatcatggcgctccatttagttgtcggaccgagctggacatgcagccccaggggttaggcctttttgtcaacacatctgctccccgtcagctgcgaacatttgtcctcccggtgacccccccacgattggtggcaccccgattccttgaagtcgaaacatcatggccagtggactgtacactagacggccttttcccagcatccgaggcacaggtgtaccttgccctaggagaccagatgctaaatgctaccgtcatgaatcacggggacactctcaccgctacagctacagccactgcaagggccgaccaggagggtgctcgtgaaatcgtgtgtaacgtaacactcggaggggaaagacgcgaagcgagagagaacctgaccgttttttcttttctgggtcctattgtgaacttaagtgaacctaccgcacacgagggatctaccgtcaccgtgagctgcatggccggagccagagttcaggtgactttagacggggtccctgcagcagcccctgggcagcccgcacagcttcaactcaacgccaccgaatccgacgatggcaggtcatttttctgtagcgcaactttggaggtggatggcgagttcctccacaggaacagtagtgtgcagctgcgcgttctgtacgggcctaagattgaccgtgcaacctgcccacaacacttgaagtggaaggacaaaacaagacacgttctgcagtgccaggccagaggcaacccttacccagaactgcgctgcctgaaggagggttcctccagagaagttcctgtggggatccctttcttcgttaacgtgacacataacggcacctatcagtgccaggccagctcaagcagaggcaagtatactttagtcgtcgtgatggacatagaggcaggctctagtcacttcgtgcctgtgtttgtggccgttctcttgaccctgggtgtagtgacaatcgtactcgccctcatgtacgtgttcagagagcatcaaaggagcgggagctaccacgtgagggaggaatctacttatctccctctcacatccatgcaacccaccgaagctatgggggaggagccctcccgcgcagaatag

SEQ ID NO: 227018 - DNA, 819 bp, Artificial Sequence
  Description of Artificial Sequence: Synthetic coding sequence
atgggatctctctttcccctcagtctgctgttctttctggctgcagcttatccgggtgtggggtctgcactgggcaggcgaacaaagagggcacagagcccaaaagggagccctttggctccctcgggcactagcgttccgttttgggtccggatgtctccagaattcgttgctgtccagccaggcaaaagcgtgcaattgaattgcagtaactcttgcccccagccgcaaaactctagcctgagaactcccctgaggcagggcaagacactaagagggcctggttgggtgtcctatcagttactggacgtgagagcgtggagctcacttgcgcattgtctcgttacctgtgctggaaaaacacgttgggcgacctcacgcattacagcctactcagttccagggggactgctcggcggagaccctgaggcgtggaagcctggccacctgttccggaagcccggtgcgctacacagaccaggatcgggtcagagggatcttgatctccgcgtttgttgctggacaccgaggttactggcagctagagatctgcctcgggctcctcagtcccgccgacctgggggaccacaacagctgggaactcattacacggatgcgaggttagagcccagggcacattctttcgggctgcggttccacaggtgtccttgtcgtgatccacctcactgcggacgctgcgtgcctatgcaggttcctagctacgaagttcctggagtcaagggggacgttctgtgccgactttcggaaaagaagaggaatatgaagcagtcaggcgagatggcgatccatggcggttag

SEQ ID NO: 227019 - DNA, 816 bp, Artificial Sequence
  Description of Artificial Sequence: Synthetic coding sequence
atggggtcccttttccctctcagcctgctattttttttagcagcagcgtacccaggggttgggagtgcactgggtaggcggaccaagcgggcacagtcgcctaaggggtctccattggccccttcaggtaccagtgtgccattctgggtcagaatgtcgccggaatttgtagccgtgcaacccggtaagtccgtgcagctgaattgtagtaatagctgtccccagccccaaaactcgtctcttcggactccactcaggcaaggcaaaacgttgaggggtccgggatgggttagttatcagctgctagacgtcagggcctggagcagcttggcacattgtcttgtgacgtgtgctgggaagacacgatgggctaccagtaggattaccgcctacaagccaccccacagcgtgatccttgagccccctgtcctgaagggacggaagtatacgcttagatgtcacgttacccaggtctttcctgtgggttacctcgtggtaaccctgcgccacgggtcccgcgttatctacagcgagagcctcgagaggtttaccggtttggatctggccaatgtgacgctgacttatgagttcgctgcaggccctcgcgacttttggcagccggtcatctgccatgccaggctgaacctggacggcctggtcgtgaggaattctagcgcgcctattaccttaatgctggcctggtccccagccccaacggcactggcgagcgggtccatcgcagccctggttggcatcctcctcacagtgggagctgcgtacctgtgtaagtgtttggctatgaagtcccaggcttag

SEQ ID NO: 227020 - DNA, 714 bp, Artificial Sequence
  Description of Artificial Sequence: Synthetic coding sequence
atggggtcactcttccctttaagcctgctgttttttctggctgccgcatatcccggagtgggaagtgctttaggcaggcggacaaagcgagcccagtcacccaagggttcaccgttggctccgtcaggtacaagtgtcccattctgggttagaatgtcgcctgagttcgttgctgtgcagccaggcaaaagcgtccagctgaactgttcgaattcttgccctcagccacagaatagctctttgcgaaccccccttagacaagggaagacgctaagaggccctgggtgggtatcctatcagctgttggacgtgagagcctggagtagcctcgctcactgtctcgtgacatgtgcgggtaaaacccgatgggcgaccagcagaatcacggcctacaagccccctcacagcgtgatcttggaaccccctgttcttaagggacgcaagtataccctgaggtgccacgtgacccaagtgttccccgtcggatatctcgtggtgaccttgcgacatggatctagagtcatttactctgaaagcctggaaagattcaccgggctggatctggcaaatgtgacacttacgtatgaatttgcggcagggccacgggacttctggcagcccgttatttgtcacgccagactgaatcttgatgggctggtcgtaagaaatagctccgcccctattactctcatgctcggagaggcccctctctag

SEQ ID NO: 227021 - DNA, 498 bp, Artificial Sequence
  Description of Artificial Sequence: Synthetic coding sequence
atggaactatgcaggagtttggcgctgctgggaggtagtttgggcctgatgttctgcctcatcgctctgagtaccgatttctggttcgaggcagtgggacccacccactcagcccacagcgggctctggccaaccggccatggcgacattatttcagggtatatccatgttacacaaaccttttccatcatggccgtgctttgggctctagtttccgtatcttttttggtgctgagctgcttcccctccctgtttcctcctggccatgggccactggtgtcaactaccgcagctttcgcagccgctatctccatggtcgttgcaatggccgtgtatacctccgaacgctgggatcagccaccgcatcctcagatccagactttcttctcttggagcttctatctgggctgggtatcggccattcttctgctatgtaccggcgcactctcccttggggcacattgtggcggacctagacctggatatgagactctgtag

SEQ ID NO: 227022 - DNA, 1674 bp, Artificial Sequence
  Description of Artificial Sequence: Synthetic coding sequence
atgatggtcgtactcttgggtgccacaaccttggtgctggtggctgtcgccccttgggtgctctcagctgctgctggcggaaagaacttgaagtctcctcagaaggtggaggtggatatcatcgatgacaattttatcctgcgctggaatagaagcgacgagtcagtgggaaatgtgacattcagctttgactatcagaagacaggcatggacaactggatcaagttgtctggatgtcaaaatattacctcaacaaagtgcaattttagctcccttaagctgaacgtgtacgaggagattaagctccggatccgcgcagaaaaggagaatacctcttcctggtatgaggtggattcctttacgccatttcggaaggctcagatcggacctcctgaggtgcatcttgaagctgaggataaagcaatcgttatccatatatcgcctggaacgaaagactctgttatgtgggctctcgacggactgtcatttacatactctctcgtcatctggaaaaacagctccggtgtcgaggagagaatcgagaatatttattccaggcacaaaatctataagctgagtcctgaaaccacttattgtctaaaagtgaaggccgcactactgacatcatggaagattggagtctacagtccggttcattgtattaaaacaaccgttgaaaatgagttaccccctccagagaatatagaggtgtctgttcagaatcagaactatgtgttgaagtgggattacacgtacgccaatatgaccttccaggtacaatggctgcacgcatttttaaaacggaatcccggaaaccatttgtataagtggaaacagatccccgactgtgaaaacgttaaaacaactcagtgcgtgtttccacagaatgtcttccagaagggcatctacttgttaagagtccaggctagcgatggcaacaatacttcattctggagtgaggagataaaattcgataccgaaattcaggcattcctgctgcccccagtattcaatatcagatctctgagtgattccttccacatctacatcggagctcctaaacagtctgggaatacccctgtaatccaggactatcccctcatatatgagatcattttttgggagaatactagcaatgcagagagaaagataatcgagaaaaagaccgacgtaaccgtcccaaatctaaagcctctgaccgtgtactgtgtcaaagcccgtgcccacactatggatgagaagcttaacaagtcctccgtcttctcagatgccgtgtgtgagaagaccaagcctggcaacacttcaaagatctggctgattgtgggcatatgcatagcactgtttgcactgccattcgtgatctatgcggctaaagttttccttcggtgcattaactatgttttctttccttctctaaagccgagttcttctattgatgaatacttcagcgagcagcctctgaaaaatctgctgctgtccacttctgaggagcagattgagaaatgcttcatcatcgagaatatctccaccatagctaccgtggaagagacgaaccagacagacgaggaccataagaaatacagcagccaaactagtcaggattccggcaactactcaaacgaagacgagagtgagtccaagaccagcgaagagttgcagcaggatttcgtgtag

SEQ ID NO: 227023 - DNA, 1467 bp, Artificial Sequence
  Description of Artificial Sequence: Synthetic coding sequence
atggataattggattaaattaagcggatgccagaatatcacttcaactaagtgcaatttctccagtctaaagctgaatgtgtacgaagagattaaacttcggataagagctgaaaaagagaacacttcttcatggtacgaagttgattcattcacacccttccggaaagcccaaatcgggccacccgaggtgcacctagaagccgaggacaaagcaatcgtgattcatattagtcccggaacaaaggattcggtcatgtgggcactggacgggctcagtttcacatactcactggtcatatggaagaactccagtggagtcgaggaaagaattgagaacatatatagtcgtcacaaaatatacaagctctccccggagaccacctattgccttaaggtgaaagccgcactattgaccagttggaagatcggagtctactctcccgttcattgcattaaaaccactgtggagaacgaactgccgccacctgaaaatattgaagttagcgtacaaaatcagaattacgtcctgaaatgggattacacatacgccaacatgacttttcaggtgcagtggttgcacgccttcttaaaaaggaatcccggtaatcacctctacaagtggaagcagattcctgactgcgaaaacgtgaaaaccacgcagtgtgtgtttccccagaatgtattccagaagggcatatatctgctgagagtgcaggcaagcgatggcaataacacatctttttggtcagaggaaatcaagtttgacaccgaaattcaagctttcttattgcccccagtatttaatatcagaagcctgagcgacagttttcacatatacatcggggctcctaagcagtctggtaacacgcccgtgatccaggactaccccctgatatacgagatcattttctgggaaaacaccagcaatgccgagagaaaaataatcgagaaaaaaacggatgtcacagttcctaacctcaaaccgttaactgtttattgtgtaaaagccagagcgcataccatggacgagaagttaaataagtcgtcagtttttagcgacgcagtttgcgaaaagaccaaaccaggaaataccagcaagatttggctgatcgttggaatctgcatagcactgttcgcacttccttttgtgatttatgctgctaaggtttttctgcgatgtatcaattatgtattcttcccaagtctgaagccctcgtccagcattgacgagtatttcagcgagcagcccctcaaaaacttgctgttatccacgtcggaagaacagatcgagaagtgtttcataattgagaatattagcactatagccacggtcgaagagactaatcaaacagacgaagatcataaaaagtattctagtcagacttcccaggatagcggcaattactcgaacgaagatgaatcagaaagcaaaacaagcgaggagttgcaacaggactttgtttag

SEQ ID NO: 227024 - DNA, 1491 bp, Artificial Sequence
  Description of Artificial Sequence: Synthetic coding sequence
atgatggtcgtgctacttggagctactaccctagtgcttgtggcggtggccccttgggtcttgtcggcagctgccggaggcaagaacctgaagtctccccaaaaagtggaagtggacatcatagatgacaatttcatcttgcggtggaatcggtccgatgaaagtgtcgggaacgtgacctttagctttgactatcaaaagacgggcatggacaattggataaagctgtcaggttgccagaatattacttctacaaaatgtaactttagctccctaaaactcaatgtgtacgaggagataaagctccgaatacgggcagaaaaggagaacactagttcctggtatgaggtggacagtttcacgccctttagaaaagcccagattggcccacctgaagtgcacctggaggcagaggataaggccattgttatccatatttctcctggaacaaaagattccgtgatgtgggccctagacggactgtcctttacttatagcctggtgatttggaagaactcaagcggggtggaggagaggatagagaatatttatagccgccacaagatctataaactgagtccagaaactacatattgcttaaaggtaaaggccgcactgcttaccagttggaagattggcgtttactcacccgtgcactgtattaaaactactgtggagaatgaactgccccctccggaaaacatcgaagtgagtgtacagaaccagaactatgttcttaagtgggattacacatacgccaatatgactttccaggtccagtggctccatgccttcttaaaacgtaacccgggtaaccacctgtacaagtggaaacagattcctgactgcgagaacgtgaagacaactcaatgtgttttcccacaaaatgtctttcagaagggcatttacctactgagagtgcaggcctcggatgggaacaacacctccttctggtctgaagagattaaattcgacaccgaaattcaagcctttttgcttcccccagtctttaacatcaggtccctgagtgactcatttcacatttacattggcgcacccaaacagtccggaaatacacctgtgatccaggactatcctctaatttacgagatcattttttgggaaaatacctccaacgccgaacgcaaaataattgagaaaaagaccgatgtaaccgtgccgaatttgaagccactaaccgtttactgcgtcaaagctagggctcataccatggacgagaacgacgccgtgtgtgagtacttcagcgaacagccactaaaaaatctgctgctttctacatctgaagagcagattgagaagtgtttcataattgaaaacatatctactatagcgacagtcgaagagaccaaccagaccgacgaagatcataagaagtactcttcccagacaagccaggattccgggaactatagcaatgaagatgaatcagagagcaaaacaagcgaggagttacaacaagattttgtgtag

SEQ ID NO: 227025 - DNA, 1548 bp, Artificial Sequence
  Description of Artificial Sequence: Synthetic coding sequence
atgctgctttcacagaatgctttcatttttaggtcgctaaatctagtgttgatggtgtatatttcattggtgttcggcatctcttacgattcaccagactacacagacgagtcttgcacctttaagatctcactcagaaatttcaggtctattttatcctgggagctaaagaatcactccattgtgcccacccactataccttgctctataccataatgtctaagccagaagatctaaaggtcgttaagaactgcgctaacacaaccaggagcttctgcgaccttacagacgaatggagatccacacatgaggcctacgtgaccgtacttgaggggttttcagggaataccaccctattttcctgtagccacaacttttggctggcgattgatatgagtttcgagcctcccgagttcgagatcgtgggcttcactaatcacatcaacgtgatggtcaagtttcctagcattgtcgaagaagaactacagtttgacttaagccttgtaattgaggagcagtcagaagggattgtgaagaagcacaaacctgagatcaagggcaatatgagcggcaactttacgtacattattgataagctgattcctaatactaattattgtgtgtctgtctacttggaacattccgacgagcaggccgtaataaaaagtccactcaagtgtacattattaccccctggtcaagaaagcgagtcagccgaatccgccaagattggcggtatcattacagtgtttctgattgctctggtcctgacgtctaccattgtcacccttaaatggataggatacatatgtctccgcaatagcttgcccaaagtgttaaacttccacaatttcctggcttggccctttccaaacttgccacctttagaagctatggacatggttgaagtgatttatattaaccgtaagaaaaaggtatgggattataactatgatgatgaatcagacagtgacacggaagctgctcccagaacttccggcggaggctataccatgcatggactcaccgtcaggcccctaggccaggcctccgctacttccaccgaatcgcagctgattgacccagagtcagaagaagagccagatctgccggaggtcgacgtggagttgcctacaatgcccaaagacagtccccagcaactggagctgctgagtggcccttgcgagcgcaggaaaagtcccttgcaggaccctttcccagaggaggattatagctctactgaaggctcagggggtaggattacatttaacgtcgatttgaacagtgtgtttctgcgagtcttagatgatgaggattccgacgacctggaagcacccctgatgctgagctcccacctggaggaaatggtggacccggaggatcccgacaatgttcagtccaaccatcttttggccagcggggaaggcacacaacctactttcccgagtccgtcttctgaagggctgtggagcgaagatgctccaagtgatcagagtgacacgtcagagagcgacgtggaccttggtgacggatatattatgcgttag

SEQ ID NO: 227026 - DNA, 1548 bp, Artificial Sequence
  Description of Artificial Sequence: Synthetic coding sequence
atgttgctttctcaaaacgcctttatttttcgcagtctaaaccttgtcctcatggtctacatatccctggtatttgggatatcctatgattcccctgactacaccgatgagagttgtacgttcaagattagtcttcgcaacttcagatctatcctgtcatgggagttgaagaatcattccatcgtccccactcattacacactgctgtacacgatcatgtccaaacccgaagacctcaaggtagtcaagaattgtgctaatacaacgagatccttctgtgatctgacagatgagtggagatcgacccatgaggcttacgtgaccgtgctggaaggattctctggcaatactacgctcttttcttgttctcacaatttctggctggctatcgacatgagttttgagcccccagaatttgagatcgttgggttcaccaaccatataaacgtgatggtgaagttccccagtatagtagaagaggaacttcagttcgatctttccctggttatcgaagaacaatccgaggggatcgtgaagaaacataagccagagatcaagggcaacatgtcggggaattttacctacataatcgacaagttgatccccaacacgaactactgcgtctcggtgtatctcgagcattcggacgaacaggccgtgataaagagcccccttaaatgcacccttctcccccctggtcaggagtctgagagtgctgagagcgcaaaaattggcggaattatcacagtgttcctgatcgctctggtcctgacgagtacgatcgttaccttgaaatggattggctacatctgcctgcggaacagtcttccaaaggtactgaattttcataatttcttggcttggccttttcccaacctgccccctctcgaagctatggacatggtggaggtgatttacattaaccggaaaaagaaagtctgggactacaactacgatgacgaatcagactctgacacggaagcggctcctaggactagcgggggaggatataccatgcatggcttgacagttcggccactggggcaggcctcggccacatccaccgaaagccagctgattgatcccgagtccgaagaggaacccgacctgccggaggttgatgtcgaactgccaaccatgcctaaagattcacctcagcaactggaactgttgtctggcccatgtgaacgacggaaaagtccacttcaggacccatttccagaggaagattactcttcaacagaaggcagcgggggaagaatcacatttaatgtggatctgaacagcgtatttctcagggtgctcgatgatgaggacagtgacgatttggaagcacctttgatgctgtcgagtcatctcgaggagatggtcgatcccgaggaccccgacaacgtgcagtcgaatcacctcctggcaagcggagaagggacccagcctacctttccgtcaccatcatccgaggggctgtggtccgaagacgctcccagcgaccagtctgacacatccgagagcgatgtcgacctgggcgacggatatattatgcggtag

SEQ ID NO: 227027 - DNA, 996 bp, Artificial Sequence
  Description of Artificial Sequence: Synthetic coding sequence
atgctcctgtcccaaaatgctttcattttccgatctctcaacctggtcctcatggtgtatatcagtctcgtcttcggaatctcctacgatagccccgattatacagacgagtcatgtactttcaagattagcctccggaacttcaggagcatcctgagctgggaactcaagaaccattctattgtgccaacccactatacactgttgtatacaataatgtccaagccggaggacctgaaggtggtcaaaaattgcgccaacaccactcgctcattctgcgacctcacagacgagtggagatcgacacatgaggcttacgttaccgtcctcgagggttttagcggcaacactactctgttctcgtgttctcacaacttctggctggccattgacatgtcctttgagcctccagagttcgaaattgtcggtttcaccaatcatatcaacgtcatggtgaagtttccaagtatagttgaggaagaattgcaatttgacctcagtcttgtgatagaggagcagagcgaaggcatcgtgaaaaaacacaagccagagattaagggcaatatgagtgggaactttacttacattattgacaaactaatccctaacaccaactactgcgtgagcgtgtaccttgaacactctgatgaacaggccgtgatcaaatctcccctgaagtgcaccctactgccacccggtcaggaatctgagagtgctgaaagtgccaaaatcgggggaattataaccgtgtttctgatcgcactagtactcaccagcacaatcgtgactttaaagtggattgggtatatctgtcttcgaaactcactgccgaaagttttgcgccaagggttagccaagggatggaatgccgtcgccatccataggtgcagtcacaatgcactgcagagcgaaaccccagagcttaagcagtcctcttgtctgtcattcccttcatcctgggactacaaaagggccagcctatgcccatcagattag

SEQ ID NO: 227028 - DNA, 996 bp, Artificial Sequence
  Description of Artificial Sequence: Synthetic coding sequence
atgctgctctctcagaacgctttcatttttaggtccctcaacctggtgcttatggtgtacatcagtctggtgtttggcatttcatacgactccccggattacacggacgaatcatgcaccttcaaaatcagcttacggaatttccgctctatcctcagctgggagctgaagaaccacagcatcgtgccaacacactatactcttctttataccattatgagcaagccggaggatcttaaagtggttaagaactgtgccaacactactcgctcattttgtgacctgactgacgaatggcgcagcacccatgaggcttatgtcacagttctagaggggttctccggcaatactacactattctcatgttctcataacttctggctggccatcgacatgtcattcgaaccaccggagttcgagatagtcggctttaccaaccatattaatgtcatggtcaaattcccttctatagtcgaggaagagttgcagttcgatctgtccctcgttatcgaggagcagagtgagggcattgtcaaaaagcataagccggagattaagggcaacatgagtggaaactttacctacataatagataaattgattcccaatacgaattactgtgtttctgtctatctggaacatagcgatgaacaggctgtgatcaagagccctcttaaatgcaccctgctcccccctggtcaagaatcggaatccgccgaaagcgctaaaatcggcggtatcatcacagtttttctgatcgcgctggtcctgacctcaaccattgtgactctgaagtggattggctacatatgtctcagaaactcactaccgaaggtgttgagacaggggctggcaaaaggatggaatgctgtggccatccataggtgctcccacaacgctcttcagtcagaaacaccagagctgaaacagtcgtcatgtctaagttttcccagctcttgggactataaacgagcatccctatgtcccagtgactag

SEQ ID NO: 227029 - DNA, 561 bp, Artificial Sequence
  Description of Artificial Sequence: Synthetic coding sequence
atgttactgaaatcaccggagaattctctgctgcagttccaattcaagtacggtgtgccgacccccactaatgtaactatcgaaagttacaacatgaacccaatcgtctattgggaatatcagattatgccccaagttcccgtgttcacagttgaggtcaaaaactatggtgtgaaaaactccgagtggatagatgcttgtattaatatctcacatcactattgcaacatcagtgaccacgttggcgacccgtccaatagtctgtgggtacgcgtcaaagcccgtgtgggccagaaggagagcgcgtacgcaaagtctgaggagtttgcggtttgccgagatgggaagattggaccacctaagctagacataagaaaagaagagaaacagatcatgattgacatcttccatccctcagtctttgtgaatggagatgaacaagaggttgactatgatcctgaaacaacatgttatattcgcgtgtataatgtgtatgtgagaatgaatggctcagaaatcaaacgcagttgcgcattttctctgtttagcttttttatctag

SEQ ID NO: 227030 - DNA, 1470 bp, Artificial Sequence
  Description of Artificial Sequence: Synthetic coding sequence
atggccttgctgtttttattacctttagtgatgcaaggcgtctccagggcagagatgggcacagccgacctgggaccatctagcgtcccaaccccaacaaatgtgacgattgagtcttacaacatgaacccaatcgtctattgggagtaccagataatgcctcaagtacctgtgttcactgtggaggtcaaaaactatggtgtgaaaaatagtgaatggatagatgcctgcataaatatctctcaccactattgtaacattagtgaccacgtaggggatcctagcaactcattgtgggtcagagtcaaagcacgagtaggacagaaagaatccgcttacgctaaatcagaggagttcgccgtctgcagggacggcaagatcggccctccgaaactggacatccgaaaggaggagaagcagataatgattgatatttttcacccgagtgtattcgtgaacggagatgaacaggaagtggactacgacccggaaacaacctgttatataagagtttacaacgtctatgtgaggatgaatggaagcgagatccagtacaagatattgacacagaaggaggacgattgcgacgagatccaatgccagctggccatccccgtgtcatcgctaaattcgcagtattgtgtatctgccgaaggcgtgcttcacgtttggggagtgaccactgagaagagcaaagaggtctgtatcactattttcaatagttcaatcaaaggctctttgtggattccggtggtggcagctcttttgctctttctggtgttatcccttgtattcatttgcttctacatcaaaaagataaatccgttgaaggagaagagcataatcctgccgaagtccctcatttctgtcgttcggagcgctactctggaaaccaagcctgagtcaaagtacgtttccttgataacaagctatcagcccttctcgctggaaaaagaagtggtatgtgaagagcccctctctcccgcaaccgtgcccggtatgcacaccgaagacaaccctggaaaggtcgagcataccgaggaactttcctctatcacagaagtggtgaccacagaggagaatatccccgatgtagtgcctgggagtcacctcaccccaatcgagcgggagagctcgtcaccccttagctctaatcagtcagagccagggtcaatcgcattgaattcatatcattcacgcaactgctccgagtccgatcatagcagaaatggcttcgataccgactctagttgcctggaaagccacagttcactgtccgactccgaattcccaccaaacaataagggggaaattaaaacagagggccaggagttgataaccgtgatcaaggcccctacctcgtttggatatgacaaaccccatgtgctcgtagatttgttagtagacgattctggcaaagagtctttgatcggatatagacccacagaggattcaaaggagttttcatag

SEQ ID NO: 227031 - DNA, 486 bp, Artificial Sequence
  Description of Artificial Sequence: Synthetic coding sequence
atgttgctgaagtcaccagagaattcactcctgcagtttcagtttaagtatggtgtgcctacccctaccaatgtgaccattgaatcgtataacatgaacccaatagtttactgggagtatcaaattatgccccaggtgccagtcttcacggttgaagttaaaaactatggggtgaaaaatagcgagtggatcgatgcctgcatcaacatttcacatcactattgcaacatttctgaccatgtcggagatccatccaacagcctgtgggtccgtgtgaaggccagagtcggtcaaaaggaatcggcatatgctaagagtgaggagtttgcggtatgtagggacgggaaaatcgggcctcctaagttggacatacgtaaggaggagaagcaaataatgatagacatcttccacccaagcgtgtttgtgaatggggacgagcaggaggttgattatgaccctgagaccacatgttatattcgagtatag

SEQ ID NO: 227032 - DNA, 825 bp, Artificial Sequence
  Description of Artificial Sequence: Synthetic coding sequence
atggctcttctgtttcttctgcccttggttatgcaaggcgtctctagagcggagatgggcacggccgacctcggtccttccagcgtgccgaccccaacaaacgtgactatcgagtcttataatatgaaccctatagtgtactgggaataccaaattatgccacaggtccctgtattcactgtggaggtgaaaaactatggcgtaaaaaactccgagtggatagatgcttgcataaacataagtcatcattactgtaacattagcgatcatgttggcgacccgtctaatagtctctgggtgcgagtcaaagccagggtaggacagaaagagagtgcctacgccaagtcggaggagttcgcagtctgtcgtgacggaaaaatcggccctccaaaattagatatccgcaaagaggaaaagcagatcatgatagacatttttcacccctcggtgtttgtgaacggagacgagcaggaggtggactatgatcccgagactacctgctacattcgggtctacaacgtctacgtacgaatgaacggatccgaaatccaatacaagatcttgacccagaaggaggatgactgcgacgagatccagtgccaactggccattcccgtctcaagcctgaacagccagtattgcgtctcagccgagggggtcctacatgtatggggggtgactacggagaagagtaaggaagtttgcatcacgatctttaatagtagcatcaaaggaagcctgtggataccagtggtggccgctctgcttctcttctgtcttgcctggtattcctctgtctttatcctgcgcaagttgattcactag

SEQ ID NO: 227033 - DNA, 633 bp, Artificial Sequence
  Description of Artificial Sequence: Synthetic coding sequence
atggcactccttttcctactgcccttagtgatgcaaggcgtttcccgcgctgagatgggcaccgccgatctggggccttcttctgtacccacaccaacaaatgtgacaatagagtcttacaacatgaaccctatagtttactgggagtaccagataatgccccaggtgcccgtctttaccgttgaggtaaaaaattatggagtgaaggcacgtgtcgggcaaaaggagtctgcctacgctaagtctgaggagtttgccgtgtgtcgcgatgggaagatcggcccaccaaagctcgatatccgtaaggaggaaaagcagattatgatcgatatctttcacccctcagtgttcgtgaacggagacgaacaggaggtagattatgaccccgagaccacctgttatattagagtttataacgtatatgtccgaatgaatgggagtgaaatccagtacaagatactcactcagaaagaagatgactgcgacgaaatccagtgccagctcgcgattcccgtgagcagccttaactcccaatactgcgtgagcgcagaaggcgtgctgcatgtttggggggttaccaccgagaaatcgaaggaagtatgtattacgatcttcaactccagtattaagtag

SEQ ID NO: 227034 - DNA, 1386 bp, Artificial Sequence
  Description of Artificial Sequence: Synthetic coding sequence
atgccgacccctacaaatgtaaccattgaaagctataatatgaatccaatcgtgtactgggaatatcagatcatgccacaggtgcccgtgttcactgttgaagtcaagaactatggggtgaaaaactctgagtggattgacgcttgtataaatattagccaccactactgcaacatatccgaccacgtcggcgacccttctaactctctgtgggtgcgtgtaaaagctcgggtggggcagaaagagtctgcctacgcaaagtcagaggagtttgccgtgtgcagagatgggaaaatcggtcctccaaaactcgacattcggaaagaagagaagcaaattatgatcgacatttttcacccatctgtgtttgtgaacggcgatgagcaggaagtggactatgacccggagaccacttgttatattcgcgtgtacaacgtttacgtaaggatgaacggctcggagattcagtacaagatcctgacacagaaagaagacgactgtgacgagatacagtgccaattggcgattcccgtctcctccctcaactctcaatattgtgtctcagccgaaggtgtcttacatgtgtggggagtgaccacagagaaatcaaaggaagtgtgcatcactattttcaattcctcaattaagggctccctgtggattccggtggtggcagccttgctcctgtttctggttcttagcctcgtttttatatgtttttacattaagaaaattaaccccctcaaggagaagagcatcatcctccctaagtctctcatctccgtggtgcgcagcgctacgcttgagacaaagcccgaatcaaagtacgtgtcgttgataacatcatatcaacctttcagcttggaaaaagaggtggtctgtgaagaaccgctgtctcccgctactgtgcctgggatgcacactgaagacaacccaggcaaagtggagcacaccgaggagctttcttctataaccgaagttgtcaccactgaggagaacatcccagacgtcgtgccaggatcacatttgacacccatagagagagagtcttcctcacctcttagtagcaaccaatcagaaccaggttctatcgccctgaacagttaccatagtagaaactgtagtgaatctgaccacagccgtaacggctttgacaccgattcctcctgtctcgaatcacacagctccctttccgattctgagttcccccctaacaataagggggaaatcaagacagagggtcaggaattgatcaccgtgattaaagcccctacttcctttggctacgataaacctcatgtccttgtcgacttgctggtcgacgactctggaaaagagtcccttatcggatacagaccaaccgaggacagtaaggagttctcttag

SEQ ID NO: 227035 - DNA, 1014 bp, Artificial Sequence
  Description of Artificial Sequence: Synthetic coding sequence
atgcgccctacattgctgtggtcactgctcttactgctcggcgttttcgctgcagctgctgctgccccacccgaccccctctcccagctcccagcgcctcagcacccaaaaattcggctctataacgctgagcaggtcttgtcatgggagcctgtagccctctcaaattccacacggccagtcgtttatcaggtgcagttcaaatatacagactccaaatggttcacagccgacatcatgagtatcggagtcaattgcacacaaataacggctaccgaatgcgacttcaccgcagcatcaccatctgctggcttcccgatggactttaacgtaacactgcgactgcgtgccgagttgggagccttgcattctgcctgggtgactatgccctggttccaacactatcggaacgttacagtgggcccacccgagaacattgaggtcacgccaggagaagggtccttgatcattcgctttagctctcctttcgatatagccgacacgtccaccgcattcttctgctactatgtgcactattgggagaaaggtgggatccaacaggtaaaagggcctttcaggtccaactctatctctttagataatctgaaaccgagcagggtgtactgcctccaggtccaggcccagctgctgtggaacaagtccaacatcttccgcgtcgggcacctatctaacatttcttgttatgagactatggctgatgccagcaccgaactacagcaggtaatcttaataagtgtgggcaccttttctctcttgtctgtgcttgccggtgcctgtttctttcttgtattgaagtataggggcctaatcaagtactggttccacacacccccaagcatcccattacagatcgaggaatatttaaaggatccaacacaacccatacttgaggcactcgacaaggactcttcacctaaagacgacgtttgggactccgtctctatcatttcctttcccgaaaaggagcaggaggacgtgctgcagactctgtag

SEQ ID NO: 227036 - DNA, 378 bp, Artificial Sequence
  Description of Artificial Sequence: Synthetic coding sequence
atgcataaggaagaacatgaggttgccgttctcgggccaccacctagcacaatcttgccaaggagcactgttattaacatacactcagaaacctcggtgccggaccacgtcgtgtggtctctgttcaatacattgttcctaaattggtgctgcctcggctttatcgcctttgcctacagcgtgaaaagcagagaccgtaagatggtgggtgatgtgaccggcgcacaggcctacgcctctaccgctaaatgtcttaacatctgggctttgattttgggtatcttgatgacgattggtttcattctgctcctggtttttggatcagttacagtttaccatattatgctccagatcatccaagaaaaacgcggttattag

SEQ ID NO: 227037 - DNA, 378 bp, Artificial Sequence
  Description of Artificial Sequence: Synthetic coding sequence
atgcacaaggaggaacacgaggtggcagttttggggcctcccccatccactattcttccaagaagtaccgtcattaatatacactctgaaacatctgttcccgatcacgttgtttggtctctgtttaatacactttttctgaactggtgttgtctcggatttatcgctttcgcgtattcagttaaatccagggacaggaagatggtgggggacgtgacaggcgctcaggcatacgcatcgactgcaaaatgtttgaatatttgggctctgatcttggggattctgatgactattggcttcattctgctactggtctttggatcagtgacagtgtatcacatcatgcttcaaattatccaggagaaaagagggtattag

SEQ ID NO: 227038 - DNA, 300 bp, Artificial Sequence
  Description of Artificial Sequence: Synthetic coding sequence
cctcaatctcagaagatgcacaaagaggagcatgaggttgctgtgctgggcccaccaccgtccacaatcctccccagatccacagtgattaacatccactctgaaacatccgtgcctgaccacgtggtggtacctgtccaacaccccttactcgagtgttgtttaggcttcatagcctttgcctattctgtcaagtcgcgagaccgaaagatggttggtgatgttacaggcgcacaggctctccatcgacaggtgccagagcacctggggccagactctggccacccacatgaccattag

SEQ ID NO: 227039 - DNA, 378 bp, Artificial Sequence
  Description of Artificial Sequence: Synthetic coding sequence
atgcataaggaagagcatgaagtcgccgtactggggcctccgccttccacaatcctccctcgatctacagtgattaacatccattcagaaacctccgtgccagatcatgttgtgtggtctctctttaacacccttttcctgaactggtgttgtcttggcttcatcgcgtttgcttacagtgtaaaaagtcgggatagaaagatggtgggcgatgttaccggtgcgcaggcctatgcttcaaccgccaaatgtctgaatatctgggccctgattttggggatcctgatgacaatcgggtttatcctgctcttggtctttggtagcgtcacagtttaccacatcatgctgcagattatacaggaaaagaggggttattag

SEQ ID NO: 227040 - DNA, 495 bp, Artificial Sequence
  Description of Artificial Sequence: Synthetic coding sequence
atgaatcacatcgttcagaccttctccccggtgaacagcggccagccacctaattatgagatgctaaaagaggagcaagaagtcgccatgctgggagtgccccacaaccctgcgccaccaatgtctaccgtgatccacattcgaagcgagacatccgtgccagaccacgttgttgtgcctgttcagcatccgttgcacgaatgctgtctgggctttatcgcattcgcatactctgtaaaatcccgggaccgaaagatggtgggggacgtaacaggcgctcaggctctgcatcgacaagtaccagaacatctaggccctgactttggccacctacatgaccacagtgcccatcaccaccctagcgtgggcagaccaggcccagccattgatcaggaagccagcctgagacctggagctcttcccgtaacctgcattcccaggaccctctctagtatccctcggccagccccaagaggccaggaattgtgtccatag

SEQ ID NO: 227041 - DNA, 399 bp, Artificial Sequence
  Description of Artificial Sequence: Synthetic coding sequence
atgaaccacatcgtccagaccttcagccccgtgaactccggtcagccccctaactatgagatgctgaaggaagaacaggaagtagctatgctaggagttcctcacaatcctgccccaccgatgtctactgtcattcacatccgcagtgagacatcagtgcccgaccatgtagtgtggagtctgtttaacaccttgttcatgaacacctgttgtctcggattcattgcctttgcatattccgtgaaatctcgggacaggaaaatggtcggtgacgtgacaggagcacaggcctatgcatctactgccaaatgcctgaacatatgggccctgattttgggcatatttatgaccattctgctgatcattataccggtgctcgtggtgcaggctcagcgctag

SEQ ID NO: 227042 - DNA, 447 bp, Artificial Sequence
  Description of Artificial Sequence: Synthetic coding sequence
ccaccaaattacgagatgctgaaggaggaacatgaagttgccgttctgggcgctccccataacccagcaccaccgacctccactgtcattcatatacgtagcgagacatccgtgccagaccatgtggttgtcccggtgcaacaccctctccatgaatgttgtcttgggtttattgctttcgcctacagcgtgaaatccagggatcgtaagatggtaggtgacgtcactggcgctcaggcgttgcatcgacaggtacctgagcatttgggcccagactcgggtcacccgcatgatcacagtgctcataggcatcctagcgcagaccttcctgggctgtggatcgatcaggaggctagcctgcgtccgggagcactgcccatgacatgcatcccacggacaccgacctcaatcccacggcctgccccaggcgctgagagctgtatctag

SEQ ID NO: 227043 - DNA, 402 bp, Artificial Sequence
  Description of Artificial Sequence: Synthetic coding sequence
atgaaccacaccgtgcagaccttctttagcccagtgaactccggacaaccccctaactacgagatgttgaaagaagagcacgaggtggctgtgctcggtgcccctcacaatccagctccacctacctcaacagtcatccacatccgctctgagactagtgtccccgatcacgtggtgtggtccttgtttaacacgttgtttatgaatccatgttgcttgggattcatagcctttgcttattcagtaaaatcacgggatcgcaagatggtgggagatgtgaccggggcacaggcctatgcttctacagccaagtgtcttaacatttgggcattgatcctgggcatcttaatgaccattttgctcattgttatccccgtgctgatttttcaggcctacggatag

SEQ ID NO: 227044 - DNA, 3078 bp, Artificial Sequence
  Description of Artificial Sequence: Synthetic coding sequence
atgagcaacggctatagcacggatgaaaacttccgatacctgatatcttgctttcgggctcgagttaaaatgtacattcaggtggaacccgtcttagactacctgactttcctacctgctgaggtcaaggagcagatccaaagaaccgtggcgacctctggcaatatgcaggccgtcgagctcctcttgagtacactagagaagggggtgtggcacctaggatggactcgcgaattcgtcgaggctctccggaggactgggtcccccctggccgcacggtacatgaatccggaactgacagatctgccaagccctagcttcgaaaatgcccatgacgaatatctgcagcttctgaatctcctacagccaacattagtagacaaactcctggtaagagacgttctcgataaatgcatggaggaagagctcctgaccatcgaagaccggaataggattgccgctgctgaaaataacggaaacgagtctggcgtacgagaattgctgaagcggattgtccagaaggaaaactggtttagcgcttttctaaatgtgctgcgccagactggtaataacgaactggtgcaggaactgaccgggagtgattgcagtgaatctaatgccgagatcgaaaacctttctcaggtagacggacctcaggtggaggaacaattactcagcaccaccgtccagcctaacctggagaaggaggtttggggcatggagaataactcctccgagtcttcttttgccgatagctccgtcgtaagtgagtccgacacatctcttgcggaagggagtgtgtcttgtctcgacgagtctctgggccacaactctaatatgggcagcgacagcggaactatgggtagcgactccgacgaagaaaacgttgccgcacgagccagtcctgaaccagagctccagctgcgcccttaccaaatggaggtggcacagcctgccttagagggcaagaatattatcatttgcctgcccacgggcagcggaaaaacaagggtggcagtctacattgccaaggaccatcttgataaaaagaaaaaggcctcagaaccgggtaaggtcattgtcttggttaacaaggttctgcttgtggagcaactgtttcgcaaggaatttcagccctttctaaagaaatggtatagagttattggactctctggagatacgcagctgaagatatcttttccggaggttgtgaaaagttgcgacatcattattagtaccgctcagatactggagaactccttactgaatctggagaatggagaagatgctggcgtgcagctgagcgatttttcccttatcataattgatgagtgccaccacacaaataaggaagcggtttacaacaatatcatgagacattatctgatgcagaaattaaagaataaccggctgaagaaggagaacaaaccagtgattcctctgcctcagatacttggcttgaccgcttccccgggagtcggcggagcaaccaagcaggccaaggcagaagagcatatcctcaagctgtgcgccaacctggatgctttcacaataaagacagtgaaggagaatctggaccagctgaaaaaccagattcaggaaccttgcaagaagtttgccattgctgacgccacacgggaggatccatttaaggaaaagctcctggagatcatgacccgtatccagacctactgccagatgtcacccatgtccgacttcggtacccagccttatgaacaatgggccattcagatggaaaaaaaagctgcaaaagagggcaaccggaaggaacgcgtgtgtgccgagcatctcaggaagtataatgaagcgttgcaaattaatgatacaattcggatgatcgacgcgtatacacaccttgaaactttttacaatgaagagaaagacaaaaaattcgctgtaatcgaggatgactccgatgaaggaggtgacgacgaatactgcgacggagacgaggacgaggatgacctgaagaagcccttgaagctggacgagactgataggtttcttatgacccttttctttgagaataataaaatgctaaagaggctcgccgagaatccagaatacgaaaacgaaaagctgaccaagctcagaaatacaattatggagcaatatactaggactgaggagagcgccaggggtatcatattcactaaaacccggcagtctgcctatgccctcagccagtggataacagaaaatgaaaagttcgcagaagtgggcgttaaagcgcatcatcttattggtgcagggcactcttctgagtttaagcccatgacacaaaacgaacagaaggaagtgatctctaagtttcgcactggaaaaataaatctcctgattgctacaactgtggccgaagaaggcctcgacataaaggagtgcaacatagttatccgttacggcttagtcacaaacgagattgctatggtgcaggccagaggcagggctcgggcagacgaatctacttatgtactcgtggctcactctggatccggggtgattgagcacgaaacggttaatgattttcgggagaagatgatgtacaaagcaattcactgtgtgcagaacatgaaacctgaggagtacgcgcacaagatactggaactgcagatgcagtccataatggaaaaaaagatgaaaacaaagcgaaatatcgccaagcattataaaaataatccctctcttattacattcctctgtaagaactgttctgtactagcttgcagtggtgaggatattcacgttattgaaaaaatgcaccatgtaaacatgaccccggagttcaaggagctttatattgtgagagagaacaaggcattgcaaaagaaatgtgccgactaccagattaatggagagattatctgtaaatgcggccaggcctggggcactatgatggtgcacaaggggctggatcttccttgccttaaaattaggaattttgtcgtcgtgttcaagaacaacagcaccaagaagcagtataaaaaatgggtcgaactgccaatcactttcccgaaccttgactacagtgagtgctgtctgttctccgatgaagactag

SEQ ID NO: 227045 - DNA, 666 bp, Artificial Sequence
  Description of Artificial Sequence: Synthetic coding sequence
atgtccaacggctactccacagacgagaatttccgctacttgattagttgtttcagggcaagagtaaagatgtatattcaggtagagcccgtgttggattatctgacctttttgcctgctgaagtcaaggagcagatccaacggaccgtagctacctcaggtaacatgcaggccgtggaactcctgctcagcactctggagaaaggagtatggcatctgggatggacccgggagttcgtggaagccttacgaaggacaggctccccattggcagcacgatacatgaatccggaattaacagacctcccaagcccatccttcgagaatgcccacgacgaatatctgcagctccttaatcttctgcagcccaccctcgtagataagttactcgttagagatgtcctggataaatgcatggaggaggaacttttgacgatcgaggatagaaacagaatcgccgctgcggagaacaatgggaatgagagcggcgtgcgggaactgctgaagcgtatcgtgcagaaagagaactggttctctgcattcctgaacgtcctgagacaaaccggtaataatgaacttgtccaggagcttactgggtcagactgtagcgagagtaatgccggaatttgcaacttcacagaggaggattcgagtaatagtgcatag

SEQ ID NO: 227046 - DNA, 3078 bp, Artificial Sequence
  Description of Artificial Sequence: Synthetic coding sequence
atgagtaatggttacagcaccgacgaaaacttcaggtatctcatttcctgcttcagggcgcgagtaaagatgtatatccaagtcgagcccgtgctggactacctcacatttctgcccgctgaagtgaaagaacaaattcagcggaccgtggcaaccagtggcaatatgcaggcggtcgaactccttctcagtaccctggagaagggagtgtggcatctgggctggaccagagagttcgtcgaggcactgagaaggaccgggagccctctggccgcaagatatatgaatcccgagctaacagacctgccgtcacctagctttgagaacgcacatgatgaatacctgcagctcttaaacctgctccagccaactcttgtcgacaaactgttagtgcgggacgttttggataagtgcatggaggaagagctgttaacaattgaggatcgaaaccgaattgctgccgctgaaaacaacggaaatgaatctggcgtccgcgagctgttgaagcgaattgtacagaaagaaaattggttttcagcattcctcaacgtgctgcgacagactggaaataatgagttagtacaggaactcacaggctcggattgcagtgagtcaaacgccgaaatcgaaaacctgtcccaggtcgatgggccacaggttgaggagcagctcctgagtaccacagttcaaccgaatctagagaaagaggtgtggggcatggagaacaactcttctgagtcatcctttgccgactcatccgtggtctcggagtcagacacttccctcgccgagggaagtgtctcatgcctggatgaaagtttgggccacaactccaacatgggcagtgatagcggcaccatgggcagtgactctgacgaggagaacgtcgcggctcgagccagtccagagccagagttacagttacggccatatcaaatggaggtggcacagcccgctctggagggtaagaacataattatctgccttcccaccggcagcgggaaaacccgcgtggccgtttacattgctaaggatcacctcgataaaaagaaaaaagcgagtgaacccggaaaagttattgttttagtcaacaaagtcctcttagtagaacagctcttcagaaaagaatttcaaccattcctaaaaaaatggtacagggtgattggactcagtggagatactcagctgaaaatcagctttcctgaggtagtgaaatcctgcgatattattatcagcaccgcacagatcctggaaaatagtctcttaaatttggagaacggtgaagacgcgggtgtccagttgtcagattttagtctgattataatcgatgagtgccatcacactaacaaggaggccgtatataataatattatgagacattacctaatgcaaaaacttaaaaacaaccgcctgaagaaggagaacaagcccgtgatccccctgccgcagattctaggtctcaccgcaagtcccggagtgggaggcgcaactaagcaagccaaggcagaggaacatatccttaagctctgtgccaatctggacgcgtttaccataaaaactgtcaaggagaatttggaccagttgaagaaccagattcaggaaccgtgcaagaagttcgccattgccgacgccactagagaagacccttttaaggaaaagctgttagagatcatgacaaggattcagacctactgtcagatgtcccccatgtccgactttgggacccagccgtacgaacagtgggcaattcagatggaaaaaaaagccgctaaggaagggaatcgcaaggaaagggtttgtgctgagcaccttaggaagtataacgaggccctgcaaataaatgacaccatcagaatgatagacgcctacacccatcttgaaaccttttataacgaggagaaagacaagaagttcgctgtaatcgaggatgatagtgacgaaggaggcgacgatgagtattgcgacggagatgaggatgaggacgacctgaaaaaaccactgaaactagatgaaaccgaccggttcttgatgacactcttcttcgaaaacaacaagatgctcaaaagattggctgaaaacccagaatacgagaacgaaaaactcacaaagctgcggaacactataatggagcagtacacccgaaccgaagaaagcgccagagggattatcttcactaagacgcgccagtcggcttatgctctctctcagtggatcacggagaacgagaaattcgcggaggtgggcgttaaagcacaccaccttatcggcgctgggcacagcagcgagttcaaaccaatgacgcagaacgagcaaaaagaggtaatttcaaagtttcgcacgggcaaaatcaacctgttgatcgccactaccgtggccgaggaaggtttggatatcaaggagtgtaatattgtgattagatatgggttggtcaccaatgagatcgctatggtccaggctcggggacgagcgagagcagacgagtcaacatacgtgctggtagctcactctggtagcggagtgattgagcacgagactgtgaacgactttagggaaaagatgatgtacaaagctatacattgtgtccagaacatgaaaccagaagagtacgcccacaagattctcgaactgcagatgcaaagcattatggagaaaaagatgaaaaccaagcgaaacattgctaagcattacaaaaacaacccttccctgattacttttctgtgtaagaactgcagcgtcctagcgtgctcaggtgaagatatccatgtgatcgaaaaaatgcaccatgtcaacatgactccggaattcaaggaactctacattgtccgcgaaaataaagcactgcagaagaagtgcgctgactaccagatcaacggcgaaatcatctgcaagtgcgggcaagcttgggggacgatgatggtccataagggactggacttgccctgcctcaaaatccgtaactttgtagtagtatttaagaataacagcaccaagaaacaatataagaagtgggtcgagctcccgatcaccttccctaacttggattattcagagtgttgtctgtttagtgatgaggattag

SEQ ID NO: 227047 - DNA, 1050 bp, Artificial Sequence
  Description of Artificial Sequence: Synthetic coding sequence
atgccagtggagcggatgcgaatgcgaccgtggcttgaagaacaaatcaattcgaataccatccccggtctgaagtggctgaacaaggagaagaagatcttccagattccctggatgcacgctgccagacacggatgggacgtggaaaaggatgcacctctctttcggaactgggcaatccataccgggaaacatcaaccaggtgtagacaagccagatccgaaaacctggaaagctaacttccgctgtgccatgaacagcttgcctgacatcgaagaagttaaggataagtccatcaaaaaaggcaataatgctttccgggtgtacaggatgcttcctctcagcgagcgccctagcaaaaaggggaagaaacctaaaacagaaaaagaagacaaggttaagcatatcaaacaggagcctgttgagtcaagtttgggcttatccaatggggtgtccgatctttcccctgagtatgcagtgctcacaagcacaattaagaatgaagtagattctactgtgaatatcatcgttgtcggccagtctcatttggactcaaacattgagaaccaggagatcgtgaccaacccccctgatatttgccaagtagtggaagtgaccactgaatcagatgaacaacccgtgtccatgtctgagctgtatccactgcaaatcagcccagttagctcctacgcagagagtgaaacgactgactcagtgccaagtgatgaagaatctgcagagggacgaccacactggcggaagagaaacattgaagggaaacagtacctgagcaacatgggtacccgcggtagctacctcttaccaggcatggcatcttttgtcacctccaataagcccgacctccaggtgacaatcaaggaagagagtaacccggtgccgtacaacagctcatggcccccatttcaggacctgccccttagttccagcatgactccagcttccagtagtagccggccagacagggagacacgcgcttcggtcataaagaaaactagcgacatcacacaggcgcgagtcaaatcatgctag

SEQ ID NO: 227048 - DNA, 414 bp, Artificial Sequence
  Description of Artificial Sequence: Synthetic coding sequence
atgccagttgagcgaatgcggatgaggccgtggttggaggagcagatcaattccaacaccatccctggccttaagtggttgaacaaggagaagaagatttttcaaatcccttggatgcatgctgcgcgtcacggctgggatgtcgaaaaggacgccccactctttagaaactgggctattcacacaggcaagcaccagcctggggtcgataaaccagatcccaagacctggaaagccaatttccgttgcgccatgaactcactgcccgacattgaggaggttaaggacaaatccatcaaaaaaggcaataacgcctttcgagtgtatcgcatgctgcccctttctgaaagaccctccaaaaagggcaagaagcctaagaccgagaaagaagataaggtgaagcacattaagtag

SEQ ID NO: 227049 - DNA, 414 bp, Artificial Sequence
  Description of Artificial Sequence: Synthetic coding sequence
atgccagtggaacgcatgcgaatgcggccatggctcgaggaacaaataaacagcaatacaattccgggtctgaagtggctcaataaggagaaaaagatttttcagatcccttggatgcacgccgctaggcatggctgggacgtcgagaaggatgccccactttttagaaactgggctatccacaccggcaagcatcaaccaggagtggacaagccggacccaaagacctggaaagctaattttaggtgtgctatgaactctttacccgatattgaggaggtgaaagataaaagcatcaagaagggcaacaatgcgttccgcgtgtaccgaatgttgcccctgagtgagcggccttccaagaaagggaagaaacccaagacagaaaaagaagacaaggtcaagcatataaagtag

SEQ ID NO: 227050 - DNA, 531 bp, Artificial Sequence
  Description of Artificial Sequence: Synthetic coding sequence
atgcctgtggagcggatgaggatgaggccatggctcgaggagcagattaacagcaacacaatccctggattaaagtggctcaacaaagagaagaaaatattccagatcccctggatgcatgcggctcgccatggttgggacgtcgaaaaagatgccccactctttagaaactgggcaattcacacaggcaagcatcagccaggggtcgacaagccggaccctaagacctggaaggccaatttcaggtgcgccatgaatagcttgcccgatatagaggaagtcaaggataaatctatcaaaaagggcaacaacgctttccgggtctatagaatgctgcctcttagcgaacggccatcaaagaaagggaaaaaaccgaaaacagaaaaggaagacaaagtcaaacacataaaacaggagcccgtggaatcatctcttggactgtcaaatggagtctcagatttgtcaccagaatacgcagtcctcacctccacaatcaagaatgaagtggatagtacagtgaatatcatatag

SEQ ID NO: 227051 - DNA, 486 bp, Artificial Sequence
  Description of Artificial Sequence: Synthetic coding sequence
atgcctgtcgaacgaatgagaatgaggccctggttggaagagcagatcaacagcaacacaatacccggactcaagtggttaaataaggaaaaaaagatctttcagattccctggatgcacgcagcacgccacggatgggacgttgagaaggacgcccctctctttcgaaactgggctatccataccggcaaacaccagcccggagttgacaaacccgaccccaagacatggaaggcaaactttcgatgtgccatgaattctttacccgatatagaagaggttaaggataagagcattaaaaaaggcaataacgcttttagagtttatcggatgctgccactctccgaacgcccaagtaaaaaagggaaaaaaccaaagacagaaaaagaggacaaggttaaacacattaaacaggagcctgtcgaaagctccttaggcctaagtaacggtgtcagtgatctatcaccagaatacgccgtgctttag

SEQ ID NO: 227052 - DNA, 1284 bp, Artificial Sequence
  Description of Artificial Sequence: Synthetic coding sequence
atgggaacaccaaagccacgcattcttccctggctggtctcccagctagatttgggacagctcgagggagtagcttgggtgaacaagtctagaactaggtttcgaataccttggaaacacggcctgcgacaggacgctcagcaggaagattttggaatattccaagcctgggctgaggcgactggggcttacgttccaggcagagacaaaccagacctccccacttggaagcgcaactttcggtcagcccttaataggaaggaaggcctacgacttgccgaagatcgaagcaaggaccctcacgatccccataaaatatacgagtttgtcaattccggtgtcggagatttctcacaaccggataccagtcccgacactaacggcggtgggagcacaagcgatactcaggaagacatcctagatgaacttcttggcaatatggtgctggcgcctcttccagacccagggcctccttctctggctgtggcccctgagccttgtccccagcctttgaggtccccaagcctggacaatcctacacccttccctaatctcggcccatccgaaaatcctttgaagcgtctgctcgtgccaggggaggaatgggaatttgaggtgacagctttctaccggggacggcaagtgttccagcagaccatcagctgccccgagggcctcagattggtggggtctgaagttggagaccggacactccccggttggcccgttaccctgcctgatcccggaatgagcctgacagacagaggggtcatgagttatgtgaggcacgtactcagctgtctaggcggtggactcgccctgtggagggccggtcagtggctgtgggctcaacgtcttggccactgtcacacttattgggccgtatcggaggaactcttgcccaacagtggacacggtcctgatggtgaggttccaaaggacaaggaaggtggtgtgttcgacctgggcccattcatagtcgacttgattacgtttacggaaggttctggacggagccctcgctacgctctgtggttctgcgtaggagagtcctggccccaagatcagccgtggaccaagcgcctggtgatggttaaggtggttccaacatgcctgagagctcttgttgaaatggctcgggtgggcggtgcctccagtctggagaataccgtggaccttcacatcagtaattcgcacccactctcccttacctccgaccaatacaaagcatacttacaagacctggttgagggaatggacttccaagggccaggtgagtcgtag

SEQ ID NO: 227053 - DNA, 903 bp, Artificial Sequence
  Description of Artificial Sequence: Synthetic coding sequence
atgggcaccccgaagccgcgtatcctgccgtggctggtttcccagctggatctcggtcaactggaaggcgtggcttgggtgaacaagtccagaactcgcttcagaataccctggaagcacggcctcagacaggacgcccaacaggaagacttcggtatttttcaggcttgggccgaagccaccggggcttacgtgccaggaagggacaagcctgatctccccacatggaagcggaattttcggtcagcgctcaatcgcaaggaggggctgaggctggccgaagaccggagtaaggacccgcacgaccctcacaaaatctacgaattcgtgaattcaggcgtcggagacttcagccagccagacaccagccctgatacaaatggtggaggcagtacatctgatacccaggaagacatactggacgagttgctcggtaatatggtgttagccccacttcccgatcccggtcccccaagtctggccgttgcgcctgaaccttgtccccagccattacgttccccgagcttggacaatcctacacccttccctaatctgggaccttcagaaaacccactgaagagactgctggtgcctggcgaggacttgatcacctttaccgaaggtagcgggaggagccccagatacgctctgtggttctgtgtgggagagtcctggccgcaagatcagccgtggacaaagcgcctggtaatggttaaagtggtgcccacctgtttgagagctctggtcgaaatggctcgagttgggggagcctcaagtttggaaaacacagtggatcttcacatctccaacagtcatccactgtccctgacttccgaccagtacaaggcctatctacaggatcttgtggagggcatggacttccaggggcctggggagtcctag

SEQ ID NO: 227054 - DNA, 1284 bp, Artificial Sequence
  Description of Artificial Sequence: Synthetic coding sequence
atgggtactccgaaacccagaatactgccgtggctggtgagccagctagacctcggccaattagagggagtggcttgggtgaataagagccggacgagatttaggatcccttggaagcacgggttaagacaggacgcacagcaggaggacttcggcatttttcaggcctgggcagaggctacaggcgcatacgtaccgggtagggacaaacccgaccttcctacgtggaaaagaaactttaggagtgctttgaaccgtaaggagggcctccgcctcgccgaagatagaagcaaggatccccacgatccccacaagatctatgaattcgtgaattccggagtgggcgacttttcccaacctgatacaagtccagacactaatggcggaggaagtacctcagatacgcaggaggacatactggacgagctgctcgggaacatggttcttgcacctctccctgatcctgggcctccttccctggccgttgccccagagccatgccctcaacctctgagatcccccagtcttgataatcctaccccattcccgaacctgggtccttcagagaaccccctcaagaggctgctggttccaggagaagagtgggaattcgaagtgaccgcattttaccgaggcagacaagttttccaacaaaccatcagctgccctgagggcttaaggctggtgggctcagaggtgggggataggacactgccaggttggcccgtcacattgccggacccagggatgtcattgaccgataggggagtgatgtcctatgtaagacatgtgctgtcctgtctcggaggtgggctcgccctgtggcgcgctggacagtggctttgggctcagcgtctggggcattgccacacatattgggcggttagcgaagagctcttgcccaacagcgggcacgggcctgacggcgaggtcccaaaggataaggagggtggtgtgtttgatctcggacccttcatcgttgatttaatcacatttacggaaggcagcgggagaagtccacgctatgcactctggttctgtgtcggcgaaagttggccccaggatcagccctggaccaagagactggtgatggtgaaggtggtgcctacgtgccttcgagccctagtagaaatggctcgggtgggaggtgcctctagcctggaaaacactgtggaccttcacatcagtaatagccaccctctctctcttacgtctgaccagtataaggcctatctccaggatcttgtggaggggatggactttcagggccctggcgaatcctag

SEQ ID NO: 227055 - DNA, 315 bp, Artificial Sequence
  Description of Artificial Sequence: Synthetic coding sequence
atgggaactcccaagccgaggatcctcccatggctggtgtcccagctggacctgggccagctcgaaggcgtggcgtgggtgaataagtcacggactagatttcgcattccctggaaacacggactgaggcaggacgctcagcaggaggactttggcatttttcaagagctcggcacatttccatcgcagacacctctccgcactccgatggtggaggctgtcctcctcatacccaggaaaactttttggatgtcctattgggtcacttggtgttggccccacagccagatcagagaccctcaggcctggctttag

SEQ ID NO: 227056 - DNA, 846 bp, Artificial Sequence
  Description of Artificial Sequence: Synthetic coding sequence
atggtcctcgcgccattgccggatccaggaccaccttctttggcggtggcaccggaaccttgtccacagcctctccgctccccgtccctcgataatccgacaccctttcccaatctcgggccttctgagaaccctttaaagcgcctcctggtgccaggcgaagagtgggaatttgaagtgacagccttttaccgaggtaggcaggtttttcagcaaacaatctcctgcccagaaggcctgaggctcgttggtagcgaggtcggagatcgcacactgcccggatggcctgtgactctacccgaccccggaatgagtctaacagaccgcggagtgatgtcatacgtgcgacacgtactctcttgcctgggtgggggtctggccctttggcgcgctggtcagtggctgtgggctcagagactcggtcattgtcacacatactgggccgtgtcggaggagctgctcccgaattcaggccacgggccagacggtgaggtgccaaaagataaggagggtggagttttcgacctcgggccttttatcgttgacttaatcacctttaccgaggggtctggcagatcccccagatacgcactgtggttttgcgtaggcgagtcttggccccaggatcagccatggacaaagcggcttgtgatggttaaggtcgtcccgacgtgtttgcgtgctttggttgagatggctcgggtcggtggagcgtcaagtctcgaaaataccgtcgatctgcacatttccaatagtcaccctctgtctttaacctccgaccagtataaggcttacttgcaggatttggttgaagggatggactttcagggacctggagaatcatag

SEQ ID NO: 227057 - DNA, 465 bp, Artificial Sequence
  Description of Artificial Sequence: Synthetic coding sequence
atggtccttgccccacttcccgatcctggccctcccagtctcgccgtcgcccctgaaccatgcccgcagccactacgttcaccttcccttgataacccaacccccttccctaatttaggcccatccgagaaccccctgaagcgcctgttggttcctggtgaggacctcattaccttcactgagggttccggaaggagcccacgctacgccctgtggttttgcgtcggcgaatcctggccccaggatcaaccctggacaaagcgcctggtgatggtgaaggtggtcccaacctgtctcagagcgcttgtcgaaatggctagagtaggcggagcatcctctttggagaatacagttgatctccatattagtaatagccaccctctttcattaacaagcgatcagtacaaggcttatctccaggaccttgtagagggaatggacttccagggtccaggcgaatcatag

SEQ ID NO: 227058 - DNA, 846 bp, Artificial Sequence
  Description of Artificial Sequence: Synthetic coding sequence
atggtgctagcccctttgcccgatcccggaccacctagtctggcagtggccccagagccatgtccgcagccgctcaggtctccctctctcgacaatcccacaccctttcccaaccttggaccctctgaaaatcctcttaagagactgctggtccccggagaggaatgggagttcgaggtgacggcattttatcgtgggaggcaggttttccaacaaacgataagctgccccgagggactgagactcgtggggagtgaagtgggagaccgtactttgcccggatggccagtgacacttcctgatcccggaatgtccctcaccgacaggggcgtgatgtcttacgtgagacacgtcctgagttgcctcggaggtggactggccctgtggagggcaggacagtggttgtgggctcaaagactgggccactgccatacctactgggcagtgtcagaggagcttcttcctaactccgggcatggtcctgatggagaagtcccaaaggataaagaggggggagtgttcgatctgggcccatttatagtcgacctgatcacctttacagaaggctccggcaggtcgcctcggtacgctctgtggttctgcgtaggggagtcttggcctcaggaccagccttggacaaagagattggtcatggtaaaggtcgtgcctacctgcctgcgggctctggtggaaatggcccgtgtcgggggagccagcagcctggagaatactgtggacctgcacatatcaaacagtcatcccctgagtctgaccagtgaccagtacaaagcctacctacaggatctggtagaaggaatggactttcagggcccaggagaaagttag

SEQ ID NO: 227059 - DNA, 903 bp, Artificial Sequence
  Description of Artificial Sequence: Synthetic coding sequence
atgggtacccccaagcccagaatattgccgtggctcgtgagccagctggacttaggccaactcgaaggagtagcatgggttaataaatcccgtactcgtttcagaattccttggaagcacggactccgccaagatgctcagcaggaggactttgggatattccaagcctgggcagaagctactggagcttatgtgccaggacgggacaaacccgaccttcctacctggaaaaggaattttagatctgcactcaatcgcaaggaggggctacgcttggccgaggacagaagcaaggacccacatgatccccacaagatatacgagttcgtcaatagtggagtcggggacttctcccagcccgataccagtcccgacaccaacggcggagggagcacgtctgacacgcaggaggatattctggacgagcttctgggcaacatggttctggcccctctacctgaccccggacccccatcactggccgtcgccccagagccttgccctcagccgttgaggagcccatcactcgacaaccctacaccgtttcccaacttgggcccttccgagaaccctttgaagagactgcttgtacccggtgaagacctgattactttcactgaaggctcagggagatcacccaggtatgctctgtggttttgtgtgggagagtcttggccacaggatcaaccttggactaaacggctggtgatggttaaagtcgtgcctacctgtctcagagctctggtcgagatggccagggtcgggggtgcgtcttctctggaaaatacagtcgacctgcacattagcaacagccacccactgtcactgactagcgatcaatacaaagcctacctgcaagacctcgtcgagggtatggactttcaaggcccaggggaaagctag

SEQ ID NO: 227060 - DNA, 465 bp, Artificial Sequence
  Description of Artificial Sequence: Synthetic coding sequence
atggtactggcgcctctgcccgacccaggccctccgtctctggctgtcgcgcctgaaccgtgcccgcagcccctgaggtcccctagcttggacaatcccactcctttccccaacctcggcccatctgagaatcctcttaagcgcttgttagtaccaggagaggacttgataacttttacggaaggttcagggagatcccccagatacgcattgtggttctgcgtcggggaatcctggcctcaagatcaaccctggaccaaacgactcgtgatggtgaaggtggtccccacttgcctgcgggcactcgtcgagatggccagagttggaggggctagctccctggagaatactgtggacttgcatatctctaattcccaccccctcagcctgactagtgaccagtataaagcatatctgcaggatctggtggagggcatggatttccagggacccggtgagagctag

SEQ ID NO: 227061 - DNA, 1404 bp, Artificial Sequence
  Description of Artificial Sequence: Synthetic coding sequence
atggcattgcatcctcggagggtccggctcaagccctggttagtggctcaggtcgattctggactgtacccagggttaatttggctccacagggatagtaagcgcttccagataccttggaaacatgccacccggcattcaccccagcaggaagaggaaaacactatatttaaagcatgggctgtggaaacaggcaaataccaagaaggggtggacgatccagaccccgcaaaatggaaggctcagcttcggtgcgccctgaataaatcgcgcgaatttaacctcatgtacgatggcacaaaggaagtgccaatgaaccccgtcaagatatatcaggtgtgtgatatcccgcagccgcaggggtcgataatcaatcctggatccacaggcagtgctccctgggatgaaaaagataatgacgtagatgaggaggatgaggaggatgagcttgatcagtcccagcaccacgtgccaatacaggatacattcccctttctgaacatcaacggctctcctatggcaccagctagcgtcggaaattgtagtgtaggcaactgctctcccgaagcggtttggccaaagacagagcccctcgaaatggaagtccctcaggcccctattcagcctttttacagtagcccagagctgtggatatcatctctgcccatgacagacctggacatcaagtttcagtataggggaaaagagtatgggcagaccatgactgtgtctaatccccagggctgccgtctgttttacggagacttggggcctatgcccgatcaggaagagctttttggaccagtgtccctcgagcaggtgaagttccctgggccagagcacattaccaacgagaagcagaagctctttaccagcaagctcctcgacgttatggatcggggtttgattctcgaagtatcgggacacgccatttacgctatcagactctgccaatgtaaagtgtattggagtggtccgtgcgcaccaagcctggtggcccctaatctgatcgaacggcagaaaaaagtgaaacttttttgtttggaaacattcctctctgatctgatcgcacatcagaagggtcaaatcgaaaaacaaccaccctttgagatctatctttgcttcggggaggaatggcccgacggaaagccacttgaaagaaagttaatcctggtgcaggtcattcccgtggtcgcccgaatgatttatgagatgtttagcggggatttcaccagatctttcgatagtgggagcgttcgcctgcaaatcagtacgcctgacatcaaggataacattgtggcacagctgaaacagctctatcgcattctccagacccaagagagttggcagcctatgcagcccacccccagcatgcaactgcccccagcattgcctccacagtag

SEQ ID NO: 227062 - DNA, 831 bp, Artificial Sequence
  Description of Artificial Sequence: Synthetic coding sequence
atggccttacatcctaggcgggtccggttgaagccatggctggtcgcccaggtggactcgggcctctacccagggctgatttggctgcatagggattcaaaacgatttcaaatcccatggaagcacgcgaccaggcactctcctcagcaggaggaagaaaacacaattttcaaggcctgggcagtggaaaccggcaaataccaggagggggtggatgaccccgaccccgctaaatggaaggcacagttacgttgcgctctaaataaatctcgggagtttaatctgatgtacgatggcacgaaggaggtaccgatgaaccccgtgaaaatataccaagtgtgtgatattccgcagccgcaagggtctatcatcaacccgggtagcaccggctctgcaccttgggatgagaaggataacgacgtagacgaagaggatgaggaggatgaactggaccaatcgcaacaccacgtcccaattcaggacaccttcccattcctcaatatcaatggcagcccaatggcccctgcctccgtgggtaattgttctgtggggaactgtagccctgaggccgtctggcccaagaccgaacccctggagatggaggtgccccaagcccctattcaacctttctactcaagcccagagctctggatttcctcactgcccatgacagatcttgacataaagtttcagtacagggggaaggaatacggccaaaccatgactgtgtctaatccccaggggtgtcgtttgttttacggcgacttggggccaatgccagaccaagaggagctgttcggacccgtttcccttgaacaagtgaaattttag

SEQ ID NO: 227063 - DNA, 1119 bp, Artificial Sequence
  Description of Artificial Sequence: Synthetic coding sequence
atgtacgatggtactaaagaggtacccatgaatcccgtgaagatctatcaagtatgcgacatcccccagccacagggcagcatcattaacccgggttcaactggctcagcgccatgggacgagaaagacaacgatgttgacgaagaggatgaggaggacgaactggatcaatcccagcaccatgtcccaatccaagacacttttccctttttgaacatcaacgggtcacctatggctcccgcatccgtaggaaattgtagtgtcgggaattgtagtcctgaagcagtctggcccaagactgagcctcttgaaatggaggtaccccaggcacccatccaaccgttttacagctcaccagagctctggatttcatccttgccaatgacagaccttgacattaagttccagtataggggcaaagagtatggtcaaactatgaccgtgtctaacccccagggatgccgcctcttctacggcgacctaggccctatgccagatcaggaagaactcttcggcccagtgtcactggagcaggttaagtttccgggtccagagcatattactaacgaaaagcagaagctttttaccagtaaactgttagacgtaatggacagggggctgattctggaagtgtccggccacgccatctacgcaattaggctgtgccagtgcaaggtatattggtccggaccatgtgcccctagccttgtcgcaccaaatctaattgagcgtcagaaaaaagtgaagctgttctgtttagagacattcctcagcgatctcatagctcatcagaagggacaaattgagaagcaacccccttttgaaatctatctgtgttttggggaggaatggccggatggaaaacctttggagcggaaactgattctcgtacaggtgatcccagtggttgctcggatgatctacgagatgtttagtggtgatttcacccgcagtttcgactccggatccgtgcggctccagatctcgactccagatattaaggataatatcgtcgcgcagctgaaacagctgtaccggatcctgcagacacaagagtcttggcagccaatgcagcccaccccttctatgcagctccccccagcccttcctccccagtag

SEQ ID NO: 227064 - DNA, 1281 bp, Artificial Sequence
  Description of Artificial Sequence: Synthetic coding sequence
atgtgcgatagaaatgggggacgcagactcagacagtggctgatagaacagattgatagctctatgtatcctggcctgatctgggagaatgaggagaagtcgatgttccggataccttggaagcacgcagggaagcaagactataaccaggaggttgacgcaagcattttcaaagcatgggctgtgtttaaagggaaatttaaagagggtgataaggccgaaccggctacttggaagactcggctgcgttgcgctctgaacaagtcacctgacttcgaggaggtgaccgaccgctctcaattagatatcagcgaaccttataaggtgtaccggatcgttccagaggaagaacagaaatgtaaactgggggtggccacagcgggttgcgttaatgaagtcacagagatggaatgcgggaggagtgaaatcgatgagctgattaaagaacctagcgtcgacgactatatgggaatgatcaagagatccccaagcccgccagaggcgtgccgatcccagctgctccccgattggtgggcacagcagccatctacaggtgtgccattggtgacaggttacacaacatacgacgctcatcacagcgcgttttcgcagatggtcattagcttctactacggtggtaagttggtgggacaagcaaccacaacttgtcctgagggctgtcgcttatccctgtcacagccagggcttccaggtaccaaactctatggcccagaggggcttgagttggtcagatttcctcccgcagacgcgatcccctccgagcgccagaggcaggtgacaagaaaacttttcgggcacctggaaaggggggtattacttcatagctctaggcagggcgtcttcgtgaagcgcttatgccagggccgtgttttctgttctgggaacgccgtcgtctgtaagggacggccaaataagttggagcgagacgaggtagtgcaggtgttcgacacatcacagttcttcagagagttacagcagttctacaacagccagggtaggttgccagatggaagggttgtcctttgtttcggggaggaattccctgacatggccccactgagaagcaaactcattctagtccaaatcgagcagttgtatgtgcggcagttggccgaagaggctgggaagtcctgtggagctggctcagtcatgcaggcacccgaagagcctccaccagatcaggtattcaggatgtttcccgacatctgtgcttcccatcagcgatctttcttccgggaaaaccaacagattacagtttag

SEQ ID NO: 227065 - DNA, 546 bp, Artificial Sequence
  Description of Artificial Sequence: Synthetic coding sequence
atggccggaagccgggaagttgtggctatggactgcgaaatggtcggccttggccctcatcgggaaagcgggctcgcccgatgctcgctggtgaatgtacacggggctgttctctacgacaaattcataagacccgagggcgagatcacagactaccgcacgagagtgtctggagtgacaccccaacatatggttggagcgacaccatttgctgtggccaggctggagatcctgcagctactgaaaggaaaactggtggttgggcatgatctcaagcacgacttccaggctcttaaagaggatatgagtggttatactatttacgatacgagcacagataggctgctctggcgggaggctaaactggaccattgccggagagtgtctcttcgcgtgctgtctgaaaggcttctgcacaaaagtatccagaattcacttctgggccattccagcgttgaagatgcacgggcaacaatggagctataccagatctctcaaaggattagagcaaggaggggactgccccgtctggccgtgagcgactag

SEQ ID NO: 227066 - DNA, 546 bp, Artificial Sequence
  Description of Artificial Sequence: Synthetic coding sequence
atggcaggatctcgtgaggtggtggcaatggactgcgagatggtggggctgggtccacaccgggaaagtggcctggcaaggtgttcccttgtgaatgttcatggggctgtgctctacgataagttcattcggccagagggggaaattaccgactatcgaacacgggtgagcggtgtcaccccccagcacatggtgggtgcaacacctttcgccgttgctcgcctcgagatactgcaactgttgaagggcaagctagtggtgggccacgaccttaagcatgatttccaggcgttaaaggaagatatgagcggttacactatctatgacacttccacagacagactcctctggcgtgaggccaagctcgaccactgccgcagagtaagtctcagggtgttaagcgagaggcttctacataaatctatccaaaattcactactggggcactcgagcgtggaggacgctcgtgctaccatggagttgtaccaaattagccagcggatacgggctcggagaggactgccacgtcttgccgtgtctgactag

SEQ ID NO: 227067 - DNA, 1062 bp, Artificial Sequence
  Description of Artificial Sequence: Synthetic coding sequence
atgagcaccctactgctgaatctggacttcggcgagccgccacccaaaaaagcactggaggggaacgcgaagcaccgaaacttcgtaaagaaacgcagattgctggagagacgcggttttttaagcaagaagaaccagcccccatctaaggcacccaaactccactctgagccatctaaaaaaggtgagacacctactgtggatggaacctggaagacccccagcttccccaagaaaaaaactgccgcaagcagcaatggcagcgggcagccacttgataaaaaggcagccgtgtcctggttaacacccgctccatcaaaaaaggccgattctgtcgctgccaaggtggatctgttaggcgagttccagtcagctctccccaaaatcaacagccatcccaccagatcccagaagaagtcctctcaaaaaaaaagctcaaaaaagaaccatccccagaagaacgcaccgcaaaactctacccaggcacattccgagaacaagtgctcaggcgcttcacagaagctaccgagaaagatggttgctatcgactgcgaaatggtcggcacaggcccaaaaggccacgtatccagcttggctcgatgctccattgtcaactataacggcgatgtcctctatgacgagtacattctgccgccatgccacattgttgactatcgcactcggtggtctgggatccgcaagcagcatatggtgaacgctaccccttttaagatcgcccgaggacaaatcttgaaaatactcaccggaaaaatagtagtgggccatgcgatccataacgatttcaaggcactccagtactttcatccaaagagtctcacacgcgatactagtcacattccacctttaaaccgcaaggccgattgccctgaaaacgcaacaatgagcctgaaacatctcacaaagaagctgctgaatcgtgatatccaggtcggcaagagcggacacagctctgttgaagatgctcaggcaacaatggagctgtacaagctcgtagaggtggaatgggaggaacacctagctcgcaacccacctactgattag

SEQ ID NO: 227068 - DNA, 1062 bp, Artificial Sequence
  Description of Artificial Sequence: Synthetic coding sequence
atgagcacactgttgctgaaccttgactttggggaacctcccccaaaaaaagcacttgaagggaacgcaaaacaccggaatttcgttaagaaaaggcggctgctggaacgacgcggattcctgtcgaaaaagaatcagccaccttcaaaggccccaaagctgcactctgaaccttcgaaaaagggagaaactcccacagttgacggcacctggaagaccccatccttcccaaagaagaaaaccgcagccagttcaaacggaagcggacagccactggataagaaggctgctgttagctggctgacccctgccccttctaagaaggctgactccgttgctgctaaggtagatctccttggcgagtttcaaagcgctttacccaaaattaacagtcaccccactaggtctcagaaaaaatcatcgcagaaaaaatcaagcaaaaagaaccatccacagaagaacgcaccacagaatagtacccaagcgcactctgagaacaagtgttccggggcatcccagaaacttccccgaaagatggtcgccatagactgcgagatggtaggtacaggccctaaggggcacgtaagctccctcgcacgttgcagcattgtgaattataacggggatgtcctctatgatgagtacatacttccaccctgccacattgttgattacagaacgaggtggagcgggatcaggaaacagcacatggtgaacgccactcccttcaaaatcgctcggggacaaatcctgaagattctgactgggaaaatagtggtgggacacgcgattcacaacgacttcaaggcgctgcagtattttcatcccaaaagcctgactcgggatacctcccatatcccccctctcaatcgcaaagcggactgcccagaaaatgcaacaatgtcactgaagcatctgactaaaaaacttctcaacagggatattcaggtcggcaagtctgggcactctagcgttgaagacgcgcaggcaacaatggaactgtataaactggtggaggtagagtgggaggaacatttggcgcgtaacccacctacagactag

SEQ ID NO: 227069 - DNA, 360 bp, Artificial Sequence
  Description of Artificial Sequence: Synthetic coding sequence
atggaggcctccgctttgacttctagcgctgtgacaagcgtcgctaaggtcgtgcgcgtcgcttctggcagtgctgtggtgctgcctctggctcggattgcaactgtagtcattggaggtgtcgtggccgtccctatggtcctgagtgctatgggattcaccgccgcaggaatcgcaagttcgtctatcgccgcaaaaatgatgtctgccgctgctatagccaacggcggaggggtggccagcggtagtctagtggcgaccctccagagcctgggtgcgaccggactcagtgggctcaccaaattcatcctgggctctattgggagcgctattgccgcagtgatcgctagattctattag

SEQ ID NO: 227070 - DNA, 369 bp, Artificial Sequence
  Description of Artificial Sequence: Synthetic coding sequence
atggaggcaagcgctctcacatcaagtgccgtcacctcagttgcgaaagttgttagagtcgccagcggttccgccgttgtgctgcccttggctaggattgcaaccgtagtgattggaggtggtgagtccgtggttgctgttccaatggtgctcagcgctatgggcttcaccgccgcaggaattgcatctagctccatcgcagcaaagatgatgagcgctgcggcaattgcaaatgggggtggtgtggctagtggatcactagtcgctaccttacagagcttaggcgcaacaggcctaagcgggctcactaagtttattttgggttccataggctccgcaattgcagcggtgatagccaggttttattag

SEQ ID NO: 227071 - DNA, 369 bp, Artificial Sequence
  Description of Artificial Sequence: Synthetic coding sequence
atggaggcctccgccctcactagctcagccgtaaccagcgttgctaaggtcgtgagagtagcatcagggtccgcagtagtactgccactcgctcgcattgcaaccgtggtcatcggaggtgtggcaagcatcgttgctgtgcccatggtgttgtcagctatgggttttacagccgctggtattgcgtcttcctcaatcgcggctaaaatgatgtctgctgccgctatcgccaacgggggtggtgtggcaagcggatcgttggtggccacgctccagagccttggcgcaaccggcctgtcagggctgaccaagtttattctgggctccataggctccgccatcgcagctgtcatcgcaaggttctactag

SEQ ID NO: 227072 - DNA, 189 bp, Artificial Sequence
  Description of Artificial Sequence: Synthetic coding sequence
atggaagcttcagcattgacctcctccgctgttaccagtgttgctaaggttgtccgcgtggcatccgggtccgctgtcgtgctgcctctggctagaatagcaactgtagtgatcggtggggtggtagccgttcccatggtcctgtctgccatgggtttcacagctgcgggtatcgcttctagctcctag

SEQ ID NO: 227073 - DNA, 174 bp, Artificial Sequence
  Description of Artificial Sequence: Synthetic coding sequence
atggaagccagcgcgctcacttctagcgccgttacctcagtggctaaggtggtgcgagttgcttctgggtccgccgtcgtcctgccactagctagaatcgctaccgtggtaatcggtggcgtggtggctgtcccaatggtgctctccgccatggggttcactgccgcagggtag

SEQ ID NO: 227074 - DNA, 360 bp, Artificial Sequence
  Description of Artificial Sequence: Synthetic coding sequence
atggaagcaagcgccttaacctcttcagcagtgacctctgtggccaaggtggtgagagttgccagtggctccgctgtggtgcttccccttgccaggatcgctaccgtagtcattggtggggtggtcgccgttccaatggtgcttagcgctatggggttcacagcagcaggaattgctagttccagcatagcagcgaaaatgatgagtgcagcagcaatagcgaatggtggcggtgtcgcctccggatcgctggtcgccacactgcaatctttaggtgccaccggcctttcagggctgactaaatttatcctggggagcatcggctcagccattgcagctgtaatcgccaggttttactag

SEQ ID NO: 227075 - DNA, 123 bp, Artificial Sequence
  Description of Artificial Sequence: Synthetic coding sequence
atggaggcgtctgcactgacaagctctgctgttacctccgtggcaaaagtggtgagggtggcaagcggatcagcggtggtgctgccgttggctcgaatcgcaacagtcgtcattggaggctag

SEQ ID NO: 227076 - DNA, 282 bp, Artificial Sequence
  Description of Artificial Sequence: Synthetic coding sequence
atggaagcctctgccttgacaagctcggctgtgacttctgtggccaaggtggtgcgagtagcttccggcagcgctgtggtactgcctctggccaggatagctaccgtggtgatagggggagtcgtggctgtgcctatggtgcttagtgctatggggttcaccgccgcaggaatcgccagcagtagcattgccgctaagatgatgagcgcagctgccatagcgaatggcggaggagtggcctcaggttctttagtggccacactgcagtcacttggagcctag

SEQ ID NO: 227077 - DNA, 2358 bp, Artificial Sequence
  Description of Artificial Sequence: Synthetic coding sequence
atggggaaaaaatacaagaatattgttctcctcaaaggcctagaggtgattaacgactaccatttcagaatggtgaagtccctcctgtctaacgacttgaaactgaatctgaagatgagggaagagtatgataagatacaaatcgctgatctgatggaagaaaagttccgcggagatgctggcttaggaaagctcatcaagatttttgaagatatcccaacactggaggacctggctgagaccctcaaaaaagagaaattaaaggtcaaaggcccagctctctctcggaagagaaagaaagaagttgacgccactagccccgcaccctccacctccagcactgtgaagacggaaggggcagaagctacgccaggggcacagaagagaaaaaagtccactaaagaaaaggcgggtcccaagggaagcaaagtttctgaagagcagactcagcccccatcacccgctggtgccggaatgagcaccgccatgggcagatctccgtcccccaaaacctccctttctgccccaccaaattcatcatcgaccgagaatcctaaaaccgtggctaagtgccaggtcactcctcggcgtaatgtattgcagaaaaggcccgtgatcgtcaaggtgttatctaccacaaaaccctttgagtacgaaactcccgagatggagaagaaaatcatgttccacgcaacagtggcgacccagactcagttttttcacgtaaaagttctgaatacatcgctcaaggaaaagttcaacggcaaaaagattatcattatctcagattacctggagtacgattccctccttgaagttaatgaggagagcacagtctctgaggccggacctaatcagacttttgaggttccaaacaaaattattaaccgcgctaaggaaaccttgaaaattgatatcctccacaagcaagcctctggcaatattgtgtacggcgtgtttatgttgcacaaaaagaccgtaaatcaaaaaacaaccatatacgagatccaagacgacagaggtaagatggatgtagtcgggaccgggcaatgccacaacattccctgtgaggagggcgacaagttgcagttgttctgtttcagacttagaaagaaaaaccagatgtccaagctcatctccgagatgcactcttttatccagatcaagaagaagacaaatccaagaaataatgatcctaagagcatgaagcttccacaggagcaacgccagctgccctacccatctgaggcttccactaccttcccagagagccatttgcggacccctcaaatgccccctactacccccagttcttcctttttcaccaaaaaatccgaggacacaatttcgaaaatgaatgacttcatgagaatgcaaatcctaaaagaggggtctcatttccccggacccttcatgacaagcatcgggccagctgaatcgcacccccatactcctcagatgcccccatcgaccccctcaagctcatttctgacgaccaagagcgaagacaccatctccaaaatgaacgatttcatgcggatgcaaatcctaaaggaaggcagccactttccgggtcctttcatgactagcattggacctgcagagtctcatccacatactcctcaaatgcctcccagcacaccatcctccagtttcctgaccaccctgaaaccgagactcaagactgaaccggaagaggtgtcaattgaggactcggctcaatcggatcttaaagaggtgatggtgctgaatgccactgagagcttcgtgtacgaacccaaagagcagaagaagatgtttcacgctacggtggccacagagaacgaggtgtttcgggttaaggtcttcaacatcgatctcaaagagaagttcacacctaaaaaaatcatcgccattgcaaactatgtctgccggaacggctttctggaggtttacccctttacgctggtggcagacgtcaacgctgaccgcaacatggaaattcctaagggccttatcagatctgcctccgtgactcctaagatcaatcagctgtgtagccaaactaagggaagtttcgtgaatggcgtcttcgaagtgcacaaaaagaacgtgagaggtgagttcacttattacgagattcaagataacaccgggaagatggaggtggtagtacatggtcgactcacaacaataaactgcgaagagggggacaagctcaagcttacatgcttcgaactcgctcccaagtctggcaatacaggagagctgcgttctgtcattcacagccatataaaagttattaagacacgaaagaacaaaaaggatattttaaatcctgattcatccatggaaactagccctgactttttcttctag

SEQ ID NO: 227078 - DNA, 2022 bp, Artificial Sequence
  Description of Artificial Sequence: Synthetic coding sequence
atgggaaagaagtacaaaaacattgtgctcctgaagggactggaggtcatcaatgattaccactttaggatggtcaagtctctcctgtccaacgatctgaagttgaatctgaagatgagggaagagtatgataaaatccagatcgcagatctgatggaagaaaaattcagaggggacgccggtctggggaagcttattaagattttcgaggacatcccgaccctcgaggacctggctgaaactcttaagaaagaaaagctgaaagttaagggtcctgccctgtcacgcaaaaggaaaaaggaagtcgacgctacaagcccggcaccatccacatctagtacagtaaagactgaaggggctgaagccacacctggcgctcagaaaaggaaaaagtctacaaaggagaaagccggaccgaagggaagcaaagtatccgaagagcagacccagccacctagtcccgctggagcaggcatgagcacggccatggggaggtctccctcccctaagacctccctcagcgctccaccgaattcctcgagcacagagaaccctaagacagttgctaagtgtcaagtcacccctaggcgcaacgtattacagaagcgtcccgttattgtaaaggtgctctctacgacaaagccgttcgagtatgagaccccagagatggaaaagaaaattatgttccatgcaaccgtggctacccagacgcaatttttccacgtcaaggtcctgaacacctccctcaaggaaaaattcaatggaaagaagatcattattatctccgattatctggaatatgatagcctcctcgaagtgaatgaagagagcactgttagtgaagcaggtcctaatcagacgttcgaagtaccaaacaagatcataaatagagccaaggagacattgaaaattgacattctgcacaaacaggctagcggtaacatagtatacggagtgttcatgcttcacaaaaagacggtgaatcagaagaccaccatctacgaaattcaggatgacaggggcaagatggatgtggtgggcacagggcagtgtcataacatcccctgtgaagagggagacaagctccagctgttctgtttcaggctgcgcaaaaaaaatcagatgtcaaaactgatcagtgaaatgcacagctttatccagattaagaagaaaaccaacccccgtaacaacgatccgaagtctatgaagcttcctcaagagcagagacaactcccataccccagtgaggcgtcaaccacgttccccgaatcccacttgcgcactccacagatgccccctacaacacctagttcctcattcttcacgaaactgaaaccaaggttaaagacagagcccgaagaagtgtccatcgaggactctgcacagtccgacttgaaggaggtgatggtcctcaacgccactgaatcattcgtatacgaacctaaggagcaaaaaaaaatgtttcatgccaccgttgccacggagaatgaggtgttccgcgtcaaggtgttcaacattgatctgaaagagaagttcacacccaaaaaaattatagctatcgctaactatgtctgcagaaacggattcctggaggtgtacccatttacccttgtagcagacgtgaacgccgacagaaatatggagattccgaaaggacttatcagatcggcatcagtgacgcctaagatcaatcagctgtgttctcaaacaaagggaagttttgtgaacggagtctttgaggtccataagaaaaacgtgcgcggagagtttacctattacgagatccaggacaacaccggcaagatggaggtcgtggttcacgggaggcttaccaccataaactgcgaggagggagacaagctaaagctcacatgcttcgagctcgcaccaaaatctggaaacacgggagaactcaggtctgttatccactctcatattaaagtgattaaaacacgcaagaacaagaaggacatcctgaacccagatagtagtatggagacctcccccgacttctttttctag

SEQ ID NO: 227079 - DNA, 1245 bp, Artificial Sequence
  Description of Artificial Sequence: Synthetic coding sequence
atgggcaagaagtataaaaatatcgtgctgttgaaagggctggaagtgatcaatgactatcatttccgaatggtgaaatctcttttgtcaaatgacctgaaactgaacctgaagatgcgcgaggaatatgataaaattcagattgccgacttaatggaagaaaagttccggggtgacgcagggctcgggaaattaataaaaatctttgaggatattcccactctcgaggacctggccgaaacattgaagaaggaaaagttaaaagttaaggggccagccctgagccggaaacgtaaaaaagaagtggatgctactagtcctgccccatctacatcttccaccgtcaaaactgagggagctgaggctacccccggtgcccagaagcggaaaaagtctacaaaagaaaaggctggtcctaagggcagcaaggtgtctgaggaacaaactcagccaccgtctccagcaggtgcgggtatgtctacagccatgggccgaagtccctccccgaagacaagtctctctgctccccctaactctagcagtactgagaacccaaagacagtcgctaagtgtcaggtaacccctagacgaaatgtgctgcaaaagagacctgttatcgtaaaagtactatcgactacaaaaccctttgagtacgagactccggaaatggagaaaaagattatgttccacgctacagtcgccacccagacccagttttttcacgtgaaggttctcaacacatcattaaaggaaaagttcaccccgaagaagatcattgccatcgcaaattacgtgtgccgcaatgggtttttagaagtgtatccattcacactggtggccgatgtcaacgccgatcggaacatggaaatccccaagggactgattaggagcgccagcgtgacgcctaaaatcaatcagctctgttctcagactaagggaagcttcgttaatggcgtctttgaggtgcataaaaagaatgtgagaggggagtttacgtattacgagattcaagacaatactgggaagatggaggtagttgtccacgggcgactcactaccattaattgcgaagagggagataagcttaagctgacttgcttcgagctggccccaaagagcggcaacaccggggaattacggagtgtcatccactctcacattaaagtaatcaagacccgcaagaacaaaaaggacatacttaatcccgactcttctatggaaacgtcaccagacttcttcttttag

SEQ ID NO: 227080 - DNA, 2190 bp, Artificial Sequence
  Description of Artificial Sequence: Synthetic coding sequence
atgggcaagaagtacaagaacatcgtgttactgaagggacttgaggtaatcaacgactaccattttagaatggttaaatcgctgctgtcaaacgatttgaaactgaacctgaagatgcgcgaggagtacgataagatccagattgctgacctgatggaggaaaagtttcggggtgatgctggcttgggtaagctgatcaaaatatttgaggacataccgacacttgaggacctcgctgagacactgaagaaggaaaagctcaaggtgaagggacctgcacttagtaggaaaagaaagaaagaagtggatgctacatcacccgctccatcaacatcttcaactgtgaaaactgagggggctgaagcgacccccggagcgcagaagaggaagaagagcacaaaagagaaagcgggacctaagggttccaaggtttcagaggagcagacccaacccccaagtcctgcaggcgcagggatgtccaccgctatggggaggagccccagccctaaaacctcactgtctgctccccctaacagctccagtaccgagaacccaaagaccgtagctaagtgccaggtgaccccacgcagaaatgtactccagaagcggcctgttattgtgaaagtgctgtccacgacaaagccgtttgaatacgagactcccgaaatggagaagaagattatgtttcatgctaccgtcgccacccagacacaattctttcacgtgaaggtattgaacacctccctgaaggaaaaatttaatggaaagaagattatcatcatctccgattaccttgaatacgacagtctcttggaagtaaatgaagagtcaactgtctccgaagccggtcccaatcagacgtttgaagtcccaaacaagattatcaatcgtgcgaaggaaaccctgaagatcgacatcctccataaacaagcatccgggaacatcgtgtacggagtcttcatgctccacaaaaagacagtgaatcaaaagaccacgatctatgagatacaagacgacagggggaaaatggacgtggtgggaactgggcaatgccataacattccttgtgaagagggggataagctgcagttgttttgcttcaggctacgcaaaaagaaccagatgtcaaagctgatctcagagatgcactctttcatccagataaaaaaaaaaaccaaccccaggaacaatgacccaaagtctatgaaactgccacaggagcagcgccagttgccttatcccagtgaagcaagcactacctttccagagagccacctgaggaccccccagatgcccccaacaacgccatcatcatccttttttactaaaaagtcggaggacacgatctcaaaaatgaatgacttcatgagaatgcaaatcctcaaagagggatctcacttcccgggacctttcatgacctccatcggccctgctgagtcgcacccacacaccccgcagatgcccccttcaacgcctagcagcagctttctgaccactctgaaaccccgtctgaaaaccgagcctgaggaggtatccatcgaggactcggcccaatctgatcttaaagaggttatggtgctcaacgctaccgaatcatttgtctacgaacctaaagagcaaaaaaagatgtttcacgcaacagtagcgacggagaacgaagtgttccgagttaaggtgtttaacatagatctgaaggagaagtttacaccgaaaaaaatcatcgcgattgctaactatgtatgcagaaacggctttctggaagtatacccatttaccctggtggccgacgtaaacgcggataggaatatggagatacctaaaggcctcatccgaagcgcttcagtcacacctaaaataaaccaactctgctctcagaccaagggaagctttgtcaatggtgtgtttgaggtgcacaagaaaaacgttcggggtgaattcacttattacgagatccaggataacaccgggaaaatggaggtcgtcgtgcatgggcgactgaccactattaattgcgaggaaggtgacaagctgaaattgacctgttttgagctagcaccaaaaagcggtaacactggcgagttgcggagcgtcatacatagtcacattaaagtcatcaagaccaggaagaacaaaaaggatattctgaatcccgacagctccatggaaacttctccagactttttcttctag

SEQ ID NO: 227081 - DNA, 2190 bp, Artificial Sequence
  Description of Artificial Sequence: Synthetic coding sequence
atgggcaagaaatacaaaaacatcgtgctcctgaaggggctggaagtcatcaatgactaccactttcgaatggtgaaatcccttctgagtaatgaccttaaattgaacctgaaaatgcgggaggaatacgataagatccagattgccgatctgatggaagagaagttccggggtgacgccggactggggaaactcatcaaaatctttgaagacattccaactcttgaggacctggccgagacattgaagaaggagaaattgaaagtgaaaggcccagccctgagtagaaagagaaaaaaggaggttgacgcgacgtcaccggcaccctcaactagctcgacagtgaagacagaaggtgcagaagcgaccccgggagcacaaaaacggaagaaaagtactaaagaaaaggccggaccaaaaggttcgaaggtgagcgaagagcaaacccagcccccatctccagccggagcgggaatgagcactgccatggggcgatcaccttcacctaaaactagtctgtcagcacctcctaatagctcttcaacagagaacccaaagacggtggcaaaatgtcaagtgacccccagaagaaacgtgttacaaaagcgcccagtgattgttaaggtactctccaccactaagcctttcgagtatgagactcccgaaatggagaaaaaaatcatgttccatgccactgtcgctactcagacacagtttttccacgtaaaggtgctgaatactagcctgaaagaaaaatttaatggcaaaaagattatcattattagtgactatcttgaatatgacagtctgctcgaggtgaacgaagaatcaactgtttccgaagccggacccaatcagacttttgaagttccaaataaaattataaatcgcgctaaagagacactcaaaattgatattctgcacaaacaggcctctggcaatatcgtttatggcgtgttcatgctccacaagaagaccgtgaaccagaagactaccatctatgagatccaggatgataggggcaagatggacgttgttggaacaggacagtgtcataatataccctgcgaggagggcgacaaactccagctgttctgcttcaggctgaggaaaaagaatcaaatgtcaaagttgatcagcgagatgcattcatttatccaaattaaaaaaaaaacgaaccctaggaataatgaccccaagtccatgaaactcccccaggagcagcgacaactgccttatcctagtgaggcatctaccacttttcctgagtcccatctgcgaactccccaaatgcctcctacgacccctagcagctcattcttcacaaagaaaagcgaggacacgataagcaagatgaatgactttatgcgcatgcagatcctcaaggagggcagtcatttccctggcccttttatgacaagtatcgggccagctgagtcacatcctcatactccacaaatgcctccctccactccctcatcaagctttttaacgactttaaagccaagattaaaaaccgaaccggaggaggtgtctattgaggacagcgcccagtcagacctgaaggaagtgatggtgctgaacgccacagaaagttttgtttatgaacccaaagagcagaagaagatgttccatgccacggtagccaccgaaaacgaggtcttcagagtcaaggtcttcaacatcgatctgaaggagaaatttacccctaaaaagattatagccattgccaactacgtgtgtcgtaatggctttcttgaggtctacccattcaccctagttgcagacgtcaatgcagaccggaacatggagatccctaagggcttgattagaagtgcctcggtcacgcctaagatcaaccagctttgctctcaaacaaaaggcagttttgtgaatggcgtctttgaggtgcataagaagaacgtaaggggcgagttcacctattatgagattcaagacaacacaggcaaaatggaggttgtggtgcacgggaggctaaccacaatcaactgtgaagaaggagataagctcaaactgacttgctttgagcttgccccaaagagtggcaacaccggcgaacttaggtctgtgattcattcacacattaaagttattaagactcggaaaaacaagaaggatattctaaatcccgacagctcgatggagacgtccccggatttctttttttag

SEQ ID NO: 227082 - DNA, 384 bp, Artificial Sequence
  Description of Artificial Sequence: Synthetic coding sequence
atgggcaagaagtacaaaaacattgtgctcttaaagggacttgaagtcatcaacgactatcatttccggatggtgaagagtctccttagcaacgacctgaagctgaatctgaagatgcgggaggagtacgataaaattcagatcgccgatttaatggaggaaaaatttaggggagacgccggtctgggcaagttgattaagattttcgaagacatcccgacattagaggacctggccgagacactgaagaaggagaaacttaaagttaaaggtcctgcgctgtccagaaagcgtaagaaagaagtggacgcaactagtccagcgccaagcacctcatccaccgtgaagactgagggtgccgaagcgacaccgggagctcagtag

SEQ ID NO: 227083 - DNA, 2202 bp, Artificial Sequence
  Description of Artificial Sequence: Synthetic coding sequence
atgtccgtgaagatgggcaaaaagtataagaacatagttctgctgaagggtctggaggtgatcaacgattatcatttcaggatggtcaaaagccttctttctaatgacctgaaactcaaccttaagatgagggaggagtatgataaaatccagattgcagacctgatggaggagaaattcagaggcgacgccggactcgggaagctaattaagattttcgaagatatccccaccttggaggacctggcagaaactttgaagaaggaaaagctgaaagttaaaggtcccgctttaagtagaaagcgcaagaaagaagtagacgctacaagtccagcccctagtaccagctcaacggtaaagactgagggcgctgaggctactcccggtgcccagaacccgaaaaccgtcgctaagtgtcaggtgacacctcgcaggaacgtgctccaaaaacgtcccgtgatagtgaaggtgctctcaacgaccaaacctttcgagtatgagaccccagagatggaaaaaaagataatgtttcatgccacagtggctactcagactcagttctttcatgtgaaggtcctcaatacaagtcttaaagaaaagttcaatggcaagaaaattatcattatatcagactatctcgagtacgactcattgctcgaagtgaatgaagagtcgaccgtgtcagaagccggaccaaatcagaccttcgaggtgcctaataaaatcattaatcgggcaaaagagactctaaaaattgatatcctgcataagcaggcatctgggaatatcgtttatggagtctttatgctgcacaaaaaaactgttaaccagaagaccacaatttatgaaatccaggatgatcgcggaaagatggacgtcgtgggcaccgggcagtgccacaatatcccctgcgaagagggcgataagctacagttgttctgtttccgcttgaggaaaaaaaatcagatgtctaagctgatttcagagatgcatagttttattcagatcaagaaaaagaccaaccccagaaataatgatccaaaaagcatgaagctgcctcaggaacagagacagctcccctacccatccgaggcatccactacctttccggagagtcatctccgcactccccagatgccgcctaccacaccatccagctcgtttttcaccaagaagagcgaggatacgatctccaaaatgaacgactttatgagaatgcagatcctgaaagaggggtcccactttcctggccctttcatgacaagcataggccctgcagaaagccatccacatactcctcagatgccaccatctacaccctcgtccagcttcctcaccaccaagtctgaggatacaatatctaaaatgaacgactttatgaggatgcagattctgaaggagggctcccacttcccaggaccgttcatgacttccattgggccagcagagagccacccacacactcctcagatgccccctagcacccccagctccagctttttgaccacccttaagcccaggttgaagacagaaccagaggaagtaagcattgaggacagtgcacagtcggatctgaaagaagtgatggtcttgaatgccaccgagtcttttgtgtatgaacctaaggagcaaaagaagatgttccatgccaccgtggcgaccgagaacgaggtcttcagagtgaaagtttttaatatcgatctgaaagagaagttcacccctaagaaaattatcgccatcgcaaactacgtctgtcggaatggctttctcgaggtctacccatttaccctcgttgccgacgttaatgccgacagaaacatggagattccaaaggggctgattcgtagcgcgtctgtgaccccaaaaataaaccagctgtgtagccagactaagggatcctttgttaatggcgtttttgaggtacataagaagaacgtgcgcggagaatttacatactacgagattcaagacaatacagggaagatggaagtggtggtccatgggaggctaacaaccataaactgcgaggagggagataaactgaagctgacctgtttcgagctcgctccaaaatctggcaataccggggagctccggagtgttattcacagccacatcaaggtgatcaagacacgcaaaaataaaaaggatattctcaaccccgattcctctatggagacttctcctgacttctttttctag

SEQ ID NO: 227084 - DNA, 543 bp, Artificial Sequence
  Description of Artificial Sequence: Synthetic coding sequence
atgggcaagaagtataagaatatcgtgctactgaagggtctggaggtcatcaatgactatcactttcgcatggtcaaatcacttttgtcgaatgacctgaagctgaatttgaaaatgcgcgaggagtacgataagatacagattgccgacctgatggaggaaaaattcagaggcgatgcagggcttggcaagctgatcaagatctttgaagatatccccacacttgaggatttagccgaaacactaaagaaagaaaagttaaaagtgaaaggcccagccctatcacgtaagagaaagaaggaggtggacgctactagtcctgcccctagcacaagctccactgtgaagactgagggagcagaggctacccctggcgctcagaagcggaaaaaaagtactaaagaaaaagctgggcctaaaggctccaaggtgtccgaagaacagacccagccaccttcacccgcaggggcaggcatgtccacggcaatgggcagatccccttctccaaaaacatcactgtcagctcccccaaatagcagctag

SEQ ID NO: 227085 - DNA, 1485 bp, Artificial Sequence
  Description of Artificial Sequence: Synthetic coding sequence
taaagcaccgagaatccaaagaccgtcgcaaaatgtcaggtcacccctagacgcaacgtcctgcagaaacgtcctgttatcgtcaaggtgctctcaacaaccaagccgttcgagtatgaaactccggagatggaaaaaaaaataatgttccacgcgacagtagccactcagacccagttttttcacgtgaaggtgctcaatactagcctgaaagagaagtttaacgggaagaaaataattatcatctcagactatttggaatacgactcactgcttgaggtgaacgaggagtcgaccgtcagcgaggcagggcctaatcagacttttgaggttcccaacaaaatcataaaccgtgcgaaggagacacttaagatcgatatcctgcacaaacaagcaagtggaaacatcgtctatggcgtgtttatgctgcacaagaaaaccgttaaccagaagaccactatctatgagatccaggacgatcggggaaagatggacgtggtagggacagggcagtgccacaacattccatgcgaggagggggacaagcttcagttgttctgctttcgactgagaaagaagaatcagatgtctaagcttattagtgagatgcactccttcatccagattaagaagaaaaccaaccccaggaataacgaccctaagtctatgaagctgccacaagaacagaggcaactgccctatccttctgaggcttcaactactttcccggaaagtcacttgagaacccctcagatgcccccaaccactccctcatcaagtttttttacaaagctcaaaccaagactcaaaactgaacctgaagaggtcagcatcgaagacagcgcccagagcgatctcaaagaggtgatggtgctaaatgccaccgagagctttgtgtatgagcccaaggagcagaaaaagatgttccatgccacggtggctaccgagaatgaggttttcagggttaaagttttcaacatcgatctgaaggagaaatttacccctaaaaagatcattgcaattgcgaattacgtctgccgcaatggattcctggaggtgtacccattcaccctcgtggcggacgtgaatgctgacagaaacatggaaatccccaaaggcctcattcggagcgcctctgtcacacctaagatcaaccagttgtgttcacagacaaagggcagtttcgtcaatggagtattcgaagttcataaaaaaaatgttaggggcgaattcacttactatgagatccaagacaacacgggtaaaatggaggttgttgttcatgggagattgacaacgatcaattgcgaggagggggataaattaaagctcacatgcttcgaactggctcctaagagtgggaacaccggcgaacttaggtccgtgattcattctcatattaaagttatcaaaacccggaaaaacaagaaggatatcctgaatccagacagcagtatggagacatctcccgacttcttcttctag

SEQ ID NO: 227086 - DNA, 753 bp, Artificial Sequence
  Description of Artificial Sequence: Synthetic coding sequence
atgacgctttccccactcctcctttttttgccaccacttctgttgctgctggacgtgcctaccgccgctgtccaggcctcacccctgcaggcactggacttctttggcaatggtcctcctgtcaactataagaccgggaatctatacctgaggggacctcttaagaaatctaatgcaccacttgtgaacgtgaccctgtactatgaagccttgtgcggcggatgcagggcatttctaattcgggaattgttcccgacatggctgcttgtgatggaaatcctcaacgtgaccctggtgccttacgggaatgctcaagagcagaacgtctctgggcgatgggagttcaagtgccagcacggcgaggaggagtgcaagtttaataaggtggaggcttgcgtattggacgaactggacatggagctggccttcctgactatagtgtgcatggaagagttcgaagacatggagcgctccctgcccttatgtttgcagttgtatgccccaggattatctccggatacaattatggagtgcgccatgggcgaccggggtatgcaacttatgcacgctaacgcacagcgtacagatgcactgcaaccaccccatgagtacgtgccttgggtcaccgtcaatgggaagccgctggaagaccagacacaactcctgacccttgtgtgccagctttaccagggaaagaagcccgacgtgtgtccttcgagcacgagctctctgagaagtgtctgcttcaaatag

SEQ ID NO: 227087 - DNA, 588 bp, Artificial Sequence
  Description of Artificial Sequence: Synthetic coding sequence
atggcacttttgttcccactcctcgccgctctggtgatgacctcttacagccctgttggaagccttggctgcgatctaccacagaaccatggattactctctcgtaatacactggtcctccttcaccagatgcgccgaatcagtcctttcttgtgcctgaaggatcgtcgggatttccgctttccccaggagatggttaaaggcagtcagctgcaaaaagcacacgtgatgtcagttctccacgagatgctgcagcagatcttctccttgtttcacacagagcgaagctctgccgcttggaacatgacactgctagaccagttgcataccgggttacaccaacagttacagcacctggagacctgcctactccaggtggtgggcgaaggtgaaagtgccggagcaattagttctcccgcattgacactcagacgatactttcagggcatcagagtctatctgaaggaaaagaaatattctgattgtgcgtgggaggtcgtgcggatggagattatgaagtcactgttcttatccacaaacatgcaggaacggcttagatcgaaagaccgcgatttaggctcgtcttag

SEQ ID NO: 227088 - DNA, 861 bp, Artificial Sequence
  Description of Artificial Sequence: Synthetic coding sequence
atgtccgctcccctcgacgctgccctacacgcactccaggaagaacaggctcgcctgaaaatgagactctgggacctccagcaactcaggaaagaattgggggactctccgaaagacaaagtgcctttttcggtgcctaagatcccactggtcttccggggacacacgcagcaggatcctgaggttcccaagtccctggtcagcaatctccggatccactgtcccctcctggcaggcagcgccttgattacctttgatgatccaaaggtagctgaacaagtgctgcagcaaaaagaacacacaatcaatatggaagagtgtaggctccgggttcaggtgcagccactcgaactgcccatggtcacaacaatccaaatgtcctcccaactttcgggccgacgtgtactggtcacaggattcccagcgagcctgcggctgagcgaggaggagttgttggacaagctggaaatcttttttggaaagaccagaaacggaggcggagacgtggatgtgagggagctcctgccaggaagcgtgatgctggggtttgccagagatggtgtcgctcagcgcttgtgccagatcggtcagttcacagtcccacttggcggacagcaggtgcccctgagggttagtccctatgtgaatggcgagatccagaaggctgaaattaggagccaacccgtaccaaggagcgttctcgtgctgaacatcccagacattctggacggccctgagctccatgatgtcctggaaatccactttcaaaaacccacacgcggtggaggcgaagtagaggctttgaccgtggtacctcagggccagcaaggcttagccgtgtttaccagcgaatctggctag

SEQ ID NO: 227089 - DNA, 867 bp, Artificial Sequence
  Description of Artificial Sequence: Synthetic coding sequence
atgtctgcccctctggacgctgccttgcacgccttgcaggaggagcaggcccgactcaagatgagactgtgggatcttcagcagctgcgaaaggaacttggggattctcccaaggacaaggtacctttcagcgttcccaagataccactggtgtttagggggcatacgcagcaggatccagaagtgccaaaatctctcgtcagcaaccttcggatccattgcccgctgctcgctggctcagccctcatcacgttcgacgaccctaaagtggccgagcaggtgctgcagcagaaagagcacacaattaacatggaagagtgtaggctacgagtccaggtgcaaccactggaactgcccatggtcactacgattcaagtcatgatgtctagtcagctctcgggacggagggtgctggtgactggctttcctgcgtccctgaggctgagcgaagaagagctgctcgacaaacttgagatcttctttgggaaaacccgtaacgggggaggagatgtggacgtgcgggagctgctccctggttctgtaatgttagggttcgctagggacggtgtcgcccaaagactgtgccaaattgggcagtttacggtgccactcgggggacagcaagtgccgctgcgagtgtcaccctacgtgaatggtgaaattcagaaggccgagatccggtctcaacctgtgcccaggagcgtgctagtgctgaatattcccgacattttggacggcccagagttacacgacgtgttggagattcatttccagaaacctacacgtgggggaggcgaggtcgaggctttgacagtcgtcccccaaggccagcagggcttagcggtgttcacaagcgagtctggttag

SEQ ID NO: 227090 - DNA, 1335 bp, Artificial Sequence
  Description of Artificial Sequence: Synthetic coding sequence
atggccgtgacaaccagactgacctggctgcacgagaagatcctacagaatcatttcggaggtaagaggctcagtctgctgtataaggggagcgtccacggattcagaaatggggtcctcctcgatagatgttgtaatcaaggacccacgctcactgtgatatattccgaggaccacataatcggggcatatgctgaggagtcttaccaagaaggtaagtatgcgagtatcatccttttcgcccttcaagatactaaaatctccgagtggaagctggggttgtgcacacccgagactctattctgctgtgacgtgaccaaatataactcacccacaaactttcagattgatggacgaaataggaaagtaatcatggaccttaagacaatggagaaccttggtctcgcgcagaactgtacaatctcaattcaggattatgaagtctttcgatgcgaagatagcttagacgagagaaaaatcaaaggggtcatcgaactgcggaagtctctcttatccgcgctccgcacctacgaaccctatggaagtctcgtccagcagatcagaatcctgctcctcggtccaattggcgcaggcaaaagctccttcttcaactccgttaggtcggtttttcagggccatgtgacccatcaggcattggtgggcaccaacaccactggaatctcggagaaatacagaacatacagcatcagggacggtaaagatgggaagtatttgccatttatcctgtgcgacagtctcgggcttagcgagaaggaaggagggctctgtagggacgacatcttctacatcctgaacgggaacatccgggatcgataccagttcaatcccatggaaagcatcaaattgaaccaccacgattatattgacagccccagcctgaaagaccgcattcattgtgtcgcctttgtgtttgacgcctcttctatacagtatttttcctcacagatgatcgtgaaaatcaagaggattcgcagggaattagtaaacgccggtgtggttcacgtggctctacttacccatgtggactctatggacctgattaccaaaggagacctgatcgagatcgagcgctgcgagcccgtgagaagtaagctggaggaagtgcagcgaaagttgggtttcgccctctctgacatatctgtcgtaagcaactatagcagtgaatgggagcttgatccggtaaaagatgtcctcatcctgtctgccctaagacggatgctgtgggccgcagacgacttcttggaagacctgccatttgagcagattggaaatcttcgcgaggaaatcattaactgtgcacaggggaagaaatag

SEQ ID NO: 227091 - DNA, 588 bp, Artificial Sequence
  Description of Artificial Sequence: Synthetic coding sequence
atggatcttaaaacgatggaaaatctgggcctggcccaaaactgcactatctcgatacaagattatgaggtgttccgctgtgaggattctttggacgagaggaaaataaaaggtgtgattgagctccgtaagtcgctgctaagtgcccttaggacctacgaaccctacggatccctggtccagcagatcaggattctattactgggcccaataggggctggcaagtcctcattcttcaattccgtgcgaagcgtatttcagggtcatgtgactcaccaggctctggtaggcacaaacacgaccgggatcagcgaaaagtaccgaacgtatagcatccgtgacgggaaggacgggaagtaccttccttttattctctgtgactccttgggactgtcagagaaggaagggggtctctgtcgggatgacatcttctacatcctgaacggcaatattcgtgatcgctaccaattcaaccctatggagtctatcaagttaaatcaccatgactacattgacagcccctcactgaaagaccgcatccattgcgtggctttcgtgtttgacgctagcagtatacagtacttctag

SEQ ID NO: 227092 - DNA, 231 bp, Artificial Sequence
  Description of Artificial Sequence: Synthetic coding sequence
taactcagtgatatttccgtggtctctaactactctagcgaatgggagctggatcctgtcaaagatgtacttatcctctccgcactgcggagaatgctgtgggcagccgatgattttctggaggacctgccctttgaacagattgggcgttggttcggcggtgtggaggcctggaaacgttctggcaatctaagagaggaaattatcaattgcgcccaggggaagaagtag

SEQ ID NO: 227093 - DNA, 390 bp, Artificial Sequence
  Description of Artificial Sequence: Synthetic coding sequence
atggaatctatcaagctgaaccaccatgactacattgactcccctagtctgaaggaccgaatacattgtgttgcgtttgtctttgacgctagctctatccagtactttagttctcagatgatcgttaaaatcaagagaataaggcgcgagcttgtaaatgcaggggtagtgcatgtggcactgctgacacacgttgactccatggatctgataaccaaaggtgatctgattgagattgagagatgtgagcctgtcagatctaaagtcatgaacgatgcccttaggaagcatattttctggggaatgcttctgcaatcccatacatctgtgtataaaaacaaaaacaagcagctgctgggattgcgcaggattactaaattactaaagtag

SEQ ID NO: 227094 - DNA, 585 bp, Artificial Sequence
  Description of Artificial Sequence: Synthetic coding sequence
atgctgtgcgatacaatgggcctcgacggggctgaaggggctggtctgtgcatggatgacattcctcacatactgaaaggatgtatgcctgacaggtaccagtttaactcacgcaagcctatcaccccagagcacagcacattcattacctccccatctctgaaggaccggatccactgcgttgcctatgtgctggatatcaattccatcgacaacctatattcaaaaatgttggcaaaggttaagcaggtgcacaaagaggtgttgaactgcggcattgcttatgtcgccttgttaaccaaggtggacgactgttcagaggtgttgcaggataatttcttgaacatgtcccgctccatgacgagccagagccgggtcatgaacgtccataaaatgttgggtattccgatttcaaacatcctgatggtcgggaattacgccagtgatctcgaattagatccgatgaaggacattctgatcctttcagctttacgccaaatgctccgtgcagctgatgactttttagaagatctgcctctggaggagactggcgcaatcgaacgggcacttcaaccctgcatttag

SEQ ID NO: 227095 - DNA, 1359 bp, Artificial Sequence
  Description of Artificial Sequence: Synthetic coding sequence
atggaggtgaccaccagattgacctggaatgacgagaaccaccttagaaagctgctcgggaacgttagcttgagcctactctacaagagttctgttcacgggggatcaatcgaggacatggtggaaaggtgcagccgacaaggatgcaccattaccatggcctacatcgactataatatgattgtcgctttcatgctaggtaattatatcaacttgcatgagagctcgactgaacccaatgatagcctatggttcagcctccagaaaaaaaatgatactacggagattgagactctgctgcttaacactgctcctaaaattatcgatgaacagctcgtgtgtcgcctttcaaaaactgacatcttcatcatttgccgggacaacaaaatctatctagacaaaatgatcacgcgaaatcttaaattaagattctacgggcacagacaatatcttgagtgtgaggtctttcgcgttgaaggaattaaagataacctggacgacatcaagcgcatcattaaggcacgcgaacaccgcaatcgacttcttgccgatatcagagactatagaccatatgcagacctggtgtcggagattaggatcctgctagtcggccctgttggatctggtaaatcctccttttttaattcagttaaaagtatattccatggccacgtgacaggccaagcagtggtaggcagcgatattactagtatcactgagagatatagaatatattctgtgaaagacggcaagaatggaaagagtcttccctttatgctctgcgatacgatggggcttgatggagccgagggagctggtttatgcatggacgacatcccacacatattgaagggctgcatgcccgatagatatcagtttaattcacgcaagcccatcactcccgagcattcaacgtttatcacttcgccatcgctgaaggatagaatccactgtgtggcttacgttcttgatatcaatagcattgacaatctgtatagtaaaatgctcgcgaaagtgaagcaggtacataaagaggtgctgaactgtggcatagcctatgtcgccctactgacaaaagttgacgactgttctgaagtactccaggacaacttcttgaacatgagccgttccatgacctcccagtctcgggtcatgaacgtgcacaagatgctggggatccctatctccaacatcctgatggttgggaattacgcatccgatcttgaactcgaccctatgaaggacatactcatcctatcggcactgcgacaaatgttgcgggcagctgatgattttttggaagatctcccgcttgaagagaccggggctatcgagagagcgctccagccctgcatctag

SEQ ID NO: 227096 - DNA, 294 bp, Artificial Sequence
  Description of Artificial Sequence: Synthetic coding sequence
atggaggtcacaacacgcctaacttggaacgacgagaaccacctgaggaagcttttgggcaacgtgagtctgtccctgctgtataagtcaagcgtgcacgggggatccattgaggatatggtagagcggtgttccaggcaaggctgcacaattactatggcatatatcgactacaatatgattgtcgccttcatgctgggcaattacattaatctgcacgagtctagtactgaacctaacgacagcctctggtttagcctccagaaaaagaatgacacgacagaaatcgagtag

SEQ ID NO: 227097 - DNA, 1437 bp, Artificial Sequence
  Description of Artificial Sequence: Synthetic coding sequence
atgagtacgaatggggatgatcaccaggtgaaagattcgctggaacaactcaggtgtcactttacctgggagctgagcatcgatgacgatgagatgccagacctggaaaaccgcgtgctagaccagatcgagtttctggatactaagtactccgtgggcatccacaacctgctggcgtacgtaaagcatctgaagggacagaatgaggaagctctgaagtccctaaaggaagccgagaatctcatgcaggaagaacacgataaccaggccaacgtgcgctcacttgtcacctggggaaattttgcatggatgtattaccatatgggcaggctcgcggaagcacagacctacctggacaaggtggaaaacatctgcaaaaaactaagcaatcctttccgttacaggatggagtgtcccgaaatagactgtgaggaaggatgggctctactgaagtgcggtggtaagaattatgaaagagccaaagcctgttttgagaaagtattagaggtggatccagagaaccccgagagctctgctggatacgctatctctgcttacagactggatggttttaaactggcaacgaagaatcataagccgttctccctcctgccacttcgacaggccgtgcggctcaatccagacaacggctatataaaagtcctgctcgccctgaagttgcaggacgaggggcaggaagccgagggtgaaaaatatatcgaagaggctcttgctaacatgtcgtcacagacctatgtgttccggtacgcagcaaaattctaccgacgaaagggcagtgtggacaaggccctggagctgctcaaaaaagcgttgcaggagactccaactagcgtgctgcttcaccaccagattggtctgtgctataaggcacagatgatccagatcaaagaggccaccaaggggcagcccagaggacagaaccgagagaaactcgataagatgatccgatccgcaatatttcacttcgagtcagccgtcgagaagaagcccacctttgaagtggctcacctcgatctagctagaatgtatatagaggctggcaaccaccggaaagctgaggagaactttcaaaagctcttgtgtatgaaacccgtcgtggaagagacgatgcaagacatccacttccactacgggaggttccaggaattccagaaaaaatccgacgtaaatgccatcattcactatctcaaggctatcaagatagaacaagcttccctcacgcgggacaagtccattaattcgctgaagaagttggtgttgcgcaaacttagaagaaaggctctggatctggagagtctgagtctattgggctttgtgtacaagcttgagggaaatatgaatgaagcactggagtattacgagcgggctcttagactggccgctgatttcgaaaattcggtgcggcaggggccatag

SEQ ID NO: 227098 - DNA, 1344 bp, Artificial Sequence
  Description of Artificial Sequence: Synthetic coding sequence
atgcccgaccttgagaatcgcgtgctggaccagattgagtttctggatactaagtactctgttggaatccataatctgcttgcgtacgtaaagcatctgaagggccagaacgaagaagcactgaagtccctcaaagaagcggaaaatctgatgcaagaggaacacgacaatcaggccaatgtcagatcactcgtgacctggggtaactttgcttggatgtattaccatatggggagactggccgaggcacagacatacctcgacaaagtggagaatatctgcaaaaagcttagtaaccccttccgctaccggatggaatgtcccgagatagactgcgaggaggggtgggcactgctgaaatgtggcggaaaaaattatgaaagagctaaagcttgtttcgagaaggttctcgaagtcgacccggaaaatcctgaatcgtcagcgggatacgcgatctcagcataccggctggatggatttaaactggcaactaaaaaccacaagcctttctcgctcctgcctctgcgtcaggctgtgcggctgaatcccgacaatggctatatcaaagtcctcctggccctgaagctgcaggacgaaggacaggaagcagaaggtgagaaatacattgaggaagctctcgctaatatgtcgtcacagacgtatgttttcaggtacgcggctaaattttatagacgcaagggaagtgtggacaaagctttagagcttcttaagaaagctctgcaggagacacccacaagtgtgttattacatcatcaaattgggctctgttacaaagcccaaatgattcagattaaggaagcaaccaagggacagcctcgaggccagaatagagaaaaactggataagatgataagaagtgcaatctttcatttcgagtctgcggtggagaaaaagcctaccttcgaggtggcccacttggatctggcaaggatgtatatcgaagccggaaatcacagaaaggcagaggaaaatttccagaagcttctgtgtatgaaacccgtagtcgaggagactatgcaggacattcacttccattacggccgttttcaggagtttcagaaaaaatccgacgttaatgctattattcattaccttaaggccatcaaaatcgagcaggcgtcactaacgagagataagtctattaacagtctcaagaaacttgtcctgcggaaactccgaagaaaggctttagatctggaatctttgtctctgcttggatttgtgtacaagctggaaggaaacatgaacgaggcactggaatactacgagagggccttacggctggccgcagactttgaaaactccgtcaggcagggtccctag

SEQ ID NO: 227099 - DNA, 1419 bp, Artificial Sequence
  Description of Artificial Sequence: Synthetic coding sequence
atgagtgagaacaataagaattctctggaatccagcctgcgccagctgaaatgccattttacttggaacctgatggagggcgaaaacagcctggacgatttcgaggacaaagtgttttatagaactgagttccagaatcgcgaattcaaagctacgatgtgcaacttgctagcatatctgaagcatttgaagggccagaacgaggctgctctcgagtgtctgaggaaggcagaagaactaattcagcaggagcacgcggaccaggccgagattaggtcactggtgacatgggggaactatgcttgggtctattaccacatgggcagactttcagacgttcagatctacgtggataaggtaaagcacgtctgcgagaaatttagctccccttatcgtattgaatcccccgaacttgattgcgaggaagggtggactcggctgaaatgtgggggtaaccagaatgagagagctaaggtgtgttttgaaaaagctctggaaaaaaaacccaaaaacccagagttcacttctggtctggccatagctagttatcgattagataattggcccccttcacagaacgcaatcgatcccctgcggcaggccattcggctcaaccccgacaaccaatacctaaaagtgttgctggcattgaagctgcataaaatgcgtgaggagggcgaggaggagggggaaggcgagaaactggttgaggaggccctggagaaggctcctggagtgaccgatgtcctccgctcagccgcaaagttctacaggcgcaaggatgagcctgacaaggctattgaattactgaaaaaggcactggagtacattcctaacaacgcatacctgcactgccagattggatgttgttaccgggcaaaggtgttccaagtgatgaatttaagggaaaacggaatgtatggaaaacgaaaactcctggagctgatcgggcacgcagtggctcatctcaaaaaggcagacgaagcaaatgacaacctattccgcgtttgttcaattctggcctccttacatgcattagcggaccagtacgaggacgcggaatactattttcaaaaagaattttcaaaagaactgaccccagttgccaagcagttactgcatcttagatacggcaatttccagctctatcagatgaagtgtgaagacaaggctatccatcacttcatagaaggcgtgaagattaatcaaaaaagcagagaaaaggagaagatgaaggacaaactgcagaagatcgcgaagatgaggctgtctaagaacggcgctgatagcgaagcactgcatgtcctcgctttcctacaagaacttaacgagaagatgcagcaggccgacgaagactccgaacggggtttggaatcaggctctctcattccctccgctagcagctggaacggggagtag

SEQ ID NO: 227100 - DNA, 1356 bp, Artificial Sequence
  Description of Artificial Sequence: Synthetic coding sequence
atgcctaagaataagaagaggaacacaccccacagggggtcctcagctggtggcggtggaagcggggctgccgcagccacagccgcaaccgccggtggccagcaccggaatgtgcaaccattctccgacgaagacgcttctatcgagacaatgtctcactgttctggctactcagatccaagctcatttgccgaagacggccctgaggttttggacgaagaagggactcaggaggacctggaatacaagctcaaaggattaatagacttaaccctcgataaatccgctaagacaagacaagcggctctggaagggatcaaaaacgccttggctagcaagatgctgtacgagttcattctcgagaggcggatgactcttaccgacagcatagagagatgtctgaagaagggaaaatcggatgaacaacgagccgctgctgccttagcttcagtactatgtattcagcttggccctggaattgagtccgaagagatcctcaagacactcggacctatactgaagaagatcatctgcgacggctccgccagtatgcaggccagacaaacttgtgccacttgcttcggcgtgtgctgctttatcgccacagatgacataaccgaattatatagtaccctggagtgcttggagaatatttttaccaaatcatatttgaaagaaaaggataccaccgtcatctgttccacccccaatacggtgctccacatctcctcactgctcgcctggaccctgctgcttactatttgccccataaatgaggtcaagaaaaagctcgaaatgcacttccacaagctgccttccctcctctcttgcgacgatgtcaatatgaggattgccgctggcgaatcactggctctccttttcgaattggctcgcggaatcgaaagcgacttcttttacgaagatatggagtcattaacacagatgttgcgggctctggctacagacggaaataagcatagggccaaggtggataagcgcaagcagcgttcagtgtttcgggacgttctgcgcgctgtggaggagcgcgatttccccacagaaacgatcaagttcggtccagagcgcatgtacatcgattgctgggtgaagaagcacacatacgacacctttaaggaagtgttgggcagcggcatgcagtaccatctgcagtctaatgaattcctgcggaacgtcttcgagctgggccctcctgtcatgctcgacgccgctaccctgaaaacgatgaagataagtaggtttgaaagacatctgtataattcagctgcattcaaggcgagaacaaaggccagatctaagtgccgggacaagagagctgacgtgggtgagttcttctag

SEQ ID NO: 227101 - DNA, 1356 bp, Artificial Sequence
  Description of Artificial Sequence: Synthetic coding sequence
atgccaaaaaacaaaaaacgcaatactcctcacagaggctcctctgcaggaggagggggttcgggtgccgcagcagccactgctgcgactgccggtggacagcacagaaatgtgcagcctttctccgatgaggatgcatcaatcgagactatgtcgcactgttctggttatagcgatccttcctcctttgccgaggacggccctgaagtgctcgacgaggaaggtacacaggaagatttggaatataagctgaaaggactcatcgacctgactttagacaaatctgccaaaacgaggcaggcagccctcgaaggcatcaagaacgcactggctagcaagatgctgtacgagttcattttggagaggcgcatgactcttaccgattcaattgaaagatgcctgaaaaaggggaagtcggatgaacagcgcgctgcagccgctttagcatctgtcctgtgtatccagctgggcccagggattgagagtgaggagatccttaagacgctggggccaatcctcaaaaagatcatctgcgatgggagcgccagcatgcaggcccgacagacatgcgccacctgtttcggagtgtgctgtttcattgcaacagatgacataacggagctatacagtacactagagtgcctggagaacatattcacaaagtcctatctgaaggagaaggacactactgttatctgttctacacccaataccgttctgcatattagctccctgctggcttggactctgcttctcacgatttgccccataaatgaggtcaagaaaaagctggagatgcattttcacaagctgcctagtctgttgtcttgtgacgatgttaacatgcgcattgctgcaggggaaagtctggcactgctgtttgaactggcacggggaatcgaatctgattttttctacgaggatatggaatcactcacacagatgctgagagccctagcaaccgatgggaacaagcatagagccaaggtcgataaacgcaagcagaggtctgtctttcgtgacgttctgcgcgcagtggaagaaagggatttccccaccgaaaccattaaattcggacccgagcggatgtacatagattgctgggtgaagaagcatacttatgatacttttaaggaggtcttaggatctggcatgcagtatcacttgcagtcgaacgagtttctccgaaacgtctttgaactgggtccgcctgttatgctagacgctgccaccctaaagaccatgaaaatcagtcggtttgagagacatttgtataatagcgcagcttttaaagcccgaaccaaagccagatctaaatgcagggataaacgtgcagatgtgggcgaattcttctag

SEQ ID NO: 227102 - DNA, 57 bp, Artificial Sequence
  Description of Artificial Sequence: Synthetic coding sequence
atgcccaagaacaagaaacgtaacaccccccaccgaggatcttccgctggaggctag

SEQ ID NO: 227103 - DNA, 96 bp, Artificial Sequence
  Description of Artificial Sequence: Synthetic coding sequence
atgccaaaaaacaagaagaggaacactcctcacaggggctccagtgccggaggagggggttccggagctgccgctgccaccgctgccacagcatag

SEQ ID NO: 227104 - DNA, 189 bp, Artificial Sequence
  Description of Artificial Sequence: Synthetic coding sequence
atgcctaaaaataagaagcgtaataccccccaccggggtagtagtgcaggaggcggaggaagcggagcggctgcggcaacggctgcgactgctgggggacaacataggaacgttcaaccattcagtgatgaggacgcaagcattgaaacaatgtcacactgttctggctatagtgatccgagctcttag

SEQ ID NO: 227105 - DNA, 1206 bp, Artificial Sequence
  Description of Artificial Sequence: Synthetic coding sequence
atgagccactgttcggggtacagcgacccaagctcttttgccgaagatggccctgaagtgctggatgaggaaggaacacaagaggatctagaatacaagctaaaagggttaatagacctgacacttgacaagagtgccaagacacgacaggccgcactcgagggaattaagaacgcactcgcgtcaaaaatgctttatgaattcatacttgagcggcgtatgacccttaccgattcaatcgagcgctgcctgaaaaaaggtaaatccgatgagcagagggccgcagccgctctggcctccgtactctgtatccagctgggaccgggaatcgagtccgaagagattctgaagactcttggtcctatcctgaagaagattatctgtgacggtagcgcttccatgcaggcacgccagacatgcgccacttgttttggggtttgttgtttcattgctacagacgacatcactgagctgtattccacactggagtgcttggagaatatattcactaaatcttacctcaaggagaaggatacaacagtgatctgctctacgcctaacactgtcctgcatatcagctcacttctggcctggaccctgttgttgactatctgccccatcaatgaagtcaaaaaaaagttggagatgcacttccataagctaccctcactcctctcctgcgatgatgtgaatatgaggatcgctgccggtgagagcttggctttgttgtttgagctcgctaggggtatcgagtcagattttttttacgaagatatggaatcattgacacagatgctccgggcattggctactgacggaaacaaacacagggctaaggtcgataagcgaaagcagcggtccgtgttccgcgacgtcctgcgcgcagtcgaggaacgggatttccccaccgagacgatcaagtttggaccagagagaatgtatatcgactgctgggtgaaaaaacatacctacgataccttcaaggaagtgctaggaagcgggatgcagtaccatttacagagcaatgaattcctccgaaacgtttttgagctgggacctcccgtgatgcttgatgccgctacacttaaaacaatgaagatatcccgctttgaacgacacctctataattctgccgcattcaaagccaggacaaaagccaggtcaaagtgtcgcgacaagagagcagacgtgggggaatttttctag

SEQ ID NO: 227106 - DNA, 474 bp, Artificial Sequence
  Description of Artificial Sequence: Synthetic coding sequence
atgcacttccacaaactgccctcattgctgagttgcgacgacgtgaacatgaggatcgcagctggcgagagtttagctctgctgttcgaactcgcacgtggcatagaaagtgactttttctatgaagacatggaatcactgacccagatgctgcgggcactggctacagacggaaataagcaccgggctaaggtggataagcgcaaacagaggtccgttttccgggacgtgctccgagcagtcgaggaacgcgactttccaacggaaaccatcaagtttggccctgaacggatgtacattgattgctgggtaaagaaacatacctacgacacgtttaaggaggttcttggatccgggatgcagtatcaccttcagtcaaacgagtttctcagaaacgtgtttgaattgggcccaccagtgatgcttgacgccgctaccctgaagacgatgaagatctcacggtttgagcggtag

SEQ ID NO: 227107 - DNA, 1827 bp, Artificial Sequence
  Description of Artificial Sequence: Synthetic coding sequence
atgggaccaaagaaatcctggagaagccattttttccccctccctgaggtctggctcctcctgctccttagtcaggcactatctccctcacacggaccacaaacacaggctggtgttgggttagtctggtcagtcccactacctagtgctcttagatctcagtcctgtctcggcgcaccactgagggacgctagtgagctgacaacagttcacctcttccccaccagaggatggggggctcgcagggcattgtgggtacactccagtgcttcagcctctagtgctgcaagtcgccgacgactgagggcccaggcgtccggtatcagcagtttttccctggtggatggtggtgcaccccgtgaggacggtggggcacgcggtgtttggctcccgtctagcggacaggtgtccgcccagagaactggaagaaggctggtcgggttggaaccaaccccgaccggttccctcacccctaggcccccaagaccagtacctgggatgccacgggctcgcaaaggcaatacactccgcaaaggtggccagagaaggggcggaggcgctcggtcatctgcacaggccgattcaggaagctccgacgacgaagccgcttccgaagctaggagcaccgcaagcgaatgcccatctctgctttcgaccacggctgaggacagcttaggcggtgatgtcgtcgatgagcagggacaacaggaggaccttgaagagaagctgaaagagtacgtagactgtttgacagataaaagtgctaagacacgacagggagcacttgagtctctaaggttggctctggcgtcccggctactgcccgacttcttactggagcgtcgcttaaccctcgccgacgccctcgaaaaatgtctcaaaaaaggtaaaggtgaggagcaggcactggccgcagccgtgttaggcctactctgtgttcagctaggaccgggtccaaagggagaagaattgtttcacagtctccagcctttgcttgtgtcagtgctgagcgattctacagcctctcctgcagctcgcctgcactgtgctagcgccctgggtctcggctgttacgtggccgctgctgatatacaggacctggtgagttgtcttgcatgtctcgagagtgtcttctccaggttctatggcctgggcggaagtagtacctccccggtggtgccagccagtctgcatggcctgcttagcgccgcactccaggcatgggcactcctcctgaccatttgtccatctactcagatcagtcatattctggatagacagctgcctagactgcctcagctgttatcgtccgaatctgtcaaccttagaattgccgcaggcgagactatcgctttgctgtttgaactcgctagggatctggaggaggaatttgtttatgaggacatggaggctctgtgttcagtgctacggacactggctacagacagcaataaatatcgcgcaaaagcagacaggcggaggcagcggagtacctttagagcagtcttgcacagcgtggagggaggggaatgcgaggaagagatcgtacgatttggcttcgaagtactctacatggattcatgggctcgacatcgaatttacgccgctttcaaggaagtcctgggttcggggatgcatcaccaccttcagaacaatgagctcctaagagatattttcggtctggggcctgtgctcctgttagacgcaaccgctttaaaggcctgtaaggtgcctcggttcgaaaagcatttgtacaacgcagcagcgttcaaggcaaggaccaaagctcgaagtcgcgttcgggacaaacgggctgatattctgtag

SEQ ID NO: 227108 - DNA, 1329 bp, Artificial Sequence
  Description of Artificial Sequence: Synthetic coding sequence
atgccacgggcacggaagggtaacacattgaggaagggtggtcaaaggcggggaggtggggctagatcgtctgcgcaagcagactctggttccagcgacgatgaggccgcaagcgaggctagaagtaccgcttcggagtgtccttctttgctgtccacgaccgctgaggacagcctcgggggtgatgtagtggatgaacagggacagcaggaagatctggaggaaaagcttaaggaatacgtggactgcctgacagataagtctgcgaagacccgccagggagcgttggaatccctcagactggctctggcatctcggctacttcccgatttcctgctggaacgcaggcttaccctcgcggacgctttggagaagtgtttgaagaaaggcaagggggaagaacaagccctggccgcagcagttttaggtctgctgtgtgtgcaactgggccctggtccgaaaggagaagagctgtttcatagtctccagcccctcctggtcagtgtgctcagcgactccacagccagcccggcagcccgactgcattgtgctagcgcacttggtcttggatgttatgttgcggcagcggatatccaagaccttgtctcttgcctggcctgtctcgagtcggtgtttagtcgtttttacggactcgggggaagttcgacgtcccccgtggttccggcttccctgcacggcctactgtcagctgcactccaggcatgggcactgttgctgaccatatgcccatctacccaaatttcacatatactggacagacagttgccccgtttgcctcaactgctatcctctgagtccgtcaatcttcggattgctgcaggcgaaaccatagcattactcttcgaactggctagagatctggaggaggaattcgtgtacgaggacatggaagcgctttgttcagtgctcaggaccctcgctacggatagcaacaagtatagggcaaaggccgacagacggaggcaaaggtccaccttccgggctgttctacattcagtggaaggcggagagtgcgaggaggaaatcgtgaggttcggcttcgaggtactgtatatggattcctgggcaaggcaccggatctacgccgcttttaaggaagtgctgggatcaggcatgcaccatcacctgcagaacaacgaactgctgagggacatttttgggctgggaccagtgctcttgctcgatgcgactgctctgaaagcttgtaaggtcccgcgttttgaaaaacacctctataacgcagccgctttcaaggcacgtaccaaagcacgctcaagagtgcgggacaagcgagccgatatcctttag

SEQ ID NO: 227109 - DNA, 1521 bp, Artificial Sequence
  Description of Artificial Sequence: Synthetic coding sequence
atggcatggaactccccatctagaaggccagtctggcagggaggggctccaagggaagacggcggagctagaggggtgtggctcccgtcctccggtcaggtgagtgcacagcgcaccggcaggcgcctggtgggccttgagcccacgccaacggggtcactgacacccaggcctcctcgacccgtgccaggtatgccaagggcgcgtaaagggaacaccctgcggaagggcggacagaggcgaggcggaggtgctcgttcgtctgcgcaagccgactctggatcttccgacgatgaagccgctagcgaagccaggtctactgcttcggagtgccccagcctgttaagtaccactgctgaagattcactggggggagatgtagtggatgaacagggtcagcaggaggacttggaggaaaagcttaaagaatacgtagactgtctgactgacaagtctgctaagacccggcaaggcgcactcgaaagcctgcggcttgccctggccagccggcttttacctgatttcctgttagaaagacggctgaccttggctgatgccctggaaaagtgtctgaaaaagggaaaaggagaggagcaagccctggcagccgcagtgctgggtctactttgcgtgcagctgggtccaggacccaagggagaagaactttttcactccctccaacccctgctcgtatccgtcttgtccgactccaccgcatcacctgctgctagactccactgtgccagcgccttggggcttggatgttatgtcgccgcagccgatattcaagacctggtgagctgccttgcgtgcctggaaagtgtattctctcgtttctacggtcttgggggatcgagcacgagtcccgtggtacctgccagcctacacggactcttatctgcagctctgcaggcatgggccctgctcctgacaatctgtccctcaacccagataagtcacattctggatagacagttaccacggcttccacagctattatcaagcgagtcagtgaatcttcgtatcgccgctggcgagacaatagccctgttgtttgaattggctcgcgacttggaagaagagttcgtttatgaggatatggaggcactgtgttctgtgctacgcactttggccacagattctaataaatatcgagccaaggcagataggcggagacagcgatctacattcagagccgtgctgcatagtgtagagggcggagagtgtgaggaagaaatcgtgcgttttggcttcgaggttctgtacatggattcctgggcaaggcatagaatctacgccgcattcaaggaagttcttggctctggaatgcatcaccacctgcagaacaatgagctgttaagggatatttttggtctgggacccgttttgctgctggatgcgacagcactgaaagcttgtaaggtgcccagattcgaaaagcatctttataatgcagctgccttcaaggcgagaaccaaagctcgctccagggtccgagacaagcgcgctgatatactgtag

SEQ ID NO: 227110 - DNA, 1329 bp, Artificial Sequence
  Description of Artificial Sequence: Synthetic coding sequence
atgccgagagctcgtaagggcaacaccctcagaaaagggggacagcgcaggggtggaggggctcgcagctctgctcaagctgactctggctccagcgacgatgaagcggctagcgaagctcgctctactgccagcgagtgcccgagcttgctgtctacgactgctgaggattccctgggcggtgacgtagtggatgaacaaggacagcaggaggacctcgaggagaaactgaaagaatacgtggactgtcttacagataaatccgcaaaaactcgccagggagccctggagagtctgcggctggcccttgcgtccaggttactcccagattttttgttggaacgcaggctcacgttagcggacgcattggagaagtgtttgaaaaagggcaagggtgaggagcaggccctggccgcagctgtgctaggcttgctgtgcgtacagctgggcccagggcctaaaggggaggaactgtttcacagcctgcagcccctgctcgtgtccgtactctctgattctacagcaagtcccgctgcccgtctccattgcgcatccgccctgggtctgggctgctatgtagccgcagccgacatccaggacctggtgtcttgcctggcgtgtctagagtcagtattctctcgtttctacgggctgggtggatcgtctacaagtccagtcgtcccagcctccttgcatgggctgctgtccgctgcgctgcaagcgtgggcgctgttacttaccatttgcccttcaacacagataagccacatcttggaccgccaactgcccaggctcccacagctcctgtccagcgaaagcgtcaacttacggattgccgcaggggaaacaatcgctttgctgttcgagctggctagagatctcgaagaggagttcgtctacgaggatatggaagccctgtgcagtgtcctgaggactttggcaaccgacagcaacaaatatcgggcaaaggcagataggcggagacagcgctctaccttcagagccgtgttacactctgttgagggcggagagtgtgaagaggagattgtccggttcggcttcgaagttctttacatggattcctgggccagacaccgtatatacgccgcattcaaggaagtcttaggcagcggcatgcatcatcatttacaaaacaacgagctcttaagggatatttttgggctcggacctgtcctgctgctcgatgcaacagctttgaaggcctgcaaagtgccaagattcgaaaagcacttgtacaatgccgctgcattcaaggccagaaccaaggctaggtctcgggtcagggacaagagagccgacattctttag

SEQ ID NO: 227111 - DNA, 1713 bp, Artificial Sequence
  Description of Artificial Sequence: Synthetic coding sequence
atgaccctcctgtggtgcgtcgtttccctgtatttttacggtatcttacagagcgacgcctccgagaggtgtgatgactggggcctggacaccatgcgacagatacaggtgtttgaggacgaaccagcgaggatcaagtgccccctttttgagcatttcctcaagttcaactacagcacagcacacagcgccggtctgaccctcatctggtactggacgcgccaagatcgagatctagaagagcctatcaatttccggctacccgagaaccggataagtaaagagaaagacgtgttgtggtttcgccctacgctgcttaatgacactggaaattacacgtgcatgctaagaaacactacatattgttccaaagtggcctttccgctggaagtggtacagaaagattcctgctttaactcccctatgaagctccccgtgcacaagctgtacatcgagtacgggattcaaagaatcacttgccctaacgtcgacgggtacttcccttcatccgtgaagcccaccatcacttggtatatgggatgttataagatacagaacttcaacaacgtgatccccgaggggatgaatctgtccttcctgatcgctttgatcagcaataatggtaattatacctgcgtcgtgacctaccctgaaaacggcagaacattccatctgaccaggacgctgacggtcaaggtggtggggagcccaaagaacgccgtgcctcccgtcattcacagccctaatgatcacgtggtatacgagaaggaacctggtgaggagctgctcatcccttgtactgtatatttttcattcctgatggattccagaaacgaggtttggtggaccattgatgggaagaagcctgatgatataaccatcgatgtcacaattaacgagtccatctcacacagcagaacggaggacgaaaccaggacacagatcctgtccattaagaaagtgacaagcgaggatttgaaaagatcctatgtgtgccatgccagatccgctaagggagaagtggcgaaagcggctaaagtgaaacagaaagtgccggctccacgttacactgtagagctagcttgtgggttcggcgcaactgtgctcctagtcgtcattctgattgtcgtttatcatgtttactggctggaaatggtgctcttttaccgagcacattttggtaccgatgaaactattcttgatggtaaggaatatgacatctacgttagttatgcccgtaacgctgaagaggaggaattcgtgcttttgaccctcaggggagtccttgagaacgagtttggctacaaactctgcatctttgatagggattctctcccgggagggatcgtcacagatgagacactgtccttcatccaaaaatctcgcagactcctggtggtccttagtcccaactacgtgctgcagggaacacaagctctgttggagttaaaggctggactggaaaatatggcttctaggggtaatatcaacgtgattcttgtccagtataaagcagtcaaagagacaaaggtgaaagagcttaagcgggcaaagacagtgctcacagtcatcaagtggaaaggcgagaagagcaaatatccccagggccgattttggaagcagctccaggtcgcgatgccagtaaaaaaaagccctagacggagctcgtccgacgagcagggcctgagctacagtagcctgaaaaatgtgtag

SEQ ID NO: 227112 - DNA, 2064 bp, Artificial Sequence
  Description of Artificial Sequence: Synthetic coding sequence
atgacactgctatggtgcgtagtttcgctgtacttttatggtatcctgcagagtgacgcaagcgaacgatgtgacgactgggggctggacactatgaggcagatacaagtgttcgaggatgagcccgctcgaattaagtgccccctcttcgaacactttttgaaattcaattatagtacagcacactccgccggattgacccttatctggtactggacacgacaggacagggacctcgaagagccaatcaattttaggcttccagaaaatcggatatctaaagagaaagacgtcttgtggttcagaccgaccctgttgaacgatacgggaaactacacctgtatgctgagaaataccacttattgctctaaagtggccttccccctggaagtggtccagaaggactcatgtttcaattccccaatgaagctacccgtgcacaaactgtatatcgaatatggtattcagcggattacctgtcccaatgtcgacggttatttccccagctcagtgaagcctactataacttggtatatgggctgttataaaatacaaaatttcaataatgtaatccccgaagggatgaatttatcattcctgatcgcactaatcagcaataatggcaattacacatgtgtcgtgacctatcctgagaacggacgaaccttccacctgactcggactttaaccgtaaaggtcgtggggagccccaaaaacgcggtcccaccggtcattcattccccaaatgaccacgttgtctatgagaaggagcctggagaagagttgctgatcccgtgcacagtgtatttcagctttctgatggatagccgaaacgaggtatggtggaccatagacggcaaaaaaccagacgacattaccattgatgtgacgatcaatgaatctatttctcattcgcggaccgaagatgagacaaggacccagattctgtccatcaagaaagttacctcagaagatctcaagcgctcctatgtgtgtcatgcacgatcagccaagggggaagtcgctaaggctgccaaggtgaagcaaaaagtgccagcacctcgctacactgtggagctggcttgtggttttggggctacagtgctccttgtggtgatcctgattgtggtctatcacgtatattggctggagatggtccttttttaccgagctcacttcggcaccgacgaaactattctagatggcaaggagtacgatatctacgtgtcttatgcccgaaatgcagaggaggaagagtttgtcctgctgactcttcggggtgtgttagagaacgaatttggctataagttgtgcatcttcgacagagatagcctgcctggtggaaacaccgtggaggcagtctttgactttatccagaggtcccggagaatgatcgttgtgttatctcctgactacgtgaccgagaagagtataagcatgcttgagtttaagcttggggtgatgtgccagaactctatcgcaaccaaacttatcgtggtcgagtaccgtccactagaacatccacaccccggtatccttcaacttaaagaatcagtgtcctttgtgtcctggaaaggggagaaaagtaagcacagtgggtcaaaattttggaaagctctgagattggctctgcccctgagaagtctgtccgcttccagcggctggaatgaaagctgcagttctcagtctgatatttccctagatcacgtgcagagacggagatctcgccttaaagagccccctgagctgcagtcgagcgagagagcggctggctcacctccagctccagggactatgagcaagcatcgagggaagagctccgcgacttgtaggtgttgtgtgacatactgtgagggcgagaatcacctcagaaataagtcgagagctgagatccacaatcagccacagtgggaaacccatctgtgtaaacccgtccctcaggagagtgaaacccagtggatacagaacggtacacgtctggaaccaccagctccacagatttcagcgcttgctctgcaccatttcacagatctgtcaaacaataacgacttttatattttatag

SEQ ID NO: 227113 - DNA, 1713 bp, Artificial Sequence
  Description of Artificial Sequence: Synthetic coding sequence
atgacgttactgtggtgcgtcgtttctctgtatttctacggcatacttcagtctgatgcatctgaaagatgcgacgattgggggctggataccatgcgtcaaatacaggtgtttgaggacgaacccgcaaggatcaaatgccctctgtttgagcactttctgaaatttaactacagcaccgctcatagcgccggtctgacacttatttggtattggacgaggcaagatcgggatctagaagaacctatcaattttaggttaccggaaaataggatttccaaagaaaaggacgtcctgtggttccggcctacactgcttaatgatacaggtaattatacgtgcatgctgagaaatacgacgtattgttctaaggtcgcatttccgcttgaggtggtgcagaaggacagttgctttaactctcccatgaagttgcctgtccacaaattgtacattgaatatgggatccagcgtatcacatgccccaacgtagacggttacttcccctcaagcgtgaaaccaactattacctggtatatgggatgctataagattcagaatttcaataacgtgatcccagaagggatgaatctgtctttcttaatcgctctcatctcgaacaacggcaactatacctgcgtcgtcacataccccgaaaacgggaggacatttcatttaacaagaaccctcaccgtgaaagtggtgggaagccctaagaatgcagtgcccccagttatccacagtccaaacgaccatgtggtatatgagaaggagcccggtgaggaacttctgatcccgtgcactgtgtacttcagtttcttgatggattcgcgaaatgaggtgtggtggacaatagatggcaaaaagccagacgatatcaccatcgacgtgactattaatgaaagcatctcccattcgaggactgaggatgaaacgaggacgcagatcttgtcaatcaaaaaggtgacctccgaagatctgaaacgatcctatgtctgtcacgcaaggtctgctaaaggggaagtggctaaggctgccaaggtgaagcaaaaagttcccgctcccagatataccgtagagttagcttgcggctttggcgcaaccgtactgctggtagttatcctcattgtggtgtatcacgtgtattggctggaaatggttctattctacagagcgcacttcggtacagacgagactatccttgacgggaaagaatacgatatatatgtgtcctatgcccgaaatgccgaggaagaagagtttgtgctcctaacgcttcgaggggtgttagaaaacgagtttggctacaagctgtgcatatttgatcgagattccttgcctggaggcatcgtgaccgacgaaactctgagcttcattcaaaagtcgagacggcttcttgttgtgttgtcacccaattacgtcctacagggaactcaagccctcttagagctaaaagcaggattggaaaacatggcatcgcgaggcaatattaacgtcatcctagtccagtataaggccgtcaaggaaacgaaggtcaaagaactgaaacgcgcaaaaaccgtcttgacagtgataaaatggaaaggggagaaatccaaataccctcaaggccgtttttggaaacagttgcaggtcgccatgccggttaagaagagccctcggaggtcatcaagcgacgaacaggggctgtcttactcaagcctgaagaatgtgtag

SEQ ID NO: 227114 - DNA, 1071 bp, Artificial Sequence
  Description of Artificial Sequence: Synthetic coding sequence
atgactctgctgtggtgtgtcgtatctctctacttctacgggatcctgcagagtgatgctagcgagcgctgcgacgactgggggctggacactatgcgtcaaatccaggttttcgaagacgaacctgcacgaatcaagtgtcccctgtttgagcattttctaaaatttaactacagcaccgctcacagtgctgggcttacccttatttggtattggacacggcaggaccgcgatctggaagaacccatcaatttccggttaccagagaaccgcatctcaaaagagaaagatgtgctttggttccgtccaaccttgctgaatgatactggcaactacacatgtatgttgcggaacacaacttactgcagcaaagtcgccttccccctagaggtcgttcaaaaggactcatgtttcaatagtcccatgaagctgcctgtacacaaattatacatcgagtacggtattcagcggattacctgtccaaacgtggacggatatttccctagttcggttaagcccacaataacctggtacatgggttgttataaaatccagaactttaataacgtcattcctgaaggaatgaacctgagtttcctgatagccctgatcagtaataatggcaactacacctgtgtcgttacttaccccgagaatggaagaactttccacctaacccgcactcttacggtgaaggtggtaggatctcccaagaatgctgtccctccggtgatacactccccaaacgatcatgtggtatacgaaaaggaacccggtgaagagttgctgattccttgcacagtctatttttctttcctcatggactcgaggaatgaagtgtggtggactatcgacggcaaaaaaccagatgatatcacaatcgacgtaaccatcaatgagtcgatatctcactcgcggactgaggacgagactcgcacccaaatcttaagcataaagaaggttaccagtgaagacctcaaacggtcatacgtctgccacgccagatccgcaaaaggagaagtggccaaggctgccaaagtgaagcaaaagggaaatcgctgtggtcagtag

SEQ ID NO: 227115 - DNA, 342 bp, Artificial Sequence
  Description of Artificial Sequence: Synthetic coding sequence
atgactctgctgtggtgcgtggtgtctctgtacttttacggtattctccagtcagacgccagcgagcgctgcgacgattggggtctggacacaatgcgtcagattcaagttttcgaagatgaacccgctcgcatcaagtgtccactgtttgaacactttctcaagttcaactattctactgcgcatagcgccggactgacgctcatctggtattggacccgccaggatcgcgacctcgaggagccaatcaattttagactcccagagaatcgcattagcaaggagaaggatgtgctgtggtttagacctacactgcttaatgataccggtaactatacatag

SEQ ID NO: 227116 - DNA, 1071 bp, Artificial Sequence
  Description of Artificial Sequence: Synthetic coding sequence
atgacactcttgtggtgtgttgtatctttatacttttacggcatacttcagagtgacgcgtctgagaggtgtgatgactggggcctggatacaatgaggcaaatccaggtgttcgaagatgagcctgcacggataaagtgtcctctgtttgaacacttcttgaagttcaactactctaccgcacattcagctggcctaacactgatctggtactggacaagacaggacagggacttggaggaacctatcaatttccgtctaccagagaatcggatatctaaagagaaggacgtgttgtggttccggcctaccctgcttaacgacacaggaaactatacctgtatgctgcgaaatacgacatactgctccaaggtagcttttcccctcgaggttgtccagaaggactcctgctttaactcccctatgaaactgccagtgcataagttgtacattgaatatgggattcagcgcatcacctgtcctaatgtggacggttacttcccgagttcagtcaagccgaccataacctggtatatggggtgctacaagattcagaatttcaacaatgtcatacctgaaggcatgaatctgagctttctgatcgccctgatcagcaataacgggaattatacatgcgtggtgacctacccagagaatggaagaactttccacctgactcggacgttaacagtgaaggtggttggttcgcctaagaatgcggtcccacccgtgattcattcgcccaacgaccatgtggtgtacgagaaggaaccaggtgaggagctcctgataccatgcacggtgtatttttcttttttgatggactctaggaatgaggtgtggtggaccatagatggtaaaaaacctgacgacatcacaatagacgtcactataaacgagagcatatctcatagtcgtaccgaagatgagactcgaactcagatcctgtccattaagaaggtcaccagtgaggaccttaagaggtcatacgtctgccacgctagatcggctaaaggcgaggtagcaaaggcagcaaaggtgaaacaaaagggcaatcgatgcggccagtag

SEQ ID NO: 227117 - DNA, 1713 bp, Artificial Sequence
  Description of Artificial Sequence: Synthetic coding sequence
atgaccctcctgtggtgcgtcgtctccctctatttttatggaatattacagtccgatgcatctgagaggtgtgacgattgggggctagacacaatgcgccagatccaggtgttcgaggatgagcctgccaggattaagtgcccactcttcgagcatttccttaagttcaattattccaccgcccattctgccggtctcactcttatctggtattggaccaggcaggatcgtgatctggaagagccgatcaactttagactgccagaaaatcgcattagtaaggagaaagatgtgctgtggttccgccctacactcctgaatgacacgggaaactacacttgtatgttgcggaataccacgtactgctccaaggtcgccttccccctcgaggtagtgcaaaaagactcttgctttaacagcccaatgaaacttccagtgcacaaactgtacattgaatacggcattcagcgaatcacttgtccaaatgtggacgggtacttcccaagctcagtaaaacctactatcacttggtacatggggtgctataaaattcagaactttaacaacgtgattcctgagggaatgaacttaagttttctgattgccctcatctctaataacggtaattacacatgcgtagtcacttacccagaaaatggtcggacattccatctgactcggactctcacagtaaaagtcgtcggctcacctaagaacgccgtgccgcctgtgattcattcccctaacgatcacgtggtgtatgagaaggagccaggcgaggagctcttgataccatgcactgtttatttcagcttcctgatggactctcgaaacgaggtctggtggactattgatggcaaaaagcctgatgatataactatcgacgtgactatcaatgagagcatttctcactccaggactgaggatgaaacaaggacccagattctgtccatcaaaaaggtgacttctgaagacctgaagagatcttacgtttgccacgcaagatccgcgaagggtgaggtcgcaaaagccgctaaagtgaagcagaaagtcccggctcctaggtacaccgtggagcttgcctgcggctttggagccacggttctactggttgtcatactgatcgtggtgtaccacgtgtactggttggagatggtgcttttctacagggcccactttgggacagacgaaacaatactagacggcaaggagtatgacatctatgtgtcttacgccagaaatgcagaggaagaggaattcgtcctgctgacacttcgcggagtcctggaaaatgaatttggctacaagctgtgcattttcgaccgggacagtctgccaggcggtatcgtgacggacgagaccctcagctttattcaaaaatcaaggcggctactggtggtgcttagcccaaattacgtactgcaggggacccaggctctcctggaacttaaggcgggactcgagaatatggcttccagagggaacattaatgttatcctcgtgcaatataaggccgtgaaggaaacaaaggtgaaggaattgaagagagcaaagacggttctgaccgtgatcaaatggaagggtgagaagagcaagtacccccagggtcgtttttggaagcagctccaggtggcaatgccagtgaagaagagtcctaggcggtcaagtagtgacgagcagggactcagctacagctcactgaaaaacgtttag

SEQ ID NO: 227118 - DNA, 2064 bp, Artificial Sequence
  Description of Artificial Sequence: Synthetic coding sequence
atgacattattgtggtgcgttgtgtccttatacttttacggcattctgcagagtgacgcgtcagaaaggtgtgatgattggggccttgatacaatgaggcaaatacaggtttttgaagacgaacccgctaggataaagtgtccactattcgagcattttcttaagtttaattactctactgcccacagcgctgggctcaccctcatctggtactggacaagacaagaccgggatttagaggagcccataaatttcagactgcccgaaaataggatcagcaaggagaaggacgtgctctggtttcgcccaactcttcttaacgatactggtaactatacctgcatgcttaggaatactacttactgctctaaggtggcatttccgctcgaggtagtgcaaaaggactcatgctttaacagccccatgaaactcccggttcataagctttacattgagtatggtattcagcgcataacgtgtcccaatgttgacggctacttccctagctctgtgaagcccaccatcacatggtatatgggctgctacaaaatccaaaacttcaataacgtgattcccgaggggatgaacctctcattccttatcgcacttatttccaataacggcaattacacctgtgtcgtcacgtatccggaaaacggacgaacatttcatctcaccagaactctgacagtcaaagtagtcggaagcccaaagaacgctgtgccccctgtgatccactcccctaacgaccacgtggtgtacgaaaaagagcctggcgaagaactgctgattccgtgtaccgtgtacttctcattcctgatggatagcaggaacgaagtctggtggacaatcgacggcaaaaagccagatgacattacaatcgatgttacaattaatgaaagcatttcccacagccggaccgaagacgaaacccggacccaaatcctcagcattaagaaagtcacttccgaggatctgaagcgctcctacgtgtgtcatgcaagaagcgccaagggagaggtcgccaaggctgctaaagttaaacaaaaagtccctgcccctcgatacaccgtggagctcgcttgcgggtttggagcaacagtgcttcttgtggtaatcctcatagtcgtctaccacgtgtattggttggagatggttctgttttatcgtgcccattttggcactgacgaaaccattctggacggtaaagaatatgacatatatgtctcctacgctagaaacgctgaggaggaagagttcgtgcttttgaccctgcggggtgtcctggaaaacgagttcgggtacaagctctgcattttcgatcgggactctttgccaggtggaaatacagtggaagctgtgtttgacttcattcagaggagccgcaggatgatagtcgtcctgtcgccggattatgtaactgaaaagtctatctcaatgttggagttcaagctgggcgtcatgtgtcagaatagtatcgctaccaaactcatagtggtcgagtatcgtccattagaacaccctcatcctggaatactgcagctgaaggagtctgtgagctttgtgtcttggaagggggagaaatcaaagcactccggctcaaagttttggaaagctctgagacttgctctgcctctgcggtccttgtccgccagcagtggatggaacgaatcttgctccagccagagcgatatcagcttggaccacgttcagcgtagaaggagtaggctcaaggagccacccgaactgcagagttctgagcgagccgcagggtcacccccagctccaggcacaatgtctaagcaccggggaaagtcatccgccacatgcaggtgctgcgttacttactgcgagggtgaaaatcacctacgaaataaaagccgagcagaaattcacaatcagccacagtgggaaacacatctctgcaagcctgtgccccaagaatctgagacgcagtggatccaaaatggcacgcgtctggaaccccctgctcctcagatcagcgcgctcgccctgcaccactttacagacttgagtaataacaacgatttttacattctgtag

SEQ ID NO: 227119 - DNA, 1713 bp, Artificial Sequence
  Description of Artificial Sequence: Synthetic coding sequence
atgacactgctttggtgcgtggtgtcgttgtacttctatgggattctccagtcagacgctagtgagagatgcgacgattgggggctggacaccatgcgccagatccaagtcttcgaggacgaacccgcaagaatcaagtgtccactttttgagcacttcttgaagttcaactattctacggcccattcagcaggccttacgctgatttggtactggactaggcaggacagagacctggaggagccaattaacttcaggctccctgaaaataggataagtaaagagaaggacgtcctgtggtttcggccaacgctgctgaatgatacaggcaattatacttgcatgctgaggaacactacttactgttcgaaggtcgcattcccccttgaggtcgttcagaaggactcttgctttaacagtcccatgaagcttcccgtacacaaattgtatatcgagtatgggattcagagaatcacctgtcctaatgtcgacggctatttccctagcagcgtaaagccaacaatcacttggtatatgggatgttacaaaattcaaaattttaacaatgtgataccagagggtatgaatctgagcttcctgatagctctgattagcaataatgggaattacacctgtgtggtgacataccccgaaaatgggaggacgtttcacctgactagaactttgacagttaaggtagtggggagccctaaaaacgcggtaccgccagtcatccatagccctaatgatcacgtagtgtatgagaaggagccaggagaggaactcttgattccttgtacggtatacttcagtttccttatggactccagaaacgaagtgtggtggactattgatggcaagaagcctgatgatatcaccatcgacgtgacgataaatgagtctatctcacactcacggactgaagacgagaccaggactcagattctgagcatcaagaaggttacatccgaggacctcaagagatcttacgtctgccatgccagaagcgctaaaggtgaagtggcaaaggcagcaaaagtgaaacagaaggtacctgcccctcggtacaccgtggagctcgcatgcgggttcggcgctaccgtcctcctggtcgttatactcattgtagtgtaccacgtgtattggttggaaatggtgctgttttatcgtgctcactttggcacagatgagaccattcttgacggtaaagagtacgacatctatgtgtcttacgccagaaatgcagaagaggaagagttcgtactgttgaccctgcggggagttctggagaacgaatttggctataaactgtgcattttcgaccgagattccttgcccggtggcatcgttaccgatgaaactctgtcctttattcaaaagtctaggcggctcttagttgtgctctcgcctaattacgtactgcaaggaacacaggctctcctggagctcaaagccggtctggagaatatggcatccagaggcaacatcaacgtaatactggtgcaatacaaggcagtcaaggaaaccaaggtgaaagaactgaaacgggctaaaaccgtacttacggtgatcaaatggaagggcgagaagtccaagtacccgcagggaagattctggaaacagttacaagtggccatgcccgtgaagaagtcaccccgacgatcgtcttccgacgagcaagggctgtcatacagctctttaaaaaacgtttag

SEQ ID NO: 227120 - DNA, 438 bp, Artificial Sequence
  Description of Artificial Sequence: Synthetic coding sequence
atgaccctgctctggtgcgtggttagcctgtacttttacggcatactgcagagcgacgcctccgagagatgcgatgattggggattagatactatgaggcagattcaggttttcgaggacgagccagccaggatcaagtgcccgctctttgagcacttcctgaaatttaactactcaacagctcattccgcgggactcactctgatctggtactggacccgtcaggaccgcgatctagaagagccgattaattttaggttgcccgaaaacaggatctctaaggaaaaggatgttctttggttcagacccactcttctgaatgacactggcaattatacctgtatgctccgaaacacaacctattgcagtaaagtggcattccccttggaggtggtacagaaagactcttgcttcaacagtcccatgaagctcccctag

SEQ ID NO: 227121 - DNA, 2091 bp, Artificial Sequence
  Description of Artificial Sequence: Synthetic coding sequence
atgaaggcccctatccctcacttgatcctgttgtatgctactttcacgcagtctctcaaggtcgtcacaaagagaggatcagcggacggctgtacagactggtctatagacattaagaaatatcaggtgctggtcggtgagccagtgagaataaagtgcgcactgttctatgggtacattagaactaattatagcttagcacagagcgcagggttgtctctgatgtggtataagtcctcaggcccaggagacttcgaagagcctattgcgtttgatggttctagaatgagcaaggaagaggacagcatttggtttcgaccaactctcctgcaagactcaggcctgtacgcttgcgttattaggaacagcacttactgcatgaaagtatctatcagcttgactgtgggtgagaacgatactggcttgtgctacaactccaagatgaagtactttgagaaagcggaactgagcaaatctaaagagattagttgcagagatatcgaggactttctgttgcccacccgggaaccggaaattctgtggtataaagagtgccggactaaaacatggcggccatccatcgtgtttaaaagagatacactgctgattcgtgaagtgcgggaggacgacataggaaactacacttgcgagctcaaatacgggggtttcgtggtgcgccgtaccaccgaactgactgtcacagctcctttgaccgacaaaccccctaaactactatatcccatggagagcaaattaacgatccaggagactcagttgggggattccgctaatctcacatgtcgagcgttcttcggttatagcggggacgtcagcccccttatttactggatgaaaggtgaaaaattcatcgaggacctcgatgagaaccgcgtctgggagagcgatatacgaatactgaaggagcacctgggcgagcaggaagtctccatctctttgatcgtcgatagcgtggaagaaggtgatctgggaaactatagttgttatgtcgaaaacggcaatgggcgtaggcacgcctcagtgctcctccacaagagggagttaatgtataccgtggaacttgccggtggcctgggcgctatccttctcctccttgtgtgtctagtaacgatctacaagtgttacaagatcgaaataatgcttttctaccgaaatcacttcggagctgaagagttagacggagacaacaaggattatgatgcctatctctcttacactaaggtcgaccctgaccagtggaatcaggaaaccggagaagaggagcgctttgccctggagatcttgcctgacatgctcgagaagcattacggctataagctgttcatccctgatagagatttaattccaaccgggacttacatcgaagacgtggcaaggtgcgttgaccaatccaagcgactgattattgtgatgacacccaactatgtggtcaggcgaggatggtctatcttcgaactcgagacgaggctgcgaaacatgcttgtgacaggagagattaaagtgatcctgatcgagtgctcagagttgagagggatcatgaactatcaggaggtcgaggcactgaaacacactataaaactgcttactgtgatcaagtggcatgggcctaagtgcaacaaactgaactctaagttttggaagcggcttcaatatgagatgccattcaagcggatcgaaccaatcacccatgagcaggccctggacgtatcagaacagggtccgtttggggagttgcaaacagttagcgccattagtatggccgctgccactagcactgcattggctaccgcccacccagatttgaggtctaccttccacaatacataccactcccagatgcggcagaagcactactacagaagttacgagtacgacgtgccacctaccggtactctgcccctcacatctataggcaatcagcacacgtattgtaacatccctatgacattaataaacggacagcggcctcagactaaaagctctcgagaacagaatcctgacgaagcccacacaaactctgccatcctccctctcctgccgagggaaactagtatatcttccgtcatctggtag

SEQ ID NO: 227122 - DNA, 2091 bp, Artificial Sequence
  Description of Artificial Sequence: Synthetic coding sequence
atgaaagcccctattcctcacctaattctgttgtatgctacctttactcagagcctcaaggtggttaccaagagaggcagcgcagatggttgcacagattggagtatcgatatcaaaaaataccaggtactagtcggcgaacctgtccggatcaagtgtgctctgttctatggatacatccgcaccaactatagcctggctcagagtgccggactgagcctgatgtggtacaagtcctccggcccaggggactttgaggagccgattgcatttgatggcagccgcatgtctaaggaggaggattctatttggttcagaccaactttgctacaggactccggtctgtacgcctgcgtaatcagaaacagtacttattgcatgaaggtatcgataagcttgaccgtcggggagaacgacaccggcctctgctataactccaaaatgaagtatttcgagaaggctgagctaagtaaatccaaggaaatatcctgtcgcgatatagaagatttcttgctcccgacccgggagccagagattttgtggtataaggagtgccgcaccaagacatggagaccgagcatcgttttcaagcgtgataccctattgattcgggaggtgcgcgaggacgatatcggaaactatacctgcgaactgaagtacggagggtttgtcgtgaggagaaccacagaactcaccgtgacagcacccctgaccgacaagcctccaaagctactgtacccgatggagtcaaagcttacaatacaggagactcaattaggcgattctgctaacctgacctgtcgcgcatttttcggatatagcggagatgtgtcacccctcatatactggatgaagggtgagaagtttatcgaggacttggatgagaatagagtgtgggaaagcgatattaggatcctgaaggaacacttgggggagcaggaagtatcaattagtctgatcgtggactcagtcgaggagggagacttaggcaactattcgtgctacgtagagaacgggaatggtaggcggcacgccagcgtcctgctgcacaagagggaactaatgtacaccgtggaactcgcaggaggactgggtgctatcttactcttactcgtctgcctcgtgaccatttacaagtgctacaagatcgaaatcatgttgttttatagaaaccatttcggggctgaggaacttgatggggacaataaggattacgatgcctacctgtcctacaccaaagtggaccccgatcagtggaatcaggagaccggggaagaagaacgttttgcccttgagatcctgcccgatatgctggaaaaacattacggctacaaactcttcattccagatcgggatctcattccaacaggtacctacatagaagatgttgccagatgtgtcgatcagtcgaagagactgattattgtcatgactccgaactatgttgtccgacgcggttggtcaatcttcgagctcgaaaccagactcagaaatatgctcgttacgggcgagatcaaggtgatattgattgaatgttcggaattaagaggtattatgaactatcaggaagtggaggcactgaagcatacaatcaagctgttgaccgtaatcaaatggcatggaccgaagtgtaacaagttgaactctaagttttggaagcgcttacaatatgaaatgccttttaagcgcatcgagcctattacccacgaacaggccctcgacgtctccgagcagggcccattcggcgaactgcagaccgttagcgccattagtatggccgcagcaaccagtacggctctcgcaaccgcccaccccgacctgcgcagcaccttccataacacataccactcacaaatgagacagaagcactattaccgatcctatgagtacgatgtccctcctaccgggaccctccctcttaccagtatcggtaatcagcatacatattgtaacatcccaatgacactgataaatggtcagcgccctcagacgaagtcatctcgggagcaaaaccccgatgaggcccataccaattccgctatactgccactcctgcccagagaaactagtataagcagtgtgatttggtag

SEQ ID NO: 227123 - DNA, 2061 bp, Artificial Sequence
  Description of Artificial Sequence: Synthetic coding sequence
atgaaaccccctttccttctggcgctcgtggtctgtagcgtcgtgtcgaccaacctgaaaatggtgagcaaaagaaacagtgtagacgggtgcatcgactggagcgtggatctcaaaacgtatatggctctcgccggagaacccgtcagagtaaagtgcgctcttttttatagctacatccggaccaactacagcacagcccagtctactggtttgagacttatgtggtacaagaacaagggcgacttagaagaacctataattttttccgaagtgcgcatgtctaaagaagaagattccatctggtttcactccgccgaggctcaggattcagggttctacacttgcgtgctaaggaactctacgtattgtatgaaggtgtccatgtcacttacagtagcagagaatgagtctggactctgttataattcaaggattagatatctggagaaaagcgaagttactaaacgtaaggagatttcctgtcccgatatggatgattttaaaaagtcggaccaggaacctgatgtcgtgtggtataaggagtgtaagcccaagatgtggcgttccattatcatccagaagggtaatgccctgcttatccaggaggtgcaggaagaggacggcggtaactacacctgcgagttgaaatatgagggtaagctcgtcagaaggaccacagagttgaaggtcacagccctgctcaccgacaaacccccaaaacccctgtttcccatggaaaatcagccaagtgtgattgacgtgcaacttggtaagcccctgaatatcccttgcaaagctttcttcggtttctccggggaatctggcccaatgatctattggatgaaaggcgaaaaattcattgaagaactggccggtcacattagagagggggagatccggttgttgaaggagcatctgggcgagaaggaggttgagctggctttgatcttcgactccgtcgtcgaagccgacctcgcgaactacacctgtcatgtggagaacaggaacggaagaaaacacgccagcgtgctccttcggaagaaggacctaatctacaagatcgaactggccggagggctgggggcaatctttctgcttctcgtgctgcttgtcgtgatctataagtgctacaacatcgaattaatgctattttataggcagcattttggcgcagacgagaccaacgatgacaacaaagagtatgatgcatatctctcctacacgaaggttgaccaggacacactcgactgcgataatcctgaagaggaacagtttgctctggaggtactgcccgatgtcctggagaaacactacggatacaagcttttcattcccgagcgtgatctgatcccctcagggacttatatggaggatctgactcggtacgtggaacagtcccggaggcttattatagttctcacacccgattacatcctgcgccgaggctggagcatttttgaactggagtctagattacacaatatgctagtaagcggggagattaaagttattctgattgagtgtaccgagctgaaaggcaaagtgaactgccaggaagtagaaagccttaagcgcagtatcaaattgctttcccttattaagtggaagggctcgaaatcctctaaacttaacagtaaattctggaagcacctggtttacgagatgcctatcaagaaaaaagaaatgctccctcggtgtcatgtgctcgatagcgctgagcaggggctctttggcgaactccagccaatcccctctattgccatgacatccacttcggcaaccctggttagttcccaggctgacctgcccgaattccatccaagcgatagcatgcaaatccgccattgctgtcgcggatacaagcacgaaattccggctaccaccttaccggtgccgtctctcggaaaccaccatacttactgcaatctgccacttacactgctaaacggacagctccctttgaataataccctaaaggacactcaggaattccaccgtaactcctcgctcttgcctcttagcagtaaagagctttcctttacctcagacatttggtag

SEQ ID NO: 227124 - DNA, 2061 bp, Artificial Sequence
  Description of Artificial Sequence: Synthetic coding sequence
atgaagcctccttttctgctggctttagtagtctgctctgtagtatccacaaacctgaagatggtgtcaaaacggaactccgtggacgggtgcatagactggagtgtggacctgaagacttatatggcacttgccggagaaccagtgagagttaaatgcgccctgttctattcttacatccggacaaattattctactgcacaatccaccgggctccgcttgatgtggtataaaaacaaaggggatcttgaggagccaataatttttagtgaggtgagaatgtccaaggaagaggactcaatctggttccattccgctgaagcgcaggattccggtttctacacatgtgtgctcagaaattcaacctattgcatgaaggtcagtatgtccctgaccgttgcagagaacgaatctggactgtgctataactctagaatcaggtatcttgaaaagagtgaggtgacaaaacgcaaggagattagctgccctgacatggatgacttcaagaaatctgaccaggaacctgacgtggtgtggtataaagagtgtaagcccaaaatgtggcgaagtattatcatacagaaggggaatgccctgctgatccaagaggtccaagaggaagacggaggaaattacacctgcgagttgaagtatgagggtaagcttgtacgaaggacaacggagctcaaggtgaccgccctgctgaccgacaaacccccaaaacctctcttcccaatggagaatcagccatcagtgatcgatgtccagctgggcaaacctctgaatataccctgcaaggccttcttcgggttcagcggcgaaagtgggccaatgatttactggatgaagggcgagaagtttatcgaagaacttgcaggccacatcagagagggcgaaattcgcctactgaaggagcatctgggcgagaaggaagttgaacttgcacttatctttgatagcgtcgtagaggccgatctcgcaaattacacgtgtcacgtggagaaccggaacggacggaagcacgctagcgtgctgctccgaaagaaggacttaatttataagattgaactggccggtggtctgggcgcaatcttccttttgctcgtcttactcgtggtcatttacaaatgttacaatattgaacttatgctgttttatagacaacacttcggagcagacgaaacaaatgacgacaacaaagagtatgacgcctacctatcttacacaaaggtcgaccaggacactctggattgtgataatccagaggaagaacagttcgccctcgaggtgctgccagacgtcttggagaagcactatggctacaagctcttcatccctgagagggacttaattccaagcgggacgtatatggaagacctgactcgctacgttgaacagagccgaaggctgataattgtactcacgcctgactacatcttgcgcaggggatggagcatcttcgagctagagagcagactccataacatgcttgtgtccggagaaatcaaggtgatccttattgagtgtaccgagctgaagggaaaggtgaactgtcaagaagtggagtccctgaagaggtccattaaactgctgtcacttattaaatggaaagggtctaagtcatcaaagctgaacagcaaattttggaagcatctcgtttacgaaatgcctatcaagaaaaaggaaatgctacctagatgccacgtcttggactccgctgaacaggggttattcggcgagctgcagccgatccctagtatcgctatgacctccactagcgccacgcttgtctcctctcaggctgacctgccagaattccatccttctgatagtatgcagatccggcactgttgcaggggatataaacacgagattccggcaacgacgcttccggtgccaagcttaggaaaccaccacacttactgcaatctcccccttacactcctgaatggccagctgcccctgaacaacactctgaaagacacccaggaatttcacaggaattcctcacttctgccgctgtcatctaaagaactgagctttacttctgacatttggtag

SEQ ID NO: 227125 - DNA, 876 bp, Artificial Sequence
  Description of Artificial Sequence: Synthetic coding sequence
atgagagacaacaaagaatacgacgcttatttgtcctacactaaagtggaccaggacacactggattgcgataatcccgaagaagagcagttcgccttggaggtattgcccgacgtcctggagaagcactacgggtacaagctgtttatccctgagcgggacctcatcccctccggtacatacatggaagatctgacccgatacgtggaacaatcaagacgactgattatcgtgctcactccagattacatccttagacgagggtggtcaattttcgagttagagtccaggctgcacaatatgctggtctcaggagagatcaaagtaatcttgatagagtgcacggaactcaagggcaaagtaaattgtcaggaggtcgaaagtcttaagcggtccatcaagctgctgtccctcatcaaatggaaaggctccaaatcatccaagcttaacagcaagttctggaaacatctagtctacgagatgccaatcaagaagaaggagatgttgcccagatgccacgtgctcgattcggccgagcaggggttattcggggaactgcagccaattccttccattgccatgacctccacatctgcaacactcgtgagctctcaagccgacttacccgagttccaccctagtgattcaatgcaaattagacactgctgcagaggctacaaacacgaaatacctgcaaccacccttccggtgcctagtctgggtaatcaccatacgtactgcaacctccccctgacactgctgaacggacaacttcccctgaacaacacgttgaaggacacacaagaatttcatagaaattccagtctgttgccccttagcagcaaggagctgtctttcaccagtgatatttggtag

SEQ ID NO: 227126 - DNA, 1197 bp, Artificial Sequence
  Description of Artificial Sequence: Synthetic coding sequence
atgctgagactctatgttctggtcatgggcgtatcagcatttacgctccagccggcagctcatacaggtgctgcgaggagctgtaggtttaggggcaggcattataagagggagttcagactggagggggagcccgtggccctacggtgcccacaagtgccttattggctctgggcgagtgtgtcccccagaatcaatctgacatggcacaaaaacgactccgcaagaactgtgcccggtgaagaggaaacacgaatgtgggcccaggacggagccttatggctgttgccggcactgcaggaagacagtggcacttatgtgtgtacaactcgaaacgccagctactgcgataagatgtcaatagagctgagagtgttcgagaataccgatgccttcctgccctttattagctaccctcagatcctaaccttgagtacctccggggtgcttgtgtgcccggacctgtcagaatttactcgagataagacggacgtgaaaatacagtggtacaaggattcactcctgctggataaggataatgaaaagtttctctcagtacgtggaacgactcatttactggtgcatgacgtagccctggaggacgccggatattacaggtgtgtgttaaccttcgcacacgaggggcaacagtacaacatcactcgaagtatcgaactgaggattaaaaagaaaaaagaagagaccatacctgtgattatcagccctttaaaaactattagtgccagtctgggctcccgcttgacaatcccctgtaaggtgttcctaggtactggcactcccctgactaccatgctctggtggaccgcaaacgatacacacatcgaaagtgcgtaccccggtggcagagtcaccgaaggccctagacaggagtatagcgaaaataatgagaactacattgaagttccactgatcttcgatccagtgacacgtgaagacctgcatatggacttcaagtgtgtcgtgcacaatacactgtcgttccagactctgcgcactaccgtaaaagaggccagttcaacgtttagctggggcatagtgttggcacctctgtccctggcctttctggtgcttggaggcatatggatgcatcgaagatgtaagcatcggactgggaaggccgatggactgaccgttttgtggccccatcaccaagattttcagagttaccccaaatag

SEQ ID NO: 227127 - DNA, 1197 bp, Artificial Sequence
  Description of Artificial Sequence: Synthetic coding sequence
atgctgaggctgtacgtcttagtcatgggagttagtgccttcaccttgcaaccagcagctcacacgggggctgccaggagttgccgatttcgtggtcgacattacaagcgagagttccgtttggagggcgagcccgtggccctaagatgccctcaggtgccttattggttatgggcctcggtgtctcctaggattaatcttacatggcacaaaaatgactctgccaggacggtccctggggaggaggaaacacgaatgtgggcccaagatggtgccctctggttactgcctgccctgcaggaagactccgggacctacgtctgcacaacacgcaacgccagctactgtgataaaatgtccatcgaactccgggtgttcgagaacaccgacgcctttctgccgtttatctcataccctcagatacttacattgagtacatctggtgtactagtgtgcccagatctcagtgagtttaccagagacaaaacggatgttaaaatccagtggtataaggactcattgcttctggacaaggacaatgaaaaatttttaagcgtcagaggcaccactcacctactcgtccatgacgtcgctcttgaggatgcgggatactatagatgcgtcttgacatttgctcacgagggtcagcagtataatattacacgttcaattgagctgcgaattaaaaaaaagaaggaggaaaccattccagtgattattagccccctgaagactatcagcgcctctcttgggagtcggcttactatcccatgtaaagttttcctcggcaccggcacccccctcaccacaatgttatggtggaccgcgaatgacactcacattgaatctgcctatccgggagggagggttacggaaggaccaaggcaggagtatagcgagaacaatgagaactacattgaagttcccctcatcttcgatcctgtgacccgcgaggatttgcatatggatttcaagtgcgtggtccacaatactttatcgttccagacccttcggacaaccgtcaaggaagcttcctccacattcagctggggcatcgtgctcgcaccgttaagtctggcattcctcgtcctgggtgggatttggatgcatcgtagatgcaagcatagaacggggaaggccgatgggttaaccgttctgtggccccatcaccaggatttccagagctatcccaaatag

SEQ ID NO: 227128 - DNA, 690 bp, Artificial Sequence
  Description of Artificial Sequence: Synthetic coding sequence
atgctacggttgtacgtcctggttatgggagttagtgcctttactctgcagccggcagctcatacaggagcagcgagatcttgcagatttcggggaaggcattacaagagagaatttagactggagggagagcctgtagccctgcgttgcccacaagtaccttattggttgtgggcgtccgtgagcccaagaataaacctgacctggcacaaaaatgactcagcgcgaacagtgcctggcgaggaagaaacccggatgtgggcgcaggacggcgcactatggcttctccctgcattgcaggaagacagcggaacgtacgtttgtactaccagaaacgctagttattgtgacaaaatgagtatcgaactccgggtcttcgaaaacacagacgctttccttcccttcatatcctatcctcagatcctgaccttgtctacttcgggagttcttgtctgtcctgacctgagcgaattcacaagggacaagaccgatgtgaaaatacagtggtataaggatagtttgctcttagacaaagacaacgaaaaatttctttcggtacgcggtaccacccatctgctggtgcacgacgtggccctcgaggatgctggctattatcgatgtgtcctgacttttgcccacgaaggccagcaatacaacataacacgctccattgaactgagaattaaatag

SEQ ID NO: 227129 - DNA, 1098 bp, Artificial Sequence
  Description of Artificial Sequence: Synthetic coding sequence
atgctgcctcccctgccatcaaggcttggcctgctgctgcttctgctgttatgccccgctcacgtggggggactctggtgggccgtgggcagtcctctcgtcatggatcctacaagcatttgtcgcaaagctaggaggttggcaggaagacaggccgaattgtgtcaggctgaacctgaagtggtggcggagttggccagaggagctcgactcggggttagagaatgtcagtttcagtttaggttccgtcgatggaactgttcatctcactccaaggcgttcggaagaatcctgcagcaggacattcgggagacagcttttgtattcgccattacagcagccggagcctcccacgcggtgacacaggcctgcagcatgggtgaattgctacaatgcggttgtcaggctccccgaggcagggcgccaccacgaccgagcgggcttcctggtacccctggcccacctgggccagccggttctccagaaggtagtgcagcctgggagtggggagggtgcggtgacgacgtggatttcggagacgagaaatcaaggctttttatggacgctagacacaaaaggggcaggggagatatccgagctttagtccagcttcacaacaacgaggccggaaggcttgccgtaagaagccacacacgcactgaatgcaagtgtcatggcctatctggctcctgcgctctccgaacctgttggcagaaacttcctccatttagggaggtcggtgctagacttctggagcgattccatggcgcatccagagtcatggggaccaacgatgggaaggctctccttccagccgtacgaaccctgaagcctccagggagggcggacctgctttacgctgcagactctcctgacttctgtgcacccaaccgccgtacgggatctccaggcacgcgcggtagggcgtgtaactcatccgcccctgatttgagcggctgtgatctgttgtgctgcggccgaggccataggcaggaaagcgttcagctggaagaaaactgtctctgtcgttttcactggtgttgtgttgtacagtgtcaccggtgccgagtccggaaggagctgagcctttgtctttag

SEQ ID NO: 227130 - DNA, 987 bp, Artificial Sequence
  Description of Artificial Sequence: Synthetic coding sequence
atgggtttttggatcctcgctatattaactattctcatgtactccactgctgccaagttcagcaagcagtcctggggcttggagaatgaagctctcattgtccggtgcccacgacaaggtaaaccttcctataccgtggactggtattatagccagacaaacaaatctatccctactcaagagagaaacagggtgttcgcatcgggccagttgctcaagttcctgccggcagccgtagcagacagtggtatttatacttgcatagtccgcagccctaccttcaatagaaccgggtacgcaaacgtgacgatttacaagaagcagagcgactgcaacgtgccagactacttaatgtattcaactgtgagcggtagcgagaagaactccaagatttactgtccaacaatcgatttatataattggactgccccattggaatggttcaaaaattgccaggcactccagggctcgcggtatagggctcacaaatcgttcttggttattgataacgtaatgactgaagatgccggagattacacctgcaagtttatccacaacgagaatggtgcaaactactccgttaccgccactaggtcattcacggtcaaagacgaacaggggttctctctttttccagtgatcggagctcccgcacagaatgaaatcaaagaggtggaaatcggcaaaaatgccaacctaacatgtagtgcctgctttgggaaagggacgcagttcctagccgcagtgctgtggcagctcaatgggactaaaattaccgatttcggcgagcctaggatccagcaggaggaaggccagaaccaatcattctccaatgggctggcctgccttgacatggttctacgaatagccgacgtcaaggaagaggacttactgctgcagtatgactgtctcgcactgaatctccacggactgagaagacatacagtccggctttcccgcaagaatcctagcaaggaatgtttttag

SEQ ID NO: 227131 - DNA, 780 bp, Artificial Sequence
  Description of Artificial Sequence: Synthetic coding sequence
atgggcttttggatcttagcaatcctgaccatcctcatgtacagcaccgctgccaagttctctaagcagagctggggactcgaaaatgaagctctcatcgtgcggtgtcctagacaaggaaagccctcatatactgtagattggtactattcccagactaacaagtctattcccacccaggaacgaaatagagtgtttgccagcggccaattactgaagttcctccccgctgctgtagccgacagtgggatttatacatgtatcgtaagaagcccaaccttcaacagaacgggctacgccaatgtgaccatttacaagaagcagtctgattgtaatgtgcccgactacctgatgtattcaaccgtgagtggatctgaaaaaaactctaaaatctactgtcccacaattgatttgtataattggacggcccctctcgaatggtttaaaaattgccaggctcttcaggggtcgcgctaccgggctcacaagtcatttttagtgatcgataacgtgatgaccgaggacgctggcgactacacctgcaaatttatccacaatgagaacggggcaaattacagtgtgactgctacaaggtcattcactgtaaaggtctggtgtcagtccttttgcaagctcaaaaagtcactcattttcagcaatactcactggatccaatcccttatgcggggtttcgtaatggtttactacggcgtgcacaaatgttgccgcgtggtctttaatctgtgcctgcagtacttccaacatcaccagtggccctag

SEQ ID NO: 227132 - DNA, 636 bp, Artificial Sequence
  Description of Artificial Sequence: Synthetic coding sequence
atgtatagcaccgttagtggcagcgaaaagaattctaagatttactgtccaacaattgacctgtacaactggactgcaccattagagtggtttaaaaactgccaggctttgcaggggagccgctatagggcgcacaagtctttcctggttatagataacgtcatgaccgaggacgcaggggactacacctgtaagtttatccataacgagaacggggcaaactatagcgtcacagcaacccgctcatttacagtcaaagacgagcaaggcttttcactgtttccagtaatcggagcgccagcccagaatgagattaaagaagtggaaattggaaaaaatgctaacctcacatgtagcgcatgctttggcaaaggcacccagttcctggccgctgttctgtggcagctcaacggcaccaaaattaccgatttcggagagcctaggatacagcaagaggagggccaaaaccaaagcttctcgaatgggctggcctgtctggacatggtgctgcgtattgctgatgttaaggaagaagatctgctgcttcagtacgattgtctggcactgaatttgcatggcttgaggagacacaccgttaggctgtcacgaaagaacccaagtaaagagtgtttttag

SEQ ID NO: 227133 - DNA, 945 bp, Artificial Sequence
  Description of Artificial Sequence: Synthetic coding sequence
atgggtttctggatcctggcgatcctgacaattctgatgtattccaccgcagcaaaattctctaaacagagttggggtttggaaaacgaggcactaatcgttaggtgtcccaggcaggggaagccaagctacacggtggattggtactacagccagaccaataaaagtattcccacacaggagaggaacagggtcttcgcaagtggccagctgctcaagttcctgcctgccgcagtggccgattctgggatctacacatgcatcgttaggtcgcctacctttaaccgcacgggttacgctaacgtaaccatatataagaagcaaagcgactgcaatgtacccgactaccttatgtattccactgtgtctggttctgaaaagaatagtaaaatttattgccctaccatcgacttgtacaattggacagccccactggagtggtttaaaaattgtcaggcattacagggctcacggtacagagcgcataagagcttcctcgtcatcgacaacgtgatgacggaggacgctggagactatacgtgcaagtttattcataatgaaaatggggctaattactcggttacagccacacgtagtttcacagtcaaggacgaacagggctttagtctgtttccagtcatcggggctccggctcaaaacgaaatcaaagaagtggaaatcggtacccagttccttgcagctgtgttgtggcagcttaacgggaccaagattacagacttcggcgagcctagaattcagcaagaggaggggcagaatcagtcattttccaatggactcgcctgccttgacatggtgctgcggatcgcggacgtcaaggaagaggacctcctcctgcagtacgactgtcttgcgctgaacctgcatggcctgaggagacacacagtgagactgtccaggaagaatccatcgaaggagtgcttctag

SEQ ID NO: 227134 - DNA, 117 bp, Artificial Sequence
  Description of Artificial Sequence: Synthetic coding sequence
atgggtttctggatattggccattctgactattctgatgtactccactgccgcaaagtttagcaagcagtcttgggggctggaaaacgaggccctgatcgtgagatgcccacgatag

SEQ ID NO: 227135 - DNA, 1728 bp, Artificial Sequence
  Description of Artificial Sequence: Synthetic coding sequence
atgtggtcccttctcctctgtggcctgtctattgccctccccctgtctgtcaccgccgatggctgtaaggacatttttatgaaaaacgaaatactttccgccagccagccatttgccttcaattgcacgttccctccaatcactagcggagaggtctcagttacatggtataaaaattcatcgaagatcccagtgagtaagatcattcaatcccggatacaccaggacgaaacgtggatccttttcctgcccatggagtggggcgattcaggcgtgtaccagtgcgtgattaagggcagagactcttgccaccgcatccatgtgaacctcaccgtgtttgagaagcactggtgtgataccagcatcgggggactgcctaaccttagtgacgaatacaagcagattctacacctggggaaagacgatagtttgacctgtcaccttcacttccctaaatcatgtgttcttgggcctattaaatggtataaagactgtaacgagattaaaggagaaagatttacagtgctcgagacgagactcctggtgtcaaacgtctcagcagaggatcgtggaaattatgcctgccaggccattctcactcattccgggaagcaatatgaggtattgaatgggatcacggttagtattactgaaagagccggatatggtggaagcgtgccaaaaatcatctacccaaagaatcactcaattgaggtgcaacttgggaccaccctgatcgtggattgcaatgtcactgataccaaggacaatactaacctgagatgctggcgggtcaataacactcttgtggacgactactacgatgagagcaagcggatcagggagggggtcgagacccacgtgtctttccgggagcataacttatatacagttaacattacatttttggaagtgaaaatggaggattacgggcttcccttcatgtgccacgccggtgtgagcaccgcatacattattctgcagctcccggcacccgactttcgggcttacctgatcggcggattaattgctctggtggccgtggccgtttccgtcgtgtacatctacaacatatttaaaatcgacatcgtcctttggtaccgctcggcctttcactctactgagaccattgtcgacgggaagctgtatgacgcatacgtgctttatcctaagccgcacaaggaatcccagagacatgctgtggatgccctcgtgctcaatattttacccgaggtgctcgagcgccagtgcgggtacaagctatttatcttcggcagagatgaatttcccggtcaggccgtggcaaatgtaatcgacgaaaacgttaaactatgccgacggctaatagtgatcgttgtgccagagagtcttggcttcggcctgctgaagaatctcagtgaggaacagatcgccgtttatagcgctctgatccaagatggcatgaaagtgatcttgattgagctagagaagattgaagattataccgtgatgcctgagtccatccagtatattaagcagaagcacggtgctatcaggtggcatggtgatttcaccgaacagtctcagtgcatgaagaccaaattttggaagactgtgagataccatatgccccctagaagatgtcgaccttttccacccgtccagctgctgcagcacaccccttgctacaggaccgccggacctgagctcgggtcccggcgaaagaaatgcactttaaccaccggctag

SEQ ID NO: 227136 - DNA, 519 bp, Artificial Sequence
  Description of Artificial Sequence: Synthetic coding sequence
atgtggagtctgctgctgtgtggactgagcattgcactgccactcagcgtaacagccgacggctgtaaggatatcttcatgaagaacgagatcttatccgcctctcaacccttcgcatttaattgtaccttcccaccgatcacatctggggaggtgtccgtgacttggtataagaatagcagcaaaattcccgtcagtaaaatcatccagagccgaatccatcaagatgagacctggatactattcctgcctatggaatggggagactctggagtgtaccaatgtgtgattaagggcagagatagttgccacagaattcacgtaaatctgaccgtctttgagaagcattggtgcgacacgtcaatcgggggacttcctaacttgagtgacgaatacaaacagatcttgcacctggggaaggacgactctctgacatgtcacctgcattttcccaaatcctgcgttctggggccaataaagtggtataaggactgcaatgaaatcaagggagagaggtag

SEQ ID NO: 227137 - DNA, 1374 bp, Artificial Sequence
  Description of Artificial Sequence: Synthetic coding sequence
atgacgggcctggtgtctctttcatacttcccacttagcactagaagctgcgctttgcagtcctgctccccagtctggggatgcggaccctgctgtagtgccggatgccccagtccatttcactgcctgtcgcaacaggattgcaacgagatcaagggagaacggtttacggtcctggagacgcggctgctcgtgagcaacgtgtccgccgaagaccggggaaattacgcctgccaagccatccttacgcatagcggaaaacagtacgaggttctgaatgggatcacagtaagcattaagcgcgcaggctatggtggctcggtacccaaaatcatatatcccaagaaccattccattgaagttcagctgggaaccaccctgatcgtggactgcaatgtgacagataccaaggataataccaatctgcgctgttggcgcgttaacaataccttggtcgacgattattacgacgaatccaagcgtatccgtgagggggtcgagacacacgttagttttcgcgagcacaacctatataccgtaaacataaccttcctggaggtcaagatggaggattatggtctcccctttatgtgtcatgccggagttagcactgcgtacattattttacaactgcctgcccctgactttagggcctacttgattggaggccttattgcattggtggccgtagccgtaagtgttgtttatatatacaatatctttaagatagacatagtcctctggtaccggtccgcgtttcactccactgaaactatagttgacggtaagctttatgacgcttacgtgttatatcccaaaccccataaggaaagccagaggcacgctgtagatgctctggtgttgaacatcctacctgaggtgctggagcggcagtgcgggtacaaactgttcatctttggtcgggacgaattcccaggtcaggccgtggcgaacgtgatcgatgagaacgttaaactttgccggagactgattgttatagtcgtgcccgaatccctgggctttgggttattgaaaaacttatctgaggaacagatcgccgtttactcggctctgatccaggacggaatgaaggtaatcttgatcgagttggagaaaattgaagactacaccgtgatgccggaaagcatacagtacatcaagcagaagcacggcgctatacggtggcacggcgattttacagaacagtcccaatgcatgaagacaaagttctggaaaaccgttaggtaccacatgcctccgagacgctgccgcccattcccccctgtacagcttctccagcacactccgtgctacaggacggctggccctgaactcgggtctcggcgtaagaagtgtaccctgaccaccggctag

SEQ ID NO: 227138 - DNA, 1728 bp, Artificial Sequence
  Description of Artificial Sequence: Synthetic coding sequence
atgtggagcttgctcctatgcggactatctatcgccctcccactgtctgtgactgcagacggctgtaaagacattttcatgaagaatgaaattctgagcgccagtcaaccctttgctttcaactgtacattccctccgatcacatccggagaggtgtccgtcacctggtataagaatagttcaaagataccagtctccaagattattcagtcacggattcatcaggatgagacctggatactgttcctaccgatggaatggggagacagtggagtttatcaatgtgtgatcaaggggagggattcatgtcaccgaattcatgtgaacctgacggtgtttgagaagcactggtgtgatacatctataggcggtttgccaaatttgtccgacgaatacaagcagatccttcaccttggaaaggatgacagtctgacctgccatctgcacttcccaaagtcttgcgtcctcggaccaattaaatggtacaaagactgcaatgaaattaaaggagagcgattcactgtcctggaaactaggctgctcgtatctaatgttagcgccgaagatagagggaactatgcttgccaggccatccttactcatagtggtaagcagtacgaagtgctgaacggaataactgtttcaatcaccgaacgcgcaggctacggaggcagcgtacctaaaattatttacccaaaaaaccacagcatcgaagtgcagctgggcaccaccctcatagtcgactgcaacgtcactgacactaaagataacacaaatctcagatgttggcgcgtcaacaacactctggtggacgattactatgatgagagcaagagaatcagggagggagtggagactcacgtcagctttcgagaacataacctgtacaccgtcaacattacctttctcgaggtgaaaatggaggattatggactgccgttcatgtgccacgctggtgtgagcactgcctacataattctacaactcccagctcccgacttcagagcttacttgattgggggactgattgctctggttgctgtggccgtgtcagtagtgtatatctataatatttttaagattgacatcgttctttggtatcgtagtgcctttcatagtacggagaccatagtggatggtaagttgtacgacgcttatgtgctctaccccaagccccacaaagagagtcagcgacacgccgtggatgccctcgttcttaacatacttccggaagttctcgaacgccagtgcggctacaagctttttatttttgggagggacgaatttcctggacaggcagtagccaacgtcatcgatgaaaatgtgaagttatgtcggcgacttatcgttattgtcgtgcctgaaagcttaggctttggcttgcttaaaaatttatctgaggagcaaatagccgtgtatagtgcgctaatccaggacggcatgaaagtaatattgattgaactggagaagatcgaggactacactgttatgcccgagagcattcaatacattaaacagaagcacggcgctattaggtggcacggcgattttaccgagcagtcccagtgtatgaaaaccaagttctggaagacggtaagataccacatgcctccccgtaggtgtcggccatttccacccgtccagctactccaacacactccgtgctataggacagctggacctgagcttggctccagaaggaaaaagtgcaccttgacaactggatag

SEQ ID NO: 227139 - DNA, 300 bp, Artificial Sequence
  Description of Artificial Sequence: Synthetic coding sequence
atgcagccccgtgtgctgctggttgtggccctcctggccctgcttgccagtgctcgagcctcagaagcggaggacgcctctctgttgtcattcatgcagggctacatgaagcacgcgacgaagacagcaaaggacgcattgtcatctgtgcaggagtcacaagtagcccaacaggcacgtggctgggtaaccgatggcttttcctccctgaaggattactggtccaccgtgaaagacaagttttccgaattctgggatttggaccctgaggtgcggcctacatccgcggttgccgcttag

SEQ ID NO: 227140 - DNA, 1500 bp, Artificial Sequence
  Description of Artificial Sequence: Synthetic coding sequence
atgtcccggacagagttgccgtcacccccatccgtctggttcgaggcagaatttttccatcatatcttgcactggactccaattcccaatcagagtgagagcacctgttacgaagttgccctcctccgatacgggatagagagctggaatagtatcagtaattgtagccagaccttaagctatgatctaacagccgtgaccctcgacttataccattccaatggataccgcgctcgtgtgcgggctgtggatgggagccgccactccaactggactgttactaacacaaggttctctgtcgatgaagtgacactaacggtcgggtctgtgaatctggagatccacaacggttttatactggggaagattcagctccccagacccaaaatggctccagccaatgacacctatgagtcaattttcagccactttcgcgaatatgaaattgccattcgaaaggtccctggtaactttacattcacgcataagaaagtaaagcacgagaatttttccctgttaacctcaggagaagtcggtgaattttgcgtgcaggtgaagccatcagtggcatctcgtagcaataaaggcatgtggagcaaagaagagtgcatctcactgacgcgtcagtactttaccgttactaatgtgattatctttttcgccttcgtgctgctgctctcaggggcattggcatattgtttggcgctgcaactgtatgtgagacggagaaaaaagctcccttctgtgctgctctttaagaaaccatccccttttatatttatctcacagcgaccttctcccgagacgcaggacacaattcaccccctggacgaggaagctttcctgaaagtcagccctgagttaaagaaccttgacctccacggctctacagactccggctttggctccacaaagcctagcctgcaaacagaggaacctcagtttctcctgccagatcctcaccctcaggcagacagaactctgggtaacagagagccgcctgttctgggggactcttgcagctcaggatcttcaaacagcactgatagcgggatatgtctccaagagccgagtctgagcccctccaccggccctacatgggagcagcaggttggtagtaatagtcgaggtcaggacgacagtggcattgatctggttcagaatagcgaaggcagagcgggtgatacccagggcggtagcgctctcggccaccatagcccccctgagcccgaggttcctggcgaagaagaccccgctgccgtcgcttttcagggctatctgcgccagacaaggtgcgccgaggagaaagcaactaagactggctgtctcgaggaggagtcaccactcacagatggacttgggcctaaattcggaaggtgtctggtagacgaggcaggcctccatccaccagccctggccaaaggatatctgaagcaggatcccttagaaatgacactggcctccagcgggcctaatggaaccgtcgagcccgcacactag

SEQ ID NO: 227141 - DNA, 1677 bp, Artificial Sequence
  Description of Artificial Sequence: Synthetic coding sequence
atgtcgcgcactgagcttccatcccctccgtcggtgtggttcgaggctgagttttttcatcatatcctccactggacaccgatccctaaccaatcggaatctacctgctatgaggtggctctgctaaggtacggcattgagtcatggaatagcatttctaactgttctcagaccctgtcctatgatctgaccgcagttacacttgatctgtaccactccaatggatacagagcacgcgtgcgcgcagttgacggctcacggcatagcaactggacagtgaccaacacccggtttagcgtggacgaagtcaccctgacagtagggagtgtaaacctggagattcacaatggcttcatactgggcaaaatccaactgccaagacccaagatggctcccgcaaacgacacatacgagagcattttttcacattttcgcgagtatgaaatagccataagaaaagtacctggaaacttcacatttacccacaagaaggtgaagcacgagaactttagcctgctgacctccggcgaggttggcgagttttgtgtccaagtcaagcccagcgtggccagtagatccaacaagggaatgtggagcaaggaagaatgtatttccctcacaagacagtattttacagtaaccaatgtaatcatattctttgccttcgtcctgctattatccggagcactggcatactgccttgcgttgcaactgtacgtccgaagacgcaagaagttgccgagtgtgctcctgttcaagaaaccttcgccgtttattttcatcagccagaggcctagccctgaaacccaggatacaattcaccccctcgatgaagaagcatttctaaaggtcagccccgagctaaaaaatctggacctgcacggctctacggacagtggatttgggtccaccaagccaagtctgcagacggaagagccccagttccttctgcccgacccccacccccaggctgatagaacccttggaaatagagagccacccgttctgggtgactcctgcagctctgggagctctaattctaccgacagtggcatctgcctgcaggagccgtctctttctcccagtacaggtccgacctgggagcagcaagtcggcagcaacagtcggggtcaggacgactctggcatcgatctggtgcagaactccgaaggcagagcgggtgacacgcaggggggaagcgctctcggacaccattctcctccagagccggaggtacccggagaggaggatccagccgctgtggcattccagggctaccttcggcagactcgctgcgctgaggagaaagccactaaaaccggctgcctggaagaggagagccctctgactgatggccttggacctaagtttggtcgctgtctcgttgacgaagctggcctccatcctcctgcgttggccaagggttatttgaaacaagatcccttggaaatgaccctggcatccagcggcgcacccaccggacagtggaatcagcctactgaggagtggagtttgctcgccctgtcatcctgttctgatctagggatttccgattggtcctttgcacatgatttagcaccactgggatgcgtggcggctcctggaggattgttgggaagctttaactctgatttagtcacattaccgcttatcagctccttgcagagcagcgagtag

SEQ ID NO: 227142 - DNA, 1290 bp, Artificial Sequence
  Description of Artificial Sequence: Synthetic coding sequence
atggccccagccaatgacacctatgagtcaattttttcccatttccgagaatacgagattgccatcagaaaggtacctgggaattttacattcactcacaaaaaggtgaagcatgaaaacttttccctgctgacttctggcgaggtgggagaattttgcgtgcaggttaagccttctgtggcttcccgcagtaacaaagggatgtggtcgaaggaagaatgcattagtctgacccgccaatatttcaccgttactaacgtgattattttctttgcctttgtgctccttctgtccggcgcactggcttattgcctagctttgcagctgtatgttcggagacgaaaaaagcttccttcggttctcctgttcaagaagcccagtccttttatctttatctctcaaaggccctccccagagacccaggatactattcaccctctagacgaagaggcatttctcaaggtttctccagagttgaagaatcttgatctgcacggcagcacggactctggattcggatctaccaagccgtcacttcaaactgaagagcctcagttccttttacccgatccacacccccaggcagatcggactctgggcaacagagaaccacctgtgcttggagatagttgctcttccggaagcagcaattccacggacagtggcatatgcttgcaggagccatcccttagcccctctacagggccaacttgggagcaacaagttggctcaaactctcggggacaagacgattcagggatagatttggtccagaatagcgagggacgcgcaggggatactcagggcggatccgcgttgggccaccactccccgccagaacccgaagtccctggcgaggaagaccctgccgctgtagctttccagggatacctgaggcaaacgcgctgtgccgaagagaaggccactaaaaccggctgtctcgaggaagagagtcccttaaccgacggcttgggtccgaagttcgggaggtgcctggtcgatgaagctggcctccatcctcccgctctggccaagggttacttaaagcaggatccactcgaaatgacccttgcgtcgagtggggctcccacaggccagtggaatcagcccactgaggagtggtccttgctggccctgtcttcatgttccgatttgggcatcagcgactggtcttttgctcatgacctggccccattgggatgcgtcgccgctcctggaggcctgcttggcagttttaattcagatctggtgactctgccactgatctcatccctgcagtcttccgagtag

SEQ ID NO: 227143 - DNA, 1269 bp, Artificial Sequence
  Description of Artificial Sequence: Synthetic coding sequence
atgagctcttcatgcagtgggctgagcagagtgctggtggcagtggctaccgctctcgtgtccgcgagtagcccgtgcccccaggcctggggcccaccgggagttcaatacggacaacccggaaggagtgtcaaattatgctgtccaggagtgaccgctggggaccccgtgagctggtttagagatggcgaacctaagctcctgcagggtccagactctggtctgggccacgaactggtcctcgcacaagcagactcgaccgatgaaggcacttacatctgtcaaacactggatggcgcactgggcggaacagtcacgctgcagctgggatatccgcctgctcgacctgtcgtttcctgtcaggccgctgactatgagaacttctcgtgcacctggtccccttcccaaatctccggcctgccaacacgatatctgacttcatatagaaaaaagaccgtgttgggggcagactcccaacggagatctccctccaccggcccttggccatgtccgcaggacccccttggcgcagccaggtgcgtcgtgcatggagcggagttttggtctcaataccgcattaatgtgacggaagtcaatccactaggagccagcaccaggctgctcgacgtcagcttgcagtctatactgcggcctgaccccccacaggggctgcgcgtggagtctgtgccaggatatccccgacgcctccgcgcatcatggacgtacccggcatcctggccctgtcagcctcattttcttctgaagttcaggctgcagtataggcctgctcagcatccggcatggtcaaccgtcgagcctgccggtcttgaagaggtgattactgatgccgttgccggactaccgcatgccgtcagagtcagcgccagagactttctggacgcaggaacctggtctacctggtctcctgaggcatggggaacgcccagtacaggcaccattccaaaagagattcccgcttggggccagttacatacgcagcctgaagtcgaacctcaggtagacagtccagcaccacctagaccgagcctccagccacacccaagactactggatcatagagactcggtggaacaggtcgctgttctggcttcgcttggcatactgagctttttgggacttgtggccggagccttggctctgggactctggcttaggttacgacgcggtggcaaagatggttcacccaagccaggatttctagcatcagttattcctgtcgacaggcgcccaggcgctccaaacctgtag

SEQ ID NO: 227144 - DNA, 1173 bp, Artificial Sequence
  Description of Artificial Sequence: Synthetic coding sequence
atgtcttctagctgcagcgggttaagtagagtgctcgtcgccgtcgccaccgccttggtgagtgccagctcaccctgtccccaagcatggggacccccaggcgtgcagtatggacaacccggtaggtctgtcaaactgtgctgtccaggtgtgacggccggtgatccggtgtcctggttcagggacggcgagccgaagctcttgcaggggccagatagcggcctgggacacgagctagtgctggcccaagcagattctactgacgaaggtacgtacatttgtcaaaccctcgatggagcgctagggggaacagtgacccttcagctgggctatcccccagctcggccagttgtatcttgtcaagctgccgattacgagaacttttcatgcacctggtcgccatcccaaatctctggcctgcctacgcgctacctcacaagctaccggaagaagacagtgctgggggcagactcccagcgaagaagcccctccacaggcccttggccttgtccacaggaccctctgggagctgcaagatgtgtagtacacggtgctgaattctggtcacagtacagaataaacgttactgaggtgaaccccctcggggcaagcacacgcctgctcgatgtctccttacagtccatcctgcggccagacccgccacaggggctcagggttgagtccgtgcctgggtaccccagacgtctccgcgcttcttggacgtatccggctagctggccttgccagccacactttcttctgaaattccggcttcagtatcggcctgcacagcacccagcctggtctacggttgagcccgctggactggaagaggtcatcaccgatgctgtggccggtcttccacacgccgttagagtttctgctcgcgatttcctggatgccggtacttggtctacgtggagccctgaagcctggggcacgccttcaacagggacaataccaaaggagattcctgcctggggccagctccacacgcagcccgaggtggagccacaggtagatagccccgcaccaccgagaccgtcgctccaaccccacccacggttactcgatcaccgcgatagtgtggagcaagtggcagtgctcgcctcactaggcatcctgtctttcctagggttagtagctggggctctagctttaggactgtggtag

SEQ ID NO: 227145 - DNA, 1269 bp, Artificial Sequence
  Description of Artificial Sequence: Synthetic coding sequence
atgtctagtagttgctccggcttgtctagggtgctggtcgcagtcgcaaccgcgctggtgtctgcatctagcccttgtcctcaggcctggggaccaccgggagtgcagtatgggcagccaggccgtagcgtgaaactttgttgtccgggagttaccgccggagaccctgtctcctggttcagagacggcgagcctaagctccttcagggacccgacagcgggcttggacacgagctggtcctcgcgcaggctgactcgactgacgaaggcacctatatctgccaaaccttggatggcgctttgggcggtaccgtcacgttacagttgggttatccccctgccaggcctgttgtgtcttgccaggcggctgactatgagaatttcagctgcacatggtccccctcacagatctctggtctacccactagatacctcaccagttatagaaagaagaccgttctcggggcagacagtcagagaagaagcccttcaacggggccttggccatgccctcaggaccccctcggtgccgctcggtgtgtggtccatggcgcagaattttggtcccagtaccggatcaacgtgaccgaggttaacccccttggagcctcgaccagacttctggacgttagcttacaatccatcttaagaccagacccgccacagggtctgcgcgtggagagcgtgccgggatatcccaggaggctgcgagcatcgtggacgtatccagcatcttggccatgccagccacacttcctcctgaaattccggctgcagtacaggcccgcacagcaccccgcttggagtacagtcgaacctgcaggcctggaagaagtcattaccgatgcagtggccggtctcccccatgcagtgcgtgtgtcagccagagatttcctagatgccggtacatggtcaacttggtccccagaggcgtggggcacacccagcacaggaactataccgaaggaaattcccgcatggggccagcttcacacccagcctgaggtagaaccccaggtggatagccctgcaccccctaggccttccctacagccccatccaaggttgctggatcatagggattctgttgaacaggtcgcggttctggcgagcttaggcatcttaagcttccttggcctagtcgctggcgcattggcccttgggctgtggttgaggctgagacgtggtggcaaagacggatctcccaaaccaggatttctggcatcagtgattccagtggatagacggcctggcgctccaaatctgtag

SEQ ID NO: 227146 - DNA, 1269 bp, Artificial Sequence
  Description of Artificial Sequence: Synthetic coding sequence
atgagcagcagctgctccgggctgtcgagggtcttggtcgctgtggccactgcgctggtttctgcgtctagcccatgtcctcaggcctggggcccaccaggagtgcagtacgggcagcctgggaggtccgtcaaactgtgttgtccaggagttactgctggggacccagtgtcatggttcagggacggagaaccaaagctattacaaggaccggacagcgggctgggacatgagctcgtccttgctcaagcagattccactgacgagggaacatatatctgccaaactctggacggggcactgggcggaactgttaccctgcagctggggtatccaccggctaggcccgttgtttcgtgtcaggctgctgattatgagaacttctcctgtacgtggtcaccatcccagatttcagggttgcctaccagatacttaacaagctacagaaagaaaacagtgcttggagctgatagtcagaggagaagcccctccacaggtccttggccatgtccacaggatcctcttggggctgctagatgcgttgtgcacggagccgaattttggtcacagtaccgcattaacgtaactgaggtgaacccattgggtgcttccactcgccttctcgacgtgtccctgcagagtattttaagacccgatccaccccagggtctgagagttgaatccgtaccaggctatcccagaaggctgagggccagctggacttaccccgcttcatggccatgccaaccccactttttgcttaagttcagactccagtaccggcctgcacagcaccctgcctggagcactgtggaacccgctggcctggaagaagtgatcacagatgcagttgcagggctgccccacgccgtccgggtgtccgcacgggattttctagatgcaggaacctggtccacctggtcccccgaggcatggggtacaccaagtactggaactattccaaaggagatccccgcttgggggcagttgcacacccaaccagaagtggaacctcaggtggattcgcccgctccacccaggccttctctccagcctcatcctcggttgctagaccatcgggatagtgttgaacaggtggccgtgctggcgtcattgggcatcttatccttcctgggcctcgtggccggtgccctggcgctaggcctgtggttacgcttaaggcgaggtggaaaagatggcagccccaagcctgggtttctggccagtgtgattcccgttgacaggcgccctggtgcacccaacctgtag

SEQ ID NO: 227147 - DNA, 813 bp, Artificial Sequence
  Description of Artificial Sequence: Synthetic coding sequence
atgtcttcttcctgtagcggacttagccgggttctggtggccgtggccacagcactggtctccgcttcatctccttgcccacaagcctgggggcctccaggcgtccagtatggtcagcctggacggtccgttaaattgtgttgccccggagtaaccgctggtgatccagtttcttggttccgggatggtgaaccaaagctgctgcagggacctgacagtggtctaggtcacgagctcgtcctggcccaggccgactcaaccgatgagggcacttacatctgtcagacgttggacggcgcactggggggaacagtcactctgcaactgggatacccccctgctaggcccgtagtaagttgtcaggccgctgactacgagaatttttcttgcacttggtctcctagccaaatctcaggtcttcccacaagatatctgactagctacagaaaaaaaacagtcctcggagctgacagtcaacgcaggtctccttccacagggccttggccatgtcctcaagatccgcttggtgcagctcggtgtgtagtccacggggcagaattctggtcacaatataggatcaatgtgacagaggtcaacccgctcggcgcttctaccaggctgctagatgtgtcacttcagagcattctgcgccctgatcctcctcaagggttaagggtagagtccgttccaggctatcctaggcggctgagagcttcctggacttaccccgcatcctggccatgtcaaccccactttctcctgaaattcaggctccaatacaggccagcccagcacccagcatggtcaacctag

SEQ ID NO: 227148 - DNA, 504 bp, Artificial Sequence
  Description of Artificial Sequence: Synthetic coding sequence
atgtccagctcatgctctggactgtctagggtcttggtcgccgtggcaaccgcgctggtgtccgcttctagtccatgcccccaagcttgggggccacccggtgtccaatacggccagccaggtcgctctgttaagctctgctgtcctggcgtgacagccggtgatcctgttagttggttcagagacggcgaacctaagctactgcaggggccagactcaggcttggggcatgagttggttttggcacaggcagacagcaccgacgaggggacctatatctgtcagaccttggacggagccctaggaggcacagtgacactgcagcttggctaccccccagcaagacctgtggtgtcgtgtcaggctgccgattacgagaatttttcatgtacctggagtccgtcccaaattagcggtcttcctacaaggtacctaacctcttacaggaagaagacggtgttgggcgcagactctcagagacgcagcccgtccaccggcccttag

SEQ ID NO: 227149 - DNA, 420 bp, Artificial Sequence
  Description of Artificial Sequence: Synthetic coding sequence
atgagttcctcctgtagcggactttcacgggtgttggtcgctgtggcaacggccctggtcagtgcaagtagcccttgccctcaagcttgggggccacctggagtgcaatacggccaaccagggcgaagcgtgaagttatgttgccctggcgtgacggccggagatccggtgtcttggttccgggacggcgagccaaagctcttgcagggaccagatagtggtctaggccacgagcttgtgcttgcccaggccgactccactgacgagggaacttacatctgccagaccttggatggcgcattgggaggaaccgtgactctccagctgggctatcctcccgctcgaccggtggtaagttgccaagcagcagactacgagaatttctcctgcacgtggagccctagccaaatatcagggtag

SEQ ID NO: 227150 - DNA, 1989 bp, Artificial Sequence
  Description of Artificial Sequence: Synthetic coding sequence
atggaacccctggtgacctgggtcgttcctttgctgttcttgttcctgctgagtaggcagggagctgcctgtcggacctccgagtgttgcttccaggatccaccatatcctgacgcagatagcggaagtgcaagtgggcctcgtgatcttcggtgctaccgaatctcttctgacagatacgagtgcagttggcagtacgagggccctactgctggggtgtctcattttttgcgatgttgcctaagctcgggacgatgttgttatttcgctgccggaagtgccacccggctgcagttttctgatcaggccggtgtgtctgtactttatactgtgaccctctgggtagaatcatgggcccgtaaccaaactgagaagagcccagaagtaacactgcagttgtacaattcagtaaagtatgagccacctttgggagatatcaaggtgtcaaaactcgctggccaattgcggatggagtgggagactcccgataaccaggtgggtgccgaggtacagttcagacatcgcacgcccagctcaccttggaagttaggggattgtgggcctcaagacgatgacaccgagagttgcctgtgccctctggaaatgaatgtcgcccaggagtttcaactgaggcgtcgacagctcggttcacagggcagtagctggagcaagtggtcctcccccgtttgcgtaccccctgagaacccccctcagcctcaagtccgtttttccgtcgagcagctgggccaggacggtcgacgaaggcttacccttaaggagcaaccaacgcagctcgagttacccgagggatgccagggactggcgccaggaacggaggtcacataccgtctgcagcttcacatgctcagctgcccctgcaaagcaaaagccacgcgaactttgcacttgggtaagatgccctatctaagtggagcagcatataacgtcgcggttatctcaagcaatcagtttggtccaggcctgaatcagacctggcatatcccagccgacacacacaccgagccagtggcactcaacatttctgttggcactaacgggaccactatgtattggcctgccagggcccaatctatgacttactgcatagagtggcagcccgttggccaggatggcggtttggcaacttgttccctcaccgcccctcaggatccggaccctgcaggaatggcgacttacagttggtctcgcgagtcaggcgctatgggacaagagaaatgttactatattactatttttgccagcgctcaccctgaaaagctcaccctgtggtcaactgtcctgtcaacataccattttggaggcaatgccagcgctgccggaactccacatcacgtctccgtaaagaatcacagcttggattctgtctcagtcgattgggctccatcgctcttaagtacctgtccaggcgtgctgaaagagtatgtggtgagatgtcgcgatgaagattcaaaacaggtctccgagcatccagttcagcccacagagacacaggttacactctctggtctgcgagctggtgttgcatacacagttcaagtgcgcgctgacacagcttggttgcggggtgtgtggagtcagccccagagatttagtattgaagtccaagtgtctgactggctgatattctttgcgtccctgggaagtttcttgtccatcctgctggtcggggtcctcggctatctcggattaaaccgggctgcacgacacctctgcccacccttacctaccccttgcgcctcttctgcgatcgagttccccggtgggaaggagacctggcagtggatcaatccggtcgacttccaggaggaagcttccctccaggaggcccttgtcgtcgagatgtcctgggacaagggagaaaggacagagcccctggaaaaaaccgaacttcctgaaggtgctccagagctggcattggacactgagttaagcctggaagacggagatagatgcaaggctaaaatgtag

SEQ ID NO: 227151 - DNA, 1146 bp, Artificial Sequence
  Description of Artificial Sequence: Synthetic coding sequence
atggagcccctagtaacgtgggtcgtgccactcctattcttgtttttgttatcgcgccagggagctgcatgcaggacctctgagtgctgcttccaagacccaccataccctgacgccgacagcggaagtgccagcggcccacgggacctccgatgttatcgcatctcaagcgatagatacgaatgctcctggcagtacgagggtcccacagctggagtctcccattttctgaggtgctgtttgtcttcgggaaggtgctgttactttgcggcaggatcagctacccggcttcagtttagcgaccaggccggagtgagcgtcctctacactgtgactctgtgggtggaatcctgggccagaaaccaaaccgagaaatcgccagaggttacccttcaactctataactcagttaagtatgagcctcccctaggtgacattaaagttagtaagctggccggtcagctgagaatggaatgggaaactcccgataatcaggtgggggcagaggttcaatttcgccataggactcctagcagcccctggaagttaggggattgcggccctcaagacgacgacaccgagtcctgcctttgccccctggaaatgaatgtggcgcaggaattccagttgaggaggcgccagctgggctcccaggggtcctcttggagtaaatggtcttctcctgtgtgtgtacctccggagaacccacctcaaccacaggtgcgcttctccgtagagcagttgggtcaggacggtcgacgcagactcaccctgaaagaacaacctacccagctggaactcccagaaggatgccagggactagcgccaggaacagaagtcacttacagactccagttgcacatgctgtcatgtccctgtaaggctaaagcaactaggactctgcatctgggcaagatgccctatctgtcaggcgctgcttacaatgtggcggtgatatcctccaatcaatttggcccaggactcaaccagacctggcatatccctgctgatactcatacagacggtatgatcagcgcccattgtaacttgcggctgcctgattctcgggattcaccagctagcgcttcaagggtggcaggcattacggggatttgccaccacactaggttgattttgtacttttag

SEQ ID NO: 227152 - DNA, 1989 bp, Artificial Sequence
  Description of Artificial Sequence: Synthetic coding sequence
atggaacctctggttacgtgggtcgtgcccctcttatttctgttcttgctctcccggcagggggcagcttgccgtacgtcagaatgctgttttcaggaccctccctacccagatgctgactcgggatcggcaagcggccctcgagatctgcgatgttatcgcatctcctcagatcgttacgaatgctcttggcaatatgagggtcctacagccggagtcagccactttttgaggtgctgtcttagtagcggcagatgctgctatttcgccgcaggcagcgccaccagactccaattctcggaccaagccggagtgtctgtgctgtacactgtgaccttatgggtggaatcttgggcacgcaatcagaccgagaagtcccctgaggtaacccttcagctgtataatagcgtcaaatacgagcccccactgggtgacatcaaggtgagcaagctggccggacagctccggatggagtgggaaactcctgataaccaggtgggcgctgaggttcaatttcgccaccgaactccgtcttctccgtggaagttgggcgactgcggccctcaggatgacgatacagagagttgcttatgccctcttgaaatgaatgtagcccaggagtttcaattacgacgcaggcaactggggtcacagggatcatcctggagcaaatggtcctctcccgtgtgtgtaccaccagagaaccccccacagccacaggtcaggttctctgtggaacaactcggtcaggacggcaggagacggcttaccctcaaggagcaacctacccaattagagctgccggagggatgccaaggattggccccaggcactgaagtgacttacaggttacagctacatatgctgtcatgtccctgtaaagccaaggctacccggacactccatttggggaagatgccttatctttccggggctgcctataacgtcgctgtaatttcctcaaaccagttcgggccaggtttgaaccaaacatggcacattcctgctgacacacatacagagcctgttgcgttgaacatctctgtcggaacaaacggtaccaccatgtattggccggctagggctcagtccatgacctactgtatcgagtggcaaccagtcggccaggatgggggactggcaacctgttccctgacagcccctcaggacccagacccagccggaatggccacatattcctggtcaagagagagcggcgctatgggccaggagaagtgttattacattacaatttttgccagcgcgcacccagagaagctcaccctgtggagcaccgtgctgagcacatatcacttcgggggtaatgcgtcagcggctggaactccccaccacgtctcagtcaagaaccactcactggatagtgtttccgtggactgggccccttccctccttagcacttgccctggcgtgttgaaggaatatgttgtgcgttgcagagacgaggactccaagcaggtgtctgagcatcccgtccagcctacagagacgcaggtgaccctctctggtcttcgggctggggtcgcatatacggtccaggtcagagccgacacagcctggcttagaggcgtgtggtcccagcctcagagattctctatcgaagtgcaagtctctgattggctgatcttcttcgcctctctcggatccttcttatctatcctgttggtgggcgtacttggatacctggggctgaaccgggctgctcgccatctgtgcccccctctgcccacgccatgcgcaagcagcgctatcgaattccccggtggcaaagaaacttggcagtggattaacccagtcgattttcaggaggaggcttcactacaggaggccctggtcgttgagatgtcctgggataagggcgagcggactgagcccctagaaaagactgagcttccggagggagcaccagagctggccctggacactgaactgtccctggaggatggggacagatgcaaagcaaagatgtag

SEQ ID NO: 227153 - DNA, 2589 bp, Artificial Sequence
  Description of Artificial Sequence: Synthetic coding sequence
atggctcatacatttcgcggatgcagcctggccttcatgtttattatcacgtggctcctcattaaagcaaagattgacgcttgtaagcgaggggatgtgactgtcaaaccgtcccacgtgattttactgggatctacagttaatatcacctgctcgctcaagcccagacaaggttgtttccattacagccggaggaacaaactgattctgtacaaattcgacaggcggataaacttccaccatggccactctctgaactcccaagtaacaggcctccctctgggcaccactcttttcgtgtgcaaactggcctgcatcaactcagacgaaattcaaatttgcggtgccgagatcttcgtgggcgtagcccctgaacagcctcagaacttgagctgcatccagaagggggagcaaggaacagtagcttgcacctgggagaggggaagagatacgcacttgtacacggagtataccctgcagttgtccgggcctaagaacctaacctggcaaaaacaatgtaaggacatctactgtgactaccttgattttggaattaacttaactcctgagtctccagaaagtaattttacagccaaggtgacagcagtaaactcactgggaagtagcagttcgcttccttcaaccttcactttcctggatatagttcggccactgcctccttgggacatcaggatcaaattccaaaaagcctccgtctcacgatgtaccctctattggagggatgagggcctggtactgttaaacaggctgcgataccgtcccagcaattccaggctgtggaacatggtcaacgtcaccaaagcaaaaggacggcacgatctgctggatctgaaaccctttaccgaatatgaattccagatcagctcaaaactgcacctttacaagggttcctggtccgattggtccgagagccttagggcacagactcctgaagaggaacctactggaatgctggatgtttggtatatgaagagacatatagactactctagacagcagatatcactgttctggaagaacctgtcagtgtcagaggccagggggaagattctgcactatcaggtgaccctccaagagttgacagggggaaaagccatgacccagaacattaccgggcacaccagctggactaccgtcatccccagaaccggcaactgggcagtcgccgtgtccgcagctaacagtaagggaagctccctcccaactcggatcaacatcatgaacttatgcgaggccggactattggccccaaggcaggtcagcgccaattctgagggcatggataacatcctcgtgacatggcagccgcctcgtaaggatccgtctgccgtgcaggagtatgtggtggagtggcgcgaactccatccaggcggagacacccaggttccactaaactggctgcgatcccgtccatataacgtgtctgctctcatctccgagaatattaagtcatacatatgttatgagatcagagtgtatgcactgagcggcgatcagggtggatgttcctccatactgggaaactcgaaacataaggcccctttaagtgggcctcatatcaatgccataactgaggagaaggggagcatcctcatttcctggaactcaatccccgtccaggagcagatgggatgccttctacattaccgtatatattggaaggagcgtgattctaacagccagccgcagctgtgcgagattccctaccgggtgtctcagaactcacatcccatcaattcgctgcagccccgtgtcacctacgtactgtggatgaccgcactgaccgctgctggcgaaagtagccatggcaatgagcgcgaattttgtttacagggaaaggccaattggatggctttcgttgctccttctatatgcatcgcgatcatcatggtagggatcttcagcacgcactattttcagcagaaggtctttgtgctgctggctgcacttcggccacagtggtgctcgcgtgaaatccccgatcccgctaactcaacctgcgctaagaagtatcccattgctgaagagaaaacccagttgcccctcgacaggctgctcattgactggcctacccccgaagacccagagccactcgtgatcagcgaagtcctgcatcaggtgaccccagtgtttcgccacccgccttgctccaattggcctcaacgtgagaaggggatccagggtcaccaggcctcagagaaggacatgatgcactccgctagttcaccgcctcctccacgggctctacaagccgaaagccggcagctcgtcgacttgtataaggtcttagagagccggggatccgaccctaagccagaaaaccccgcttgtccctggaccgtgctccctgctggagatctccctactcatgatgggtacctcccgagcaatatagacgacctcccatctcacgaggcaccactagccgattcactggaagagcttgaacctcagcatatctcgctctccgtgttccctagttccagcttgcaccctctgacattcagctgtggcgataagctcacactggaccagcttaagatgcgctgtgatagtctaatgctgtag

SEQ ID NO: 227154 - DNA, 1980 bp, Artificial Sequence
  Description of Artificial Sequence: Synthetic coding sequence
atggcccacacattcagggggtgctcactcgcctttatgttcattatcacttggctgctaatcaaggccaagattgatgcgtgtaagcgaggcgacgtcactgtgaagccttctcacgtcatcctcctgggatccaccgtgaacataacctgcagcttgaagcccagacagggttgtttccactattctcgacgaaacaagctgatcctgtacaaattcgatcgccgaattaattttcatcacggtcactctctgaattctcaggttaccggattaccattaggcaccacacttttcgtgtgcaagctggcctgcatcaattctgacgaaattcagatttgcggagctgaaatatttgtgggtgttgcacccgagcaaccgcaaaacctttcatgcatccaaaaaggggaacagggcactgtggcttgtacatgggaacgtgggagggacacccatctatacacggaatacaccctacagctctccggccctaagaatctaacctggcagaagcagtgcaaggacatctactgtgactatctcgatttcgggatcaatttgactcctgaaagcccagagtctaactttacggctaaggtgacagccgtgaactcactggggtcctcctcctccttgcctagcaccttcacattccttgacattgtgcggccacttcccccatgggacatccgcattaagtttcagaaagcgagcgtgtcaagatgcacgttgtactggcgtgacgaggggctcgtcctgctaaaccggttacgttaccggcctagtaattccagactgtggaatatggtaaatgtgaccaaggctaaaggcagacacgatctactggacctaaagccctttacagagtatgaatttcagatctccagcaaactccacctgtacaaggggtcctggagtgactggtctgagagtttaagagcccagacgcccgaggaggaacctaccggaatgcttgatgtctggtatatgaagcgtcacatcgattactcaaggcagcagatctctctcttttggaagaaccttagcgtgagcgaggcgcgaggaaagatcctgcattaccaggtaacactccaggagctgacagggggaaaggcaatgacacaaaatattacaggtcatacttcttggaccacagtgatccccagaaccggcaactgggctgttgcagtgagtgcagctaacagcaagggtagtagcttacccactagaattaacatcatgaatctgtgcgaggcaggtctcctggcccctcgccaggtatcagctaacagtgagggcatggacaatatcctcgtgacttggcagccccctcgtaaggatccatccgcagtccaggaatatgttgtcgaatggcgcgagttgcatccaggcggagacactcaggtccctctaaattggttgaggtccagaccatataatgtgagcgctctgatcagtgaaaatattaagtcctacatctgttatgagatcagagtgtacgccctgtcaggtgatcaaggcggttgtagttctatactcggcaattcaaagcacaaagcaccacttagcggaccacacataaatgcgatcacggaagagaagggcagcattctgatttcctggaacagcatccccgttcaggagcagatgggctgtctcttgcattaccggatttactggaaggagagagattcaaatagccagccgcagctgtgtgagatcccctaccgtgtctcacaaaattcccaccctataaacagcctgcagcctagggtgacctatgtgttatggatgaccgccctaaccgccgctggcgagtcttcacacggcaatgaaagggagttttgcttgcagggtaaggccaactggatggctttcgtcgccccaagcatctgtattgcaattatcatggtgggaatctttagcacccattacttccagcagaagaggcgccattcctgcccttggacgggctcctag

SEQ ID NO: 227155 - DNA, 693 bp, Artificial Sequence
  Description of Artificial Sequence: Synthetic coding sequence
taacagaagggcgaacagggtacggttgcctgtacctgggagaggggcagggatacgcacttatacaccgagtatacgctgcagctcagcggtcctaagaatctgacgtggcagaagcagtgtaaggatatctattgcgattacctggattttgggattaatctaactccagagtctcccgagagtaacttcactgccaaagtgacagccgttaactccctcggtagttcaagttccctgccaagcacctttacctttttggacattgtaagaccgctgcctccttgggacatccgaattaagttccagaaggcctccgtttccagatgcacattgtactggagagacgagggcttagtcctgcttaaccgtctgcggtatcgcccatccaactcaaggttgtggaatatggttaatgtgaccaaagctaagggacgacacgatctgctagatttgaagccttttaccgaatatgagtttcagatttctagcaagctccatctgtacaaaggatcctggagtgactggtcggaatccttgagggcccagacccccgaagaagaacctacaggaatgctggacgtctggtatatgaagagacacatcgattattctaggcagcagatctccttgttttggaaagtttcattcaaaagacagctcaagacccaaggcaacaagactgaaggttag

SEQ ID NO: 227156 - DNA, 1980 bp, Artificial Sequence
  Description of Artificial Sequence: Synthetic coding sequence
atggcccacactttcagggggtgttcgctggcattcatgtttatcattacctggctactaattaaagcaaaaattgacgcctgtaaaagaggagacgtgacagtcaaaccaagccatgtgattttgttgggctccacagtgaacattacttgctcccttaagccacgtcagggctgtttccactatagccgcaggaacaagcttatcctttataagtttgacaggagaattaacttccaccacgggcactcacttaactcgcaggttaccggtcttccgctgggcacaacccttttcgtgtgcaaactggcgtgcattaattctgatgaaatccaaatctgcggggcagaaatttttgtgggagtggctcccgaacagccccaaaatctgtcatgcatccagaaaggggaacaggggactgtggcatgcacttgggagaggggcagggatactcatctgtacacagagtacaccctacaactgtccgggccaaagaacttgacttggcagaagcagtgtaaagacatctattgtgattatttagattttggaataaatttgacccccgaaagtcccgaatctaactttacggctaaagtgaccgctgtgaatagcctcgggtcttcgagttcgctaccttccacctttacttttctggatatagtcaggcccctgccgccatgggatattagaataaaattccagaaagcaagcgtgagcagatgtacactatactggcgtgatgagggattagttttgctgaatcggttacgctacagaccaagtaattccaggctgtggaacatggtcaatgtaacgaaggcaaaggggagacacgacctcctggacctgaagccgtttacagagtacgaattccagattagctctaagctgcatctctataagggctcatggagtgactggtccgagtcactgcgtgcccagacacctgaggaagagcccactggcatgcttgacgtgtggtacatgaagcgccacattgactactcccggcagcagattagcctcttctggaagaacctctctgtgagcgaagctcgtgggaagattttacattatcaggtaactctgcaggagctgactggaggaaaggccatgactcagaatatcaccggccacacttcctggactaccgtgatcccacgcaccggaaactgggcggtagcagtctccgccgcaaattcaaaaggcagttccctccccactcgaataaacatcatgaacctgtgcgaggcaggacttctggctccgcgacaggtatctgctaactctgaaggcatggataatatcctggtgacctggcagcctcctaggaaagaccccagtgccgtgcaggagtacgtcgtggagtggcgggaactgcaccccggtggagacactcaggttccactgaactggttgcggtccaggccctacaatgtgtcagctcttataagcgaaaacataaaaagttacatctgctatgaaattcgtgtgtacgccctctctggcgatcaaggagggtgtagctccatcttgggaaattccaagcacaaggcacccctaagcggtccccacattaacgccataaccgaagaaaagggctctatacttattagttggaattcaattcccgttcaggagcagatgggttgtctgctgcactatcggatttactggaaggaaagagattctaactctcaaccacagctctgtgaaatcccctatcgggtgtcgcagaattcacatccaatcaactctctccagccgagggtgacgtatgtgttatggatgacagctctaactgccgctggcgagagcagtcacgggaatgagcgagagttctgtcttcaagggaaggccaactggatggccttcgttgctccgtctatttgtattgcaatcatcatggtggggattttcagtacccattatttccagcagaaaaggaggcattcatgcccttggaccggatcttag

SEQ ID NO: 227157 - DNA, 2331 bp, Artificial Sequence
  Description of Artificial Sequence: Synthetic coding sequence
atggcccacacgtttagaggatgtagcctagcatttatgtttatcatcacttggttgctgatcaaggccaagatcgacgcttgcaaacgcggagacgtgaccgttaagccaagtcacgtaattttacttggcagcaccgtgaacatcacgtgtagtttaaagcctcgacaggggtgcttccattattctaggcgcaataaactcatactctacaagttcgaccggaggatcaactttcaccacggccacagcctcaactcgcaagtaacggggctgccgcttggtaccactctctttgtgtgcaaactggcatgcatcaattccgacgagatccaaatttgcggggctgaaatctttgtgggcgtggcccctgaacagccccaaaacttgtcatgcatccagaaaggggagcaggggaccgtcgcctgtacctgggagagaggtcgtgacactcatctgtatactgaatacactttacagctctctggtcccaagaaccttacctggcaaaagcagtgcaaagacatttactgcgattaccttgacttcggcattaacctgacacctgaaagccctgaaagcaatttcacagctaaggtgaccgctgtcaattccctcggcagctcttccagcctcccttccacttttacgtttttagacatcgtgcgcccactgcctccctgggacattagaattaagttccagaaggctagcgtctcacgctgcaccctgtactggcgggacgagggcctcgtattactgaatagactacgctacagaccatccaattccagactctggaacatggtgaatgtgaccaaagctaaaggccgtcacgatctgctggatcttaaacccttcacagaatatgaatttcaaataagttctaaactgcatctgtataagggctcatggtcagactggagtgaatccctgagggcccagacccctgaagaggaacccacagggatgctggatgtgtggtatatgaagcggcacatagattactcccggcagcagatcagtctcttttggaagaacctgagcgtgtccgaggcgcgaggcaaaatcctgcactatcaggtcactctgcaggagctgacaggcggtaaggcgatgacccagaacattacagggcatacaagttggaccacagtgattcctcgaactgggaattgggcagtcgccgtgtctgccgctaactcgaaggggagttcactgcctacgagaataaacatcatgaacctgtgcgaggctggtctgttggcccctaggcaggtctctgcaaacagtgaaggaatggataatatacttgtcacctggcagccccctaggaaagacccctccgccgtgcaggagtatgtggtcgaatggcgtgagctgcatcctgggggagacacccaagttccacttaattggcttcgcagcaggccatacaatgtttccgccctgatctctgaaatcccttaccgtgtctctcagaattctcaccccatcaactcactgcagccacgggtgacgtacgtcctgtggatgacagccttgactgccgctggggaatcctctcacggtaatgaacgtgagttctgccttcagggtaaagcgaattggatggcattcgtggcaccctccatctgtatcgcgattataatggtgggcatcttctctacccactacttccagcagaaggtctttgtccttctggccgctttgcgccctcagtggtgtagccgagagattcctgaccccgcaaattccacctgcgcaaaaaaataccctatcgcagaggaaaaaacccagttaccgctggatagactgctgattgattggccaacccccgaagacccagagcccctggtaatcagtgaggttcttcatcaagtgacacccgtgtttcgacatccaccatgctctaactggcctcagagggagaagggtattcaggggcaccaggcgtcagagaaggatatgatgcattccgcgtcgtcccctcccccacctcgggctctccaggccgaaagtcgccaactggtagacctctacaaggtgctggagagcagaggctccgacccaaagccggagaatccggcttgcccttggaccgtattacccgcaggagatctgcccactcatgacgggtacctgccatcaaacatcgacgacctgcccagccatgaggctccattagccgattcccttgaggaattggagcctcagcacatttcattaagcgtttttccctccagttccctccaccccttgactttttcctgcggcgacaaacttactctggatcagctcaagatgcgttgtgacagcctgatgctctag

SEQ ID NO: 227158 - DNA, 681 bp, Artificial Sequence
  Description of Artificial Sequence: Synthetic coding sequence
atgagcagcccaaccgcctcaagcacgacaccacgctgtggaacgagcgcagggcctgccagtccaacctggcgatgccgggctactgctttgcatctgcaccaccctgtggaccagcttccgcaccaggtcctgcagccaaccacaggtcagcggcagccgggaacagggctgccctggcattcgacccccgctcagctcgctttggcagggctcagacaagcccagccgcacccacagcagcagcgcctgcaccagccaggccttaggggagtggacgctcatggctctgccgctcatgtccctcaagcagttccgcaggccgtgagggcacacccacctggacagctattatcctgggctgccgctgtctgcctcctttgccagcaccatttacaactccctggaaagaagagaaacagtaccctgtacatcacgatgttactgattgtcccagtaatcgtggctggtgctatcatagttctacttctctacctgaagcggctgaagattatcatttttcctcctatcccagacccaggtaaaatctttaaggagatgttcggcgatcagaatgatgacacgctccactggaaaaagtatgacatatatgaaaaacagacaaaggaagaaacagactcagtcgtgctcattgaaaatttaaagaaagctagccagtag

SEQ ID NO: 227159 - DNA, 840 bp, Artificial Sequence
  Description of Artificial Sequence: Synthetic coding sequence
atggaatggccagcacggctatgcgggctgtgggccctgctcctctgcgccggaggaggcggaggtggtgggggagcagctccgaccgagacccagcccccagtcacaaatctgtctgtaagcgtcgagaatttgtgcactgttatctggacttggaacccccctgaaggcgcttcatccaactgctctctctggtacttcagtcattttggggacaagcaggacaaaaaaattgcccctgagactagaagatctattgaggtcccattgaacgagaggatttgtctgcaggttgggtctcagtgcagtaccaacgagagcgaaaagccttcaatcctggtcgaaaagtgcatcagccccccagaaggtgatcctgaaagcgccgtcaccgagctccagtgtatctggcacaatttaagctacatgaagtgctcatggttgcccggacgaaatacgagccccgatactaattacaccctttactattggcatagatccctagaaaagattcaccagtgtgaaaatatctttagagagggtcagtattttggctgtagtttcgatttaaccaaggtaaaggactcctcctttgagcaacacagtgtccaaatcatggtgaaggacaatgcaggaaaaattaaaccctccttcaatatcgtccctctgaccagccgcgtcaagcctgaccctcctcacattaagaacctctccttccacaatgatgatctatacgtacagtgggagaatcctcaaaacttcatcagccgctgcctcttttatgaggtggaggtcaacaattcccaaaccgagacccacaatgtgttctatgtccgattctag

SEQ ID NO: 227160 - DNA, 1284 bp, Artificial Sequence
  Description of Artificial Sequence: Synthetic coding sequence
atggaatggcccgcaaggctctgcggcctctgggctttactgctctgcgccggtggcggaggaggcggagggggtgctgcccctaccgagactcagcctcctgttacaaatctgagcgtgtctgtcgagaatctgtgcacggttatatggacatggaatcctcctgagggggcttcctccaattgctcattgtggtacttctcacattttggcgataaacaggacaagaagattgcgcctgaaacacggaggagcatcgaagtgcccctgaatgaaaggatctgtctccaagtaggcagccagtgctccaccaacgagagtgagaaaccttccatcttggtagagaaatgtatcagtcccccagagggtgatcctgagagcgcggtgacggaactccagtgcatttggcacaatctgagctatatgaaatgctcatggctacccggacgcaacacctctccagataccaactacactttgtattactggcaccgctctctcgaaaagattcaccaatgtgaaaacatcttccgagaagggcagtactttggctgctccttcgacctcacgaaagtgaaggatagctcctttgaacaacactccgtccagattatggtcaaggataatgctggaaaaattaagccttccttcaatatcgtccccttaacgtcacgggtgaagccagatcctccacatattaaaaatttgtcctttcacaacgacgacctgtatgtccagtgggagaatccccagaattttatttcccggtgcctgttttatgaggtggaggtgaacaattctcaaacagaaactcataacgtgttttatgtgcaggaggccaaatgcgaaaatcctgagttcgaaaggaacgttgagaacacttcatgcttcatggtgccgggagtactgcccgatacactgaataccgtaaggattagagtgaagaccaataagctgtgttatgaggacgataaactatggtctaactggtcccaagagatgtcaataggaaagaagaggaactcaaccctatacatcacaatgcttctgattgttcccgtgattgtggctggggctatcatcgtgttgctgctgtacctcaagaggctgaagataattatcttccctcccattccggaccccggtaagatttttaaagagatgtttggcgaccagaacgatgatacactgcactggaagaaatacgatatctacgaaaagcagaccaaagaggaaactgatagtgtcgttttgatagagaatctgaagaaggccagtcaatag

SEQ ID NO: 227161 - DNA, 1143 bp, Artificial Sequence
  Description of Artificial Sequence: Synthetic coding sequence
atggccttcgtttgcctggcgataggctgtctgtacacgttcctcatctccacaacctttggatgcacaagctcatccgatactgagatcaaagtgaaccccccacaagattttgaaatcgtggatccaggctacctggggtacctgtacctgcagtggcaaccaccgttgagtctcgaccacttcaaagagtgcactgtcgaatatgagctgaaatatagaaacatcggaagcgagacttggaagactattataacgaagaatctgcactacaaggatggattcgacctcaataagggcatagaggccaaaattcacacgctcctgccctggcagtgcaccaacgggagcgaggtgcaatcttcttgggccgaaacaacctattggatctcacctcagggtattccagaaacaaaggtacaagatatggactgtgtatactataactggcaatatcttctgtgctcttggaagccaggcataggtgttttgctggacacaaactataatctgttctactggtatgaaggcctggaccatgccttgcagtgcgtcgactacattaaggctgacgggcagaacattggatgtagattcccctacctggaagcctctgactacaaggatttttacatctgcgtgaatggatcatccgaaaacaagcccatccggtccagttatttcacattccaacttcagaacatagtgaaacccttaccaccagtatacttgaccttcacacgcgagtctagctgtgaaattaagctgaagtggagtattcctctaggcccaataccagccaggtgctttgattatgagatagagatcagggaagacgataccaccttagttacggctactgtcgagaatgagacatacaccctgaaaactacgaatgagacacgacaactctgctttgtggtgcggtccaaggtgaatatttattgctcggacgacggcatttggagtgaatggtcagataaacagtgttgggaaggcgaagatttatccaagaaaacactgctgaggttctggctcccatttggctttattttaattttggtgatatttgttaccgggctgctacttagaaaaccaaatacctacccaaaaatgattccggagttcttctgtgatacctag

SEQ ID NO: 227162 - DNA, 1143 bp, Artificial Sequence
  Description of Artificial Sequence: Synthetic coding sequence
atggccttcgtctgtctcgccatcggatgcctgtacaccttcctgatatcaacaacttttggatgtacgagctctagcgatacagagatcaaagttaacccaccacaagacttcgagattgtagatcctgggtacctgggttatttgtacctgcagtggcaaccacctctctcattagatcattttaaggagtgtacagtggagtacgagttgaagtaccggaatatcggaagcgagacttggaagacaattatcactaagaacctgcactataaggacggattcgacctgaacaagggtattgaagccaagattcacacactgttgccttggcagtgtacaaacggttccgaggtgcaaagttcttgggccgagactacttactggatttcgccacagggcatccccgagaccaaggtgcaggacatggactgtgtgtactataattggcagtatctgttgtgcagttggaaaccaggaataggcgttctgctggataccaactataacctgttctactggtacgaagggctggaccacgctctacagtgtgtcgactacattaaagcagatggccagaatatcggctgcagatttccatacctggaagcaagtgattacaaggatttttatatctgtgtgaatggaagctcagagaacaagccaatccgatccagctacttcacttttcagcttcagaatatcgttaaacctctgccccctgtgtacctgacctttacccgggaatcttcatgcgaaataaagcttaagtggagcatccccttagggcctatcccagctcgttgcttcgattacgagatcgaaatccgcgaagatgacacgacacttgtcactgccacggtggaaaatgagacatacaccttgaagacaactaacgaaacgcgacagctgtgcttcgtagttaggtctaaggtgaatatatattgtagcgatgatggcatctggagcgaatggagcgataagcagtgctgggagggggaagacctgagcaagaaaacactgctgagattctggttaccctttggatttatcctgattctggttatctttgtcactgggcttttgctgaggaaacccaacacgtatccaaagatgatacccgaattcttttgcgatacgtag

SEQ ID NO: 227163 - DNA, 465 bp, Artificial Sequence
  Description of Artificial Sequence: Synthetic coding sequence
atggcccctcgacgtgcaagagggtgtagaaccttggggctgcccgctctgctccttctgctcttgctccgtccgcctgcgaccagagagcctgcggcatccagcccctcttccaacaatacagccgctactactgctgccatcgttcctgggtcacagctcatgcctagtaaatcaccgtcaactggcactacagagatcagttcccatgagtccagtcatggcaccccaagtcagactaccgcaaaaaactgggaattaaccgctagtgcttcacaccaacccccaggggtttatccacaaggccattctgacactactgtggctatcagcacctcaacagtgctgctctgtggcctctcagcagtatctctcttagcttgctacctcaagtctcgggctagtgtgtgctcatgtcacccaaggagtgcagggcatacatgctctgttggatcagtttgctag

SEQ ID NO: 227164 - DNA, 804 bp, Artificial Sequence
  Description of Artificial Sequence: Synthetic coding sequence
atggcacccaggagagcaaggggctgtcggacactcggcctgcccgctctgctcttgctgttactgctgaggccccctgccactaggggcattacctgcccaccacctatgtccgtggagcacgcagacatttgggtcaagtcatactcactttactcacgagagagatatatttgcaatagtggcttcaagagaaaagccggaacctcctctttgaccgaatgcgtgttgaacaaggcaactaacgtggctcactggacgacaccaagcctcaaatgcattcgcgaccctgccctcgtgcatcagcgcccagcgcctccttctacggtgaccacggccggtgttactccccagcctgaatccctctccccatctggcaaggagcctgccgcttcaagtccgtcttccaacaacaccgccgctacgacagctgccattgtccctggttcccagctgatgccctccaagagtccatcgactggtacaaccgagatctccagccatgaaagttctcatgggacaccgagccagactactgcaaaaaactgggagctaacagcctcagccagtcatcaacctcctggtgtgtatcctcaaggccactcagacaccacagtagcaatctcaacctctaccgttctgctgtgcggactcagcgcggtgtctctgctggcgtgttacctgaaaagcagacaaaccccacctctagccagtgtggaaatggaggccatggaggccctcccggttacctggggcaccagctcccgcgatgaagatctcgagaactgttcacaccatttgtag

SEQ ID NO: 227165 - DNA, 612 bp, Artificial Sequence
  Description of Artificial Sequence: Synthetic coding sequence
atgtccgtcgagcatgctgatatctgggtcaaatcctattccctgtatagccgggagcggtacatctgtaatagcggattcaagcgcaaggctggtaccagttcactaaccgaatgcgtgctgaacaaggccactaacgttgcacactggactacgccaagtttgaaatgtatcagagaccccgcacttgtgcatcagagaccggctccgccatcgacggtcaccacagcaggggttacaccccagcccgagtctttgtccccttcaggtaaagaacctgctgcaagctcaccctcgtctaacaataccgccgcaaccactgccgctatagttccaggaagccagctgatgcctagtaagtcaccaagtacaggcacaaccgagatctcatctcatgagtccagccacgggacacctagtcagacaactgccaagaattgggagctgactgccagtgcttcccatcagcctccaggggtctatcctcagggtcactccgatacgaccgtagcaatcagcacttccactgtgctgctgtgcgggctgtcagcagtgtctctgctagcttgctacttgaagtccagcggagccgtattaagctactctggttag

SEQ ID NO: 227166 - DNA, 696 bp, Artificial Sequence
  Description of Artificial Sequence: Synthetic coding sequence
atgtcagtcgagcacgctgatatctgggttaaatcctatagcttgtatagtagggaaagatacatttgtaatagcggttttaagagaaaagccggtacctcctcgctaaccgaatgtgtgctgaacaaggctacaaatgtggctcactggactactccatctctcaagtgtatccgcgatccagcattggtgcaccagcggcctgcccctccaagtaccgtaactactgcaggggtcaccccacagccagagtccctttctccatccggaaaagagccagctgctagcagccctagtagcaacaataccgccgcaacaacggccgcaattgtaccagggagtcagctgatgccttccaagtccccttctacgggcaccacagaaattagcagccacgagtccagccatgggactccctcacaaaccacagccaagaactgggaactcacggcttcggcctctcaccagccccctggggtctatcctcagggccatagcgacacaactgtggccataagcaccagcacagtgctgctttgcggactgtcagctgtgtcacttctcgcttgttatttgaagagcaggcagaccccgccactagcatccgtcgaaatggaggcaatggaggctctgcctgtcacctggggaacttcatcacgcgacgaggacttagagaactgttctcatcacctgtag

SEQ ID NO: 227167 - DNA, 510 bp, Artificial Sequence
  Description of Artificial Sequence: Synthetic coding sequence
atggcgcctcgcagggcccgaggctgtagaactctcggtcttcccgctttacttttgctactcttgttacgcccacctgccactagggaacctgccgcatcgtcacccagcagcaataacaccgcggctaccaccgctgctattgtccccggatcacagctgatgccaagcaaaagtccatccaccggcactacagaaatttcttctcacgagagtagccatgggactccatctcaaaccactgccaagaactgggagttgaccgccagcgcaagccaccagcccccaggagtatatccccaaggacattctgacaccacagtcgccatttccacgagcactgtgttgctttgtggtctctctgccgtgtccctgctggcatgctacctgaagtccagacaaacaccacccctcgcttccgtggaaatggaagcaatggaagccctgccagtaacttggggtacctcaagcagggatgaagacttggagaattgcagtcatcacctttag

SEQ ID NO: 227168 - DNA, 609 bp, Artificial Sequence
  Description of Artificial Sequence: Synthetic coding sequence
atggcccctcgtcgagctaggggctgtcgcacgttgggtctccctgcccttcttctgctgctgctacttaggccacctgcaacccggggagatcccgctttggtacaccagaggcccgcacctccctcgaccgtgaccacagcgggagtcaccccccagccagagtcgcttagtcccagcggtaaagagccagccgcttcctccccctcaagtaataatactgccgctactaccgcggctatcgtgcccggatcccagctgatgcctagtaagtcaccttctacaggcaccactgagatttcctcgcacgaaagctctcatgggacccctagccaaactaccgccaagaattgggagctgacggcaagcgctagtcaccagccaccaggtgtctatcctcaggggcattctgacacaacagtagctataagtaccagtaccgtactactttgtggcctgagcgccgtgtccctcctggcctgctatcttaaaagcaggcagaccccacctctggcctctgtcgaaatggaggccatggaggccctcccagttacgtgggggacttcctcacgtgacgaggatctggagaactgcagccaccacctctag

SEQ ID NO: 227169 - DNA, 759 bp, Artificial Sequence
  Description of Artificial Sequence: Synthetic coding sequence
atggcaccgcgacgcgctaggggttgcaggaccctgggactcccagccctgctgctcttgctactgctgcggccacccgctacccgcggaataacctgccccccacccatgagcgtggaacacgccgatatttgggttaagtcttattcactgtatagccgtgaaagatacatctgcaattcggggtttaaaagaaaggctgggacctcaagtctaaccgaatgcgtcctgaacaaggcaacgaatgtagcccactggactaccccttcccttaagtgtatcagggacccagcactggttcatcagcgcccagccccaccatcaaccgttacaacagctggcgtgacaccccagcccgagtcactatcaccatcaggcaaggagccggctgcctcctcacctagttctaataacactgccgctaccacagccgcaatagtccccggatcccagttaatgccatctaaatccccaagcacaggcacaaccgaaatttcttctcatgaaagctctcatggtactccatctcagacaactgcaaaaaactgggagttaacggcctcggcatcccatcagcctccgggagtgtacccgcagggacactccgacacgaccgtggccatttccactagcaccgttctgctctgtggactgtcagcagttagtttgctcgcatgttacttgaaatcacgagcatccgtgtgttcatgtcacccgcgatcagcgggacatacctgtagcgtcggcagcgtctgttag

SEQ ID NO: 227170 - DNA, 564 bp, Artificial Sequence
  Description of Artificial Sequence: Synthetic coding sequence
atggcgcctaggcgcgctcgaggatgtcgcacactcggattacccgctcttttgctattgctgctgttacgaccccctgcaactcggggagatcctgccctcgttcatcagcggcctgcccctcccagcacggtcacgacagcaggggtgactccccaacccgagagcctcagcccgtcaggcaaggaacctgctgcaagctctccatctagcaacaatacagccgcaactacggccgctatcgtgccgggtagtcagctcatgcctagtaagagcccctctaccggaacaaccgaaatatcttctcatgaatcatctcacgggaccccctctcagaccacagcaaagaactgggagttgactgctagcgcaagtcatcaaccaccaggtgtgtatcctcagggacactcggacacaactgtcgccatcagcacctccacagttctgttatgtggcctctctgcagtaagcctcctggcttgttaccttaagagtagagcttccgtgtgcagttgccacccacggtcagccggtcacacctgctctgttggctctgtgtgctag

SEQ ID NO: 227171 - DNA, 705 bp, Artificial Sequence
  Description of Artificial Sequence: Synthetic coding sequence
atggccccacggagagccaggggatgcagaaccctaggcctgcctgcattgttgttgttactactccttcggccacccgctactcggggaatcacttgcccacctccaatgtctgtggaacacgccgacatctgggtcaaaagctattccctgtattcccgcgagaggtacatctgcaactccggattcaagcgaaaggccggtacgtctagcctaaccgaatgtgtgctgaacaaggcaacaaacgttgctcactggaccacccccagcctgaagtgcattaaacctgccgcatcttcaccaagcagcaacaacaccgcagccaccaccgcagccattgtgccaggaagccagctcatgccgtcaaagagtcctagcaccggcaccaccgaaatcagctcacacgagtccagtcatggaacacctagtcagaccactgccaaaaattgggaactcacagcttctgctagtcatcaacctccgggagtttaccctcaggggcactctgacaccaccgtggccatctcgacttcgacggtgctcctgtgtggactttctgcagtatctctcctcgcatgctatttaaagagtagacagactccacccttagctagcgtggagatggaggccatggaagccctaccagttacttggggcacaagctctcgggacgaggatttggaaaactgcagtcaccacttatag

SEQ ID NO: 227172 - DNA, 660 bp, Artificial Sequence
  Description of Artificial Sequence: Synthetic coding sequence
atggcgccacggagagctcggggatgtcgcaccttaggactgcccgctctgctgctcctccttctgctgcgtccgccagcaacgcgagggattacctgccccccacccatgagtgtggaacatgccgacatatgggtgaagtcttactcgctttactcccgtgaacgatatatctgcaactctggatttaaacggaaggctggcacctcctcactcaccgaatgcgtacttaataaggccaccaatgttgcacattggaccacaccaagtctgaaatgcataaaaccagcggcaagttcaccgtccagcaacaatactgccgcaacgactgcagccatcgttcctggtagtcagctcatgccaagcaaaagtcctagtacaggtacaaccgagatttctagtcacgagagctcccatggaaccccaagtcagacgaccgcaaaaaattgggaactgaccgccagcgccagtcatcagcctcccggagtctatccccagggccattccgacactacagtagccatctctacctcaactgtgctcttgtgtggactcagtgctgtgagtttgctcgcatgttatttgaagagtagggcatcagtttgcagctgtcacccacgaagcgccggtcatacctgtagcgtgggcagtgtatgttag

SEQ ID NO: 227173 - DNA, 2601 bp, Artificial Sequence
  Description of Artificial Sequence: Synthetic coding sequence
atgggtgcggcacggtctcctccctccgctgtcccgggtcctttgctcggtctcctgctccttctgctcggggtgctggctccaggcggagcttctttgagactgttggaccacagagcccttgtgtgctcccagcctggcctgaattgtaccgttaagaattcaacctgcctggacgactcttggattcacccacggaacctgacacctagttctcccaaggatctccagattcaactgcacttcgcacacacacagcagggcgacttgttccccgtagcgcatatcgagtggacactgcagaccgatgcctctatcctctacctcgaaggtgccgagctttcagtcctgcagctaaatactaacgagaggctgtgcgtgagatttgaattccttagtaaattacgacatcatcacaggaggtggcggtttacttttagtcatttcgtggttgatcccgatcaggaatacgaagtgaccgtgcaccatctaccaaaaccaattcccgacggcgatcccaatcaccagagtaaaaatttcctggtgccagactgtgagcacgcacgcatgaaagtgaccaccccatgtatgtcttctggctcactgtgggatcccaacatcaccgtggagaccctggaagctcatcagctgagggtaagtttcaccttgtggaatgaatctactcactaccaaatcctgcttacgagcttccctcacatggagaaccactcatgcttcgagcatatgcatcatatccctgctccacgcccagaagaatttcatcaacgatccaacgtcaccctgaccttgagaaacctgaaaggctgttgtcggcaccaggtgcaaatccagcccttcttctccagctgcctgaacgactgcctgaggcattccgcaaccgtgtcctgcccagagatgccagacaccccagagcctatcccagattacatgcccctttgggtttactggtttattacaggaataagtattctactagtcggcagcgtcatattgctgatcgtgtgcatgacctggcggttagccggtccaggttcggaaaagtattctgacgacactaaatacacggacgggctcccagccgctgatctcattcctcctcccctgaagccacgtaaagtctggatcatctactccgccgatcaccccctgtacgtggacgtggttctgaaatttgcacagtttctactgacagcctgtggaacagaggtcgctttagacttattagaggagcaggcaatttccgaggcaggggttatgacatgggtcgggagacaaaagcaggagatggtggaatccaattccaaaatcatcgtcctgtgttcccgcggaaccagggcaaaatggcaagccttgctggggaggggtgcacccgttagacttagatgcgaccatggaaagcctgtgggagatctttttactgccgcaatgaacatgattttgcccgattttaaacggccagcctgctttggtacctacgtggtgtgctactttagcgaggttagttgtgacggagatgtgcctgatttgtttggcgctgcccctaggtatccactgatggaccgctttgaagaggtgtatttcaggattcaggacctcgagatgtttcaaccaggcaggatgcatagggtgggcgaactaagcggggataattacctaagatcccctggagggcgtcaacttcgcgctgcactcgacaggttcagggactggcaggtgcgatgtcccgattggttcgagtgcgagaatctgtactccgctgatgaccaggacgccccttctctggacgaggaggtattcgaagagccacttctgcctccaggcactggcattgtgaagagagcaccccttgttagagagcccggatcccaagcctgccttgctattgaccctctggtaggggaagaggggggtgcagcggtagcaaaattagagccacacttgcagccccgaggacagccagcaccgcagccattgcacaccctggtccttgcggcagaggaaggagccctcgtggccgcagtggagccagggcctctggccgacggtgcagctgttcgtttggctcttgccggagagggtgaggcgtgccccttactgggcagccctggcgctggcagaaattctgtactattccttcccgttgaccctgaagattctccacttggtagttccacacccatggcttcccccgatctcctccccgaggacgtccgcgaacacctagagggtttgatgctgtctctttttgagcaatctctgagctgccaggcgcagggaggctgctctcggcctgcgatggttttaacggacccgcacaccccatatgaagaggaacagagacaatcggtgcagagcgatcagggctacatttcacgtagtagtccccagccaccagaagggctgactgagatggaggaggaggaggaagaggagcaggaccccggaaagcctgcccttcctctgtctcccgaggacttggagtcactccgctccctgcagcgccaactgctttttaggcagctgcagaagaattctggctgggacactatggggtcagagtccgaaggaccttccgcctag

SEQ ID NO: 227174 - DNA, 2445 bp, Artificial Sequence
  Description of Artificial Sequence: Synthetic coding sequence
atgggcgctgcacggtcacctcctagcgccgttccaggcccactcctcggtctgctgctgcttctgctgggggtactcgctcccggaggggcatccttacggctgttggaccatcgcgcattggtgtgttcccagccaggacttaactgcaccgtgaagaacagtacctgcctggatgactcatggatacaccctagaaatctgacccctagttcccccaaggatctacagatccagcttcacttcgcacacactcagcagggggacctgtttcctgtggcacatattgagtggactctgcagaccgatgcatccatcctgtatttggagggagccgagctgtcagtcttgcagctcaataccaacgagcgcttatgtgtgaggtttgaattcctgtcaaagctaagacaccaccatcggagatggcgatttacattctcacattttgtggtggacccggatcaagaatatgaagtgaccgtccatcacctgcctaagcctattcctgacggggaccccaatcatcagagtaagaatttcttagtgcccgattgtgagcacgctagaatgaaggtaaccactccttgtatgtccagcggcagcttgtgggaccctaacattacagtggagacattggaggcccaccagcttagggtgtcattcaccttgtggaatgagtccacacattatcaaatcttgctcactagtttccctcatatggaaaaccacagctgctttgagcacatgcaccatattcctgctcctagacccgaagagtttcatcaacgcagtaatgtcaccctaaccctaagaaatctgaaaggttgttgcaggcaccaggtgcagatccaaccctttttcagttcttgtctcaacgattgccttcggcatagcgctaccgtgtcttgcccggaaatgccggatacgccggatggtctccccgctgccgatctcattccgcctccacttaaacctagaaaagtatggattatctatagcgcggaccatcccctgtatgtagacgttgtgctgaagttcgcccagttcttattaacagcctgcggaactgaagtagctttagatctgcttgaagagcaagccatctctgaggctggtgtgatgacgtgggtgggtcgtcagaaacaagagatggtggaaagcaacagcaaaataattgtactctgcagcagaggtactcgtgccaagtggcaggctttgctggggagaggcgcacctgtcaggctccgatgcgatcatgggaagcctgtgggagaccttttcacagccgctatgaacatgatcttgccggattttaaaagaccagcatgtttcgggacctatgtggtctgctatttcagcgaggtgagctgcgacggagatgttcctgacctgttcggagccgctcctcggtaccccctgatggaccgctttgaggaggtgtatttccgcatacaggaccttgaaatgttccagccaggacggatgcacagagtaggcgaactgagtggcgataactatctgcgatcccctggtggcagacagttgagagccgctctggatcggttccgggattggcaagttaggtgcccggattggttcgagtgtgagaacctttactcggctgatgaccaggacgctccatcccttgacgaggaggtatttgaagagcctctcctcccgccagggacggggatcgtcaagagggctcctttggtcagggagcccggatcccaggcgtgcctggccatcgaccccttagtaggcgaggaaggaggggcagccgtggccaagctcgagccacacctccagccccgaggccaacctgctccgcagcccctccatacgttggtgctcgctgcagaagaaggcgcattggtcgccgctgtggagccaggtccccttgctgacggcgctgccgtgcgcctcgcattggccggagagggggaagcctgtccacttctgggttcgccaggcgctggtagaaactcagttctgttcctgccggtggaccctgaagacagtcccctgggctcctcaacacccatggccagcccggatctactccctgaagacgtccgggagcacttggaggggctgatgctgagtctgtttgagcagtctctctcatgccaagctcagggaggctgctctaggccggcaatggtgctcactgatccacacacaccttacgaagaagaacagcgccagtctgtgcagtcagaccagggctacatcagccggagttctcctcagcccccagaaggtttaaccgagatggaagaggaggaagaggaggagcaggatccagggaagccagccttgcctctgagtccagaggatttggaatccctgcgatctcttcagcggcagctgctctttaggcagctccagaaaaacagtggatgggataccatggggagtgagtcggagggcccaagcgcctag

SEQ ID NO: 227175 - DNA, 1509 bp, Artificial Sequence
  Description of Artificial Sequence: Synthetic coding sequence
atgtcgctcgtccttctgagcctcgccgctctgtgccgctccgctgtgccacgagagcccacagttcagtgtggttccgaaaccgggccatcccctgagtggatgctgcagcacgatctgatccccggagatctgcgtgacctaagggtagaaccagtgaccaccagcgttgcgaccggtgattactctatactgatgaatgtctcctgggtcctgagagccgatgcgtcaatccgcctgctgaaggcgactaagatttgcgtgacaggcaaaagcaattttcagtcttattcttgtgttagatgtaattacaccgaggcatttcagacccaaacaagaccttccggaggtaaatggaccttcagctacatcggattcccagtggaactaaatacagtttattttattggagcccacaacattccaaatgcaaacatgaatgaggatgggccatccatgtccgtgaatttcactagtcctggatgcctcgaccatatcatgaagtacaagaaaaagtgcgtcaaagccggaagcttgtgggacccaaatatcactgcttgcaagaagaatgaagagaccgttgaggtgaattttaccacaaccccattgggcaaccgttacatggctttaattcaacacagtacaatcattggcttctctcaggtctttgaaccccaccagaagaaacaaactcgcgcaagtgtggtcattcccgtaaccggtgactcagagggtgccacagtgcagctgaccccgtactttccaacttgcggttccgattgtatccggcataaaggaaccgtcgtgttatgcccgcagacaggcgttcctttcccactagacaataacaagtctaagcctgggggatggctccctctgcttctcttgtctctcctcgtggctacctgggtgctcgtggccggtatctatttgatgtggcgccacgagaggattaagaaaacctccttttctactaccaccttgttacccccaatcaaggtgttggtcgtgtatccatcagaaatctgttttcatcataccatctgttatttcacggaatttctgcagaatcactgcaggtcagaagtgatccttgagaagtggcaaaaaaagaagatcgctgagatgggcccagtgcaatggctggccacacagaagaaagctgctgacaaggttgtttttctcctcagcaatgacgttaatagcgtgtgtgatggtacgtgcggtaagtccgaaggtagtcccagcgaaaacagccaggatctgttcccactcgcctttaatctgttctgcagtgatctccgcagccaaatccatttgcataagtatgtggttgtttactttcgggagatcgacaccaaagacgattacaacgccctgtcagtgtgtcctaaatatcacctgatgaaagacgctactgccttctgcgcggagctgctgcacgtcaagcagcaagtctcagccggtaagcgctcacaggcctgccatgacggctgttgtagcttatag

SEQ ID NO: 227176 - DNA, 2376 bp, Artificial Sequence
  Description of Artificial Sequence: Synthetic coding sequence
atgccagtgccctggtttcttttgtccctggccctaggcagaagtccagtggttttgagtctggaaaggctggtgggccctcaggatgcaacccactgtagccccgtcagcctggaaccctggggagatgaggaacgcctgcgcgtgcagtttcttgcacagcagtctctgtctttagcaccagtgactgccgcaactgctcggaccgccctaagcggcctgagcggagccgacggccgacgtgaggagaggggccgagggaagagctgggtgtgtctcagcctggggggttctggcaacaccgagcctcaaaagaagggattgtcttgcaggctttgggacagtgatattctctgtctgccgggagatattgttcccgctccgggacccgtcctggcgccaacgcacctgcagacagaactggtgttgcgatgccagaaagaaaccgattgcgacctctgcctacgagtggctgtgcatctcgcggttcatggccattgggaggagcccgaggacgaagagaagtttggtggggctgcagacagcggtgttgaagaacccaggaatgcctcccttcaagcgcaggtcgttcttagctttcaggcctaccctaccgctagatgcgtgctgctggaagtgcaggtgcccgctgccctcgtgcagtttggtcagtcagttggctccgtagtctacgactgctttgaggcggcactgggatccgaagtgcggatatggtcatatactcagccaaggtacgagaaggaactcaaccatacccagcagctcccagattgcagaggccttgaagtatggaactcaattccgagctgctgggcactgccctggttaaatgtgtcagccgatggggacaacgtccacctcgtgcttaacgtgtctgaagaacagcattttggtctatcgctttactggaatcaggtccaagggccaccaaaaccaagatggcacaaaaatcttacgggcccacagattatcaccctaaatcataccgacctggtcccgtgtctatgtatacaggtttggccgctcgaacccgatagcgtgagaaccaacatctgtccctttcgcgaggatcccagagcccaccagaatctctggcaagctgccaggctgcagttgctgacactgcaatcatggctgctcgatgccccttgctcactgcccgctgaagctgcgctctgttggcgcgctcccggaggcgatccgtgtcagcctctcgtgccgccactctcatgggagaatgtcaccgtcgacaaggtgttggagttcccgcttctgaagggccaccctaacctctgtgttcaagtcaatagcagcgagaagctccaactgcaggaatgcctctgggcagactcacttggcccactcaaggatgatgtcttactcctcgagacccgcggtccccaggacaaccgtagcctgtgcgctctagagccttccggctgcacttcattgccgtcgaaggccagtacccgcgcagcacgactgggggagtacttgctgcaagacttgcagagcggacagtgcctccaactgtgggacgatgatctgggcgctctatgggcctgcccgatggacaagtatatccacaaacggtgggcgctagtgtggctcgcgtgtctgctctttgccgcagccctaagcctaatactcctactgaagaaagaccacgccaagggatggttaagactattgaagcaagacgttcgctccggagcagcagcaagaggaagggcggctctgttgttatactctgctgacgatagcgggtttgaacgactcgtgggagcactggcctctgccctctgtcaactgccgctaagggtcgccgtggatctctggagtcgccgagagcttagcgcccagggtccagtggcatggtttcacgcacaacgaagacagacgctacaggaggggggtgtggtggttctgctgttttcaccaggtgctgtcgcgctgtgcagcgagtggcttcaggatggggtgtcaggacctggggctcacgggcctcacgatgcgttccgggcttccctatcttgtgtgctgcccgactttttacagggacgagccccaggttcctacgtgggagcctgctttgaccggttactgcatccggacgccgtaccagctctatttcggaccgtgcccgtgtttacgcttccatctcagctgccagacttcttgggcgctttgcagcaacccagagctcctagaagtggacgactccaggagcgggcagagcaggtcagcagagctctccaaccagcactcgacagttactttcacccacccggaacgcccgctccagggaggggcgtcggtcccggtgccggacccggtgctggagatggaacttag

SEQ ID NO: 227177 - DNA, 2118 bp, Artificial Sequence
  Description of Artificial Sequence: Synthetic coding sequence
atgcctgtgccctggtttctgctttctctagctctgggtcggtccccagtggtcctttctctcgagagattggtgggtccacaggacgctactcattgtagcccaggtctaagttgcagactgtgggacagtgatatcctgtgcttaccaggcgatattgtccctgcgccaggtcccgtgctcgcaccaacccacttacagaccgaactcgtcctccgctgtcagaaggaaactgactgtgacctgtgtcttcgcgtggctgtgcacctggcagttcacggtcattgggaggagccagaagacgaagagaagttcggcggtgcagcagattctggagtggaggagccacgtaacgccagtctgcaggcccaagtcgtgctgtcttttcaggcttaccccactgccaggtgtgtgctgctggaggtgcaggtcccggcagcactggtgcagttcggccagagcgtcgggtccgtggtttatgactgcttcgaagctgccctggggagcgaagtgaggatctggtcctacacgcagcctaggtatgaaaaggagctgaaccatacacagcagttacccgcactgccctggctaaacgtgagcgccgacggcgacaacgttcacttggtgttgaacgtgtcagaggaacagcactttggccttagcctctattggaatcaggttcagggcccaccaaaacctcgctggcataagaatctgaccgggccacagatcattacactcaatcacactgatctcgtgccatgcttatgtattcaagtatggccgctcgaaccggatagcgtcaggaccaacatatgtccttttagagaggatccgagagcccaccagaatttgtggcaggccgctcggctccagctccttactttgcaaagctggctgcttgacgcaccttgttctctgccagccgaagctgccctgtgctggcgagcacctggaggggatccttgtcagccacttgtccccccattatcatgggaaaatgtgaccgtcgacaaagtcctggagttcccattactcaagggccacccaaacctgtgtgtccaggttaattcgtccgagaaactgcagctgcaggagtgcctatgggctgacagcctggggcctttaaaggacgacgtcctgctcttggaaacccgagggcctcaggataatagatcactttgcgccctggaaccttctggctgtaccagtcttccttccaaagccagtactagagccgctagactcggcgaatatctgctccaagatctccagagcggtcagtgtcttcagctctgggacgacgacctcggagcgctctgggcctgcccaatggacaaatacattcacaagcgctgggccttggtgtggctggcatgcttgctattcgcggctgccctttcgcttattttactgttaaaaaaagaccatgcgaagggttggctgcgtctcctgaaacaggatgtcaggagcggcgcagcggcaagaggccgagccgcattacttctttactcagccgacgatagcggcttcgagcggctggtgggagcgctggcaagtgcactttgtcagctgcctctccgagtcgcagtggacctgtggtcaaggcgcgaactctcagcacaggggccagtcgcctggttccatgcccagcgtagacagactctccaggaagggggtgttgtggtgctgctgtttagcccgggtgccgtggcgctgtgctcagaatggctgcaggatggtgtttccggcccaggggctcatggccctcacgacgcctttagagctagtctatcttgcgtgctccctgacttcctccagggcagggccccaggatcgtacgtgggggcttgcttcgaccgtctactgcacccagacgcagtaccggctttatttcgcacggtgccagttttcacactgccctctcagctccccgattttcttggggcactacagcagcctcgggcaccaagaagtggacgcctgcaggagcgagccgagcaggtgtcccgggctctccagccagccctcgattcctatttccatcccccaggtaccccggcaccaggcaggggcgtgggccctggcgctggacccggtgccggagacggcacatag

SEQ ID NO: 227178 - DNA, 2163 bp, Artificial Sequence
  Description of Artificial Sequence: Synthetic coding sequence
atgccagtcccttggtttctattatctctcgccttaggcagatcaccagtggtgttaagtctggagcgactggtgggccctcaggacgctacccattgttcgcccggactttcctgccgactctgggacagtgatatcctgtgcctgcccggagacatcgtaccagcccctggacctgttcttgccccaacccatctacaaaccgagctcgtcctgcggtgtcagaaagaaactgactgtgatctttgcctgcgggtggcagtgcatctagctgttcatggacactgggaagagccagaggacgaggagaaattcgggggtgctgccgactctggggttgaagagcctagaaacgcttcactgcaggctcaagtagtgctgtccttccaggcttatcctaccgctcggtgcgtcctcctggaggtacaggtgccagcggcattggtgcagttcggtcagtctgtgggaagtgttgtgtacgactgcttcgaagcggcactcgggtctgaggttcggatctggtcgtacacccagccacgctatgagaaggaactcaatcacacccagcagttgccagactgtcgtggactcgaagtctggaattctattccgagctgttgggcactgccctggctgaacgtgtctgctgatggtgataacgttcacctggtgctcaatgtatccgaagaacagcactttggactgtctctgtattggaatcaagttcagggaccacccaagcccagatggcacaagaacctcacgggcccacagatcattactctcaaccatactgatctggtgccatgcctttgcatccaggtgtggccccttgagcctgattcagtcagaaccaatatttgtcctttccgtgaggacccacgggctcaccaaaatttgtggcaggcagcgagactccaactgctgaccctacagtcttggcttctcgacgctccttgttcattgcccgcagaagctgccttgtgctggagggcccctggaggagacccttgtcaacctctggtccctcctcttagctgggaaaacgtgaccgtcgataaagtcctcgagtttcccttgctcaaaggccatcccaatctgtgtgtacaggtgaatagtagcgagaaactccagctacaggaatgcctctgggcggatagtctcggccctctgaaggacgacgtcttgctgctggagacgaggggaccccaggataatcgttccctttgtgctctggaacccagcggatgcacgtccctgccctccaaggcttctactagagcagcacgactgggcgaatatctgctccaggatctccaaagcgggcagtgtctgcagttatgggacgacgatctgggagcactctgggcgtgcccaatggacaaatacattcataagaggtgggctctggtttggctggcatgtctgctgttcgccgcagcactttcgctgattttgctgctgaagaaagaccatgctaaaggctggctgagactgttgaaacaggacgtgagatcaggagccgctgccagaggcagggcagctctgctgctgtatagcgccgacgacagcggatttgaacgtctagtcggggctctggcttcagcactgtgtcagctgcccctgagagtcgccgtagacttgtggagcagacgagagctcagtgcacaagggcctgttgcctggtttcacgctcagaggcggcagacactgcaggagggcggtgtggtggtattgctattttcccctggagcagtggctttgtgtagcgaatggcttcaggacggcgtcagcggtcccggtgcacacgggcctcatgatgcattcagagcatcactgagctgcgtccttccagactttttgcagggaagggcgcctggatcttacgtcggggcatgctttgacagactgttgcatcctgatgccgtcccagctttattcagaactgttccagtatttactctgccatctcaactgcctgactttttaggcgctctacaacagccacgtgctcctcgtagtggtcgcctgcaggaaagggcagaacaggtgagcagggcccttcaacctgcattagacagctatttccatccacccggtacacctgcccctggcaggggcgtaggccctggcgctggccctggagccggagatgggacatag

SEQ ID NO: 227179 - DNA, 1641 bp, Artificial Sequence
  Description of Artificial Sequence: Synthetic coding sequence
atggcctatccaactgcaaggtgtgtgctgctggaggtgcaggtgcctgccgctctggtacagttcggtcaatccgtcggctccgtggtgtacgattgtttcgaggcagcccttgggagcgaagttcggatctggtcctacacacagccacgatacgagaaagaactaaatcatactcaacagctgccggcactgccctggctcaacgtgagtgccgatggagacaacgtacacctcgtattgaacgtgtctgaggagcaacattttggactttccttgtattggaatcaggtacaaggaccaccaaaacccagatggcacaaaaacttaaccggcccacagatcatcacattaaatcacactgatttagtcccatgcctttgtatacaggtgtggcctctggagccagacagtgtgcggactaatatctgtccatttagagaagacccacgtgcccaccagaatttgtggcaggccgcaagactgcagctgctgactttgcagtcttggctgcttgacgccccatgtagcttgccagctgaagctgccctgtgttggagagcccctgggggtgacccgtgtcagcctttggtgcctcccttgtcgtgggaaaatgtcacagtagatgttaactcctccgagaaacttcagttgcaggagtgtctgtgggccgacagtctgggtcctctgaaggacgacgtgctccttttggagacccgaggtccacaagacaatcgatctttgtgtgcccttgagccttctggttgcacatccctaccctccaaagcatccacacgggctgcgcgtcttggcgagtatctgctgcaggatcttcagtctggccagtgccttcagctgtgggatgatgacctgggtgctttgtgggcttgtcccatggacaagtacatacataagcgctgggcactggtgtggctcgcgtgtttattgttcgcagccgcactgagtctgatcctgctcctgaaaaaagaccacgctaaggccgctgccagggggcgagcagctttgctactctatagcgccgatgactctggatttgagaggctcgtgggggctctggccagtgccctttgccagttgccacttcgggtcgctgtggacctatggagtagaagagagctttctgcccaggggcctgtggcctggttccacgctcagcggagacagacattgcaggaaggtggagtggtcgtgttgctgttctctccaggagctgtcgcactctgcagcgaatggctgcaggacggtgtgtccgggcctggcgctcatggaccccatgacgcctttagagccagcctgtcttgtgttctgcccgatttccttcagggcagagcacctgggagttacgtaggagcctgttttgatcgtctcttgcaccctgacgccgtgccggctctcttccggaccgtgcctgtgttcaccctgccatctcaactgcctgatttcctgggcgctttgcagcagccacgggctcctagatctggacgtctgcaggagagagccgaacaagtcagtcgagcactacagcccgcactggactcctactttcacccgcctgggacccctgcccctggaaggggtgtcggaccaggcgctggcccaggagccggagatggcacttag

SEQ ID NO: 227180 - DNA, 2124 bp, Artificial Sequence
  Description of Artificial Sequence: Synthetic coding sequence
atgccagtgccatggttcctgctgtcactggctctgggtaggtctccagtggtactgtcactggagcgcctggtggggcctcaggatgctacacactgcagccccggactgtcttgccgactttgggattcagacatactttgtctccctggtgacatcgtgcctgcacccggaccagtgctcgctcccacacacctgcaaacagaactggtgcttcgatgccagaaagaaacagactgcgatctgtgcctaagggtggcagtccacctcgccgtgcatggtcactgggaagaacccgaggatgaagaaaagttcggcggagctgccgacagtggggtagaggaaccgaggaatgcatctttgcaggcccaggtcgtcctcagctttcaagcctacccgacagcacgatgtgtactacttgaagtgcaggtgcctgctgctcttgtgcagtttggacaaagcgttggaagcgtagtgtatgattgctttgaagcagcactgggaagcgaagtcagaatctggtcctatacccagccacggtacgagaaagaactcaaccacacccaacagctccccgactgtagaggattggaggtgtggaattcaatcccatcgtgttgggctctcccatggctgaatgtgagtgctgatggagataacgtccatttggttttgaatgtcagtgaagagcaacacttcggacttagcctctattggaaccaagtgcagggccctcccaaaccacgctggcataagaatcttacgggtccccagatcatcacattgaatcataccgaccttgtgccttgtctgtgcattcaagtgtggcctctggaaccagactcggtgcgcacaaacatttgtccatttagggaagaccctcgagcgcatcagaatctgtggcaggctgccaggctccagcttctgacgctgcagtcttggctgctggacgccccatgctctctgcccgcagaggctgctctttgctggcgtgcccctgggggtgacccatgtcagcccctggtgccccctctgtcctgggagaatgttacagtcgacaaagttttagagtttccgttgttaaagggccaccccaatctgtgcgtccaggtcaatagctctgaaaagctgcaactgcaggagtgtttatgggccgacagtcttgggccactgaaggatgacgtactgttgctcgaaactcgaggccctcaagataacaggagcctctgcgctttagaaccttctggctgcacctccctcccttctaaggcaagcacacgtgctgcaagactgggcgaatatttacttcaggatctccagagcggccagtgcctacaattgtgggatgacgatctaggcgctctctgggcttgcccgatggataagtatatccacaaacgatgggccctggtgtggttagcgtgcctgctcttcgctgccgctctgagtctaatcttgctactgaagaaagatcatgccaaagcagccgcaagaggccgtgccgctctgcttttgtactccgccgacgattctgggttcgaacggttagtgggggctcttgcttccgccttgtgtcagcttcctttacgagtcgctgttgatctgtggtcaagacgggagttgtctgcacagggccctgtcgcttggttccatgcccagagacgacaaaccctgcaggagggtggcgtggttgtcttgctcttcagcccaggcgctgtggctctttgtagcgagtggctccaggacggggttagcggaccaggcgcacatggcccacacgatgccttcagggcatccttatcatgcgtcttgcctgactttctgcagggacgggctcccggaagctatgtgggggcttgctttgatcgcctgttgcaccccgatgccgttcccgcactgttcaggaccgtaccagtgttcacactgccaagtcagctccctgatttcttgggtgctcttcagcaaccacgtgcgccaagatccgggagactgcaagaacgggctgaacaggtgagcagagccctccagccagctttggatagttattttcatccgcctggcacccccgcacccggtcgcggagtggggccaggcgcaggccctggagcgggagacggaacctag

SEQ ID NO: 227181 - DNA, 213 bp, Artificial Sequence
  Description of Artificial Sequence: Synthetic coding sequence
atgccagtaccctggtttctgctatctttggctctgggacgctcccccgtggtcctctcactggaacggctggtggggccacaggacgccactcactgctcacccggtcttagctgtcgtctgtgggttacatatagtgcctgtctcggcacctcatgtctcctgcgagccccttgctggagactacgcacctgtcgacagtcgtggtgttag

SEQ ID NO: 227182 - DNA, 2067 bp, Artificial Sequence
  Description of Artificial Sequence: Synthetic coding sequence
atgcccgtgccatggttcctcctctctcttgccctcggacgaagtcccgtggttctgtcactggagcggttggtggggcctcaggatgccactcattgctctcccggactatcctgtcggctctgggactcggacatcttatgcctccctggcgatattgttcccgctcccggaccggttttggccccaacccacttacagacagaactagttctgcggtgtcagaaggagactgattgcgatctgtgcctccgtgtcgccgtccatctggctgtgcatgggcattgggaggagcctgaggatgaggagaaattcggcggtgccgcagatagtggcgttgaagagcccaggaacgcctccctacaggcgcaagtcgtgctgtctttccaggcttaccctactgccagatgcgtgctgctagaagtgcaggtgcccgcagccctggtccaatttgggcagtctgtgggttcagtggtgtatgactgcttcgaggcggcacttgggtctgaggtacgcatttggagctacacgcagccaagatacgagaaggaactgaatcacacccagcaattgccagccctcccatggctcaatgtgtccgccgacggcgataatgtccatcttgtgctgaacgtttctgaagaacagcactttggattgtccctgtattggaaccaagtgcagggacccccaaagccaagatggcacaaaaatctaacagggccacagattattactctgaatcatactgatttagtcccatgcctctgcattcaagtatggcccctggaaccggactctgtccgcacaaatatctgccctttcagggaagacccccgagctcaccaaaatctgtggcaagccgctcggttgcagctgctgaccctgcaatcctggttgttagacgcgccttgtagcctgcctgcagaggccgctctgtgttggagagccccaggtggcgatccctgtcagcctctggtacccccattgtcttgggagaatgtgaccgtggacgtaaactcgtctgagaaactgcaactccaggaatgcttgtgggcggattccttaggcccactaaaagacgatgtgcttctgttagaaacccggggaccgcaggacaaccgttcactgtgcgctctcgagcccagcgggtgcacatcacttccatccaaggcgtctactagagcagcccgtctgggagaatacctgttgcaagacttgcagtctggtcagtgcttgcaactgtgggatgatgatctcggagccctgtgggcctgccccatggacaagtacatccacaaacgctgggccttggtctggttagcgtgtttgctatttgccgcagcattatcccttatcttgctcctcaaaaaagatcatgcgaaaggatggctccgactgcttaaacaggacgttagatccggggctgcagctagggggcgagcagctctgctcctgtatagcgccgatgatagcggctttgagagactggtaggagccctcgcctctgccctgtgtcagcttcccctcagagtcgccgttgacctttggtctaggagagaactttccgcacagggcccagtggcttggttccatgcccagaggagacagacgcttcaggaggggggtgtcgtggtgttactcttctccccaggtgcagtagcactgtgctccgaatggctccaggacggtgtcagcggccctggggctcacggcccacacgacgccttccgggcttctctgtcatgcgtgctccccgatttccttcaaggtcgtgctccaggctcttacgtaggagcttgcttcgatcgtctgctccaccccgacgccgtgccagcccttttccggaccgtcccagtgttcacgttgcccagccagctgccagactttcttggcgcactccaacagcctagggcacccagaagtggtagactgcaggaaagagctgaacaggtgtctagggctctacagccagccttggactcgtactttcaccccccagggacgcccgctcccggacggggagtaggacctggagctggcccaggagccggagatgggacctag

SEQ ID NO: 227183 - DNA, 2220 bp, Artificial Sequence
  Description of Artificial Sequence: Synthetic coding sequence
atggcaccttggcttcagctctgctctgtgttcttcactgtaaatgcctgtctcaacggtagtcagctggcggtcgctgctgggggtagcggcagggcaagaggtgcggacacctgcggatggagaggagtggggcctgcctccagaaatagtggcctgtacaacattacctttaaatacgataactgtacaacatatctcaaccctgtgggcaaacatgtcattgccgacgcccagaacatcacgatttcacaatacgcctgccacgaccaggtagccgtgactattctctggagtcccggtgccctgggcattgaatttctgaaaggctttagggtgattttggaagaactcaaatccgaagggaggcagtgtcagcagctcatcttgaaggacccaaagcaactaaatagctctttcaaacggacagggatggaatctcagcctttcctgaacatgaaatttgagactgattacttcgtaaaagtggtcccgttccccagcattaaaaacgaatcgaattaccatcccttttttttccgtaccagagcgtgcgacctcttactgcaacctgacaatctggcgtgtaaacccttctggaagcctaggaacctgaacatttctcagcatggttcagatatgcaggtgtcatttgatcacgcccctcacaacttcgggttccgcttcttttatctgcattacaaattgaaacacgaaggtccctttaagcggaaaacgtgcaaacaggaacagactacagagacaacatcttgtctcctgcagaacgtaagcccaggtgattacataatcgagttggtcgatgatacgaatactactcgcaaagtgatgcattatgcattgaaacctgttcacagcccctgggccggaccaatacgtgccgtcgcaatcacagtgcccttagtagtcatatcagcgtttgcaacccttttcacagttatgtgtcgcaagaagcagcaggaaaacatttatagccacctggatgaagagtccagcgaatcatccacctacacggctgccttgccgagggagagattgagaccaaggcccaaagtatttctctgttacagcagtaaggacggacagaatcatatgaatgtggtccagtgctttgcctacttcctgcaagatttttgcgggtgcgaagtggccctcgatctctgggaagacttctcgctgtgccgggagggccagcgggagtgggtgatacagaagattcatgagtcccagttcataattgtagtgtgcagcaagggtatgaaatacttcgtggacaagaaaaactataagcataaagggggaggccgtggctctggcaaaggcgagctgtttctcgtggctgtcagcgcgattgccgagaaactgcggcaggccaagcagtctagcagcgctgccctctcgaagtttatcgcggtgtatttcgactactcatgtgagggtgatgttcctggcatattggacctctcgacaaaatatcgcctgatggataatctaccccagctttgcagtcatctgcacagtcgggatcacggattgcaagagccaggtcagcatacgagacagggctcgcgccgaaactacttcagatccaagtccggcagaagtctgtatgtggccatatgtaacatgcaccaattcatcgatgaagagcccgattggtttgagaaacagtttgtgccttttcacccacccccactacgatacagagagccggtactggagaaattcgattctggactggtgctgaatgacgtgatgtgtaaaccagggccagagtccgacttctgtctcaaagtggaagctgccgtgctaggggcaaccggccctgccgatagccagcatgaaagccagcacggcggtttggatcaggacggggaagctcggcctgccttggacggtagtgccgcacttcagcctctcctacacaccgtaaaggcgggatctcccagcgatatgcccagagattccggaatctatgacagttcagtacctagtagcgaactaagcctgccactgatggagggattgtccacggatcaaacagaaacttcatccctcaccgagagcgtctcatccagctcaggcttgggcgaggaagagccacctgccctgcctagcaagttgctgtcctctgggtcatgtaaggccgatctaggatgccgttcctacaccgatgagctgcatgccgtcgcccctctgtag

SEQ ID NO: 227184 - DNA, 1788 bp, Artificial Sequence
  Description of Artificial Sequence: Synthetic coding sequence
atggaatcacaaccttttctaaatatgaagtttgagaccgactactttgtgaaagtggtcccattcccctctattaaaaatgagtccaactatcatcccttcttttttaggacgcgagcctgcgacctgctgttacagcccgataatttggcctgtaagcctttctggaaacctaggaacttaaacatatcgcagcacggcagcgacatgcaggttagctttgaccacgctcctcataactttggattccggttcttctatcttcattataagctgaaacacgaagggccatttaaaagaaagacctgcaagcaggaacaaacaaccgagacaacctcctgtctcttgcagaatgtgtccccaggggactatatcattgaactggtggacgacactaacacaacgagaaaggtcatgcattacgctctgaaacccgtgcactcaccatgggcgggacccatccgtgcagtcgctattacagtgccactcgtcgtgatcagcgcgtttgccaccctgtttacggtgatgtgcagaaaaaagcaacaagagaacatctacagtcacttggatgaggaaagcagcgagagttcgacgtataccgcagctttgccaagggagcgactccgaccaagaccgaaggtgttcctctgctactcctcgaaggatggacagaatcacatgaacgttgtgcagtgttttgcttatttcttacaggacttttgtggctgcgaagtcgccttggatctgtgggaagacttttcactatgtagagaggggcagcgggagtgggtcattcaaaaaatccatgagagtcagttcattatcgtggtatgcagtaagggaatgaagtacttcgttgacaaaaagaactacaagcacaaagggggagggcgtggctcgggcaagggcgaactcttcctggtagctgtgagtgcaatagcagagaaactgagacaggccaaacagtccagcagcgctgcgctgtccaaatttatcgcagtctacttcgattattcgtgcgaaggagatgttccaggcattctggacttaagcacgaaatatcgactcatggataacctgccacagctctgcagtcatctccattcccgagaccacggactacaggaaccaggacagcacactcgccagggttccaggagaaattattttagatctaaatcgggacgctccttgtacgtggcaatttgcaacatgcatcagtttattgatgaagagcctgactggtttgagaagcagttcgtgccttttcatccacccccactgcggtaccgggaacccgtactggagaaattcgattccgggctggtactgaatgatgtaatgtgtaagcctggccctgaaagcgacttttgcctgaaggttgaggccgctgtgcttggggctacgggacctgctgattcacaacacgagtcacagcatggcggtctagatcaggacggagaagctaggcctgccctggacgggtctgctgcactccagccgttgctgcataccgtgaaagccggttcccctagcgacatgcctcgcgactcaggaatctacgatagtagcgtgccatcttcagaattaagcctcccattgatggaggggctatcgaccgatcagaccgaaacttccagccttactgagagcgtctctagcagttccgggctgggtgaagaggagcccccagcactgccatcgaaattgctgtctagtggttcgtgtaaagccgacttgggctgccggtcgtacacagatgagctccacgctgtggcgccactttag

SEQ ID NO: 227185 - DNA, 2148 bp, Artificial Sequence
  Description of Artificial Sequence: Synthetic coding sequence
atgcccagggcgtccgctagcggtgtccccgctctctttgtgagcggtgagcagggcgtcggccctgcgtctcggaacagcgggctgtacaatatcacttttaaatacgacaactgcaccacctacctaaaccccgtaggtaaacacgtgattgcagatgctcaaaatattactattagccagtatgcttgccacgatcaggtcgcagtcactatcctgtggagcccaggcgctctcggaatagaattcttgaaggggttcagagttattctcgaggaactgaagagtgagggacggcagtgccaacagcttattctgaaagaccccaagcagctgaatagcagcttcaagaggactggcatggaatcacaacccttcctcaacatgaaattcgagacggattactttgtcaaagtagtcccgtttccaagcataaagaacgaatccaattaccaccctttttttttcagaacgcgcgcttgcgacttgctgctccagcccgacaacctggcttgcaaacctttctggaagcccagaaacctcaatattagtcagcacggctctgacatgcaagtctctttcgaccatgctccccacaattttgggtttcgctttttttacctccactacaagctgaaacacgaagggccattcaaacgaaagacttgcaagcaggaacagactacagagaccaccagttgcctgttgcagaacgtgtccccgggagactacataatcgaactggtcgatgataccaacactacccgtaaggtgatgcactatgccctgaagccagtgcactcgccatgggcgggtcccatcagggctgtcgccattactgttcccctggtggttatctccgccttcgctacgctctttacagtcatgtgtagaaagaagcaacaagaaaacatttactcccatctggatgaggaatcatctgagtcttccacgtacacagccgcactcccacgggagcgcctccggcctcggcctaaagtttttctgtgctacagttcaaaagacggacagaaccatatgaatgtcgtccagtgtttcgcctattttcttcaggatttctgtgggtgcgaggtcgcactcgatctctgggaagatttctctctttgtagagaaggccagcgggaatgggtgattcagaagatacacgaaagccagtttatcatcgtcgtctgctctaagggaatgaagtatttcgtggataaaaaaaactacaaacataagggaggaggcaggggatcagggaagggagagctgttcctggtcgccgtgagtgctatagccgaaaagttgcgccaggccaagcagtcatcctctgctgctctgtcgaaatttatcgccgtctacttcgactacagttgcgaaggagatgtgcctgggatcttggatctcagcacaaaatatcgcttgatggacaatctcccacagctgtgttcacacctgcattcacgagatcacggtcttcaagaaccaggacagcataccaggcagggcagtcggcgtaactactttcgcagtaaatctggacggtccttgtacgtcgccatttgcaacatgcatcagttcatcgatgaggagccagactggttcgaaaagcagtttgtccccttccatcccccacccttgcggtaccgggagcccgtgctcgaaaaatttgactctggactcgtgctcaatgatgttatgtgcaagccagggcctgaaagtgacttctgtttgaaagtggaggccgcagtgctcggcgcaacaggcccagcagactcccaacacgagtcacagcacgggggactggatcaagatggagaagccagacccgctctggatggcagtgctgccctgcagccactgttgcacaccgtcaaagccggatcaccaagtgatatgccgcgagactctggaatatacgactcatctgtgccctcttctgaattaagcctcccactgatggagggcctctcaacagatcagacagaaacctctagcctaactgagtcagtgtcctcctcgagcggcctcggcgaggaggagccccctgccttaccgtccaaactgctgagcagcggatcatgcaaggccgatctgggttgtcggagttacaccgatgagcttcacgccgtcgctccattgtag

SEQ ID NO: 227186 - DNA, 1788 bp, Artificial Sequence
  Description of Artificial Sequence: Synthetic coding sequence
atggaatcccaaccatttctgaatatgaagttcgagactgattacttcgtaaaagtggttcctttcccaagcattaaaaacgaatccaattaccaccctttcttcttcagaaccagagcttgtgacctgctgttacaaccggacaacctagcctgcaagcctttttggaagccgaggaatttgaacatcagccagcacggttccgacatgcaagtgtcattcgatcatgcaccccacaactttggcttccgcttcttctacctgcactataagctcaaacatgagggccctttcaagcgtaagacttgcaagcaggaacagactacagagaccactagctgtttgctgcagaacgtgtctcctggcgactatatcatcgaactcgttgacgatactaacacgacaagaaaggtgatgcactatgctcttaagccagtccattcaccatgggcagggccaatcagagccgtggctatcactgtgcccctggtcgttattagtgccttcgccaccttattcacggtaatgtgcagaaagaaacagcaggagaatatatacagtcatttggacgaggagtcatctgagagttctacatacacagcggcacttcctagggagcgcttaaggccccgtcccaaggttttcctgtgctattcttcaaaagatggccagaatcacatgaacgttgtgcaatgtttcgcttatttcctgcaggatttctgcgggtgtgaggtcgctcttgacttgtgggaggacttttccctatgccgtgaggggcaaagggagtgggtgatacaaaagatccacgaatctcagttcatcatagtggtgtgctcaaagggtatgaaatattttgtggataagaagaactacaaacataagggcggagggcgagggtccggcaagggcgagctgtttctggtggctgtctctgccatcgccgagaaactgcgtcaagctaagcagtctagtagcgccgctctgagcaaattcatcgctgtgtacttcgactactcgtgtgagggggacgtgcccggtatactggacctgagcaccaaatacagattaatggacaatcttccccaactgtgctctcacctgcattcacgagatcatggcctgcaggaacctgggcagcatacaaggcaggggtcaagacggaactatttcagatccaagagtggtcgcagcctgtatgttgctatctgtaatatgcaccaattcattgacgaagagccagactggttcgagaagcagttcgtgccattccatcctccaccactgcgttatagggagccagtgctggaaaagttcgacagcgggctggtcctgaatgatgtgatgtgcaagcccggacccgaatccgatttctgtctaaaggtcgaagccgcagtgctgggggctactggacccgctgacagccagcacgaatcccaacacggtggcctcgatcaggatggagaggctcggcctgcgctagacgggtcagccgcacttcaaccactcctgcacacggttaaggcaggcagcccatctgacatgcctcgagactcaggaatctacgactccagtgttccttccagtgagctgagcttgcccctgatggaagggctgtcaaccgatcagacagagacatcaagcctgactgaaagcgtgtcttccagttccggcctgggtgaggaagagcctcctgcattgccttccaagctcctgtcatcagggagttgtaaggcagatctgggctgtaggtcttacaccgacgaactgcatgccgtcgccccactgtag

SEQ ID NO: 227187 - DNA, 222 bp, Artificial Sequence
  Description of Artificial Sequence: Synthetic coding sequence
atggaatctcagcctttccttaatatgaaatttgagacagattattttgtgaaggtggtcccgttcccgagtattaaaaacgaatccaactatcacccattctttttccggacacgagcatgtgatttgctcttgcagcccgataatctggcatgtaagcctttctggaagcccaggaatctcaatatctctcagcatggtagcgacatgcaggttagctag

SEQ ID NO: 227188 - DNA, 1671 bp, Artificial Sequence
  Description of Artificial Sequence: Synthetic coding sequence
atgggcttttggatccttgcaatccttacaatactcatgtacagtacagcggcaaagttctccaaacagagctggggactggagaatgaagcactgattgtccgatgccctagacaagggaaacccagctacacagtggattggtactatagtcagactaacaaatctattcctacccaggagagaaatcgcgtctttgcatccggacagctgctgaaattcctgcctgccgcagtggccgacagcggcatttacacctgcatagtgcggtcacccaccttcaatcggaccggctatgcaaatgtgactatttataaaaaacagagtgactgcaatgtcccagactatctcatgtattctaccgtgagcggaagcgaaaagaatagtaagatttattgccccactattgatttgtataactggactgcgccacttgaatggtttaagaattgccaggctttacagggctctcgctaccgtgctcataagtcttttctggtcatcgataatgttatgaccgaggatgcaggtgactacacatgtaaatttattcacaacgagaacggggctaactacagtgtgaccgccacaagatcatttacagtgaaggatgagcagggattcagtctgttccccgtgattggcgctcctgcgcaaaacgaaatcaaggaagtcgaaatcggtaagaacgctaacctgacgtgctccgcctgtttcggaaagggcacccagttcctggcagcagtactgtggcaactgaacggcaccaagattaccgactttggggagccccgtattcagcaagaggaagggcaaaaccagtcattcagcaatgggctcgcatgcctggacatggtactgcgcattgccgatgttaaggaggaggacctcctgttacagtatgattgcctcgccctcaacctgcatggcttgcgacggcatacagtgagactgtccaggaagaatccaatcgaccaccactccatctactgcatcatcgctgtgtgtagtgttttcttgatgctgattaacgtactagtgattattctgaaaatgttctggattgaagcgacgcttctgtggcgagatatcgctaagccctataagacacggaatgacggcaaactgtatgacgcttacgtcgtgtatcccaggaactataagtccagtacagatggcgctagccgggttgagcactttgtgcaccagatcctacccgacgtgctggagaataagtgcggatacaccctctgtatctacggacgggatatgctcccaggcgaagacgtcgtaacagcagtggaaactaatatacgcaaatctagaaggcacatattcatccttactcctcagattacccataacaaggaattcgcctatgagcaagaagttgccctgcactgtgccctgatacagaacgacgctaaagtcattctcatcgaaatggaggctctgtctgaactggatatgttgcaggctgaagcgcttcaggactccctgcagcatttgatgaaggtacagggaacaattaagtggagagaagaccatatagccaacaagcgtagcttgaatagtaaattttggaaacatgtccgctatcaaatgcctgtcccaagtaagattcccaggaaagcatcctccctcacgcctcttgctgcgcagaagcagtag

SEQ ID NO: 227189 - DNA, 513 bp, Artificial Sequence
  Description of Artificial Sequence: Synthetic coding sequence
atgaactgcagggaactgccgctgaccctgtgggttttaatcagcgtcagtacagcagaaagctgtaccagccgtcctcacattaccgttgtggagggtgaacctttctatctaaagcactgttcatgcagcctggcccatgaaatcgagactacaaccaaaagctggtataaatcctcaggatcacaggagcatgttgagttgaatccaaggagctcttccagaattgctttgcacgattgtgtccttgagttttggcctgtcgagctgaatgacacaggctcctacttctttcagatgaagaactacactcaaaaatggaagttaaacgtcataagaagaaacaagcatagctgttttacggaacgtcaggtgacctcaaagatagttgaggtcaagaagtttttccagataacctgtgaaaacagttactaccaaacattagtcaattccacaagtctgtataagatcgggccacccatctgcagaaaaacgagctccgggttgcattag

SEQ ID NO: 227190 - DNA, 1626 bp, Artificial Sequence
  Description of Artificial Sequence: Synthetic coding sequence
atgaactgccgagagctgccactcactctttgggtgctcattagtgtgtcaacagcagaatcatgtactagccggccacacatcacagtggtggaaggcgagcctttctacctgaaacactgctcttgctcacttgcacacgagattgaaacaaccacaaagagttggtataagtcatcaggaagtcaggagcacgttgagcttaacccaaggagttcctcccggatcgccctccacgattgtgtgctggagttctggccagtggaactgaacgacacggggtcctattttttccagatgaaaaactacacgcagaaatggaaactcaacgtgattagaagaaataaacatagctgctttacagagcggcaggtcacctctaaaatcgtggaggtgaaaaaatttttccagattacctgcgagaacagttactatcagacgttagtgaacagtacgtccttgtataaaaattgcaagaaactactcctggaaaacaataagaatccgactataaagaagaatgctgaattcgaggatcaagggtactattcatgtgttcacttccttcaccacaacgggaaactgtttaatattaccaagacttttaatattacaatagtggaggatcgtagcaatatcgttccagtcctgctgggacccaagctcaatcacgtcgcagtggagctgggcaagaacgttcgtctgaactgtagcgctctgttgaatgaagaggacgttatatattggatgtttggagaagagaatgggagcgatcctaacattcacgaggagaaagagatgaggatcatgacacctgaaggcaaatggcacgcatctaaggtgttaaggatcgagaacatcggagaatcaaacctcaacgtcctatataattgcaccgtggccagcactgggggaaccgacactaaatccttcatcctggtgcggaaagcagatatggcagatatccccggacacgtgttcacaagggggatgatcattgccgttctcatcttggtggctgtggtgtgtcttgtcaccgtgtgtgtaatttaccgtgtagacctcgtgctcttctatcggcacttgaccagacgagatgagacgctgacagatggcaagacgtatgatgcattcgtcagctacctcaaagagtgtaggcccgagaacggagaggaacataccttcgccgtggagatccttcctcgcgtcctcgaaaagcatttcggatataaattatgtatcttcgagagggacgttgtccccggaggtgccgtggtcgatgagatccactcgctgattgaaaagagccgacgacttattatcgttctgtcaaagtcctacatgtcaaacgaagttcgctatgaactagaatccggcctgcacgaggctcttgtggaacggaaaattaagatcatcctcatcgaattcacaccagttactgacttcacttttttgccgcagtctctcaagctactgaagtcacatagggtgcttaagtggaaggcagataaaagtctgagctacaattcccgattttggaagaatctcctttatttaatgccagcaaaaaccgttaagccaggtcgggacgaaccggaggtgttgcccgtgctttccgagtcctag

SEQ ID NO: 227191 - DNA, 1626 bp, Artificial Sequence
  Description of Artificial Sequence: Synthetic coding sequence
atgaactgccgcgaactgcccctaaccctgtgggtgctcatctccgtgtcaactgctgagtcttgcacctcccggcctcacatcactgttgttgaaggcgagcccttttatctcaagcattgcagttgctcccttgcgcacgagatagaaactaccactaagtcatggtataagtcatcgggaagccaggagcatgtagaactgaaccctcggtcttcttcacggatcgcactccatgactgcgtgctagaattttggcctgtagaactgaacgacaccgggagctacttcttccaaatgaagaactacacacaaaaatggaaattaaacgtgatccggcgtaacaaacactcctgtttcaccgagcgccaggtgacaagcaaaattgttgaggtgaagaagttcttccagatcacatgcgaaaacagctactaccaaaccttggtgaatagcacttcgctgtacaaaaattgtaaaaaactgcttcttgagaataataagaatcctactataaagaagaatgccgaattcgaggatcagggctattacagctgtgtgcacttcctacaccacaacggtaaattgtttaatataacaaagaccttcaatatcacaattgtggaggatcgctccaatattgtccccgttctcttgggcccaaagctgaatcacgtagcagttgaactcggcaaaaacgtccgtctcaattgcagtgccctgctcaacgaggaggacgtgatttattggatgtttggagaggagaatggctccgatcctaacattcatgaagaaaaggagatgaggatcatgacacctgaaggtaagtggcacgcctctaaggtgctgcgaatcgagaacattggcgagtccaatctgaacgtgctgtacaactgcaccgtggcctcaaccggcggaactgatacaaagtcttttattctggtgcgcaaggctgacatggctgacatccctggtcatgtgttcacacgcggaatgatcattgccgtgctgattctggtggcagtggtgtgccttgtgaccgtgtgtgttatctatagggttgacttggtcttgttctatagacatctgacgaggcgtgatgaaacactcacagatggcaaaacttacgatgcgtttgtgtcctatttgaaagagtgtcggcctgagaatggggaggaacatacatttgccgtggagatcctgcccagggtgttggagaagcattttggttacaagctttgtatctttgaacgcgacgtcgtacccggtggtgccgttgtggatgagatccacagcttgatcgaaaagagtcggcgtctaatcattgtactcagcaaatcttacatgtccaacgaggtacgatatgaacttgaaagcggcctgcacgaagcgctggtcgaacgcaagattaagatcattctaatcgagttcacccccgttacagacttcaccttcctgccccagagcctgaagctattaaaaagccatagggtccttaaatggaaggctgataagtctttgagctataatagccgattttggaaaaacctactgtacctcatgcccgctaaaaccgtcaagcccggtagggatgaaccagaagtgctgccggtgctcagcgaatcatag

SEQ ID NO: 227192 - DNA, 1800 bp, Artificial Sequence
  Description of Artificial Sequence: Synthetic coding sequence
atgctgtgtctggggtggatatttctgtggctcgtcgcaggggaacgcattaaaggattcaacatctccggatgctcaaccaagaagctattatggacatactcaacgcgatcggaagaggagttcgttctattctgtgatctgcctgaaccgcagaagagccatttctgtcaccggaatcgcctgagccctaaacaggttccagagcatttaccttttatgggctcgaatgacctctcggatgttcagtggtaccagcaacctagtaatggcgaccctctggaagatattcggaagtcttatccgcatatcattcaggataagtgtaccctgcactttctgactccaggtgtcaacaactccggctcttatatctgtagacctaagatgatcaagtcgccatacgatgtcgcctgttgcgtcaagatgattctcgaagtgaaacctcagaccaacgcaagttgcgagtattcagcttcccataagcaggacctgttactgggctcaacaggctctatcagttgtccctccctttcatgtcagagcgatgcccaatcccccgctgtcacatggtacaaaaatggtaagctcctctccgtagagcgctctaacaggatcgtagtggacgaagtgtacgattatcatcagggcacctacgtctgcgattacacccagagcgacacggtttcaagttggactgtgcgagctgtagtgcaggtcaggacaatcgtaggagacaccaaactgaagcctgatatcctcgatcctgtcgaagacacactagaagtcgagctgggtaagccactgaccatttcctgcaaagctagattcgggttcgagcgcgtcttcaaccccgtcataaagtggtacataaaggacagcgatctcgagtgggaagtctccgtgcccgaggcaaagtcaatcaagtcaacactgaaagatgaaattattgagaggaatatcattcttgaaaaagttacccaaagggatctgcggagaaagtttgtatgttttgttcagaattctatcggcaacaccacacaaagcgtacaactaaaggaaaaacgcggtgtcgtactcctgtacatcctgctgggcaccatcggtacactggtggccgtgttggcggcttcagccctcctctacagacactggattgaaattgtcctgctgtatcgcacttaccaatcgaaagatcaaaccctgggcgacaaaaaggacttcgatgcttttgtgagctatgccaaatggagctcttttccatctgaggctactagctcgctgagcgaggaacaccttgccctcagcctgtttccagacgtgctggaaaacaagtacggatacagcctgtgccttcttgagagagatgtggctcccggaggcgtttatgctgaggacatagtatccataattaaacgatctaggagaggcatctttatcttgagccccaattatgttaacggaccctccatctttgagctccaagctgccgtaaatcttgcccttgatgatcagacactgaaacttatcttgattaaattctgttactttcaggagcctgagtcattgcctcatctggttaaaaaggcgctcagagtgttgccaaccgtaacctggagggggctgaagagcgtgcctcccaatagtcgattttgggccaagatgcggtaccatatgccagtgaagaattcccaaggttttacctggaatcagcttaggattacatcacgcatcttccagtggaaaggacttagcagaactgaaaccaccggacgcagttcccagcccaaggaatggtag

SEQ ID NO: 227193 - DNA, 1374 bp, Artificial Sequence
  Description of Artificial Sequence: Synthetic coding sequence
atgatattagaggtcaaaccccagaccaacgcgtcgtgtgaatactcggccagtcataaacaggacttgctgctgggttccactgggtccatttcttgccctagtctctcttgccagagtgacgcccagagtccagccgtgacctggtacaagaatggtaaattgctctccgttgagagatcaaacaggatcgtcgtggacgaggtctatgattaccatcagggcacttacgtgtgtgattacacccaatccgacacagtttcaagttggacagttcgggctgttgtccaggtgagaactatagtaggggataccaaactgaaaccggacattcttgacccagtggaggatacattagaggtagagctaggtaagcctttaacaatttcatgcaaagcacggttcgggtttgaacgtgtctttaatcctgtgatcaagtggtatataaaagacagtgatttagaatgggaggtgtcggtccccgaggctaagtcaattaaatctactttgaaggatgagatcatcgaacggaatattattctggagaaggtgacacagagggacttaaggcgcaaatttgtttgcttcgtgcagaattccattggaaacacgactcaaagcgtgcagctcaaagagaagaggggggtggtgttactttacattcttctgggcaccatagggaccctggtagccgtcctggccgctagcgccctgctttatcgacattggattgagattgtgttgctgtataggacctaccagtctaaggaccagaccctgggggacaaaaaggatttcgacgcgttcgtgagctatgccaagtggtccagttttccttctgaagccaccagcagtctgtccgaagagcacctcgccttgtctctctttccggatgtgctcgagaacaagtatggttattctctatgtcttttagaacgcgacgtggctcctggcggtgtctacgccgaggacatcgtcagcatcattaaacgtagtaggcgagggatctttatcttgtcccccaattatgtgaacggaccctcaatctttgaactgcaagcagctgtgaatctggccctggacgatcagaccttaaaactcatcctcattaagttctgctacttccaggagcccgaaagccttccccatttggttaagaaggccctgcgagtactgccaacagttacttggagaggactcaagtccgtcccgccaaacagcaggttctgggctaagatgagatatcatatgccagtaaaaaattcacaaggcttcacctggaatcaacttagaatcacctccaggattttccaatggaagggcctatctagaacagagaccaccggcaggtctagccagcccaaagagtggtag

SEQ ID NO: 227194 - DNA, 135 bp, Artificial Sequence
  Description of Artificial Sequence: Synthetic coding sequence
atgctctgtcttggttggattttcctttggctggtcgccggtgaacggataaaggggttcaacatttctggctgttctaccaagaagttactgtggacatactccactcgttccgaagaagaattcgtgttatag

SEQ ID NO: 227195 - DNA, 534 bp, Artificial Sequence
  Description of Artificial Sequence: Synthetic coding sequence
atgaagctccagtgcgtcagcctctggttacttgggactattctgatcctgtgtagcgtggataaccatggccttcgcagatgtttaataagtacggacatgcatcatatcgaggaatctttccaggagattaaacgtgccattcaggcaaaggatacgttcccaaatgtaacaatcctatcaactctcgaaacactgcagatcataaaacctctggacgtgtgttgtgtaacaaagaatttgctggcgttttacgtggacagagtgtttaaggatcaccaggagcccaatcccaagatattgagaaagatatcatcgatagcaaactcttttctctacatgcaaaaaaccctcaggcagtgtcaggaacagagacagtgccactgtcgtcaggaggccaccaatgcgacacgcgtaatacacgacaactatgaccagcttgaggtccacgctgctgcaataaagagccttggggaactcgatgtgtttttggcatggataaataagaaccatgaagtgatgttctctgcgtag

SEQ ID NO: 227196 - DNA, 648 bp, Artificial Sequence
  Description of Artificial Sequence: Synthetic coding sequence
atgtgtactgagggcgcttttccacaccgtagtgcctgtagtctgccactaacccacgtccatacgcacattcacgtttgcgtgcccgtgctgtggggctctgtccctcggggaatgaaactgcagtgtgttagcctatggcttttaggcactatactgatactttgtagtgttgataaccacggacttaggcgatgtctcataagtaccgacatgcatcatatagaggagtcttttcaggaaataaaacgcgcaatccaggcgaaggacaccttccctaatgtcaccattctgtcaacactggaaaccctgcaaatcatcaagcctctggacgtgtgctgtgtaactaaaaacctgttggccttctatgtggaccgcgtgtttaaagaccaccaggaacctaacccaaaaatccttaggaagatcagttccatcgctaactctttcctgtatatgcagaaaactcttcgtcaatgtcaggaacaaagacaatgtcactgcaggcaagaagcaaccaatgcaacacgggttatacacgacaactacgatcagctggaggttcatgcagcggcaatcaaaagtttgggtgagctggatgtgttcctggcttggatcaataaaaatcacgaggtgatgttttcagcgtag

SEQ ID NO: 227197 - DNA, 792 bp, Artificial Sequence
  Description of Artificial Sequence: Synthetic coding sequence
atggattcttatttactgatgtggggcttactgacatttattatggtgcctgggtgtcaggctgaactttgcgatgatgaccccccagaaataccacatgccacttttaaagcaatggcctacaaggaaggtaccatgctgaactgtgaatgcaaacgaggttttaggcgcattaagtctggcagcctctacatgctgtgtaccgggaacagctctcactcatcgtgggacaaccaatgccagtgcacaagctccgcaactcggaatacaacaaaacaggttacacctcagcctgaggagcagaaggaacgcaagaccacagagatgcagtctcctatgcagcccgtggatcaggcctccttgcccggacactgccgcgagcctccgccatgggaaaatgaggcgacggaaaggatctaccatttcgttgtagggcaaatggtgtattaccagtgtgtccaaggctatagggctctccaccgcggaccagccgaatccgtatgtaagatgacgcacgggaaaacgcggtggacccagccgcagctgatctgtacaggggaggaaaagccccaggcaagcccagaggggagacccgagtctgaaacctcctgtctggtcacaacaaccgacttccagatccagacagaaatggcggcaacaatggaaaccagcatctttactacggaatatcaggtcgcggtcgccggttgcgtatttttgcttatttccgtgctactgctgagtggactgacctggcagcgaaggcaacggaaatcccggcgtaccatatag

SEQ ID NO: 227198 - DNA, 603 bp, Artificial Sequence
  Description of Artificial Sequence: Synthetic coding sequence
atggattcctacctgctgatgtggggtctgctgacattcattatggtgccagggtgtcaggccgaactctgtgatgacgatccgcctgagattcctcacgccacatttaaagccatggcatataaagaaggcaccatgctcaactgtgaatgtaaaagaggctttcggaggatcaaatcaggctcactctacatgttgtgcacgggaaatagtagtcactcttcttgggacaaccagtgccaatgtactagttccgccacacggaacaccactaaacaggtcactcctcaacccgaggagcagaaagagcgcaaaaccactgagatgcaatctcccatgcagcccgttgaccaagcgtctctccctggggaggaaaaacctcaggccagtcctgaggggagacctgaaagcgaaacgtcttgccttgtgaccacgaccgatttccagatccagaccgaaatggcggcaaccatggaaacttccatcttcaccacggagtatcaggtggccgtggcgggatgtgtcttcttactcatctctgtacttcttctctccggcctgacctggcaacgcaggcagaggaagtctcggaggaccatttag

SEQ ID NO: 227199 - DNA, 819 bp, Artificial Sequence
  Description of Artificial Sequence: Synthetic coding sequence
atggatagttacctgctgatgtggggcctgctcacctttattatggttcccggatgccaggcggagctttgtgacgatgacccccctgagatcccacacgccacgttcaaggccatggcatataaggaggggacgatgcttaactgtgagtgcaagaggggatttaggcgcatcaaaagtggttcactttacatgttgtgtaccggaaactcctctcactcatcttgggataatcagtgccagtgcacgtccagtgcaacccgcaatacaactaagcaggtgaccccccagccggaggagcagaaagagaggaagacaactgagatgcagagtcccatgcagcccgttgatcaggcaagtctgcccggacactgtcgtgagcccccaccgtgggagaacgaggcgaccgaaagaatctaccatttcgtggtgggccaaatggtgtactatcagtgcgtgcagggttatcgagccctccatcgaggtccagcggaatctgtgtgtaagatgacacacggtaaaacccgatggactcagccacagctgatctgcaccggggaaatggagaccagtcagtttcctggggaagaaaaaccgcaggcttctcccgagggccgacctgagagtgaaacgagttgcttagtcacaacgactgactttcagatacagactgaaatggccgcaactatggagaccagcattttcaccactgaatatcaggtggccgtagccggatgcgttttcctgcttatcagcgtccttttactctccggattgacctggcagagacggcagaggaagtcgcgcaggactatctag

SEQ ID NO: 227200 - DNA, 489 bp, Artificial Sequence
  Description of Artificial Sequence: Synthetic coding sequence
atggtgcccggttgccaggctgaactgtgtgacgacgaccctcccgagatcccacacgcaacattcaaagctatggcctataaggaagggactatgcttaattgtgaatgcaaaagaggatttaggcggattaagagtggttcgctgtatatgctgtgcacgggaaattcgagccactcttcttgggataaccaatgccaatgtacgtcgtcggctacacggaatacaaccaaacaggtgactccacagccagaggagcaaaaggagaggaagaccacggagatgcaaagcccgatgcagccggtggaccaggcctccttacccgactttcagattcagactgagatggccgcaaccatggagacctcaattttcacgacagaataccaagtggctgtggccggatgcgtattccttctcatttccgttctacttctttccggtttgacgtggcagcggaggcagcgcaagtctagacggaccatctag

SEQ ID NO: 227201 - DNA, 330 bp, Artificial Sequence
  Description of Artificial Sequence: Synthetic coding sequence
tgaattccccacgccacctttaaggcgatggcctataaagaaggaactatgcttaattgcgagtgcaaacggggattccgcaggattaagagcggcagcctgtacatgctgtgcacaggcaactcttctcactcctcctgggataaccagtgccaatgcacctcttctgccaccagaaataccactaagcaggtgaccccacagcctgaagaacagaaagagagaaagacgacagaaatgcagagcccgatgcaacctgtggatcaggcctcactccccgacttccagattcagaccgagatggcagctaccatggaaacctccatttag

SEQ ID NO: 227202 - DNA, 1110 bp, Artificial Sequence
  Description of Artificial Sequence: Synthetic coding sequence
atggaccccaggaaggtcaacgagttgagagctttcgttaaaatgtgtaagcaggatcccagcgtgcttcacactgaggagatgagatttcttcgtgaatgggttgaatctatggggggaaaagtgcccccagccacacagaaggctaaaagcgaagagaatacaaaggaggaaaagcctgatagcaaaaaggtcgaggaagatcttaaggccgacgagcccagcagtgaagaatccgatctggagatagacaaggagggggtcatagaacctgatactgacgccccacaggaaatgggtgatgagaatgcggaaataacagaagagatgatggatcaagctaatgataagaaagtagccgctattgaagccctgaatgatggcgaattacagaaggccatcgacttattcacggacgcaattaagctgaatccacgactggccatcctgtacgccaaacgagcctcggtgtttgtgaaactgcagaaacctaatgcagccatccgggactgcgaccgcgctatcgagatcaaccctgatagtgcgcagccctataaatggcggggaaaagcgcaccggctgctgggtcattgggaagaagccgctcacgatctggctttggcgtgcaaactcgactacgacgaagacgcctccgcgatgttgaaagaagttcagcccagggcacaaaagatagccgagcatagaagaaaatatgaacggaaaagggaagaaagagaaattaaggagcggatagaacgggtcaagaaagccagagaagagcatgagcgggctcaacgcgaagaagaagccagaaggcagtcaggggctcaatacggcagcttccctgggggtttccctggtggcatgcccggtaacttccccggaggaatgccaggcatggggggagggatgccagggatggccggaatgccaggcctgaacgagatcttgtcagatcccgaggtgctggctgcgatgcaggaccccgaggtgatggtggccttccaggatgttgctcagaacccagccaacatgagtaagtaccagtcaaatcccaaagtcatgaatttgatttcgaagctgtctgccaagtttggaggtcaggcttag

SEQ ID NO: 227203 - DNA, 441 bp, Artificial Sequence
  Description of Artificial Sequence: Synthetic coding sequence
atggcagcccctgctctatcctggagattgccattactgatcctgctgctgcctctggccaccagctgggcatctgccgcagtgaacgggacaagccagtttacatgtttctataactcccgagctaacatcagttgtgtgtggtcacaggatggggctctgcaggatacctcctgccaagttcacgcctggccggataggagacggtggaatcaaacgtgcgagctcttacctgtttcacaagccagttgggcatgcaacctgattctaggagcacccgatagccagaagcttactacagtcgacatcgtgacgttgagggtcctgtgtcgagagggagtgcgatggcgggtaatggccattcaggattttaagccattcgagaatttgcgcctcatggcccctatatctctccaagtggtccacgtcgagacccattag

SEQ ID NO: 227204 - DNA, 267 bp, Artificial Sequence
  Description of Artificial Sequence: Synthetic coding sequence
atggccgcacccgctctcagttggagactgccactgctgatattgttactgccattagccacatcatgggccagcgcggctgtgaatgggaccagtcagtttacctgtttctataattcacgagcaaacatctcttgcgtatggagtcaggatggcgcactgcaagacacatcctgtcaggtccacgcttggcccgaccgcaggaggtggaaccagacgtgcgaactcttgcccgtttctcaggcctcttgggcttgtaacctctag

SEQ ID NO: 227205 - DNA, 567 bp, Artificial Sequence
  Description of Artificial Sequence: Synthetic coding sequence
atggcggctcccgctttgtcttggcgcctaccccttctgatcctgctcctcccattggccacatcctgggccagtgcagccgttaacgggacctcacaattcacatgcttctacaactcgagggctaatattagttgtgtttggagtcaggacggcgcactgcaggacacctcatgtcaggtgcatgcatggcctgatcgcaggcggtggaaccaaacatgcgaattactgcccgttagccaggctagctgggcctgcaacctgatactgggggcacccgattcccaaaagctgacaaccgtcgacatcgtaaccctgcgcgtgctatgtagggaaggagtgaggtggagagtcatggcgattcaggacttcaaacccttcgaaaacctaagactcatggcacccataagcctacaagtagtccatgtggagacacacaggtgtaatatcagctgggaaatcagccaggccagccactacttcgagagacatctggaatttgaagcacgaactctcagtcccggtcacacatgggaagaagcccctctcctgactttgaagcagtag

SEQ ID NO: 227206 - DNA, 297 bp, Artificial Sequence
  Description of Artificial Sequence: Synthetic coding sequence
atggaacccccaaaccccttgggggagcagtactttaaacgcacaatgccacgtatccccactctgaagaacttggaggacctggtgaccgagtatcatgggaatttcagtgcgtggagcggagtgtctaaagggctggccgaaagcttgcagcctgattactctgagaggctgtgtctggtgtccgagatcccgccaaaaggaggcgctctgggagagggcccaggggcaagtccttgcaatcaacattcaccctactgggcacccccttgttataccctcaaaccagaaacctag

SEQ ID NO: 227207 - DNA, 474 bp, Artificial Sequence
  Description of Artificial Sequence: Synthetic coding sequence
atgcttaaaccgagtctgccattcaccagccttctcttccttcaactgcctttgctaggcgtaggactgaacacgaccatcctcacccccaatggcaatgaggatacgaccgcagacttctttctgaccacaatgccgaccgatagcctgtcagtttccaccctgcctctcccggaagtgcaatgcttcgtgttcaatgtggaatatatgaactgtacttggaattctagctccgaacctcaaccgacaaacttgactctacattactggtacaagaactcagataatgataaagtccaaaaatgctcacattacctgtttagtgaggagattacttccgggtgtcagctgcagaagaaggagattcacctgtaccagacctttgtggttcaattgcaggacccgagagagccccgaagacaggcaactcagatgctcaaactgcaaaatcttggtactatatctggactgtag

SEQ ID NO: 227208 - DNA, 1110 bp, Artificial Sequence
  Description of Artificial Sequence: Synthetic coding sequence
atgttaaagccgtctctaccttttacatctctcctgtttctccagctgcccctcctcggagtaggcctgaacacgacgatcctcactcctaacgggaacgaggacactaccgcggattttttccttacaaccatgccaaccgactcgctaagtgtgtcaacactaccactgcctgaagtgcagtgctttgttttcaatgtggagtacatgaactgcacgtggaacagctcaagcgagcctcagccgaccaacttaaccctgcactattggtataaaaacagcgacaacgataaagtgcagaaatgttcccactatttgttctctgaggagataacatctggctgtcaactgcagaagaaagagattcatctgtatcaaacctttgtagtgcagctgcaggaccctagggaaccacggagacaggctacacagatgctgaaactgcagaacctagtgataccctgggctccggaaaaccttaccctccataaactgagtgaatcacaacttgagctgaactggaacaaccggtttctcaatcactgcctcgaacaccttgtccagtaccgcacagattgggatcactcatggactgagcagtctgtcgactataggcacaaattttctctgccttctgtagatggtcagaaacgctatacattccgcgtaaggtcaagattcaaccccctgtgtggcagcgctcagcactggtcagaatggtcacacccaatacactggggctctaacactagcaaggagaatccgtttctgttcgcactggaggcggtcgttattagcgtaggatctatgggactaattattagtcttctttgtgtttacttttggctagagcgcactatgcccaggatccctactctcaagaaccttgaagacttggttactgaataccacggaaactttagcgcttggtctggggtgagcaagggattggccgagagtctccagcctgactattcagagcgcttatgtttggtgagtgagatcccaccaaagggaggcgctttaggagaaggccctggggctagcccttgtaaccagcacagtccatactgggctcccccatgctacacattgaagccggagacttag

SEQ ID NO: 227209 - DNA, 540 bp, Artificial Sequence
  Description of Artificial Sequence: Synthetic coding sequence
atgggcatgaaaaccccacagctggaacaatccgtagactatagacacaagttttccttgccaagtgtggatggccagaaacgctataccttccgcgtgaggtccaggtttaacccattgtgcgggtccgctcagcactggtctgagtggtcccatcccatccactgggggagtaatacttccaaagaaaatccttttctgttcgcattggaggccgtcgtgatctctgtggggagcatgggactcatcatatctctcctttgcgtatatttctggctcgagagaacgatgcctcgtatccctaccctgaagaatttggaggacctggtcacagagtatcacggcaacttcagcgcatggtccggagtctcaaagggtctcgctgagtctctgcagcctgactatagtgaacgcttgtgcctcgtgtcagaaatccctcccaagggtggggcactcggtgaaggccctggggcatccccatgcaatcagcacagcccctactgggctcctccatgctacactctcaaacctgaaacatag

SEQ ID NO: 227210 - DNA, 1662 bp, Artificial Sequence
  Description of Artificial Sequence: Synthetic coding sequence
atgcgcgctcctgggaggcccgctctccgcccacttcccctgccgccactgctactacttctgctggctgcgccatgggggagagctgtaccctgtgtatccggcggtttacccaagcctgcgaatattacattcctctctataaatatgaagaatgtgctccagtggacccctccggaagggctgcagggggtgaaagtaacttataccgtgcagtatttcatttatggccagaagaaatggcttaacaagtcggagtgcagaaacatcaatcgaacctattgcgacctctccgctgagaccagcgactacgagcatcaatattacgcaaaagtcaaagccatctgggggacaaaatgcagtaaatgggccgaatccgggcgattttatccatttctggaaacccagatcggacctcctgaagttgctctaaccacggacgagaaaagcatatccgtggtgctcaccgctcctgagaagtggaagcgaaatcctgaggacctcccggttagcatgcagcagatttattccaatctaaagtacaacgtttcggttttgaacactaaatccaacagaacatggagccaatgcgtcaccaatcacacgttggtgttgacgtggctcgaaccgaatacactgtactgtgttcacgtggagagctttgtgcctggccctcctaggcgtgcacagccttccgaaaaacagtgtgcacggactctcaaggatcagtccagtgaattcaaagctaaaatcatcttctggtatgtcctgccggtgagcatcacagtgttcctcttctccgtaatggggtatagcatctatcgttacattcacgtcgggaaggaaaaacaccccgcaaacttaatcctgatttatggaaatgaatttgacaagaggttctttgtgccagccgaaaagattgtgatcaactttatcactctgaacatctcagatgattccaaaatctcacaccaggatatgagcttactcggcaaatccagtgacgtgtcctccctgaatgatcctcagccctcgggaaacctgcgacctccccaggaggaagaggaggtgaagcatctcggctatgcatctcatctcatggagatcttttgtgactccgaggagaatacagaaggcaccagtctgacacagcaggaatcactgagccggactataccaccagacaaaacggtgattgagtacgaatatgatgtcagaacaacggatatctgcgcaggccctgaggagcaagagttgagcctccaggaggaggtgagtacccaggggaccctcctggaatctcaggctgctcttgcagtgctgggccctcagactctgcagtattcgtacaccccacagctgcaagatttagatcctcttgctcaagaacatactgattctgaagaaggacctgaggaagaaccatctaccacactggtcgattgggacccgcagacgggacggctctgcatacccagtctatcgtcattcgaccaggacagtgaagggtgtgaaccctctgagggggacggattaggagaggaggggttactctctagactgtatgaagagcccgctccagatcgcccaccaggggagaatgaaacttatttgatgcagtttatggaggaatgggggctctacgtgcagatggaaaattag

SEQ ID NO: 227211 - DNA, 630 bp, Artificial Sequence
  Description of Artificial Sequence: Synthetic coding sequence
atgcgagcgcctggaagacccgctctgaggcctttgcctctgccccctctacttctcttgttactcgccgcaccttgggggcgtgccgtaccttgcgtgtcaggaggcctgccaaaacctgccaatatcactttcctcagtattaacatgaagaacgttctgcagtggacacctcccgaaggccttcaaggcgtcaaagtgacctacaccgtgcagtacttcatatatggtcagaaaaagtggctgaataaaagcgagtgcagaaatattaatcggacgtattgcgacctctcagccgagactagcgattacgagcaccaatattacgcaaaggttaaagcaatctggggcacaaaatgttcaaagtgggcagaatctgggcgtttttacccgttcctggaaactcaaattggaccccctgaggtggccctgactacagatgagaagagcatctcagtcgttctcacggccccagaaaagtggaagcgaaaccctgaagatctaccagtgagcatgcagcaaatctatagcaatctgaaatacaacgtgtccgtgctgaatacaaagtcaaatcggactgtgtccctcaaatggaatggagcatatattcacgtacccttgtgctcttag

SEQ ID NO: 227212 - DNA, 1329 bp, Artificial Sequence
  Description of Artificial Sequence: Synthetic coding sequence
atgtcctataacggattacaccaacgggtgtttaaagagctgaagctactgactctgtgctctatctcatcgcagattggccctccagaagtggcactgacaacggacgaaaagtctatttccgtggtgctcaccgcccctgagaaatggaagagaaatccagaggacttgccagtgagcatgcagcagatctacagcaacctaaaatataacgtttctgtgctgaacacgaagtcaaataggacctggagccaatgcgtcacaaaccacacacttgtacttacgtggctggagcccaacacgctctattgcgtgcacgtcgaatccttcgtgcctggtcctcctcgacgcgcacagcccagcgagaagcaatgtgctcgtaccttgaaggatcagagcagtgagttcaaagccaagatcatcttttggtacgttttaccggtctcaatcaccgtgtttctcttttcagtcatggggtactctatctacaggtacatccacgtaggcaaggaaaagcatcctgccaaccttatactgatttacgggaacgagttcgacaaacgcttttttgttcccgcagaaaagatagtcattaacttcatcaccctgaacatttctgacgacagtaagatctcccaccaggatatgagtctcctggggaagtcttcagatgtgtccagcctcaatgacccacagccgagcggcaacctacgcccaccccaggaggaagaagaagtgaaacatctcggatacgcaagccatctgatggaaattttttgtgactcggaagagaataccgaggggacgagcctgacccaacaagagtcgttgagcagaacaataccaccagacaaaacggttatcgagtacgagtacgatgtacgtactaccgatatttgcgccggaccagaagaacaggaattgtctcttcaagaagaagtgtccacccagggcactcttttggagtcgcaggcagctttagcagtacttgggccacagacactccagtattcttacaccccacagctccaggatctcgaccccctcgcacaggagcataccgacagcgaagagggaccggaagaggaacctagcactacactggtggattgggacccccagaccggaaggctgtgtattccgtcattaagttcattcgaccaggattcggaaggttgcgagccttccgaaggcgacggcctgggcgaggaaggattgctgtcacggctgtatgaggaacccgcaccggatcggccacccggagagaatgaaacttacttaatgcaatttatggaagagtggggactttacgtgcagatggagaactag

SEQ ID NO: 227213 - DNA, 1515 bp, Artificial Sequence
  Description of Artificial Sequence: Synthetic coding sequence
atgaagaacgtgcttcagtggactccgcctgaaggcctccagggggtgaaggtgacatacacagtccaatacttcatttacggccagaagaaatggctgaacaagtccgagtgcagaaacataaatagaacttactgtgatctctctgccgagacttcagattacgaacatcaatattacgccaaagtgaaggcaatttggggcactaagtgctcaaagtgggcggagtccgggcgtttttacccgttccttgaaacccagattggccctcccgaagtggctttaaccactgacgagaaatccattagcgttgtgcttaccgcacctgagaaatggaaacggaacccggaagacctgcctgtcagcatgcaacaaatatactccaatctgaagtataatgtctcagtgctcaatactaaaagcaataggacttggtctcagtgcgtgactaaccacactttagttcttacctggctcgagcctaatacactctattgtgttcatgtcgaatctttcgtgcccggacccccaagacgagcccagccgagcgaaaagcagtgcgctagaacactgaaggatcagtcaagtgagttcaaggccaaaattatcttctggtatgtgttgcctgtgagtatcactgtgtttttgttctctgtcatgggttacagtatttaccggtacatccatgtggggaaggaaaaacaccctgctaatttgatccttatctatggtaatgaatttgataagcggttttttgtaccagcagagaagattgttataaatttcataacgttgaacatttctgatgattcaaaaatatctcaccaggacatgagtctgctcggcaagagtagcgacgtttctagtctgaatgacccacagccatcaggcaatctgcgtcctccacaggaagaagaagaggtgaagcacctcggatatgccagccacctgatggaaattttctgcgactctgaagagaataccgaggggacttccctcactcagcaggagagcctgagccgcacaataccacccgacaaaacggttattgaatatgaatacgatgttcgcacaaccgacatctgcgctggtcctgaggaacaagagctcagcctccaggaggaggtgtctactcaaggcacactgctggaatctcaggccgcactggcagtgctgggcccacagacactccagtatagttacacccctcagctgcaggacctcgatcctctggcccaggagcatactgattcggaagagggcccagaggaagagcctagtaccactctcgtggactgggacccacagaccggcaggctgtgcatcccatccttgtcttcgtttgatcaggattctgaaggctgtgaaccttccgaaggagacggcctgggagaagaaggtctgctttctcgcctgtatgaagagcctgcgcctgatagaccacccggtgaaaacgaaacttacctcatgcagtttatggaggaatggggtctttacgtacagatggagaattag

SEQ ID NO: 227214 - DNA, 1617 bp, Artificial Sequence
  Description of Artificial Sequence: Synthetic coding sequence
atgcctagggggtgggcagccccactgctgctcctcctgctgcagggtgggtggggctgtcctgacctggtgtgttacacagactacttacagaccgtaatttgtatcctcgaaatgtggaatctgcatcccagtacattgacgctcacctggcaggaccagtatgaggagctgaaagatgaggcaaccagttgctcattgcaccggagtgcacacaacgctacccacgctacctatacctgtcacatggatgtttttcacttcatggccgacgacatcttttctgtcaatattactgatcagagcggcaactacagccaggaatgtggctccttcttgctcgccgaatccatcaagccagctcctccctttaatgtgactgtgactttctcaggtcagtataatatcagctggaggagtgattacgaggaccccgcattctacatgctgaaggggaagctccagtacgaactgcagtaccgcaaccgcggtgacccatgggcagtgagccctcggagaaaacttatatctgtggattctaggagcgtttccctgctcccattggaattccgcaaagattccagctatgagctccaagtgcgtgccggaccaatgccagggagctcataccaggggacatggtcagaatggtcagatccagtaatttttcaaactcagagcgaggagttgaaggagggctggaacccacatctactactcctgcttttgcttgtgatagtgttcataccagccttttggtcgctgaagacccatccgctttggaggctttggaagaagatctgggcagttccaagtcctgaacgctttttcatgcccctttataaaggctgcagtggagacttcaaaaagtgggtaggagcaccgttcacaggctctagtctggagctggggccttggagtcctgaagttccgtcaaccctggaagtgtactcttgtcatcctccacgctcgcctgccaagcgcttgcagctgacagagctccaggagccagctgagctggtcgagtcagacggcgtgccgaagccgagcttttggcctacggcccagaacagtggcggaagtgcttactccgaggagagagatagaccctatgggctggtcagtatagacacggttacagtgctcgacgcagaaggcccatgtacttggccatgcagctgtgaggacgatggataccctgctctcgatttggatgcaggacttgagccaagcccaggccttgaggatccgctgctggacgccggaacaactgtgctttcgtgcggatgtgtcagcgctgggtctccagggctcggaggaccactgggaagtctcctggataggctgaagccacccctagctgatggcgaagattgggccggtggcttgccgtggggtggtcgctctcctggcggagtgtcggagagtgaggctggttccccactggctggactcgacatggacactttcgatagcggctttgttgggagcgactgctcgtcccctgtggagtgtgattttacatctcctggggacgagggtcctccccgatcgtacctccggcaatgggtggtcatcccaccccctttgtcttcaccaggacctcaggcttcctag

SEQ ID NO: 227215 - DNA, 1617 bp, Artificial Sequence
  Description of Artificial Sequence: Synthetic coding sequence
atgccccgaggctgggcagcacctctgctcctgctcctcttgcaggggggttggggctgtcctgatctggtgtgctacacggattacttgcagacggttatatgcatcctggaaatgtggaatctgcatccctccacccttacactaacctggcaggatcagtacgaggagctcaaagatgaagctacctcatgctcactgcaccgctcggcacacaatgccactcatgccacttatacctgtcacatggacgtgttccatttcatggctgatgacatttttagtgtgaacatcacagatcaaagtggaaattactctcaggaatgtgggtcattcctgctggccgaatccatcaagccagccccacctttcaacgtgactgtgactttctctggtcagtacaacatttcttggaggagcgactacgaggaccccgctttctacatgcttaaaggaaaactccaatacgaactgcagtatcggaacagaggggacccctgggccgtctcccccaggagaaaactgatatctgtggactcaagatctgtgtccctgctgccgctggaattcagaaaggactcctcctacgagttgcaggttagagccggacccatgcctgggtcctcttatcaagggacgtggagcgaatggtctgatcctgtcatatttcagactcagtcagaggaactcaaagaagggtggaacccccacttgcttctgctcctgctactcgttatcgtgtttatccctgccttctggagtcttaagacacaccccctctggcgtctctggaagaagatctgggctgtgccctcccctgagcggtttttcatgcccctgtataagggctgtagtggcgacttcaagaaatgggtgggcgcaccctttactgggtcatcactggaactgggcccatggtcccccgaggttccctcgactttggaggtctacagctgccaccctcccaggagccccgctaaacggctgcagctcaccgagctccaggaacctgcagaactagtggagagtgacggcgtgcctaaacctagcttttggcccacggctcaaaacagtggaggaagcgcctacagcgaagagagggaccgcccttatggactggtgagcatcgataccgtgacagtgctcgacgccgaaggaccatgcacatggccatgttcttgcgaggatgacggttatcctgccttggacctggacgccggtcttgagccaagccctggcctggaagacccgctgctggatgccggaactaccgtactctcatgcggatgcgtgtccgccggaagtccaggactcggtggacccctgggttccctcctggatcgcctgaagccacctctcgccgacggagaagactgggcgggtggattgccctggggaggcaggtcacccggaggggtttcagaatcagaggccggtagccccctggctggcctcgatatggatacctttgatagtggtttcgtcggctcagactgcagcagccccgttgaatgtgactttacatctccgggagacgagggtccacctaggtcgtatctgagacagtgggtggtcatccctccacctctgtcgtctccgggaccccaggccagttag

SEQ ID NO: 227216 - DNA, 1617 bp, Artificial Sequence
  Description of Artificial Sequence: Synthetic coding sequence
atgccaagaggttgggcggcaccacttctcctgcttctgttgcagggcggatggggctgtccagatctggtttgctataccgactatttacagaccgtgatttgcatcttggagatgtggaacctccacccaagcactctcaccctgacttggcaggaccagtacgaggagctgaaggatgaggccacatcttgttctcttcacaggtccgcacacaatgcgactcacgcaacctacacctgtcatatggacgtgttccatttcatggccgatgatatcttcagcgtgaatattaccgaccagtccggcaattattctcaggaatgtggcagtttcctcctcgctgagagcattaaacctgccccaccgtttaatgtcactgtgacgttttctgggcagtataatattagctggaggagcgattacgaggatcccgcattttacatgctcaaggggaagctgcagtacgaactacaatatcgcaacaggggggatccctgggccgtttccccaaggagaaaactcatctccgtggattcaagatctgtctctctgctccctcttgagttcagaaaagacagctcctacgaattgcaggttagagctgggcctatgccaggaagtagttatcaggggacctggagtgagtggtcggaccctgtcatattccagactcagtcagaagaactgaaggaaggatggaacccccatcttcttctcctgctgttgttagtgatcgtatttattcccgcattttggtcactgaaaacccaccctctatggaggctgtggaaaaaaatttgggccgtgccttcccccgagcgcttttttatgccattatataagggctgctccggggattttaagaagtgggtgggtgctccttttactggttcctcactcgaactcgggccatggagcccagaggtcccctcaaccctggaggtatactcctgccatcctcccagatctcctgctaaaagacttcagctcaccgagctgcaggagccagctgagttggtggaatcagacggggtgccaaaaccatcattttggccaactgcccagaactcaggtggctctgcgtactcagaggagcgggatcgaccgtacggtctggtaagtatcgacaccgtgacagtgctggacgcagagggcccatgcacctggccatgctcttgtgaagacgacgggtatcccgcactggacctcgacgccggactggaaccctctcctggcctcgaagacccattgctcgacgcgggaactactgtcctgtcctgtgggtgcgtatccgcgggttccccagggctcggaggtccactcggctccctgctcgatcgactcaagcccccactcgctgatggtgaggactgggccggtggattgccttgggggggtcggtcccctggcggtgtatcggagagcgaagctggatcacctctagcaggactggatatggacacattcgactcaggcttcgtcgggagcgattgctccagcccagtggagtgcgatttcacgagtcccggagatgaaggtccaccacgatcctacctgagacagtgggtggtaattccaccccctctgagcagccctggcccacaggcctcctag

SEQ ID NO: 227217 - DNA, 792 bp, Artificial Sequence
  Description of Artificial Sequence: Synthetic coding sequence
atgatgcctaaacactgcttcctgggatttctgataagtttttttctgaccggcgtggcaggaacccagagtacacacgagtctctcaaaccacagcgcgttcagtttcagtctcggaacttccacaatatcctgcaatggcagccagggagagctctgaccggcaattcttccgtatatttcgttcagtacaaaattatgttctcctgctcgatgaagtccagtcatcagaagccgtccggatgctggcagcacatctcatgcaattttcccggttgcagaacccttgcaaagtacggtcagcgccaatggaagaataaggaagactgttggggcacacaagagctctcctgtgacctaacctcggaaactagtgacatccaagaaccatattatgggagggtgcgagccgcaagcgccggttcctactctgaatggtctatgacaccgaggtttaccccgtggtgggagactaagatcgatccacccgtgatgaacatcacccaggtcaacggcagcctgttggtaattctccacgccccaaatctgccttaccggtaccaaaaggagaagaacgttagtatcgaagactattatgagttactttacagagtgtttattatcaacaattccttagagaaggaacagaaggtgtatgagggtgctcaccgcgctgtggaaatcgaggccctgacaccacactcatcatattgcgtggtggccgagatctatcaaccgatgctggaccgaaggagtcagcgctctgaggagcgatgtgtcgagatcccctag

SEQ ID NO: 227218 - DNA, 393 bp, Artificial Sequence
  Description of Artificial Sequence: Synthetic coding sequence
atgatgccaaaacactgctttctcggatttctgatcagctttttcctgactggggtggccggaactcagagtacccatgaatccctcaagccccagcgcgtacaattccagtcccggaactttcacaatatattacagtggcagcccggtcgcgcactcacaggaaactcctccgtctacttcgttcaatacaagatttacggacagagacagtggaagaacaaggaggattgctggggcacccaggagctgtcatgcgacctgacttctgagacatccgacatccaagagccttactatggaagagtgcgcgcagctagcgccggatcttattccgaatggagtatgacgccgaggttcaccccatggtgggaaagggctaaggggctctag

SEQ ID NO: 227219 - DNA, 696 bp, Artificial Sequence
  Description of Artificial Sequence: Synthetic coding sequence
atgatgcctaagcattgcttcctcggtttcttaatcagtttttttttgacaggagtggccggaacccagtccacccacgagtctctaaaacctcaacgagtccagttccagagcaggaactttcacaacattctgcagtggcagcccggaagggcattgaccggaaacagttccgtatattttgtgcagtataagatctatggccagcgtcagtggaagaacaaagaagactgttgggggactcaagagctgtcttgtgacctgacttctgagacttccgacattcaggagccttattatggcagggttcgggcagcctctgcgggttcatacagcgagtggagcatgactccgcgtttcacaccctggtgggagacgaagattgaccccccagtcatgaacatcacacaggtcaacggctcactccttgtcattctccatgccccaaacctgccttaccggtaccagaaagagaaaaacgtttccatcgaggactactatgagctactttatagagttttcataatcaataattcgcttgagaaagagcagaaagtctacgaaggagcacatagggcggtagagatagaggcactgactccacacagcagctactgtgtggtggcagagatttaccagcctatgttggatcgtagaagtcagagaagtgaagagcgctgtgtggagattccatag

SEQ ID NO: 227220 - DNA, 1563 bp, Artificial Sequence
  Description of Artificial Sequence: Synthetic coding sequence
atggctggacccgagcgctggggcccacttctgctgtgcctgcttcaggcagctcctggcaggccgcgactggccccaccccagaacgtaacgctgctttcccagaatttttccgtgtacctgacttggcttcccggtctgggaaacccccaagatgttacctattttgtggcttatcaatcatctcctacacgccgtcggtggcgggaggttgaggaatgtgctgggactaaggagcttctgtgttccatgatgtgtctgaaaaaacaggacctgtataacaaattcaaggggcgagtgaggaccgtttccccctcctccaagtcaccctgggtggagtctgaatatctcgactatctcttcgaagtcgagcctgcgccaccagtgttggtgcttacacaaaccgaggagatcctgagcgccaacgccacctatcaacttccaccttgcatgcctccattggatctcaaatatgaggtggcgttttggaaggagggcgcaggaaacaaaacactgttcccagtaaccccacacgggcaaccggtccagatcactttacaaccagcagcttcggaacatcattgcctgtccgccagaacgatttatacctttagcgttccgaagtactccaagttctctaagccaacctgcttcctcttggaagtacccgaagctaattgggcattccttgtcctgccctccttgttaatccttcttctggttatcgcggcagggggtgttatttggaagacccttatgggcaacccatggttccagcgtgccaagatgccgagagccctggatttttccgggcacacacacccggtcgctacatttcagccgagccggcctgagagcgtaaacgaccttttcctctgcccccaaaaggaattgacacggggagttcgccctactccaagagttagagcccctgctacccagcagacaaggtggaagaaggatctggcggaagatgaagaagaggaggacgaggaggacaccgaagatggcgtgtcctttcagccatatatcgaaccaccttcattcttgggccaagagcaccaagcccctggacactctgaagccggaggtgtggatagcggaaggccgcgagctccactggtccccagcgagggaagtagtgcctgggatagtagcgatcgatcatgggcctctacggttgacagctcatgggatcgtgccggaagttcggggtatttggctgaaaaagggcctggacagggcccaggaggcgatggccatcaggaatcgctgcctccccctgagttcagcaaagactccgggttcctggaagagcttccagaggataacctctcttcctgggcaacatggggtactctgccccctgagccaaacctcgtgcctgggggacccccagtgagtctgcagacactgactttctgctgggagagctctcctgaagaagaggaagaagcacgtgagagtgagatcgaggactccgatgccggatcttggggagccgagtccacacagcgcaccgaggatcgaggcaggaccctcggccattatatggctcgctag

SEQ ID NO: 227221 - DNA, 735 bp, Artificial Sequence
  Description of Artificial Sequence: Synthetic coding sequence
atggcaggtcctgagagatggggacccctgctgctgtgtctgctgcaggccgctcctgggcgtcccaggctggcccctccccagaacgtgacgctactcagtcaaaattttagtgtgtatcttacgtggctgcccggattaggaaacccacaggatgttacttatttcgttgcctatcaatctagtccaacccgtagacgctggagagaggtcgaggaatgcgcgggaacaaaagaacttctgtgtagcatgatgtgtctgaaaaaacaggacctgtacaataaattcaagggccgtgtgcgcacagtaagcccatcttctaaaagcccttgggtggagagtgagtacctggactatctctttgaagtggaacccgcacccccagtgctggttcttactcagaccgaggaaatcctgagtgctaatgccacgtaccaactgcccccatgtatgcccccactggacctaaaatatgaagtcgcgttttggaaagaaggcgcaggaaacaaaactctgtttcctgtgacccctcacggccagcctgtacaaattactttgcagcccgcagcatctgaacaccactgcctaagcgctaggaccatatacacgttttcagtccccaaatattctaagttcagcaaaccgacttgttttctactcgaggtgcctgggttgttctggacacataccccctgtggcaacttatctgcccaacagaccagagtgagggagtag

SEQ ID NO: 227222 - DNA, 636 bp, Artificial Sequence
  Description of Artificial Sequence: Synthetic coding sequence
atggccggacccgagagatggggcccattgctgctgtgtctcctccaggctgctcctggacggccaaggctagcacctccacagaacgtgactctactcagtcaaaatttctctgtctaccttacatggctgcccggacttggcaacccccaggatgtgacctacttcgtcgcctaccagtctagcccaacgaggaggcggtggagagaggttgaggagtgcgccggaacaaaagagctcctgtgctccatgatgtgtctcaagaagcaagatctatacaacaagttcaagggacgcgtgcggactgtgtccccgtctagtaagagtccctgggtggagagtgagtaccttgactatctgtttgaggttgaacctgcgccaccagtgcttgtacttacccagactgaggaaattttaagtgctaacgccacatatcagctgcccccatgtatgccacccctcgacttgaaatatgaagtcgccttctggaaggagggggcagggaacaaagtgggctcaagtttcccagcacctagactggggcctttactacacccttttctcctgcgcttttttagcccatcacagccagctccggctcccttactgcaggaggtgttcccagtgcattcctag

SEQ ID NO: 227223 - DNA, 558 bp, Artificial Sequence
  Description of Artificial Sequence: Synthetic coding sequence
atgatgtgcttaaagaagcaggatctttacaacaagtttaagggccgagtccgtaccgtgtctccttcatctaagtctccttgggtggaatctgaatatcttgactacctgttcgaggttgagccagctcccccagtgctcgtgctgactcagaccgaagagatcctgtctgcaaatgctacctatcagctgcctccttgtatgcctccacttgatttaaaatatgaagtcgccttctggaaggagggagctgggaacaagaccttatttcctgtgactcctcacggccagccagtgcaaatcactttgcaacctgcagccagcgagcatcactgtctaagtgctaggactatctatacctttagcgttccgaagtatagcaaattttctaagccaacatgcttcctcttagaggtcccggaagccaactgggcttttcttgtcttgcccagcctccttattctgttgctggtgatcgccgcaggcggtgtgatttggaaaacattgatgggcaatccttggttccagagagcaaaaatgccgagggctctcgtgtag

SEQ ID NO: 227224 - DNA, 1476 bp, Artificial Sequence
  Description of Artificial Sequence: Synthetic coding sequence
atggcaggccctgaaagatggggcccactcctcctgtgtcttttgcaggctgcgccaggacgcccaagacttgccccaccccagaacgtgacattgttgtctcagaacttcagcgtgtacttgacgtggctaccgggactgggtaacccacaggacgtcacgtacttcgtcgcctatcaatcctctccaacccgtagaagatggcgggaggtggaagagtgtgccggaaccaaagagctcttgtgctctatgatgtgtcttaaaaagcaggacctctacaacaagttcaaggggagggtccgcacagtgtccccgtctagcaagtcaccctgggtggagtccgaatatctagattatttattcgaggtagagccagcgccaccagtcctggtcctgactcagaccgaagagattctgtccgccaacgccacctatcagcttcctccctgtatgccacctttggatctcaagtatgaggttgcgttctggaaggaaggagccggtaacaaaactctcttcccagtgacgccacatggacagccagtgcagattacactgcaacccgcagcctcagaacaccactgtctgtctgccagaactatttacacttttagtgtacctaagtacagtaaattcagtaagcctacttgcttcctactggaggttcctgaggccaattgggccttcctggtccttccgtcactgctgatactgctgctcgtgattgctgctgggggagtaatctggaaaaccctcatggggaacccctggttccaaagagccaagatgcctcgggctcttgagctcacacgtggagtgcgcccaacccccagggtcagggccccagccacccaacaaacccgctggaagaaagacctggcagaggacgaggaggaagaagacgaagaggataccgaggatggagtgtccttccagccctatattgagcccccttcatttctgggccaagaacatcaggccccagggcactcagaagctgggggagtggatagtggccgaccacgggctccactcgtcccatctgaaggatctagcgcttgggattcgtccgaccgctcctgggcctctacggttgattcaagctgggacagggccggttcctccggttatctagccgaaaaaggtccaggtcaagggccaggcggagacgggcaccaggagtcactgccaccccctgaatttagcaaggactcggggtttcttgaagaactgcccgaggacaacttaagttcttgggcgacgtggggtaccctcccgccagagccaaatctcgtacccggaggtccgccagtgagcttacaaacattaacgttctgctgggagagtagcccagaggaggaggaggaggccagagagagtgagatcgaggactcagacgcagggtcttggggggcagagagcacccaaagaacagaggataggggaagaacattgggccattacatggccagatag

SEQ ID NO: 227225 - DNA, 459 bp, Artificial Sequence
  Description of Artificial Sequence: Synthetic coding sequence
atgtccaggctgcccgtcctcctgctgctccagctgttagtaagacccggattacaagcccctatgacgcaaactaccccactgaaaacttcatgggtcaactgctctaacatgattgacgagatcattacgcatttgaagcaaccccctcttccactcctggacttcaataacctgaacggagaagatcaggacattttgatggagaataaccttcgcagaccaaatttggaggcattcaaccgcgctgtgaaatccctccaaaacgcctctgccattgagtctattctgaagaatctgttgccttgtttacccctggctactgcagcccctacacggcaccccattcacattaaggacggtgattggaacgagtttaggagaaaattaacattctaccttaagaccctagagaatgctcaagcccaacaaactacgctttcattggctatcttctag

SEQ ID NO: 227226 - DNA, 1137 bp, Artificial Sequence
  Description of Artificial Sequence: Synthetic coding sequence
atggtgttgctctggttgacgcttctattgatcgcgcttccatgtttgcttcagaccaaggaggacccgaatccacctatcactaatctcaggatgaaagccaaagcacaacagcttacatgggacctaaatcggaatgtgaccgatatcgagtgtgtaaaagatgcggactactcaatgcctgctgtgaacaattcatactgtcagttcggcgctatctccctgtgcgaggtgaccaattatactgtgagggtggctaaccccccatttagcacgtggatcttgttccctgaaaactctgggaaaccatgggccggtgcggagaacttaacctgctggatccacgatgtggacttcctgagttgctcatgggcagtgggacctggcgctcctgcagatgttcagtatgacttgtacttgaacgtggctaatagaaggcagcagtacgaatgtctgcattacaagaccgatgcccagggaacccggatcgggtgccgattcgacgatatttcaagactatcttccggctcacaatcttcacacatcctggtcagaggacggtctgcagccttcgggatcccgtgcaccgacaagtttgttgtgttttcacagatcgaaatccttacccctcctaacatgaccgccaagtgcaataagacgcactcgttcatgcattggaagatgaggtcccatttcaataggaagttccgctatgagctccagatccagaaacggatgcagcctgttattactgaacaggtgagggaccgcaccagctttcaattgctgaatcccggaacatacactgtacagattcgcgcacgagaaagggtttacgagttcctgagtgcttggagtaccccccagagatttgaatgcgaccaggaggagggggctaacacacgggcatggcggacgtctctgttgatagcccttggcaccctgctcgccctggtgtgcgtgttcgttatctgccggcgatatctggtcatgcagaggcttttcccgagaatccctcacatgaaggaccctatcggcgattcatttcagaacgataagctggtcgtttgggaagccggaaaggctggtctggaggaatgtttagttaccgaagtacaggtcgttcagaagacttag

SEQ ID NO: 227227 - DNA, 903 bp, Artificial Sequence
  Description of Artificial Sequence: Synthetic coding sequence
atggtgctgctgtggctcactctccttctcattgccctgccctgtctcctccagacgaaggagggcggtaagccatgggctggggctgagaaccttacctgctggatccacgacgtggatttcctcagctgttcctgggctgttggcccaggggcacccgctgatgtccaatacgatctctacctgaatgtggctaaccgccgacagcaatacgaatgtctccattacaaaaccgacgcccaggggaccaggattggttgtaggtttgatgatatctcccgcctgagctccgggagccagtctagtcacattctggtgcgcggtagatcggcagcatttggaattccttgcaccgacaagtttgtggtgttttctcagatcgaaatcctcacacccccaaatatgactgccaagtgtaataagacgcatagctttatgcattggaaaatgagatcgcactttaacaggaagttccggtacgagctgcagatccagaagcggatgcagcctgttataacggaacaggtgagggataggacctcattccagctcctgaaccccggaacctacacagttcagattcgcgctagggaaagagtttacgagttcctgtcagcatggtccacccctcagcggttcgagtgcgaccaggaggaaggggctaacacgcgtgcatggcggacatcattacttatagctctaggcacactactggccctggtctgtgtatttgtgatctgccgcagataccttgtgatgcaacgcttgttcccaagaatcccccatatgaaagaccccatcggggattcattccagaacgataaactggtcgtgtgggaagcgggaaaagccggattggaggagtgcttggtcaccgaggtgcaggtggtgcagaagacctag

SEQ ID NO: 227228 - DNA, 495 bp, Artificial Sequence
  Description of Artificial Sequence: Synthetic coding sequence
atggtgttgctgtggctgactctcttgctcattgcactgccatgtctgctgcagacaaaagaaggtggcaagccctgggccggagctgagaacctcacctgctggatccacgacgtagacttcctgagctgctcatgggccgtaggcccaggagcccctgcagacgtacagtatgatctttacctaaacgtggccaatcggcgtcaacagtacgagtgtctgcattataagacagatgctcaagggacaaggattggatgccgcttcgacgatatatcccgactctctagtggtagccaatccagtcacattctcgttaggggcaggtctgccgcatttggtattccttgtaccgataaatttgtggtgttttctcagatagaaatcctcacccctcccaacatgacagcaaagtgcaacaagacccacagctttatgcactggaagatgagaagccactttaatcgtaagtttaggtacgaactgcaaatctag

SEQ ID NO: 227229 - DNA, 1323 bp, Artificial Sequence
  Description of Artificial Sequence: Synthetic coding sequence
atgacttattggcgtctagaaaacatcgctaagaccgaaccacccaagatttttagggtgaagcctgtgctcggaattaagcggatgatccaaatcgaatggattaagcccgaactcgcacccgtgtccagtgacctcaagtacaccctacgctttcgaaccgtaaactcgaccagctggatggaggtcaacttcgcaaagaacagaaaggacaaaaaccagacatataatctcactggactgcagcctttcaccgaatatgtgattgcattgagatgtgcagtgaaagagagtaaattctggagtgattggtcccaagagaagatgggcatgactgaggaagaggcaccttgtggcctggagctttggcgggtactcaaaccagccgaggctgatgggcgaagaccagtacggctgctttggaaaaaggcaaggggtgctcctgtgctggaaaagacactgggatacaacatatggtactaccctgagtcaaacacgaatctgactgaaacgatgaacaccaccaaccagcaactggaactgcacttaggtggcgaatcgttttgggtgagcatgatcagctacaattcattaggcaagagtcctgtcgccactttgaggattcccgcaatccaagaaaagtccttccagtgtatcgaagtaatgcaggcatgcgtcgccgaggatcagctggtagtgaagtggcagtcctctgccttggacgttaatacatggatgattgaatggttcccagacgtcgactccgagcctaccaccctgagctgggagtccgtctcccaggctaccaattggaccattcagcaggataagcttaaaccattctggtgttataacatctcagtgtaccctatgttacatgacaaggtcggtgaaccttacagtatacaggcttatgcaaaagagggggtccccagtgagggccctgaaaccaaagtcgagaacatcggagtgaagactgtcacgattacgtggaaagaaattccaaaaagcgaacgaaagggaattatctgcaattacactatcttctatcaggccgaagggggtaagggcttttgcaagcacgcccatagcgaggtggagaagaatccgaagcctcagatcgacgccatggacaggcccgtggtcggaatggcacccccttcacattgtgatctgcagccaggaatgaaccacctggcaagcctgaatctgtcagagaacggtgctaagtccacacacctgcttggattctggggcctcaatgagagcgaagtgaccgtccccgagcgccgagtcctgagaaagtggaaggaactgctgtag

SEQ ID NO: 227230 - DNA, 1989 bp, Artificial Sequence
  Description of Artificial Sequence: Synthetic coding sequence
atgaagctgagtccccagcctagctgcgtgaacctggggatgatgtggacctgggccctgtggatgttgccgtccttgtgtaagtttagcttggccgctctgcctgccaagcccgaaaatatcagctgtgtctactattatcggaagaacctgacgtgtacatggtcccccggtaaagaaacctcttatactcagtacacagtgaagcgtacctacgcttttggtgaaaagcacgataattgcacgactaactcaagcacttcggagaaccgagcttcatgttcctttttcttgcctaggattaccatcccagataactacacaattgaagttgaggctgagaatggggatggtgtaatcaaatcacacatgacatattggcgactagagaacattgcaaagaccgaaccccctaagatcttccgggtaaagccagtgctgggtataaagcggatgatccagatagaatggatcaagcctgagttggctccagtgtctagtgatctcaaatacaccctccggtttcggacggtgaattctacctcttggatggaggtaaacttcgcaaaaaatcggaaagacaaaaaccaaacctacaacttgaccggattgcagcccttcactgaatacgtgattgccctccgatgcgcggtgaaagagtctaaattttggtcagactggtcccaggagaaaatgggcatgactgaagaggaagcaccttgcggactagagttgtggagagtgctgaagccagcggaagcagacggcaggaggcccgtgaggctgctttggaagaaagctcgcggtgctccggtgctcgagaaaacccttggctacaatatctggtactaccctgagagcaacacaaatctaaccgagacaatgaatacgacaaatcagcaacttgagctgcatcttggcggagagagcttctgggtaagcatgatatcatataactctttgggtaaaagccctgtcgcgaccctcaggataccagctatccaggaaaaatccttccagtgcatcgaagtcatgcaggcctgtgtcgcagaagatcaactggtggtgaagtggcaaagttcagcccttgatgtaaatacttggatgattgagtggtttcccgacgtggatagtgaacccactacactttcatgggagtcagtcagtcaggcaaccaattggaccatccagcaagacaaactgaagcctttctggtgttataatatttctgtctatccgatgttgcacgacaaggtgggtgagccatacagtatccaggcctacgcgaaggagggggtcccttccgaaggcccagagaccaaggtggaaaatatcggggtgaagacggtaacgatcacgtggaaggagatccccaagagcgagcggaaaggcatcatatgcaattacactatcttctaccaagcagagggtggtaaaggcttctctaagactgtgaactcgtcgattctgcagtatggtctcgaatccctgaagagaaagactagctacatcgtgcaggtgatggcttcgacctcagccggtgggacaaatgggacctctattaactttaaaaccctcagcttcagcgtctttgagattatcttgatcacctcactcatcgggggaggcctattgattctaataattcttactgtggcctatggcctgaagaagcctaacaaactgacacatttgtgttggcccactgttcccaaccccgcagaatcctctatagcaacgtggcacggagacgactttaaggataaactaaaccttaaggaaagcgatgattctgtaaacaccgaggacaggattctgaaaccctgtagcacacctagcgataagctggtgatagataagttggtcgtcaatttcggtaatgtgctccaagaaattttcacagatgaggccaggaccgggcaggaaaacaatctggggggagaaaaaaatggcacacgcattttgtcgtcttgcccaacttcgatatag

SEQ ID NO: 227231 - DNA, 2046 bp, Artificial Sequence
  Description of Artificial Sequence: Synthetic coding sequence
atgtgcataagacaactcaaattcttcacaacagcatgcgtctgtgagtgcccgcagaacatcctctctcctcaaccaagctgcgtcaaccttggtatgatgtggacatgggcgttgtggatgcttcccagcctgtgtaaattctctttggccgcactccccgcaaaaccagagaacatcagctgcgtctattactatcggaagaacctgacgtgtacgtggtcccctgggaaggaaacttcttatacccagtataccgtcaaaagaacttatgctttcggagaaaagcacgacaactgtactactaatagctcaacgtctgaaaatcgagccagttgctcttttttcctcccacgaattactatccccgacaactataccattgaggtggaggcagagaacggggatggggtgatcaagagtcatatgacatattggaggctggagaacatcgcaaagacagaacccccaaaaatttttagggtcaagccagtgctggggatcaagaggatgatccagattgaatggatcaagccagaactggctcctgtgtcgtccgatctgaagtatactctgagattccgcacagttaactctaccagttggatggaggttaacttcgccaagaatcgtaaagataagaaccagacctataacctgaccgggctgcagccattcaccgagtacgtgatagcactgcgctgtgcagttaaagaatccaaattctggagcgattggtcacaggagaagatgggaatgaccgaagaggaggctccctgcggactggagctctggcgggtccttaaacctgctgaagcagatggcaggagaccagtgcggctcctctggaagaaagccagaggagcgccagttttagagaagaccctgggctataacatctggtactatccagagtctaatacaaatctcactgaaacgatgaatacaaccaatcaacagctcgagcttcacctggggggagagtccttctgggtgtcaatgatcagttacaacagcttgggcaaatctcccgtggccacgttacggattcccgctatccaggagaagagctttcaatgcatcgaagtgatgcaagcgtgcgtcgccgaggaccaactagtcgtaaaatggcagagtagcgcccttgatgtgaacacatggatgatcgagtggttccccgacgtcgattctgaaccgaccacgttaagctgggagagcgtgtcacaggctactaattggactatccagcaggacaagctaaaaccgttctggtgttacaacattagcgtgtaccccatgctgcacgataaggtaggcgagccctacagtattcaagcatacgcgaaggagggtgtgccgtctgagggacctgaaactaaggtggagaacatcggcgtaaagacagtaactatcacttggaaggagattcccaagagtgagagaaagggcataatttgcaactatacaatattctaccaagcggaagggggaaaggggttctcaaagacagtgaattctagcattctccagtatggcctggagtccctaaagcggaaaacatcttatattgtacaggtgatggcttccacttccgccggtggcactaatgggactagcataaacttcaaaaccctaagcttctccgttttcgagatcatccttataacgtctctgattggcggtggtttactcatcctcattatcctgacggtggcgtatgggctgaaaaagcccaacaagctgactcatctctgctggcccaccgtgcctaaccccgcagagtcttctattgcgacatggcatggggatgacttcaaggacaaattaaacctgaaagaatccgacgactctgtgaacacggaagatcggattctcaaaccttgttctactccaagcgacaaactggtgatcgacaagttggtcgttaatttcgggaacgtgctgcaggagatcttcacggatgaggccaggacagggcaggaaaacaatctgggaggtgagaagaacggcacacgcatcctgagttcttgtcctacctccatctag

SEQ ID NO: 227232 - DNA, 1989 bp, Artificial Sequence
  Description of Artificial Sequence: Synthetic coding sequence
atgaagctgagccctcagcccagttgcgttaatttaggcatgatgtggacctgggctctgtggatgctgcctagcctgtgtaagtttagcctggccgctttaccagcaaaacccgaaaatatctcctgtgtgtattactacaggaagaacctgacatgtacttggagtcctggaaaggagacatcttacacgcagtacacagtgaaacgaacatatgcttttggggaaaaacatgataactgtacgaccaatagttctacatctgagaacagagcgagttgtagtttcttcctgcctaggatcactattccagacaattacactattgaggtggaagcggagaatggagatggtgtgataaaatcccatatgacttattggcgcctggaaaacatagccaaaacggagccgcctaaaattttccgtgtcaaaccggtactgggtatcaaacgcatgatacaaatagaatggatcaagcctgagctcgccccagttagttcggatctcaaatatacattacggttccgtaccgtgaatagtactagctggatggaggtgaattttgctaaaaaccggaaggataaaaaccagacctataatcttaccgggctccagcccttcacggagtacgtgattgcgctaagatgcgccgtgaaggagtctaaattctggagtgattggtctcaggagaagatgggaatgacagaggaggaggccccatgtggattagagctgtggagggtgctcaagcctgcggaggcagatggtcgtaggccagtccggttgctctggaaaaaagccaggggtgcgcctgtccttgaaaagacactcggatataacatttggtactatcccgagagtaacacaaacctgaccgaaacaatgaacaccacaaaccagcagctggaactgcacctagggggagaaagtttctgggtttccatgatctcctataactcactgggaaagagtcctgtggcaaccctgagaatccccgctatccaggagaagagcttccagtgcattgaagtgatgcaggcgtgtgtggcagaggatcagctggttgtcaaatggcagtcttccgctctggatgtgaacacatggatgattgaatggttcccggacgtggatagcgagcccaccaccctctcttgggaaagcgtgtcacaggcaaccaattggaccattcagcaggataaactcaaacctttttggtgctataatatcagcgtttatccaatgttacacgacaaggtgggagaaccctattctattcaggcctatgccaaagagggggttccaagtgaggggcctgaaacaaaagtagagaatataggagttaaaaccgtgactataacctggaaagagatcccaaaatcagagcggaagggaattatctgcaattatacaattttttaccaggctgaaggtgggaagggattttccaaaacagtcaacagctcgatccttcaatacggtcttgagtctctgaagaggaaaacttcctacattgtccaggtaatggcatcaacatcagcagggggtactaacggtacatctatcaattttaagactctgtcctttagtgtttttgaaattatcctcattacttccctgattgggggtggattgctgattctgatcatcctgaccgtggcgtatggacttaagaagcccaacaagctaacccatctctgttggcctaccgtgcccaacccggctgaatcttctatcgcaacttggcatggcgacgattttaaagataagctcaacttaaaagagtcggatgacagcgtgaacacagaggatcgcatcctcaagccatgctctacgcccagcgacaagttagtcatagacaaattggtcgtcaacttcggcaacgttctacaggagatcttcaccgatgaggccagaacaggccaggaaaacaatctcggcggtgaaaaaaacggaacacgaatcctgagctcctgtccgaccagcatttag

SEQ ID NO: 227233 - DNA, 1749 bp, Artificial Sequence
  Description of Artificial Sequence: Synthetic coding sequence
atgtgtatacgacagctgaagttctttacaactgcatgcgtgtgcgaatgtccacagaatattctaagcccacagccatcatgcgtgaacttggggatgatgtggacttgggcactttggatgctgccctccttgtgcaaatttagcttagctgctttgcccgcaaagccagaaaacatctcttgcgtgtattactataggaaaaacctgacatgcacctggagtccagggaaggagacgagttatactcagtataccgttaagaggacttatgcttttggcgaaaagcatgacaactgtactaccaactctagtacctctgagaacagggcatcttgctcgttcttcctccctcgcatcaccatcccggataactacacgattgaggttgaggctgagaacggagacggtgtcataaagtctcacatgacatactggcgcttagaaaatatcgcaaagactgaacccccaaagatttttcgtgtcaagcccgtgctcgggatcaagcggatgatacagatcgaatggattaagcctgaactggcccctgtgtctagtgacctgaagtacaccttgaggttcagaacggtcaattccaccagttggatggaagtcaacttcgccaaaaacagaaaagataagaatcaaacttacaatctcaccggtctgcagccattcaccgagtatgtgattgcgttacgctgtgcagttaaggaaagcaaattctggagtgactggagtcaggaaaaaatgggaatgacagaggaagaagcaccttgtggcctggagctgtggcgggtcctaaaaccggctgaagctgacggtcggagacccgtacgcctgctgtggaagaaagccaggggagcgccagttctagagaagaccttaggttataacatctggtattatccggagtctaacaccaacttgactgagacgatgaatacaacaaaccagcagttggagctccacctgggtggcgaatcattctgggtgtcaatgatttcttacaactcccttggcaaatcccctgtcgctacactgcgcattccagcaattcaggagaaatcattccaatgtatagaggtgatgcaggcctgcgtcgctgaagatcagctggtggtgaagtggcagtccagtgccctggacgttaatacttggatgatcgaatggttccccgatgtagattctgaacctaccactctgagctgggagtcggtgagtcaagctaccaattggactatccagcaggacaagctgaagcctttctggtgctacaatatttccgtatacccaatgctgcatgacaaagttggcgagccttattccatccaagcctacgccaaggagggagtgccctcagagggacctgaaaccaaagtagagaacatcggagtcaaaaccgttactatcacatggaaggagatacccaaaagcgagcggaagggcattatctgcaattacactattttctaccaggcagaaggtggcaaaggattctgtaaacacgctcattcagaggtggagaagaatcctaagccgcagatagatgccatggacagacctgtcgtgggtatggctccaccttcacactgcgacctgcagccaggtatgaatcacctggctagtctgaacctgtccgagaatggggctaagagcactcacttgctcggtttctgggggttgaacgagagcgaggttaccgtgccggagcgcagggtgctccgcaagtggaaagagctgctgtag

SEQ ID NO: 227234 - DNA, 2295 bp, Artificial Sequence
  Description of Artificial Sequence: Synthetic coding sequence
atgtgcattcgccagctaaaattctttaccacagcctgcgtgtgcgaatgtcctcagaatattctgtcgcctcagcctagttgtgtaaatcttggaatgatgtggacttgggctctttggatgttgccctcactttgcaaattctccctggccgctcttccagcaaaacctgagaacatatcttgtgtgtactactatcgcaagaaccttacctgcacttggtccccaggaaaagagacatcatacacccagtacaccgtgaagagaacctacgcctttggcgaaaaacatgataattgcaccaccaactcctccaccagcgagaacagggcatcctgttcattttttcttccaagaatcactattcctgacaactacacaattgaggtcgaggccgagaacggagacggcgtcattaaaagtcacatgacatattggagactcgaaaatatcgctaaaacggagcccccaaaaatcttccgtgtaaaacctgtcctgggaattaagaggatgatccagatcgaatggatcaagccagagctggcccctgtgagctcagatttgaaatataccctgaggttccgcacggtgaattcaactagctggatggaagtcaacttcgctaaaaaccggaaggacaaaaaccagacatacaacttgaccggcctgcaaccattcacggagtacgtgatcgccttgaggtgtgccgtaaaagaatccaaattctggagtgactggtctcaagaaaagatgggcatgaccgaggaagaagccccatgtggccttgaattgtggagggttctaaaacccgctgaggccgatggcagacgcccagtgcggttgctgtggaaaaaggccaggggtgcccctgttttggagaagactctcgggtacaacatctggtattatcctgagtccaacaccaatctgaccgaaactatgaataccactaaccaacagctggagctgcatttaggcggagagtccttttgggtgtccatgatctcttataatagccttggcaagagcccagtcgctacactcaggatccccgcaattcaggaaaaaagttttcagtgcattgaagtgatgcaggcctgcgtggccgaagaccagttagtggtgaaatggcagtcgtctgcgctcgatgtcaatacgtggatgatcgagtggtttcctgacgtggactccgagccaacgaccctctcgtgggagtctgtgtctcaggctactaattggacaatccagcaggataagctgaaacctttctggtgctataatatttctgtctaccccatgcttcacgataaggttggggaaccttactccatacaggcctacgccaaagagggcgtgcccagcgaaggacccgaaacaaaggtcgaaaatattggtgtaaagacggttaccatcacttggaaggaaatccctaagagcgaacgcaagggaatcatttgtaattataccatattttaccaggcggaaggcggaaagggattctctaagacagtgaactcctcaatcctgcagtacggactggaatctcttaaacgtaagacttcatacattgtccaggtgatggcttccactagcgcgggtggaacaaatggaactagtatcaatttcaagaccctgtctttttctgtcttcgagattattctgatcactagcctcatcgggggaggattactgatcctgatcatcttgaccgtggcatacggccttaaaaaacccaataaacttacccacctatgttggcccactgtgcctaatccagcagagagcagtatcgctacatggcacggcgatgacttcaaagacaagctaaacttgaaggaatccgacgacagtgtgaacacggaggatagaatcctgaaaccctgctctacccccagtgataagctcgtgatcgataaactcgtggtgaattttggcaatgtcttgcaagagatcttcactgacgaagccaggaccggccaggagaataatctaggtggagagaaaaacgggtacgtgacctgccctttccgacccgattgccccctgggaaagtcctttgaggaactgcccgtgtctcccgaaatcccccctagaaaatcacagtacctgcggagcaggatgcctgagggcacccgcccagaggcgaaagagcaactgctcttttctggacaatcgttagtgcccgaccatctgtgtgaggagggcgctcctaatccctatctgaagaactctgtgacagctcgagagtttctcgtgagcgaaaagctgcctgagcacactaaaggcgaggtgtag

SEQ ID NO: 227235 - DNA, 1869 bp, Artificial Sequence
  Description of Artificial Sequence: Synthetic coding sequence
atgacatactggcgtctggagaacatcgcaaagaccgagccgcctaagatcttccgtgtgaaacctgtcctcggcatcaagcgcatgatccagatcgaatggatcaaacccgagctggcgcctgtttcttccgatctcaagtacacgctgcgcttcaggacagtgaattcgacgagttggatggaggttaactttgctaagaatcgtaaagataaaaaccaaacttacaatttgacagggttacagccttttactgagtacgttatcgctttacggtgcgccgtgaaggaatcgaagttttggtccgattggtcacaggagaagatgggtatgacggaggaagaagccccatgtggacttgagttgtggcgggtgctaaagccagcagaagccgatggtcggcgacctgttagattgctctggaagaaggcacgcggagccccagtgcttgagaagactctcgggtacaacatttggtactatcctgagagcaacaccaatcttactgagacaatgaacaccacaaatcagcagctcgagctccacttaggtggcgaaagtttctgggtgtcaatgattagttataattcacttggcaagagcccagtggcaactcttcgaattcctgccatccaggaaaagtcgttccagtgtatagaggtcatgcaggcctgcgtggctgaggaccagctggtggtaaagtggcagtcgtcagcactggatgtgaacacttggatgatcgagtggtttccagatgttgatagtgagcctactacgttgtcctgggagtccgtgagtcaggccactaattggacaatccaacaagataagttgaagccgttctggtgttataacatctcagtatatccaatgctgcacgataaggtgggggagccatactctatccaagcttacgctaaggagggtgtgcccagcgaaggacccgaaacaaaggtcgagaatataggtgtcaaaaccgtcacaattacctggaaagaaatccccaagtctgagagaaagggcataatctgtaattacacaatcttttaccaggctgaaggcggtaaaggattctccaaaacagtcaactcatctattttacagtacggactggagtccctaaagcggaagacttcttatatagtccaggttatggctagcacctctgctggcggaaccaacggtacctctataaattttaaaaccctcagcttctcagtatttgagatcattttaataactagcctgattggcggaggcctactgattctgatcattctcacggtcgcttatgggctaaaaaagccaaacaagctcactcatctgtgctggccaacggtccctaatcccgctgaaagctctattgctacttggcacggagatgatttcaaagacaagctgaatttgaaggaatcagacgattccgtaaacactgaggacagaatcctcaagccttgtagcaccccctcggacaagctggtaattgataagctcgtggtgaattttgggaatgtcctacaggaaatctttactgatgaagcgcgaacgggacaggaaaataatttgggtggggaaaaaaatggatatgtcacatgcccattccgtcccgattgccccctgggcaagagtttcgaggaactgccagttagtcccgaaatcccccctcggaaaagccaatatctccgctcgagaatgccggagggaacaaggcctgaagccaaggagcagctcctgttctccggacagagcctcgtaccagatcatttatgcgaggaaggcgcaccgaatccctacctaaaaaactccgtcacagccagagagttcttagtcagcgagaagctgcctgagcacacaaaaggggaggtgtag

SEQ ID NO: 227236 - DNA, 468 bp, Artificial Sequence
  Description of Artificial Sequence: Synthetic coding sequence
atggtgctctctggcgctctttgctttaggatgaaagattcagctctgaaagtgctctacctacacaacaatcagctacttgccggaggcctgcatgcgggtaaagtcattaagggcgaggagatcagcgtggttccaaaccgatggctggacgctagcctgagcccagtgatcctcggggttcaaggcggaagtcagtgtctgtcatgcggagttggccaggagccaaccctgaccttggagcccgtcaacataatggagctgtacctgggtgccaaggagagtaaatcctttactttctatcgccgtgacatgggcctgactagttctttcgagtccgccgcatatcccggatggttcctctgtactgtgccagaggcggaccagcccgtcaggcttacccagctgccggaaaatgggggatggaatgccccaatcaccgacttctactttcagcagtgcgattag

SEQ ID NO: 227237 - DNA, 468 bp, Artificial Sequence
  Description of Artificial Sequence: Synthetic coding sequence
atggtcctgtctggggcattgtgttttcggatgaaggattccgcactgaaggtcctttatctccataataaccagctgctcgccggagggcttcacgccggtaaggtgatcaagggagaggagataagcgtggtgccaaatcggtggctggacgcatcactgtcccctgtcattctcggagtgcaggggggttctcagtgcttatcatgcggcgtcggacaggaaccgaccctcacactggagccagtgaacatcatggagctctacctgggcgcaaaggaatctaagagtttcaccttttaccgcagagatatgggtctgaccagcagttttgagtccgctgcgtatccaggctggttcttgtgtacagtgccagaagctgaccagcccgtaaggttgactcagctgcccgaaaatggcggatggaacgcaccaattacagatttttattttcagcaatgtgactag

SEQ ID NO: 227238 - DNA, 354 bp, Artificial Sequence
  Description of Artificial Sequence: Synthetic coding sequence
atggtgttaagtggtgccctctgttttcgtatgaaagactccgccctaaaagtgctgtatttgcataacaaccagctgttggccggaggcttacacgctgggaaggtaattaagggcgaggagatttccgttgtgcccaaccggtggctcgacgcgtcattgagcccagtgattctcggggtgcaaggcggttcacaatgtctgagctgtggtgtgggacaggaacctaccctgactttggaacctgttaacataatggaactttacctcggtgcaaaagagtcaaagagctttacattttatcgccgagacatggggttgacctcctcatttgagtctgccgcatatccctag

SEQ ID NO: 227239 - DNA, 2478 bp, Artificial Sequence
  Description of Artificial Sequence: Synthetic coding sequence
atgggatggctgtgctctggactgctcttccctgtgtcctgcctcgtactcctccaggttgcatccagcggcaatatgaaggtcctacaggagcccacgtgtgtctccgactacatgtcaatcagcacgtgcgagtggaaaatgaacggacccacaaactgctccacagaacttcggttactgtatcagctggtatttttgctctcagaagcccacacctgcatccccgaaaataacggaggagcaggatgcgtgtgtcacctccttatggatgacgtggtatctgctgacaattacactctggacctgtgggccggacagcagctgctctggaagggatctttcaagccttcagaacacgtcaagcccagagccccaggcaatctcacggtgcatacaaatgtttccgacactctgcttctgacttggagcaacccttatcctcccgataattacttgtacaatcacttgacatacgctgtaaacatttggtctgaaaacgaccccgcagacttccgaatttataatgttacttacctggagccgtcactgaggatcgccgcttccactctgaagagcgggatttcctatcgcgctcgggtaagggcctgggcacaatgttataatactacttggagtgagtggagtccttccacgaaatggcataattcctaccgagaaccctttgagcagcatctgttgttaggagtgtcagtaagctgtatcgttattttggccgtgtgtctcttgtgctatgtttctatcaccaagattaaaaaagagtggtgggaccagatacccaatcctgccaggtcccgcctggtcgccattattatacaggacgcacaggggtcccagtgggaaaagaggagccgtggacaggaacctgccaaatgcccacattggaagaactgcctcaccaagttgctgccttgttttcttgagcacaacatgaagcgcgatgaagacccacataaagctgccaaagaaatgccattccagggctccggtaagagcgcctggtgcccagtggagattagcaaaaccgtcctctggcccgagagcatttccgtcgtacgatgtgtggaattgttcgaggcacccgtggaatgtgaggaggaagaggaggtggaagaggaaaaggggagtttctgcgcatctccggaatcaagcagggatgatttccaggagggtcgggaagggatcgtggctcgcctaaccgagtcattgtttctagatctcctgggtgaggagaacggcggtttctgccagcaggacatgggggaatcctgtttactccctccctccgggtctacatcagcccacatgccttgggatgagtttccaagcgcgggacctaaagaggcgcctccatggggcaaagaacagcccctccacctcgaaccctctccgcctgctagccctacacaatccccagacaatctgacgtgcacggagacacccctggtgatcgcgggaaaccccgcttatagaagcttcagtaactctctctcacaaagcccctgtcccagggagctgggcccagaccccctccttgctcggcatctggaagaggtcgagcccgagatgccctgtgttccacaactgtcggagcctaccaccgtccctcaaccagagccggaaacatgggagcagatcctgaggcgcaatgtcctccagcacggggcagccgcagcccctgtgagcgctcctacatcggggtaccaggaattcgtgcatgccgttgaacagggaggaacgcaggcatctgcagtggtaggtcttggccctcccggagaagctgggtataaggccttctcatccctcctggctagcagcgccgtcagccctgaaaagtgtggattcggagcgagttcaggtgaagaaggctacaaacccttccaggacctgattccagggtgtcccggtgaccctgcgccagtaccagtgccattatttacattcggtctcgacagagaaccaccacgtagcccacaatcaagccatctaccctctagcagcccagagcatcttggtctggaacctggagaaaaggtagaggatatgcccaagccccctctgccccaagaacaagccaccgaccctctagtggattcccttgggagcgggatagtttactccgcccttacctgccatctgtgcgggcacttgaagcagtgtcatggccaggaagacgggggacagactccagttatggcctcaccctgctgtggatgctgttgtggcgaccggtcctcaccacccacgacacccctccgtgcacccgacccatctcctggcggagttccactcgaagctagcctgtgcccggcatccttggccccaagtggaattagtgaaaagtcaaagtcgtcatccagctttcatccagcccctggcaacgcgcagtccagtagccaaacaccaaagatagtgaattttgtgagcgtgggtcctacttacatgcgggtgtcttag

SEQ ID NO: 227240 - DNA, 2433 bp, Artificial Sequence
  Description of Artificial Sequence: Synthetic coding sequence
atgcagaaggatgccaggcgcgagggcaacatgaaagtactgcaggaacccacatgcgtgtcagactatatgagtatcagtacctgcgaatggaaaatgaacggaccaaccaattgctcaacggaactgcggttgctgtatcagctggttttcttgttgtctgaggcccacacgtgcattccagaaaacaatggcggagccggatgcgtgtgtcacctccttatggacgatgtagtgtccgcagataactataccttagatctatgggcgggtcagcagctgctctggaagggctctttcaagcccagtgagcacgtaaagccaagggcccctgggaatttaaccgtgcatacgaacgtctccgacacccttctccttacatggagcaacccatatcctcctgacaactatctgtacaatcaccttacttacgctgtgaacatctggagtgagaacgatcccgctgacttccgcatctataacgttacttaccttgagccctccctgcggatagctgcgagtaccctgaaaagtggcatttcctatagagccagggtgcgcgcttgggcccagtgttataacacaacttggtctgagtggagcccgtctacaaagtggcataattcatacagggaaccttttgaacaacacttgctacttggtgtctccgtcagctgtatcgtgatactcgcagtgtgtctgttgtgttacgtatcgattacaaaaatcaagaaggaatggtgggatcagattccgaatcctgctcgctctagactggtggctatcatcattcaggatgctcaagggtcccagtgggaaaaacgaagtcgcggtcaggagcctgccaagtgcccgcactggaaaaactgtctgactaaattgctgccatgcttcctggagcacaatatgaagagggatgaggaccctcacaaggcagccaaggaaatgccatttcagggcagtggtaagtccgcctggtgccccgtggagatctctaagaccgtgctctggcccgaaagcattagcgttgtacgctgtgtggaattatttgaagcccctgtagagtgcgaagaagaggaggaggtggaagaggagaaagggagcttttgcgcatcgcccgagtcgtcccgcgacgatttccaggaaggcagagagggcattgttgcgaggcttactgaatcactgtttctcgatcttttgggcgaagagaacggtggtttctgccagcaagacatgggagagtcttgcttactacctcccagcggatcaacaagcgcacatatgccatgggatgagtttccctcagccggtcccaaagaggctccaccttgggggaaggagcagcccctacacctcgaaccaagcccccctgcctcccccactcagagcccagacaacctcacctgtactgagacgcccctggtgatcgctggcaatccagcctaccgctccttttctaactcgttatcccagtccccctgtcctcgtgaactgggcccagaccccttgttagccaggcacctggaagaagtggaaccagagatgccatgcgtgcctcagctgtcagagcctacaaccgtccctcagccagagcctgagacctgggagcaaatcctaaggagaaacgtcttgcagcacggggcagcggctgcacccgtgtccgctccaacctcaggatatcaggaatttgtccatgctgttgagcaagggggaacccaagcttctgccgtggtggggcttggcccaccaggggaggcgggttacaaagccttcagctccctgctggcatcgtctgccgtcagccccgaaaagtgtggatttggagcttcttccggggaagaggggtacaagccatttcaggatctcataccaggttgccccggtgatccagctcctgtacctgtccctctcttcaccttcgggcttgatcgcgaaccccctcggtcgccacaaagttcacacctcccttcctccagccccgaacaccttggcctcgagcctggggagaaagtggaggacatgccaaagcccccactgccccaggagcaggcaacagatccactcgtggacagtcttgggagcgggatagtttacagcgcattgacatgtcacttgtgcgggcacctgaagcagtgccacggccaagaagacgggggtcagactcccgtcatggcaagcccgtgctgcgggtgttgttgtggagatcggtccagtccgcctaccacgccactgcgcgcacctgatccgagccccggaggagttcccttggaggccagcctttgcccggctagtcttgccccatctggcattagcgagaagtccaagtcgtcatcctcctttcacccagcgcctggcaatgctcagagtagctcacaaacaccaaaaatcgtgaatttcgtgtcagtgggcccaacatacatgcgggtgtcctag

SEQ ID NO: 227241 - DNA, 684 bp, Artificial Sequence
  Description of Artificial Sequence: Synthetic coding sequence
atgggatggctttgctctggcctactgttcccagttagttgtctggtgctgttacaggtcgcgtccagcggcaatatgaaggtgctgcaggagccaacctgcgtgagtgactacatgtcaatctccacttgcgagtggaagatgaatggtccgactaattgttcaacagagctgaggcttttgtatcagttagtattcttgttgagtgaagctcatacctgcatcccagagaataacgggggtgcagggtgcgtgtgtcatctcctaatggacgacgtcgtcagtgccgacaactataccctggatctctgggccggtcagcagttgttgtggaaaggctccttcaagccaagcgaacacgttaaacccagagccccaggtaatctgacggtgcatactaatgtgtccgataccctcctgctgacctggtccaacccatacccacccgataattatctctacaatcacttaacatacgctgttaatatatggagcgaaaatgaccccgctgattttaggatctacaatgttacttacttggaaccatctttgagaattgctgctagcactctgaaatccgggatttcatatcgcgcacgtgtaagggcttgggcgcagtgctataatactacttggagtgagtggtctccttctacgaagtggcacaatttttctgtatgctag

SEQ ID NO: 227242 - DNA, 2478 bp, Artificial Sequence
  Description of Artificial Sequence: Synthetic coding sequence
atgggctggctgtgcagcgggttgctctttccagtgtcatgcctcgtcctgctccaggtagcttccagcggaaatatgaaagtccttcaggagcccacctgtgtaagcgactatatgtccatcagtacttgcgaatggaagatgaacggccctaccaattgttccactgagcttaggctcctgtaccagctcgtgttccttctttctgaggcccacacttgcattccagagaataacggtggagcgggatgcgtgtgccacctacttatggacgacgtggtgtcagcagataactacacactggacctgtgggctggccagcagctgttgtggaagggatccttcaaaccaagcgaacacgttaaaccccgagcgccaggcaacttgaccgttcacacgaatgtaagcgataccctgctcctcacatggtctaatccctacccccctgataactacttgtacaatcatttgacgtatgccgtgaatatctggagtgagaatgaccccgcagactttaggatctataacgtgacctacctcgagccatccctgcgcattgctgcatccacactcaagagcggtatttcatacagagcccgtgttagagcctgggctcaatgttacaatactacctggtccgaatggtctccatccacgaaatggcataacagttacagggaacccttcgaacagcacctgctgctgggagtgagcgtgagttgcatcgtaattctagcagtgtgccttctttgttatgtgtcgatcacaaagatcaagaaagagtggtgggaccagattcctaatccggctagaagcaggctagtcgcgataatcatccaggatgcgcaggggtctcagtgggagaagcgcagccgcggacaagagcctgcgaaatgcccgcattggaaaaactgcctgacgaaactcctaccttgtttccttgaacacaacatgaagagagacgaggaccctcacaaggcagctaaggaaatgccgttccagggatccggcaaatctgcctggtgtccggtcgagatatccaagactgtgctgtggcctgaaagcattagcgtagtgcgatgcgtggaacttttcgaagctcctgtggagtgtgaagaggaggaggaagtggaagaagagaagggatctttttgtgcctcccctgaatctagcagagacgattttcaggagggaagagaaggtatcgttgctaggttgaccgagagcctgttcttagacctgctcggagaggaaaatggtggattctgccagcaggacatgggcgaatcttgcctgctgccaccatcagggagtacatccgcgcacatgccttgggacgaatttcccagtgctggacccaaggaagccccaccttggggcaaagaacagccattacatctcgaaccttctcccccagcctccccaacccagagtcctgacaatctaacttgcacggaaacccccctggttatcgcgggaaaccctgcctaccgcagctttagcaattccctgagccagtcaccgtgccccagagagttgggacccgatcctctgctcgcacggcatctggaggaggtggagcccgaaatgccttgtgtgccgcaactctctgagccaaccacagtacctcagcccgaacccgaaacatgggagcaaattctcagacgcaacgtcctgcaacacggcgcagccgcagcccctgttagcgcaccgacatcaggttaccaagaatttgtccatgccgtggaacagggcggaacccaagcctctgcagttgtaggcttaggcccacccggagaggcaggctataaggcattttccagcttacttgcctcaagcgcagtgtccccagagaaatgcgggtttggtgcatcctcgggagaagagggctataagccttttcaagacctgattccaggttgcccgggagaccccgctccagtccccgttccactgttcacttttggccttgacagagagccacctcggtctccacagagctcccacttgccgtcttcatcaccggaacacctgggactggaaccgggtgaaaaggtcgaagatatgcctaaacctcctctgccgcaggagcaggcaaccgatcccctcgtggattcactgggctctgggatcgtgtactcagccctcacttgccatctgtgcggtcacctgaaacagtgccacggtcaagaggacggcggacagacaccggtgatggctagcccttgttgtggctgttgctgtggtgataggtcatccccacccacaacccctttacgggctcccgacccctcccctggcggtgtgccactcgaagcaagcctgtgtccagcatcattagctccatctggaattagcgaaaaatcgaagagtagctctagtttccaccctgccccaggtaatgcgcaatcctcttcccagacacctaagattgtgaacttcgttagcgtgggaccaacatatatgagagtgtcctag

SEQ ID NO: 227243 - DNA, 684 bp, Artificial Sequence
  Description of Artificial Sequence: Synthetic coding sequence
atgggatggttgtgctcggggttgttgttcccagtctcctgcctggtgctcttgcaggtcgccagctccgggaacatgaaggtgctgcaggagcccacatgcgtatctgattacatgtcaatcagcacctgcgaatggaagatgaatgggcctacaaattgcagtacagagctcagactgctctaccagctggtctttctgttaagtgaggcacatacatgcatccccgagaacaatgggggtgccggatgtgtgtgccacctgctgatggacgacgtcgtgtccgccgacaattataccttggatctgtgggctggccagcagctgctttggaaagggagtttcaaaccctccgagcatgtgaagcccagggcccctggaaatctgacagtgcatacgaatgtgagcgacacactactgttgacatggtcaaacccctaccctcccgacaattacctctacaatcacttgacttatgctgtaaatatttggtctgaaaatgatcctgcagacttccgaatttacaatgtgacctacctggagccctcactgcgaatcgcagcttccactctgaaatccgggatttcttatcgggctcgcgtgcgtgcatgggcacagtgctataatactacttggagtgaatggagcccatctaccaagtggcacaactccaacatttgctag

SEQ ID NO: 227244 - DNA, 2478 bp, Artificial Sequence
  Description of Artificial Sequence: Synthetic coding sequence
atgggctggctctgctccggactgctgttccctgtgtcatgccttgttctactacaggtggccagctcgggcaacatgaaggtcctccaagagccaacgtgcgtctcagattatatgtctatttcaacgtgtgagtggaaaatgaatggcccaaccaattgcagcactgagcttaggctgctctaccagttggtgttcctcctcagtgaagcccacacttgcattcctgagaacaatggaggagccggatgcgtgtgtcaccttcttatggatgatgtggtcagtgctgacaactatacattggacctgtgggctggacaacagctcctgtggaaagggtcattcaagcctagtgagcatgtgaagccccgagctcctggtaacctgactgtgcacaccaacgtctcggacactctccttctcacatggagtaatccttatcctccagataactacctctacaaccaccttacctatgcagtgaacatatggagcgaaaatgatcctgctgactttcgcatctataacgttacatacctggagccttccttgaggattgctgccagcacacttaagtcaggtatttcgtacagggcacgggtcagagcatgggcacagtgctacaataccacatggtcggagtggtccccaagcactaagtggcacaattcctatcgggagccatttgaacagcacctgctgctaggagtatccgtgagttgcatcgtgatccttgctgtgtgtcttctttgttatgtgtccattaccaagataaagaaggaatggtgggaccagatcccaaacccggcacgttctcgcctggtggcgatcatcattcaggacgcacagggctctcaatgggagaaacgctctcgtggccaggaacccgctaagtgtccgcattggaagaactgtctgacaaaactgcttccatgcttcctggagcacaatatgaaaagggatgaggatccccacaaggcggcaaaggaaatgccttttcagggatccgggaagagtgcctggtgtccagtcgaaatttctaaaacagtgctctggccagaatctatttctgttgtacgatgcgtagaactgtttgaagctcccgttgaatgtgaggaagaagaagaagtggaagaggaaaagggcagcttttgcgcttctccggagtcctctcgcgatgactttcaggaaggcagggaaggcattgtggctaggcttacagagtcactcttccttgacttgctgggtgaggaaaatggcggtttctgccagcaggacatgggggaatcctgcctgctgcccccttccggtagcacctctgcacatatgccatgggatgaattccctagcgcgggtcctaaagaggcgcctccctggggtaaggaacagccgctacaccttgaaccaagcccacctgcgtctcccactcagtcccctgacaatttaacgtgcacggagactcccctggtcatagcaggcaaccccgcttaccgcagtttttccaactccctgagtcagtctccctgtccacgggagcttggccctgatcccctgttagcccgacacctggaggaagtggaacctgagatgccatgtgtgccgcagctttccgagcccacgaccgtcccccagccagaaccggaaacttgggagcaaattctccgtagaaatgtccttcagcacggagccgctgcagctccagtgagcgcacccacatctgggtaccaagagttcgttcacgccgtggaacaaggcggaacccaggcgagcgctgtggtcggcttagggccacccggtgaagctgggtacaaggctttttcttccctgctggcctcaagcgccgtctctcctgagaaatgcggcttcggcgctagtagcggggaggaagggtataaaccatttcaggacctcatccctgggtgccccggtgacccagctcctgtgccagtgcccctctttacctttggcctcgaccgagagccgccaaggtcgccccaatcaagccatttgccctcttctagccccgaacacctcggcttggagcctggggaaaaagtggaagatatgcctaagcctccattaccgcaagaacaagctactgacccactcgtcgatagcttaggatcaggcatagtgtactcagcgctcacgtgtcatctgtgcggacacctaaagcagtgccatggtcaggaggatgggggacaaacgcccgtgatggcaagtccctgttgcggctgctgctgtggtgaccgcagctcacctcccacgactcctctgcgcgcacccgaccctagtcccggaggcgttccccttgaggcatccctgtgtcctgccagtctggccccaagtggcataagtgaaaaatctaagagctcaagtagtttccatccagctcctggaaatgcacagtcaagcagtcagactcccaagatagtgaattttgtgtccgtaggtcccacatacatgcgagtgagctag

SEQ ID NO: 227245 - DNA, 1263 bp, Artificial Sequence
  Description of Artificial Sequence: Synthetic coding sequence
atgataatcgtggcccatgtgctgctcatcctcctgggcgcaactgaaattctccaagcagacctgctgcccgacgaaaagatctctctcctcccgcctgtcaactttaccatcaaagttaccggcctggcccaggtgcttctgcagtggaaacctaaccctgaccaggaacagaggaatgttaacctggagtatcaggttaaaattaatgctcccaaggaggacgactacgagacaagaatcactgaaagcaaatgtgtgaccatcctacataagggattttcagcctctgtgagaactatcttgcagaacgatcacagcctcttggcaagctcctgggctagcgcggagttacacgcccctccgggtagcccaggtacatcaattgttaatctgacatgcacgacaaacaccactgaggacaattattcccggcttagatcctatcaggtttctctgcactgcacatggctcgttggcactgacgcccctgaagacacccagtacttcctctactacagatacgggtcttggaccgaagagtgccaggagtacagcaaggacaccctggggaggaacatagcttgttggtttccgaggacattcattctgagcaaggggagggactggctagccgttctcgtgaatggcagctccaaacatagtgctattcggcctttcgaccagctgtttgccctgcatgctatagatcagatcaatccgccactgaacgtgacagctgaaatagaagggaccagactcagtatacagtgggaaaaaccagtctccgcatttcccattcattgttttgattacgaggtgaagatccataatacacggaatggctatctgcagatcgagaagctgatgactaacgcctttatcagcatcatcgatgatttatctaaatatgatgttcaagtgagagcggcagtgagttcaatgtgtcgggaggcgggactgtggtcggagtggagccagccaatatacgtcggcaacgacgagcataaaccactcagggagtggttcgttatcgtgatcatggcgacgatttgctttattcttcttatcctcagtttgatttgcaaaatttgtcacctgtggatcaagctgttccccccaatcccagcccctaagagtaacataaaggacctgtttgtcaccaccaactacgagaaggctggctcaagtgagaccgaaattgaggtgatctgttacattgagaagccaggggttgagacccttgaagactctgtgttctag

SEQ ID NO: 227246 - DNA, 1008 bp, Artificial Sequence
  Description of Artificial Sequence: Synthetic coding sequence
atgataattgtcgctcacgttctgcttatacttctgggggctaccgagatcctccaggccgacctgttaccggatgagaaaatttccctgctcccacctgtcaactttacaatcaaagtcacaggtctggcccaggttctcttgcagtggaaacctaaccccgaccaggaacagcgcaacgttaaccttgagtatcaggtcaagatcaacgcccctaaggaggacgattatgagacacgaattacagagagcaagtgcgtgaccatactgcataaggggttctcagccagcgtgaggaccatcctgcagaatgatcatagcctgttggcctcttcatgggctagcgctgagctccacgcccctccaggttcgccgggtacaagcatcgtgaatctgacctgtacaactaataccactgaggataattactctcgtcttagaagctaccaggtgtctctccactgtacatggcttgttggcacggatgctccggaggacacccagtattttctttactatcgctatgggagttggacagaagaatgccaagagtactctaaggatacactggggagaaatattgcctgctggttccctcggacattcattctctcgaaaggacgcgactggctggccgtgctggtgaacggaagctctaagcatagcgccatccggccttttgaccagctcttcgctctgcacgcaatcgaccagatcaatcccccattgaacgtcacggcagagatcgagggcacaaggctgagcatccagtgggaaaaacctgtgagtgccttcccgatacactgttttgattacgaagttaagattcataacaccaggaacggctatcttcagatcgagaaactaatgacaaacgctttcatatctatcatcgacgatttgagtaaatatgatgtgcaggttcgcgctgcagtttccagcatgtgcagagaggccggactctggtccgagtggagccagcccatctatgtgggttttagtcgctag

SEQ ID NO: 227247 - DNA, 453 bp, Artificial Sequence
  Description of Artificial Sequence: Synthetic coding sequence
atgacaaacgcgtttatctccattatcgatgacctgagcaagtacgatgttcaggtgcgcgctgcggtatcctctatgtgtagagaggcgggtctctggtcagagtggagccagccaatttatgtgggcaatgacgagcacaaaccgcttagggaatggttcgtgatcgtcatcatggcgaccatttgcttcattctgctgattctgtccctcatatgcaaaatttgccacctgtggatcaagctctttcctccgattcccgctcccaagagtaacatcaaggacctgtttgtcacaacaaattacgaggtgctctgtatttttatttacatcttggactcggctgataattttctacagaagaaaaaagctggctcatcagagaccgaaatcgaagtgatctgctacatcgagaagcccggagtggagaccctggaggattctgtattctag

SEQ ID NO: 227248 - DNA, 1008 bp, Artificial Sequence
  Description of Artificial Sequence: Synthetic coding sequence
atgatcatcgtggcacatgttctgctcatcctcctcggcgctacagagattcttcaggcggacctacttcccgacgagaaaatcagtcttttgccccctgttaattttaccattaaggttaccggactcgcccaggtgcttttacagtggaaacccaaccctgatcaagagcagcggaatgtgaatttggaataccaagtgaagatcaatgcaccaaaagaagatgactatgagaccaggatcactgagagtaaatgtgtcaccatccttcataaggggttctccgccagcgtgagaaccatcttgcagaacgaccactcactccttgccagtagttgggcaagcgcggagttacacgctcccccaggctcacccggtacatctattgtgaacttgacatgcactactaatactactgaagacaattattcaagactaaggagttatcaggtttccctgcactgcacctggctggtgggtacagatgcccctgaggatacccagtacttcctctactacagatatggaagctggactgaagaatgccaggaatactcaaaagacactctgggcaggaatatcgcttgctggtttcctagaacattcatcctaagcaaaggtcgggattggctggcagtgcttgtgaacggatcctctaagcactctgctataagaccttttgatcagttgtttgcgctccacgcaatcgaccagataaacccacccctgaatgtgactgccgagattgagggaacgcgactgtctattcaatgggagaagcccgtgagtgccttccctatacactgtttcgactacgaggtgaaaatccataatacacgtaatggatacttgcagattgagaaactaatgacaaacgcattcatttccattattgacgacctaagtaagtatgacgtccaggtcagggcagctgttagcagcatgtgccgcgaggcaggattgtggagcgagtggtctcagccaatctatgtcggcttcagtcgctag

SEQ ID NO: 227249 - DNA, 978 bp, Artificial Sequence
  Description of Artificial Sequence: Synthetic coding sequence
atgatcattgtggcacatgtccttctcatccttctcggcgcaacagagatcctgcaggcggatctgttgcctgatgagaagatcagccttcttcctcccgtgaacttcaccataaaagttaccggacttgcgcaggtgctgttacagtggaagcctaaccccgatcaggagcaacgcaacgtgaacctggagtaccaggttaagatcaacgcaccaaaggaggatgattacgagacaaggatcaccgaaagcaaatgcgtgacaattctgcacaaagggttcagcgcatctgtgcggactattttgcaaaatgaccacagtttactggccagctcttgggcctcagccgagctgcatgctcctccaggatctccgggtacctctatcgtgaatctgacttgcactacgaatacgacggaggacaactatagcaggctcagatcgtaccaggtgtccttgcactgcacatggctagttggtacggatgcaccagaagatacccagtattttttgtactatcggtatggctcttggacggaagagtgccaggagtactctaaagatacactgggcagaaatatcgcctgctggttccctcggaccttcatcctgagtaaaggccgagattggttggccgtccttgtgaatgggtcttcaaagcactcagccataagaccattcgatcagctcttcgcgctgcacgctatcggaaatgatgaacataagccgttacgagagtggtttgtgattgtgatcatggcaactatctgttttattcttctgattctcagcctgatatgtaagatctgccatctttggattaaattatttccccctattccggctcccaagtcaaatattaaagacctttttgtcacgacaaattacgagaaggcaggctcttccgaaacagaaatcgaggtgatttgctacatcgaaaaaccgggtgtggaaaccctggaggactccgtgttttag

SEQ ID NO: 227250 - DNA, 330 bp, Artificial Sequence
  Description of Artificial Sequence: Synthetic coding sequence
atgattattgtagcacacgtccttttgatcctgctgggcgcaactgaaattttgcaggcagatctactgccggacgaaaaaatctcactcctcccacccgtgaacttcaccataaaggtcactggtttagcccaggtgctgctgcagtggaagcccaatccagatcaagagcaacggaacgtgaatctcgagtaccaggttaagattaacgcccctaaggaggacgattacgagactcgaatcactgagagcaagtgtgtaacaattctgcacaaggggtttagcgcttccgtgcgtacaatcctgcagaatgatcatagtctgttgtag

SEQ ID NO: 227251 - DNA, 1002 bp, Artificial Sequence
  Description of Artificial Sequence: Synthetic coding sequence
atgattatcgtggcccacgtgctacttatattgcttggcgctaccgagatacttcaggccgacttgctgccagacgagaaaatcagtttgctgcctcccgtgaactttacgataaaggttaccgggctggcccaggttctactgcagtggaaacctaaccctgatcaggaacagagaaacgtcaacttggaataccaggtgaaaatcaacgccccaaaagaggacgactacgagactagaatcactgaatctaaatgcgtgacaatcctgcacaaaggcttttcagcgtccgtgcgcaccatcctgcaaaacgaccattccctcctggcgtcaagctgggcgtctgctgagctgcacgctcccccaggttctcccggaacctccatagtcaacttaacctgtacaacaaacaccactgaagacaactattcccgcttgagaagttatcaggtaagcctgcactgcacttggctggtggggactgatgctcctgaggacacacagtactttctctattaccggtatggatcctggactgaggaatgccaagaatactctaaagatacgttggggagaaacatcgcctgttggttcccacgcacattcatattgtctaaaggacgggattggttagcagtcctggtgaacggcagtagcaagcatagcgcaattaggcccttcgaccagctgttcgcactccacgcaatcgaccaaatcaacccacctttgaacgttacagctgagatcgaagggactaggctgagtatccagtgggaaaagccagtgagcgcttttcctatacattgtttcgattacgaggtcaagattcacaacaccaggaacgggtatctccagatcgaaaagcttatgacgaacgccttcatatcgattatcgacgacctgtcaaagtacgacgtgcaggtcagagcagccgtgagcagcatgtgccgagaggcaggcctttggtctgagtggagccagcccatctacgtgggtaaatag

SEQ ID NO: 227252 - DNA, 1137 bp, Artificial Sequence
  Description of Artificial Sequence: Synthetic coding sequence
atgattatcgtcgcccatgtgttgctgattttgctgggcgctaccgaaatcctccaggccgaccttctgccggacgagaagatttctcttcttccacctgtgaatttcacaattaaggtgacaggactcgcccaggtcctgttgcagtggaaacctaaccccgatcaggagcagcgtaacgtgaatctggagtaccaagtcaagatcaatgcgcctaaagaggatgattacgagactcgcattactgaatcgaaatgcgtaacaattctgcataagggtttctccgcctccgtgcgcaccattctccaaaatgaccatagtctgctggcaagctcctgggcttccgccgagttacatgccccacctggaagcccgggaacctccatcgtgaatttgacttgcactactaataccaccgaagataattatagcaggctcagatcgtaccaagtgtcactgcattgtacttggcttgtgggcacggatgccccagaggatacacagtacttcctctattaccgttacgggtcctggaccgaggaatgtcaggagtactctaaagatacgttgggaagaaatatcgcttgctggtttcctcggaccttcatcctgtctaaaggccgagactggctcgcggtgctcgtaaatggctcaagcaaacacagcgcgatcagaccctttgaccagctgtttgcactgcacgctatcgaccagattaatcctccgctaaatgttaccgcagagatcgaaggaactaggttatctatccagtgggagaagcccgtatccgcattccccattcattgttttgattacgaggtcaagattcataatacgcggaacggatatcttcagatcgagaaactaatgacaaacgcttttatctccataatcgacgacttatctaagtatgatgtgcaggtgcgggcagccgtttcttccatgtgcagagaagctgggctttggagcgagtggtcacagcccatctacgtgggcaacgacgaacataaaccactgagggaatggtttgtcatcgtgatcatggcaactatctgcttcattctcctgatcctgtccttaatctgtaagatcaaactcggaccagttcgcagaaagcttaaaagctccgttatttag

SEQ ID NO: 227253 - DNA, 591 bp, Artificial Sequence
  Description of Artificial Sequence: Synthetic coding sequence
atgatcatcgtcgcacatgtgctgcttatcctcctcggggctacagagattcttcaggccgacctcctcccagatgagaaaatatccctgcttccgcctgtaaattttacgattaaagtgacgggtctggctcaagtgctgctgcagtggaaaccaaatccagaccaggagcaacgtaacgttaatctggaataccaggtgaaaattaacgcaccaaaagaggacgactacgaaacacgcattacagaatctaagtgcgttactatcttacacaaagggttttcggccagcgtgcgtaccatcttacaaaatgaccattcattgttggccagctcttgggcttcagcagaattgcatgcaccccctgggagtccagggaccagtatcgtgaatctgacctgcaccactaatactacagaagataactattctcggcttagaagttatcaggtgtctttgcattgcacctggctggtgggaaccgacgcaccagaggatacacagtactttctttattatcgctatgggagttggacagaagagtgccaggaatattcgaaagacaccctagggaggaacattgcttgctag

SEQ ID NO: 227254 - DNA, 636 bp, Artificial Sequence
  Description of Artificial Sequence: Synthetic coding sequence
atgatcatcgtggcacatgtgttgctcatcctgctgggcgcaacagagatcttacaggccgacctccttcctgacgaaaaaatcagtcttctgcccccagtgaatttcaccatcaaagtgacgggattggcacaggtcctgttgcagtggaagcctaacccagaccaggaacagcggaatgtaaatctggagtatcaggtgaagatcaacgctcctaaagaggatgattacgaaacaagaatcacagagagcaagtgtgtgacgattctgcataaggggttcagtgccagcgtgaggacaatcctccagaatgaccactccctgcttgcgtctagctgggcgtcagcagagctacacgcaccaccaggcaacgacgaacacaagccactgagagagtggttcgtcattgtcattatggccaccatctgcttcattctactcattctgtccttgatctgcaagatctgccacctgtggataaaattgtttccacccattcctgcgcctaagtcaaatatcaaggatctcttcgtgaccacaaactacgagaaagcgggtagctctgaaactgaaattgaagtgatttgctatatcgagaagccaggagtggaaacgctggaagatagtgttttctag

SEQ ID NO: 227255 - DNA, 1263 bp, Artificial Sequence
  Description of Artificial Sequence: Synthetic coding sequence
atgatcattgtggcccacgttctgttgatcctcctcggggcaacagaaatacttcaggccgacttactgcccgatgagaagatatcactcttacccccagtgaatttcaccataaaggtgactggcttggcacaggtgctgttgcagtggaaacccaatccggaccaagagcagcgtaatgtgaatctagagtatcaggtgaagatcaatgcccctaaggaggacgattacgagacccgtatcacagagtccaaatgtgtgaccattctccacaagggatttagcgctagcgtgcggactatactgcaaaatgatcattcactgctggctagctcttgggcatctgcagagttgcacgccccaccgggttctccgggtaccagcatagtcaacttgacatgcacaaccaatactacagaagacaactattctcgcctgcgctcgtatcaggtgtcactgcactgtacatggttagtgggaaccgacgcccctgaggacacacagtactttttgtattataggtatgggtcttggaccgaagaatgccaagagtatagcaaggacactctcggtcggaacatcgcttgttggttcccacggactttcatcctaagtaaaggtagagattggctggcggttctagtgaatgggagttccaaacacagcgccatcaggcctttcgatcagctgttcgcactgcacgccatagatcagatcaaccctcctcttaacgtcactgcggaaattgagggcacccgcctgtccatacagtgggagaagccagtgagcgcttttcccattcattgctttgattacgaggtgaagatccacaatacacgcaacggttacctacagattgagaagctcatgactaacgcctttatctccatcatcgacgatcttagcaaatatgacgtacaggttagagcggcagtgtccagtatgtgtagagaggccggattatggagcgagtggagtcagcccatctacgtaggcaacgatgaacacaaacctttgcgggagtggttcgtaattgtaatcatggctaccatctgttttatcctcctaattctctcgctcatttgtaaaatttgtcacctgtggatcaaactgttccctcctatacctgcgcctaaatctaacataaaagatctttttgtcaccactaactacgagaaagctggctcctctgagacggaaatcgaggtaatatgctacattgaaaagcccggtgtcgagaccctggaagatagtgtgttttag

SEQ ID NO: 227256 - DNA, 1002 bp, Artificial Sequence
  Description of Artificial Sequence: Synthetic coding sequence
atgataattgtggcccacgtactcttaatcttgctaggagccacggaaatccttcaggccgacctccttcctgacgaaaaaatttccctgttaccgcctgtcaattttacaatcaaagtgaccggcttagcacaagtgttgttgcaatggaaaccaaatcctgaccaggagcaacgcaatgtaaatttagagtaccaggtcaagattaacgctcccaaggaggacgactatgaaacccgcatcactgagtccaaatgcgtgactattctgcacaaggggttcagtgctagtgtgaggacaatcctccagaatgaccatagcctcctggccagcagctgggcatccgctgagctgcacgctccccctgggagccccggaacaagcattgtaaacctgacatgtaccacaaacactactgaggacaattactcgagattgcggtcttatcaggtctctctccattgcacatggctagttggcacggatgctcccgaagatacacagtattttctctactataggtacggatcatggaccgaggagtgccaggaatactcgaaggacacactgggtcggaacattgcgtgttggtttcccaggacatttatcctgagtaagggcagagattggcttgccgtgctcgtgaatgggagttctaaacatagcgctatccgcccttttgatcagcttttcgccctccacgctattgaccagattaacccacctctcaatgtgacagccgagatcgagggaacgagactctctatacagtgggagaaacctgtcagtgctttccccattcattgttttgactacgaagtgaagatacacaacacccgcaatggctatctgcaaatagaaaagctcatgacaaatgcgttcattagcataatcgatgacttgagtaaatacgatgtgcaagttagagctgccgtatccagtatgtgcagggaggcgggactatggtctgaatggtcacaaccaatttatgtcggtaaatag

SEQ ID NO: 227257 - DNA, 1098 bp, Artificial Sequence
  Description of Artificial Sequence: Synthetic coding sequence
atgttggctgtcggctgtgcgttactggcggctctcttggccgcaccaggagcggctctggccccaagaaggtgcccagcacaggaagtagcgagaggggtgctaaccagtttaccaggcgattcagtgaccttaacttgtcctggcgtggaaccagaagataacgccactgtgcattgggtgcttagaaagcccgctgcaggatcccaccctagccgatgggccggaatggggagaaggctgctcctgagatccgttcagctacatgattccgggaactatagctgctacagggccggaaggcccgctggtacagttcatctgttagttgacgtaccccctgaagaacctcagctgtcttgctttagaaaatccccattgagtaatgtagtgtgcgagtgggggcctagaagcacccctagtctaacaaccaaggctgtgcttcttgtgagaaagtttcaaaatagcccggctgaggactttcaggaaccatgtcagtacagtcaggaatcccagaaatttagctgtcaactggccgttccagaaggtgattcgagcttttatattgtcagcatgtgtgtggccagcagcgtcgggagtaagttcagcaagacacagacctttcagggttgcggtatcctacagcctgatccccctgccaacattactgtgacagcagtcgctcggaatccaagatggctctcagtgacctggcaggatccccactcatggaatagctcattctatcgcctgcgatttgagctgaggtaccgcgctgaaaggtctaagacctttacgacctggatggtgaaagatctgcagcatcattgcgtcattcatgatgcctggtccggcttaaggcacgtagtccagttgagagcgcaggaggaattcggccagggtgaatggtcagagtggtcaccagaagcaatggggactccgtggacagaatcccggtctcctccagccgagaatgaagtctccaccccaatgcaggccttaaccaccaacaaggatgacgacaatatcctatttcgggattctgcaaacgcaaccagcttgcctggtagtcggagacggggaagttgtgggttatag

SEQ ID NO: 227258 - DNA, 1407 bp, Artificial Sequence
  Description of Artificial Sequence: Synthetic coding sequence
atgctggctgtgggctgcgcactcttggccgcattacttgctgcgcctggagccgctctggcccctcgaagatgtcccgcacaagaggtggcccgaggcgtcctgacctctctcccaggggattctgtaacattaacctgtcctggagtcgaaccagaagacaatgctactgtgcattgggtcttgcgcaagccggcagctggctcccaccccagcagatgggcgggtatgggaaggcggctgctgctcagaagtgtgcaactgcatgattccggtaactacagctgctatagggctggcagacccgctgggacagttcatctgttggtggatgtccctcccgaggaacctcagctgtcctgcttccggaagtcacccttatcgaatgtggtttgtgagtggggccctaggagtactccctcactgactaccaaagccgtgctgctcgtgaggaaatttcaaaatagccccgctgaggacttccaggagccttgccagtactcccaagagagccagaaatttagttgccagctcgcagtgccagaaggcgattcttcattctacattgtgtcaatgtgcgtcgctagtagtgtggggagtaaatttagtaaaactcagacgttccagggttgcggcattctgcagcccgacccacccgcaaatattacggtaacagccgtggcacgtaacccacgctggctatccgtcacttggcaggaccctcactcatggaattccagcttttatcggttacgctttgagctgaggtatagagccgaacggtccaaaacattcacaacttggatggttaaggacttgcaacaccattgtgtcattcacgatgcatggtctgggcttcgtcacgtggttcagctgagagcccaggaagaatttggacagggtgagtggtcggagtggtcccccgaagccatgggcactccctggaccgaaagccgtagccctccggctgaaaacgaggtgtccaccccgatgcaggctctgacaacaaacaaagacgatgataacatcctgttccgggactctgcaaatgcgaccagtctcccggtacaggattctagttccgtcccacttcctacctttctggtggcaggcggtagcttagcctttggcacactgctttgtatcgccatcgttttaaggttcaagaaaacatggaaactccgcgctctcaaggagggtaagaccagcatgcacccaccatacagcctcggccaactggtccccgagcggcctagacccacacccgtcttggtgccgttgatctcaccccctgtgtctccatcttctctagggtcagacaataccagctcccacaaccggccagacgccagggatcccagatcaccttatgatatctcaaataccgactatttctttcctaggtag

SEQ ID NO: 227259 - DNA, 2757 bp, Artificial Sequence
  Description of Artificial Sequence: Synthetic coding sequence
atgctgaccctgcagacatggctggtgcaagccctttttatcttcttaacaacagagtccacgggtgaactgctggacccctgtggctacattagccccgaaagtcccgtggtccaactgcactctaatttcactgcggtctgcgttctgaaggagaaatgcatggattactttcacgtgaacgccaattacattgtttggaagactaatcatttcaccatacccaaagagcagtacaccataataaatcgcaccgccagttcagtaactttcacagacatagcatctttaaatattcaactgacttgcaacatcttaacctttggccaactcgaacagaatgtgtatggaattacaataatctcaggtctgccccctgagaaacctaaaaatctgtcttgcatcgtgaacgaagggaaaaaaatgagatgcgagtgggacggagggcgtgaaactcatctggaaacaaacttcacactgaagtccgagtgggcaactcacaaattcgccgattgtaaggctaagcgcgacactccgacatcatgcacggtggattattcaaccgtctatttcgttaatattgaggtgtgggtggaagctgaaaatgcactaggcaaagtcactagcgatcacattaatttcgaccctgtgtacaaagttaagccaaaccctccacataatcttagcgttatcaattctgaggaattgtcctcaatcctgaaactgacctggactaacccctccatcaagtccgtcatcattttaaagtacaatatccaatacaggaccaaggacgcttctacatggtctcaaattcctccagaggacacagctagcacacgaagtagttttactgtccaggacctgaagcctttcaccgagtacgtattccgaatccgctgcatgaaggaggatgggaaagggtattggagcgattggagcgaggaagcttcaggaatcacctatgaagaccggccttctaaggcacccagcttttggtataagatcgacccttcacatacacaggggtaccgaaccgtgcagctggtctggaagacactgcccccttttgaagcaaacggcaagatcttggactacgaagtgaccctaaccagatggaaaagccacctgcaaaactatacagtcaacgccacaaagctcaccgtgaatctcaccaatgatcgatatctggccacactgactgtgcggaatctggtgggcaaatccgatgcggcagtgctgacaatcccagcttgcgactttcaggctactcacccagtgatggacctgaaggctttcccaaaagataatatgctttgggtcgagtggaccacaccaagagagagcgtgaagaaatacatcctggaatggtgcgtgctttcagacaaagccccttgcatcaccgactggcagcaggaggatggcacagttcatcgcacctacctcagaggtaatctggctgaaagtaagtgttacctgatcaccgtgacacctgtgtacgcagatggtcccggatcacctgagagtataaaggcgtacctcaaacaagcaccgccatcaaaagggcctacagtcaggacgaaaaaggtcgggaagaacgaagccgtcctcgaatgggatcagctgccagtggatgtgcagaacgggttcatccgaaactacactatcttctaccggacaattattggaaacgaaaccgccgtaaacgtcgactccagtcatacagagtacactctgtcttctcttacatctgataccctgtacatggtgaggatggcggcttacacagacgagggcggaaaagatgggccagagttcacctttactacgcccaagttcgcacagggtgaaatcgaagcaatcgtggttcctgtgtgcttagcctttctgttgacaaccctgctgggagtgctgttttgctttaataagcgggacctcattaaaaagcacatctggccaaacgtacctgaccccagtaagtcccatattgctcagtggtctccacacactccccctaggcataatttcaattccaaggatcagatgtattctgacggtaacttcacggatgtgtccgttgtggaaattgaagcaaatgataaaaaacctttccccgaggacctgaagagcctggatctgttcaaaaaagagaaaataaacactgagggtcacagtagtggaatcggaggaagttcgtgtatgtctagctccaggccatccatctcttcctctgatgaaaacgagagctcccaaaatacttcatcaacagtgcagtattcaaccgttgtccatagcgggtacaggcaccaggtgccttccgttcaagtgttctctcgtagtgaaagcacgcagccactgttagattcagaggaaaggccagaggatctgcaactggtcgaccacgtggatgggggagatggtatcctgcccaggcaacagtatttcaaacaaaattgttctcagcacgaatcaagccccgacatctcccattttgagagatccaaacaggtcagctcggttaacgaggaggacttcgtgcgtctcaagcagcagatctctgatcacatcagtcagagttgcgggtctggtcagatgaagatgttccaggaggtatccgcagctgacgcatttggcccagggaccgaggggcaagttgagaggttcgaaacagtcgggatggaagccgctactgacgaggggatgccaaaatcttatctacctcagaccgtgcggcaaggtgggtatatgcctcaatag

SEQ ID NO: 227260 - DNA, 990 bp, Artificial Sequence
  Description of Artificial Sequence: Synthetic coding sequence
atgctaacgctccagacttggttagtgcaggcgctcttcatatttcttacaacagagagtacaggcgaactgctcgatccatgtggatatatcagtccagagtccccagtcgtccagcttcacagcaactttacagcggtgtgcgtgctgaaggagaaatgtatggactacttccacgtgaatgccaactacatagtctggaagacaaaccattttaccattcccaaggaacagtatacaatcattaaccggaccgcctcatcagtgacgttcaccgacattgcctccctcaacattcaattaacctgcaatatcttgacttttgggcagctcgagcagaatgtctatgggattacaataatttccggtctcccgccagagaagcccaaaaatctcagctgtatcgtgaatgaaggaaagaaaatgcgttgcgaatgggacggaggaagggagacacaccttgagacaaacttcactctgaagagcgagtgggccacccacaagttcgccgattgtaaggcaaagcgggatacacccacaagttgtactgtggattacagcaccgtttacttcgtgaacattgaggtgtgggtggaagctgaaaacgcactcgggaaagtcacaagtgaccacatcaacttcgatcccgtgtacaaggtaaaaccaaacccgccacataatctgtccgtgatcaattcagaggagctcagcagtatactgaagctcacatggactaatccttctatcaagtctgtgataatccttaaatacaatattcagtatcgtaccaaagacgccagcacctggtcacaaattccaccggaggatactgccagcacgcgttcctcatttacagtccaagacctgaaaccatttacagaatacgtttttcgcatacgctgtatgaaggaagatggtaagggctattggtcagactggtcagaggaggcgagcggcattacgtacgaggacaatatcgcctctttctag

SEQ ID NO: 227261 - DNA, 2574 bp, Artificial Sequence
  Description of Artificial Sequence: Synthetic coding sequence
atgttgacattgcaaacctggctggttcaggctctgtttatcttcctgacaacagagtcaactggcgaattattggacccatgtggctacatctctccagaatcaccagtggtacagcttcactccaactttacagccgtctgcgtactaaaggaaaaatgtatggactattttcatgtgaatgctaactacatcgtctggaaaaccaaccacttcaccatcccaaaagaacagtatacaataatcaaccgcacagctagttctgtgaccttcacggacatcgcttcgctgaatatacagcttacctgtaatatactcacattcggtcagctcgagcagaacgtgtacggcatcaccatcatctcaggattacccccagagaagcccaagaacctcagttgcatcgtgaatgagggaaaaaagatgcgctgtgaatgggacggcggaagggagactcatttagagactaattttaccctgaaaagtgagtgggctactcataagttcgccgattgtaaggcaaagcgggatactccaacctcctgtacagtggactattctactgtgtatttcgtgaacatcgaagtttgggttgaagctgagaatgctcttgggaaggtgacatcggatcacatcaattttgaccctgtatacaaagtgaaacctaacccacctcacaacttgtccgtgattaactcagaggaactctcatcaattctcaagctaacctggacgaatccatctatcaaatcggtgataatcctgaagtacaacattcagtacaggactaaggatgcaagtacatggagccaaataccaccagaagatacagccagcaccaggagttcatttacggtgcaagatctgaaaccgtttactgagtatgtcttccgtatccgctgcatgaaagaagatggtaaagggtactggtccgattggtctgaggaagcgtccggcatcacatatgaggaccgtccctctaaagcaccttcgttctggtacaaaattgacccatcccacacacagggatatagaacagtgcagctcgtctggaaaacactcccacccttcgaggctaacggaaagatactggattatgaggtgaccttgacaagatggaagagtcacttgcagaattacactgttaacgccacaaaactaaccgtgaatctcaccaacgatcggtacctagctaccttaacagtgcgtaacctcgttggaaaaagtgatgccgcagtccttacaatacccgcttgtgatttccagggtaatctggctgagtccaagtgctatcttattaccgtgacccctgtgtacgcagacgggccagggtcacctgagtcaattaaagcctacctgaaacaggcacccccatctaagggtccaactgtcagaactaagaaagtgggaaagaacgaggccgttctggagtgggaccagctgcctgtcgatgtccaaaacgggtttatccgcaactatactatcttctacaggactattattgggaacgaaacagcagttaatgtggactcatcacacacagagtatactttaagtagcctgacaagcgacactctgtacatggtaagaatggccgcatacactgacgagggaggtaaggacggacccgagtttactttcaccacacctaagttcgcccaaggcgagatcgaggctattgtcgtaccagtgtgtctcgcttttcttttgacaacactgctgggggtgctcttttgctttaataagcgggatcttatcaagaagcacatttggcctaatgttcccgatccgagcaaatcccacatcgcccagtggtcccctcatacgccaccacggcataatttcaactccaaagatcagatgtatagcgacggaaacttcacagacgtcagtgtcgttgaaatcgaagctaacgacaagaagccatttcctgaggatttgaaatccttggacctgttcaagaaggagaagatcaacaccgagggacacagttctggcattgggggatcatcttgcatgagcagttcacggccatccataagcagttctgacgagaatgaaagtagccaaaacacttcttcaaccgtccaatattccactgtcgtacattccggttataggcatcaagtgccgtcagtgcaggtgttcagtcgcagcgaatctacccagccactattggactccgaagagcgcccagaggacctgcagctggtggatcacgtggacggcggtgacggtatcctgcccaggcagcagtattttaagcagaattgctcccagcacgagtcttcaccggatatcagccattttgagcgatccaagcaggtctcttctgtgaatgaagaggatttcgtaagactaaaacagcagatttctgatcacatcagccaaagttgcggctctggccagatgaaaatgttccaagaggtgagcgctgccgatgcgtttggacctgggacagaaggtcaggtggagagatttgagaccgtcggcatggaagccgctactgatgagggaatgccaaagtcatatctaccacagactgtgagacagggcggatatatgccccagtag

SEQ ID NO: 227262 - DNA, 2757 bp, Artificial Sequence
  Description of Artificial Sequence: Synthetic coding sequence
atgctaacactgcagacctggctggtgcaggccctgttcattttcctgaccaccgagtcgacaggagaattgctggacccatgcggttatattagccccgagtcaccggtggtccagctgcactctaatttcacagcggtctgtgtgctgaaggagaagtgcatggactacttccacgtgaatgcgaactacatagtatggaaaaccaaccactttaccatccccaaagaacagtatacgataattaaccgtacggcttcctcggtgactttcacagatatcgccagtctgaacatccagctgacgtgtaacatcctgacctttggccagctggagcagaatgtgtacggcattactataattagcgggcttcctcctgaaaagcctaagaacctcagttgtattgtgaatgagggtaagaagatgcgctgtgagtgggacggagggcgagaaactcacctggaaactaacttcaccttgaagagcgagtgggctactcacaagttcgcggactgtaaggcaaagagggataccccaacctcatgcacagtagattactccaccgtatactttgtgaacatcgaagtgtgggttgaggcagaaaatgctctcggcaaggtcacaagcgatcacattaacttcgatccagtctataaggtgaagccgaatccacctcacaacctgtctgtgatcaacagcgaggagctctcctcaattctgaagcttacgtggaccaatcccagcattaaatccgtgatcattctgaagtataacattcagtatcgtactaaggatgcctcaacctggtcacaaatccccccagaagacaccgcttctactcggtcttcctttaccgtccaggatttgaaaccattcacagaatatgtgttccggatacgctgcatgaaagaggacggtaaaggatattggagcgactggagcgaggaagcctctggcatcacgtatgaggacagaccaagcaaagcgcctagtttctggtataaaatcgacccctcccatacccaaggttatcgcaccgtccagttggtctggaaaacactgcccccattcgaagctaacggtaagatccttgactacgaagtcacactcacacggtggaagagtcacctgcaaaactacactgtcaatgcgaccaaactaaccgtcaacctcaccaacgacaggtacctcgccacattgaccgtgaggaaccttgtgggtaagtccgatgccgctgtgctgacgatcccagcatgtgatttccaagcaacacaccccgtcatggatctcaaggctttcccgaaggacaacatgttatgggtggagtggacaaccccgagagagtctgtcaagaagtacatccttgagtggtgtgtgctgtctgataaggcaccctgcatcacagactggcagcaggaggacggaacagtacaccgcacttatctccgagggaacctggctgagagtaaatgttatctgatcacagtgacgccagtgtatgcggatggcccaggatcccccgagtctattaaagcctacctaaaacaggcaccacctagcaagggaccaacagtacgcactaaaaaggtgggcaaaaatgaagctgtcctggaatgggaccaactgccagtcgacgtgcagaatggatttatcagaaactatacaatcttctatagaacgattatcggaaacgagaccgctgtgaatgttgattcttcacacaccgagtatactctgtcttccctgacgagtgatacactatacatggtaagaatggctgcttataccgatgaaggagggaaagacggacctgaatttacgttcaccaccccaaagttcgcccagggcgagatcgaggccattgtggtgcctgtgtgtcttgcgttcctgttgactaccctgctgggcgtcctgttctgtttcaacaagagagatctaatcaaaaaacatatctggcccaatgtgcccgatccatctaagagtcatatagcgcaatggtctcctcatacgcctccaaggcacaatttcaatagtaaggatcagatgtattccgatggtaatttcactgatgttagtgttgtggaaattgaagctaacgataagaaaccgtttcccgaagatctgaaatcactcgacttatttaagaaagagaagataaacactgaaggccattcttccgggattgggggatcctcgtgtatgagcagttcgaggccatctattagttcaagtgacgagaatgaatcctcccagaatacctcaagcaccgtgcagtacagtaccgtagtccactctggttatcggcaccaggtgccaagtgtccaggtgttctcaagatcagaatccacccagccgctgctagacagcgaggagcgccctgaggatcttcaactcgttgatcatgttgacggtggggatggcatactgcctcggcagcaatacttcaagcagaactgttcccagcacgagtcttctccggacataagtcactttgaacgctccaaacaggtgagctcagttaacgaagaggatttcgtgcggttaaaacaacaaatttccgatcacattagccagagctgtggatcgggccagatgaagatgttccaggaagtctcagccgcagacgcattcgggccaggcaccgagggacaagtggagaggtttgagaccgtcggtatggaggcagcgaccgatgaaggcatgccaaaatcttatttgcctcagaccgtgcgacagggcggttacatgcctcaatag

SEQ ID NO: 227263 - DNA, 990 bp, Artificial Sequence
  Description of Artificial Sequence: Synthetic coding sequence
atgctaactttacagacttggttagtgcaggccttgtttatttttctaacgaccgagagcaccggggagctactggatccttgcggctacatatcccctgaaagtcctgtcgtgcagctgcatagcaacttcactgctgtgtgtgtgctgaaggaaaagtgtatggactacttccacgtgaatgctaattatattgtgtggaagactaaccacttcacaattcctaaggagcagtacaccattatcaataggactgccagttcagtcaccttcacagacattgcctcccttaatattcagctgacctgcaacatcctgaccttcgggcagcttgaacaaaacgtctacggcattaccattatcagcggtttacccccagaaaaacccaagaacctaagctgcatcgtgaatgagggcaaaaagatgcgatgcgaatgggacggagggagagagacccaccttgaaaccaattttacattgaaatcagagtgggccactcataagtttgcagactgcaaagccaaacgggatacgcctacttcgtgcacagtcgactactctaccgtgtatttcgtgaacattgaggtgtgggtcgaggcagaaaacgcactgggaaaggtcaccagtgatcacatcaattttgatccagtctataaagtcaagcctaatccaccacataatttatctgtaatcaattcagaagagctcagtagtattttaaagttgacatggactaatccctctattaagtccgtgatcatcttaaaatacaatattcaatatcggacaaaggatgcctccacctggtcacaaataccccctgaggataccgcatccacaagatcttccttcactgtgcaagatctaaaaccctttaccgaatatgtgtttcggataaggtgtatgaaagaggatgggaaagggtactggtccgattggtctgaggaggcgagcggaatcacctacgaggacaacattgcatctttttag

SEQ ID NO: 227264 - DNA, 990 bp, Artificial Sequence
  Description of Artificial Sequence: Synthetic coding sequence
atgttaaccttgcagacttggcttgttcaggctctgtttatatttctgaccactgagtctacaggtgagttactcgacccctgcggctacatttcacctgaatcccctgtggtccagctgcactctaactttactgccgtctgcgtgttaaaggaaaagtgtatggactattttcacgtcaacgccaattatattgtgtggaaaaccaatcattttaccattcccaaagaacagtacactattataaacaggactgccagtagcgttaccttcactgacatcgcctctctgaacatccaactgacctgcaacatccttaccttcggccaacttgagcagaatgtgtatggcattacgattatatccggcttgccacctgagaagccaaagaacctgtcctgtatcgtgaatgaggggaagaagatgcgatgcgaatgggatgggggaagggaaacccacctcgagacaaatttcacgttgaagagtgagtgggccacccacaaatttgccgactgtaaggctaaacgggacacaccaacaagctgcacagttgattactctacagtgtacttcgtcaatatcgaagtatgggtggaggctgaaaatgctctcgggaaagtcacttcagaccatatcaatttcgaccccgtgtacaaagtgaagcccaaccctcctcacaatctaagtgtaattaactcagaagaactgagttcaatcctgaagctaacatggacaaatccctctattaaaagcgttattatcctcaagtacaatatccagtaccggaccaaggatgccagtacctggagccaaataccccctgaagatacagccagtacacgctcatccttcaccgttcaggacctcaaaccatttacagaatacgttttcaggatcagatgcatgaaagaagatggcaaggggtactggagtgattggtccgaagaagcgtccggcataacttacgaggacaatattgctagcttctag

SEQ ID NO: 227265 - DNA, 990 bp, Artificial Sequence
  Description of Artificial Sequence: Synthetic coding sequence
atgcttacactgcagacttggctagtgcaggccctcttcatctttttgaccacagagagcacaggcgagttgctggacccctgtgggtatataagtcctgagtcccctgtggttcaactacattctaacttcaccgccgtctgcgtcctcaaggaaaaatgcatggactactttcacgtgaacgccaactatattgtgtggaaaaccaatcactttaccatccctaaagagcagtacactattattaacaggaccgctagctcagtgacatttacagacattgctagcttgaacatccaactaacttgcaacatcctcaccttcggacagctggagcagaacgtttacggtattactataattagcggattgccacctgaaaagcctaagaatctgtcatgtatcgtcaatgaaggaaagaaaatgagatgcgagtgggatggcggacgcgaaacacatttggaaactaacttcacgctcaagtctgaatgggcaacacacaagtttgctgattgtaaggctaagcgggatacaccaacatcatgcaccgtggactactcaactgtgtatttcgtgaacattgaggtctgggtggaggcagaaaatgcattgggtaaagtcacgagtgaccacattaacttcgacccagtatacaaagtcaagcccaaccctccccacaatctctccgtgataaattctgaagagctgagctctatcctcaagctgacatggacaaacccgagtataaagtctgtcatcatcctgaaatacaacattcaatataggaccaaagatgcctcaacttggtcacagatcccgccagaagataccgcgtctaccagaagtagtttcacagtgcaagacttgaaaccatttactgagtatgtcttcaggatcagatgtatgaaggaggacggtaagggctattggtctgattggtccgaggaggcgagcggaatcacgtacgaggatactatcttcagcttttag

SEQ ID NO: 227266 - DNA, 1380 bp, Artificial Sequence
  Description of Artificial Sequence: Synthetic coding sequence
atgaccatcttaggcaccaccttcgggatggttttcagcttgctgcaggtcgtcagtggagagagcggctacgctcaaaacggtgatctggaggatgccgagttggacgactatagtttcagttgctatagccagctggaggtcaatggctcgcagcacagtctgacttgcgctttcgaagacccagatgtgaatatcactaatctggagtttgaaatctgcggcgctctcgtggaagtcaagtgcctgaactttcggaagttacaggaaatttatttcattgagaccaagaaatttttgcttattggcaagtctaacatatgtgtgaaggtgggtgagaaatcacttacgtgtaagaaaatagatttaactacaattgtgaaacctgaagcaccatttgatctgagcgtagtttaccgtgagggagcaaacgacttcgtagtaacctttaatacctcacacctccagaagaaatacgttaaagtcttgatgcacgatgtagcctatcgccaggagaaggacgagaacaagtggacccatgtgaacttgagctcaacaaaactgactttgctacagagaaagctccaacctgccgctatgtacgaaattaaggtcagaagcattcccgaccattatttcaaggggttctggagtgagtggtccccctcctactattttagaacgcctgagattaacaacagctcaggtgagatggaccctattctcttaaccatctcaatcttatctttcttctctgtggccctgctcgtgatcctggcttgtgtgttgtggaaaaagagaattaaacccatcgtgtggccaagcctgcctgatcataaaaaaacactcgagcatctgtgtaaaaagccgaggaagaatttgaacgtgagtttcaaccccgagagcttcctcgattgccagattcaccgtgttgacgatatacaagctcgtgacgaagtagagggcttccttcaggatacctttccacagcagttggaggaaagcgaaaagcagaggctgggaggggatgtgcaatcaccgaactgccctagcgaagatgtcgtgattacccccgagagctttggacgggatagctctctcacttgtttagcaggcaacgtttctgcctgtgatgccccaatcctgtcctcttcccgctctctcgattgccgagaaagcggcaagaacgggccacatgtgtatcaggatttgcttctgagcctagggactacaaactcaaccctgccccctccattctcactgcagagcgggatcctcacactgaacccagtcgcacagggccagcctattctgacaagtcttggatcgaaccaggaggaggcctatgtgacgatgagttctttctaccagaaccagtag

SEQ ID NO: 227267 - DNA, 789 bp, Artificial Sequence
  Description of Artificial Sequence: Synthetic coding sequence
atgaccatattgggcacaactttcgggatggtgtttagccttctacaggttgtttctggtgagtcaggctacgcccaaaacggcgatttagaggacgcggaactcgatgactactctttcagctgctactcccagctggaagtcaatggcagccagcacagtctgacgtgcgcctttgaggaccccgatgtgaatataacgaacctcgagtttgagatctgtggtgcgcttgtagaggtgaagtgccttaactttagaaagctgcaagagatctactttatcgaaacaaaaaagttcctcctcatcggaaagagtaacatctgtgtgaaagtgggggagaagagtcttacctgcaagaagatagatctgaccaccatagtgaaacctgaggcgcctttcgacctgtccgtggtgtatcgggaaggagctaatgactttgtggtgacctttaatacgagccaccttcaaaaaaaatatgtcaaggtcttgatgcatgatgtggcataccgtcaggagaaggatgagaacaaatggacccatgtgaacctttcttcaacaaaacttacacttcttcaacggaagcttcaacctgccgcaatgtatgagattaaggtgaggtccatcccagatcactacttcaaggggttttggtcagagtggagcccctcatactacttccggacccctgagattaacaacagcagcgggttgagtctgtcttacggcccagtgagcccaattattagaaggctgtggaacattttcgtccggaaccaggagaagatttag

SEQ ID NO: 227268 - DNA, 786 bp, Artificial Sequence
  Description of Artificial Sequence: Synthetic coding sequence
atgactattctgggaactacctttggtatggttttttctctcctgcaggtggtgagtggcgagtcaggttatgcccaaaatggagatctagaggatgcagagctggacgattatagcttctcttgctactctcagttggaggtcaatggaagtcaacacagcctaacttgcgcgtttgaggatcctgatgtgaacatcaccaacctcgagttcgaaatttgcggtgcgttagtggaagtgaagtgtctcaactttcgcaaactccaggagatctactttattgagaccaaaaaatttctgctaattggcaaatcaaatatatgcgtgaaagtgggagaaaagtcattaacatgtaaaaagattgatttaaccacaatcgtgaaaccggaagccccttttgacctctctgttgtataccgggaaggcgctaacgacttcgtggtgacctttaacacaagccacctgcaaaagaaatatgtgaaagtgcttatgcacgatgtcgcctaccggcaggagaaggatgagaataagtggacccatgtgaatctcagctctaccaaacttacgctgttgcagcgaaaactccagccagccgctatgtacgaaattaaggtgcggtctatacccgaccactacttcaaagggttctggtcagagtggtccccaagttattacttcagaacccccgagatcaataattcctcgggtctgtcactgagctatggccctgtctctcccatcatcaggcggctgtggaatatttttgttaggaaccaagagaaatag

SEQ ID NO: 227269 - DNA, 180 bp, Artificial Sequence
  Description of Artificial Sequence: Synthetic coding sequence
atgacaatcctgggaactacctttggaatggttttctctctgctgcaggttgtcagtggggagagcggatatgcacaaaatggtgacctggaagatgccgagctggacgactactccttttcctgctattcacagttggaagtgaacggtagccaacactccctcacgtgtgcgttctag

SEQ ID NO: 227270 - DNA, 159 bp, Artificial Sequence
  Description of Artificial Sequence: Synthetic coding sequence
atgacaattctcgggaccacctttggaatggtgttttcactgctccaggtggtgagcggcgaatcgggttacgcccaaaacggtgacttggaagatgctgagctcgacgactactccttttcatgttactcacaactggaggtcaacgggtcacagtag

SEQ ID NO: 227271 - DNA, 1566 bp, Artificial Sequence
  Description of Artificial Sequence: Synthetic coding sequence
atgggtcttggacggtgcatctgggaggggtggactctggagtcagaagcacttcgaagagacatgggtacctggctgctagcctgtatttgtatctgcacttgcgtgtgtttaggcgttagcgttaccggcgaaggacagggtcctcgaagccgcacattcacttgccttaccaacaatattcttcgcatcgactgtcactggtcagcgcctgagttagggcaagggtcctctccttggctgttgtttacttcgaaccaggctcccggtggcactcacaaatgtattttaagaggaagtgaatgcaccgttgtcctccctcctgaagcagttctggtgcctagtgacaattttaccattacgttccaccactgcatgtccggccgagaacaagtctcgctggttgacccggagtacctgcccaggcgccatgtcaagcttgatccccctagtgatctgcaatccaacatctcatccggacactgtatcctgacatggtcgatctcacctgccctggaaccaatgacaactctactgtcttacgaattagcatttaagaagcaggaagaggcttgggagcaggcccagcatcgggatcacatagtgggtgtgacatggctaatcctcgaggccttcgagctggaccccggtttcattcatgaggcaaggctgcgagtgcaaatggccacactggaagatgacgttgtcgaggaggagcgttacactgggcagtggtcggaatggtcacaacccgtttgtttccaggcgcctcaacgacagggcccattgataccaccttggggctggccgggaaataccctggtggccgtgtctatttttcttctcttgacgggcccaacatatttgctcttcaagttatccccaagggtgaaacggatcttttatcagaatgtgccttcacccgctatgtttttccaacccctgtactccgtacataatggcaattttcaaacgtggatgggcgctcatggagcaggcgtcctgctgtcacaggattgtgccggtacaccccaaggtgcccttgagccgtgcgtgcaggaggccaccgcgcttctcacttgcggaccggcaaggccctggaaaagcgtcgctctggaagaagagcaagagggacctggcacacggcttcccggtaatctttccagtgaagacgttctgcctgcagggtgcactgaatggcgggtgcaaacactggcctacctgcctcaggaggactgggcccctacttctctcactagacccgcaccgcctgactctgaggggagccgttctagctctagcagctcttcatccaacaataataactattgcgctctcggctgctacgggggttggcacctaagtgccctgccagggaacacacagagttctggaccgattcctgcccttgcctgcgggctctcttgcgaccaccagggactggagacacagcagggcgtggcctgggttctggctgggcactgtcagagacctggcttacacgaggacttgcaaggcatgcttcttccgagcgtgctgagcaaagcacggagttggactttctag

SEQ ID NO: 227272 - DNA, 1029 bp, Artificial Sequence
  Description of Artificial Sequence: Synthetic coding sequence
atgccacagacttgcgatggcaccggccagatgcacctcggtagcaactgttgcaagaacgggcaaaccctgctgcagcggacctgtcacggggtgagttgctgtggctggtggtttcaggcagcacggagtatattagggaaggggccatcagctcagtccctcgcgggatggactctggagtccgaagctctccgccgtgacatggggacctggcttctggcctgcatttgcatttgcacatgtgtgtgtctgggagttagcgtcactggcgagggacaaggaccacggagtagaacatttacatgtctgactaacaatattctgaggattgactgccattggtccgccccagagttaggccagggatcctcgccgtggcttttgttcactagactcctcgccgctcacattagcgcaagttgtggtgctgtgagtgctccgagctgttgccacctaaggcagtgcagctgccaccttacaatctcaccttctttatctacaacagcatgtttaggcggaagccgcagtgcgtggtggacaaggtcaacatgtcctggcgatacctctaacatcagcagtggacactgtattctgacctggagtatatctccagcactcgaaccaatgacaacactcctctcttacgagctcgcctttaagaaacaggaagaggcttgggagcaagcccagcacagagatcacatagttggcgttacttggttaatcttagaagcttttgagttggatccaggtttcatccatgaggctcgcctcagagtgcaaatggcgaccctcgaagacgacgtggttgaagaggaacgctatactggacagtggtctgagtggtcccagcccgtctgctttcaggctcctcagagacagggacctctgatccctccttggggttggcctggcaacacgttggtcgcggtgtcaatctttttgctgctgaccggtcctacatacctattgttcaagctttcaccgagacttggctggggcccaacagggccagtgtgctgctag

SEQ ID NO: 227273 - DNA, 1503 bp, Artificial Sequence
  Description of Artificial Sequence: Synthetic coding sequence
atgggtacctggctcctggcttgtatatgcatctgcacatgtgtgtgtctgggggtgtccgtcaccggtgaaggacaaggcccaaggagccggactttcacatgccttaccaataatattcttagaatagattgtcactggagtgctcctgaactgggccaggggagctctccctggctgttgttcaccagcaaccaggcacccggtgggactcacaagtgtatcttgcggggttctgaatgtacagtggtactgcccccagaggccgtgctcgtgccctctgataactttacaatcacgttccatcactgtatgtccggcagagagcaggtgagtctcgtggatcctgagtatctccctaggcgacacgtgaaactggaccctcccagcgacttacagtccaacattagcagtgggcattgcattctgacgtggagcatcagcccagcattagaaccaatgacaacccttttgtcttacgagctggcttttaagaagcaagaggaggcatgggaacaagctcagcaccgtgatcatattgtgggggtaacatggcttatccttgaagcctttgagttggatcccggtttcatccatgaagcaagactcagggtgcagatggcaaccctggaggacgatgtggtggaagaagaaaggtataccgggcagtggtcggagtggagccagccggtgtgtttccaagctccgcagcggcagggccctctgattcctccctggggttggcccggaaacacattggtcgcagtatctatatttctgttgctgactggacctacgtatcttctgttcaaattgagcccaagggtgaagagaatcttctaccagaatgtacctagccctgctatgttttttcagcctctgtactccgtccacaacggcaatttccagacttggatgggcgctcacggggctggggtgctgctttcccaagattgtgccggtacacctcagggggctctggaaccctgtgttcaggaggctaccgcccttctgacctgcgggccagctcgtccttggaagagcgttgcgctggaagaagagcaggaaggtcccggaaccagactaccaggaaacctgtcctctgaggatgtgctgcctgccggttgtacagagtggagagtgcagacgctcgcctatctacctcaggaggactgggcaccaaccagtctaaccaggcccgcacccccagactccgaaggatccagaagtagcagcagcagttccagcagtaataacaacaattactgtgcactaggttgctatggcggatggcacctgtcagcgctgccgggtaatactcagtcctcaggacccatacccgctcttgcttgcgggctgtcctgcgatcatcaaggattagaaacccagcagggcgtggcatgggtcttagccggacattgtcagaggcccggtctccacgaggatttacagggcatgctcctgcctagcgtcctgtccaaggccagaagctggaccttttag

SEQ ID NO: 227274 - DNA, 990 bp, Artificial Sequence
  Description of Artificial Sequence: Synthetic coding sequence
atgggcacctggctcctcgcatgtatatgcatttgtacatgcgtgtgcctgggggtatccgttaccggcgagggacagggccctcggagccgaacctttacctgcctgaccaacaacattctgagaattgactgccactggtccgccccagaactggggcaaggatcatcaccttggctcctgtttacaagcaatcaggcgccaggtggaacacacaaatgtatactaagaggaagcgagtgtacggtggtgctccccccagaggctgtgctggtcccatccgataattttacaatcacatttcaccattgcatgagtggcagagagcaggtgtctttagtggatccggagtacttgcctcgtagacacgtgaagctggaccccccaagtgatctacaatcaaacatctcttccggccattgtatactgacctggtctatcagtcccgctctggaacctatgacaactttgctgagttacgagcttgcatttaaaaagcaggaggaagcctgggaacaagcgcagcaccgcgatcacatcgtgggtgtgacctggctgatcctggaagcattcgaactcgatcctggattcatccatgaagctagattgagggtgcagatggccacactcgaggacgacgtggtcgaagaggagcgatatactggacaatggtctgagtggagtcaacctgtgtgctttcaggcgcctcagcgtcaaggtccacttattcctccttggggatggccagggaatactttagtggcagtgagcattttcctgctgctgactggacccacctacctgctgttcaagcttagtccccgtgtgaaaagaatattttaccagaatgttccatcccccgctatgttcttccaacctctgtacagcgttcacaacggaaatttccaggtgtgcgccgagactaccgaaggccacggcggtcaaggcctgcccagggcgctagcgtgcccacggtgttggctgtcatag

SEQ ID NO: 227275 - DNA, 999 bp, Artificial Sequence
  Description of Artificial Sequence: Synthetic coding sequence
atgcatctgggctcaaactgttgcaaaaatggacaaaccctgctacagcgcacctgtcatggggtcagttgctgcggttggtggtttcaagcggcacgttcaattctgggtaaaggcccttccgctcagtctctagcgggatggaccttagagagcgaggctcttcggcgagatatgggaacctggctgctcgcatgcatctgcatttgtacttgtgtgtgcctgggggttagtgtcacaggtgaggggcagggacctaggtcgcgcacatttacctgcctgaccaataatatcctacgcatcgattgtcattggtccgcacctgaactaggccaaggctccagtccttggctcctgtttacacgcctgctagcagctcacatctctgcgtcctgtggtgcagtgtcagccccatcatgctgtcatcttcgacagtgttcctgtcacctgacaatatctccaagcctatccactactgcctgtctgggaggcagccggtccgcttggtggactcggtcgacctgtccaggggatacatcaaacatctccagcggccactgcatcctgacatggagcatcagtccagctctggagcctatgacgacacttctgagttatgagctggctttcaagaagcaggaggaggcatgggaacaagcccagcatcgagatcatatagtcggcgtgacatggctgatactagaggccttcgaactggatccagggttcattcatgaagcccgtctgagagtgcagatggctacactagaggacgacgtggtcgaggaagagcgctataccggccaatggtctgaatggtctcagccagtctgctttcaagcccctcagagacagggaccactgatcccaccttggggctggcccggtaatacactagttgcggtctccatattcctgctactaaccggacctacttatcttctcttcaagctgtcacctcggttaggctggggacccactggccctgtctgttgctag

SEQ ID NO: 227276 - DNA, 1878 bp, Artificial Sequence
  Description of Artificial Sequence: Synthetic coding sequence
atggcttgttacatctatcagttgccttcttgggtactagacgatttgtgtcgcaacatggatgccctgtccgaatgggactggatggagtttgcgtcctacgtaatcaccgacctcacacagctcaggaagattaagtcgatggagagggtgcagggcgtgtccattacacgtgagttgctatggtggtggggaatgcggcaggcgacagtgcaacagctggtcgatttactatgtaggctggagttataccgggctgcccagatcattcttaactggaagcccgctccggagatccggtgccctatccctgcattccccgactcggtcaaacctgagaaacccctggcggcatcagtccgcaaggctgaagacgagcaggaagaaggtcagcctgtcaggatggccacattccccggacccggatcttcacccgcacgcgctcatcagcccgctttcctgcagcctcctgaagaggacgccccacactcactaaggtcagatcttccaacgtcatcggattccaaggatttctccaccagcatcccaaaacaggagaagctgttgtccttagctggcgactccttgttctggtcagaagcggatgtggtccaagccactgatgactttaaccagaaccggaagatttctcagggcacctttgccgatgtctacagaggccatagacacggcaaaccgttcgtcttcaagaagctgagggagaccgcctgctctagcccgggttccatcgagcggttcttccaggcagagttacaaatttgcctccgctgttgccatccaaatgtcctccctgtgctgggcttttgtgccgcaagacaatttcacagcttcatttacccctacatggcaaacgggtcactgcaagatcgcctgcaagggcagggtggctcagaccccctgccttggccccaacgcgtgagcatttgttcagggctgctgtgtgccgtcgagtacttgcatgggctggagatcattcacagcaacgtaaagtctagcaatgtgctgctggaccagaatctaacaccaaaactggcccaccctatggcccacctttgcccagtcaacaagaggtcaaagtataccatgatgaagacccatcttctgcggacaagcgcggcatatctgcccgaagactttattcgcgtgggtcagctgacaaaaagggtcgatatcttcagctgtggcatagtgctagccgaggtgttgaccggaattcccgcaatggataacaaccggagtcccgtttacctgaaagaccttctgctgagcgatatacccagttctacagcatcattatgtagtcgcaagacaggtgtggagaacgtgatggctaaggaaatctgccagaagtatcttgagaagggcgctggccgtctgcccgaggactgcgccgaagcacttgctactgcggcttgcctgtgcctaagaaggagaaatactagtttgcaggaagtgtgcggtagcgttgccgcagtcgaggaacggttaaggggcagggagactctcctaccatggagcggactctccgagggcacgggttcatctagtaacacacctgaagagaccgatgatgtagacaattcctccctggacgcctcgtcaagtatgagcgttgcgccttgggctggcgctgctacccccctgctgcccacagagaacggagaagggagactgagagtgatcgtaggaagggaagcggattccagtagcgaagcctgcgttggcttggaaccaccgcaagacgtgacagaaacttcatggcagatcgaaattaatgaagccaaaaggaagttaatggaaaatattcttttgtacaaagaagaaaaagttgattctatagagctcttcggcccatag

SEQ ID NO: 227277 - DNA, 1791 bp, Artificial Sequence
  Description of Artificial Sequence: Synthetic coding sequence
atggccggaaactgcggggctcggggagccctgagcgcccatactctactattcgacctgcctccagccctactgggggagctgtgtgccgtgctggactcatgcgacggcgcattgggctggaggggcctggctgaacgcctgagcagctcctggcttgatgtccgccacattgagaagtatgtcgatcagggcaaatccggcacccgggagttattatggtcctgggctcagaagaacaaaacgatcggagacctcctccaagtgctgcaggagatggggcataggcgtgccattcatctgattaccaactacggcgcagtgctgtctcccagtgagaagagctatcaggagggtggctttccgaatattctcttcaaggagactgcaaatgttaccgtggataacgttctgattcctgagcacaacgaaaaaggcattctgctgaagagctcaatctcatttcaaaacatcattgagggtacccgcaattttcacaaggacttcctcatcggcgagggcgagatattcgaggtttaccgggtcgagatccagaacctgacttatgccgtgaaacttttcaagcaggagaagaagatgcaatgcaaaaaacactggaagcgttttctaagcgaactggaggtcctcctgctcttccaccatcctaacatactcgagctcgccgcttacttcaccgaaactgagaaattctgtctgatatacccttatatgcgcaatgggacactgtttgaccggctccagtgtgtcggagatacagcccctctgccctggcacatcaggattgggatactcattggaatttcaaaagccatacactatttacataacgtccaaccctgttccgtcatctgtggcagcatcagtagtgctaatatccttctggacgaccagttccagcccaaactgactgattttgccatggctcacttccgctctcatctggagcaccaatcatgcacgatcaacatgacttcctccagctccaagcacttgtggtacatgccggaggagtacatcagacagggtaaattgtctattaagacggatgtgtactctttcggaatcgtgattatggaggtcttaactggatgcagagttgtccttgatgatcctaagcacatccagctacgtgatttgctgagagagctaatggaaaagcgaggtttggacagctgcctctcctttctggacaagaaagtgcctccttgccccagaaacttctctgccaagctcttctgtctggccggtaggtgcgcggctactagagccaagctgaggcccagcatggacgaggtcctgaacactctcgagtcgacacaagcctctttatacttcgccgaagacccacctaccagcctaaagagttttcggtgtcccagtcccctgtttctcgagaacgtgccctctatcccagtcgaggacgatgagtcgcaaaacaacaacttactaccatccgacgaggggctgagaatcgaccgtatgacgcagaaaacgccctttgagtgttcccagtctgaagtgatgtttctatctctcgataagaagcccgagagcaagcgtaacgaagaagcatgtaacatgccctcttcatcatgcgaagagtcttggtttcccaaatacatcgtgccctcccaggatttgcggccttacaaggtgaatatcgatccgagcagcgaggctcctggtcacagttgccggagccgccctgtcgagagcagctgctcaagtaaatttagctgggatgagtatgagcagtacaaaaaggaatag

SEQ ID NO: 227278 - DNA, 1608 bp, Artificial Sequence
  Description of Artificial Sequence: Synthetic coding sequence
atggccggtaattgcggggctcgaggggctttgagcgcgcatacactcctgtttgacctcccccctgcactcctgggagagctgtgcgccgttctggactcctgtgacggcgctctgggttggcgcggtctgggcgctgtgctgtcacccagtgaaaagtcctaccaagaggggggatttcctaacatcctgtttaaagaaaccgcgaatgtgactgttgataatgtgctgatcccggaacataatgagaagggaatccttctcaagagctccatctcattccagaacattatcgaagggactaggaacttccacaaagacttcctgattggtgagggcgagatatttgaagtgtaccgcgtcgaaattcagaacctaacttacgcagtaaaactttttaagcaagagaagaaaatgcagtgcaagaagcactggaagaggttcctctccgagttggaggttctgttgctgttccaccaccccaatatattagaactggcggcatattttacggagaccgaaaagttctgtctgatatatccctatatgagaaacgggactctgttcgatcgtctgcagtgcgtcggcgataccgctcccttgccctggcatatccgcattggtatcctgataggaatctctaaggccatacattacttacacaatgtgcagccttgctcagttatttgtggctccattagcagcgccaacatcctgctggacgatcagtttcagcctaaactgactgactttgcgatggcccattttagatctcacctggagcaccagtcctgtacgattaatatgactagtagctccagtaagcatctgtggtatatgcccgaggagtacatccgccagggcaaactgagcatcaaaacagacgtatatagcttcggaattgtcattatggaagtgctcacgggctgtagggtagtgctggacgacccaaaacacatccagctgagagatttattgagagagctgatggagaagcggggtctagattcgtgcttgagtttcttggacaagaaggtccccccatgcccacggaatttctcagcaaaactgttctgtcttgcaggccgatgcgctgccacacgggcaaagttgcggccttctatggacgaagttctcaacaccctcgagtccacacaggcaagcctgtatttcgcggaagatccaccaaccagcctgaagtctttccgctgtccctcccccctcttcctggagaacgtgcccagcatcccagtggaagacgacgagtcacagaacaacaacctattacctagcgacgaaggcctgcgaatcgatcgtatgactcaaaaaactccctttgagtgttctcagtctgaggttatgtttctctcactggacaaaaagccagagtctaagcgtaatgaggaagcctgtaatatgccctctagctcctgtgaggagagttggtttcccaagtacatcgtgccctcccaggacctgcgcccttacaaggtgaacatcgatccatcctcggaagcgcctggccacagttgtcgatcacgcccagtggaaagctcttgctcttctaaattcagctgggatgagtatgagcagtacaagaaagagtag

SEQ ID NO: 227279 - DNA, 657 bp, Artificial Sequence
  Description of Artificial Sequence: Synthetic coding sequence
atgaacaaacccattaccccaagcacctacgtgaggtgcctgaacgtgggactcatccgcaagctgtctgatttcatcgatccacaggaagggtggaaaaaattggctgtagctattaagaaacccagcggcgatgaccgctataatcagttccacatcagacgatttgaggccttgttacagacaggaaagagccctacctctgagctgctgtttgattgggggaccaccaattgtacggtgggggacctcgtggatctgctgattcagaatgagttcttcgctccagcaagtctgttgctgccagatgcagtcccaaagactgccaatactctgccgagtaaagaagccattacggtacagcagaagcaaatgcctttttgcgacaaggaccgcactctgatgacaccggtacaaaacctggaacaatcctatatgccccctgattccagttcccccgagaacaaaagcttggaagtgtccgatacaagatttcacagcttcagtttttacgaactaaagaatgtcacgaataactttgatgagagacccatctcagttggaggaaacaaaatgggcgagggaggcttcggagttgtatataagggctatgtcaataacaactgtgggtccgaggaggcatgctccaacggatag

SEQ ID NO: 227280 - DNA, 1011 bp, Artificial Sequence
  Description of Artificial Sequence: Synthetic coding sequence
atgcccttttgtgacaaagatcgaacccttatgactccagtgcagaacctggagcaaagctatatgcctcctgacagtagtagccccgagaataagtccctggaagtaagcgatacccgctttcactcgttttctttctacgagctcaagaacgtcacaaataactttgatgagcgacccatttccgttggcggaaacaaaatgggagaagggggttttggcgtggtatacaagggctatgttaacaacacgaccgtggcggtaaagaagttggcggctatggttgacattacaacagaagagttgaagcagcagttcgatcaggaaatcaaagtgatggccaagtgccagcacgagaatcttgtggagctgttgggtttttcctcagatggggatgacctgtgcctcgtgtatgtatatatgcccaacggaagcctgttggaccggctgtcctgcctggatgggacccctcccctctcctggcatatgagatgcaaaatcgcgcagggagctgcaaatggcattaacttcctgcacgagaaccaccatatccaccgggacattaaatctgcgaatatcttgttggacgaggcattcacggccaaaattagcgattttggattggccagagctagcgaaaaatttgcccaaacagttatgacaagccggattgtgggaacgactgcctacatggcccctgaggcattgcggggagagattacccccaagagcgatatatattcgtttggcgttgtcctgctggaaattatcacggggctccccgctgtggatgagcaccgagagccacagctgctattggacattaaggaggagatcgaagacgaggagaagactattgaggattatattgacaagaagatgaacgatgcagatagtactagcgttgaggctatgtattccgtggctagccagtgtctacacgaaaagaagaataaacgcccagatattaagaaggtccagcagctcctccaggagatgactgcttcttag

SEQ ID NO: 227281 - DNA, 1011 bp, Artificial Sequence
  Description of Artificial Sequence: Synthetic coding sequence
atgcctttctgcgacaaggatcgaacactgatgacgccggtgcaaaacttagaacagtcctatatgccgcctgactcctctagccccgagaataaatctctggaagtgtcggatacgagattccacagcttttcattctatgaattgaagaacgtcacaaacaactttgatgaacgacccatcagcgtaggcggaaataagatgggcgaggggggttttggcgttgtgtacaagggctatgtgaacaacaccacagtcgctgtgaaaaagctggctgcaatggtggatataacaacagaggaactgaagcagcaatttgaccaggagattaaggtgatggcaaagtgtcagcatgaaaatctggttgaacttctggggttctcctcggacggagacgatctctgtctggtgtatgtctacatgccaaacggatccctactagataggctcagttgcctggatggtacgccaccactctcttggcatatgcgctgtaagattgcacagggggcagcgaatgggattaactttctgcatgagaaccatcatatccaccgcgatattaaatctgctaacattcttctcgacgaagccttcacggctaagattagtgattttggactcgctcgcgcatccgaaaagttcgcccaaactgtaatgacatcccgcatcgtaggtaccaccgcttatatggcacccgaagcactgcgaggggagatcacaccaaagtcggacatatactcttttggcgttgtgttactggagatcatcacaggactgccagccgtcgatgaacatagggaaccacagctgctgttagatattaaggaggagatcgaagacgaagaaaaaaccatagaggactatatcgataagaagatgaacgacgctgattctacgagtgtggaggcaatgtatagtgtggctagccagtgtttacatgaaaaaaagaacaagaggccagatatcaagaaggtacaacagttgctccaggaaatgaccgccagctag

SEQ ID NO: 227282 - DNA, 1383 bp, Artificial Sequence
  Description of Artificial Sequence: Synthetic coding sequence
atgaataaacctatcaccccctctacatacgtgcgttgccttaatgtcggcctgatcaggaagctttccgactttattgacccgcaggagggctggaagaagctggcggtagctattaaaaaaccatcaggtgatgaccggtataaccagtttcacatccggaggtttgaggctctcttgcagactggcaaatccccaaccagcgagctcctgttcgactgggggaccaccaattgcactgttggtgacctggttgacctactgattcaaaatgaattcttcgctcctgcctctctcctcttacccgacgcagtgccaaagactgctaacactctgccctccaaagaggctatcaccgtccaacaaaagcagatgccattctgcgataaagaccggacattgatgaccccagtgcaaaatctggagcagtcgtatatgcctcctgacagttcctctcccgaaaataagagcctcgaagtgtcagatacccgttttcattccttctccttctatgagttgaagaatgtaactaacaactttgatgaaaggcctatatcggtaggtgggaacaaaatgggggaagggggatttggagtggtctacaaaggctatgttaataatacgacagtcgcagtcaagaaattagccgcaatggtcgatatcacgactgaagaacttaagcagcagttcgatcaagaaataaaggtcatggctaagtgccagcacgagaatcttgtagagttgctcggcttttcaagtgatggtgacgatctatgccttgtgtatgtctacatgcccaacggatctctactggatcgcctgagctgcctggatggaacacccccactgagttggcacatgcggtgtaagattgcccagggagccgctaatggaattaattttctccacgagaatcaccacatccatcgtgacattaagagtgcgaacatccttctggacgaggcgtttacagcaaagatcagcgacttcggcttggcaagagcctccgagaagttcgcccagacagttatgacctcccgcattgtaggtacgactgcttatatggcacccgaggcactccgaggagaaattactccaaaatcggacatatacagcttcggtgttgtgctgctcgagattataaccggcctcccggctgtagatgaacacagggagccgcagctgcttctggatataaaagaggaaatcgaggacgaagagaaaaccatcgaagactacatcgataagaagatgaacgatgccgattctactagcgttgaagctatgtattccgtagccagccagtgtctgcatgaaaagaagaacaaaaggcccgacattaagaaggtccagcagctgttacaggagatgaccgcctcatag

SEQ ID NO: 227283 - DNA, 270 bp, Artificial Sequence
  Description of Artificial Sequence: Synthetic coding sequence
atgaacaagcccatcacacctagcacttacgtgaggtgtctgaatgtcgggctgattcgcaaattatccgacttcatcgaccctcaggaaggttggaagaagctggccgtggccattaagaagccaagcggcgatgataggtacaatcaattccacatacggcgatttgaggctcttttgcagaccgggaagagtccaacgtccgagttgctgtttgactggggtacaaccaattgcaccgtaggtgatctggtggatctccttatttag

SEQ ID NO: 227284 - DNA, 1383 bp, Artificial Sequence
  Description of Artificial Sequence: Synthetic coding sequence
atgaataagccaattaccccttctacttatgtgagatgtctgaacgtcgggctcatcaggaagctgtcagacttcattgatccgcaggagggctggaaaaagttggccgtggccatcaagaagccaagcggggacgaccgctacaatcagttccatatccggcgttttgaggcactcctgcagacaggtaagagtcctacttccgaactattattcgattggggcaccactaactgcacagtgggtgaccttgtggaccttctgattcaaaatgagttttttgcccctgctagcctcctgctacccgacgccgtgcctaagactgccaatacactgcccagcaaggaagcaatcactgttcagcagaagcagatgccattctgcgataaagacagaacgcttatgacacccgtacagaatctggagcagagctacatgccacctgacagttcctctcccgagaacaagagtctggaagtgtctgacactcgctttcactcattttccttctatgagctgaagaacgtcaccaacaattttgatgaaaggccgatcagcgtcgggggtaataagatgggtgaaggaggtttcggagttgtctacaaaggatacgtaaataatactaccgtggctgttaagaagctggcggcaatggtcgatattaccaccgaagaactgaagcaacagtttgaccaagaaattaaagtgatggctaagtgtcagcatgaaaacttggtggagctgctgggattctcttccgacggtgatgatttgtgtctggtgtatgtctatatgcctaatggttctcttcttgaccggttgtcttgtctagacggaacccctccgctctcctggcatatgagatgtaaaattgcacagggagccgcaaacggcatcaacttcctgcacgagaatcaccatatccatcgcgacatcaaatcagccaacatcctgctggatgaggcatttacagcgaaaatttccgacttcggacttgcgcgtgcctctgagaaattcgcccagaccgtgatgaccagcagaatcgtggggactacagcgtatatggcacctgaggcgctgcggggagaaatcacccctaaatccgatatttattcatttggagtggtactgctcgagatcatcactggactgccagccgttgacgagcatcgggaaccgcaactcctgctcgacattaaagaggaaattgaagacgaagagaagaccatcgaggactacatcgacaaaaagatgaatgacgccgactctacaagcgtggaggccatgtacagcgtcgcttcccagtgcctgcacgagaagaagaataaacgccctgacataaagaaggtccagcagctgctgcaagaaatgacagcgtcgtag

SEQ ID NO: 227285 - DNA, 2394 bp, Artificial Sequence
  Description of Artificial Sequence: Synthetic coding sequence
atgtaccttgagacacgcagggctatcttcgttttctggattttccttcaagtgcaagggaccaaggacatctctataaatatatatcacagcgagacgaaggatatcgataacccgcctcgcaatgaaactactgagtcaacagagaaaatgtacaaaatgtccactatgaggaggatatttgacctggctaagcaccgcactaagcgcagtgcattctttcccaccggggtgaaggtttgcccgcaggaaagcatgaagcagatcctggattccctgcaagcatattacagacttcgggtgtgtcaggaggctgtatgggaagcttaccgcatcttcctggacaggattcccgatacgggcgaatatcaggactgggtaagcatctgccagcaggaaacattctgcctgttcgacatcgggaaaaactttagcaacagccaggagcacctcgacttgttgcagcaacggattaagcagcggtcctttccggacagaaaagatgagattagtgccgagaagaccctgggggaaccaggagaaacaatcgtaatctccacagatgtcgccaatgtgagtctggggccatttccgttgactcctgacgataccctgctgaatgagattctggataacaccttgaacgacactaagatgccaactaccgagcgtgaaaccgagtttgcggttctggaggagcagcgtgttgagctgtccgtatcgttagtgaaccagaagttcaaggccgaattggccgattctcagagcccatactatcaggaactggccggaaagtcccagctccagatgcagaagatctttaagaagttgcccggttttaaaaaaatccacgtgctgggcttccgcccaaagaaggagaaggatggttcctctagtaccgaaatgcaactgaccgccatatttaagagacacagcgccgaggccaaatcccccgcttctgacctgctcagtttcgactcaaataagatagagtcagaggaagtgtaccacggaactatggaggaggataagcagcccgagatatatttgacagccaccgacctgaaaaggcttatctccaaagctcttgaggaggagcagagcctggacgtcgggactatccaatttacggatgagatcgccggtagcttgcccgcttttggacctgacacccagtcagagctgcccacatccttcgccgtgatcacagaggacgctacattgtcccccgagctcccaccagtcgagccacagctggaaactgtcgatggtgctgagcacgggctacccgatacgagttggtcaccgccagccatggcctccacatctctgtcagaagccccaccctttttcatggctagctctatcttctctcttaccgaccagggaaccaccgacacgatggccaccgaccaaaccatgctggtacctggtctaactatcccaacttccgattatagcgctatctcacagcttgctctgggaatttcccacccaccagcttcaagcgacgactcccgcagttccgccggaggggaagacatggtgcggcacctcgacgagatggatctctctgacaccccagccccatccgaagtgcccgagctctctgaatatgtctccgtgccggaccattttctggaggacacgactcccgtgagtgctttgcagtacatcactacctctagcatgacaatcgctcccaagggtagagagctggtggtcttcttttctctcagggtagcaaacatggcattttctaatgatctgtttaacaagtcttcactggagtacagagcattagaacagcagttcacccagctgctggttccctacctcaggtccaacctcaccggctttaaacagctcgagatcttgaatttcagaaatggatccgtgatagtcaacagcaaaatgaagtttgccaagagcgttccgtacaatctgaccaaagccgtgcatggggtactggaggatttccgtagcgccgcagcccagcagttacacctggagatagattcatatagtctcaacatcgaacctgcggaccaggccgacccctgcaagttcctagcttgcggagagtttgcacagtgtgtgaaaaatgagagaaccgaggaggccgagtgcaggtgcaagcctgggtacgacagccagggctccctcgacggcctagagcctggtctgtgcggcccaggcacaaaagaatgtgaggttctccagggaaagggtgccccttgccggctgcccgaccattccgaaaatcaggcatataaaaccagtgtcaaaaagtttcagaaccagcagaacaacaaggtcattagtaaacgaaactccgagctattaacagttgagtacgaggagttcaatcatcaggactgggaggggaattag

SEQ ID NO: 227286 - DNA, 477 bp, Artificial Sequence
  Description of Artificial Sequence: Synthetic coding sequence
gagcgccctaacggaacgtctgctcagccggcacaggtcaagcctgagttttaccggcaggccgagctgaagccatgtccgtggacaggaagcaaccagcggaggtgtatcactttctgtcccacccctgatcaggcagatccctgtaagttcttagcttgtggggagttcgcccagtgcgtcaagaacgaaaggacggaagaggcagaatgccggtgtaagccaggctatgattcccaggggtcactcgacgggctggagcctggcctctgcgggcctggtacaaaagaatgtgaagtactgcaaggaaagggcgctccttgcaggctgccagatcatagtgagaaccaggcttacaagacctctgttaagaaatttcagaaccaacagaataataaggtgataagcaagcggaactctgagctgcttaccgtggagtacgaagagtttaatcatcaagactgggaaggaaactag

SEQ ID NO: 227287 - DNA, 444 bp, Artificial Sequence
  Description of Artificial Sequence: Synthetic coding sequence
atgtacttggaaacaagacgggctattttcgtgttttggatttttcttcaagtgcagggcaccaaagtctgccaggaggctgtctgggaagcatataggatctttctagaccggattccagatacaggagagtaccaggactgggtttcaatctgccagcaggaaactttttgtctgtttgatattggaaagaacttttccaatagccaggaacacctcgaccttctccagcaacggatcaagcaacgctctttccccgatcgaaaagatgaaattagcgctgagaaaaccctaggcgagcctggcgaaacaatcgtgatcagcacagagaagaacaagggcaagacgaaacccttcaatattctgcagttcggcaataaccaccatgaacacctgttaccaatcttctgtcttctgagttccatcatctatacttactactag

SEQ ID NO: 227288 - DNA, 3726 bp, Artificial Sequence
  Description of Artificial Sequence: Synthetic coding sequence
atgatcatgtttcccctttttgggaaaattagcttgggcatcctgattttcgtgttaattgagggtgatttcccatccctcactgcacagacctacctttctatagaagagatacaggagccaaaatccgccgtgtcattcctcttgccagaggaatccacagacctgtccctcgcaaccaagaaaaagcagcctctcgaccgtcgggaaacagagaggcagtggctcataagaagaaggaggtccattcttttcccaaatggggtgaagatatgcccggacgagagcgtggcagaggcagtggcgaatcacgtaaagtacttcaaggtgcgggtgtgccaggaggcagtttgggaggcctttagaaccttttgggacaggctgcccggacgggaggagtatcattactggatgaacctctgcgaagacggcgttacaagtatcttcgaaatgggaactaatttctcagagagtgtggagcacaggtcgttaataatgaagaaattaacttacgcgaaagaaacagtgagtagttccgagctatcatcacccgtgccggtcggtgataccagcacactgggggatacgaccttgtcggtccctcaccctgaggtggacgcttatgagggggcttccgaatcctcactggaacgccctgaggagtctataagcaatgaaatcgaaaacgttattgaggaagccactaagcccgcaggggaacagatcgccgaattcagtatacacctcctgggtaaacagtacagggaggagctgcaagactctagctcattccatcatcaacatcttgaggaggaattcatcagcgaagttgagaatgccttcaccggtctgcccggttacaaggaaatcagggtcttagagtttcgcagcccaaaggaaaacgattctggtgttgatgtttactatgccgtgacgttcaatggggaggctatctccaatacgacttgggacctgattagccttcatagcaataaggtggagaatcacggcttggtggaactggacgacaagcccactgtggtttacacaataagcaattttagagactacattgcggagaccctccaacagaactttctgctgggtaacagcagccttaatccagatccagactctctgcagctgattaacgtgagaggtgtgctgaggcaccaaactgaagatttagtctggaatacccagagtagctctctgcaggccacaccttcatccatcctggacaatacattccaggccgcatggccttcagccgacgagtctattactagctctatccctccattggatttcagctccggtcctccaagtgctacaggaagagaactgtggtctgaatccccacttggcgatctggtttcaacacacaagctggcctttccttctaaaatgggcctgtcaagctctcccgaggtgttggaggtgtcgtcattgacccttcattctgttacccctgccgtgctgcagaccgggttacctgttgcctccgaggagcgaacctccgggtcccacctggtcgaggatgggcttgcaaatgtcgaggagtctgaggactttctgtccattgattcactgccctcctcctcttttacccaaccagtgcctaaagaaactatccccagtatggaagactccgacgtgtccctgactagctcaccttatctcacaagctccattcccttcggcctggactccctgacctctaaggtgaaagatcagctgaaggtgtcccctttcctgccggacgcgtctatggaaaaggagctgatattcgacggagggttgggctcaggctctggccagaaagtagatctcattacatggccctggtcagaaacctcctctgaaaaatctgccgaacctctctcaaagccgtggcttgaggacgatgatagcctactgccagcggagatagaggataagaaactcgtactggtggacaagatggactctaccgaccagatctcaaagcatagtaagtatgagcacgacgaccgttcaacccacttccccgaagaagaaccactgagcggacccgctgtgcctatcttcgcagacacagcagctgagtctgctagcctcactctgcccaagcatatttcagaggtgcccggtgtagatgactactccgtcacaaaagcccctctcattctgacttctgttgccatatctgctagcaccgacaaatcagatcaggcagatgcaatactgagagaagacatggaacagattacagagtcctccaactatgagtggtttgattctgaggtgtccatggtcaaaccagatatgcagacattgtggaccatcctcccagaaagtgagcgcgtgtggacccggacctcgtcactggagaagctgagccgggatatcttggcctccacaccacagtctgcagacaggctctggctaagcgtcacacaaagcacaaaactgccccctacaactatcagcacactcctggaggacgaggtgatcatgggggtccaggacatatctctggaactagataggataggaactgattattatcagcccgagcaggtccaggagcaaaatgggaaggtcgggtcgtacgtggagatgtcgacgtctgttcactctaccgaaatggtgagcgtagcatggcctacagagggcggagatgaccttagttacacccagacctcaggagctctagtggtcttcttctcgctgagggttaccaacatgatgttttcagaggatctgttcaacaaaaattccttagagtacaaagctctcgaacagcggtttttagaactattggtgccctatctgcagtccaacctgaccggttttcagaatctggagatcctaaactttcgtaacggatccatcgtcgtaaactcacgcatgaagttcgccaacagtgttcccccaaacgtgaataatgccgtgtacatgattctggaggatttttgcacaaccgcttacaatactatgaatctcgctatagacaagtactccctggacgtcgagagcggcgacgaggcaaacccatgtaaattccaggcctgcaatgaattcagtgaatgtttggtgaatccatggtcgggagaagcaaaatgcaggtgtttcccaggatacctgagcgttgaagagcgaccatgtcaatccttgtgtgatcttcagccggatttctgtttaaatgacggtaaatgcgacataatgcctggacacggagcgatctgccggtgcagagtgggggagaattggtggtaccggggaaaacattgcgaagaattcgtctccgaacccgtgatcattggaataacaatcgctagtgtcgtaggcctgctggtgatattcagtgctatcatctatttcttcatacggacgttgcaggctcatcacgatagatccgagcgagagagcccctttagcggaagttccagacagcccgactcactgtcgagcatcgagaacgccgttaaatacaaccctgtgtacgagagccacagggcaggatgcgaaaagtatgaaggcccatatccgcagcaccctttttactcttcggcctcaggggatgtgataggtgggcttagcagggaagagatccgacaaatgtatgaaagttccgagctgagccgtgaggaaatacaggaacgaatgcgcgttctggaattgtacgcaaatgacccggaattcgcagccttcgttagagaacaacaggtggaagaggtgtag

SEQ ID NO: 227289 - DNA, 201 bp, Artificial Sequence
  Description of Artificial Sequence: Synthetic coding sequence
ggctatctgagcgtggaggagcggccttgccaatctctttgtgatctgcagcctgatttctgcctaaacgacggtaagtgtgacataatgcctggacacggcgcaatttgttctggctcctcccgccaacccgatagcctgagctcaatagagaatgctgtgaagtataatcccgtctacgagtcccacagggctggttag

SEQ ID NO: 227290 - DNA, 2745 bp, Artificial Sequence
  Description of Artificial Sequence: Synthetic coding sequence
atggcgcagttccctactcctttcggagggtcactggacatctgggcaataacggtggaggagcgagctaagcatgatcagcagtttcactcgctgaagccgatttccggtttcattactggcgatcaggcgaggaactttttcttccagtctggcttgcctcagccagtcctggcacaaatctgggcactggccgatatgaacaatgatgggagaatggatcaagtggagtttagtatagccatgaagctgatcaaactcaagctgcaggggtaccagctaccctctgccctgccgcctgtcatgaaacagcagcctgtcgccatttcctccgcccctgcctttggaatgggcggaatcgcatctatgcccccactgaccgctgtagcgcctgttcccatggggagcatccctgtggtaggaatgtcccccactctggtcagcagtgtgcccacagcagctgtacctcctctggctaacggcgcacctccagtgattcagcctctaccagcctttgcccatcccgcagccaccctccccaagtcatccagctttagtaggagcggccctggctctcagctgaacacaaagctgcagaaagcacaatcctttgacgtagcctcagtgccacctgtggccgaatgggctgtgccacagtcctcaaggttgaaatatcgtcaactcttcaactcccacgataagacgatgtcaggacacctgactggtcctcaagcaagaactatcctgatgcaaagctctctgcctcaagcgcaactggccagcatttggaacctttctgatatcgaccaagacggaaaactcactgccgaggagtttatactcgcaatgcatcttattgatgtcgctatgtcaggccagcctctgccccctgtattgcctcctgaatatataccacctagctttcggcgagtccggagcgggtccggaatctctgttatcagttccacatcagtcgaccaaaggctgcctgaggagccggtgttggaggacgaacagcaacagctggagaagaagttacctgtgacctttgaagacaagaaacgggagaacttcgagcggggaaatttggaactggagaagagaagacaggccctactagagcagcagagaaaagagcaggagcgactcgctcagcttgaacgtgcagagcaggagagaaaggaaagagagagacaggaacaagagagaaagcggcaattggagctcgagaagcaacttgagaagcagagagagttggagcgtcagagggaagaggagcgccgaaaggaaattgaaagaagggaggccgcaaagagggaactggagcggcagcgacagctggaatgggagagaaacagaaggcaggagttactcaatcagcggaataaggagcaggaggatatcgtcgtattgaaagcgaagaaaaagacactggaattcgagttagaggctctcaacgacaaaaagcaccagctggaaggtaagctgcaggatattcgctgtcgcctgacaacacagaggcaggagattgagtctaccaacaagagtcgtgagttgcggatagcagaaatcacgcatctgcaacagcagctacaggagagccagcagatgttaggacgccttattcctgagaagcagattttgaacgatcagctgaagcaggtccaacagaattcactgcatcgagatagcctcgtgacactcaaaagagcactcgaagccaaggaactggctcgccagcacttgcgcgatcagttagatgaggtagagaaggaaactagatctaagttgcaggaaattgacatatttaacaaccaactgaaggagttgcgtgaaatccataacaaacagcagcttcagaaacaaaagtccatggaagccgagagactgaagcagaaagagcaggagaggaagattattgaactagaaaagcaaaaggaagaagcccagaggagggcccaggagcgggataaacagtggctcgagcatgtgcagcaggaagacgagcaccagcgtcctcggaagctacacgaagaagagaaactgaaaagggaagagagcgtcaagaagaaggacggagaggagaaaggcaaacaagaggcccaagacaaattagggagactcttccaccagcaccaggaacccgcaaagcctgcagtgcaggccccttggtctacggccgaaaagggaccactgaccatcagcgctcaggagaatgttaaggttgtttactacagagctctatacccctttgaatcccgctcccacgatgaaattactattcaacctggagacatcgtgatggtcgatgaatcccagactggcgaacccggatggctgggaggggaattgaagggcaaaacaggatggttcccagccaactacgcagaaaaaatccccgaaaacgaagtgccagcacccgtgaaaccagtgaccgattccacctcagccccagcccctaaacttgcactgcgagaaacccctgctccgttggctgtcacatcatccgaaccttccacgactccaaataattgggccgacttttcctccacctggccaacttccaccaatgaaaaaccagagactgacaattgggacgcatgggccgcacagcctagcctgactgtaccaagcgccggacagctgcggcagcgctctgcttttacacccgctactgcaacagggagttcgccttcccctgtattggggcagcacggcttctggttttttcgcgagtcctgttag

SEQ ID NO: 227291 - DNA, 954 bp, Artificial Sequence
  Description of Artificial Sequence: Synthetic coding sequence
tgaccgttaatggaatcggaactgctcacagaaaaagaggtggcaatgattttcgtaaactggaaggaattaattatgtgtaacattaagctgttgaaggcattacgggtccgcaagaaaatgagcggtgagaagatgcctgtaaagatgatcggagacatactgagtgcacagctaccacatatgcagccttacatcagattctgttctcgacagctgaatggagccgcactcatccagcaaaagaccgatgaggccccagatttcaaagaatttgtcaagcgactcgcgatggatcccagatgtaagggtatgcctctctccagcttcattctcaaacccatgcagagagtgacaaggtatcccctgatcattaagaaccaattagtattcaactccgtcacaaattgtcttgggccacggaagtttctccattccggaaagctctacaaagcgaagtcgaataaggagctgtatggctttctgttcaatgatttcctcctgctgacccagatcacaaaacccctagggtcatcaggaacagacaaagtcttctcaccaaaatctaacctccaatataaaatgtacaaaactcccatttttttgaacgaagtgctagtcaagctccccaccgacccctccggcgacgaaccaatttttcatatctcccacatcgacagagtctacactctgcgggctgaatcaataaacgagagaactgcttgggtgcagaagattaaggcagctagcgaattgtacatcgagacggaaaagaaaaagcgggaaaaggcctacctggtccgtagccaaagggctactggtatcggacgcctgatggttaacgtggttgagggcatcgagctgaaaccatgtcgctcacatggaaagtccaatccttactgcgaggtgaccatgggctcacagtgccatatcacaaagaccatccaagactag

SEQ ID NO: 227292 - DNA, 5165 bp, Artificial Sequence
  Description of Artificial Sequence: Synthetic coding sequence
atggcccaatttcccactcctttcggaggcagtctggacatttgggctattacagttgaggaaagagccaaacacgaccaacagttccatagcctgaagccaattagcggatttataacaggagatcaggccagaaactttttcttccagagcggccttccacagcccgttctcgctcagatttgggccctcgccgatatgaacaacgatggcagaatggaccaggtcgagttctcaatcgcaatgaagctgatcaagctgaaactgcagggctaccaactgccctcggccctccctccagtgatgaaacagcaaccggtcgcgatctccagcgcgccagccttcggtatgggtggcatagcgtcaatgcctcccctaactgctgttgccccagtacccatgggatcgattcctgtagtcggaatgtctccaacactggtcagctcagtacctaccgccgcagtcccccctctagcaaacggcgctccgcctgtgatacagccgttacctgcatttgcccaccctgccgcaaccctgcctaagtcctcctcctttagtcgatctggtcctgggtcccagctcaacactaaactccagaaggcacagagttttgacgtggcatccgttcccccagtggctgaatgggcagtgccacagtctagtcggctgaagtaccgccaactttttaacagtcacgacaaaactatgtccggccatctgaccggcccacaagcaagaacaattctaatgcagagcagcctcccacaagcccaactcgcctctatttggaacctatctgacatagaccaggacgggaagctgacagcagaggaatttattttggcaatgcacttaatagacgtcgctatgagtggacagcccctacctcctgtactgcctcctgagtacatcccaccttctttccgaagggtcaggagtggtagcggcatttcagtgatctcatcaaccagcgtcgatcaacgattgcccgaagagccagtcctggaagacgaacagcagcagttagagaagaagttgcctgtgacattcgaggataaaaagagagagaactttgagcgcggtaatctggagcttgagaagcggaggcaagccttgctggaacagcagcggaaagagcaggaaagactggcccagctcgagagagcagagcaggaaaggaaagaaagagagaggcaggaacaggagcggaagagacaactggagctcgaaaagcagctggagaagcaaagggagctggagcgccagcgagaggaggagcgcaggaaagaaattgagcggcgagaagctgccaagcgggagctagaaagacagcgccagctggaatgggaacggaatagaaggcaggaactgctgaatcagagaaacaaggaacaggaagatatcgttgtcctcaaggccaaaaaaaagaccctggaatttgaactagaagctttgaacgataaaaaacaccaactggaaggtaagttgcaggacattcggtgtcgcctaaccacacagcggcaggagattgagtccacaaataagtcccgggaactgaggattgctgaaattacgcatttgcagcagcagcttcaagaaagtcagcagatgctcggcagactgattcctgaaaaacagattttgaatgaccagctaaagcaagtccagcagaacagccttcatcgggattcgttagtgacactgaagagagccttggaagccaaggaattggcacgacaacacctgagggaccagctggatgaggtcgagaaggaaacccgtagcaaactccaggaaatagatattttcaataaccagctgaaggagctgcgggaaatacacaacaagcagcagttgcagaaacagaaatcaatggaggctgaacgactgaaacagaaagagcaggagcgcaagatcattgagctggagaaacagaaggaggaggcacagcggagggcccaagagcgagacaaacagtggctcgagcatgtacaacaggaagacgaacaccagcggcctaggaaactgcatgaggaggaaaaactgaaacgcgaagagtccgtgaagaaaaaggatggggaggaaaaaggcaagcaggaggcacaggataagctgggacgactcttccaccagcaccaggagcccgctaaacctgcagtccaagccccttggtcaactgctgaaaagggacctttgacgatctcagcgcaggaaaacgtgaaggtggtgtactacagagcactttacccctttgaaagccggagtcacgacgaaatcaccatccagcctggggacatcgtgatggtcatcggctgctgggtggatgagtcacaaaccggcgagccaggctggctagggggagagttgaaaggcaaaactggctggttccctgctaattacgctgagaagatacccgagaacgaagttccggcacccgtgaagcctgtcacagatagcacttccgcaccggcacctaaactcgccttaagggagacacccgctcctctagccgtaacaagctctgaaccctcaaccacacctaataactgggcagacttcagtagcacatggcccacaagtacaaacgaaaagcctgagaccgacaattgggatgcttgggccgctcagccctctttgactgtccctagtgccggacaactgcggcagcgcagcgcatttacaccagcaacagccaccggttctagcccctcacctgtgctgggacaaggtgagaaggtggagggcttgcaggctcaggcactctatccctggcgtgcgaagaaggataaccatctaaatttcaataaaaacgacgtcatcacagtgctggaacagcaggatatgtggtggttcggcgaggtgcagggccagaagggctggttcccaaagagctatgtgaagttgatcagcggtcctatccgcaagtccacaagtatggactctggcagttctgaatcccctgcgagcctgaagagggtcgctagtccagcagccaaacctgtggtcagtggagaggagttcatagcaatgtatacctacgagtccagcgagcagggagaccttactttccagcagggagacgtgatcctcgttaccaagaaggatggagactggtggacaggtacagttggcgacaaagctggggtttttccaagcaactatgtgcggctaaaggactctgagggctccggaaccgctggcaaaactggcagcctaggcaaaaagcctgagattgcccaggtcattgcctcttatacagccactggaccagaacagctgaccttggccccagggcagctgattcttattcggaagaagaaccctggaggttggtgggagggagaactgcaggcgcgaggcaaaaagaggcaaatcggttggttccctgcaaattatgtcaagctcctctctccaggaacgtccaagatcacccctacagaacccccaaagtcgacagctctcgcagccgtctgccaggtgatagggatgtacgattatactgcccagaacgatgacgagctcgcatttaacaagggccagattataaatgtattgaacaaagaagaccctgattggtggaaaggtgaggtgaacggacaggtgggtctgtttccttcaaactatgtcaagctcactaccgatatggatccctctcaacagtggtgtagtgacctacatttgctcgatatgctcacgcccactgagagaaaacgacagggatacattcatgagctgatcgtgacggaagagaattacgtgaatgatttgcagctggtgacggagattttccagaagcctctcatggagtctgagctgttaaccgagaaagaagtagcaatgatctttgtcaattggaaggaattaatcatgtgcaacatcaaactgcttaaagcactgcgggtccgcaagaagatgtccggagaaaagatgcctgtaaaaatgattggtgacatcctgtccgcccagctcccccatatgcagccgtatataaggttctgcagtcgccagttgaatggagccgctttgattcaacagaagacggatgaggctccagatttcaaagaattcgtgaaacgcctggcgatggacccacggtgcaagggcatgccactgtcctcgttcatcctcaagcccatgcagagagtgaccagataccccttaattataaaaaatatcctggaaaataccccagagaaccaccccgaccacagtcacctgaagcacgctctggagaaagccgaggaactatgctcccaggttaatgaaggggtaagagagaaagaaaatagtgacagactggagtggatccaggcacacgtccaatgcgaaggactcagtgagcagctggttttcaacagtgtcacaaactgcctgggaccccgaaagtttctgcatagtgggaagttatacaaggccaagtccaacaaggaactgtatgggttcttgttcaacgacttcctcctgctgacccagattacaaagccgctcggatctagcggcacagataaagttttttcccctaaaagcaatttgcagtacaaaatgtataaaacacccatctttttgaacgaggtgctggtgaagctgccaacggacccctccggagatgagccaatctttcacatcagccacattgatcgagtgtatactctgcgcgctgaaagcattaatgaacgcacagcctgggttcagaagattaaagcagcttcggaactctatatagagactgaaaaaaagaaacgagagaaggcttaccttgtgcgtagccaaagagccaccggaattggcagactcatggtgaatgtagtggagggaattgagctcaagccctgccgctctcatgggaagtctaatccttactgcgaagttacaatggggagccaatgtcatattactaagacaattcaggacacgctcaatcctaagtggaactcaaattgtcaattctttattagggatctggaacaggaagtattgtgtattaccgtcttcgagagagaccagttttcccccgacgattttctcggtagaaccgaaatcagagtcgccgacatcaagaaggatcagggtagcaagggcccagttaccaagtgcctgctgctgcatgaagttcctaccggcgaaatcgtcgtgcgcctggatttgcaactgtttgacgaaccata

SEQ ID NO: 227293 - DNA, 4953 bp, Artificial Sequence
  Description of Artificial Sequence: Synthetic coding sequence
atggcccagttcccgactccattcggtggctccctggatatttgggccattacagtggaagagcgggcaaagcatgaccaacagttccacagtctcaaaccgatctccggcttcatcacaggggaccaggcacggaacttttttttccagtccggtctcccgcagcccgtgctggcacagatatgggctctggcagacatgaataatgatggtaggatggatcaggtcgagtttagcatcgccatgaagctcattaagctgaaactccagggataccagttgccttctgctcttcctccagtcatgaaacagcaacccgtggccatttcttcagcccctgcgtttggtatggggggaatcgctagcatgcctcctctgactgccgtcgccccagtgcccatggggagtatacctgttgtgggcatgagtcccacactggtgtcatccgtgccgacagctgccgttccacctcttgctaacggagcccctcctgttatccaacccttgccagcttttgcacaccccgctgccacactcccaaagtcctcctcattctcccgctccgggccaggatcgcagctgaacactaaacttcaaaaagctcagagctttgacgtcgcatcagtgcctcccgtggccgaatgggcagtcccccaaagctctcggctgaaatatagacagctgttcaacagccatgataagaccatgtcaggtcacctgacaggtccccaggctcgcacgattttaatgcagagtagcctcccccaggcccagctcgcgtcaatatggaatctatctgacatcgatcaagatggaaaattgacagccgaggaattcatattggccatgcatctgattgacgtcgccatgtctggtcagcctctgccccctgttttgccgccagagtatatccccccatcattcaggagggttcgctctggctccggcattagtgttatatcgtctacttccgttgatcagaggcttcctgaggagcccgtcttggaagacgagcaacaacagcttgaaaagaaactgcctgtgacgtttgaggacaagaagagggagaacttcgagcgcggtaacctggaactagaaaagaggaggcaagctttgctggaacagcagcgcaaggaacaagagagactagctcagctagaacgcgcagaacaggagaggaaggaaagagagcgccaggaacaggaaagaaagaggcaactggagctcgaaaaacagttggagaagcagcgggaactcgagcggcagagggaggaggaacgcaggaaggaaatcgaaagaagggaagcagcgaagcgggagctcgagcggcagcgccagcttgagtgggagcgtaatcgacggcaagaactgcttaaccagcgcaacaaggagcaagaagacatagtcgtgctgaaggccaaaaagaaaaccctagagtttgaactggaggcattaaatgataaaaagcaccagctcgagggcaagttgcaggatataaggtgtcgactaacaacccagcggcaggagattgagtccactaacaagtctcgagagttgcgaattgcagaaatcacgcacctacagcaacaactgcaggagagccagcagatgcttgggagacttattccagaaaagcagatcctcaacgaccagctaaagcaggtacagcagaactctctccacagagattcactagtgaccttgaagcgggctctggaggcaaaggagctggcacgtcagcacctacgggatcagctggacgaagtcgagaaggagacgcgtagcaaacttcaggagatagatattttcaacaaccagcttaaggagctgcgagaaatccacaacaaacagcaattgcaaaaacaaaagtccatggaagcagagaggctgaaacagaaagagcaggagagaaaaattattgaactggagaagcagaaagaggaggcccagaggcgggcacaagagcgggacaagcagtggctcgaacacgtacagcaggaggacgagcaccagcggcctcggaaacttcacgaggaggagaagctcaagcgcgaagaaagcgttaagaaaaaagatggcgaggagaaggggaaacaagaggctcaagataaactggggcgactgttccatcagcatcaggaacctgcgaagcctgctgttcaggccccttggtccacagcggagaaaggtcctctgacaatctccgcccaggaaaatgtgaaggttgtctactacagggcattgtacccctttgagagtaggagtcacgatgagatcacaattcagccaggggacattgtcatggtcatcggatgctgggtggatgagtcacaaactggggagccagggtggctggggggagagctcaaaggcaaaaccggttggttccccgctaattacgccgagaagatccccgaaaatgaagtccctgctcctgtaaagcctgtcaccgacagcacgtctgcacccgctccaaaattggctttacgggagacgcccgcacctctggcggtgacaagctccgagcctagcacaacacccaacaactgggccgacttcagctcgacttggccaacatccacaaatgaaaagccagagacggacaactgggacgcttgggcagcacagccctctctgacagtgccctccgcaggccagcttcggcagcgcagtgcatttacacccgctaccgcgacaggctcctctccatcgccggtactgggccaaggggaaaaggtggaaggtctgcaggcccaagctttgtatccttggcgcgctaagaaagacaatcatcttaacttcaataagaatgacgtcatcacggttttggagcaacaagacatgtggtggttcggagaggtgcagggtcagaagggatggttccccaaaagctacgttaagcttatctccggtcctatcagaaaatcaacatctatggattcaggctcaagtgagtcacctgcttctttgaagagggttgcctcccccgctgccaaaccagtggtctctggagaggagatcgctcaagtgatcgcttcctacacagccactggccctgaacaattgaccctagcccctggccagctgattctgataagaaaaaaaaaccccggtgggtggtgggagggcgaactgcaggccagaggaaagaaaagacagatcgggtggttccctgccaactatgtgaagttactgtcgccagggacgtccaagatcacccccactgagccaccaaagtcaaccgctctcgctgccgtgtgccaggtgatcggcatgtatgactatactgctcagaatgatgacgaattagctttcaacaagggccaaatcattaatgttcttaataaagaggacccggactggtggaaaggcgaggtcaatggccaggtcggactgttcccaagtaactacgttaaactgacaacagacatggacccatcccagcagtggtgttctgacctgcaccttttagatatgctgacgcctactgaacggaaaaggcaggggtatattcacgagctgattgttactgaggaaaattacgtgaatgatctccaactcgtcaccgagatctttcaaaagcctctgatggaatccgagctgctgacggagaaagaagtcgcaatgatttttgtgaactggaaggaactgataatgtgcaatattaagctattgaaggcattgcgagtgcggaagaagatgtctggagagaagatgccagtgaagatgataggggatattctcagcgcccagttgccgcatatgcaaccgtatatccgtttttgctctagacaactgaacggtgctgcactgattcagcaaaagaccgatgaggccccagacttcaaagaattcgtcaagagactggccatggatccaagatgtaagggaatgcccctctcttcgtttatcttaaaacctatgcagcgggtcacccgctatccactgattattaagaacatcctggagaacactccagagaaccatccagatcactctcacctgaaacacgcactggaaaaggcggaagaactgtgcagtcaagtgaatgaaggcgtgagggaaaaagaaaattcagatcggttagagtggatccaagcccatgtgcaatgcgaggggctgagcgagcagttagtctttaactcagttactaattgtcttggccctcggaagtttctgcacagcggaaagctgtataaagcgaaatcaaacaaggagttgtacggcttcttgttcaatgatttcctgttattaactcagattaccaagccccttggctcaagtgggaccgataaggtgttctcccccaagtcaaatctgcaatataagatgtacaaaacccccatatttctcaatgaagtgttagtgaaactgcccacagatcccagtggggacgaacctattttccacatttcacacatagatcgcgtttacactctgagagctgagagcatcaacgaaaggacggcatgggtgcagaaaattaaagccgcaagtgagttgtatatcgagaccgagaagaagaagagagagaaggcctacctggtcaggtctcagcgggctactgggattggacgactgatggtcaacgttgtagaaggtattgagttaaagccctgtcgctcccacggtaaatccaacccctactgcgaggtgacaatggggagccagtgccatattactaagactatccaagatacacttaaccctaagtggaactccaattgtcagttttttatcagggacctggagcaggaagttctgtgcataactgtgtttgaaagagatcagttttcccctgatgactttctcggtaggacagagattcgagtggccgacatcaagaaggaccaaggcagcaagggtccggtgacaaagtgcctcctccttcatgaggttccaactggagaaatagttgtgcggcttgatctgcagctgttcgacgaaccttat

SEQ ID NO: 227294 - DNA, 3237 bp, Artificial Sequence
  Description of Artificial Sequence: Synthetic coding sequence
atggctcagttcccgacaccatttggcggatcactggatatctgggcaattacagtggaggaacgcgcaaagcacgatcagcaattccatagtctgaaaccgatctcagggtttataactggcgaccaggctagaaatttcttctttcagagcgggctcccacaacctgtgttggctcagatctgggccttggccgacatgaataatgatggccgaatggaccaagttgagttttcgatcgcaatgaagctgatcaagttgaaactgcagggctaccagcttcctagcgccctgccaccggtgatgaaacagcagcccgttgctatttcaagtgcccctgccttcggtatggggggtattgctagtatgcctccgttaacagcggtcgccccagtcccaatggggtctattccagtggtgggaatgtctcctacgcttgtgagtagcgtcccaacagccgcagtgccaccactggccaacggtgcaccccctgtgattcagccactcccggctttcgcccacccagctgcgactttgcccaagagcagttccttctctcgttcaggtcccggttcacagctgaacacgaaactgcagaaggcccagagctttgacgtggcctctgttccccctgttgcggagtgggctgtcccccagagtagtcggctgaagtaccgccagctctttaactctcacgataagaccatgtctgggcatctgaccggccctcaggctcgtaccattctgatgcagtcaagcctgccccaggcgcaactggccagtatttggaacctgtcggacattgatcaagacggcaagctgacagcagaggagtttatcctcgccatgcacctgatcgatgtagctatgtctgggcaaccgttacccccagtgctgcctcctgaatatattccgccatcattccgtcgtgtccgtagtgggagcggcatctccgtgataagctcgaccagtgttgaccaacggcttccggaggaacctgtgctggaggacgaacagcagcagctggaaaagaagctccctgtgacatttgaggataagaaacgcgagaacttcgagcgagggaatttggagctcgagaagcgacgacaggcactccttgagcagcagcggaaggagcaggaaagattagcacagcttgagcgagcagagcaggagagaaaggagcgggagaggcaagagcaggaaagaaagcgccagctggagttggaaaagcagctggaaaaacagcgggaacttgagaggcaacgggaagaggagcggagaaaagaaattgagagaagagaagccgcaaagcgcgagttggagagacaacggcaattggagtgggagaggaataggcgacaggagcttttgaaccagaggaacaaagagcaggaggatatcgtcgtgctgaaggcaaagaagaagaccctggagtttgaactggaggctctcaacgacaaaaaacaccaactcgagggcaagttgcaggacatcagatgcagattaaccacgcaaaggcaggagatcgagtcaaccaataaatcacgagaactgcgtatcgccgagatcacccatcttcagcaacagttacaggagagtcagcagatgttgggcagattgattcctgaaaagcagatccttaatgaccaactgaagcaggtccagcagaattcactgcaccgcgattcactcgtgaccctaaagcgggcactcgaagcaaaggagctggccaggcagcacctcagagaccaactagatgaagtggagaaggagacccgatccaaactgcaggaaattgacatttttaataaccagctgaaggagcttcgggagattcacaataagcagcagctccaaaaacagaagtccatggaagcagagcgtctcaaacaaaaggagcaagagaggaagatcattgaactggaaaagcagaaagaagaggctcaacgtcgggcacaggagagagacaagcaatggttggagcacgtccagcaagaggatgagcaccagcggcctaggaaactgcacgaagaagaaaagctgaaacgcgaagaaagcgttaagaagaaggacggggaagagaagggtaagcaggaggctcaagataagcttggtcggttgtttcaccagcaccaggagcctgcgaaacccgcagtgcaggccccatggtccactgctgagaaaggcccactcactatctctgcacaggaaaatgtcaaagttgtgtactatcgggcactgtatccctttgagtcacggagccacgatgaaatcaccatccagcccggagacatcgtgatggtggatgaatctcaaacaggagaacccggatggcttggcggagagctgaaaggtaaaacaggatggttccctgctaactacgcggagaagattccagagaatgaagtccccgctccagtcaaacctgtcaccgactctacatctgccccagcacccaagctcgcacttagggaaaccccagcgccattagcggtgacatcatctgagccctccacaaccccaaacaactgggctgatttttcctcaacatggcccacgtctaccaacgagaaacctgaaaccgataactgggacgcatgggctgcacaaccttcactgacagtgccctctgccggtcagcttagacagcgctcagcttttacccctgccacggctactgggtcttctccctctcccgtactgggccagggggaaaaagtggagggactacaagctcaggccctgtacccctggcgcgctaagaaagataatcatcttaacttcaataaaaatgacgtgattacggttctggaacagcaagacatgtggtggttcggtgaagtacaggggcaaaaggggtggttcccaaaatcttatgtgaaactgattagtggccctatcaggaaaagtacctccatggactctggaagttccgagagccccgcttcgctcaaaagggttgcttctccagccgctaagccagtggtaagcggggaggagttcatagcaatgtatacctatgagtccagtgagcagggagacctgacttttcagcagggtgacgtgatactggtcacgaagaaagatggagactggtggacggggacggtgggcgacaaagccggagtcttcccctctaactacgttaggcttaaagattctgaaggcagcgggaccgccggtaagactgggtctttgggtaaaaaacccggtcctagttgtaatgtgaagtag

SEQ ID NO: 227295 - DNA, 3663 bp, Artificial Sequence
  Description of Artificial Sequence: Synthetic coding sequence
atggcacagtttccaactccctttggaggcagcctcgacatatgggcaattaccgtggaagaaagggccaaacacgatcagcagtttcacagcctgaaaccaatctccggcttcatcacaggcgaccaggctcgaaattttttttttcagtcggggctcccccagccagtgctggcgcaaatctgggccctggcggatatgaacaacgacgggagaatggaccaggtggagttctccatcgctatgaaactcattaagttgaaactgcagggataccagctcccctccgctcttccccctgttatgaaacagcagccagtcgcaatttctagcgcacccgcttttggcatgggtgggattgcttccatgccccctctgacagcagtcgcccctgtgcctatgggctcaattccagtagtgggaatgtcacccacactggtctctagcgtaccaacagccgctgttcctccactggctaacggggctcccccagtgatacagccccttcccgcatttgcacaccctgccgctacactgcccaaatctagcagcttctcgcgatccggtcccggtagccagctgaataccaaattgcagaaagctcaatcttttgatgtggcctcagttccccctgtggcagagtgggctgtgccccagtcatcgcggctgaagtatcgacaattattcaactcccatgataaaacaatgtctgggcatctgaccgggccacaagctcgcacaatactgatgcagtcctctttaccccaagctcagctggcctccatttggaatttatcggacatagaccaagatggtaaactgactgcagaggagttcattctggctatgcatttgatcgatgtggcaatgagcgggcagccactcccacccgttctccctccagaatatataccgccttcgtttagacgcgtaagaagcggttccgggatctccgtaataagcagcaccagtgtggaccagcgactcccggaggaacctgtcctggaggatgagcagcagcaattggagaagaagctgcctgtaaccttcgaggacaagaagcgtgaaaattttgagcgcggtaacctcgaactggaaaaacggaggcaggccttgctggagcagcagcgtaaggagcaggagcgattggcccaactggagcgcgctgagcaggagcgcaaagagagggaacggcaagagcaggaaagaaagcgacagttggagcttgaaaagcagcttgaaaagcagcgggagctggagaggcaacgggaagaagagcggcgaaaggaaatcgagagaagagaggccgcaaagcgggagttagaacggcagcgccagcttgaatgggaacgcaaccgtcggcaggagttgcttaatcagcgaaataaggagcaggaggatattgtggtcctaaaagccaaaaagaaaactttagaattcgaactggaggcccttaatgacaagaaacaccagttggagggcaaattgcaggatattcggtgccggctcaccacacagaggcaggaaatcgagagcacgaataaaagccgtgaacttaggattgccgagataacacatcttcagcaacaattgcaagaatcccagcagatgctgggacggctgatcccagagaaacagattttaaacgatcagctgaagcaggttcagcagaattcacttcaccgcgatagtttggtgaccttaaagcgggctttagaggcaaaggaacttgcacgccagcacttacgcgatcagttggacgaagtggagaaggaaacaaggagcaaactgcaggagatcgatattttcaacaatcagttgaaagagttacgcgagatccataacaaacagcagctccagaagcaaaagtcaatggaggccgagaggctgaaacagaaggaacaggagaggaagattattgaactggagaagcagaaggaagaggcacagcggagggcccaagaaagggataaacagtggctggagcacgttcagcaggaagacgaacaccagaggccgaggaaactccatgaggaagagaaattaaagcgggaggaatctgtgaaaaaaaaagatggcgaggaaaaaggaaaacaggaggcccaggacaagctcgggagactgttccatcagcaccaagaaccagctaagccggcagtgcaggccccatggtcaaccgccgagaaagggcctctcactatctcagcccaggaaaatgtgaaggtggtctactatcgagctctctatccattcgaaagccgctcacatgatgagattacaatacaaccaggcgacatcgtcatggtgaagggtgagtgggtggacgaaagtcagacaggcgagccgggatggttgggaggagagctgaaaggcaagacgggttggttccctgcgaattacgcggagaaaattcctgaaaatgaggtgccggcacccgtcaaacctgtgactgactcaacctccgcgccagctccaaaactcgccttgcgcgagacccctgcccctcttgccgtcacctccagcgagcctagcactacaccgaacaactgggccgattttagtagcacttggccaacaagtaccaacgaaaaaccagaaaccgacaattgggatgcctgggccgcacagccttctctcacagtgccttcggctggtcaactgagacaaaggtccgctttcaccccagcaaccgccaccggatccagccctagccccgttttgggacagggtgaaaaggtggaaggtcttcaggctcaagctctgtatccctggcgggctaaaaaggacaaccacttaaattttaacaagaatgatgtgattaccgtcctggaacagcaggacatgtggtggttcggcgaggtccaaggacaaaagggctggttccctaagtcgtacgtcaagctaatctctggccctattcgtaaatcaacatcaatggactcagggtcatcggagagccctgcctccctcaagcgggtggcctctccagcggctaaacccgtagtgtccggcgaagagttcatcgctatgtatacatacgaatcctccgagcaaggagacctcacgttccagcaaggagatgtaatccttgtcaccaagaaagacggagactggtggacgggcacggttggcgacaaggccggtgtgtttccctctaactacgtgaggcttaaggattccgaaggctcaggtaccgctggtaaaaccgggtccctgggaaaaaaacccgagatcgcccaggtcatcgctagctacaccgcgacaggccctgagcagctgaccctagcgcctggacagctcatcttgatccggaaaaaaaaccctggtggctggtgggaaggtgaactccaggctcgtggaaagaaaaggcagataggttggtttccagctaactacgtgaagttgctgagccccggtacctccaaaatcacacccaccgagccccctaaaagtacggccctcgctgcagtatgccaggtgatcggcatgtatgattacaccgctcagaatgacgacgagttagctttcaataagggccagatcatcaatgtgctgaataaggaagatcccgactggtggaaaggtgaagtgaacgggcaggtcgggctcttccctagcaactacgttaaacttacaactgatatggacccatcccagcaatag

SEQ ID NO: 227296 - DNA, 5165 bp, Artificial Sequence
  Description of Artificial Sequence: Synthetic coding sequence
atggcccaatttcctacaccttttggcggaagccttgacatctgggccatcacagtggaggagcgtgcaaagcatgaccagcaattccatagcctcaagccaattagtggatttatcactggagatcaagctcgaaactttttctttcagtctggcctgcctcagcctgtcctggcccaaatttgggccttggccgacatgaacaatgatggacgtatggaccaggtggagttttccatcgccatgaaattaataaagctcaagctgcaggggtaccaactgccatccgccctcccccctgtgatgaagcagcagccagtagccataagcagtgctccagcgttcggcatgggagggatcgcgtccatgccaccccttaccgcagtagcacctgtgccaatgggctcaatccccgtggtagggatgtctcctacactcgtgagttccgttccgactgcagctgttccaccattggcaaacggcgcaccacccgtaatccagcctttgcctgcttttgcacacccagcggctaccctcccaaagagctctagcttctccagaagtggcccaggttcgcagctaaacaccaaattacaaaaggcacaaagctttgacgttgccagcgtacccccagtcgcagagtgggccgtgccccagtcatccaggcttaaatacagacagctcttcaatagccacgacaaaacaatgtcagggcatctgacagggccacaggccagaaccattctaatgcagagtagcttgccacaggctcagctggcctccatctggaacctcagcgatattgaccaggatggaaaactcaccgcagaagagttcattttggcaatgcacttgattgacgttgccatgtcagggcagccacttccccctgtgctcccccctgaatacataccaccatcgttccgaagggtgaggtccggaagtggaattagcgtcattagctccaccagtgtagaccagcggctgcccgaggagccggttttagaggatgagcagcaacagctagagaaaaaactgccagtgacttttgaggataaaaagagagagaactttgaacgcggaaatcttgagttagagaagcgccgtcaagccctgcttgagcagcaaagaaaggagcaagagagattggctcagctggagcgcgctgagcaggagagaaaggagcgagagcgtcaggaacaggaacgtaagcgtcagctggaactcgagaagcaactggagaaacaaagagagttagaacgccagcgggaagaggagcggcgaaaagaaatcgaaagacgagaagccgcaaaacgagagcttgaacggcagaggcagctggagtgggagcgcaaccgcaggcaagaactattaaaccagcgaaacaaggaacaagaagatatagtcgtgctgaaagccaagaagaaaaccctggaattcgagctggaagctttgaacgataaaaagcaccagctggaaggcaagttacaagatatccggtgcagactcaccacacagagacaggagatagagtccacaaataaaagtagggagttacggatcgccgaaattactcatttgcagcagcagctgcaggaatcacagcagatgctcggtcgactgatccccgaaaagcagatactgaacgatcagctgaagcaagtgcagcagaactctctgcacagagatagcctcgtgaccctcaagcgtgcgctcgaagctaaggaactagctagacagcacttgagagaccagctggatgaggtggagaaggagacacggtcgaagctccaggagattgacatattcaataatcaacttaaagaactgagagagatccacaacaaacagcaattgcagaagcaaaagagtatggaagccgaaaggctgaagcaaaaagagcaggaacgcaagattattgagctggagaagcagaaggaggaggcgcaaagaagggcccaggaaagagataagcagtggctcgagcacgtacagcaggaggacgagcaccagcgccctcgaaagctgcacgaagaagaaaaactgaagagagaagagagcgttaagaaaaaggacggagaagaaaagggaaagcaggaggcacaggataagctgggccgtctttttcatcagcatcaggagcctgcaaagcccgctgtgcaagccccatggtccactgccgaaaaggggccactgactatcagcgcccaggagaacgtcaaggtagtttattatagagcgctctacccattcgagtcccggtcacatgacgaaatcacaatccagcccggagatattgtcatggttaagggcgagtgggtggacgagtcccaaacaggtgagccaggttggctggggggtgagttgaagggaaagaccggctggtttccagcaaattacgcagagaagatccctgaaaacgaggtgcctgccccagtgaaacccgtgaccgacagcacaagcgctcccgcacctaagctggctctgagggaaacgcccgcaccacttgccgtgacatcatcagaacctagcacaactccaaataattgggctgacttctcctccacttggccaaccagcacgaacgagaagcctgaaacggacaattgggacgcctgggcggcacagccatccttaactgtccctagcgcgggacagcttcgacagcgtagcgcttttacgcctgcaaccgcaactggttcctcccctagtcctgtgctgggacaaggggaaaaggtggaaggtctgcaggcccaggcactgtacccctggcgagccaagaaggataatcatcttaacttcaacaagaatgacgtgatcaccgttctggagcaacaggatatgtggtggtttggagaggtccaagggcaaaaagggtggtttcccaaatcatatgtgaagcttatcagcggccctatccggaagagcacgagcatggattccggcagttccgaatcacctgctagcctgaagcgggtggcctctcccgctgcgaagcccgttgtgtccggtgaggagttcattgccatgtatacatacgaatcatcagagcagggcgacctgacattccagcaaggcgacgtgatcctcgttaccaaaaaggatggggattggtggaccgggacagtgggcgacaaagcaggggtctttccaagcaactacgtccgcctgaaagacagcgagggtagcggcacagccggaaagaccgggtcattaggtaaaaaacctgagattgcccaggtgattgccagctataccgccaccgggccagagcaactcaccctcgctccaggccagctgattcttatacgcaagaagaaccctggcggatggtgggagggcgagcttcaggcacgaggcaagaaaaggcaaattggttggttccccgcaaactacgtcaagttgctgtcgcccggtacctcaaagatcactcccacagaaccaccaaaatccactgcccttgcggctgtgtgccaggtgatcggaatgtacgactacacagcccagaatgacgacgagctcgcttttaacaaagggcagattataaacgtgctgaataaggaagaccccgattggtggaagggtgaggttaacggccaggtgggtctcttcccgagtaactatgtgaagctgactaccgatatggacccaagtcagcagtggtgcagtgatctacacctactggacatgctaactccaaccgagcggaaacgtcaaggctatatacatgaacttattgttaccgaagagaactacgtcaatgatcttcaactcgttaccgaaatttttcagaagccactgatggagtccgaactactcacagagaaggaggtggctatgatcttcgtgaactggaaggagttaattatgtgcaatatcaaactcctcaaagcattgcgggtgcgcaaaaaaatgagcggggaaaaaatgcccgtaaagatgattggcgatatcctaagtgctcagctcccacacatgcagccttatattcgattctgttctcggcagctgaatggagccgctctgatacaacagaaaactgatgaggccccagatttcaaggaattcgtcaagagactcgccatggatcctcggtgcaaaggtatgcctctctcgtcgtttattctgaaacccatgcaaagagtgactcgctaccccctcataataaagaacatcctcgaaaacacccccgagaaccatccagatcactcacacttaaagcatgcccttgaaaaagctgaggaactttgttctcaggtaaacgagggagtccgagaaaaggagaactccgatagactggagtggattcaggcgcatgtgcagtgcgaagggctctccgagcagctggtgtttaattccgtgactaactgtctgggtcccagaaaatttcttcactccggtaaattgtacaaggcaaaaagtaataaggaactttatgggttcctgttcaacgattttctgctgttgacccagattacaaagcctttaggctccagcggaactgacaaggttttcagtcctaagtccaatttgcaatataaaatgtacaaaactccgattttcctgaatgaagtcctcgtaaagctgcctacagatccctcaggagacgaacctatcttccacatctcccacatcgatcgcgtgtacacccttcgtgccgagtccatcaacgagagaaccgcatgggtgcaaaagataaaggctgcgagcgaactgtacatagaaacggagaaaaagaaacgtgaaaaggcttacttagtccgctcacaaagagccaccgggatcggacgtctgatggtgaacgtggttgaagggatcgaactgaagccctgcaggagccatggcaaatctaacccttattgcgaggttaccatggggagtcagtgtcacattaccaagactatacaggatacactgaatcccaaatggaattcaaattgtcagttctttatacgagacctcgaacaggaggtcctgtgcattacggtgtttgagcgcgaccaatttagtccagacgacttcctgggtcggacggaaatcagggttgctgacattaaaaaagatcagggctcgaaagggccagtgaccaaatgcctcctccttcatgaggtccctactggagagatagtggtcagattggatctgcaactgttcgatgagccata

SEQ ID NO: 227297 - DNA, 3048 bp, Artificial Sequence
  Description of Artificial Sequence: Synthetic coding sequence
atggcgcaattcccaactccgttcgggggatctctcgacatatgggcaatcactgtggaagagcgcgcaaagcacgaccagcagttccactcactgaaacccatctcaggatttatcacgggggatcaggcccgaaactttttctttcagtctggtctgccgcaaccagtgctcgcgcagatatgggctctcgcagatatgaataatgacggcaggatggatcaggtggagttctcaattgcgatgaaactgattaaacttaagctgcagggctaccagctcccctctgctttgcctcctgtgatgaaacagcagcccgtcgcaatctcctcagccccagctttcggtatggggggaatcgcatcaatgccaccactgaccgctgttgccccagttcccatgggaagcattccggtcgtgggcatgtcccccactctggtttcttccgtacctaccgccgcagtcccgcctctcgctaacggggctccacccgttattcagccccttcctgccttcgctcatcccgctgcaacgctgccaaagtccagctcattctcgagatcaggacccggaagccaactcaacactaaacttcagaaagcccagtccttcgatgttgctagcgtacccccagtggcggagtgggctgtcccccagagcagtagactcaagtatagacagctgtttaattcacatgacaagactatgtctggacatttgacagggcctcaggcccgaacaatcctgatgcagagcagccttccccaggcccagcttgcatcaatatggaacctcagtgacattgaccaggatggtaagctgactgccgaggaatttatattggccatgcatctgatcgatgttgccatgagtggccagccgcttccgccagtactcccgccagagtacattcccccatcttttagaagggtgaggtctgggagcggaattagcgtgatcagttccacatctgtcgatcaacgattgcccgaggagcctgtcctagaagatgagcaacagcagctggaaaagaagctcccagttaccttcgaggataagaaacgggaaaactttgaacgaggcaacctggagctggagaaacgcagacaggcgctacttgagcagcagcgcaaagagcaggaaagactggcgcagctggagcgggctgaacaggagagaaaagagagggagagacaggaacaggaaagaaagagacagctagaattagagaagcagttggaaaaacagagggagctcgagcgacagcgcgaggaggagaggaggaaggagatcgaacgacgagaggcagcaaaaagggaacttgagcggcaaagacagctggagtgggagagaaaccgtaggcaggagttacttaaccagagaaacaaagagcaggaggacatagtcgtgttgaaagcaaagaaaaagacgctggaattcgaactggaagctctgaatgataagaaacaccaattagaaggtaaacttcaagatattcgctgcagactgacgacacaacggcaagagatagagagtactaataaatcacgtgagctgcgcattgccgagatcacccacttgcagcagcaactccaggagagccagcagatgctggggcgacttatccccgagaagcagattcttaatgaccaactgaagcaggtccagcagaattcacttcacagggatagtctggtcacattaaaacgtgccctggaggcaaaggaacttgccagacaacacttaagagatcaactggatgaagtcgagaaagaaaccaggtccaagctgcaggagattgacatttttaacaaccagctgaaggaactccgggaaatccataataaacaacagctccagaagcagaagtcaatggaggccgaacggctgaagcagaaggagcaagagcgcaagattatcgaactcgagaagcagaaggaggaagctcagcgacgggcacaggagagagacaagcagtggctggagcatgtgcagcaggaggatgagcaccagaggccacgcaaactccatgaagaagagaagcttaagagagaggagtctgtgaaaaaaaaagacggagaagagaagggcaaacaggaagcacaggataaattaggaagactgttccaccaacatcaagaaccggctaaaccagctgtacaggcaccctggtcaaccgccgagaagggcccactaaccatcagcgcacaggaaaacgtcaaggtcgtttattaccgagccctctatccattcgaatccaggagccacgatgaaattactatacagcctggtgacattgtgatggtggacgaaagccagaccggtgagcctggatggctgggcggagaattaaaaggaaaaaccggctggttccccgctaattacgcagagaaaatcccggagaacgaagtgcctgccccagtgaaacctgtgacggatagtacctctgccccagcacccaaacttgccttaagggagacccccgcaccacttgccgtcacatctagcgagccttctacgacaccgaataactgggcagatttcagtagcacatggccgacttctaccaatgagaaaccggagaccgataactgggacgcttgggctgctcagccttcactgacagtcccctccgccggtcaactcagacagaggagtgccttcaccccggctactgctacaggctcttcaccctcgcccgttctgggccagggtgagaaagtcgaaggcctacaggcccaggccttatatccctggagagcaaaaaaggataaccacctcaacttcaacaagaatgacgtgattacagttcttgagcagcaagatatgtggtggtttggcgaggtccagggtcaaaagggctggtttccgaagagttatgtcaagctcataagtggacctattcggaagtcaaccagcatggactccggctcttctgagtcccccgcttctctaaagcgggtcgcatcccctgccgctaagcccgtcgtgagcggggaaggtctctggaattgctgggaaaaccgagaatttaggaaaaagacatag

SEQ ID NO: 227298 - DNA, 3063 bp, Artificial Sequence
  Description of Artificial Sequence: Synthetic coding sequence
atggcccagttcccgaccccatttgggggttccttggacatctgggctatcaccgtggaggaacgggcaaaacacgatcagcagtttcactcactaaaaccaatttccggtttcatcaccggagaccaagctcggaactttttttttcaatcaggcctgccacagcccgtccttgcacagatctgggccttggccgatatgaacaatgatggccgaatggatcaggtggaattctcgattgccatgaagctgatcaaactgaaattacagggctatcagctacccagcgccctgccacctgtaatgaaacagcaaccagtggctatctcatccgcccctgccttcgggatgggcggtatcgccagtatgccgccactaaccgcggtggctccagttcctatgggcagtatcccagtggtcggaatgagcccgacactcgtgtcctccgtcccaactgccgctgtgccacccttagccaatggcgcacccccagtgatccagcctctgcccgcttttgcgcaccctgccgctacactgcctaaaagctctagcttttctcgctctggacctggatcacagctgaacaccaaacttcagaaggcccaatctttcgacgtcgcgtctgttccccctgttgcggagtgggcagtgcctcaatcttcccgcctgaagtatagacagttatttaattcacacgacaagaccatgagtggacacctcaccggaccccaggcaagaacaatacttatgcagtcatcgctcccacaagcacagctggcttctatttggaatctgagcgatattgaccaagacggaaaacttaccgcagaggagtttattctcgctatgcatctcatcgacgtggcaatgtctggtcaacctctcccccctgtgcttcctccggaatatatacctcccagcttcagaagggtgagaagtggcagtggaatttcagtgatctcatctacttccgttgaccagcgcttacccgaggagcccgtactagaggacgagcagcaacagttggagaaaaaattacctgtgactttcgaggacaaaaagcgcgagaatttcgaaaggggaaacctcgagctggaaaaacgtcgtcaggcattattggaacagcagcgaaaggagcaggaacgcctggcacagctcgagcgcgctgaacaggagaggaaagagagggaaagacaggagcaggagcggaagcggcaactagaactggagaaacagttagaaaaacagagggagcttgagcgccagcgcgaagaggagaggcggaaggagattgagagacgcgaggcagcaaagagggagctagagagacagaggcaacttgaatgggagaggaataggaggcaggagttgttgaatcagcgaaacaaagagcaggaggacattgtggtgttgaaggctaagaagaagactcttgaattcgaattggaagcactgaatgataagaaacatcagcttgaagggaagttgcaggatatacgctgtagactgactacacagcgccaagagattgaatccacaaataagtccagggaattgaggattgcagaaatcacccacctgcaacaacagctccaagaatcccaacaaatgctggggaggctgattcctgaaaaacagatccttaatgaccagctgaagcaggtacagcaaaatagtctacatagggatagcctcgtgactctgaagcgagcactggaggctaaggagctggcacgccagcacttacgtgatcaattggacgaggtggagaaggaaacgcgaagcaaactacaggagatcgatatatttaacaaccaattgaaggagctgcgcgaaattcacaacaaacagcagctgcagaagcagaagagtatggaggccgaacgcctaaagcagaaagaacaggagagaaagataatcgagcttgaaaagcaaaaggaggaggctcagcggagagctcaggagagagacaaacaatggctggagcacgttcagcaagaggatgagcatcagcggccacggaagctgcacgaagaggagaagctcaaacgcgaagaaagtgtgaaaaaaaaagatggcgaggaaaagggcaagcaggaggctcaggacaagcttggccgtcttttccaccagcatcaggagccagcaaaacccgcagtacaggctccctggtccacagcggagaaagggccactgaccatctctgcccaggagaacgtcaaagttgtatactaccgtgccttgtatccatttgagagtcgctcccacgacgagatcaccattcagccgggtgacattgtaatggttgatgaatcccagacaggcgaaccaggctggctaggcggtgaattgaaagggaaaaccgggtggtttcctgctaattacgcagaaaagattcctgagaatgaagttcccgctcccgtaaagccggtgactgactccactagcgcgcctgccccaaaactggctcttagagagaccccagcccctctggccgtgactagtagtgagcctagcaccactccaaacaattgggccgattttagttcgacttggcctacctccacaaatgaaaaacccgaaaccgataactgggacgcctgggctgcccagcccagtttgacggtgccgtccgcagggcagcttagacagcgcagcgctttcacacccgcaaccgccacgggcagctccccatcgcccgtgctcgggcagcctgatttcctgctgcacccctccatgagactcggacacatgcagcccaggatcgtgctgctgtttccagatcccctgcaatgctcaacgtctcgcttgctacctatgctgcgtcctcgtcctggggttccatttcttaggtctccctcctgccagtcaccaagccacccatctcgaccaatttccgatgccgctcctagcgtcaagttcacccttatgcccccagggagaatacacccatgctttctctttattcctgccgttaacagtcgtaactcctttttggtctacttcatcctccctggtggtaccctaggctgtttctacctctgtttgccccattatttgtag

SEQ ID NO: 227299 - DNA, 3435 bp, Artificial Sequence
  Description of Artificial Sequence: Synthetic coding sequence
atggcccaatttcccaccccctttgggggaagcttggatatctgggccataacagtcgaggaacgggctaagcacgatcaacagtttcacagtctaaaaccaatcagcggctttattacaggcgatcaggcgcgaaattttttctttcagtctgggctgccgcagcccgtgctcgcacagatttgggcgctcgccgatatgaataacgacggccgaatggaccaggtggagttttccatcgcgatgaagctgatcaaacttaaactgcaggggtatcaactcccgtccgccttgccccctgtgatgaagcagcagccagtggcaatcagttccgcacccgcttttggtatgggcggtattgcatcaatgccacccctaactgccgttgcccctgtgcccatgggaagcatccccgtcgtgggcatgtctcccacgctggtgtcgagcgtgcctaccgcggctgtgccaccacttgctaatggtgccccaccagtgatccagcccttgccggcattcgcacaccccgctgcaacgttgccgaagagctccagtttctcaagaagtggcccaggtagccagctcaacacaaaactgcagaaggcacagagttttgacgttgcatcagtgccccctgtcgccgaatgggcggttcctcaatcttcccgactgaagtaccgtcagctgttcaattcccacgacaaaaccatgtccggtcatcttactggaccccaggccagaacaatcttaatgcagtcatcccttccgcaggcccagctcgctagtatttggaatctctctgacattgatcaagacgggaagctgaccgctgaggagttcatactcgctatgcacttgattgacgtggcgatgtccgggcagcctctccccccagtgcttccaccagagtacattccaccttcctttaggcgggtaaggtccgggagtggcatttcggtgatctcctcgacgtccgtcgatcagcggttacctgaagaacccgtgctcgaagacgaacaacagcaacttgaaaagaaattgccggttacctttgaggacaaaaagcgggaaaactttgagaggggcaacctcgaactggagaagaggcgtcaggcactcctcgagcagcagcgcaaggagcaagagagactggcccagctcgagcgagccgagcaggagagaaaagagcgcgaacgtcaggagcaggaaagaaaacgccaactggaactcgaaaagcagcttgagaaacagcgggaactcgagcgacagagagaggaggaacgtcgcaaagaaattgaacggcgagaagccgctaagagagagctggagagacaacggcagctcgagtgggagcgaaaccgaaggcaagaactgctcaaccagaggaataaggagcaggaggacatcgtggtcttgaaagctaaaaaaaagacgctggaatttgagttggaagccctcaatgataagaagcaccagctcgaagggaagctgcaagacatcaggtgccggctgacaacccaacggcaggaaattgaatctactaacaagtcgagggaactccgcattgcagagattacacaccttcaacagcagctgcaggagtctcagcagatgcttggcaggctcatcccagaaaagcaaattcttaatgatcagctaaagcaagttcaacagaacagtttgcacagagactcactggtcaccctcaagcgggcacttgaggccaaagaactggcgagacagcacctgcgggaccaactggacgaggtggaaaaggagacccgcagcaagttacaggaaattgatattttcaataatcaacttaaggagttaagggagatccacaataaacagcagctgcagaagcagaaatcaatggaagctgaacggctgaagcagaaagagcaagaacgcaagatcatcgaactcgaaaagcagaaagaggaggcccagcgacgagctcaagaacgagacaaacagtggttggagcacgtacagcaggaagacgagcatcaacggcctaggaaactccacgaggaggagaagctgaagagagaggaaagtgttaagaaaaaagatggcgaggagaaaggtaagcaagaggcacaggataaattaggtcgattgttccaccaacaccaagaaccagccaaaccggcagtccaagcaccttggagtactgcagaaaaaggccctctgaccatcagcgcccaagaaaacgttaaagtggtttattatagggccctgtaccccttcgagtcacgctcccatgacgaaatcaccatccagccgggagacatcgttatggtcgacgagtcacagaccggagaaccagggtggctgggcggtgagctgaagggaaagaccggatggttccctgctaactacgcagagaagatccccgagaatgaggttccagctcctgtcaaaccggtgacagactctaccagcgccccagcacccaagctggccctgagggagacacctgctcctcttgcagtgactagttcagagccttcgactacaccgaacaattgggccgacttttcttctacgtggcctacctccacaaatgaaaagcctgagacggacaactgggatgcgtgggcagctcaaccttctctcaccgtaccttccgctggtcagctgcgccagaggtctgcgtttaccccagcaactgccaccggatctagcccgagcccggtgcttggtcagggcgaaaaagtagagggcctccaggcccaggcgctctacccgtggagggcaaagaaggataatcacctgaattttaataagaacgacgtgattacagttcttgaacagcaggatatgtggtggtttggcgaagtgcaggggcagaaagggtggtttcctaagtcatatgtcaagctgatttctggacctattcgaaagtccacctctatggactccgggtcaagtgagagccccgcttctttgaagcgagtcgccagccccgctgccaagccagtagtgagtggagaggaaatagcccaggtcatcgccagttacactgctaccgggcctgaacagttaacacttgcacccggacagcttatactcattcgaaagaaaaatccgggtggttggtgggagggggagctgcaagcacgtggaaagaagcgtcagattgggtggtttcccgctaattacgtgaaacttttgtcccctggaacatctaagatcacccccacagaaccacctaagtccacagcgctcgcggcagtctgccaggttatcggcatgtatgactataccgctcagaacgacgacgagctcgccttcaacaaggggcagataatcaacgtcctcaacaaagaggaccctgattggtggaagggagaggttaacggacaggttgggcttttcccatccaactatgtaaaactgaccaccgatatggacccctctcaacagtag

SEQ ID NO: 227300 - DNA, 3648 bp, Artificial Sequence
  Description of Artificial Sequence: Synthetic coding sequence
atggctcaatttccaactccatttggaggttctttagacatctgggccattactgtcgaagaacgtgccaaacacgaccagcagttccattcccttaaacccatatctggatttattactggagatcaggccagaaacttcttcttccagtccggattgccacagcccgtgctggcccaaatctgggctcttgcagacatgaataacgatggacggatggaccaggttgaattttccatcgctatgaagctgatcaagttgaagttgcaaggttatcagctcccttcggcccttccgcctgtcatgaaacagcaacctgtggctataagcagcgcgccagcttttgggatgggagggatcgcttctatgcccccactgactgctgtagcgcctgtccctatgggatccatccccgtggtaggtatgtccccaacactggtgtcctccgttcctaccgctgctgtgccccctcttgccaacggcgctcccccagtgatccagcccctccccgctttcgcacaccctgcagcgactcttcccaagtctagctccttcagtcgctcaggccctggatctcagcttaacacaaagctccagaaagcccagtcattcgatgtggcatctgtgcccccagtggcagagtgggccgtcccacagtctagcagactgaaatacagacaactgttcaactcccacgataaaaccatgtctggacaccttacgggcccacaggctcgcacaattctgatgcagtccagcctgccccaggcccaattggctagtatttggaatctttctgatattgatcaagacggaaaacttacagcggaggagtttattctcgctatgcatctgattgatgtagccatgagtggccagcccctaccccctgtccttcccccagaatatattcctccaagctttagacgcgtgaggagtggcagtggtatctctgtcattagcagtacgagtgtggaccagagactgccagaagagccagttctcgaagatgagcagcagcagcttgaaaaaaaattgcccgttacgtttgaagataaaaagagggaaaactttgagagggggaatcttgagctggagaaacgaagacaggcccttctagagcagcagcgcaaggaacaggaaaggctcgctcagctcgaacgagctgaacaggagagaaaggaaagagaacgacaggagcaggagaggaaacgccagctcgagctggagaaacagctggagaagcaacgggagctggagcgccaacgagaggaggagagacgaaaggagattgaaagacgcgaggccgctaagcgtgagctcgagagacagcggcagctggagtgggagagaaatcgaaggcaggagctccttaaccaaaggaacaaggagcaggaagatatcgttgtgctcaaggctaagaagaaaactctggagtttgaattagaagcactgaacgacaaaaagcaccagctggagggtaagctgcaggatattaggtgccggctcactactcagagacaggaaatcgaaagtacaaataagtctcgggagctgagaattgctgagatcacacatctgcagcaacagctacaagaaagccaacagatgctgggcagactgatccccgagaaacagattctcaatgaccaactaaagcaggtgcaacagaactccctacaccgagacagtctagtgaccctaaaaagggcccttgaggctaaagaactcgccaggcaacacctccgggatcaactcgatgaagtcgagaaagagactcgctccaaattgcaggaaattgacattttcaacaaccagcttaaggagttaagagaaattcacaacaaacagcagttgcagaagcagaagtcaatggaggcagaacggcttaagcaaaaggagcaggagagaaagattattgagttggagaaacagaaggaggaagcacagagacgagcacaggagcgggataagcaatggctggaacacgtacagcaagaggacgaacaccagcggcctcggaagctccacgaggaagaaaaactgaaaagggaagagtccgtcaaaaagaaagatggcgaggagaagggcaagcaggaagcgcaggacaaactcggaaggttgtttcaccagcatcaggaaccagctaaacctgccgtccaggccccatggagcacggccgaaaagggccctttaaccattagtgctcaggagaatgtgaaggtcgtctattaccgagcactgtatcctttcgagtctaggtcacatgatgaaatcacgattcagccaggagatattgttatggtggatgagtctcagacaggagaaccaggttggctgggaggcgagctcaaaggcaaaaccggctggttcccagctaattatgccgaaaagatcccggaaaacgaagtccctgcccctgtcaagccggtcaccgatagcacctctgctccagcgccaaagcttgcactgagggagaccccagccccactggccgtgaccagttctgaaccatcgaccacgccaaacaattgggctgacttctcctccacttggccaaccagcactaatgagaaacctgagacggataactgggacgcatgggccgcacagcctagccttaccgttcccagcgcgggacagctccggcagcgaagtgccttcaccccggctacagccacaggctcctcccctagtccagtgctaggccagggtgagaaggtcgaaggacttcaggcgcaggccctttatccgtggagagccaagaaggacaatcatcttaattttaataagaacgacgtgatcacagtgctggagcaacaggacatgtggtggttcggtgaagtgcaggggcagaaaggatggttccccaaatcgtatgtcaagcttatatccggacccattcgtaagtccaccagtatggatagtggttcctcagagtctccagcgagtctgaaacgagtggccagtccggctgccaagcctgtcgtatcgggagaggagttcatcgccatgtatacatacgagagtagtgagcagggcgatctcaccttccagcagggtgacgttattttagtaaccaaaaaagatggtgactggtggactggcaccgtgggcgataaggctggcgtgttcccatcaaactacgtgcgattaaaggacagtgaaggaagcggcactgcaggaaaaaccggctctctgggcaaaaaacctgaaattgcccaggttatagcatcttacacagccactggacctgaacagctcaccctcgctcctgggcagttgatcttgatcagaaaaaagaacccaggcggatggtgggaaggagaactgcaggctcgcggaaagaagcggcagattgggtggttccccgctaattacgtgaaactgctgagccctggaacatcgaaaattacccctactgaacctcctaagtcgaccgcactggcagcagtgtgtcaggtgattggcatgtatgattacactgcacagaacgacgacgaattggcttttaataagggtcagatcattaacgtcctgaacaaagaagatcccgactggtggaagggcgaagttaatggccaggtaggtctcttcccatccaattacgtcaaattgaccacagacatggacccatcccagcagtag

SEQ ID NO: 227301 - DNA, 3537 bp, Artificial Sequence
  Description of Artificial Sequence: Synthetic coding sequence
atggcgcagtttccaacgccttttggcggttccttggatatctgggctatcacagtggaggaaagagccaagcatgatcagcaatttcattccctgaagccgatcagcgggtttattaccggcgatcaggccagaaatttctttttccagagcggactcccccaaccagtgctggcacagatttgggccctcgccgacatgaataacgacggcaggatggatcaagtggagttctccatcgccatgaagctcatcaaattgaaactgcaagggtaccagctgccctctgcccttcctcccgtgatgaaacagcaaccggttgccatatccagcgccccagcatttgctgctgtcccacccctggctaacggcgctcctcctgtgatccagccgctgcccgcatttgcgcaccctgctgccactctgcccaagagttcctctttctcacgcagtggccctggtagccagctgaatactaagctccagaaggctcagagtttcgatgtggcgtccgtcccgcctgtcgcagaatgggccgttccacagagtagtcggcttaaataccggcaactgttcaatagtcacgataaaaccatgagcgggcaccttaccggccctcaggccaggactattctcatgcaaagcagcttgccacaggcccagctggcctccatctggaacttgagcgacattgatcaggacggcaaattaactgctgaagagttcatccttgcaatgcacttaatagatgtcgcgatgagtggccagccccttcccccagtgctgccaccggaatatatacctcccagttttcggagagtgcgaagtggaagcggaatctccgtaataagctccacttctgttgaccagcggctccccgaggaaccagtactcgaggacgagcagcaacaactggagaagaaattgccagtcaccttcgaggataagaagagagaaaattttgaacggggaaacctggagctcgagaaacgcagacaggccttgctggagcagcagcggaaggagcaggagaggctggctcaattagagcgagctgaacaggaacggaaggaacgggaacgccaggagcaggagcggaaacggcagttggagctggaaaagcagctggaaaaacagcgcgaactcgagagacagcgtgaggaggaacggagaaaggagatagagcgcagagaggccgcaaaaagagaactggaacgccagcgccaattggagtgggagcgcaataggcgccaggaactgctcaatcagcggaacaaggaacaagaggacatagtggtactcaaggcaaagaaaaagaccttagaattcgagctggaagctctgaacgacaaaaagcaccagctagagggcaagcttcaggatattaggtgccggctgaccacacaaagacaggagattgaatcaacaaacaaatcacgagagcttagaatcgccgaaattactcacctccagcaacaattgcaagagtctcagcaaatgctgggtagactgataccagaaaaacaaattctgaacgaccagcttaagcaggtgcaacagaacagcctacaccgggactctttggttacgttgaagcgagcgcttgaggccaaagagctcgcccgacagcacctgcgtgatcagctggacgaggtggagaaagagacccgatctaagctgcaggagatcgacatcttcaacaatcagctgaaggagttgcgagagatacataacaagcagcagctccagaagcagaaatccatggaagctgagcgcctaaaacagaaggaacaagagcgaaagattatagaactggagaagcagaaagaggaggctcaacgaagagcccaggagcgcgacaagcagtggctcgagcacgttcagcaggaggacgagcaccagcggccacgcaagctgcacgaagaagaaaaacttaaacgggaggagtccgtgaagaaaaaagacggtgaggaaaaaggtaagcaggaggcccaggacaaactgggtcgtttatttcatcaacaccaggagcctgccaagccggcagtgcaagcaccgtggtccactgctgagaaaggtccactgacaatatccgcacaggagaatgtgaaagttgtgtactatcgggcactgtaccccttcgaaagccgctcgcatgacgagatcactattcagcctggggatattgtgatggttgatgagagccagaccggtgaaccaggctggctgggaggcgagctgaaaggcaaaactggttggttcccggcaaattacgccgagaagatccctgaaaatgaggttcccgctccagtgaaacctgttactgatagtacatcggcacctgctcctaagctcgctctgagggaaacacccgcacccctcgctgtaacatcttctgaaccctcaaccacccccaacaactgggcagacttctccagcacatggccaacatcaacgaatgaaaaaccagagaccgacaactgggacgcttgggctgcccagccttccctgactgtgccttctgctggacaactccgacaaagatcagcttttactccagccacagcgaccggcagttctccatcgcccgtgttaggtcagggtgagaaagtggagggactccaggctcaggcactgtatccatggcgggctaagaaggacaaccacctcaatttcaataaaaacgatgttatcaccgtgctggaacaacaagacatgtggtggtttggagaggtgcaaggtcagaaggggtggtttcctaaatcatacgtgaagttaatctcggggcctatccgcaaaagtacctctatggactctgggagctccgaaagtccggctagtctaaaacgggtagcgagccctgctgcaaaaccagttgtgagcggcgaggagttcattgccatgtatacttacgaatcaagcgaacagggtgatctgacgtttcagcagggcgacgtgatactagtgaccaaaaaggacggggattggtggactggaaccgtcggtgataaggctggcgtgttccccagcaattacgtgaggctcaaagactccgagggatccgggactgcaggcaaaactggcagtctcggaaaaaagccagagatcgctcaggtcatcgccagctacacagccacggggcctgagcaactcactttagctccaggacagttgatccttattcggaagaagaatcccggaggctggtgggaaggagagctgcaggcccgtgggaagaagcgtcagattgggtggtttcccgctaactacgtgaagctgttgtccccaggcactagtaagatcaccccaaccgaacctccgaaatctacggccctagcagcggtgtgtcaggtcattgggatgtacgattacaccgctcaaaacgatgacgaactggccttcaataagggccagatcattaatgttctgaacaaggaggatcctgactggtggaagggcgaggtgaacggacaggttggtctgtttccatccaattacgttaaactgacaacagacatggatccaagccaacagtag

SEQ ID NO: 227302 - DNA, 3450 bp, Artificial Sequence
  Description of Artificial Sequence: Synthetic coding sequence
atggcccaatttcccaccccgtttggtggaagcctggacatatgggccattactgtggaagaaagggccaaacatgatcagcaatttcactctctgaagccaatttctggctttatcaccggcgaccaggcccgaaattttttctttcagagcggcttaccgcaacctgtccttgcccaaatatgggcactggccgacatgaataatgacggaaggatggaccaggttgagtttagcatcgcaatgaaactgatcaagttaaaactccagggatatcagttgccttcagccctcccacccgtgatgaaacaacagcctgtcgccattagctcagctcctgcttttggaatggggggaatcgcttcgatgccacccctcaccgcagtggccccagtcccaatggggtcaattcccgtagttggcatgtccccaacgttagtcagcagtgtcccaaccgcagccgtccccccattagccaatggagcacctcccgtaattcaaccacttcctgcctttgcccaccccgcagcaaccctccctaaatccagttcattctcccggtcaggtccaggctcccagttgaataccaagctgcaaaaggcacaatccttcgacgtggcctctgtgccacctgtagcggagtgggccgtcccccagagtagtaggttgaagtatcggcagctttttaattcccacgataagactatgtctggacacctcacagggccacaggctcggacaatcttgatgcagtctagtctgccccaggcccagctcgcttctatttggaatttatccgacattgaccaggatggcaaacttacagctgaggagttcatactggcgatgcatctcattgatgtagcaatgagtggacaacccttgcccccagtgttgccaccagaatacataccaccttcctttcggagggtgagaagcggcagcggaatctccgttatctcaagtacgtccgttgaccagcgtctcccagaggagcccgttctggaggacgagcagcagcagttggaaaaaaagttgcccgtgactttcgaggacaagaaacgggagaactttgaaaggggaaatctggagctcgagaaaaggcgccaagctttgctcgaacagcagcgcaaagagcaagagaggcttgcccagttagaacgcgcagagcaggagaggaaggagagagaacgccaagagcaagagcggaagcgccagctggaattagagaaacagctcgaaaaacagagagagctggagcggcaacgcgaggaggaacgacgcaaagaaattgagcgacgcgaagccgctaagagggagctggagcgacagagacagctggagtgggagcggaatagaagacaggagctcctcaaccaacgcaataaagagcaagaagacattgtggtccttaaagccaaaaagaagaccttggaatttgagttggaggctcttaacgataaaaagcaccaactggagggaaaactccaggatatccgatgtagacttacgacacagaggcaggagattgagagtacaaacaagagtcgtgagctcagaatcgcagaaatcacacacctgcagcagcaactccaggaatcccaacagatgctgggacggcttattcccgaaaagcaaatccttaacgaccagctaaagcaggtacagcagaattcactccacagggattcactggtgactcttaagcgggctctcgaagccaaggagttggcacgtcagcacctgcgggaccagttggacgaggttgagaaagaaacgagatctaaactgcaggaaatcgatattttcaataaccagcttaaggagctccgcgagattcacaacaagcaacaactacagaaacagaaatcaatggaagcagagcgactcaagcaaaaagaacaggagaggaagattatcgaacttgagaagcaaaaagaggaagcacagcgacgcgcacaggagagggacaagcagtggctagaacacgttcaacaggaggacgaacatcagcgtcctaggaaacttcatgaagaagagaagctcaagagagaggaaagtgtcaagaaaaaagacggcgaagagaaaggaaaacaagaggcgcaggacaagctgggacggctgtttcaccaacaccaggaacccgcaaaaccagcggtccaggcgccttggagcacagccgaaaagggccctctgactatatcagcgcaggaaaacgttaaggttgtgtattaccgggcactctacccctttgagagcagatcacatgatgaaattaccattcagccaggggatatcgtgatggtcaaaggcgagtgggtggacgaatcccagactggcgaacccggttggctgggaggggagctgaaaggaaaaaccggctggtttccggcaaattacgccgagaaaatccccgagaatgaagttcctgctccagtgaagcctgtaaccgattctacctcagctccagcaccaaagttagccttaagagaaactcccgctcctctggccgtgacatcctcagagccgtctacaactccaaacaattgggccgacttttcaagcacatggcctacgtccacaaatgagaaaccggaaacagataactgggatgcctgggctgcccagccttcattaaccgtaccatccgccggacaattgcgtcaacggagcgccttcacccctgccacagccacaggcagctcccctagccccgtattgggacagggggagaaggtggaggggctgcaggcccaagcgctttatccctggcgagccaaaaaagacaaccacctcaatttcaataagaatgacgttataacggttctcgagcagcaggatatgtggtggttcggggaagtgcagggtcaaaagggttggtttcctaagagctacgtaaagctgatttcaggccctatccgcaagagtacaagtatggattccggaagctccgagtcacccgcatccctgaaaagagttgcttctccggctgcaaaacccgtggtcagtggggaagaaattgcccaggtcatagcgtcatacacagctaccggccctgagcagctcacattagctcctggacagctaatcctaatacggaagaaaaaccccggaggttggtgggaaggcgagctgcaagcgagaggcaagaagcgtcagatcgggtggtttcccgcaaattacgtaaaactgctgagccccggaacaagcaaaattacccctacagagcctccaaaaagtaccgcccttgcggctgtgtgccaggtgattggcatgtacgactatacagcccagaacgatgacgagctggcctttaacaagggtcagattataaacgttctgaacaaagaggatccagattggtggaaaggggaggtcaacggacaggttggtctattcccatcaaattacgttaagctgacaaccgacatggacccctcccagcagtag

SEQ ID NO: 227303 - DNA, 5150 bp, Artificial Sequence
  Description of Artificial Sequence: Synthetic coding sequence
atggcgcagttcccaaccccgttcggtgggagtctggacatatgggcgataaccgttgaggagcgggctaagcacgaccagcagttccactccctcaaacccatctctgggttcataactggtgaccaggcccgaaactttttcttccagtcaggactaccacagcccgtcctggctcagatctgggcccttgccgacatgaataacgatggcagaatggaccaggttgaatttagtattgcaatgaaactgattaaactgaaacttcagggttatcaactccccagcgccttacccccagtcatgaaacagcaacctgttgctatcagcagcgcacccgcttttgggatgggcggaattgccagtatgccaccattgactgctgtcgctcccgtgcccatgggatccatcccggtcgtgggaatgtcgcctaccttggtttccagtgtccccactgctgcagtcccgccactagctaatggggctccccctgtgattcagcccctgcctgcatttgcccaccccgcagccaccctgcccaaatcatcttctttcagtcgctctggccctggcagccaacttaacaccaaattgcaaaaagctcagtccttcgacgtcgcctccgtcccacctgtcgcggaatgggccgtgccacagtcgagccgactgaaatatagacagcttttcaatagccacgataaaaccatgagtggccacctcaccgggcctcaagcacggaccatcctcatgcaaagcagtctaccgcaggcgcagctggcatccatctggaatctgagtgacattgatcaggacggaaaactcactgcggaggaattcattctggcgatgcacctcatcgacgtggcgatgagtggccagcccctgcccccagtgctgcccccagaatacatccccccaagctttcgcagagtccggagtgggtccgggatttccgtcataagctcaacaagcgtggatcagagacttcccgaggagcccgtactggaagacgagcaacagcagctagaaaaaaagctccccgtgaccttcgaagacaaaaaaagggaaaacttcgagagaggtaatctcgagctggagaaacgcagacaagccctgttagaacagcagagaaaagagcaggaacgtctggcccagttggagcgtgctgaacaggaacggaaagagagagagaggcaggagcaggagcggaagagacagctggagcttgagaaacagctcgagaagcagagagagcttgagcgccaacgagaggaggagagacgtaaggaaatcgaacgtcgggaggcagcaaaacgtgaattggagcgacagcggcagctggagtgggagcgtaatcgccgtcaagagctgctgaaccagcgcaataaagaacaagaagacattgtggtgctgaaagccaagaagaaaacgctcgaatttgagctcgaggctctgaatgataaaaagcatcagttggagggaaaactgcaggacataaggtgccgactaacgacgcagcgacaggagatcgagagtactaataaatctcgagaattgagaatcgctgaaattactcaccttcagcagcagctgcaggaatcccagcagatgcttggcaggctgataccagagaaacagatcctgaacgaccagctgaagcaagtgcaacaaaactccctgcacagagacagccttgtcaccctgaagcgcgcactggaggcgaaagagctcgctagacagcatctccgcgaccagctcgatgaggtcgagaaggaaacccgctccaagctgcaggaaatagacatttttaacaaccagctgaaggaactccgggagattcacaacaagcagcagttgcagaagcagaagtcaatggaggccgaaaggctgaagcagaaggagcaagaaaggaagatcatcgagctggaaaagcagaaggaggaggcacagcgcagggcacaggagagagacaaacaatggctggagcacgtgcaacaggaagacgaacaccaacgtccacgcaagctgcatgaggaggagaagctcaaacgggaggagtcagttaagaaaaaggatggggaggaaaaggggaaacaagaggctcaggataaacttgggcgtctgttccaccagcaccaggagcccgcaaagcccgctgttcaggctccgtggagcacggccgagaagggccctttgacaatctccgcccaggagaacgttaaagtggtatactatcgggcactgtatcccttcgagtcaaggtcacatgatgagattacgattcaacctggcgacatagtaatggtggatgaaagccagacaggcgagccaggatggctggggggtgagctgaaggggaaaaccggatggtttccagctaactatgcagaaaagattcctgaaaatgaagtcccagcccctgtcaagccagtgaccgactccacaagcgcccctgcgccaaaacttgccttgagggagactcccgcacctctggccgtcacttcaagcgagcctagcaccacccccaataattgggccgacttttcatccacatggcccacatccacaaacgaaaaacccgagaccgataattgggatgcgtgggccgctcaaccttcgctcactgtgcctagtgcgggacagcttcggcagaggtccgcctttacccccgcaaccgctaccggctccagccccagtcctgttctgggccaaggcgagaaggttgaggggttgcaggcccaagctctgtacccatggcgcgctaagaaagataatcatctaaacttcaacaaaaacgatgtcatcacggtgcttgaacagcaggatatgtggtggtttggcgaggttcagggccagaaagggtggttccctaagtcctatgtcaaactgattagcggacctattaggaaaagcacttccatggactccggatcttcagaatcccccgcttcactgaagagggttgcctcgccagctgcaaaacccgttgtgtcgggggaagaattcatcgccatgtacacatacgagagcagtgagcagggagacttgacattccagcagggcgatgtgattctggtgacgaaaaaagacggtgactggtggaccggaactgtcggggacaaagcaggtgtgtttccatcaaattatgttagactgaaagatagcgagggctccggcactgctggaaaaaccggctcgctgggcaaaaagccagagatcgcccaggttattgcatcatacacagcaacaggccctgagcagctcacattagcacccggtcaactcattctgattaggaaaaagaacccagggggatggtgggagggggaattacaggcacgtggtaagaaacggcagatcgggtggtttcctgccaattacgtcaaactactatctccgggtacgagcaaaatcactcccactgaacctccgaagagcactgctctggcagcagtgtgtcaagtgatcggcatgtatgattacaccgcacagaatgatgatgagctggccttcaacaaggggcagatcattaacgttttgaacaaagaggacccagactggtggaaaggcgaagtaaatggacaggtaggtctatttccatccaattacgttaagctgactacagatatggacccatcgcagcagtggtgctctgacttacacttactcgatatgttaacccccacagagcgtaagcggcagggatacattcacgagttgatcgtgacagaggagaattacgttaacgacctacagttggtaaccgaaatattccagaagcccctcatggagagcgaactcctgacagagaaagaggtcgcaatgatcttcgtaaattggaaagagctgataatgtgcaatataaagctgctaaaagctctgcgcgtgaggaaaaagatgagtggagagaaaatgccagtgaaaatgatcggcgacatactgtcagcccagctgccccatatgcagccctacataaggttttgctctagacagttaaacggggcagcacttatccagcaaaaaacggacgaagcaccagactttaaagagttcgttaagcggctcgcgatggaccctagatgcaagggcatgccgctgagtagtttcatcctaaaacctatgcagcgagtcacgcgttacccactgatcatcaagaacatcctggagaacacgcccgagaatcatcccgatcactctcatcttaagcacgcgctagaaaaagctgaggaactgtgttcgcaagtcaacgaaggagtgcgcgaaaaggagaattcagatcgccttgagtggatccaggctcacgtccaatgcgaagggctctctgagcaacttgtgtttaatagtgttaccaattgcctaggtcctcggaagtttttgcattcgggcaagttgtataaagccaagtccaacaaagagctgtatggtttcctgtttaatgattttctcctgctgactcaaatcaccaagcccctcggctctagtggaacagacaaagttttctcacctaagtctaacctccagtacaagatgtacaaaacaccgatatttctcaacgaggtattggtcaagctaccgaccgatcctagtggcgacgagcctatttttcacattagtcacatcgatcgggtctacacacttcgagctgagtcaatcaacgagaggaccgcctgggtgcagaagataaaagccgctagtgagttatatattgaaaccgagaaaaaaaagcgggagaaggcgtatcttgtcagatcacagcgtgcgacagggatcggacgcctgatggtgaacgtagttgagggcatagagttgaaaccctgcagatctcatggaaaatcaaacccctattgcgaggtcaccatgggtagtcagtgccacatcacgaagactatccaagatacgctcaatcccaagtggaactctaattgtcagttcttcatccgggacttagaacaggaggtgttgtgtattaccgtgttcgagcgagatcaattttcccctgatgacttccttggaaggaccgagatacgagtggcagatatcaaaaaggatcaggggagtaaagggcctgtgacaaaatgcctgctcctccatgaggtcccgaccggagaaattgtcgtgaggctggatctccagctgttcgatgaaccata

SEQ ID NO: 227304 - DNA, 4983 bp, Artificial Sequence
  Description of Artificial Sequence: Synthetic coding sequence
atggcccagttcccaaccccgtttgggggtagcctggacatctgggcaattacagtggaggaacgagcgaagcacgatcagcaattccatagcctaaaacccataagcggctttattaccggcgatcaggcacgtaattttttctttcaatccggcctgccccagcccgttctcgcccaaatctgggccttggccgatatgaacaacgatgggaggatggaccaggtagaatttagtattgcaatgaagctaatcaaactgaaactccaggggtaccagttgccaagcgccctgccccctgtcatgaagcaacagcccgtggcaattagctctgcgcctgctttcggtatgggaggtatagctagcatgcctcccctgacggcagttgcacctgtccccatggggtccatccctgttgtgggtatgtcacccactctggtgtcaagcgttccgacggcagcagtgcctccattagcaaatggggcaccaccagtgattcaaccactacccgctttcgcccaccctgccgctacattacctaaatcgagcagtttctctcgcagcgggcctgggtctcagctcaacaccaaacttcagaaggctcaaagttttgatgtggcctcggtacccccagttgccgagtgggccgtgccacaatctagtcggcttaagtacaggcaactatttaatagccacgataaaaccatgtcggggcacttgaccggtccacaggcacggacgatcctaatgcagagctccttgcctcaggcccagctggcttccatctggaatctctccgatattgatcaggacggaaagctcactgctgaagaatttattttagccatgcatttgattgacgtagccatgtcagggcaacctttgccccctgtccttcctccagaatatattcctccatccttccggcgtgtgcgctcggggagcggcatttccgttatttccagcaccagcgtggaccaacgcttaccagaagaaccggtcctcgaggatgaacagcagcagctcgaaaagaagttacccgtaacattcgaggataagaaaagagagaatttcgaacggggaaacctggagctggaaaagcggaggcaggcacttttagagcagcaacggaaggaacaagagcgcttagctcagctggagcgggctgaacaggagcgcaaggaacgtgagcggcaagagcaggagcgaaagcggcagctcgaactagaaaaacagcttgaaaagcagcgggagcttgagagacaacgggaagaggagcggaggaaagagatcgaacggagagaggccgctaaaagagagctggaacggcagagacagttggaatgggagcggaaccggaggcaagagctgctgaaccagaggaataaggagcaggaggatattgtggtgcttaaggcgaagaagaagacactggagtttgagctagaggctctaaacgataaaaaacatcagctcgaaggtaagctccaggatattcgatgcaggttgacaactcagaggcaggaaatagaatcaacaaataaaagcagagagctgcggattgcggagatcacacacctgcagcagcaacttcaggaatctcagcagatgctaggccgtttaatccccgaaaagcagattcttaacgaccagctgaaacaagtgcagcaaaattcactccatcgggactctctggtgactctgaaacgggcattggaggcaaaagagctcgctaggcagcacctgagagaccaactggatgaggtcgagaaagagacgcggtcaaagttacaagagatcgatatctttaacaaccaactcaaagagttgagggagatacacaataagcaacagctccagaagcagaagtctatggaagcggagaggctgaagcagaaggaacaagagagaaaaatcatcgaactggaaaaacagaaagaggaagcacagagacgagcccaggaacgagacaaacagtggttggaacatgtgcagcaggaggacgaacaccagcggcctcgaaaattgcacgaggaggaaaaactgaaaagggaagagtctgtgaaaaagaaggacggggaggagaaagggaagcaagaggctcaggacaagctgggccgactcttccaccagcaccaggaacccgcaaaacctgctgtacaagcaccttggtcgacagcagagaaagggcctctcacgatatccgcgcaagagaatgtgaaagtcgtctattaccgcgcactgtatccgtttgagtccaggtcacacgacgagatcacaattcagccaggagatattgtcatggtcgacgagtctcagactggagaacctggatggttaggcggtgaactcaagggaaaaacgggttggttccctgctaattacgcggagaagataccagagaatgaggtgccagcccctgtgaaacccgtgactgactctacctccgcacctgcgccaaagttggccctgagagagacaccagcaccattggcagtgacctccagcgagcctagcactactcccaataattgggccgacttttcatccacttggccaacatcgaccaatgagaaacccgagactgataattgggatgcctgggcggctcaaccttcactgacggtgcctagcgccggacaacttcggcagcggtccgccttcactccagccacggctacgggctcctcaccatctcctgttctcggccagggggagaaagttgaggggctacaggcccaggccctttacccatggcgggctaaaaaggataatcacctgaatttcaataaaaacgacgtgatcaccgtgttagagcagcaggatatgtggtggttcggagaagtccaagggcaaaagggatggtttcccaagagttacgtgaagcttatttccgggcctattcgtaagtccactagcatggacagcggcagttctgagtctcctgcgtcactcaagagagtcgcttcccctgctgctaagccagtggtgtctggagaagaatttatcgccatgtacacatatgagtcttcagagcagggcgatcttacattccagcaaggtgacgtcatattggttaccaaaaaagacggggattggtggacagggacagtgggagataaggctggcgtgtttccttcgaattacgttagactgaaggattcagaagggtcaggaaccgcgggaaagacgggtagcctcggaaagaagcctgagatcgctcaggtcatcgcgtcttatactgcgacaggccctgagcagctgacattagctccgggacagctcatcctgatccggaagaagaatccgggtggctggtgggagggtgagctgcaggcaagaggtaagaagcgacagattggctggttccccgctaactatgtgaaactcctgagtccaggaactagcaagatcactcccaccgaacctccgaaatcgacagcactggctgctgtgtgccaggtcatcgggatgtatgactacaccgctcagaatgacgatgaactggcctttaacaaaggccagatcataaacgtgctgaacaaggaggatccagactggtggaaaggggaggtgaatgggcaggtgggcctgtttccgagcaactatgtcaagctcaccaccgacatggatccgtctcagcagtggtgctcagatctccacctgcttgacatgctgacaccgacagagaggaaaaggcagggatacatacacgaactgattgtaactgaagaaaattatgtcaatgatctgcagctggtgaccgaaatttttcaaaaacctcttatggagtctgaactgctgactgagaaggaggttgccatgattttcgtcaattggaaggagcttatcatgtgcaatataaaacttctgaaagctctaagagtgagaaagaagatgtctggagagaagatgcccgtcaagatgatcggtgacatcttgagcgcacagcttcctcacatgcagccttatattagattttgtagtaggcagctaaacggcgctgcgctcatccaacaaaagaccgacgaagctccagacttcaaagaattcgtgaaaagactggcaatggatcctcgttgtaagggcatgcccctctcttcattcatcctcaagccaatgcagagggtgacgaggtatcccctgatcattaagaatcagctcgtattcaacagcgtgacgaattgtctgggccctaggaagtttcttcacagcggcaagctctacaaggccaagagcaacaaagaactctacggctttctatttaacgacttcctgctcctgactcaaattacaaaaccactggggtcctcaggcacagataaggtgtttagtcccaaatccaatctccaatataaaatgtacaaaacacccatttttttaaatgaagtattagtaaagctcccaaccgatcccagcggggacgagcctatcttccatatttctcacattgatagggtatataccctccgagctgaatcaatcaacgaaagaaccgcctgggttcagaaaattaaggcggcttccgaactgtatattgagaccgagaagaagaaaagggaaaaggcctacctggtgagatcccagagggccaccggcattggccgattgatggtaaatgttgtcgagggcattgaactaaaaccctgtagaagtcacgggaagtctaatccatactgtgaggtgaccatgggttctcagtgccatataacgaaaacaatccaggatacactgaatccaaaatggaacagcaactgtcagttctttatccgggatctggaacaggaggttctttgcatcactgtgtttgagagagaccagttttcaccagacgatttcctcggacggacagaaattcgggttgccgatataaaaaaagaccagggatccaaaggaccagtcaccaagtgcttgctgttgcacgaagtacccaccggcgagatagtcgtgcgcctggatctgcagctctttgacgagccttag

SEQ ID NO: 227305 - DNA, 348 bp, Artificial Sequence
  Description of Artificial Sequence: Synthetic coding sequence
atggcccagttccctacacctttcggtggaagtctagatatctgggcaataaccgttgaagaacgggctaagcatgaccagcagttccacagccttaaacctatctcagggttcataaccggggatcaagcgcgaaacttcttttttcagtccggattgccacagcccgtgttagcacagatctgggcactagccgacatgaataatgacggccgaatggatcaggttgagttttctatcgcgatgaagctgattaagctcaagttgcaaggttatcagttaccttctgcgctgcctccagtcatgaaacagcagccggtcgcaatctcatcggctccagccttctag

SEQ ID NO: 227306 - DNA, 237 bp, Artificial Sequence
  Description of Artificial Sequence: Synthetic coding sequence
atggcccagtttccaacgcccttcggagggagccttgatatatgggcaatcacagtggaggagcgcgcaaaacatgatcagcagtttcacagtctgaagccgataagcggattcatcacaggagatcaagcaaggaacttcttcttccagtccgggctcccacaaccagtactagcccagatttgggcactggccgatatgaacaatgatggcaggatggatcaggtagagttttag

SEQ ID NO: 227307 - DNA, 5093 bp, Artificial Sequence
  Description of Artificial Sequence: Synthetic coding sequence
atgatggcccaatttccaactgccatgaacggcggacccaacatgtgggctattacctcggaggagcgcaccaagcatgatagacagttcgacaatttaaagcctagcggagggtatatcacaggggaccaggctagaaactttttcctccagtcgggcctgccagcccctgtcctggcagagatttgggctctgagtgatctcaataaggatggaaaaatggatcaacaggagtttagtatcgccatgaagctgataaagctgaaacttcaaggtcagcagctgccagtcgtccttccacccatcatgaaacaacctcccatgttcagcccgcttattagcgctcgttttggcatgggctccatgcccaacttaagcattccacagcctctccccccagctgccccaattacttctctatccagcgccacctctggtacaaatctgccaccccttatgatgcctacgccactggtaccttccgtaagcacatcatcactgcccaatggcaccgcctccttgatccagccacttcccatcccgtacagcagctctacgttgccccacgggtcatcctactcactgatgatgggcggattcgggggtgcttccatacagaaagcacagtcactgatcgaccttggctcttcctcttcaacttctagtactgcctcacttagcggtaatagtcccaaaaccgggacatctgagtgggcagtgcctcagcctacccgactgaaatatagacaaaagtttaacaccctggataagtccatgtctggttacttatcaggtttccaggcccgtaatgctctcctgcagtctaatctcagccagacacagctcgcaaccatatggactctggcggacgtggacggggacggccagctgaaggccgaggagtttattctggcaatgcatctcacagacatggctaaagctggacagcccctgcctttaaccctgcctccagagctagtgccaccttcgttcagaggaggaaagcagatagactctattaatgggaccctgccctcttatcagaaaatgcaggaggaggaaccccaaaagaagctgcccgtgacatttgaagacaagcgcaaagccaattatgagcgcggtaatatggaactcgagaaacggagacaggcactgatggaacagcagcagcgggaggccgagaggaaggctcagaaggagaaagaggaatgggaaagaaaacaacgtgagctgcaagagcaggagtggaaaaaacagcttgagttagagaagcggctggagaagcagagggaactggaacgtcaaagagaggaagaacggcgtaaggatattgaacggagggaggcagccaagcaagagttggaaagacagcgcaggctggagtgggaacggattcggagacaggagcttctcaaccagaaaaaccgggagcaggaagagatcgttaggctgaactcgaagaagaagaacctgcacttggagttagaggccctgaacggcaaacaccagcagatctctggacggcttcaggacgtgcgcctcaaaaagcaaacccaaaaaaccgaactggaggttcttgacaagcagtgcgatttagagataatggagatcaagcagcttcaacaagaactacaggagtatcaaaacaagctgatttaccttgtccctgagaaacaattactaaatgagaggattaagaatatgcaattctcaaacactcccgatagcggagtgtccctgttgcacaaaaaaagcttggagaaagaagagctgtgtcaaaggcttaaggaacagctggacgccctcgaaaaggagactgccagcaagctttcagagatggattcctttaacaaccagctcaaatgcggtaacatggatgattctgtgcttcagtgcctgttgtcattactttcttgtctaaacaacctgttcttgctcctcaaggaactcagggaaacatacaacactcaacagctggccttggagcagctgtataaaattaagcgggacaagctgaaggaaatcgagcgaaaaagactcgaactgatgcaaaaaaaaaaattagaagatgaggccgctagaaaggctaagcagggcaaggaaaacttgtggaaggaaaacctccggaaagaggaggaagaaaaacagaaacgcctgcaggaggagaaaacacaggaaaagatccaggaagaggaacgtaaagctgaggagaaacagcgaaaggataaggatactcttaaagctgaagaaaaaaagcgagagacggcatccgtgctcgtaaattacagagccctgtatccctttgaggccagaaaccatgatgagatgagctttaactcaggtgacattatccaggtggacgagaagaccgtcggggaaccagggtggctctacggctccttccaggggaatttcggctggttcccttgtaactatgtagaaaaaatgccttccagtgaaaatgagaaggccgtgagtcccaagaaggccctgctgcccccaactgtgtctctaagcgctactagcacgtctagcgagcctctgtccagcaatcagccggcttctgttactgactaccagaacgtgtcattttccaacctcaccgtcaatacctcctggcagaaaaagtccgccttcacaaggacagtttcacccggaagcgtgagccctattcacggacagggccaggttgttgagaatctcaaggctcaagccctgtgcagttggactgccaaaaaagataaccatctcaattttagcaagcatgacatcatcacagtcctcgaacagcaggagaattggtggtttggcgaagtgcatggtggcagaggttggttcccaaaatcatatgtcaagatcatcccgggatcagaggtcaagcgcgaagaacctgaggcactgtatgctgcggtgaacaaaaagccaacctctgccgcttatagcgtaggtgaggaatacatcgccctgtacccatacagtagtgtagagcccggagacctgaccttcacagaaggcgaggagattttggtgacccagaaagacggagaatggtggacgggcagtattggtgataggtccggtatttttccaagcaattacgtgaagcccaaagaccaagagagctttggaagcgcaagtaaaagtggggcatcaaataagaaaccggagatagcacaagttacctccgcctatgtggcttctggcagtgaacagctgtctctggcgccaggtcagttaatcttgatcttgaaaaagaacacatcgggctggtggcaaggcgagctacaagccaggggcaaaaagcggcagaagggctggttccctgcctctcacgtgaagcttctgggtccctctagcgaaagagccacaccagcgtttcaccccgtgtgtcaagtaatcgcaatgtacgactacgccgcaaataatgaggacgagctgtccttttcaaaaggacagctgattaatgtcatgaacaaggatgaccccgattggtggcagggagagatcaacggcgtcaccgggcttttcccgagcaattacgtgaaaatgacaactgatagcgatcctagccagcagtggtgtgctgacctacagacactggacacgatgcaacctattgaaaggaaaagacagggatacatccatgagctgattcaaacggaggaacggtacatggccgacctgcagttggtcgtggaagtgtttcaaaagaggatggctgagagcggtttcttaaccgagggggaaatggctctaatctttgtcaactggaaagagttgatcatgagcaacaccaagctgctgaaggccttgagggtgcggaaaaaaacgggcggagagaagatgcccgtccaaatgatcggggacatcctggctgcagagctgtcccatatgcaggcttatataaggttctgctcatgtcaactgaatggcgcagcgctattgcagcaaaaaaccgacgaagacactgacttcaaggaatttttaaaaaagttggctagtgatccaagatgtaaaggtatgccactatccagcttcctgctcaaacccatgcaaaggataacacggtatccgttgcttatcaggtctattctggaaaacaccccagaatcccacgcagatcactccagtcttaagctcgctctggaacgtgccgaagaactttgttcacaggtaaacgagggcgtcagagagaaggaaaattccgatagactcgaatggattcaggctcacgtgcagtgtgaaggtttggccgagcagctgatcttcaacagtttaaccaattgtctagggcctcgaaaactgttacatagtggaaagctctacaaaacaaagagcaataaagagctgcacggcttcctattcaacgacttcctgctgctaacttatatggtgaagcagttcgccgtgagttcagggagtgagaagctattttcaagtaagtcgaacgcccagttcaaaatgtataagacccccatattcctcaacgaagtgctcgtgaaactcccaaccgaccccagttccgacgaacctgtatttcacatctcgcacatagatcgggtgtacacccttcggacagacaacattaacgaacgtactgcttgggtgcagaagattaaggccgcttccgaacagtatatagatacagagaagaaaaaaagggaaaaggcataccaggcacggtctcaaaaaacgagtggaatcgggcgtctgatggtacacgtaatcgaagcaacggaactgaaggcctgtaagcccaatggaaaaagtaatccatattgtgagatctccatgggcagccaaagctatactacccggaccatacaagacacgttgaatccgaagtggaattttaattgccagtttttcattaaagatctctaccaggacgtgctgtgtctcaccctcttcgatcgagatcagttttcacccgacgactttctgggcagaaccgaaatcccagtagccaagattaggaccgagcaggagtcaaagggccctatgacccgacgccttctcttgcacgaggtgcctacaggtgaagtatgggtgagatttgacctgcaattatttgagcagaaaaccctgttata

SEQ ID NO: 227308 - DNA, 5013 bp, Artificial Sequence
  Description of Artificial Sequence: Synthetic coding sequence
atgatggcccaattccccacagctatgaatggtgggcctaatatgtgggctatcacaagcgaagaacgcacaaaacacgatcggcagtttgacaatttaaagccctctggaggttacatcaccggggaccaggccaggaacttctttctacagtcagggttgcctgccccagttttggcagaaatttgggccctgtctgacctcaacaaagacgggaaaatggatcaacaggaattctccatcgccatgaaactgatcaagctgaaactgcagggacagcagctcccggttgtgctgccccctatcatgaagcagccacccatgttttcccccttgatttccgcccgtttcggaatggggtccatgccaaacctgagtatccctcagcccctccctcccgcagccccaattactagcttgagttcggccacatcgggtacgaacttgccacccctgatgatgccgacacccctggttccatcggtgtccacctccagtctgcccaacggcactgccagtctgattcaacctctgccgatcccgtactcatcttcgactctgccccatgggagctcctatagtttgatgatgggcggatttggcggtgccagtattcagaaagctcagagcttgattgacctcgggtctagctcttcgacttcatcaaccgcaagcctgtctggaaattccccgaaaacaggcacatccgaatgggctgtcccacagcccacaaggctcaagtacaggcagaaattcaacactttggacaagtctatgtctggatacctgtcaggattccaggccaggaacgccctgctgcagtcaaatctgagtcagacccaactggctaccatttggacactggccgatgtggacggggacggacagctgaaggcggaagagtttatcctcgccatgcacctgactgatatggctaaagcgggacagccgcttcccctcactcttcctcccgagcttgtcccaccctctttccggggtggaaagcagatcgactccataaatgggaccttgccatcttaccagaaaatgcaggaggaggagcctcagaagaagttaccagtgacatttgaggataagcgcaaggctaactatgagaggggtaatatggaactggaaaagagacggcaggctctcatggaacaacagcagagggaagccgagagaaaggcacaaaaagaaaaggaggaatgggaacgtaagcagcgcgaactacaggaacaggagtggaagaaacagctcgagttggaaaagagattagaaaagcagcgcgagttggaaagacagcgtgaagaggaacgcaggaaggatattgagagacgagaagcggctaaacaggaactggagcgacagagacgcctcgagtgggagcggataaggcggcaggaattgttaaaccagaagaatagggaacaggaagagattgtgcggctaaatagcaagaagaagaatctgcacctagagctcgaagccctcaacgggaagcaccagcagatctcaggcaggctccaggacgtacgcctcaagaaacagacacaaaaaaccgagctagaagtgttggataaacagtgcgacctcgagataatggaaatcaaacagttgcagcaggagctacaggagtatcagaataagctgatctatttagtgccggaaaagcagctcctaaatgagcgtattaagaacatgcagttttcgaatacgccagactccggagtctccctgctgcacaaaaaatctctggagaaagaggagctctgtcaacggctgaaggagcagttggacgctctggagaaagaaaccgcgtctaaactatctgaaatggacagctttaataaccagttgaaggagcttagagagacctataacacccagcagttggccctggaacagctgtataaaataaaacgggataaattaaaggaaattgaacgtaaaaggctagagttaatgcagaaaaagaagctggaagatgaggccgctcgaaaggccaaacagggcaaagagaacctttggaaagagaaccttcgaaaggaagaggaggagaaacaaaaacggttgcaggaggagaagacacaggagaagattcaggaagaagagcgaaaggccgaggagaagcaaagaaaagacaaagacaccctgaaggcagaggaaaagaaacgcgagacagcctctgtgttggtcaactatagagcgctctatccctttgaggccaggaatcatgacgagatgagttttaacagcggggacattatccaggtggacgaaaaaacagttggagaacccggttggctctatggttctttccagggcaatttcggatggttcccctgcaattatgtagaaaaaatgccgtcttcggagaacgagaaagccgtttctcccaaaaaggctctgctgcctcccaccgtgagtttaagtgcaacgtcaacaagcagtgagcccctgagttcaaaccaacctgctagcgtaacagactaccaaaatgtctctttctccaatctgaccgtgaatacaagttggcagaagaagtctgccttcactcggactgtgtctcccggatccgtttcccccattcacggtcagggccaggtggtcgagaatctgaaagcccaggcgctatgctcgtggacagccaagaaggacaatcaccttaactttagtaaacatgatatcatcacggtgctcgaacagcaggagaactggtggttcggtgaggtgcacgggggacgaggatggttcccgaagtcctacgttaaaattattcctgggagcgaggtcaagagagaggagcctgaagccctgtatgctgcggttaacaagaagccgaccagcgcggcttacagcgttggggaggagtatattgctctgtacccctactcttctgtggagccgggagaccttacctttactgagggagaggaaatcttggtgacgcaaaaggacggagagtggtggacaggaagcatcggtgatcggtctgggattttcccaagcaactacgtcaagcctaaagatcaggagagtttcggttccgcctccaagtcaggcgcatccaataagaaacccgaaattgcgcaggtgacatctgcatatgtggcttctggctcagaacagttgtcactagctccaggccagctgattctgatcctgaaaaagaatacctctggctggtggcaaggcgagctacaggccagaggtaagaagcggcagaaaggctggttcccagctagtcatgtgaagctgctcggccctagcagcgagcgagcaactcccgctttccacccagtgtgtcaggtgatcgccatgtatgattatgcagcaaacaatgaagacgaactctcgttcagtaaaggacagttaatcaacgttatgaacaaggatgacccagattggtggcagggggaaatcaatggtgtcaccggcctgtttccaagtaactatgtgaagatgactacagattctgatccatcgcagcagtggtgcgcggacctgcagaccctggatacaatgcaaccaatcgagagaaagcggcagggttacattcatgagctgattcagacggaagagaggtatatggctgatctgcagcttgtggtggaggtgtttcaaaagcggatggctgagtccggcttcctcacagagggagagatggctcttatcttcgtcaattggaaagagctgatcatgtccaatacaaagctcctcaaggcgctgagggtgaggaaaaagactgggggtgagaaaatgcctgtgcagatgataggggatatccttgctgctgagctaagtcacatgcaagcctatatacggttttgtagttgtcaactgaatggagcagctttgctgcagcagaagacggacgaagacacggactttaaggaattcctgaaaaaacttgcatctgaccccaggtgtaagggcatgccgctcagctcttttctgctaaagcccatgcaaagaattaccagatatccactcctgatccggtccattttggaaaacactccagagagccacgcagatcatagctcccttaagctcgccctggagcgggcagaagaactgtgcagtcaggttaatgagggggttcgtgagaaggaaaattccgataggctcgagtggatacaggcccacgtgcagtgtgaaggacttgccgagcagctaatttttaactccctgactaattgtctggggccacgtaagctgcttcactccggtaaactgtacaaaactaaatccaataaagagctgcatgggtttctgtttaacgatttcctcctcctgacgtacatggttaaacagttcgctgtttccagtggctctgaaaagcttttctccagcaagtcgaacgctcaatttaaaatgtataagacccccattttcctgaacgaggtgctggtgaaactccctactgacccctcctccgacgagcctgtatttcatatctcccacattgacagggtgtacaccctgaggaccgataatatcaatgaacgaactgcatgggtccaaaagattaaggcagcatcagagcagtatatcgacaccgagaaaaaaaagcgcgagaaggcctaccaggccaggagtcagaaaactagcggaattggccgactcatggttcatgtcatcgaggctacggaactcaaagcttgtaagcctaacggtaagtcgaacccctactgcgaaatctcaatgggcagtcaatcgtataccacccgcaccatacaagacactctcaatccgaaatggaatttcaactgccagttttttattaaagacctctatcaagacgtactttgtctgacactgtttgacagagaccagtttagccccgacgactttttgggaaggaccgagatccctgtcgccaagattcgtaccgagcaggagagtaagggaccaatgactcgacgcctgctcctgcatgaagtccctacaggagaagtgtgggtgcggtttgatcttcagttattcgagcaaaaaacattgctgtag

SEQ ID NO: 227309 - DNA, 5012 bp, Artificial Sequence
  Description of Artificial Sequence: Synthetic coding sequence
atgatggctcagtttcctacggcaatgaacggcggacctaatatgtgggctatcacctcagaggagaggacaaagcatgatagacagttcgacaacctcaaaccgtccgggggttatataacaggagaccaggcccgaaatttcttcttgcagagcggattaccagccccagtgcttgccgagatatgggcgctctcagacctgaacaaagacgggaaaatggaccagcaggagttctcaattgcgatgaagctgattaagctgaaactgcagggccaacaattgccggttgtactcccccctattatgaaacagcccccaatgttctcacccttgatctccgcacgatttggtatgggtagcatgcccaacctgagtatcccacagcctctaccccctgccgcacccatcacatccctgagcagcgccacaagcggcaccaacctcccccctttgatgatgcccaccccactggtgcccagtgtgtcaacctcctctctgcccaacggcacggcgagtctgattcagccactgcccatcccatatagctccagcacactgcctcacggatcttcctacagcctgatgatgggaggctttggaggggcatctattcagaaagcgcaatcacttatcgacctcggcagctcgagctccacctccagcaccgcgagtcttagcggtaacagccctaagacaggcacctcagaatgggccgtgccgcagcctacccggctgaaatatcggcaaaaattcaatactctggacaagagcatgtctggatatctgtctgggttccaggcacgtaatgccctgttgcagtctaacctgagccaaacccagctagccactatctggacactggcggatgtagacggtgatggtcagctgaaggctgaagagttcatactggcaatgcacctcaccgacatggccaaagcagggcaaccattacccctgacactgcccccagagctggtgcctcctagtttccggggaggcaagcagatcgattcaataaatggaacactgccgtcctatcagaagatgcaagaggaggaaccgcaaaagaagctgcccgtgaccttcgaagacaagagaaaggccaattatgagcgcggaaatatggagctcgagaagagacggcaggcgctcatggaacaacagcaacgggaggctgagaggaaagcccagaaagaaaaagaggagtgggagcggaagcagcgcgagctgcaggagcaggaatggaagaagcagctggaactggagaaacggttagagaaacaaagagaactggagagacaaagagaggaggaacgtaggaaagacatcgaaaggcgggaggccgctaaacaggaactggagaggcagcgaagattggaatgggagagaatccggagacaagaactcctgaaccaaaagaaccgggaacaggaggagatcgttagactaaattccaagaagaagaacctgcacctggagctggaggccctgaatggaaagcaccagcagatttccggacgccttcaagatgtacggctgaaaaaacagacccagaagacggagcttgaggtcctcgataagcaatgtgatctggagattatggagataaagcagcttcaacaagaacttcaggaatatcagaataagctgatttatcttgtccctgaaaagcagcttcttaacgaacggattaaaaacatgcagtttagtaacacaccggatagcggcgtgtcactgcttcataagaaatctcttgagaaggaggagctttgccaaagactcaaagagcaactggacgcactggagaaggaaactgcaagcaagttgtccgagatggacagttttaataatcagctcaaagagctcagagagacttacaacacccaacagctggctctcgaacagctttacaagatcaagcgagataaactcaaagagattgagcggaaaaggctcgaactcatgcaaaagaaaaagctcgaggatgaggcggcacgcaaagccaagcaggggaaagagaacttgtggaaagaaaacctcagaaaagaggaagaggaaaaacagaaaaggttgcaggaggagaagacccaggagaagatccaggaggaggagcgaaaagcggaggagaagcagagaaaagacaaggatactctcaaggccgaagaaaagaagagagaaactgcttctgtgctcgtgaactacagagccttgtacccttttgaggcacgcaatcacgatgaaatgtctttcaatagcggtgatatcatacaggtagatgaaaagaccgtgggagaaccaggctggctttatggcagctttcagggaaactttggttggtttccatgtaattacgtggaaaagatgccgtcttccgagaatgaaaaagctgtaagtcccaagaaggctttgctgcctcccacagtctcactctccgcaaccagtacatcaagtgaaccgctcagtagcaaccagcccgctagcgtaaccgactaccagaacgttagctttagcaatctgaccgtcaatacgagttggcagaaaaaaagcgcctttacgcgaaccgtgtcccctggcagcgtcagccccattcatgggcaaggtcaggttgttgagaatctgaaggcccaggccctgtgttcatggacagccaagaaagataaccatctgaacttctccaagcacgacatcataactgtactggagcagcaggagaactggtggttcggtgaggtacacggcggtcggggatggttccctaaatcctacgtgaagattattcccggttcggaggttaaacgggaagaacctgaagcactctacgctgctgttaacaaaaagcctaccagcgcagcttactctgtaggcgaagagtatatagctctgtatccctattcctccgtcgaaccaggggatctaactttcaccgagggcgaagaaatccttgtgactcagaaggatggagagtggtggactggctctatcggcgatcggtcaggcatcttccctagtaactacgtgaagccaaaggatcaggagtcctttgggtccgcatccaagagtggtgcttcaaacaagaaaccggagattgctcaggtgacctcggcctacgtggcctcgggttccgaacagctgtcgctggcacccggacagctgatattgatcttgaaaaagaatacctcaggttggtggcagggagaactgcaggccagaggcaagaaacgtcagaagggatggttccctgcttcacatgtgaagctgctgggcccaagttcagagcgggctacaccagccttccatcccgtgtgtcaagtaatcgcgatgtacgattacgctgcaaacaacgaagatgagctcagtttctcaaagggccagctgatcaacgtgatgaacaaggatgatccagattggtggcagggtgagatcaacggcgtgactggactcttcccttctaactacgtcaagatgacgaccgactccgacccatctcaacaatggtgtgctgacttacagaccctcgacaccatgcagccgattgaaagaaaacgccaaggctatatccatgagcttattcagaccgaggaaagatacatggcggaccttcagctcgttgtggaggtcttccaaaaacgaatggccgaatcaggctttttgacggagggcgagatggccctcatttttgtgaattggaaagagctcattatgagcaacaccaaactgcttaaagctctgagggttcggaaaaagactggcggtgagaagatgcctgttcagatgattggcgatattctggccgcagaactcagtcacatgcaggcatacatccgcttttgcagctgtcagctgaacggcgcagcactcctacagcagaagaccgatgaagatacggacttcaaggaatttttgaaaaagctggcttcagatcctcgctgtaagggtatgcccctgtcctcatttctactaaagcccatgcagagaatcacaagatacccactccttatcagaagtatcctggagaacacacccgaatcgcatgcggaccactcgagcctgaagttggcacttgaacgggcagaagaactgtgctcacaggtaaacgagggcgtgagggagaaagagaactcggataggctggaatggatccaagcgcacgtgcaatgcgagggtctcgctgagcagctgatctttaatagcttgacaaactgcttgggcccaagaaaactgctgcactccggaaaactttacaagactaagtccaataaggagttgcatgggttcctgttcaatgatttcctgctgctgacgtatatggtgaaacaattcgccgtttcatctggctccgagaaacttttcagttccaagagtaatgcccagtttaagatgtacaagactccaatcttccttaatgaggttctcgtcaaattacctaccgaccccagcagcgacgagccagtgttccacatttcccatattgatagggtgtacactctccggactgacaacattaacgaacggactgcgtgggtgcaaaaaatcaaagcggctagcgaacaatatatcgacacagagaagaaaaagcgagaaaaggcctatcaggcccgtagccagaagacgtccggtattggcaggctgatggtccacgtcatcgaagccactgagctgaaagcttgtaaaccgaacggtaagagtaacccatactgtgagatctctatgggatcccagagttataccacacggacaatccaagacaccttaaaccctaagtggaactttaactgtcagttctttatcaaagatctgtaccaggacgtgttgtgcctgacgctttttgaccgagaccagttctcccctgatgattttctgggcaggaccgagatcccagtggcaaaaattagaaccgagcaggagtcgaaagggccaatgactaggcggcttctgctgcacgaggttcctacaggtgaggtttgggttagattcgacttgcagctgtttgaacagaaaacactcctgta

SEQ ID NO: 227310 - DNA, 1836 bp, Artificial Sequence
  Description of Artificial Sequence: Synthetic coding sequence
atggctcagtttcctacggctatgaacggcggtcccaatatgtgggcgatcacatctgaggagcgcacaaaacacgatcgccagtttgataacttaaaaccaagcggcggatacatcacgggagatcaggccaggaacttcttccttcagagcggcctgcctgctccagttctcgccgagatttgggccctcagtgatctaaacaaagacgggaagatggaccagcaagagttcagcattgcgatgaagctgataaaattgaaattacaaggacaacagctccccgtcgtgttgccaccaataatgaaacagccgccaatgtttagccctctcataagtgctcgtttcggcatgggttctatgcccaatctgtcgattcctcagcccctgccacccgctgcgcctattaccagcttatcaagtgcgaccagcggtaccaatctaccccctctcatgatgcctactcctttggtcccaagtgtttctacatcctcccttccaaacggcaccgctagcctcattcagcccctccccatcccttacagctcatccaccctaccccacggctcatcgtatagccttatgatggggggttttggaggggctagtatccaaaaggcgcagtcacttatcgacctgggatcttctcggtcctggtcttcgggttcatctgctcacagccctgctacccaccgcgctcctttgtccagccctgtccccaactcatccacttccagcacagcgtcattgtctggcaatagtcccaaaaccggcaccagcgagtgggccgtgccacaacctacaagactcaagtatcgccagaaatttaacacactcgacaaatcgatgtctggatacctttctggatttcaggcacgaaacgctctgttgcagagcaatttatcccagactcaacttgcaacgatatggactctggctgatgtggacggtgacgggcaactcaaggccgaggaatttatccttgctatgcacttaactgacatggcaaaagccggacagcctttacccctgacactgccaccagagcttgtgccaccatcattcagaggcggtaaacagatagactcaattaacggaacccttcctagctaccagaagatgcaagaagaagagcctcaaaagaaactccccgtgactttcgaggataagcgtaaggccaactacgagaggggcaatatggagctcgaaaagagacggcaggctttgatggaacaacagcaacgggaggccgaaaggaaagctcagaaggaaaaggaagagtgggaaagaaaacagcgcgagcttcaggagcaggaatggaaaaagcagctagaactagagaaacggctggaaaagcagagagagctcgaacggcagcgggaggaggaaaggagaaaggacattgaaaggcgtgaagcggcaaaacaagagcttgaaagacagcgcagattggaatgggagcgcataaggagacaggagctactgaatcaaaagaaccgggagcaggaagaaatcgtacggcttaattccaaaaagaaaaacctgcatttagaacttgaagcattgaatgggaaacatcaacagatctcgggacgcctccaagacgtacgactgaagaagcaaacacagaagactgaactcgaggtgctcgacaagcagtgtgatcttgaaattatggaaattaagcagttgcaacaagagctccaggaatatcagaataagctgatatatctggtaccagagaagcagttacttaatgagaggatcaagaacatgcagttctcaaacacacccgacagtggggtgtccctcttgcataaaaagtcgctcgaatag

SEQ ID NO: 227311 - DNA, 3750 bp, Artificial Sequence
  Description of Artificial Sequence: Synthetic coding sequence
atgatggcccagttcccaaccgccatgaatgggggaccgaatatgtgggccataacatcagaggagcgaacaaagcacgaccggcagttcgataatctcaaacccagcggaggatatataactggtgatcaggctcggaatttttttctgcagtccgggctcccagctccagtactggccgagatttgggctttaagtgacctgaacaaggacgggaagatggaccagcaagagttttccatcgcaatgaaactgatcaaattaaagcttcagggccagcagcttcccgtggttctgccacccataatgaagcagccacctatgttctctccgttgatcagcgccaggttcggtatgggctccatgcccaatttgtccattcctcagcctcttcctccggctgcccctattacatccctgtcaagtgctacaagtggaactaatctgccccctctgatgatgcccaccccactggtgccatccgtttctacgtcatcactgccaaacggcacagccagcttaatccaacctttacccataccctactccagtagtaccttacctcacggatcctcatactccctgatgatgggtggattcgggggagcctccatacaaaaggcccagtccctcatcgatctcggatccagttccagtacttccagcacagcgagcctcagcggaaattcaccaaaaacaggaacatctgagtgggcggtgccacaacccaccagactgaaatacaggcaaaaattcaatacactcgacaagagcatgagtggatatttgtcaggcttccaagcaagaaacgcgctgctgcagagcaacctgtctcagactcagcttgcgacgatttggacactggccgacgtcgatggtgacggccagctcaaggcggaagaattcatcctcgccatgcacctcaccgacatggcaaaggcgggacagccactcccattaacgcttccccctgaactcgtgccgccaagcttcaggggaggcaaacagatcgattctatcaacggcactcttccctcttatcagaagatgcaggaggaggaaccccagaaaaaactgcccgtgacctttgaggacaagcggaaagcaaactacgagagaggcaatatggagctggagaagaggcggcaggcactcatggaacagcagcaacgagaggccgagcgcaaggctcagaaggagaaggaggagtgggagcggaaacagcgcgaattacaggagcaggagtggaagaaacagttggagctggagaaacggcttgagaaacagcgagaattggagcggcagcgtgaagaggagcgaagaaaagacattgagagaagagaggctgcaaaacaagagctggaacggcagcggaggctggagtgggagcggatccgcagacaggagctgctgaatcagaagaaccgtgagcaagaggagattgttcgactcaacagtaagaaaaagaacctccatctcgagctggaggcgttgaatggtaagcaccaacagatatccggacggcttcaggacgtacgcctcaaaaaacaaacccagaagactgaactggaggtactcgacaaacaatgtgatcttgaaatcatggaaattaagcaattacagcaagagctccaggaataccagaataaactcatctaccttgtccctgagaaacagctgctgaatgagagaattaaaaatatgcagttctcaaacaccccagattccggtgtatctctcctccacaagaagagcctggaaaaagaggagctgtgccagaggctgaaggagcagctggacgcacttgagaaggagactgccagtaaattgtccgaaatggactcatttaataatcagctcaagtgtggcaacatggatgactctgttctccagtgcctacttagtcttctgagctgcttgaacaacctgttcctgctgttgaaagaactacgcgagacctacaacacacagcagctcgctctagaacaactttataaaattaagagggacaaactaaaagagatagagcgaaagcgcctggagcttatgcaaaaaaagaagcttgaggatgaggccgcacggaaagccaagcaaggcaaggaaaacctgtggaaggaaaatctgagaaaggaagaggaagagaagcagaagcgcctgcaggaagagaagacacaggagaagattcaagaggaagagagaaaggctgaggagaagcagaggaaggataaggatactttaaaagccgaagaaaagaaacgggaaactgcgagtgtgctggtcaactatcgagccctctatcccttcgaggctagaaatcatgacgaaatgagttttaatagcggtgatatcatccaggtggatgaaaaaacggtgggagaaccaggatggctgtacggcagctttcaagggaactttggctggttcccctgcaactatgtggagaagatgccatcttcagagaacgaaaaggccgtttcccctaaaaaggccctgctgccccctactgtgtctttatccgctacttccacgtcatccgagccactctcttcaaaccagcccgcatcagttacagattatcagaacgtctccttttctaatctgactgtcaatacctcgtggcagaagaagtcagcctttacccgaactgtgagccctggctccgtctcgcctattcacgggcagggccaggtggttgagaacctcaaagcgcaagcactttgtagctggactgctaagaaagacaaccatctgaatttttccaagcacgatataatcactgtgctggaacaacaggaaaattggtggtttggcgaggtccacgggggacggggttggtttccaaagagctatgtgaaaatcataccaggtagcgaagtcaaaagagaggagcccgaagcattgtatgcggctgtgaacaagaaacccacgagtgcagcctattctgtgggtgaggaatacatcgcactttacccctactcaagcgtggaacctggggatctgacatttactgagggcgaggaaatcctggtgacccagaaagacggtgaatggtggacaggctcgataggggaccgtagcggcatttttccatccaactatgtaaagccaaaagatcaagagtcattcgggtctgcgtcaaagagcggggcttccaacaagaagccggagatcgcacaagtgacatctgcatacgtggcatctggcagcgagcagctctcattagccccaggccaactgattctgattctgaagaagaacactagtggctggtggcaaggagagttacaggcacgaggaaaaaaacggcagaaggggtggttccctgcgtcccatgttaaactgctcggtccgagctctgagagagccactccagccttccacccggtgtgccaagtgattgcaatgtacgactatgccgctaacaacgaggatgagctatctttctccaagggccagctcatcaatgttatgaataaagatgaccctgattggtggcagggcgaaatcaatggcgttacaggtctgtttccttcaaactacgtgaaaatgaccaccgactctgatccatcccaacaatggtgcgctgacttgcagaccttggacacaatgcaacccatcgagaggaagcgtcagggatatattcacgaactgatccaaactgaggaacggtatatggctgatctgcagcttgtggtggaggttagacgacttcttttggccagctcccgcggtatctgctgtttgagctag

SEQ ID NO: 227312 - DNA, 1899 bp, Artificial Sequence
  Description of Artificial Sequence: Synthetic coding sequence
atgaatcgatacactactataaggcaactcggcgacggaacctatggatcagtccttttggggagatctatcgagagcggtgagcttatcgctattaaaaagatgaagcgtaagttctatagttgggaagagtgcatgaacctacgcgaagtcaagagcctgaagaaactcaatcacgccaatgtggtgaagctgaaagaagtaattcgtgaaaatgaccacctctactttatattcgagtatatgaaggaaaatctttaccagctgattaaagaaaggaacaagttgtttcccgagtccgctattcggaatattatgtatcaaatcctccaggggttggcattcatccacaagcacggcttttttcaccgtgatctcaagcccgaaaatttactctgcatgggaccagaactcgtaaagattgctgacttcggtctggcacgtgagatcagaagtaagccaccctacactgactacgtttcaacacgatggtaccgtgctcctgaagtgctgctcaggtcaactaactacagctccccaatcgatgtgtgggcagtgggatgtatcatggcggaagtatacaccctgcgtcccctgttccctggcgcatccgagatcgacaccatctttaaaatttgtcaggtgctgggtacgccgaagaagacagactggcccgagggataccagctttcatctgccatgaatttccgctggccccagtgcgtgcctaataatctaaaaacactgattcccaacgcatcttccgaggctgtgcagttgttgcgtgacatgcttcagtgggaccccaagaaaaggccaactgcttcacaggccttgcgctatccgtacttccaggtgggccatcctcttgggtccacaacccagaacctccaggactccgaaaaaccacaaaaaggcatcctcgaaaaagctggtcctccgccttatattaagccggtgccccctgctcagccgccagcaaagccccacactcgcatcagctctcgtcagcatcaagcgtcccagcccccactgcatcttacctatccttataaggcggaagttagccgcacggatcatccatcccacctgcaggaggataaaccaagtccactgctgttcccctctctacataataagcatcctcagtccaagataacagccggactggaacataagaatggcgaaattaagccaaaaagcaggcggaggtgggggctcatcagtcgcagcaccaaggactccgacgactgggccgaccttgacgatcttgacttttctccctccctatctaggatcgacctgaagaacaagaagcgccagtctgacgacaccctgtgccgtttcgaatctgtgctggatctgaagccctctgaaccagtggggaccggaaattcagctcccacacagaccagctaccagcgtcgggatacccctacattgagatctgcagcgaaacaacactatctgaaacacagtcgttacttgcctggaatcagtattaggaatggcattctgagcaaccctggaaaagaattcattccgccaaacccttggtccagttccgggttgtctggcaaatccagcggaactatgagtgtgatctccaaagtgaattctgtcgggagtagttctacctccagttcgggcttaaccggcaactatgtccccagcttcctgaagaaagagattgggtcggccatgcaaagggtccatttagccccaatcccagacccctctcctggttactcatccttgaaggcaatgcgccctcacccaggccgtcctttttttcacacacagcccaggtcaaccccagggctgatcccaagaccgccagcagcccaacccgtgcacggaagaaccgactgggccagtaagtatgcatcacgtaggtag

SEQ ID NO: 227313 - DNA, 1899 bp, Artificial Sequence
  Description of Artificial Sequence: Synthetic coding sequence
atgaatagatacacaactatccggcagctgggagatgggacatacgggagcgtgctgctcggccgttccattgagtcaggtgaattaattgccataaagaagatgaagcggaagttttacagctgggaagagtgtatgaaccttcgtgaagtgaagtcactgaagaagctgaaccacgcaaatgtggttaagctgaaagaggtaatcagagaaaacgaccatctgtacttcatcttcgaatacatgaaggagaatctgtaccagttgataaaggagcgcaacaagctgtttcctgagtcagctatcagaaacattatgtaccagattttgcagggattagctttcattcacaagcatggattcttccacagggatctgaaacccgagaatctcttatgcatgggcccagaattggtgaagatcgccgacttcggcctggctcgcgagatccggtctaagcccccttacactgattatgtttctactaggtggtatagggccccagaagtgctcctgagaagtacgaactacagcagtcctatcgatgtgtgggcagtggggtgcatcatggcggaggtttatacattgaggcctttattccctggggcatccgagattgataccattttcaaaatttgccaggtgctgggtacacctaagaaaaccgactggccggaaggttatcagctcagttcagcaatgaactttcggtggccacagtgtgtgcccaataacctgaaaacgctgatccccaacgcctccagcgaggctgtacagcttctgagagatatgctccagtgggatccaaagaaaagacctaccgcctcccaggctctaagatacccatacttccaagtgggacacccgctgggatctacgacacaaaatctgcaggactctgaaaagccgcagaagggaatcttggagaaggcaggtccacctccttacattaaaccggtcccaccagctcaacctcctgccaagccccatacgaggatctcatctcggcagcatcaggccagtcagcccccactgcacttaacttacccctataaggccgaagtcagccggaccgatcacccctcgcacctacaggaggacaagcctagccccctgctgttccctagcctgcataataaacatcctcagtccaagattacggctggccttgaacataaaaacggagaaataaaacctaagagcaggcggaggtggggcctcatctcccgcagcacgaaagactccgacgattgggcggatctggatgacctggactttagtccctcattgtccagaatcgacctgaagaacaaaaaacgtcagagcgacgacaccttgtgtcggttcgaaagcgtgttagatttaaagccgagtgaaccagttggtacaggcaacagtgcgcctacccagacttcctaccagcgcagagatacacctaccctcaggagcgcagccaaacagcattatctcaagcacagcagatatcttccgggaatctctatccgaaacggcatcctgtcgaaccctggcaaggagttcatccccccaaatccatggtcaagtagtggtctgtctggtaagtctagcggtacaatgtctgtgattagcaaagtaaacagcgtgggttctagttctacgtcctcatcggggctaactggcaattatgtccctagcttcctgaagaaagagatcggctcggccatgcagcgcgtacatctagcgccaatccccgacccgtccccaggctactcaagcctcaaggctatgcgtccgcacccaggacgaccattttttcatactcagccacgctccacaccagggctgattcctcgaccccctgccgctcagcccgtgcacggtcggacggactgggcaagcaagtacgcgagtagaagatag

SEQ ID NO: 227314 - DNA, 738 bp, Artificial Sequence
  Description of Artificial Sequence: Synthetic coding sequence
atgtgtgcagaggtaggccctgcactgtgccgcggtatggagcgaaattctcttggctgttgcgaagcgccaaagaagttgagcctatccttttctattgaagctatcttaaagagaccagccagacggagtgacatggacagacccgaaggtcccggtgaagagggacctggggaggccgcagccagcggttccggcctcgagaagccaccgaaggatcagccgcaggagggccgtaagagcaaacgacgagtaagaacaacatttactacggaacagcttcatgagctggagaaaattttccatttcacacattaccccgacgtgcacatcaggagtcagctcgccgcacgcatcaacctgccagaggcacgagttcaaatttggtttcagaaccagagagccaagtggaggaagcaagagaaaattggaaaccttggagctccccagcagctttccgaggcctctgtggccctacccacaaatcttgacgtggcaggaccgacctggacttctaccgctctgcgccgactcgcgccaccaacctcatgttgcccaagcgctcaggatcagcttgcgtccgcctggtttcctgcatggatcaccctgcttccagctcacccttgggaaacccaaccagttccaggacttcctatccaccaaacttgtatccccgtcctttgtatcttgccgcctccacacccgaaatgggggagcatctgcgctacctcaacctag

SEQ ID NO: 227315 - DNA, 738 bp, Artificial Sequence
  Description of Artificial Sequence: Synthetic coding sequence
atgtgtgctgaagtagggccagcgctctgcaggggtatggaacgaaatagtctgggttgctgtgaggctcccaagaagttatccctcagcttctcaatcgaggctatactcaaacgcccagcaagaagatccgacatggatcgccctgaagggccaggggaggaagggccaggagaggcagctgcgtccgggagtgggttggaaaagcctcccaaggaccaaccgcaggagggcaggaagtctaagagacgagtgcggactactttcaccactgaacagcttcacgaactggaaaagatattccactttacccactacccagacgtccatatccggagtcagcttgcagccaggattaaccttcctgaagccagggtgcagatctggtttcagaaccaaagagccaagtggcggaagcaggagaagattgggaacctcggagcaccccagcagctttccgaggcatctgtggcccttcctacaaacttagatgtggctggccctacttggaccagtaccgccctacggcgtctggcacccccaacctcatgttgtccatctgcacaggaccagttggcaagtgcctggttccctgcatggataacactcctgccggctcacccctgggaaacccagccagttcccggactgcctattcaccagacctgtattccagtgctgtgtattctgccccctccgcaccccaaatggggatccatttgtgctacttctacctag

SEQ ID NO: 227316 - DNA, 1749 bp, Artificial Sequence
  Description of Artificial Sequence: Synthetic coding sequence
atggccaacgaagattgcccaaaagcagcagacagtcctttcagctcagataagcacgcccagctgatactggcacagattaataagatgaggaatggccaacacttctgtgacgttcagctacaagtcggtcaggagtcattcaaagcacatagactcgtgctggcagccagctctccttactttgcggctctttttacaggcggtatgaaagaatcatctaaagacgtagtccccattctcggaatcgaagccggtatctttcaaatcctgctggacttcatttacacagggatcgtgaacattggagtgaacaatgtgcaggagctaataatagctgctgatatgttgcagctaactgaagtggtacacttgtgttgtgaattcttgaaggggcagatcgaccccttaaactgcatcggcatattccaattctctgaacagatagcctgtcatgatctgctagagtttagtgagaattacatccacgttcatttcctggaggttcactccggggaggaatttttagcactgaccaaggaccagttgataaaaattttgaggagcgaggaattatctattgaggatgaatatcaagtctttctggcggctatgcagtggattcttaaagacttgggcaagagacgaaagcatgtggtcgaggtacttgatcctatcagattccccttgttgccaccgcagaggctgttgaagtacatcgaaggggttagcgacttcaatctccgcgtggctctgcagacattgctgaaggagtactgcgaggtgtgcaagagtcctaaagaaaataaattttgcagttttctgcagacctcaaaagtgaggcccagaaaaaaggccagaaagtatctgtatgcagtaggaggctatactagactgcagggaggcaggtggtctgactctcgggctctcagctgtgttgagcgcttcgacaccttttcacaatattggaccacggtgagctcacttcaccaggcacggtcagggctcggggttactgttttaggaggaatggtctacgctatcggcggtgagaaggattccatgatcttcgattgtactgaatgttatgaccccgtgacgaaacaatggactacggtcgcatccatgaaccacccaaggtgcggcctgggagtctgtgtgtgctacggggcaatttatgctctgggaggatgggtcggcgctgagataggaaacactattgaaagatttgaccccgatgagaacaagtgggaggtcgtggggaacatggccgtttccaggtattattttggttgttgcgaaatgcagggactaatttacgttatcggaggtatatcaaacgaaggaattgagttacgctcttttgaagtatacgatcccctttccaagaggtggtctccactgcccccaatggggacacgacgagcctacctaggggtggcagcattaaacgattgcatatatagcgtcggaggatggaacgagactcaggacgcgctccataccgttgagaaatactctttcgaggaagagaagtgggttgaggtggcttctatgaaggtgccgagagcaggcatgtgtgtggtggctgtgaacggattactgtatgttagtggaggcagatcttcatctcacgacttcctcgcacctgatacccatagatatgaggtgttcaggttgaagtgggaaaatatgtgtattctgttcaatgaccacaaaactttaactaagggtatatttaacctgtag

SEQ ID NO: 227317 - DNA, 1755 bp, Artificial Sequence
  Description of Artificial Sequence: Synthetic coding sequence
atggccaatgaagactgtcccaaggcagcggatagcccgtttagtagtgacaagcacgcccagttgatcctcgcgcagatcaacaagatgcgaaatggccaacacttttgcgacgtgcagcttcaggtcggccaggagagctttaaggctcacaggctagtactggcggcttccagcccatacttcgccgcactgttcacaggcggaatgaaagaatcttcaaaagacgtggtcccaatattgggtattgaggccggaatcttccagatcctcctcgacttcatatacaccggtatagtaaacattggagttaacaacgtgcaggagctgattatcgccgcagatatgctgcagctcaccgaagtggttcacctatgttgcgagttcctcaaaggccaaattgaccctctgaactgtatcggcatatttcagttctcagaacagattgcctgtcacgatcttctggaattctcagagaattacatccatgtgcactttctagaagtgcatagcggagaagagtttctggccctgactaaggaccagctgataaaaattctgaggagcgaagagctgtccatcgaagacgaatatcaagtgtttcttgccgctatgcagtggattctgaaggatttagggaaacgtagaaagcatgtggtggaagtactagatccaataagattccccctgctgccacctcagcgtctacttaagtatatcgaaggtgtaagcgacttcaatctgcgggtggccttacaaaccttgttaaaagagtattgcgaggtttgtaagagtcccaaggaaaacaaattttgttctttcttgcagacttcaaaggtcagaccacggaaaaaggcccgtaagtatctttatgctgtcggcggttacaccaggttgcagggaggcagatggagtgatagccgcgctctaagctgtgtggaaaggttcgacaccttctctcagtattggacgaccgtaagctcacttcatcaggcaaggagcggccttggggtgaccgtactcgggggtatggtgtatgccattggcggagaaaaagatagcatgatcttcgactgcactgagtgttatgatccagttactaaacagtggaccactgtcgcaagtatgaatcaccccaggtgtggtcttggagtgtgcgtctgctatggtgcaatatacgcgctcgggggttgggtcggagcagaaatcggaaacaccatcgagcggtttgatcccgatgagaacaaatgggaggtcgtcgggaatatggcagtgtccaggtattacttcggatgctgtgaaatgcagggactgatttacgtgattggcggaatttccaatgagggcatagagctgaggagttttgaagtctacgatccactgagtaagagatggagtcctctccctcctatgggcacacggagggcctacctgggcgtcgcggctcttaacgactgtatctactctgtgggcggatggaacgagactcaggatgcgctgcatacggtggaaaagtattctttcgaggaggagaaatgggtggaagtcgctagtatgaaagttccacgcgctggaatgtgtgtcgtggcggtgaatggactcctgtatgtgagcggcggacggtcaagctcccacgattttcttgccccaggtacattagactcggtggaggtttataatccacacagtgacacctggactgagattgggaatatgatcaccagccggtgcgagggcggtgtcgccgtgttgtag

SEQ ID NO: 227318 - DNA, 3879 bp, Artificial Sequence
  Description of Artificial Sequence: Synthetic coding sequence
atgcgggctgtgttgacatggcgggacaaagccgagcactgcatcaacgatatcgctttcaaaccagatggtacgcagttaattttggctgctgggagtcggctactagtgtatgacaccagcgatggaactctgttacaacctctcaaaggccacaaggacacggtctattgtgtggcctacgcgaaggatggaaagcggttcgcatccgggagcgccgataagagcgtcataatttggacatcaaagctggagggcattctaaagtataccagctggtcagttatgtccagcctacacctacacctgcctttcctggggctacacaagaccgtcagggtgaccgccacagataaagcccctaaaggacagggcggacgcattgattgtttgcgacctagtgtgcagaatcaaccaggccagaaacacaatgacgcaatccagtgcgtctcatataaccccattacacaccagctagcctcttgcagtagcagcgatttcggtctatggtcacctgaacagaaaagcgtgtctaaacataagtcctcttctaagataatatgctgtagttggactaatgacggacagtacctggcactgggaatgttcaatggcataattagtattcggaataagaacggggaggaaaaggtaaaaatagagcgtcccggaggatccctatcgccaatttggtccatctgttggaatcctagctccagatgggagagtttttggatgaacagggagaacgaggatgcggaggatgtgattgtgaatagatatatccaagaaatcccgtccaccctcaagtccgccgtgtactcatcccagggcagtgaggcggaagaagaggagcccgaagaagaagacgattcaccacgggatgacaacctagaggagcgtaacgatattcttgccgttgcagattggggacagaaagtgagtttctaccagcttagtggaaagcaaatcggtaaggaccgggctctcaacttcgacccatgttgcattagctattttacaaaaggagagtatattctcctgggcggaagtgataaacaggttagcctgttcacgaaagatggagtacgactggggacagtcggtgaacaaaattcctgggtgtggacctgtcaggcaaaacccgactctaattatgttgtcgtgggttgtcaggacggcaccatctccttctaccagttaatattttctacagtccacgggctgtacaaggacaggtacgcctatcgggacagtatgaccgacgtgatcgtccaacacttaatcactgaacagaaagtccggataaaatgtaaagagttggttaaaaaaatagccatttaccggaatcgcctggcaatccaactgcctgaaaaaatcctgatctacgaattgtactcagaagacttaagtgacatgcactaccgagttaaagagaagatcataaagaaattcgagtgcaaccttttggtagtctgtgccaatcatattattctgtgtcaagaaaagcgcctacagtgtctgagtttttccggcgtgaaggaacgcgagtggcaaatggagtccctgatacgatatattaaggttattggaggtccgccagggagggagggactgcttgtcggcttgaaaaatggccagatcttaaaaatattcgtagacaaccttttcgctatcgtgttgctcaaacaggctactgcagtgagatgcctggacatgagtgcctctcggaagaaattagccgtcgtggacgaaaacgatacatgcttggtttacgatattgatacaaaggagctgctgtttcaagagcccaacgccaactcagtggcatggaacactcaatgcgaagacatgctgtgttttagtgggggaggatacttgaacatcaaggcaagtactttccccgtccacaggcagaaattgcaggggttcgtagtgggctacaacggaagcaaaattttttgcctgcacgttttttcaataagcgccgtggaagtgccacagtcggccccaatgtatcagtacttggaccggaagttgtttaaagaagcctaccagattgcctgccttggggtgacagacactgactggcgcgagctcgccatggaggctctagaaggtctggacttcgagacagccaaaaaagccttcattcgagtccaggacttaagatacctggagctgatatcatctatagaggaacgtaaaaaaaggggcgaaaccaacaatgacctgttcctggctgacgtgttttcatatcaaggaaaattccacgaggccgctaagctgtataagaggtcagggcacgagaacctagcattagagatgtacacagacctgtgcatgtttgagtacgccaaagacttcctcggctctggtgacccaaaggagactaaaatgctgattactaaacaggctgactgggctagaaacataaaagagcctaaggccgctgtggagatgtatatctccgcaggtgagcatgttaaggccatcgagatatgcggggatcatggttgggttgacatgcttatagacattgctaggaagcttgacaaagcagagcgagaaccactcctcctttgtgcaacctacctgaagaaactcgattcccctggctacgcggctgagacctacttgaaaatgggcgacctcaagtcattagtgcagttgcacgtagaaacacagcggtgggacgaagcgttcgccttgggggaaaaacatccagagtttaaagacgacatttacatgccttacgcgcaatggctggcggagaacgataggtttgaggaggctcagaaagctttccataaggccggtcgacagcgggaagccgttcaggtgctcgaacagctgactaataatgccgtcgccgagtcacgttttaacgacgccgcttattattattggatgctgtccatgcagtgcttagacattgcccaggaccctgcgcaaaaggatacgatgcttggaaagttttatcattttcagcgactggctgagctgtaccacgggtaccacgcaattcacaggcacacggaggatccattctctgtccatcggccagagaccctgttcaacatctctagatttctcctgcacagtctccctaaggacactccgagcggcataagcaaagttaaaatcttatttaccctcgctaagcaaagcaaagccctcggcgcttacaggctggcgcgacatgcttatgataaacttagaggactgtacataccagcccgattccagaagagcattgagctcgggacactgaccattagagccaaaccattccatgactccgaggaactggtccctctgtgctacaggtgctcgacaaacaatcctctgctgaacaatctgggcaacgtgtgtatcaactgtcggcagccatttatcttcagcgccagctcatacgacgttttacatctggtagagttctacctcgaggaagggatcaccgatgaggaggccatctctctgattgatctggaggttctgcggccaaagcgggatgatcgccagctggagatcgcaaataattcgtctcagattctgcggctcgtcgagaccaaggactctatcggagacgaagacccctttacagccaaactttccttcgagcagggaggctcagagtttgtccccgtggtggttagtagactggtcctgaggtcaatgtctaggagggatgtgctgattaaaaggtggccacctccacttcgctggcagtacttccgcagcctccttcctgacgccagcataaccatgtgcccttcctgcttccagatgtttcactctgaagattatgagctactggtcctccagcatggatgctgtccctactgccggcgatgcaaagatgatcctggcccatag

SEQ ID NO: 227319 - DNA, 3549 bp, Artificial Sequence
  Description of Artificial Sequence: Synthetic coding sequence
atgcgggctgtcttgacgtggagggataaagccgaacattgcattaatgatattgccttcaaacccgatgggacacagcttatactggccgctggatcgcgcctcttagtatacgatacctctgacggaactctcctgcagcccttgaagggccataaagacacagtctactgcgtggcttatgccaaagacggcaaaagatttgcttcaggctctgccgataagtccgtgatcatctggacctccaagctggagggaatcttgaagtacacccacaacgatgccattcagtgcgtgtcctataacccaatcacccaccaactagcaagttgtagttcctcagactttggcttgtggtcccccgagcagaaatcagtttctaagcataagtcttctagcaagatcatctgttgcagttggactaacgatggacagtacctggcattgggaatgtttaacggtattatctctatccgcaataagaatggggaagagaaggtcaagattgagcgcccaggagggtccctctctcccatctggtcaatctgctggaatcctagccgcgaagagcggaacgatattctggccgtcgccgactggggccagaaggtgagtttctatcagctctctggaaagcagatcgggaaagatcgcgcactcaatttcgacccttgttgcatctcctattttaccaagggcgagtacatacttttaggaggttcggataagcaggtgagtctgtttactaaagatggagttcgccttggaacagtgggagaacagaactcttgggtgtggacctgtcaggccaaaccagatagtaactacgtggtggtcggatgccaggacggaacaatatccttttaccagctgattttctctactgttcatggcctatacaaggataggtatgcataccgtgactccatgactgatgtgatcgtacagcacctaatcactgaacagaaggtgcgcatcaagtgcaaagaactggttaagaagatcgccatttaccgtaacaggctcgccatacagttgccagaaaagatcctgatctatgaattgtattcagaagatctatcagatatgcactatcgggttaaggagaagatcatcaagaagttcgagtgtaatctcctagtggtctgtgcgaaccacataatcctttgccaagaaaaaagactgcagtgtctttcctttagcggagttaaggagcgcgaatggcagatggaatctctcattcggtacattaaggtgattggaggacctcccggaagggaggggctactggttggcttgaaaaatggacaaatcttgaaaatattcgttgataatctattcgcaatcgtcctgctcaaacaggccactgctgttagatgcttagatatgtcagcctcaagaaagaagctggccgtagtggatgagaacgacacatgcctggtgtacgatatcgacactaaggaactgttgtttcaagagccaaatgcaaactctgttgcgtggaacacacagtgtgaagatatgctgtgcttctccggaggaggttatctcaatattaaagccagcacttttcctgtgcaccgccaaaagctgcagggattcgtcgtgggttacaacgggagcaaaatcttttgcctccatgtgttcagcataagcgccgtggaagtcccacaatctgccccaatgtaccagtacctcgaccgcaagctctttaaagaagcctatcaaatcgcatgcctgggagttaccgacacagactggagagagttggcaatggaagcactagaaggcctcgatttcgaaactgccaaaaaagccttcatcagggtccaggatctccgttacctggagctgatctcatcaatcgaagaacggaagaagcggggtgagactaacaacgacctgtttctcgccgacgtgttttcatatcagggcaaatttcacgaagcggcaaaactgtacaaacgctccgggcacgaaaacctcgctctggagatgtatacggatctgtgcatgtttgaatatgctaaagattttttggggtccggagatcctaaggaaactaaaatgctgatcacaaagcaggctgactgggcgagaaacatcaaagagcctaaagcagctgtggaaatgtatatctccgccggagaacatgtgaaagcaatcgagatctgcggtgatcatgggtgggtggatatgctgatcgacattgcccgaaagcttgataaagccgagcgggagccactcctgctgtgcgccacttatctcaaaaagttggattctcccggatacgccgcagagacatatttgaagatgggagacttgaagagcctcgtccaattacacgtcgagacgcagagatgggacgaagctttcgcattgggggaaaagcacccggaattcaaagacgatatttacatgccatacgcacagtggctggccgaaaacgacagattcgaggaagctcaaaaagcttttcataaggcgggaagacagagagaagccgtccaggtgctagagcagctcaccaataacgctgtcgctgagagtcggttcaatgacgcagcctattactactggatgctaagtatgcaatgcctggacatcgcccaagaccctgcccagaaggatacaatgttgggtaagttttaccatttccagaggctggccgaactgtaccacggctatcatgcaatccatcgacacaccgaggacccattctcagtacatcggccagagactctgttcaacatatctagatttttactacactccctacctaaggacacaccctccggcattagcaaggtaaagatcctctttactctggcgaaacagtcaaaagcactgggggcttataggctggcaagacacgcttacgataagctgagagggctatacatccctgctcggtttcagaagtcgattgaactcgggacgcttaccatcagggctaagcccttccatgatagcgaagagcttgtcccgctgtgctatcgctgtagcactaataacccacttctcaacaacttaggcaatgtgtgcatcaactgcagacaaccgttcatcttttctgctagcagttacgacgtgcttcacctagtagaattttacctggaggagggtatcacagatgaggaagccatatcattgatagacctagaagtgctccgacctaaaagggacgacaggcagctggagatcgcgaacaattccagtcagatcttgaggctagtagagactaaggactccattggggacgaggatccattcactgccaaactctctttcgagcaggggggttccgagttcgttccggtggttgtgtccagactggttctgcggtcaatgtcccggagggacgttcttatcaaaaggtggcctccacccctccggtggcagtacttcagatctctgcttccagatgcctcaatcactatgtgtcccagctgtttccagatgttccactcagaagactatgagctgctggtgttacagcacggatgttgtccatactgccgtcggtgcaaggacgaccccggaccttag

SEQ ID NO: 227320 - DNA, 3726 bp, Artificial Sequence
  Description of Artificial Sequence: Synthetic coding sequence
atgcgcgctgtactgacttggcgggataaagccgaacactgcatcaacgacatcgcctttaaacccgacggaacccagctcatcctcgctgctgggtccagacttctggtttatgacacctcggacggaacactccttcagcccttaaagggccataaagacaccgtctattgtgtagcatatgcaaaagatggaaagcgcttcgcatccggtagcgcggataagtcggtgattatctggacaagcaaactcgaaggaattctgaaatatacacacaacgatgcaatacagtgtgttagttacaaccccattacacaccagctcgcatcctgttcatcaagtgactttgggctctggtcacccgagcagaagtccgtgtccaagcacaaatcttcaagcaagattatctgctgttcctggacaaatgatggtcagtacctggcgttaggcatgtttaacggtataatatctattcgcaacaagaacggcgaggagaaagttaagattgagagaccgggtgggtctttgtcccctatttggagcatctgttggaacccctcatctcggtgggagtctttttggatgaatcgcgagaacgaggacgccgaagatgtgatagttaacagatatattcaggagattccttctacactcaaatctgccgtttattcctctcagggctctgaagccgaagaggaggagcctgaagaggaagatgactctccacgggacgataatctcgaggaaagaaatgatatcttggccgttgccgactggggccaaaaggtaagcttctatcagctttccggcaagcagattggaaaagaccgagcattgaatttcgacccctgctgcatctcgtatttcactaagggtgagtacatcctcctcgggggatcagacaagcaggtcagcttgtttactaaggacggtgttcgactgggcacggtgggcgaacaaaattcttgggtgtggacctgtcaggctaagcccgacagcaactatgtggtcgtcggttgtcaagacggaactatttctttttatcagctcattttttctacagtccatggactttacaaggatcgctacgcgtaccgcgattccatgactgacgtgattgtgcagcacctgatcacagaacagaaggtccgcatcaaatgtaaggagttggtcaagaagatagctatttatcggaaccgcctggcaattcagctgcctgagaaaattctcatctatgagctgtatagcgaggacctttccgatatgcattaccgagttaaagaaaaaataatcaaaaaatttgagtgtaatcttttagtcgtttgcgcaaatcacatcatcctgtgtcaggagaaaagattgcagtgtctcagcttctctggcgtaaaagaaagggaatggcagatggaatcactgattcgatacatcaaggttatagggggacctcctggacgcgaggggcttctagtgggcctgaagaatgggcagatcctcaagatttttgtggacaacctatttgccatcgtgttgctcaaacaagctaccgccgtgagatgtctggacatgagtgcaagtaggaaaaaacttgccgtagtagatgagaatgacacctgcctcgtgtacgacatcgataccaaggagctgttgttccaggagcccaatgcaaatagcgtcgcatggaacacacagtgtgaagacatgctgtgtttctctggtggcggttatctcaacatcaaagcatccaccttccctgtgcaccgccagaaactgcaagggttcgtcgtcggctacaatggtagtaagatcttttgtttgcacgtgttttctattagtgcagtcgaggtgcctcagagcgcgccaatgtaccagtatctcgaccggaaactgtttaaggaagcataccaaatcgcctgcttaggcgtcacagatacagattggagggagctggccatggaagctctagaggggctggactttgagaccgcgaaaaaggcctttattcgtgttcaagatctaagatacctggaactgatatcttccatcgaggagaggaaaaagcggggagaaaccaataacgacctgttcctagccgatgttttttcctaccagggcaagtttcacgaggctgctaaactgtacaaacgttcaggtcacgagaacctcgctttggagatgtatacagacctgtgtatgtttgaatatgccaaggactttctcggcagcggggatcctaaggagacaaagatgcttatcaccaagcaggcagattgggcgagaaatatcaaggagcccaaggccgctgtcgagatgtacatcagtgctggggagcatgtcaaagcgatcgagatatgtggcgaccacggttgggtggatatgctgattgacatcgctaggaaactcgacaaggccgagagggagcccctgctgctttgtgcaacttacctgaagaaactcgattccccgggatacgcagctgagacttacctcaaaatgggggatctgaaaagtctggtgcagttacacgtcgaaactcagagatgggatgaggcctttgcattaggagagaagcatccagagttcaaggatgacatctacatgccctatgcccagtggctggcggaaaatgacagatttgaggaggcccaaaaggctttccacaaagccggtcggcagagggaggccgtccaagtgctggaacagctgaccaacaatgcggtcgctgaaagccgctttaatgacgccgcttactactactggatgcttagtatgcaatgcctggacatcgcacaggatcccgcacaaaaggacactatgctcggcaagttctaccacttccaacgcctggctgagctgtatcacggctaccatgctatccaccgacacaccgaggaccctttcagtgtacaccgccctgagaccctcttcaacatctcccggtttctgttacactccctgcctaaagacactcctagcggcatcagcaaagtgaaaatcttgtttacccttgctaaacaatcgaaggccctgggcgcatacagactagcccgacatgcttacgacaagttgaggggactttatatccccgcacgcttccagaagagcatcgagctgggtacccttacgataagggcaaaacctttccatgatagtgaagagctggtgccactgtgttaccgatgtagcactaacaacccacttctgaataacttgggcaatgtgtgcatcaactgtagacaaccatttatatttagtgcctcaagctatgacgtcctccacctggtggaattctaccttgaggaaggcataaccgatgaagaggctataagtcttatcgatctagaggtcctccggcctaagcgggatgacaggcaacttgagatcgcaaacaattcaagtcagattttgaggctggttgagacaaaggattctatcggagacgaggatccctttacagcgaagctctcctttgaacagggaggcagtgagttcgtgccagtcgtggtctccagactggtgctcaggagtatgagcagaagggatgtgcttatcaaaaggtggcctcctccgcttcggtggcaatacttcaggagcctgctgcctgacgcgagtataacaatgtgcccatcttgctttcagatgtttcattcagaggattatgaattgctggtcctccagcacggatgctgtccctattgtaggcggtgcaaagacgaccctggaccctag

SEQ ID NO: 227321 - DNA, 3396 bp, Artificial Sequence
  Description of Artificial Sequence: Synthetic coding sequence
atgcgcgcagtgctgacatggagagataaagctgaacattgtatcaatgacatagccttcaagcccgacgggacccaactaattcttgccgcaggaagcaggctgcttgtttatgatacatctgatggcacattactacagcctctgaaaggtcacaaagacactgtttactgtgtcgcttacgcaaaggacgggctctggtcccccgagcagaaaagtgtgtcaaaacacaaaagctccagcaaaataatctgctgtagctggacaaacgatggtcagtacctggcattgggtatgtttaatgggatcataagcatccggaataaaaacggggaggagaaagtgaaaatagagagacccggtggctcccttagcccaatctggagcatttgctggaatccgtctcgggaggaacggaatgacatcctcgctgtcgcagattggggccagaaagtgagtttttaccagctgtctggtaagcagatcgggaaagacagagctctgaacttcgacccctgctgcatcagctattttactaaaggagaatacatactgttggggggttctgataagcaggtttcactatttaccaaagacggggtgcgcttggggaccgttggcgagcagaactcatgggtttggacgtgccaggcaaagccagatagtaattacgtggtggtcggctgccaagatggtactatctctttttatcagttaatattctccactgtccacgggctttataaagatagatatgcataccgggacagcatgaccgacgtcatagtacagcaccttatcactgagcagaaagttcgcattaagtgcaaggagttagtgaaaaagattgcaatatacagaaataggctcgctatccaattgccagaaaagatcctcatttacgagctgtatagcgaggacttgagcgacatgcattaccgggtaaaggagaagatcatcaagaagtttgagtgtaatttactggtggtgtgcgcaaatcacatcatcctgtgccaagaaaagcggctgcaatgtctttcttttagtggggtaaaggaaagggaatggcagatggagagcctgattaggtacattaaggtgatagggggtcccccagggcgagaaggcctgctggtgggtctgaagaatggtcaaatcctcaagattttcgtcgataacctctttgcaattgtgctgctgaaacaggccacggctgtcaggtgcttggacatgagcgcctcccggaagaaattggcagtagtggatgaaaatgacacttgtctcgtctacgatatcgataccaaagagctcctctttcaggaacctaatgccaatagcgtggcctggaacactcagtgtgaggatatgttgtgtttctctggaggcggatatctgaacatcaaagcgagtaccttccctgtgcaccgccaaaaactgcaggggttcgtggtgggctacaacggatccaagatattctgtctgcacgtgttcagcattagcgccgttgaggttccacaaagcgcgccaatgtatcagtatttggatagaaagctgttcaaagaagcctaccagattgcatgcctgggtgtgaccgacacagattggagggaactggccatggaggctcttgaaggactggatttcgagacagctaagaaggctttcattagagtccaagacttacggtacctggagctgatctcttccatcgaagagaggaagaagaggggagaaacaaataacgatctgtttctggcagatgtgttttcctatcagggcaaattccacgaagccgctaagctatacaaaagaagcggacatgagaacctagcccttgaaatgtatacagacctatgtatgttcgagtatgcaaaagacttcctggggtccggagaccccaaggagacaaagatgctgataaccaagcaggccgattgggcgagaaatatcaaagagcccaaggcagccgtggagatgtacattagtgctggagagcatgtgaaggctatcgagatctgcggggaccacgggtgggtagacatgcttattgatatcgccaggaaactagataaggcggagcgggaacccctgcttctgtgtgcgacttacctcaaaaagctggacagccccggatatgctgctgaaacctatctgaagatgggcgatttaaaatcccttgtgcaactccatgtggagacccagcgctgggatgaagcttttgctttgggggagaaacatcccgaattcaaggatgacatttatatgccatacgcgcagtggctcgcagaaaatgacagattcgaggaggcgcagaaagctttccacaaagcaggccgtcagcgcgaagcagtgcaggtgctcgaacagctgaccaacaacgcggtggcagagtcaaggttcaacgacgccgcttactattactggatgctatccatgcagtgcttagatatcgcccaggcagatccagcccagaaggatacaatgttggggaagttctaccactttcaaaggttagcggagctttaccacggatatcacgccattcataggcatactgaagacccgttttctgttcaccgcccagagaccctgtttaatatctccagattcttgctgcactccctaccgaaggacactcccagcggaatctcaaaggtgaagattctgttcaccttagcaaaacagagcaaggccctgggtgcatatcggcttgcacgccatgcatacgacaagctgagagggctgtacatccccgcacggttccagaagtccatcgaacttggaaccctaactatcagagcaaagccatttcacgattccgaggaacttgttcccctgtgctaccgatgctctacaaacaacccactactgaacaatttgggaaatgtctgcattaactgccggcagccgttcattttctccgcttcctcttacgacgtgctgcacctcgtagagttctacctcgaggagggtatcactgacgaagaagcgatttctctaatcgacttagaagtgctgagacccaaacgcgacgacaggcagctcgaaatcgcgaataatagcagtcagattcttcgtctcgtcgagacaaaggactcgattggcgatgaggaccccttcacagccaagctgtcctttgagcaaggcggttcagagttcgtgccagtggtcgtatctcgcttagtattacgttcaatgagccgaagagatgtgctcatcaagcgatggccacccccactacggtggcagtatttcaggtcgctcctgccagacgcctcaataacaatgtgtccatcttgctttcagatgttccattcagaggactatgaacttctagttttgcaacatggctgctgtccctactgtcgacggtgcaaagatgatcctggtccctag

SEQ ID NO: 227322 - DNA, 3276 bp, Artificial Sequence
  Description of Artificial Sequence: Synthetic coding sequence
atgtttaatgggataatctccattagaaacaaaaatggggaagaaaaagttaaaatcgagcggcctggcggttccttaagtcctatatggagtatatgctggaatccgagcagcaggtgggaatcattctggatgaatcgcgagaacgaagatgcagaagatgtcatcgttaacaggtatatccaagagatcccaagcaccctcaaatctgctgtctattcctcacagggtagtgaagcagaagaagaagagcctgaagaagaggatgatagtccaagagatgacaatctggaagaaagaaacgatattctagctgtggcagattggggacagaaggtctccttttatcaactcagtgggaagcagatcggcaaggacagggccctcaacttcgacccctgttgcatctcctattttacgaaaggggaatacattctacttggcggaagcgacaagcaggtgtctctcttcactaaagacggggtgagactaggcacggtgggggagcagaatagttgggtgtggacttgtcaggcaaagccagactccaattatgtggtggtgggttgccaagacggcaccatctccttctaccaactgatcttttccaccgtacacggcttgtataaagatagatacgcttatcgcgacagtatgacagacgtgatcgtgcagcatcttattacagaacagaaagttcgaatcaagtgtaaggagctggttaagaaaatcgctatctaccggaacagactggctattcaactccctgagaaaatccttatatatgagttgtattcagaggatctctcagatatgcactatcgcgtcaaggagaagatcatcaagaagttcgagtgtaatctcctggtggtatgtgccaatcatattatcctttgtcaggaaaagagactccagtgcctatctttttctggtgtaaaagagcgggaatggcagatggagtcattgattcggtatattaaagtaatcggaggccctccagggcgagagggacttttagttgggctaaagaatggccagattctgaaaatctttgtcgataacctgttcgctatcgtgctgctgaagcaggccaccgctgtgcgttgcttggatatgtctgcgtcaagaaaaaagctcgctgtcgtcgatgaaaatgacacatgtctggtctacgacatcgatacaaaagaactcctttttcaagaaccaaatgcgaatagcgtggcttggaacacacagtgcgaagacatgctgtgtttttctggcggagggtacctgaacattaaagctagtaccttccccgtacacaggcaaaagctgcaagggttcgtcgtgggttacaacggatctaaaattttctgcctgcatgtgtttagcatatccgcagtggaagtgccccagagcgctccaatgtaccaatacctagaccggaagttatttaaggaggcgtaccagatcgcctgcctgggcgtcacagacacagactggcgggaactcgcgatggaagcattagaaggtttagatttcgagacagctaagaaggccttcattcgggtgcaggatcttcggtacctcgaactgatcagctcaatcgaggaacgcaagaagaggggggagacaaacaacgacctgtttctcgccgacgttttttcttatcagggcaagttccatgaagcggctaagctttataaacgctcgggccatgagaatcttgccctggaaatgtacactgatttgtgcatgttcgagtacgcaaaggacttcctcggcagcggagatccgaaggaaaccaagatgttaataactaaacaggcagattgggcccgtaacatcaaggaacctaaagccgctgtagagatgtacatctctgccggtgagcacgtgaaagcaattgagatttgtggagaccatggatgggtcgacatgttaatagatatcgcgagaaaacttgacaaagcggaacgggagcctctgctgttgtgcgcgacctacctcaaaaaactggactccccaggatatgcagcagagacctatctgaagatgggagatttaaagagcctggtgcagctgcatgtggagacccagagatgggatgaggcctttgcgctgggcgaaaaacaccccgagttcaaggatgacatctatatgccctatgcccagtggctggctgaaaatgaccgatttgaagaggcgcagaaagcatttcataaggcaggcagacaaagggaagcggtccaggtccttgagcagctgaccaataacgcagtcgcagaatcacggtttaacgacgccgcttattactactggatgctgtcaatgcagtgtctcgatatcgctcaagaccctgcgcagaaagataccatgctgggtaaattttaccacttccagcggttggctgaactgtaccatggataccacgctatccacaggcacactgaagatcctttttccgtgcaccggccagagacgctatttaatattagccgtttcctgcttcacagcctgccaaaggatactccctctggtattagtaaagtgaagatcctcttcacacttgcgaaacaatccaaggcgctgggcgcttacagactggcgaggcatgcctacgacaagctgaggggtctgtatattcctgctaggtttcagaaatcgattgaattgggcactctaaccattagggccaaaccctttcacgatagtgaagaactggttcccttgtgttacagatgtagcaccaataatcctctgctgaataacctgggcaatgtttgcattaattgtaggcaaccatttatatttagcgcaagcagctatgatgtcctgcacctagttgaattctatcttgaggagggaattactgacgaggaggccatatctctcatagatcttgaagtactgaggccgaagagagacgacagacagctagaaatcgccaacaactcttctcagatcctgcgattggtggagactaaggactcaattggggacgaggatccattcacggcaaaactgtcgtttgaacaggggggtagcgagttcgtccccgtcgtagtgtctcgtttagtactgaggtcaatgtctagacgagacgttctgattaaaagatggcccccacccctgcggtggcagtactttaggtcactcttaccggatgccagcataacaatgtgcccttcgtgtttccaaatgtttcatagtgaggattacgaattactggtattgcagcacgggtgctgcccgtactgtcggcgttgtaaggatgatcctgggccttag

SEQ ID NO: 227323 - DNA, 3099 bp, Artificial Sequence
  Description of Artificial Sequence: Synthetic coding sequence
atgttcaacggtatcattagtatcagaaacaagaacggcgaggagaaagttaaaattgagcggccaggcggaagtctgtcacccatatggagtatttgttggaatccgtccagagaggaacgtaatgacatcctggcagtcgcagattgggggcagaaagtgagtttctaccagctatcaggcaaacagattggtaaggatagagcccttaatttcgatccttgttgcatctcttactttaccaagggagaatacattttacttggaggcagcgataagcaggtctctttgttcaccaaagacggggtgcgcctgggcaccgtcggggagcagaacagctgggtttggacttgtcaggccaaaccagattctaattatgttgtagttggatgccaagacgggactataagtttttatcaactaatcttttctaccgtccacggcttgtacaaagaccgctacgcctacagggacagcatgacggatgtgatagtccagcacctgatcaccgagcagaaagttcggattaagtgcaaggaattagtcaagaaaattgccatttaccgtaataggctggctattcaactccctgagaaaatcctgatctacgaattatattctgaggatctgtccgatatgcattaccgagtaaaggaaaaaatcataaaaaaattcgaatgcaatctgttagtagtgtgtgcaaatcacatcatactgtgccaggaaaaacgtctccagtgtttgtctttcagtggggtgaaagagcgcgagtggcagatggagagtctgatccgttacattaaagtcatagggggtcctccgggtcgcgaaggcctgctcgtaggcctgaagaacggccagatcttaaaaatttttgtggacaatttgtttgccattgtgctgttaaagcaggcaaccgctgtgagatgcctggacatgagcgccagcaggaagaaactggccgtggtagacgagaacgacacttgtctcgtatacgacatcgatactaaggaacttttatttcaagaacccaacgcaaacagcgtcgcttggaatacccaatgcgaagatatgctctgcttctctggtggtggatacctcaacattaaagcttcgacattccctgtgcaccggcaaaagctgcagggttttgtggttggttataatggatcgaagatattctgcctgcacgtgttttctatttccgctgtcgaggttcctcagtccgcacccatgtaccagtatctggataggaagctctttaaagaggcgtaccagattgcatgtctgggtgtcactgacactgattggagggaactggccatggaggccctggaaggtctagatttcgagacagctaaaaaagcattcattcgcgtgcaggatctgaggtacctggaactaatatcatccatcgaggaacggaagaagagaggggagactaacaacgatctcttcctggcagacgttttcagctatcagggcaaatttcacgaggctgctaagctctataaaaggtcaggtcacgaaaatcttgctctcgaaatgtacacagatctatgcatgtttgaatatgctaaggattttcttgggtcaggcgacccaaaggaaacaaagatgctgattactaaacaggctgattgggcaagaaacatcaaggagcctaaagcagcagtggagatgtacattagcgcaggggagcacgtgaaagccattgagatatgcggcgaccacggatgggttgatatgctaatagacattgctcgaaagctggacaaggccgaaagggagccgctgctcttatgtgcgacgtatctcaagaaattggattctcccggatacgccgctgaaacctacttgaaaatgggggacctgaagtccctggtccagctacacgtagagacccaacgctgggatgaggcctttgctctcggcgaaaaacacccggagttcaaggacgacatatatatgccttatgctcagtggctggcagaaaacgatagatttgaggaggcacaaaaggccttccataaagctggtcgccagcgggaagccgtgcaggtcctggagcagctcacaaacaacgcagttgctgaatccagattcaacgatgctgcctattactactggatgttgtctatgcagtgcctcgatattgctcaggatcccgctcagaaggacaccatgctgggcaaattttaccatttccagcgcctcgccgaactataccatggctatcacgctatccatcggcacactgaagatccattttctgtgcataggcctgagactctctttaacattagccgcttccttctccatagtctgcccaaagataccccaagtggaatttccaaagtaaagattctttttaccctcgcaaaacagagtaaagcattgggagcctacagactagctaggcacgcatatgacaaattgaggggcctctatattccggctagatttcaaaagtctattgagttaggcacacttacaattcgagccaaaccattccatgactccgaggaactggtgcccctgtgctatcgttgtagtacaaacaaccctcttttgaataatctgggtaacgtatgtatcaattgtcgacagcctttcattttctccgcatctagctacgatgtgttgcatctagtggagttctacctggaggaaggcattacagacgaggaggccatctctctgattgacttagaggtgttgaggcctaagcgcgacgataggcagcttgagatagctaataattcttcacagatactgagactggtcgagaccaaagactctattggcgacgaagaccctttcaccgccaagctcagttttgagcaaggagggagcgagttcgttcctgtggttgtttcccggctagtgttacggtccatgagtagacgcgatgttctgattaagagatggccaccacctttgcgctggcagtattttcggagcttgcttcccgacgcctctatcacaatgtgcccgtcatgctttcagatgtttcatagtgaagactatgaactccttgtgctgcagcatgggtgctgtccctattgtagaagatgtaaagacgaccccggtccgtag

SEQ ID NO: 227324 - DNA, 3252 bp, Artificial Sequence
  Description of Artificial Sequence: Synthetic coding sequence
atgcgggcagtgctgacgtggagagataaggccgagcattgtattaatgacattgccttcaagccagatggcacccagctgatactagccgctggatccaggctgctggtatacgataccagtgacgggacactgctccagccacttaagggccacaaggatacggtgtactgcgtggcctacgccaaggacggcctttggtcacctgagcagaagtctgtctctaaacacaagtctagctctaagataatctgctgcagggaggagaggaacgacattctggctgttgcagactggggccaaaaggtgtcgttttatcagctctccggaaagcaaatcggaaaggaccgcgctctgaattttgacccctgctgtatctcctattttacaaaaggagaatacatcctgttgggcggatctgacaagcaggtgtctctgttcaccaaggacggtgtccgactggggaccgtgggagaacagaactcctgggtgtggacttgtcaggcgaaacccgatagtaattacgtggtggtaggctgtcaggacggcaccatctctttctaccaactgatcttcagtaccgtccatggtctatacaaagatagatacgcataccgagacagcatgactgacgtgatcgtccagcacctcatcactgagcaaaaggtgcgcattaagtgtaaggaactggtgaagaaaatcgccatatatcggaatcggttagcaatccaacttcctgagaaaattcttatatacgaattgtattccgaggacctgagcgacatgcattacagagtgaaagaaaagatcattaagaaattcgagtgcaatcttctggtggtctgcgctaatcacatcatcctctgccaggagaaacgattgcagtgtctgtcatttagcggcgtaaaggagcgcgaatggcagatggaatctctcatccggtacataaaagtgatcgggggaccccctggtagagaaggtctgctagtaggactgaaaaatggacagattctgaagattttcgtcgataacctttttgccatcgtcctactcaagcaagcaaccgctgttagatgcttggacatgtcagcaagtcgcaagaagctggccgttgtggacgaaaatgatacctgcctcgtgtatgacattgacaccaaggagctcctatttcaagaacccaacgcaaacagcgttgcttggaatacacagtgcgaagacatgctttgtttctctggtggaggttacctgaatattaaggcctcaactttccccgttcaccggcagaagttacagggcttcgtggtggggtacaacggctcaaagatcttctgcctgcacgtgtttagcatcagcgctgtggaggtgccccagtccgctcccatgtatcagtatctcgatcgcaagctcttcaaggaggcctaccagatcgcgtgtttaggggtcaccgataccgactggcgggagttggcaatggaggcccttgaaggcttggactttgagaccgccaaaaaagcctttatacgagtgcaggatcttcgttatttggaactgattagttccatcgaagaacggaaaaagaggggcgaaacaaataatgacctgtttctggcagatgtgttctcctaccaggggaagtttcacgaggcggcaaagctgtacaagagatctggccacgaaaacctcgccctggagatgtacacagacctatgtatgtttgagtatgcaaaagatttcctgggctcaggcgatccaaaggagaccaagatgctgattactaagcaggcagactgggccaggaacatcaaagagcctaaggccgcagtggaaatgtacattagtgccggtgaacacgtgaaagccatcgagatttgcggcgatcatggctgggtggacatgctaatcgacatagctcggaaattagataaagccgagcgagagccgctgttactgtgcgctacctacctcaagaaactggattctcccggttacgcggcagagacttatctgaagatgggagatctgaagtcactcgtgcaactgcatgtggagactcaacgttgggacgaagcgttcgccctcggagagaaacatccagagtttaaggatgacatatacatgccctacgcccagtggttggccgagaacgatcggtttgaagaggctcagaaagccttccacaaggccggtcggcaacgggaagccgttcaggttctggagcagctgacgaacaatgcagtggctgagtctcgcttcaatgacgcggcttattattactggatgctcagtatgcagtgcttggatatcgcccaggccgatcctgcccagaaagatacgatgttgggcaagttttaccactttcagaggctcgccgagctttatcatgggtaccacgccatccaccgtcacacggaggacccattctccgtccatagacctgagacactcttcaatatctcccggtttttattgcacagtctccccaaagatacccctagcgggataagcaaagtgaggaagattctctttactctggccaaacaatccaaagccctcggcgcatatcgactcgcaaggcatgcttatgacaaattacgcggtctctacataccagcgaggtttcagaaatccattgagctggggacgttgaccattagagccaaaccatttcacgacagtgaggagctcgtgcctctctgttaccggtgttcaactaataaccccttactgaataatctcggcaatgtctgcatcaattgtaggcagccctttatcttcagtgctagctcttacgacgtcctacaccttgtggagttttatctggaggagggaatcaccgacgaagaggcaatctcccttattgatctcgaagtactccggcctaagcgggacgatcgtcaactggagatcgcaaataactcgagtcagattctaagactcgtggagactaaagattctatcggcgacgaagacccattcacggcaaagctgtcatttgagcaaggcggatcagaattcgtcccggttgtggttagccgcctcgtgctccggagtatgtcacgccgagacgtgctcataaaacgatggcctccaccgctaaggtggcagtactttcgtagcctgctccctgacgcttctattactatgtgccccagctgtttccagatgtttcattcagaggactatgaactgttagtacttcagcacggttgctgcccttattgtaggagatgcaaggatgatcctggtccgtag
